United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 91

SEQ ID NO: 3848140 - DNA, 12 bp, Homo sapiens
aactatggcctg

SEQ ID NO: 3848141 - DNA, 21 bp, Homo sapiens
aactcaaagcaagctcttctc

SEQ ID NO: 3848142 - DNA, 17 bp, Homo sapiens
aactcagatttaaaaca

SEQ ID NO: 3848143 - DNA, 22 bp, Homo sapiens
aactcatctaggtaaattacag

SEQ ID NO: 3848144 - DNA, 12 bp, Homo sapiens
aactcatctcat

SEQ ID NO: 3848145 - DNA, 18 bp, Homo sapiens
aactccacatctgcctta

SEQ ID NO: 3848146 - DNA, 20 bp, Homo sapiens
aactccagctgagtcctggg

SEQ ID NO: 3848147 - DNA, 14 bp, Homo sapiens
aactcctcccaccc

SEQ ID NO: 3848148 - DNA, 12 bp, Homo sapiens
aactctgccagc

SEQ ID NO: 3848149 - DNA, 13 bp, Homo sapiens
aactgaagcataa

SEQ ID NO: 3848150 - DNA, 14 bp, Homo sapiens
aactgaagcataaa

SEQ ID NO: 3848151 - DNA, 18 bp, Homo sapiens
aactgatgttactagcct

SEQ ID NO: 3848152 - DNA, 11 bp, Homo sapiens
aactgctgcca

SEQ ID NO: 3848153 - DNA, 22 bp, Homo sapiens
aactggttctacaaatttttac

SEQ ID NO: 3848154 - DNA, 15 bp, Homo sapiens
aactgtaaatcataa

SEQ ID NO: 3848155 - DNA, 17 bp, Homo sapiens
aactgtaaatcataatg

SEQ ID NO: 3848156 - DNA, 17 bp, Homo sapiens
aacttaagttaaacata

SEQ ID NO: 3848157 - DNA, 21 bp, Homo sapiens
aacttcagttttactgcattt

SEQ ID NO: 3848158 - DNA, 12 bp, Homo sapiens
aacttgaacaaa

SEQ ID NO: 3848159 - DNA, 14 bp, Homo sapiens
aacttgaacaaagt

SEQ ID NO: 3848160 - DNA, 16 bp, Homo sapiens
aacttgaacaaagtct

SEQ ID NO: 3848161 - DNA, 16 bp, Homo sapiens
aacttgccatttcttt

SEQ ID NO: 3848162 - DNA, 19 bp, Homo sapiens
aacttgccatttctttata

SEQ ID NO: 3848163 - DNA, 12 bp, Homo sapiens
aactttcccttg

SEQ ID NO: 3848164 - DNA, 16 bp, Homo sapiens
aactttttaataaagt

SEQ ID NO: 3848165 - DNA, 18 bp, Homo sapiens
aagaaaactacatgtaaa

SEQ ID NO: 3848166 - DNA, 19 bp, Homo sapiens
aagaaaactacatgtaaaa

SEQ ID NO: 3848167 - DNA, 23 bp, Homo sapiens
aagaaactttttaataaagtata

SEQ ID NO: 3848168 - DNA, 22 bp, Homo sapiens
aagaaagattgtaaactaaagt

SEQ ID NO: 3848169 - DNA, 15 bp, Homo sapiens
aagaaagctaatact

SEQ ID NO: 3848170 - DNA, 18 bp, Homo sapiens
aagaaataaatctatatt

SEQ ID NO: 3848171 - DNA, 14 bp, Homo sapiens
aagaagctgggagg

SEQ ID NO: 3848172 - DNA, 17 bp, Homo sapiens
aagaagggagaagaaag

SEQ ID NO: 3848173 - DNA, 13 bp, Homo sapiens
aagacagagcagg

SEQ ID NO: 3848174 - DNA, 19 bp, Homo sapiens
aagacagagcaggctttgt

SEQ ID NO: 3848175 - DNA, 17 bp, Homo sapiens
aagacaggcacaaaatg

SEQ ID NO: 3848176 - DNA, 17 bp, Homo sapiens
aagactgttttcagacc

SEQ ID NO: 3848177 - DNA, 15 bp, Homo sapiens
aagagaccaactttt

SEQ ID NO: 3848178 - DNA, 12 bp, Homo sapiens
aagagtttacaa

SEQ ID NO: 3848179 - DNA, 13 bp, Homo sapiens
aagattaaatata

SEQ ID NO: 3848180 - DNA, 13 bp, Homo sapiens
aagattcaggctt

SEQ ID NO: 3848181 - DNA, 22 bp, Homo sapiens
aagattcaggcttgcattaaaa

SEQ ID NO: 3848182 - DNA, 19 bp, Homo sapiens
aagattcccaggagttctg

SEQ ID NO: 3848183 - DNA, 21 bp, Homo sapiens
aagattcccaggagttctgct

SEQ ID NO: 3848184 - DNA, 15 bp, Homo sapiens
aagattgtaaactaa

SEQ ID NO: 3848185 - DNA, 16 bp, Homo sapiens
aagattgtaaactaaa

SEQ ID NO: 3848186 - DNA, 21 bp, Homo sapiens
aagattttgtgaaatttcatg

SEQ ID NO: 3848187 - DNA, 22 bp, Homo sapiens
aagattttgtgaaatttcatga

SEQ ID NO: 3848188 - DNA, 14 bp, Homo sapiens
aagcaaatgtgaat

SEQ ID NO: 3848189 - DNA, 18 bp, Homo sapiens
aagcaaggtgtttaagta

SEQ ID NO: 3848190 - DNA, 19 bp, Homo sapiens
aagcaattttccttgaagc

SEQ ID NO: 3848191 - DNA, 17 bp, Homo sapiens
aagcagaaaacaagaga

SEQ ID NO: 3848192 - DNA, 14 bp, Homo sapiens
aagcagaataaagc

SEQ ID NO: 3848193 - DNA, 15 bp, Homo sapiens
aagcagaataaagca

SEQ ID NO: 3848194 - DNA, 16 bp, Homo sapiens
aagcagaataaagcaa

SEQ ID NO: 3848195 - DNA, 18 bp, Homo sapiens
aagcagaataaagcaatt

SEQ ID NO: 3848196 - DNA, 20 bp, Homo sapiens
aagcagaataaagcaatttt

SEQ ID NO: 3848197 - DNA, 17 bp, Homo sapiens
aagcagcccttggccag

SEQ ID NO: 3848198 - DNA, 18 bp, Homo sapiens
aagcataaacatcacatg

SEQ ID NO: 3848199 - DNA, 11 bp, Homo sapiens
aagccaaagaa

SEQ ID NO: 3848200 - DNA, 12 bp, Homo sapiens
aagccaaagaaa

SEQ ID NO: 3848201 - DNA, 12 bp, Homo sapiens
aagccacacagc

SEQ ID NO: 3848202 - DNA, 13 bp, Homo sapiens
aagccacacagcc

SEQ ID NO: 3848203 - DNA, 14 bp, Homo sapiens
aagccacacagccc

SEQ ID NO: 3848204 - DNA, 18 bp, Homo sapiens
aagccacacagcccagaa

SEQ ID NO: 3848205 - DNA, 13 bp, Homo sapiens
aagccaccacaca

SEQ ID NO: 3848206 - DNA, 16 bp, Homo sapiens
aagccaccacacactg

SEQ ID NO: 3848207 - DNA, 18 bp, Homo sapiens
aagccaggaggaaactac

SEQ ID NO: 3848208 - DNA, 11 bp, Homo sapiens
acctgagcctg

SEQ ID NO: 3848209 - DNA, 12 bp, Homo sapiens
acctgagcctgg

SEQ ID NO: 3848210 - DNA, 14 bp, Homo sapiens
acctgagcctggcc

SEQ ID NO: 3848211 - DNA, 18 bp, Homo sapiens
acctgcccccgcatcccc

SEQ ID NO: 3848212 - DNA, 23 bp, Homo sapiens
acctgcgcagggccctctggggc

SEQ ID NO: 3848213 - DNA, 18 bp, Homo sapiens
acctggcccctgagctct

SEQ ID NO: 3848214 - DNA, 22 bp, Homo sapiens
acctggctgaggttcctctgcc

SEQ ID NO: 3848215 - DNA, 15 bp, Homo sapiens
acctgtaataaatat

SEQ ID NO: 3848216 - DNA, 16 bp, Homo sapiens
acctgtaataaatatg

SEQ ID NO: 3848217 - DNA, 16 bp, Homo sapiens
accttcacccagagct

SEQ ID NO: 3848218 - DNA, 20 bp, Homo sapiens
accttggccctacagccctg

SEQ ID NO: 3848219 - DNA, 21 bp, Homo sapiens
accttgtaaattccccttccc

SEQ ID NO: 3848220 - DNA, 15 bp, Homo sapiens
acctttgtctgaagg

SEQ ID NO: 3848221 - DNA, 17 bp, Homo sapiens
acctttgtctgaaggat

SEQ ID NO: 3848222 - DNA, 22 bp, Homo sapiens
acctttgtctgaaggattttaa

SEQ ID NO: 3848223 - DNA, 19 bp, Homo sapiens
acgaaagtaaagtaaagta

SEQ ID NO: 3848224 - DNA, 18 bp, Homo sapiens
acgatttagatttaatga

SEQ ID NO: 3848225 - DNA, 19 bp, Homo sapiens
acgcaaacctctccttcct

SEQ ID NO: 3848226 - DNA, 13 bp, Homo sapiens
acgcagccacaca

SEQ ID NO: 3848227 - DNA, 18 bp, Homo sapiens
acgcattttgggttgttt

SEQ ID NO: 3848228 - DNA, 19 bp, Homo sapiens
acgcccccatgcagtgacc

SEQ ID NO: 3848229 - DNA, 13 bp, Homo sapiens
acgccctcccctc

SEQ ID NO: 3848230 - DNA, 17 bp, Homo sapiens
acgcgacttctcaggac

SEQ ID NO: 3848231 - DNA, 13 bp, Homo sapiens
acgcgtgcataaa

SEQ ID NO: 3848232 - DNA, 18 bp, Homo sapiens
acgcgtgcataaaaactg

SEQ ID NO: 3848233 - DNA, 21 bp, Homo sapiens
acgctaaagagcccttgcctc

SEQ ID NO: 3848234 - DNA, 18 bp, Homo sapiens
acggcaggctcactgcca

SEQ ID NO: 3848235 - DNA, 20 bp, Homo sapiens
acggcaggctcactgccagg

SEQ ID NO: 3848236 - DNA, 22 bp, Homo sapiens
acggcaggctcactgccaggcc

SEQ ID NO: 3848237 - DNA, 14 bp, Homo sapiens
acggctactctata

SEQ ID NO: 3848238 - DNA, 14 bp, Homo sapiens
acggtattatgctt

SEQ ID NO: 3848239 - DNA, 17 bp, Homo sapiens
acggtattatgcttctt

SEQ ID NO: 3848240 - DNA, 18 bp, Homo sapiens
acgtaaacctgaaatata

SEQ ID NO: 3848241 - DNA, 22 bp, Homo sapiens
acgtataaaagcctgtttaaga

SEQ ID NO: 3848242 - DNA, 22 bp, Homo sapiens
acgtctatgcaattgtacaaaa

SEQ ID NO: 3848243 - DNA, 21 bp, Homo sapiens
acgtgcaatttgtttgtgctt

SEQ ID NO: 3848244 - DNA, 13 bp, Homo sapiens
acgttccctttgg

SEQ ID NO: 3848245 - DNA, 21 bp, Homo sapiens
acgttttgcctcatgaacact

SEQ ID NO: 3848246 - DNA, 15 bp, Homo sapiens
actaaaacattgtct

SEQ ID NO: 3848247 - DNA, 11 bp, Homo sapiens
actaacagatt

SEQ ID NO: 3848248 - DNA, 21 bp, Homo sapiens
actaacagattataataaatt

SEQ ID NO: 3848249 - DNA, 17 bp, Homo sapiens
actaagggtggagagtt

SEQ ID NO: 3848250 - DNA, 19 bp, Homo sapiens
actaagggtggagagttgg

SEQ ID NO: 3848251 - DNA, 17 bp, Homo sapiens
actaatagcctaaaaga

SEQ ID NO: 3848252 - DNA, 18 bp, Homo sapiens
actaatagcctaaaagat

SEQ ID NO: 3848253 - DNA, 22 bp, Homo sapiens
actaatatggttttgttttcaa

SEQ ID NO: 3848254 - DNA, 22 bp, Homo sapiens
actaatatttgtctgtgtgcta

SEQ ID NO: 3848255 - DNA, 12 bp, Homo sapiens
actaattcattt

SEQ ID NO: 3848256 - DNA, 22 bp, Homo sapiens
actacaccacactaaaacattg

SEQ ID NO: 3848257 - DNA, 13 bp, Homo sapiens
actacacctggct

SEQ ID NO: 3848258 - DNA, 17 bp, Homo sapiens
actagcctttggctctg

SEQ ID NO: 3848259 - DNA, 14 bp, Homo sapiens
actagtgctgaagc

SEQ ID NO: 3848260 - DNA, 13 bp, Homo sapiens
actatattaactt

SEQ ID NO: 3848261 - DNA, 13 bp, Homo sapiens
actattgtattat

SEQ ID NO: 3848262 - DNA, 22 bp, Homo sapiens
actattgtattatagtactgct

SEQ ID NO: 3848263 - DNA, 15 bp, Homo sapiens
actcaagattcccag

SEQ ID NO: 3848264 - DNA, 18 bp, Homo sapiens
actcagatttaaaacaag

SEQ ID NO: 3848265 - DNA, 13 bp, Homo sapiens
actcaggattctc

SEQ ID NO: 3848266 - DNA, 23 bp, Homo sapiens
actcatctaggtaaattacagtt

SEQ ID NO: 3848267 - DNA, 12 bp, Homo sapiens
actccacaccag

SEQ ID NO: 3848268 - DNA, 22 bp, Homo sapiens
actccacaccagtaataaaaag

SEQ ID NO: 3848269 - DNA, 14 bp, Homo sapiens
actccacatctgcc

SEQ ID NO: 3848270 - DNA, 20 bp, Homo sapiens
actccagcagataaggccga

SEQ ID NO: 3848271 - DNA, 17 bp, Homo sapiens
actccagctgagtcctg

SEQ ID NO: 3848272 - DNA, 14 bp, Homo sapiens
actccataaaaaga

SEQ ID NO: 3848273 - DNA, 23 bp, Homo sapiens
actcctcccacccaacttcccct

SEQ ID NO: 3848274 - DNA, 23 bp, Homo sapiens
actcctcggcctggctcctaccc

SEQ ID NO: 3848275 - DNA, 13 bp, Homo sapiens
actctgtgtgaga

SEQ ID NO: 3848276 - DNA, 15 bp, Homo sapiens
actcttgtttcctta

SEQ ID NO: 3848277 - DNA, 12 bp, Homo sapiens
actgaagcataa

SEQ ID NO: 3848278 - DNA, 16 bp, Homo sapiens
actgaagcataaacat

SEQ ID NO: 3848279 - DNA, 23 bp, Homo sapiens
actgaagcataaacatcacatgg

SEQ ID NO: 3848280 - DNA, 23 bp, Homo sapiens
actgacagggcccagttaaatat

SEQ ID NO: 3848281 - DNA, 23 bp, Homo sapiens
actgactttttccattttttaaa

SEQ ID NO: 3848282 - DNA, 18 bp, Homo sapiens
actgatgcttttagctca

SEQ ID NO: 3848283 - DNA, 20 bp, Homo sapiens
actgatgttactagcctctc

SEQ ID NO: 3848284 - DNA, 13 bp, Homo sapiens
actgcagggccag

SEQ ID NO: 3848285 - DNA, 19 bp, Homo sapiens
actgcattttcacaacata

SEQ ID NO: 3848286 - DNA, 22 bp, Homo sapiens
actgcattttcacaacatatca

SEQ ID NO: 3848287 - DNA, 17 bp, Homo sapiens
actgcccctgccctgag

SEQ ID NO: 3848288 - DNA, 23 bp, Homo sapiens
actgccgccgccgtggtgacccc

SEQ ID NO: 3848289 - DNA, 12 bp, Homo sapiens
actgctcatttg

SEQ ID NO: 3848290 - DNA, 15 bp, Homo sapiens
actgctccctgaagc

SEQ ID NO: 3848291 - DNA, 21 bp, Homo sapiens
actgctccctgaagccagcct

SEQ ID NO: 3848292 - DNA, 17 bp, Homo sapiens
actgctggtgtttatgt

SEQ ID NO: 3848293 - DNA, 18 bp, Homo sapiens
actgctggtgtttatgtg

SEQ ID NO: 3848294 - DNA, 21 bp, Homo sapiens
actgctttactgtgtatctca

SEQ ID NO: 3848295 - DNA, 17 bp, Homo sapiens
actggaggttgaagcca

SEQ ID NO: 3848296 - DNA, 18 bp, Homo sapiens
actggaggttgaagccaa

SEQ ID NO: 3848297 - DNA, 19 bp, Homo sapiens
actgggtggtttggttttt

SEQ ID NO: 3848298 - DNA, 16 bp, Homo sapiens
actgtaacatttacga

SEQ ID NO: 3848299 - DNA, 16 bp, Homo sapiens
actgtagatttcagta

SEQ ID NO: 3848300 - DNA, 22 bp, Homo sapiens
actgtagatttcagtagtttct

SEQ ID NO: 3848301 - DNA, 11 bp, Homo sapiens
actgtctgtgt

SEQ ID NO: 3848302 - DNA, 14 bp, Homo sapiens
actgtctgtgtcct

SEQ ID NO: 3848303 - DNA, 22 bp, Homo sapiens
actgtcttttttctaaagtaaa

SEQ ID NO: 3848304 - DNA, 13 bp, Homo sapiens
actgtgctttcta

SEQ ID NO: 3848305 - DNA, 20 bp, Homo sapiens
actgtgctttctattgtaca

SEQ ID NO: 3848306 - DNA, 15 bp, Homo sapiens
actgtggaggggagc

SEQ ID NO: 3848307 - DNA, 16 bp, Homo sapiens
acttcagttttactgc

SEQ ID NO: 3848308 - DNA, 22 bp, Homo sapiens
acttccacaaaattatgctgca

SEQ ID NO: 3848309 - DNA, 16 bp, Homo sapiens
acttctagtcagtcat

SEQ ID NO: 3848310 - DNA, 11 bp, Homo sapiens
acttctgtgta

SEQ ID NO: 3848311 - DNA, 22 bp, Homo sapiens
acttgaacaaagtctctgggtc

SEQ ID NO: 3848312 - DNA, 16 bp, Homo sapiens
acttgagtatcataat

SEQ ID NO: 3848313 - DNA, 16 bp, Homo sapiens
acttgctcccaggagg

SEQ ID NO: 3848314 - DNA, 17 bp, Homo sapiens
acttgctctggacctgc

SEQ ID NO: 3848315 - DNA, 19 bp, Homo sapiens
acttgctctggacctgccc

SEQ ID NO: 3848316 - DNA, 13 bp, Homo sapiens
acttgtattatgt

SEQ ID NO: 3848317 - DNA, 18 bp, Homo sapiens
acttgtccattgcgttat

SEQ ID NO: 3848318 - DNA, 20 bp, Homo sapiens
actttacatcctactaagaa

SEQ ID NO: 3848319 - DNA, 20 bp, Homo sapiens
actttccactgacaacgaaa

SEQ ID NO: 3848320 - DNA, 17 bp, Homo sapiens
actttcctttccccagc

SEQ ID NO: 3848321 - DNA, 19 bp, Homo sapiens
actttcctttccccagccc

SEQ ID NO: 3848322 - DNA, 21 bp, Homo sapiens
actttgaggcagcgcattgtt

SEQ ID NO: 3848323 - DNA, 15 bp, Homo sapiens
actttggttttgggg

SEQ ID NO: 3848324 - DNA, 19 bp, Homo sapiens
actttgtataaaagggact

SEQ ID NO: 3848325 - DNA, 23 bp, Homo sapiens
actttttaataaagtatattgaa

SEQ ID NO: 3848326 - DNA, 13 bp, Homo sapiens
actttttcattcc

SEQ ID NO: 3848327 - DNA, 12 bp, Homo sapiens
actttttgtaaa

SEQ ID NO: 3848328 - DNA, 13 bp, Homo sapiens
actttttgtaaat

SEQ ID NO: 3848329 - DNA, 14 bp, Homo sapiens
actttttgtaaatg

SEQ ID NO: 3848330 - DNA, 15 bp, Homo sapiens
agaaaaataaccctt

SEQ ID NO: 3848331 - DNA, 20 bp, Homo sapiens
agaaaattatgtaaagttta

SEQ ID NO: 3848332 - DNA, 15 bp, Homo sapiens
agaaacaataaagag

SEQ ID NO: 3848333 - DNA, 17 bp, Homo sapiens
agaaacaataaagagat

SEQ ID NO: 3848334 - DNA, 21 bp, Homo sapiens
agaaacaatgtctggggacag

SEQ ID NO: 3848335 - DNA, 14 bp, Homo sapiens
agaaactttttaat

SEQ ID NO: 3848336 - DNA, 14 bp, Homo sapiens
agaaagaaattact

SEQ ID NO: 3848337 - DNA, 14 bp, Homo sapiens
agaaagaaggcaaa

SEQ ID NO: 3848338 - DNA, 12 bp, Homo sapiens
agaaagattaaa

SEQ ID NO: 3848339 - DNA, 17 bp, Homo sapiens
agaaagattgtaaacta

SEQ ID NO: 3848340 - DNA, 16 bp, Homo sapiens
aggcaaggatggtggg

SEQ ID NO: 3848341 - DNA, 22 bp, Homo sapiens
aggcaaggatggtggggccccc

SEQ ID NO: 3848342 - DNA, 13 bp, Homo sapiens
aggcaaggtctgg

SEQ ID NO: 3848343 - DNA, 19 bp, Homo sapiens
aggcacacactgtgctttc

SEQ ID NO: 3848344 - DNA, 23 bp, Homo sapiens
aggcacatgcaccacgcccggct

SEQ ID NO: 3848345 - DNA, 14 bp, Homo sapiens
aggcagccagatcc

SEQ ID NO: 3848346 - DNA, 22 bp, Homo sapiens
aggcaggcatagaggcttctcc

SEQ ID NO: 3848347 - DNA, 16 bp, Homo sapiens
aggcaggtagccaggg

SEQ ID NO: 3848348 - DNA, 17 bp, Homo sapiens
aggccagaaaaggcagc

SEQ ID NO: 3848349 - DNA, 17 bp, Homo sapiens
aggccagcctccgagag

SEQ ID NO: 3848350 - DNA, 23 bp, Homo sapiens
aggccagcctccgagagggagag

SEQ ID NO: 3848351 - DNA, 17 bp, Homo sapiens
aggccaggatgcctgag

SEQ ID NO: 3848352 - DNA, 19 bp, Homo sapiens
aggccaggatgcctgagcc

SEQ ID NO: 3848353 - DNA, 18 bp, Homo sapiens
aggccatggggcagcctc

SEQ ID NO: 3848354 - DNA, 20 bp, Homo sapiens
aggccatggggcagcctcca

SEQ ID NO: 3848355 - DNA, 23 bp, Homo sapiens
aggccatgttccaataaacagga

SEQ ID NO: 3848356 - DNA, 21 bp, Homo sapiens
aggcccaaattatcaagctaa

SEQ ID NO: 3848357 - DNA, 23 bp, Homo sapiens
aggcccaaattatcaagctaata

SEQ ID NO: 3848358 - DNA, 22 bp, Homo sapiens
aggcccaggagaattaggaagg

SEQ ID NO: 3848359 - DNA, 21 bp, Homo sapiens
aggcccccgttgaagccgctc

SEQ ID NO: 3848360 - DNA, 13 bp, Homo sapiens
aggccgagcccac

SEQ ID NO: 3848361 - DNA, 16 bp, Homo sapiens
aggccgagcccacacc

SEQ ID NO: 3848362 - DNA, 18 bp, Homo sapiens
aggccgggcacagtggct

SEQ ID NO: 3848363 - DNA, 14 bp, Homo sapiens
aggccgtttgcttt

SEQ ID NO: 3848364 - DNA, 15 bp, Homo sapiens
aggcctggtggaggg

SEQ ID NO: 3848365 - DNA, 20 bp, Homo sapiens
aggctatggttgccacccca

SEQ ID NO: 3848366 - DNA, 14 bp, Homo sapiens
aggctcactgccag

SEQ ID NO: 3848367 - DNA, 15 bp, Homo sapiens
aggctcactgccagg

SEQ ID NO: 3848368 - DNA, 17 bp, Homo sapiens
aggctcactgccaggcc

SEQ ID NO: 3848369 - DNA, 20 bp, Homo sapiens
aggctcactgccaggccagc

SEQ ID NO: 3848370 - DNA, 21 bp, Homo sapiens
aggctcactgccaggccagcc

SEQ ID NO: 3848371 - DNA, 14 bp, Homo sapiens
aggctcggggctcc

SEQ ID NO: 3848372 - DNA, 16 bp, Homo sapiens
aggctcggggctcccc

SEQ ID NO: 3848373 - DNA, 20 bp, Homo sapiens
aggctcggggctccccacgc

SEQ ID NO: 3848374 - DNA, 23 bp, Homo sapiens
aggctcggggctccccacgcccc

SEQ ID NO: 3848375 - DNA, 16 bp, Homo sapiens
aggctgagcacctttg

SEQ ID NO: 3848376 - DNA, 14 bp, Homo sapiens
aggctgggaggctc

SEQ ID NO: 3848377 - DNA, 20 bp, Homo sapiens
aggctgggaggctcggggct

SEQ ID NO: 3848378 - DNA, 14 bp, Homo sapiens
aggctggtgggagg

SEQ ID NO: 3848379 - DNA, 13 bp, Homo sapiens
aggctgtgccagg

SEQ ID NO: 3848380 - DNA, 20 bp, Homo sapiens
aggctgtgccaggctgggag

SEQ ID NO: 3848381 - DNA, 10 bp, Homo sapiens
aggcttcctg

SEQ ID NO: 3848382 - DNA, 18 bp, Homo sapiens
aggcttgagttttcattt

SEQ ID NO: 3848383 - DNA, 20 bp, Homo sapiens
aggcttgagttttcatttca

SEQ ID NO: 3848384 - DNA, 14 bp, Homo sapiens
aggctttgtgagag

SEQ ID NO: 3848385 - DNA, 17 bp, Homo sapiens
aggctttgtgagagagg

SEQ ID NO: 3848386 - DNA, 23 bp, Homo sapiens
aggctttgtgagagaggacctcc

SEQ ID NO: 3848387 - DNA, 24 bp, Homo sapiens
aggctttgtgagagaggacctcca

SEQ ID NO: 3848388 - DNA, 19 bp, Homo sapiens
agggaaaggggtgctttta

SEQ ID NO: 3848389 - DNA, 18 bp, Homo sapiens
agggaagacagagcaggc

SEQ ID NO: 3848390 - DNA, 16 bp, Homo sapiens
agggaatccccgaagg

SEQ ID NO: 3848391 - DNA, 20 bp, Homo sapiens
agggaatccccgaaggtgct

SEQ ID NO: 3848392 - DNA, 13 bp, Homo sapiens
agggactgagaaa

SEQ ID NO: 3848393 - DNA, 14 bp, Homo sapiens
agggactgagaaat

SEQ ID NO: 3848394 - DNA, 11 bp, Homo sapiens
agggagagaga

SEQ ID NO: 3848395 - DNA, 17 bp, Homo sapiens
agggagcatagaaggca

SEQ ID NO: 3848396 - DNA, 15 bp, Homo sapiens
agggagggggaggtg

SEQ ID NO: 3848397 - DNA, 18 bp, Homo sapiens
agggagggggaggtgaaa

SEQ ID NO: 3848398 - DNA, 21 bp, Homo sapiens
agggaggtcactggaaagggg

SEQ ID NO: 3848399 - DNA, 13 bp, Homo sapiens
agggatggactga

SEQ ID NO: 3848400 - DNA, 19 bp, Homo sapiens
agggatggccgttggccac

SEQ ID NO: 3848401 - DNA, 22 bp, Homo sapiens
agggcaagaggtgcctgggagg

SEQ ID NO: 3848402 - DNA, 16 bp, Homo sapiens
agggcagaggcaagga

SEQ ID NO: 3848403 - DNA, 11 bp, Homo sapiens
agggcagcctc

SEQ ID NO: 3848404 - DNA, 20 bp, Homo sapiens
agggcaggcccaaattatca

SEQ ID NO: 3848405 - DNA, 22 bp, Homo sapiens
agggcatcttggtccaggaaat

SEQ ID NO: 3848406 - DNA, 15 bp, Homo sapiens
agggcatgccccggc

SEQ ID NO: 3848407 - DNA, 20 bp, Homo sapiens
agggcatgccccggccacct

SEQ ID NO: 3848408 - DNA, 13 bp, Homo sapiens
agggccaagccgg

SEQ ID NO: 3848409 - DNA, 15 bp, Homo sapiens
agggccaagccggcc

SEQ ID NO: 3848410 - DNA, 20 bp, Homo sapiens
agggcccagttaaatatgat

SEQ ID NO: 3848411 - DNA, 11 bp, Homo sapiens
agggccctctg

SEQ ID NO: 3848412 - DNA, 20 bp, Homo sapiens
agggccctgaggaataaagc

SEQ ID NO: 3848413 - DNA, 16 bp, Homo sapiens
agggcgcccagcccag

SEQ ID NO: 3848414 - DNA, 17 bp, Homo sapiens
agggcgcccagcccagg

SEQ ID NO: 3848415 - DNA, 19 bp, Homo sapiens
agggcgcccagcccaggcc

SEQ ID NO: 3848416 - DNA, 21 bp, Homo sapiens
agggcgcccagcccaggcctg

SEQ ID NO: 3848417 - DNA, 22 bp, Homo sapiens
agggcgcccagcccaggcctgg

SEQ ID NO: 3848418 - DNA, 15 bp, Homo sapiens
agggctccagcctgt

SEQ ID NO: 3848419 - DNA, 15 bp, Homo sapiens
agggctcctgaagga

SEQ ID NO: 3848420 - DNA, 16 bp, Homo sapiens
agggctcctgaaggaa

SEQ ID NO: 3848421 - DNA, 21 bp, Homo sapiens
agggctctctttccttcttgc

SEQ ID NO: 3848422 - DNA, 22 bp, Homo sapiens
agggcttcctctagaagccaag

SEQ ID NO: 3848423 - DNA, 23 bp, Homo sapiens
aggggaatctggaacgctctagg

SEQ ID NO: 3848424 - DNA, 16 bp, Homo sapiens
aggggagaagccaagg

SEQ ID NO: 3848425 - DNA, 17 bp, Homo sapiens
aggggagagcctgctgg

SEQ ID NO: 3848426 - DNA, 16 bp, Homo sapiens
aggggagctgctggcc

SEQ ID NO: 3848427 - DNA, 23 bp, Homo sapiens
aggggagctgctggccatggctg

SEQ ID NO: 3848428 - DNA, 17 bp, Homo sapiens
aggggaggggggagcca

SEQ ID NO: 3848429 - DNA, 18 bp, Homo sapiens
aggggaggggggagccag

SEQ ID NO: 3848430 - DNA, 21 bp, Homo sapiens
aggggatatatgtttgtggaa

SEQ ID NO: 3848431 - DNA, 14 bp, Homo sapiens
aggggcgcccacct

SEQ ID NO: 3848432 - DNA, 15 bp, Homo sapiens
aggggctacaagagg

SEQ ID NO: 3848433 - DNA, 15 bp, Homo sapiens
aggggctctggagag

SEQ ID NO: 3848434 - DNA, 23 bp, Homo sapiens
agggggaggtgaaaagggcagag

SEQ ID NO: 3848435 - DNA, 16 bp, Homo sapiens
agggggcttgaagcca

SEQ ID NO: 3848436 - DNA, 16 bp, Homo sapiens
aggggggagccagagg

SEQ ID NO: 3848437 - DNA, 16 bp, Homo sapiens
agggtcggggaggagg

SEQ ID NO: 3848438 - DNA, 13 bp, Homo sapiens
agggtgagaaggg

SEQ ID NO: 3848439 - DNA, 17 bp, Homo sapiens
agggtgctcagtctcct

SEQ ID NO: 3848440 - DNA, 13 bp, Homo sapiens
agggtggagagtt

SEQ ID NO: 3848441 - DNA, 15 bp, Homo sapiens
agggtggagagttgg

SEQ ID NO: 3848442 - DNA, 22 bp, Homo sapiens
agggtggagagttgggggccag

SEQ ID NO: 3848443 - DNA, 19 bp, Homo sapiens
agggtggcagagacagtgg

SEQ ID NO: 3848444 - DNA, 21 bp, Homo sapiens
agggtggcagagacagtgggc

SEQ ID NO: 3848445 - DNA, 23 bp, Homo sapiens
aggtaaatcagactatgaagttt

SEQ ID NO: 3848446 - DNA, 18 bp, Homo sapiens
aggtactggtgagggcaa

SEQ ID NO: 3848447 - DNA, 23 bp, Homo sapiens
aggtagggtgtgtatatataaaa

SEQ ID NO: 3848448 - DNA, 16 bp, Homo sapiens
aggtcactggaaaggg

SEQ ID NO: 3848449 - DNA, 21 bp, Homo sapiens
aggtcactggaaaggggagag

SEQ ID NO: 3848450 - DNA, 12 bp, Homo sapiens
aggtcgctgcag

SEQ ID NO: 3848451 - DNA, 13 bp, Homo sapiens
aggtcgctgcagc

SEQ ID NO: 3848452 - DNA, 18 bp, Homo sapiens
aggtgaaaagggcagagg

SEQ ID NO: 3848453 - DNA, 20 bp, Homo sapiens
aggtgaaaagggcagaggca

SEQ ID NO: 3848454 - DNA, 20 bp, Homo sapiens
aggtgagtttgagctgcctt

SEQ ID NO: 3848455 - DNA, 22 bp, Homo sapiens
aggtgagtttgagctgccttcc

SEQ ID NO: 3848456 - DNA, 22 bp, Homo sapiens
aggtgatccgcccgcctctgcc

SEQ ID NO: 3848457 - DNA, 18 bp, Homo sapiens
aggtgcctgggaggagtg

SEQ ID NO: 3848458 - DNA, 19 bp, Homo sapiens
aggtgcctgggaggagtgg

SEQ ID NO: 3848459 - DNA, 17 bp, Homo sapiens
aggtgctggaggtggga

SEQ ID NO: 3848460 - DNA, 15 bp, Homo sapiens
aggtggaagaaggga

SEQ ID NO: 3848461 - DNA, 15 bp, Homo sapiens
aggtgggagcaggag

SEQ ID NO: 3848462 - DNA, 22 bp, Homo sapiens
aggtgggagccaccactcctgc

SEQ ID NO: 3848463 - DNA, 20 bp, Homo sapiens
aggtgtttaagtaattgcca

SEQ ID NO: 3848464 - DNA, 16 bp, Homo sapiens
aggttaaatatataaa

SEQ ID NO: 3848465 - DNA, 15 bp, Homo sapiens
aggttcctctgcctg

SEQ ID NO: 3848466 - DNA, 18 bp, Homo sapiens
aggttcctctgcctgccc

SEQ ID NO: 3848467 - DNA, 15 bp, Homo sapiens
aggttgaagccaagt

SEQ ID NO: 3848468 - DNA, 23 bp, Homo sapiens
aggttgaagccaagtggggtgct

SEQ ID NO: 3848469 - DNA, 14 bp, Homo sapiens
aggttgtgtcactg

SEQ ID NO: 3848470 - DNA, 22 bp, Homo sapiens
aggttgttttgttttatagtat

SEQ ID NO: 3848471 - DNA, 18 bp, Homo sapiens
caccccttctctcctccc

SEQ ID NO: 3848472 - DNA, 17 bp, Homo sapiens
cacccgcctccctctca

SEQ ID NO: 3848473 - DNA, 15 bp, Homo sapiens
caccgacccttcctg

SEQ ID NO: 3848474 - DNA, 18 bp, Homo sapiens
caccgacccttcctggcc

SEQ ID NO: 3848475 - DNA, 15 bp, Homo sapiens
cacctcatgcccacc

SEQ ID NO: 3848476 - DNA, 20 bp, Homo sapiens
cacctcatgcccaccccctg

SEQ ID NO: 3848477 - DNA, 21 bp, Homo sapiens
cacctcatgcccaccccctgc

SEQ ID NO: 3848478 - DNA, 19 bp, Homo sapiens
cacctccccactccagcag

SEQ ID NO: 3848479 - DNA, 15 bp, Homo sapiens
cacctccccagacag

SEQ ID NO: 3848480 - DNA, 16 bp, Homo sapiens
cacctccccagacagg

SEQ ID NO: 3848481 - DNA, 21 bp, Homo sapiens
cacctctgcggaccccagctg

SEQ ID NO: 3848482 - DNA, 19 bp, Homo sapiens
cacctgcacagggccctct

SEQ ID NO: 3848483 - DNA, 20 bp, Homo sapiens
cacctgcacagggccctctg

SEQ ID NO: 3848484 - DNA, 23 bp, Homo sapiens
cacctgcctccggcctgcactcc

SEQ ID NO: 3848485 - DNA, 19 bp, Homo sapiens
cacctggctgaggttcctc

SEQ ID NO: 3848486 - DNA, 20 bp, Homo sapiens
cacctggctgaggttcctct

SEQ ID NO: 3848487 - DNA, 17 bp, Homo sapiens
cacctgtgcagggccct

SEQ ID NO: 3848488 - DNA, 17 bp, Homo sapiens
cacctgttgtgtgcctg

SEQ ID NO: 3848489 - DNA, 22 bp, Homo sapiens
caccttccttgcgaccaccaac

SEQ ID NO: 3848490 - DNA, 14 bp, Homo sapiens
cacctttaaaaagc

SEQ ID NO: 3848491 - DNA, 14 bp, Homo sapiens
cacgcccccatgca

SEQ ID NO: 3848492 - DNA, 20 bp, Homo sapiens
cacgcctgtaatcccagcac

SEQ ID NO: 3848493 - DNA, 20 bp, Homo sapiens
cacgcgacttctcaggacga

SEQ ID NO: 3848494 - DNA, 17 bp, Homo sapiens
cacgcgtgcataaaaac

SEQ ID NO: 3848495 - DNA, 16 bp, Homo sapiens
cacgctggagctgtgt

SEQ ID NO: 3848496 - DNA, 20 bp, Homo sapiens
cacggcaatcagaagaaagg

SEQ ID NO: 3848497 - DNA, 15 bp, Homo sapiens
cacgtcttccttctg

SEQ ID NO: 3848498 - DNA, 16 bp, Homo sapiens
cacgtcttccttctgc

SEQ ID NO: 3848499 - DNA, 18 bp, Homo sapiens
cacgtcttccttctgcct

SEQ ID NO: 3848500 - DNA, 23 bp, Homo sapiens
cacgtcttccttctgcctgagct

SEQ ID NO: 3848501 - DNA, 16 bp, Homo sapiens
cactaaaacattgtct

SEQ ID NO: 3848502 - DNA, 23 bp, Homo sapiens
cactaaacagagaaaagcttgga

SEQ ID NO: 3848503 - DNA, 16 bp, Homo sapiens
cactaagggtggagag

SEQ ID NO: 3848504 - DNA, 23 bp, Homo sapiens
cactacacctggctgaggttcct

SEQ ID NO: 3848505 - DNA, 17 bp, Homo sapiens
cactagcctttggctct

SEQ ID NO: 3848506 - DNA, 15 bp, Homo sapiens
cactcagctggactg

SEQ ID NO: 3848507 - DNA, 22 bp, Homo sapiens
cactcagctggactgcattgaa

SEQ ID NO: 3848508 - DNA, 21 bp, Homo sapiens
cactccagcagataaggccga

SEQ ID NO: 3848509 - DNA, 13 bp, Homo sapiens
cactcctgcctgc

SEQ ID NO: 3848510 - DNA, 18 bp, Homo sapiens
cactcggggcccccatct

SEQ ID NO: 3848511 - DNA, 19 bp, Homo sapiens
cactcggggcccccatctt

SEQ ID NO: 3848512 - DNA, 19 bp, Homo sapiens
cactgacaacgaaagtaaa

SEQ ID NO: 3848513 - DNA, 15 bp, Homo sapiens
cactgatttagccat

SEQ ID NO: 3848514 - DNA, 13 bp, Homo sapiens
cactgccaggcca

SEQ ID NO: 3848515 - DNA, 17 bp, Homo sapiens
cactgccaggccagcct

SEQ ID NO: 3848516 - DNA, 23 bp, Homo sapiens
cactgcctcgggaacctcactct

SEQ ID NO: 3848517 - DNA, 18 bp, Homo sapiens
cactgctggtgtttatgt

SEQ ID NO: 3848518 - DNA, 20 bp, Homo sapiens
cactggaggttgaagccaag

SEQ ID NO: 3848519 - DNA, 21 bp, Homo sapiens
cactggaggttgaagccaagt

SEQ ID NO: 3848520 - DNA, 14 bp, Homo sapiens
cactggctgccagc

SEQ ID NO: 3848521 - DNA, 20 bp, Homo sapiens
cactggctgccagctatttt

SEQ ID NO: 3848522 - DNA, 18 bp, Homo sapiens
cactgtatcatttcatgc

SEQ ID NO: 3848523 - DNA, 23 bp, Homo sapiens
cactgtatcatttcatgctttga

SEQ ID NO: 3848524 - DNA, 17 bp, Homo sapiens
cactgtgctttctattg

SEQ ID NO: 3848525 - DNA, 12 bp, Homo sapiens
cactgtgtaagc

SEQ ID NO: 3848526 - DNA, 18 bp, Homo sapiens
cacttcctcatcatgaaa

SEQ ID NO: 3848527 - DNA, 11 bp, Homo sapiens
cacttggccaa

SEQ ID NO: 3848528 - DNA, 22 bp, Homo sapiens
cacttgtccattgcgttatttt

SEQ ID NO: 3848529 - DNA, 19 bp, Homo sapiens
cactttctttttttacgta

SEQ ID NO: 3848530 - DNA, 12 bp, Homo sapiens
cactttgcataa

SEQ ID NO: 3848531 - DNA, 21 bp, Homo sapiens
cacttttggaaggtgactttt

SEQ ID NO: 3848532 - DNA, 22 bp, Homo sapiens
cagaaagcctatcaaagacctt

SEQ ID NO: 3848533 - DNA, 14 bp, Homo sapiens
cagaaaggctgcaa

SEQ ID NO: 3848534 - DNA, 22 bp, Homo sapiens
cagaaaggtgattccaggagga

SEQ ID NO: 3848535 - DNA, 22 bp, Homo sapiens
cagaagaagctgggagggaggg

SEQ ID NO: 3848536 - DNA, 22 bp, Homo sapiens
cagaagcccatgaactgtgttt

SEQ ID NO: 3848537 - DNA, 22 bp, Homo sapiens
cagaaggccagaaaaggcagcc

SEQ ID NO: 3848538 - DNA, 20 bp, Homo sapiens
cagaaggtattttttaactc

SEQ ID NO: 3848539 - DNA, 11 bp, Homo sapiens
cagaataaagc

SEQ ID NO: 3848540 - DNA, 16 bp, Homo sapiens
cagaataaagcaattt

SEQ ID NO: 3848541 - DNA, 23 bp, Homo sapiens
cagaataaagcaattttccttga

SEQ ID NO: 3848542 - DNA, 16 bp, Homo sapiens
cagaataaatgtttta

SEQ ID NO: 3848543 - DNA, 18 bp, Homo sapiens
cagaataaatgttttaca

SEQ ID NO: 3848544 - DNA, 16 bp, Homo sapiens
cagaatacttttctct

SEQ ID NO: 3848545 - DNA, 18 bp, Homo sapiens
cagacagggctccagcct

SEQ ID NO: 3848546 - DNA, 22 bp, Homo sapiens
cagacagggctccagcctgtcg

SEQ ID NO: 3848547 - DNA, 12 bp, Homo sapiens
cagacctcccca

SEQ ID NO: 3848548 - DNA, 14 bp, Homo sapiens
cagacctccccagc

SEQ ID NO: 3848549 - DNA, 15 bp, Homo sapiens
cagacctccccagcc

SEQ ID NO: 3848550 - DNA, 18 bp, Homo sapiens
cagacctccccagcccct

SEQ ID NO: 3848551 - DNA, 21 bp, Homo sapiens
cagacctccccagcccctagc

SEQ ID NO: 3848552 - DNA, 15 bp, Homo sapiens
cagacctctcccacc

SEQ ID NO: 3848553 - DNA, 16 bp, Homo sapiens
cagacctctcccaccc

SEQ ID NO: 3848554 - DNA, 15 bp, Homo sapiens
cagactccaggcccc

SEQ ID NO: 3848555 - DNA, 17 bp, Homo sapiens
cagactccgcctgaggc

SEQ ID NO: 3848556 - DNA, 10 bp, Homo sapiens
cagagacagt

SEQ ID NO: 3848557 - DNA, 15 bp, Homo sapiens
cagagaccctctgcc

SEQ ID NO: 3848558 - DNA, 19 bp, Homo sapiens
cagagactggggcctggac

SEQ ID NO: 3848559 - DNA, 18 bp, Homo sapiens
cagagagcggtctcaggc

SEQ ID NO: 3848560 - DNA, 18 bp, Homo sapiens
cagagcaagtctgcaggt

SEQ ID NO: 3848561 - DNA, 12 bp, Homo sapiens
cagagcaggctt

SEQ ID NO: 3848562 - DNA, 14 bp, Homo sapiens
cagagcaggctttg

SEQ ID NO: 3848563 - DNA, 13 bp, Homo sapiens
cagagccaagctg

SEQ ID NO: 3848564 - DNA, 17 bp, Homo sapiens
cagaggccaggatgcct

SEQ ID NO: 3848565 - DNA, 23 bp, Homo sapiens
cagaggccaggatgcctgagccc

SEQ ID NO: 3848566 - DNA, 14 bp, Homo sapiens
cagagtaacaaaaa

SEQ ID NO: 3848567 - DNA, 22 bp, Homo sapiens
cagagttgggggctaggggagg

SEQ ID NO: 3848568 - DNA, 22 bp, Homo sapiens
cagataaaggttcatgcaaact

SEQ ID NO: 3848569 - DNA, 19 bp, Homo sapiens
cagataaggccgagcccac

SEQ ID NO: 3848570 - DNA, 12 bp, Homo sapiens
cagatccccagg

SEQ ID NO: 3848571 - DNA, 16 bp, Homo sapiens
cagatccccagggcag

SEQ ID NO: 3848572 - DNA, 17 bp, Homo sapiens
cagatccccagggcagc

SEQ ID NO: 3848573 - DNA, 18 bp, Homo sapiens
cagatccccagggcagcc

SEQ ID NO: 3848574 - DNA, 20 bp, Homo sapiens
cagatccccagggcagcctc

SEQ ID NO: 3848575 - DNA, 21 bp, Homo sapiens
cagatccccagggcagcctcg

SEQ ID NO: 3848576 - DNA, 19 bp, Homo sapiens
cagatctgtcctgggggat

SEQ ID NO: 3848577 - DNA, 21 bp, Homo sapiens
cagatgaagaaggagcagaat

SEQ ID NO: 3848578 - DNA, 19 bp, Homo sapiens
cagatgatggggtcagcag

SEQ ID NO: 3848579 - DNA, 18 bp, Homo sapiens
cagatgtttctcatttta

SEQ ID NO: 3848580 - DNA, 16 bp, Homo sapiens
cagattataataaatt

SEQ ID NO: 3848581 - DNA, 22 bp, Homo sapiens
cagcaaagccccatgctggagc

SEQ ID NO: 3848582 - DNA, 23 bp, Homo sapiens
cagcaactttcccttgccctggg

SEQ ID NO: 3848583 - DNA, 12 bp, Homo sapiens
cagcacagctga

SEQ ID NO: 3848584 - DNA, 15 bp, Homo sapiens
cagcacagctgagga

SEQ ID NO: 3848585 - DNA, 20 bp, Homo sapiens
cagcacgcgacttctcagga

SEQ ID NO: 3848586 - DNA, 22 bp, Homo sapiens
cagcactgaccccgacctcaga

SEQ ID NO: 3848587 - DNA, 16 bp, Homo sapiens
cagcagataaggccga

SEQ ID NO: 3848588 - DNA, 15 bp, Homo sapiens
cagcaggcccaggag

SEQ ID NO: 3848589 - DNA, 13 bp, Homo sapiens
cagcatgtagggc

SEQ ID NO: 3848590 - DNA, 14 bp, Homo sapiens
cagcatgtagggct

SEQ ID NO: 3848591 - DNA, 21 bp, Homo sapiens
cagcatgtagggcttctgtgg

SEQ ID NO: 3848592 - DNA, 22 bp, Homo sapiens
cagcattttgagaggctgaggc

SEQ ID NO: 3848593 - DNA, 16 bp, Homo sapiens
cagccacacagtggcc

SEQ ID NO: 3848594 - DNA, 18 bp, Homo sapiens
cagccacacagtggccgg

SEQ ID NO: 3848595 - DNA, 19 bp, Homo sapiens
cagccacacagtggccggg

SEQ ID NO: 3848596 - DNA, 23 bp, Homo sapiens
cagccagatccccagggcagcct

SEQ ID NO: 3848597 - DNA, 13 bp, Homo sapiens
cagccagccctgg

SEQ ID NO: 3848598 - DNA, 15 bp, Homo sapiens
cagccatcccaaggc

SEQ ID NO: 3848599 - DNA, 17 bp, Homo sapiens
cagccatcccaaggctc

SEQ ID NO: 3848600 - DNA, 14 bp, Homo sapiens
cagcccagaaggcc

SEQ ID NO: 3848601 - DNA, 17 bp, Homo sapiens
cagcccagaaggccaga

SEQ ID NO: 3848602 - DNA, 19 bp, Homo sapiens
ccagccttcttccatccca

SEQ ID NO: 3848603 - DNA, 22 bp, Homo sapiens
ccagccttcttccatcccagga

SEQ ID NO: 3848604 - DNA, 20 bp, Homo sapiens
ccagctacttgggaggttga

SEQ ID NO: 3848605 - DNA, 19 bp, Homo sapiens
ccagctatttttactagaa

SEQ ID NO: 3848606 - DNA, 13 bp, Homo sapiens
ccagctcctccca

SEQ ID NO: 3848607 - DNA, 15 bp, Homo sapiens
ccagctgatgactca

SEQ ID NO: 3848608 - DNA, 13 bp, Homo sapiens
ccagctgccaggg

SEQ ID NO: 3848609 - DNA, 14 bp, Homo sapiens
ccagctgccaggga

SEQ ID NO: 3848610 - DNA, 21 bp, Homo sapiens
ccagctgccagggaagacaga

SEQ ID NO: 3848611 - DNA, 17 bp, Homo sapiens
ccagctgcgcttgcttt

SEQ ID NO: 3848612 - DNA, 19 bp, Homo sapiens
ccagctgcgcttgcttttc

SEQ ID NO: 3848613 - DNA, 20 bp, Homo sapiens
ccagctgcgcttgcttttct

SEQ ID NO: 3848614 - DNA, 16 bp, Homo sapiens
ccagctgtgagccttg

SEQ ID NO: 3848615 - DNA, 21 bp, Homo sapiens
ccaggaaactccacatctgcc

SEQ ID NO: 3848616 - DNA, 23 bp, Homo sapiens
ccaggaaactccacatctgcctt

SEQ ID NO: 3848617 - DNA, 22 bp, Homo sapiens
ccaggacacaacgctgctgcct

SEQ ID NO: 3848618 - DNA, 19 bp, Homo sapiens
ccaggacaccacacccagc

SEQ ID NO: 3848619 - DNA, 17 bp, Homo sapiens
ccaggacctgagcctgg

SEQ ID NO: 3848620 - DNA, 16 bp, Homo sapiens
ccaggactgagccccg

SEQ ID NO: 3848621 - DNA, 19 bp, Homo sapiens
ccaggactgagccccgcag

SEQ ID NO: 3848622 - DNA, 13 bp, Homo sapiens
ccaggagaaggga

SEQ ID NO: 3848623 - DNA, 16 bp, Homo sapiens
ccaggagttctgctca

SEQ ID NO: 3848624 - DNA, 14 bp, Homo sapiens
ccaggcagctcctg

SEQ ID NO: 3848625 - DNA, 18 bp, Homo sapiens
ccaggcagctcctgtttg

SEQ ID NO: 3848626 - DNA, 18 bp, Homo sapiens
ccaggcaggtagccaggg

SEQ ID NO: 3848627 - DNA, 19 bp, Homo sapiens
ccaggcaggtagccagggg

SEQ ID NO: 3848628 - DNA, 16 bp, Homo sapiens
ccaggcagttctctcg

SEQ ID NO: 3848629 - DNA, 12 bp, Homo sapiens
ccaggccagcct

SEQ ID NO: 3848630 - DNA, 23 bp, Homo sapiens
ccaggccagcctccgagagggag

SEQ ID NO: 3848631 - DNA, 20 bp, Homo sapiens
ccaggcccccgttgaagccg

SEQ ID NO: 3848632 - DNA, 15 bp, Homo sapiens
ccaggccgtttgctt

SEQ ID NO: 3848633 - DNA, 22 bp, Homo sapiens
ccaggcgggagcggtggccctg

SEQ ID NO: 3848634 - DNA, 22 bp, Homo sapiens
ccaggctatggttgccacccca

SEQ ID NO: 3848635 - DNA, 19 bp, Homo sapiens
ccaggctggagtgcagtgg

SEQ ID NO: 3848636 - DNA, 15 bp, Homo sapiens
ccaggctggccccca

SEQ ID NO: 3848637 - DNA, 16 bp, Homo sapiens
ccaggctggcccccac

SEQ ID NO: 3848638 - DNA, 16 bp, Homo sapiens
ccaggctgggaggctc

SEQ ID NO: 3848639 - DNA, 17 bp, Homo sapiens
ccaggctgggaggctcg

SEQ ID NO: 3848640 - DNA, 16 bp, Homo sapiens
ccagggaaatgcctcg

SEQ ID NO: 3848641 - DNA, 15 bp, Homo sapiens
ccagggaagacagag

SEQ ID NO: 3848642 - DNA, 19 bp, Homo sapiens
ccagggaagacagagcagg

SEQ ID NO: 3848643 - DNA, 21 bp, Homo sapiens
ccagggaagacagagcaggct

SEQ ID NO: 3848644 - DNA, 12 bp, Homo sapiens
ccagggcagcct

SEQ ID NO: 3848645 - DNA, 23 bp, Homo sapiens
ccagggggactagcccctgtgga

SEQ ID NO: 3848646 - DNA, 22 bp, Homo sapiens
ccaggtacaaccggatgccagc

SEQ ID NO: 3848647 - DNA, 18 bp, Homo sapiens
ccaggtctccccaggccc

SEQ ID NO: 3848648 - DNA, 20 bp, Homo sapiens
ccaggtgaggaatttgaagc

SEQ ID NO: 3848649 - DNA, 23 bp, Homo sapiens
ccaggtgaggaatttgaagctca

SEQ ID NO: 3848650 - DNA, 22 bp, Homo sapiens
ccagtaataaaaagccaccaca

SEQ ID NO: 3848651 - DNA, 21 bp, Homo sapiens
ccagtcccaccctgctgctgc

SEQ ID NO: 3848652 - DNA, 16 bp, Homo sapiens
ccagtccccacccctg

SEQ ID NO: 3848653 - DNA, 21 bp, Homo sapiens
ccagtctgctctcagcttgtg

SEQ ID NO: 3848654 - DNA, 19 bp, Homo sapiens
ccagtttaatcattgcctg

SEQ ID NO: 3848655 - DNA, 17 bp, Homo sapiens
ccagttttattttctaa

SEQ ID NO: 3848656 - DNA, 23 bp, Homo sapiens
ccagttttattttctaaattctt

SEQ ID NO: 3848657 - DNA, 17 bp, Homo sapiens
ccataaaaagaaagcta

SEQ ID NO: 3848658 - DNA, 19 bp, Homo sapiens
ccatagaatggcacatgtc

SEQ ID NO: 3848659 - DNA, 21 bp, Homo sapiens
ccatatccatgttgctgactt

SEQ ID NO: 3848660 - DNA, 12 bp, Homo sapiens
ccatcagtctag

SEQ ID NO: 3848661 - DNA, 14 bp, Homo sapiens
ccatcccaggacac

SEQ ID NO: 3848662 - DNA, 12 bp, Homo sapiens
ccatcctgctag

SEQ ID NO: 3848663 - DNA, 16 bp, Homo sapiens
ccatcctttctgcctc

SEQ ID NO: 3848664 - DNA, 13 bp, Homo sapiens
ccatctaccttcc

SEQ ID NO: 3848665 - DNA, 14 bp, Homo sapiens
ccatctaccttcca

SEQ ID NO: 3848666 - DNA, 16 bp, Homo sapiens
ccatctctaccccctc

SEQ ID NO: 3848667 - DNA, 20 bp, Homo sapiens
ccatctgcaccccttctctc

SEQ ID NO: 3848668 - DNA, 23 bp, Homo sapiens
ccatctgcaccccttctctcctc

SEQ ID NO: 3848669 - DNA, 21 bp, Homo sapiens
ccatctggcccaggctggccc

SEQ ID NO: 3848670 - DNA, 22 bp, Homo sapiens
ccatctggctgtgacagcctct

SEQ ID NO: 3848671 - DNA, 16 bp, Homo sapiens
ccatgaactgtgtttc

SEQ ID NO: 3848672 - DNA, 16 bp, Homo sapiens
ccatgaccttacattt

SEQ ID NO: 3848673 - DNA, 19 bp, Homo sapiens
ccatgcccccgccacctcc

SEQ ID NO: 3848674 - DNA, 23 bp, Homo sapiens
ccatgcccccgccacctccccac

SEQ ID NO: 3848675 - DNA, 15 bp, Homo sapiens
ccatgctggagcctg

SEQ ID NO: 3848676 - DNA, 24 bp, Homo sapiens
ccatgctggagcctgtgtaacagc

SEQ ID NO: 3848677 - DNA, 20 bp, Homo sapiens
ccatggaatgactgaagaca

SEQ ID NO: 3848678 - DNA, 21 bp, Homo sapiens
ccatggaatgactgaagacag

SEQ ID NO: 3848679 - DNA, 13 bp, Homo sapiens
ccatggcctcaga

SEQ ID NO: 3848680 - DNA, 21 bp, Homo sapiens
ccatggctggggggtctcagc

SEQ ID NO: 3848681 - DNA, 19 bp, Homo sapiens
ccatggctttgtgctgctg

SEQ ID NO: 3848682 - DNA, 18 bp, Homo sapiens
ccatgttccaataaacag

SEQ ID NO: 3848683 - DNA, 17 bp, Homo sapiens
ccattcaccctgtgtaa

SEQ ID NO: 3848684 - DNA, 17 bp, Homo sapiens
ccattctacttgctctg

SEQ ID NO: 3848685 - DNA, 15 bp, Homo sapiens
ccattctcccaggta

SEQ ID NO: 3848686 - DNA, 23 bp, Homo sapiens
ccattgtaacttggatgtagcca

SEQ ID NO: 3848687 - DNA, 13 bp, Homo sapiens
ccatttcccatct

SEQ ID NO: 3848688 - DNA, 13 bp, Homo sapiens
ccatttctttata

SEQ ID NO: 3848689 - DNA, 12 bp, Homo sapiens
ccattttcgctt

SEQ ID NO: 3848690 - DNA, 20 bp, Homo sapiens
cccaaattatcaagctaata

SEQ ID NO: 3848691 - DNA, 19 bp, Homo sapiens
cccaacagcgacatagccc

SEQ ID NO: 3848692 - DNA, 12 bp, Homo sapiens
cccaatattgag

SEQ ID NO: 3848693 - DNA, 17 bp, Homo sapiens
cccacaccatctggccc

SEQ ID NO: 3848694 - DNA, 15 bp, Homo sapiens
cccacccccagccag

SEQ ID NO: 3848695 - DNA, 21 bp, Homo sapiens
cccaccccgggctctcctgcc

SEQ ID NO: 3848696 - DNA, 13 bp, Homo sapiens
cccaccccgggga

SEQ ID NO: 3848697 - DNA, 14 bp, Homo sapiens
cccaccccggggac

SEQ ID NO: 3848698 - DNA, 17 bp, Homo sapiens
cccaccccggggaccct

SEQ ID NO: 3848699 - DNA, 15 bp, Homo sapiens
cccaccctgctgctg

SEQ ID NO: 3848700 - DNA, 18 bp, Homo sapiens
cccaccgacccttcctgg

SEQ ID NO: 3848701 - DNA, 10 bp, Homo sapiens
cccacctccc

SEQ ID NO: 3848702 - DNA, 15 bp, Homo sapiens
cccacctccccacgc

SEQ ID NO: 3848703 - DNA, 18 bp, Homo sapiens
cccacctctgtgacctca

SEQ ID NO: 3848704 - DNA, 20 bp, Homo sapiens
cccacctctgtgacctcagg

SEQ ID NO: 3848705 - DNA, 15 bp, Homo sapiens
cccagaaggccagaa

SEQ ID NO: 3848706 - DNA, 18 bp, Homo sapiens
cccagacagggctccagc

SEQ ID NO: 3848707 - DNA, 23 bp, Homo sapiens
cccagacagggctccagcctgtc

SEQ ID NO: 3848708 - DNA, 15 bp, Homo sapiens
cccagactccaggcc

SEQ ID NO: 3848709 - DNA, 20 bp, Homo sapiens
cccagagatggctccttggg

SEQ ID NO: 3848710 - DNA, 15 bp, Homo sapiens
cccagagcagggtgt

SEQ ID NO: 3848711 - DNA, 15 bp, Homo sapiens
cccagatctgtcctg

SEQ ID NO: 3848712 - DNA, 16 bp, Homo sapiens
cccagatctgtcctgg

SEQ ID NO: 3848713 - DNA, 11 bp, Homo sapiens
cccagcaccct

SEQ ID NO: 3848714 - DNA, 12 bp, Homo sapiens
cccagccaggct

SEQ ID NO: 3848715 - DNA, 10 bp, Homo sapiens
cccagcccag

SEQ ID NO: 3848716 - DNA, 11 bp, Homo sapiens
cccagcctcag

SEQ ID NO: 3848717 - DNA, 15 bp, Homo sapiens
cccagctgccaggga

SEQ ID NO: 3848718 - DNA, 19 bp, Homo sapiens
cccaggacaccacacccag

SEQ ID NO: 3848719 - DNA, 17 bp, Homo sapiens
cccaggacctgagcctg

SEQ ID NO: 3848720 - DNA, 18 bp, Homo sapiens
cccaggacctgagcctgg

SEQ ID NO: 3848721 - DNA, 19 bp, Homo sapiens
cccaggacctgagcctggc

SEQ ID NO: 3848722 - DNA, 15 bp, Homo sapiens
cccaggagagagaaa

SEQ ID NO: 3848723 - DNA, 20 bp, Homo sapiens
cccaggagagagaaagccag

SEQ ID NO: 3848724 - DNA, 18 bp, Homo sapiens
cccaggagttctgctcat

SEQ ID NO: 3848725 - DNA, 21 bp, Homo sapiens
cccaggagttctgctcattct

SEQ ID NO: 3848726 - DNA, 14 bp, Homo sapiens
cccaggcagctcct

SEQ ID NO: 3848727 - DNA, 16 bp, Homo sapiens
cccaggcagctcctgt

SEQ ID NO: 3848728 - DNA, 22 bp, Homo sapiens
cccaggcgggagcggtggccct

SEQ ID NO: 3848729 - DNA, 19 bp, Homo sapiens
cccaggctggagtgcagtg

SEQ ID NO: 3848730 - DNA, 21 bp, Homo sapiens
cccaggctggcccccacccac

SEQ ID NO: 3848731 - DNA, 15 bp, Homo sapiens
cccagggcagcctcg

SEQ ID NO: 3848732 - DNA, 17 bp, Homo sapiens
cccaggtaccagctgcg

SEQ ID NO: 3848733 - DNA, 21 bp, Homo sapiens
cccaggtgaggaatttgaagc

SEQ ID NO: 3848734 - DNA, 14 bp, Homo sapiens
ctcatctgccaaaa

SEQ ID NO: 3848735 - DNA, 17 bp, Homo sapiens
ctcatgaacactggctg

SEQ ID NO: 3848736 - DNA, 12 bp, Homo sapiens
ctcatgaagccc

SEQ ID NO: 3848737 - DNA, 19 bp, Homo sapiens
ctcatgcccaccccctgcc

SEQ ID NO: 3848738 - DNA, 21 bp, Homo sapiens
ctcatgcccaccccctgccct

SEQ ID NO: 3848739 - DNA, 13 bp, Homo sapiens
ctcatgctatttc

SEQ ID NO: 3848740 - DNA, 16 bp, Homo sapiens
ctcatgctatttctac

SEQ ID NO: 3848741 - DNA, 20 bp, Homo sapiens
ctcatgtctctttggggaga

SEQ ID NO: 3848742 - DNA, 23 bp, Homo sapiens
ctcatgtctgaaaaatgcctgct

SEQ ID NO: 3848743 - DNA, 19 bp, Homo sapiens
ctcattacccttttctggg

SEQ ID NO: 3848744 - DNA, 18 bp, Homo sapiens
ctcattctaatgatggcc

SEQ ID NO: 3848745 - DNA, 14 bp, Homo sapiens
ctcattttaaacaa

SEQ ID NO: 3848746 - DNA, 15 bp, Homo sapiens
ctcattttaaacaac

SEQ ID NO: 3848747 - DNA, 19 bp, Homo sapiens
ctccacaccagtaataaaa

SEQ ID NO: 3848748 - DNA, 15 bp, Homo sapiens
ctccacatctgcctt

SEQ ID NO: 3848749 - DNA, 17 bp, Homo sapiens
ctccagatgtttctcat

SEQ ID NO: 3848750 - DNA, 21 bp, Homo sapiens
ctccagatgtttctcatttta

SEQ ID NO: 3848751 - DNA, 18 bp, Homo sapiens
ctccagcagataaggccg

SEQ ID NO: 3848752 - DNA, 22 bp, Homo sapiens
ctccagcagataaggccgagcc

SEQ ID NO: 3848753 - DNA, 17 bp, Homo sapiens
ctccagcctgtcggcca

SEQ ID NO: 3848754 - DNA, 16 bp, Homo sapiens
ctccagctgagtcctg

SEQ ID NO: 3848755 - DNA, 17 bp, Homo sapiens
ctccagtctgctctcag

SEQ ID NO: 3848756 - DNA, 21 bp, Homo sapiens
ctccataaaaagaaagctaat

SEQ ID NO: 3848757 - DNA, 15 bp, Homo sapiens
ctccatcccttcccc

SEQ ID NO: 3848758 - DNA, 17 bp, Homo sapiens
ctccatcttctttgcag

SEQ ID NO: 3848759 - DNA, 19 bp, Homo sapiens
ctccatgcccccgccacct

SEQ ID NO: 3848760 - DNA, 21 bp, Homo sapiens
ctccatgtagaacttgaacta

SEQ ID NO: 3848761 - DNA, 14 bp, Homo sapiens
ctcccacctctgtg

SEQ ID NO: 3848762 - DNA, 17 bp, Homo sapiens
ctcccacggggtccccg

SEQ ID NO: 3848763 - DNA, 15 bp, Homo sapiens
ctcccaggagggctt

SEQ ID NO: 3848764 - DNA, 13 bp, Homo sapiens
ctcccatggcttt

SEQ ID NO: 3848765 - DNA, 15 bp, Homo sapiens
ctccccacgccccca

SEQ ID NO: 3848766 - DNA, 20 bp, Homo sapiens
ctccccacgcccccatgcag

SEQ ID NO: 3848767 - DNA, 13 bp, Homo sapiens
ctccccactccag

SEQ ID NO: 3848768 - DNA, 14 bp, Homo sapiens
ctccccactccagc

SEQ ID NO: 3848769 - DNA, 17 bp, Homo sapiens
ctccccagacagggctc

SEQ ID NO: 3848770 - DNA, 20 bp, Homo sapiens
ctccccagacagggctccag

SEQ ID NO: 3848771 - DNA, 18 bp, Homo sapiens
ctccccagatctgtcctg

SEQ ID NO: 3848772 - DNA, 22 bp, Homo sapiens
ctccccagatctgtcctggggg

SEQ ID NO: 3848773 - DNA, 13 bp, Homo sapiens
ctccccagcccct

SEQ ID NO: 3848774 - DNA, 12 bp, Homo sapiens
ctccccagctcc

SEQ ID NO: 3848775 - DNA, 21 bp, Homo sapiens
ctccccatcgccagctgatga

SEQ ID NO: 3848776 - DNA, 19 bp, Homo sapiens
ctccccatttcccatctgc

SEQ ID NO: 3848777 - DNA, 22 bp, Homo sapiens
ctccccatttcccatctgcacc

SEQ ID NO: 3848778 - DNA, 15 bp, Homo sapiens
ctcccctcacagcct

SEQ ID NO: 3848779 - DNA, 13 bp, Homo sapiens
ctcccctcccctg

SEQ ID NO: 3848780 - DNA, 20 bp, Homo sapiens
ctcccgcagagactggggcc

SEQ ID NO: 3848781 - DNA, 18 bp, Homo sapiens
ctcccggttccctcccca

SEQ ID NO: 3848782 - DNA, 21 bp, Homo sapiens
ctccctctcaaccttgtaaat

SEQ ID NO: 3848783 - DNA, 14 bp, Homo sapiens
ctccctgaagccag

SEQ ID NO: 3848784 - DNA, 15 bp, Homo sapiens
ctccctgaagccagc

SEQ ID NO: 3848785 - DNA, 17 bp, Homo sapiens
ctccctgaagccagcct

SEQ ID NO: 3848786 - DNA, 15 bp, Homo sapiens
ctccgccagcctcct

SEQ ID NO: 3848787 - DNA, 21 bp, Homo sapiens
ctccgccagcctcctctggac

SEQ ID NO: 3848788 - DNA, 15 bp, Homo sapiens
ctccgcctgaggcca

SEQ ID NO: 3848789 - DNA, 16 bp, Homo sapiens
ctccgcctgaggccag

SEQ ID NO: 3848790 - DNA, 22 bp, Homo sapiens
ctccgctgtgcccgccctgggc

SEQ ID NO: 3848791 - DNA, 21 bp, Homo sapiens
ctcctcccacccaacttcccc

SEQ ID NO: 3848792 - DNA, 17 bp, Homo sapiens
ctcctccccaaatcaat

SEQ ID NO: 3848793 - DNA, 14 bp, Homo sapiens
ctcctcccttcctt

SEQ ID NO: 3848794 - DNA, 22 bp, Homo sapiens
ctcctcccttccttttccctgc

SEQ ID NO: 3848795 - DNA, 18 bp, Homo sapiens
ctcctcggcctggctcct

SEQ ID NO: 3848796 - DNA, 14 bp, Homo sapiens
ctcctctgtcccca

SEQ ID NO: 3848797 - DNA, 16 bp, Homo sapiens
ctcctcttccagagtc

SEQ ID NO: 3848798 - DNA, 23 bp, Homo sapiens
ctcctgagggtcctgctggtgac

SEQ ID NO: 3848799 - DNA, 17 bp, Homo sapiens
ctcctgcctcagcctct

SEQ ID NO: 3848800 - DNA, 18 bp, Homo sapiens
ctcctgggcaccccaggc

SEQ ID NO: 3848801 - DNA, 23 bp, Homo sapiens
ctcctggtggggcagaaaggctg

SEQ ID NO: 3848802 - DNA, 19 bp, Homo sapiens
ctccttccctgtgtctttt

SEQ ID NO: 3848803 - DNA, 19 bp, Homo sapiens
ctccttgggaggaagcaga

SEQ ID NO: 3848804 - DNA, 12 bp, Homo sapiens
ctcctttcacca

SEQ ID NO: 3848805 - DNA, 22 bp, Homo sapiens
ctcgagccatagagcctgaaat

SEQ ID NO: 3848806 - DNA, 17 bp, Homo sapiens
ctcgcaggggcgctggc

SEQ ID NO: 3848807 - DNA, 20 bp, Homo sapiens
ctcgctgctgcgccctgggc

SEQ ID NO: 3848808 - DNA, 15 bp, Homo sapiens
ctcggagtgtggcct

SEQ ID NO: 3848809 - DNA, 16 bp, Homo sapiens
ctcggagtgtggcctg

SEQ ID NO: 3848810 - DNA, 17 bp, Homo sapiens
ctcggagtgtggcctgg

SEQ ID NO: 3848811 - DNA, 22 bp, Homo sapiens
ctcggagtgtggcctggatcca

SEQ ID NO: 3848812 - DNA, 21 bp, Homo sapiens
ctcggccacccgcctccctct

SEQ ID NO: 3848813 - DNA, 16 bp, Homo sapiens
ctcggggctccccacg

SEQ ID NO: 3848814 - DNA, 16 bp, Homo sapiens
ctcgtggtccccaaca

SEQ ID NO: 3848815 - DNA, 19 bp, Homo sapiens
ctctaaggtaacaaattac

SEQ ID NO: 3848816 - DNA, 23 bp, Homo sapiens
ctctaccaccacaccaaatgact

SEQ ID NO: 3848817 - DNA, 18 bp, Homo sapiens
ctctagaagccaagggaa

SEQ ID NO: 3848818 - DNA, 20 bp, Homo sapiens
ctctagaagtgccatctcaa

SEQ ID NO: 3848819 - DNA, 13 bp, Homo sapiens
ctctaggcagaag

SEQ ID NO: 3848820 - DNA, 17 bp, Homo sapiens
ctctcagcttgtgcctt

SEQ ID NO: 3848821 - DNA, 23 bp, Homo sapiens
ctctcatggtgaaatctgctctg

SEQ ID NO: 3848822 - DNA, 18 bp, Homo sapiens
ctctcccattcaccctgt

SEQ ID NO: 3848823 - DNA, 14 bp, Homo sapiens
ctctcctctgtccc

SEQ ID NO: 3848824 - DNA, 17 bp, Homo sapiens
ctctcctctgtccccat

SEQ ID NO: 3848825 - DNA, 15 bp, Homo sapiens
ctctccttcctcaga

SEQ ID NO: 3848826 - DNA, 13 bp, Homo sapiens
ctctcctttgtag

SEQ ID NO: 3848827 - DNA, 16 bp, Homo sapiens
ctctctgtctccaggc

SEQ ID NO: 3848828 - DNA, 20 bp, Homo sapiens
ctctctttccttcttgcctt

SEQ ID NO: 3848829 - DNA, 18 bp, Homo sapiens
ctctgacccctcctcact

SEQ ID NO: 3848830 - DNA, 13 bp, Homo sapiens
ctctgaggctcag

SEQ ID NO: 3848831 - DNA, 19 bp, Homo sapiens
ctctgcatttgtctattct

SEQ ID NO: 3848832 - DNA, 23 bp, Homo sapiens
ctctgcatttgtctattctccag

SEQ ID NO: 3848833 - DNA, 11 bp, Homo sapiens
ctctgccacca

SEQ ID NO: 3848834 - DNA, 15 bp, Homo sapiens
ctctgcctgccccgc

SEQ ID NO: 3848835 - DNA, 14 bp, Homo sapiens
ctctgcggacccca

SEQ ID NO: 3848836 - DNA, 19 bp, Homo sapiens
ctctgcggaccccagctgt

SEQ ID NO: 3848837 - DNA, 20 bp, Homo sapiens
ctctgcggaccccagctgtg

SEQ ID NO: 3848838 - DNA, 14 bp, Homo sapiens
ctctggaatttgaa

SEQ ID NO: 3848839 - DNA, 21 bp, Homo sapiens
ctctggacctgcccccgcatc

SEQ ID NO: 3848840 - DNA, 16 bp, Homo sapiens
ctctggagacagcccc

SEQ ID NO: 3848841 - DNA, 17 bp, Homo sapiens
ctctggagacagcccca

SEQ ID NO: 3848842 - DNA, 19 bp, Homo sapiens
ctctggagacagccccaga

SEQ ID NO: 3848843 - DNA, 24 bp, Homo sapiens
ctctggagacagccccagagcagg

SEQ ID NO: 3848844 - DNA, 15 bp, Homo sapiens
ctctggagagaaaca

SEQ ID NO: 3848845 - DNA, 16 bp, Homo sapiens
ctctggagcaagccct

SEQ ID NO: 3848846 - DNA, 17 bp, Homo sapiens
ctctggagcaagccctg

SEQ ID NO: 3848847 - DNA, 21 bp, Homo sapiens
ctctggggctcagccctgagc

SEQ ID NO: 3848848 - DNA, 12 bp, Homo sapiens
ctctgtaattac

SEQ ID NO: 3848849 - DNA, 23 bp, Homo sapiens
ctctgtaattacaactaaattat

SEQ ID NO: 3848850 - DNA, 16 bp, Homo sapiens
ctctgtctccaggcag

SEQ ID NO: 3848851 - DNA, 19 bp, Homo sapiens
ctctgtgacctcaggcact

SEQ ID NO: 3848852 - DNA, 24 bp, Homo sapiens
ctctgtgacctcaggcactagcct

SEQ ID NO: 3848853 - DNA, 21 bp, Homo sapiens
ctctgtgctgcatcccaccag

SEQ ID NO: 3848854 - DNA, 13 bp, Homo sapiens
ctctgtgtgagag

SEQ ID NO: 3848855 - DNA, 18 bp, Homo sapiens
ctctgtgtgagagagagg

SEQ ID NO: 3848856 - DNA, 22 bp, Homo sapiens
ctcttactttcctttccccagc

SEQ ID NO: 3848857 - DNA, 15 bp, Homo sapiens
ctcttactttttgta

SEQ ID NO: 3848858 - DNA, 21 bp, Homo sapiens
ctcttactttttgtaaatgct

SEQ ID NO: 3848859 - DNA, 21 bp, Homo sapiens
ctcttgccaacctgtaataaa

SEQ ID NO: 3848860 - DNA, 23 bp, Homo sapiens
ctcttgccaacctgtaataaata

SEQ ID NO: 3848861 - DNA, 19 bp, Homo sapiens
ctcttggaattactgaaag

SEQ ID NO: 3848862 - DNA, 16 bp, Homo sapiens
ctctttccttcttgcc

SEQ ID NO: 3848863 - DNA, 17 bp, Homo sapiens
ctgaaaaatgcctgctg

SEQ ID NO: 3848864 - DNA, 20 bp, Homo sapiens
ctgaaaaatgcctgctgctg

SEQ ID NO: 3848865 - DNA, 23 bp, Homo sapiens
ctgaaagtctgtggcccaagaga

SEQ ID NO: 3848866 - DNA, 13 bp, Homo sapiens
ctttctggcctgc

SEQ ID NO: 3848867 - DNA, 22 bp, Homo sapiens
ctttgcataacgtataaaagcc

SEQ ID NO: 3848868 - DNA, 13 bp, Homo sapiens
ctttgccccactg

SEQ ID NO: 3848869 - DNA, 12 bp, Homo sapiens
ctttgctgttcg

SEQ ID NO: 3848870 - DNA, 16 bp, Homo sapiens
ctttggaaacaacatt

SEQ ID NO: 3848871 - DNA, 13 bp, Homo sapiens
ctttggctctgga

SEQ ID NO: 3848872 - DNA, 15 bp, Homo sapiens
ctttggctctggaga

SEQ ID NO: 3848873 - DNA, 16 bp, Homo sapiens
ctttggggagagctgg

SEQ ID NO: 3848874 - DNA, 17 bp, Homo sapiens
ctttggggagagctggc

SEQ ID NO: 3848875 - DNA, 17 bp, Homo sapiens
ctttggtttttttcttc

SEQ ID NO: 3848876 - DNA, 14 bp, Homo sapiens
ctttgtaaattatt

SEQ ID NO: 3848877 - DNA, 18 bp, Homo sapiens
ctttgtagtttgcccaga

SEQ ID NO: 3848878 - DNA, 21 bp, Homo sapiens
ctttgtcatgcgtctctggcc

SEQ ID NO: 3848879 - DNA, 19 bp, Homo sapiens
ctttgtgagagaggacctc

SEQ ID NO: 3848880 - DNA, 22 bp, Homo sapiens
ctttgtgagagaggacctccat

SEQ ID NO: 3848881 - DNA, 23 bp, Homo sapiens
ctttgtgagagaggacctccatg

SEQ ID NO: 3848882 - DNA, 13 bp, Homo sapiens
ctttgtgctgctg

SEQ ID NO: 3848883 - DNA, 12 bp, Homo sapiens
ctttgtgtctgg

SEQ ID NO: 3848884 - DNA, 19 bp, Homo sapiens
ctttgttggctcagaaaat

SEQ ID NO: 3848885 - DNA, 22 bp, Homo sapiens
cttttagctcaaacgtggcttt

SEQ ID NO: 3848886 - DNA, 19 bp, Homo sapiens
cttttataccatcatgagt

SEQ ID NO: 3848887 - DNA, 17 bp, Homo sapiens
cttttccaaataaaggt

SEQ ID NO: 3848888 - DNA, 14 bp, Homo sapiens
cttttccctgcttc

SEQ ID NO: 3848889 - DNA, 15 bp, Homo sapiens
cttttctgccctggc

SEQ ID NO: 3848890 - DNA, 19 bp, Homo sapiens
ctttttcaggttgttttgt

SEQ ID NO: 3848891 - DNA, 13 bp, Homo sapiens
ctttttcattccc

SEQ ID NO: 3848892 - DNA, 15 bp, Homo sapiens
ctttttcattccctg

SEQ ID NO: 3848893 - DNA, 15 bp, Homo sapiens
ctttttcctttataa

SEQ ID NO: 3848894 - DNA, 18 bp, Homo sapiens
ctttttcgccaaactgtc

SEQ ID NO: 3848895 - DNA, 20 bp, Homo sapiens
ctttttctgaagcctctaac

SEQ ID NO: 3848896 - DNA, 19 bp, Homo sapiens
ctttttctttttttgcata

SEQ ID NO: 3848897 - DNA, 21 bp, Homo sapiens
ctttttgtaaatgctgtaaat

SEQ ID NO: 3848898 - DNA, 21 bp, Homo sapiens
gaaaaacttgctcccaggagg

SEQ ID NO: 3848899 - DNA, 21 bp, Homo sapiens
gaaaactttttaatggcaata

SEQ ID NO: 3848900 - DNA, 19 bp, Homo sapiens
gaaaagcagcccttggcca

SEQ ID NO: 3848901 - DNA, 13 bp, Homo sapiens
gaaaaggcagcca

SEQ ID NO: 3848902 - DNA, 14 bp, Homo sapiens
gaaaaggcagccag

SEQ ID NO: 3848903 - DNA, 14 bp, Homo sapiens
gaaaagggcagagg

SEQ ID NO: 3848904 - DNA, 20 bp, Homo sapiens
gaaaagttgctgaaagggaa

SEQ ID NO: 3848905 - DNA, 17 bp, Homo sapiens
gaaactccacatctgcc

SEQ ID NO: 3848906 - DNA, 18 bp, Homo sapiens
gaaactccacatctgcct

SEQ ID NO: 3848907 - DNA, 19 bp, Homo sapiens
gaaactccacatctgcctt

SEQ ID NO: 3848908 - DNA, 12 bp, Homo sapiens
gaaagattttat

SEQ ID NO: 3848909 - DNA, 14 bp, Homo sapiens
gaaagattttatgt

SEQ ID NO: 3848910 - DNA, 14 bp, Homo sapiens
gaaagccaggcagg

SEQ ID NO: 3848911 - DNA, 17 bp, Homo sapiens
gaaagctaatactaata

SEQ ID NO: 3848912 - DNA, 19 bp, Homo sapiens
gaaagctaatactaatagc

SEQ ID NO: 3848913 - DNA, 20 bp, Homo sapiens
gaaaggggagagcctgctgg

SEQ ID NO: 3848914 - DNA, 21 bp, Homo sapiens
gaaaggggagagcctgctggc

SEQ ID NO: 3848915 - DNA, 14 bp, Homo sapiens
gaaaggggtgcttt

SEQ ID NO: 3848916 - DNA, 22 bp, Homo sapiens
gaaaggtgagtttgagctgcct

SEQ ID NO: 3848917 - DNA, 16 bp, Homo sapiens
gaaaggtgattccagg

SEQ ID NO: 3848918 - DNA, 18 bp, Homo sapiens
gaaaggttgaggggctcc

SEQ ID NO: 3848919 - DNA, 23 bp, Homo sapiens
gaaaggtttggaaaactaactca

SEQ ID NO: 3848920 - DNA, 13 bp, Homo sapiens
gaaagtaaagtaa

SEQ ID NO: 3848921 - DNA, 21 bp, Homo sapiens
gaaagtctgtggcccaagaga

SEQ ID NO: 3848922 - DNA, 23 bp, Homo sapiens
gaaagtttccccaccagtgaatg

SEQ ID NO: 3848923 - DNA, 15 bp, Homo sapiens
gaaataaatctatat

SEQ ID NO: 3848924 - DNA, 17 bp, Homo sapiens
gaaatggggagctggcc

SEQ ID NO: 3848925 - DNA, 23 bp, Homo sapiens
gaaatggggagctggcctaggtg

SEQ ID NO: 3848926 - DNA, 16 bp, Homo sapiens
gaaatttataaacttt

SEQ ID NO: 3848927 - DNA, 14 bp, Homo sapiens
gaaatttcatgaaa

SEQ ID NO: 3848928 - DNA, 15 bp, Homo sapiens
gaacacagaaagcct

SEQ ID NO: 3848929 - DNA, 13 bp, Homo sapiens
gaaccaggagctg

SEQ ID NO: 3848930 - DNA, 16 bp, Homo sapiens
gaacctcactcttgcc

SEQ ID NO: 3848931 - DNA, 19 bp, Homo sapiens
gaacctcactcttgccaac

SEQ ID NO: 3848932 - DNA, 21 bp, Homo sapiens
gaacgctctaggcagaagaag

SEQ ID NO: 3848933 - DNA, 17 bp, Homo sapiens
gaactctgtgtgagaga

SEQ ID NO: 3848934 - DNA, 11 bp, Homo sapiens
gaactgctgcc

SEQ ID NO: 3848935 - DNA, 21 bp, Homo sapiens
gaactgggtggtttggttttt

SEQ ID NO: 3848936 - DNA, 20 bp, Homo sapiens
gaagaagctgggagggaggg

SEQ ID NO: 3848937 - DNA, 16 bp, Homo sapiens
gaagaagcttaggcag

SEQ ID NO: 3848938 - DNA, 17 bp, Homo sapiens
gaagaagcttaggcagg

SEQ ID NO: 3848939 - DNA, 19 bp, Homo sapiens
gaagaagggagaagaaagg

SEQ ID NO: 3848940 - DNA, 18 bp, Homo sapiens
gaagacaggcacaaaatg

SEQ ID NO: 3848941 - DNA, 21 bp, Homo sapiens
gaagacaggcacaaaatgtga

SEQ ID NO: 3848942 - DNA, 17 bp, Homo sapiens
gaagatttggtttttgt

SEQ ID NO: 3848943 - DNA, 13 bp, Homo sapiens
gaagcagaataaa

SEQ ID NO: 3848944 - DNA, 19 bp, Homo sapiens
gaagcagaataaagcaatt

SEQ ID NO: 3848945 - DNA, 23 bp, Homo sapiens
gaagcagaataaagcaattttcc

SEQ ID NO: 3848946 - DNA, 12 bp, Homo sapiens
gaagccaaagaa

SEQ ID NO: 3848947 - DNA, 15 bp, Homo sapiens
gaagccaagggaaag

SEQ ID NO: 3848948 - DNA, 20 bp, Homo sapiens
gaagccaagggaaaggggtg

SEQ ID NO: 3848949 - DNA, 21 bp, Homo sapiens
gaagccaagggaaaggggtgc

SEQ ID NO: 3848950 - DNA, 19 bp, Homo sapiens
gaagccaagtggggtgctg

SEQ ID NO: 3848951 - DNA, 23 bp, Homo sapiens
gaagccaagtggggtgctgggag

SEQ ID NO: 3848952 - DNA, 17 bp, Homo sapiens
gaagccacacagcccag

SEQ ID NO: 3848953 - DNA, 22 bp, Homo sapiens
gaagccacacagcccagaaggc

SEQ ID NO: 3848954 - DNA, 23 bp, Homo sapiens
gaagcccatgaactgtgtttcca

SEQ ID NO: 3848955 - DNA, 11 bp, Homo sapiens
gaagcctggac

SEQ ID NO: 3848956 - DNA, 17 bp, Homo sapiens
gaagcctggacgcagcc

SEQ ID NO: 3848957 - DNA, 18 bp, Homo sapiens
gaagcctggacgcagcca

SEQ ID NO: 3848958 - DNA, 13 bp, Homo sapiens
gaagctcagaaag

SEQ ID NO: 3848959 - DNA, 20 bp, Homo sapiens
gaagctgacctttaactgag

SEQ ID NO: 3848960 - DNA, 12 bp, Homo sapiens
gaagctgctgtc

SEQ ID NO: 3848961 - DNA, 17 bp, Homo sapiens
gaagctgggagggaggg

SEQ ID NO: 3848962 - DNA, 16 bp, Homo sapiens
gaaggccagaaaaggc

SEQ ID NO: 3848963 - DNA, 22 bp, Homo sapiens
gaaggccatggggcagcctcca

SEQ ID NO: 3848964 - DNA, 14 bp, Homo sapiens
gaaggtgctggagg

SEQ ID NO: 3848965 - DNA, 20 bp, Homo sapiens
gaaggtgctggaggtgggag

SEQ ID NO: 3848966 - DNA, 23 bp, Homo sapiens
gaagtcttttccacatggcagat

SEQ ID NO: 3848967 - DNA, 15 bp, Homo sapiens
gaagtgccatctcaa

SEQ ID NO: 3848968 - DNA, 13 bp, Homo sapiens
gaataaagcaatt

SEQ ID NO: 3848969 - DNA, 16 bp, Homo sapiens
gaataaagcaattttc

SEQ ID NO: 3848970 - DNA, 17 bp, Homo sapiens
gaataaagcaattttcc

SEQ ID NO: 3848971 - DNA, 19 bp, Homo sapiens
gaataaagcaattttcctt

SEQ ID NO: 3848972 - DNA, 21 bp, Homo sapiens
gaataaagcaattttccttga

SEQ ID NO: 3848973 - DNA, 14 bp, Homo sapiens
gaataaagcttctc

SEQ ID NO: 3848974 - DNA, 14 bp, Homo sapiens
gaataaatgtttta

SEQ ID NO: 3848975 - DNA, 17 bp, Homo sapiens
gaatacatattacaaga

SEQ ID NO: 3848976 - DNA, 20 bp, Homo sapiens
gaatactttgaatgttgtgt

SEQ ID NO: 3848977 - DNA, 16 bp, Homo sapiens
gaatatgtgccttcta

SEQ ID NO: 3848978 - DNA, 15 bp, Homo sapiens
gaatccaaatgtgaa

SEQ ID NO: 3848979 - DNA, 18 bp, Homo sapiens
gaatccagctgggctaga

SEQ ID NO: 3848980 - DNA, 17 bp, Homo sapiens
gaatgactgaagacagg

SEQ ID NO: 3848981 - DNA, 15 bp, Homo sapiens
gaatgaggtgggagg

SEQ ID NO: 3848982 - DNA, 17 bp, Homo sapiens
gaatgtatatcagggtt

SEQ ID NO: 3848983 - DNA, 13 bp, Homo sapiens
gaatgtgagcaca

SEQ ID NO: 3848984 - DNA, 18 bp, Homo sapiens
gaatgttttcgcaaatgt

SEQ ID NO: 3848985 - DNA, 16 bp, Homo sapiens
gaattaagaaagatta

SEQ ID NO: 3848986 - DNA, 12 bp, Homo sapiens
gaatttaaaaaa

SEQ ID NO: 3848987 - DNA, 20 bp, Homo sapiens
gaatttctatagactgactt

SEQ ID NO: 3848988 - DNA, 19 bp, Homo sapiens
gaatttgaagctcagaaag

SEQ ID NO: 3848989 - DNA, 12 bp, Homo sapiens
gaattttgtaag

SEQ ID NO: 3848990 - DNA, 13 bp, Homo sapiens
gacaaaatttaga

SEQ ID NO: 3848991 - DNA, 18 bp, Homo sapiens
gacaagagatgggaatga

SEQ ID NO: 3848992 - DNA, 21 bp, Homo sapiens
gacaaggctgtgccaggctgg

SEQ ID NO: 3848993 - DNA, 16 bp, Homo sapiens
gacacaggagaccacc

SEQ ID NO: 3848994 - DNA, 17 bp, Homo sapiens
gacacaggagaccaccc

SEQ ID NO: 3848995 - DNA, 17 bp, Homo sapiens
gacaccacacccagcct

SEQ ID NO: 3848996 - DNA, 21 bp, Homo sapiens
gacaccacacccagcctcagt

SEQ ID NO: 3848997 - DNA, 18 bp, Homo sapiens
gacacctttaaaaagcag

SEQ ID NO: 3848998 - DNA, 12 bp, Homo sapiens
gacagagcaggc

SEQ ID NO: 3848999 - DNA, 17 bp, Homo sapiens
gccacacagcccagaag

SEQ ID NO: 3849000 - DNA, 19 bp, Homo sapiens
gccacacagcccagaaggc

SEQ ID NO: 3849001 - DNA, 22 bp, Homo sapiens
gccacacagcccagaaggccag

SEQ ID NO: 3849002 - DNA, 14 bp, Homo sapiens
gccacacagtggcc

SEQ ID NO: 3849003 - DNA, 19 bp, Homo sapiens
gccacacagtggccggggc

SEQ ID NO: 3849004 - DNA, 14 bp, Homo sapiens
gccacaccccagac

SEQ ID NO: 3849005 - DNA, 16 bp, Homo sapiens
gccacaccccagactc

SEQ ID NO: 3849006 - DNA, 21 bp, Homo sapiens
gccacaccccagactccaggc

SEQ ID NO: 3849007 - DNA, 22 bp, Homo sapiens
gccacaccccagactccaggcc

SEQ ID NO: 3849008 - DNA, 21 bp, Homo sapiens
gccaccagagaccgtcctcac

SEQ ID NO: 3849009 - DNA, 19 bp, Homo sapiens
gccacccgcctccctctca

SEQ ID NO: 3849010 - DNA, 12 bp, Homo sapiens
gccacctcccca

SEQ ID NO: 3849011 - DNA, 14 bp, Homo sapiens
gccacctccccact

SEQ ID NO: 3849012 - DNA, 11 bp, Homo sapiens
gccacctctgc

SEQ ID NO: 3849013 - DNA, 21 bp, Homo sapiens
gccacctctgcggaccccagc

SEQ ID NO: 3849014 - DNA, 22 bp, Homo sapiens
gccacctctgcggaccccagct

SEQ ID NO: 3849015 - DNA, 14 bp, Homo sapiens
gccactgctggtgt

SEQ ID NO: 3849016 - DNA, 14 bp, Homo sapiens
gccagaggccagga

SEQ ID NO: 3849017 - DNA, 17 bp, Homo sapiens
gccagaggccaggatgc

SEQ ID NO: 3849018 - DNA, 13 bp, Homo sapiens
gccagatccccag

SEQ ID NO: 3849019 - DNA, 15 bp, Homo sapiens
gccagatccccaggg

SEQ ID NO: 3849020 - DNA, 17 bp, Homo sapiens
gccagatccccagggca

SEQ ID NO: 3849021 - DNA, 21 bp, Homo sapiens
gccagatccccagggcagcct

SEQ ID NO: 3849022 - DNA, 16 bp, Homo sapiens
gccagcaaagccccat

SEQ ID NO: 3849023 - DNA, 15 bp, Homo sapiens
gccagcacagctgag

SEQ ID NO: 3849024 - DNA, 15 bp, Homo sapiens
gccagccctggcttc

SEQ ID NO: 3849025 - DNA, 19 bp, Homo sapiens
gccagccctggcttccaag

SEQ ID NO: 3849026 - DNA, 20 bp, Homo sapiens
gccagcctgcgggaagctga

SEQ ID NO: 3849027 - DNA, 17 bp, Homo sapiens
gccagctgatgactcaa

SEQ ID NO: 3849028 - DNA, 19 bp, Homo sapiens
gccagctgatgactcaaga

SEQ ID NO: 3849029 - DNA, 22 bp, Homo sapiens
gccaggcacacactgtgctttc

SEQ ID NO: 3849030 - DNA, 19 bp, Homo sapiens
gccaggcaggtagccaggg

SEQ ID NO: 3849031 - DNA, 14 bp, Homo sapiens
gccaggccagcctc

SEQ ID NO: 3849032 - DNA, 17 bp, Homo sapiens
gccaggctatggttgcc

SEQ ID NO: 3849033 - DNA, 12 bp, Homo sapiens
gccaggctggga

SEQ ID NO: 3849034 - DNA, 14 bp, Homo sapiens
gccaggctgggagg

SEQ ID NO: 3849035 - DNA, 19 bp, Homo sapiens
gccaggctgggaggctcgg

SEQ ID NO: 3849036 - DNA, 23 bp, Homo sapiens
gccaggctggtcttgaactcctg

SEQ ID NO: 3849037 - DNA, 15 bp, Homo sapiens
gccagggaagacaga

SEQ ID NO: 3849038 - DNA, 21 bp, Homo sapiens
gccagggaagacagagcaggc

SEQ ID NO: 3849039 - DNA, 21 bp, Homo sapiens
gccagggggactagcccctgt

SEQ ID NO: 3849040 - DNA, 13 bp, Homo sapiens
gccatcccaaggc

SEQ ID NO: 3849041 - DNA, 20 bp, Homo sapiens
gccatctcaattgtgctttg

SEQ ID NO: 3849042 - DNA, 21 bp, Homo sapiens
gccatctcaattgtgctttgt

SEQ ID NO: 3849043 - DNA, 23 bp, Homo sapiens
gccatctcaattgtgctttgtat

SEQ ID NO: 3849044 - DNA, 14 bp, Homo sapiens
gccatggctggggg

SEQ ID NO: 3849045 - DNA, 15 bp, Homo sapiens
gccatggctgggggg

SEQ ID NO: 3849046 - DNA, 14 bp, Homo sapiens
gccatggggcagcc

SEQ ID NO: 3849047 - DNA, 23 bp, Homo sapiens
gccatggggcagcctccagtctg

SEQ ID NO: 3849048 - DNA, 14 bp, Homo sapiens
gccatggggtaggg

SEQ ID NO: 3849049 - DNA, 16 bp, Homo sapiens
gccatgtcctcaaccc

SEQ ID NO: 3849050 - DNA, 16 bp, Homo sapiens
gccattggcctctgtc

SEQ ID NO: 3849051 - DNA, 17 bp, Homo sapiens
gccattggcctctgtct

SEQ ID NO: 3849052 - DNA, 15 bp, Homo sapiens
gccatttctttatat

SEQ ID NO: 3849053 - DNA, 23 bp, Homo sapiens
gcccaaattatcaagctaataaa

SEQ ID NO: 3849054 - DNA, 13 bp, Homo sapiens
gcccacaccatct

SEQ ID NO: 3849055 - DNA, 15 bp, Homo sapiens
gcccacaccatctgg

SEQ ID NO: 3849056 - DNA, 18 bp, Homo sapiens
gcccacaccatctggccc

SEQ ID NO: 3849057 - DNA, 22 bp, Homo sapiens
gcccacaccatctggcccaggc

SEQ ID NO: 3849058 - DNA, 23 bp, Homo sapiens
gcccacaccatctggcccaggct

SEQ ID NO: 3849059 - DNA, 13 bp, Homo sapiens
gcccaccagagct

SEQ ID NO: 3849060 - DNA, 15 bp, Homo sapiens
gcccacctccccacg

SEQ ID NO: 3849061 - DNA, 18 bp, Homo sapiens
gcccacctccccacgccc

SEQ ID NO: 3849062 - DNA, 21 bp, Homo sapiens
gcccacctccccacgccctcc

SEQ ID NO: 3849063 - DNA, 19 bp, Homo sapiens
gcccacttctgtgtagaca

SEQ ID NO: 3849064 - DNA, 12 bp, Homo sapiens
gcccagaaggcc

SEQ ID NO: 3849065 - DNA, 16 bp, Homo sapiens
gcccagaaggccagaa

SEQ ID NO: 3849066 - DNA, 23 bp, Homo sapiens
gcccagaaggccagaaaaggcag

SEQ ID NO: 3849067 - DNA, 13 bp, Homo sapiens
gcccagcccaggc

SEQ ID NO: 3849068 - DNA, 15 bp, Homo sapiens
gcccagcccaggcct

SEQ ID NO: 3849069 - DNA, 16 bp, Homo sapiens
gcccagcccaggcctg

SEQ ID NO: 3849070 - DNA, 17 bp, Homo sapiens
gcccagcccaggcctgg

SEQ ID NO: 3849071 - DNA, 16 bp, Homo sapiens
gcccagccccaggtct

SEQ ID NO: 3849072 - DNA, 21 bp, Homo sapiens
gcccagccccaggtctcccca

SEQ ID NO: 3849073 - DNA, 14 bp, Homo sapiens
gcccagctgccagg

SEQ ID NO: 3849074 - DNA, 18 bp, Homo sapiens
gcccagctgccagggaag

SEQ ID NO: 3849075 - DNA, 12 bp, Homo sapiens
gcccaggagaat

SEQ ID NO: 3849076 - DNA, 22 bp, Homo sapiens
gcccaggagaattaggaaggcc

SEQ ID NO: 3849077 - DNA, 12 bp, Homo sapiens
gcccaggagaga

SEQ ID NO: 3849078 - DNA, 14 bp, Homo sapiens
gcccaggagagaga

SEQ ID NO: 3849079 - DNA, 12 bp, Homo sapiens
gcccaggcctgg

SEQ ID NO: 3849080 - DNA, 16 bp, Homo sapiens
gcccaggcctggtgga

SEQ ID NO: 3849081 - DNA, 21 bp, Homo sapiens
gcccaggctggcccccaccca

SEQ ID NO: 3849082 - DNA, 12 bp, Homo sapiens
gcccatccctgc

SEQ ID NO: 3849083 - DNA, 14 bp, Homo sapiens
gcccatccctgcct

SEQ ID NO: 3849084 - DNA, 16 bp, Homo sapiens
gcccatccctgcctgg

SEQ ID NO: 3849085 - DNA, 18 bp, Homo sapiens
gcccatccctgcctggtc

SEQ ID NO: 3849086 - DNA, 13 bp, Homo sapiens
gcccattctactt

SEQ ID NO: 3849087 - DNA, 19 bp, Homo sapiens
gcccattctacttgctctg

SEQ ID NO: 3849088 - DNA, 17 bp, Homo sapiens
gccccacccccagccag

SEQ ID NO: 3849089 - DNA, 19 bp, Homo sapiens
gccccacccccagccaggc

SEQ ID NO: 3849090 - DNA, 18 bp, Homo sapiens
gccccactgggagagtcc

SEQ ID NO: 3849091 - DNA, 23 bp, Homo sapiens
gccccactgggagagtccttagc

SEQ ID NO: 3849092 - DNA, 14 bp, Homo sapiens
gccccaggagaagg

SEQ ID NO: 3849093 - DNA, 12 bp, Homo sapiens
gccccatgctgg

SEQ ID NO: 3849094 - DNA, 15 bp, Homo sapiens
gccccatgctggagc

SEQ ID NO: 3849095 - DNA, 16 bp, Homo sapiens
gccccatgctggagcc

SEQ ID NO: 3849096 - DNA, 21 bp, Homo sapiens
gcccccaccccggggaccctg

SEQ ID NO: 3849097 - DNA, 12 bp, Homo sapiens
gcccccagcacc

SEQ ID NO: 3849098 - DNA, 20 bp, Homo sapiens
gcccccgttgaagccgctcc

SEQ ID NO: 3849099 - DNA, 19 bp, Homo sapiens
gccccgcagacctccccag

SEQ ID NO: 3849100 - DNA, 20 bp, Homo sapiens
gccccgcagacctccccagc

SEQ ID NO: 3849101 - DNA, 21 bp, Homo sapiens
gccccgcagacctccccagcc

SEQ ID NO: 3849102 - DNA, 20 bp, Homo sapiens
gcccctagcccaggagagag

SEQ ID NO: 3849103 - DNA, 21 bp, Homo sapiens
gcccctagcccaggagagaga

SEQ ID NO: 3849104 - DNA, 17 bp, Homo sapiens
gcccctgccctgaggag

SEQ ID NO: 3849105 - DNA, 11 bp, Homo sapiens
gcccctgggct

SEQ ID NO: 3849106 - DNA, 19 bp, Homo sapiens
gcccctgggcttggcctgc

SEQ ID NO: 3849107 - DNA, 23 bp, Homo sapiens
gcccctgggcttggcctgctgtg

SEQ ID NO: 3849108 - DNA, 16 bp, Homo sapiens
gccccttggtgccaca

SEQ ID NO: 3849109 - DNA, 14 bp, Homo sapiens
gcccgcacagagct

SEQ ID NO: 3849110 - DNA, 14 bp, Homo sapiens
gcccgccctgggct

SEQ ID NO: 3849111 - DNA, 17 bp, Homo sapiens
gccctcccctcccctgc

SEQ ID NO: 3849112 - DNA, 21 bp, Homo sapiens
gccctccctcctgcctgcgca

SEQ ID NO: 3849113 - DNA, 18 bp, Homo sapiens
gccctcctgggcacccca

SEQ ID NO: 3849114 - DNA, 19 bp, Homo sapiens
gccctcctgggcaccccag

SEQ ID NO: 3849115 - DNA, 14 bp, Homo sapiens
gccctctgaggctc

SEQ ID NO: 3849116 - DNA, 16 bp, Homo sapiens
gccctctgaggctcag

SEQ ID NO: 3849117 - DNA, 13 bp, Homo sapiens
gccctctggggct

SEQ ID NO: 3849118 - DNA, 21 bp, Homo sapiens
gccctgagctggcctcacctg

SEQ ID NO: 3849119 - DNA, 13 bp, Homo sapiens
gccctgaggaata

SEQ ID NO: 3849120 - DNA, 15 bp, Homo sapiens
gccctgaggaataaa

SEQ ID NO: 3849121 - DNA, 16 bp, Homo sapiens
gccctgaggaataaag

SEQ ID NO: 3849122 - DNA, 23 bp, Homo sapiens
gccctgaggagggccctgaggaa

SEQ ID NO: 3849123 - DNA, 20 bp, Homo sapiens
gccctgatccaggaaaatgt

SEQ ID NO: 3849124 - DNA, 22 bp, Homo sapiens
gccctgcagtaatctccagggc

SEQ ID NO: 3849125 - DNA, 17 bp, Homo sapiens
gccctggaggtgccagc

SEQ ID NO: 3849126 - DNA, 18 bp, Homo sapiens
gccctggaggtgccagca

SEQ ID NO: 3849127 - DNA, 23 bp, Homo sapiens
gccctggaggtgccagcaaagcc

SEQ ID NO: 3849128 - DNA, 10 bp, Homo sapiens
gccctggctg

SEQ ID NO: 3849129 - DNA, 19 bp, Homo sapiens
gccctggctgctgccccca

SEQ ID NO: 3849130 - DNA, 23 bp, Homo sapiens
gccctgggcgcagctgaagcctg

SEQ ID NO: 3849131 - DNA, 13 bp, Homo sapiens
gccctgggctgcc

SEQ ID NO: 3849132 - DNA, 13 bp, Homo sapiens
ggccatggggcag

SEQ ID NO: 3849133 - DNA, 15 bp, Homo sapiens
ggccatggggcagcc

SEQ ID NO: 3849134 - DNA, 17 bp, Homo sapiens
ggccatggggcagcctc

SEQ ID NO: 3849135 - DNA, 18 bp, Homo sapiens
ggccatggggcagcctcc

SEQ ID NO: 3849136 - DNA, 23 bp, Homo sapiens
ggccatgttccaataaacaggag

SEQ ID NO: 3849137 - DNA, 21 bp, Homo sapiens
ggcccaaattatcaagctaat

SEQ ID NO: 3849138 - DNA, 12 bp, Homo sapiens
ggcccagctgcc

SEQ ID NO: 3849139 - DNA, 15 bp, Homo sapiens
ggcccattctacttg

SEQ ID NO: 3849140 - DNA, 14 bp, Homo sapiens
ggcccccagcaccc

SEQ ID NO: 3849141 - DNA, 15 bp, Homo sapiens
ggcccccagcaccct

SEQ ID NO: 3849142 - DNA, 19 bp, Homo sapiens
ggccccctttctatgttca

SEQ ID NO: 3849143 - DNA, 16 bp, Homo sapiens
ggccccgtctcctgag

SEQ ID NO: 3849144 - DNA, 20 bp, Homo sapiens
ggcccctgggcttggcctgc

SEQ ID NO: 3849145 - DNA, 21 bp, Homo sapiens
ggcccctgggcttggcctgct

SEQ ID NO: 3849146 - DNA, 16 bp, Homo sapiens
ggcccgcacagagctg

SEQ ID NO: 3849147 - DNA, 18 bp, Homo sapiens
ggccctagtgacaggttt

SEQ ID NO: 3849148 - DNA, 23 bp, Homo sapiens
ggccctctggggctcagccctga

SEQ ID NO: 3849149 - DNA, 13 bp, Homo sapiens
ggccctgaggaat

SEQ ID NO: 3849150 - DNA, 15 bp, Homo sapiens
ggccctgaggaataa

SEQ ID NO: 3849151 - DNA, 17 bp, Homo sapiens
ggccctgaggaataaag

SEQ ID NO: 3849152 - DNA, 18 bp, Homo sapiens
ggccctgtccctcccacc

SEQ ID NO: 3849153 - DNA, 20 bp, Homo sapiens
ggccctgtccctcccacctc

SEQ ID NO: 3849154 - DNA, 22 bp, Homo sapiens
ggccctgtccctcccacctctg

SEQ ID NO: 3849155 - DNA, 13 bp, Homo sapiens
ggcccttcctggc

SEQ ID NO: 3849156 - DNA, 18 bp, Homo sapiens
ggcccttcctggctagga

SEQ ID NO: 3849157 - DNA, 18 bp, Homo sapiens
ggccctttcctcaggcaa

SEQ ID NO: 3849158 - DNA, 16 bp, Homo sapiens
ggccgagcccacacca

SEQ ID NO: 3849159 - DNA, 20 bp, Homo sapiens
ggccgagcccacaccatctg

SEQ ID NO: 3849160 - DNA, 19 bp, Homo sapiens
ggcctaggtgggagccacc

SEQ ID NO: 3849161 - DNA, 22 bp, Homo sapiens
ggcctcacctgggttccccacc

SEQ ID NO: 3849162 - DNA, 17 bp, Homo sapiens
ggcctggatccatcctg

SEQ ID NO: 3849163 - DNA, 21 bp, Homo sapiens
ggcctggatccatcctgctag

SEQ ID NO: 3849164 - DNA, 11 bp, Homo sapiens
ggcctgggttt

SEQ ID NO: 3849165 - DNA, 20 bp, Homo sapiens
ggcctgtggatcaaatccag

SEQ ID NO: 3849166 - DNA, 21 bp, Homo sapiens
ggcgcagctgaagcctggacg

SEQ ID NO: 3849167 - DNA, 14 bp, Homo sapiens
ggcgcccacctccc

SEQ ID NO: 3849168 - DNA, 19 bp, Homo sapiens
ggctaggactgtggagggg

SEQ ID NO: 3849169 - DNA, 24 bp, Homo sapiens
ggctaggggaggggggagccagag

SEQ ID NO: 3849170 - DNA, 17 bp, Homo sapiens
ggctcagccctgagctg

SEQ ID NO: 3849171 - DNA, 19 bp, Homo sapiens
ggctccagcctgtcggcca

SEQ ID NO: 3849172 - DNA, 14 bp, Homo sapiens
ggctccgctgtgcc

SEQ ID NO: 3849173 - DNA, 18 bp, Homo sapiens
ggctcctggtggggcaga

SEQ ID NO: 3849174 - DNA, 23 bp, Homo sapiens
ggctccttgggatgaagagggta

SEQ ID NO: 3849175 - DNA, 19 bp, Homo sapiens
ggctctggagacagcccca

SEQ ID NO: 3849176 - DNA, 14 bp, Homo sapiens
ggctctggagagaa

SEQ ID NO: 3849177 - DNA, 20 bp, Homo sapiens
ggctgaagccacacagccca

SEQ ID NO: 3849178 - DNA, 22 bp, Homo sapiens
ggctgagggatggactgatgct

SEQ ID NO: 3849179 - DNA, 23 bp, Homo sapiens
ggctgagggatggactgatgctt

SEQ ID NO: 3849180 - DNA, 17 bp, Homo sapiens
ggctgaggttcctctgc

SEQ ID NO: 3849181 - DNA, 20 bp, Homo sapiens
ggctgaggttcctctgcctg

SEQ ID NO: 3849182 - DNA, 21 bp, Homo sapiens
ggctgcactcaagaccctcga

SEQ ID NO: 3849183 - DNA, 18 bp, Homo sapiens
ggctgccctccatccctt

SEQ ID NO: 3849184 - DNA, 12 bp, Homo sapiens
ggctgctccttc

SEQ ID NO: 3849185 - DNA, 13 bp, Homo sapiens
ggctgctgccccc

SEQ ID NO: 3849186 - DNA, 23 bp, Homo sapiens
ggctgctttgtagtttgcccaga

SEQ ID NO: 3849187 - DNA, 13 bp, Homo sapiens
ggctggcccccac

SEQ ID NO: 3849188 - DNA, 14 bp, Homo sapiens
ggctggcccccacc

SEQ ID NO: 3849189 - DNA, 17 bp, Homo sapiens
ggctggcccccacccac

SEQ ID NO: 3849190 - DNA, 21 bp, Homo sapiens
ggctggcccccacccaccttc

SEQ ID NO: 3849191 - DNA, 23 bp, Homo sapiens
ggctggctcctggggatggccag

SEQ ID NO: 3849192 - DNA, 15 bp, Homo sapiens
ggctgggaggctcgg

SEQ ID NO: 3849193 - DNA, 17 bp, Homo sapiens
ggctgggcccttcctgg

SEQ ID NO: 3849194 - DNA, 22 bp, Homo sapiens
ggctgggcccttcctggctagg

SEQ ID NO: 3849195 - DNA, 18 bp, Homo sapiens
ggctggtttgcccagagc

SEQ ID NO: 3849196 - DNA, 23 bp, Homo sapiens
ggctggtttgcccagagccaagc

SEQ ID NO: 3849197 - DNA, 15 bp, Homo sapiens
ggctgtgccaggctg

SEQ ID NO: 3849198 - DNA, 18 bp, Homo sapiens
ggcttctccgccagcctc

SEQ ID NO: 3849199 - DNA, 21 bp, Homo sapiens
ggcttctccgccagcctcctc

SEQ ID NO: 3849200 - DNA, 16 bp, Homo sapiens
ggcttgagttttcatt

SEQ ID NO: 3849201 - DNA, 21 bp, Homo sapiens
ggctttgtgagagaggacctc

SEQ ID NO: 3849202 - DNA, 17 bp, Homo sapiens
ggctttgtgctgctgag

SEQ ID NO: 3849203 - DNA, 13 bp, Homo sapiens
gggaaaggggtgc

SEQ ID NO: 3849204 - DNA, 19 bp, Homo sapiens
gggaatccccgaaggtgct

SEQ ID NO: 3849205 - DNA, 19 bp, Homo sapiens
gggacacaggagaccaccc

SEQ ID NO: 3849206 - DNA, 17 bp, Homo sapiens
gggacctgccaggcagg

SEQ ID NO: 3849207 - DNA, 23 bp, Homo sapiens
gggagagagagagagagaggaca

SEQ ID NO: 3849208 - DNA, 13 bp, Homo sapiens
gggagagcctgct

SEQ ID NO: 3849209 - DNA, 16 bp, Homo sapiens
gggagagcctgctggc

SEQ ID NO: 3849210 - DNA, 13 bp, Homo sapiens
gggagagctggca

SEQ ID NO: 3849211 - DNA, 15 bp, Homo sapiens
gggagccagaggcca

SEQ ID NO: 3849212 - DNA, 22 bp, Homo sapiens
gggagccagaggccaggatgcc

SEQ ID NO: 3849213 - DNA, 15 bp, Homo sapiens
gggagctgctggcca

SEQ ID NO: 3849214 - DNA, 16 bp, Homo sapiens
gggagctgctggccat

SEQ ID NO: 3849215 - DNA, 19 bp, Homo sapiens
gggagctgctggccatggc

SEQ ID NO: 3849216 - DNA, 23 bp, Homo sapiens
gggagctggcctaggtgggagcc

SEQ ID NO: 3849217 - DNA, 20 bp, Homo sapiens
gggaggaagcagaataaagc

SEQ ID NO: 3849218 - DNA, 18 bp, Homo sapiens
gggaggctcggggctccc

SEQ ID NO: 3849219 - DNA, 13 bp, Homo sapiens
gggagggaacatc

SEQ ID NO: 3849220 - DNA, 14 bp, Homo sapiens
gggagggaggggga

SEQ ID NO: 3849221 - DNA, 17 bp, Homo sapiens
gggaggggggagccaga

SEQ ID NO: 3849222 - DNA, 19 bp, Homo sapiens
gggaggggggagccagagg

SEQ ID NO: 3849223 - DNA, 11 bp, Homo sapiens
gggagggtggc

SEQ ID NO: 3849224 - DNA, 22 bp, Homo sapiens
gggaggtgaaaagggcagaggc

SEQ ID NO: 3849225 - DNA, 23 bp, Homo sapiens
gggaggtggaagaagggagaaga

SEQ ID NO: 3849226 - DNA, 12 bp, Homo sapiens
gggatggccagg

SEQ ID NO: 3849227 - DNA, 21 bp, Homo sapiens
gggcaagaggtgcctgggagg

SEQ ID NO: 3849228 - DNA, 22 bp, Homo sapiens
gggcaagaggtgcctgggagga

SEQ ID NO: 3849229 - DNA, 18 bp, Homo sapiens
gggcacagacctctccca

SEQ ID NO: 3849230 - DNA, 15 bp, Homo sapiens
gggcacagtggctca

SEQ ID NO: 3849231 - DNA, 22 bp, Homo sapiens
gggcagaaaggctgcaacgctg

SEQ ID NO: 3849232 - DNA, 17 bp, Homo sapiens
gggcagatgaaaagcta

SEQ ID NO: 3849233 - DNA, 21 bp, Homo sapiens
gggcagcctcgttaggacaag

SEQ ID NO: 3849234 - DNA, 15 bp, Homo sapiens
gggcaggggtgtcct

SEQ ID NO: 3849235 - DNA, 16 bp, Homo sapiens
gggcatgccccggcca

SEQ ID NO: 3849236 - DNA, 22 bp, Homo sapiens
gggcatgccccggccacctctg

SEQ ID NO: 3849237 - DNA, 22 bp, Homo sapiens
gggccagcacagctgaggaccc

SEQ ID NO: 3849238 - DNA, 22 bp, Homo sapiens
gggccagccccacccccagcca

SEQ ID NO: 3849239 - DNA, 23 bp, Homo sapiens
gggccagccccacccccagccag

SEQ ID NO: 3849240 - DNA, 21 bp, Homo sapiens
gggcccctgggcttggcctgc

SEQ ID NO: 3849241 - DNA, 13 bp, Homo sapiens
gggccctctgagg

SEQ ID NO: 3849242 - DNA, 13 bp, Homo sapiens
gggccctgaggaa

SEQ ID NO: 3849243 - DNA, 18 bp, Homo sapiens
gggccctgaggaataaag

SEQ ID NO: 3849244 - DNA, 23 bp, Homo sapiens
gggccgcaggcgggaaaagcagc

SEQ ID NO: 3849245 - DNA, 14 bp, Homo sapiens
gggcctcctcctag

SEQ ID NO: 3849246 - DNA, 18 bp, Homo sapiens
gggcgcagctgaagcctg

SEQ ID NO: 3849247 - DNA, 13 bp, Homo sapiens
gggcgcccacctc

SEQ ID NO: 3849248 - DNA, 21 bp, Homo sapiens
gggcgcccacctccccacgcc

SEQ ID NO: 3849249 - DNA, 16 bp, Homo sapiens
gggcgcccagcccagg

SEQ ID NO: 3849250 - DNA, 13 bp, Homo sapiens
gggctacaagagg

SEQ ID NO: 3849251 - DNA, 13 bp, Homo sapiens
gggctccagcctg

SEQ ID NO: 3849252 - DNA, 18 bp, Homo sapiens
gggctccgctgtgcccgc

SEQ ID NO: 3849253 - DNA, 17 bp, Homo sapiens
gggctcgtctttgcaga

SEQ ID NO: 3849254 - DNA, 14 bp, Homo sapiens
gggctctggagaga

SEQ ID NO: 3849255 - DNA, 15 bp, Homo sapiens
gggctctggagagaa

SEQ ID NO: 3849256 - DNA, 16 bp, Homo sapiens
gggctctgtgcagtca

SEQ ID NO: 3849257 - DNA, 22 bp, Homo sapiens
gggctgaagccacacagcccag

SEQ ID NO: 3849258 - DNA, 20 bp, Homo sapiens
gggctgcctcctcctgagag

SEQ ID NO: 3849259 - DNA, 13 bp, Homo sapiens
gggcttaattgaa

SEQ ID NO: 3849260 - DNA, 13 bp, Homo sapiens
gggcttgaagcca

SEQ ID NO: 3849261 - DNA, 17 bp, Homo sapiens
gggcttggcctgctgtg

SEQ ID NO: 3849262 - DNA, 22 bp, Homo sapiens
ggggaatctggaacgctctagg

SEQ ID NO: 3849263 - DNA, 21 bp, Homo sapiens
taaataaagtttgttgaaaca

SEQ ID NO: 3849264 - DNA, 16 bp, Homo sapiens
taaatagtttaacact

SEQ ID NO: 3849265 - DNA, 15 bp, Homo sapiens
taaatatataaacaa

SEQ ID NO: 3849266 - DNA, 16 bp, Homo sapiens
taaatatataaacaaa

SEQ ID NO: 3849267 - DNA, 18 bp, Homo sapiens
taaatatatataaatata

SEQ ID NO: 3849268 - DNA, 17 bp, Homo sapiens
taaatatatctttgtaa

SEQ ID NO: 3849269 - DNA, 14 bp, Homo sapiens
taaatatttcataa

SEQ ID NO: 3849270 - DNA, 16 bp, Homo sapiens
taaatatttcataaat

SEQ ID NO: 3849271 - DNA, 19 bp, Homo sapiens
taaatctatatttttgtga

SEQ ID NO: 3849272 - DNA, 17 bp, Homo sapiens
taaatgctgtaaatatt

SEQ ID NO: 3849273 - DNA, 15 bp, Homo sapiens
taaatgctgtatgtc

SEQ ID NO: 3849274 - DNA, 22 bp, Homo sapiens
taaatgctgtatgtcattaaag

SEQ ID NO: 3849275 - DNA, 16 bp, Homo sapiens
taaatgtattaactga

SEQ ID NO: 3849276 - DNA, 23 bp, Homo sapiens
taaatgtggaatgatgtatataa

SEQ ID NO: 3849277 - DNA, 16 bp, Homo sapiens
taaatgttttacaact

SEQ ID NO: 3849278 - DNA, 13 bp, Homo sapiens
taaatgttttagt

SEQ ID NO: 3849279 - DNA, 23 bp, Homo sapiens
taaatgtttttttttaaagactt

SEQ ID NO: 3849280 - DNA, 11 bp, Homo sapiens
taaattatttt

SEQ ID NO: 3849281 - DNA, 14 bp, Homo sapiens
taaattattttatg

SEQ ID NO: 3849282 - DNA, 23 bp, Homo sapiens
taaatttgccagttttattttct

SEQ ID NO: 3849283 - DNA, 17 bp, Homo sapiens
taacaatggcaggtttt

SEQ ID NO: 3849284 - DNA, 20 bp, Homo sapiens
taacaatggcaggttttaca

SEQ ID NO: 3849285 - DNA, 20 bp, Homo sapiens
taacaccaacactgtaacat

SEQ ID NO: 3849286 - DNA, 11 bp, Homo sapiens
taacagctcct

SEQ ID NO: 3849287 - DNA, 15 bp, Homo sapiens
taacagctccttggg

SEQ ID NO: 3849288 - DNA, 20 bp, Homo sapiens
taacagctccttgggaggaa

SEQ ID NO: 3849289 - DNA, 23 bp, Homo sapiens
taacagctccttgggaggaagca

SEQ ID NO: 3849290 - DNA, 16 bp, Homo sapiens
taacagttataaagaa

SEQ ID NO: 3849291 - DNA, 19 bp, Homo sapiens
taacatgaatatttagtgt

SEQ ID NO: 3849292 - DNA, 20 bp, Homo sapiens
taaccccgtctgctcctccc

SEQ ID NO: 3849293 - DNA, 17 bp, Homo sapiens
taactaatatggttttg

SEQ ID NO: 3849294 - DNA, 20 bp, Homo sapiens
taactaatatttgtctgtgt

SEQ ID NO: 3849295 - DNA, 21 bp, Homo sapiens
taactaatatttgtctgtgtg

SEQ ID NO: 3849296 - DNA, 22 bp, Homo sapiens
taactaatatttgtctgtgtgc

SEQ ID NO: 3849297 - DNA, 13 bp, Homo sapiens
taactgaagcata

SEQ ID NO: 3849298 - DNA, 22 bp, Homo sapiens
taactgaagcataaacatcaca

SEQ ID NO: 3849299 - DNA, 19 bp, Homo sapiens
taactgagggctgatcttt

SEQ ID NO: 3849300 - DNA, 20 bp, Homo sapiens
taactgagggctgatcttta

SEQ ID NO: 3849301 - DNA, 19 bp, Homo sapiens
taacttggatgtagccatg

SEQ ID NO: 3849302 - DNA, 11 bp, Homo sapiens
taacttttatt

SEQ ID NO: 3849303 - DNA, 14 bp, Homo sapiens
taagaaattttatt

SEQ ID NO: 3849304 - DNA, 17 bp, Homo sapiens
taagaaattttattaga

SEQ ID NO: 3849305 - DNA, 21 bp, Homo sapiens
taagaaattttattagacatt

SEQ ID NO: 3849306 - DNA, 13 bp, Homo sapiens
taagagtttacaa

SEQ ID NO: 3849307 - DNA, 15 bp, Homo sapiens
taagagtttacaaga

SEQ ID NO: 3849308 - DNA, 23 bp, Homo sapiens
taagatgaatccaaatgtgaaag

SEQ ID NO: 3849309 - DNA, 23 bp, Homo sapiens
taagcttaaaaaagaaagatttt

SEQ ID NO: 3849310 - DNA, 14 bp, Homo sapiens
taaggcccagctgc

SEQ ID NO: 3849311 - DNA, 17 bp, Homo sapiens
taagggtggagagttgg

SEQ ID NO: 3849312 - DNA, 15 bp, Homo sapiens
taagtatataaatac

SEQ ID NO: 3849313 - DNA, 13 bp, Homo sapiens
taagtatatttgt

SEQ ID NO: 3849314 - DNA, 22 bp, Homo sapiens
taagtatatttgtaaaagctaa

SEQ ID NO: 3849315 - DNA, 16 bp, Homo sapiens
taagtctgttattgtt

SEQ ID NO: 3849316 - DNA, 16 bp, Homo sapiens
taagtctttttgaagt

SEQ ID NO: 3849317 - DNA, 14 bp, Homo sapiens
taataaaaagccac

SEQ ID NO: 3849318 - DNA, 17 bp, Homo sapiens
taataaaatatcattca

SEQ ID NO: 3849319 - DNA, 13 bp, Homo sapiens
taatagaaagaaa

SEQ ID NO: 3849320 - DNA, 23 bp, Homo sapiens
taatagaaagaaattacttctag

SEQ ID NO: 3849321 - DNA, 18 bp, Homo sapiens
taatatattgtgttttaa

SEQ ID NO: 3849322 - DNA, 22 bp, Homo sapiens
taatatattgtgttttaacacc

SEQ ID NO: 3849323 - DNA, 24 bp, Homo sapiens
taatatggttttgttttcaatgaa

SEQ ID NO: 3849324 - DNA, 20 bp, Homo sapiens
taatattaaaaagaagtttc

SEQ ID NO: 3849325 - DNA, 16 bp, Homo sapiens
taatattcatacaaca

SEQ ID NO: 3849326 - DNA, 15 bp, Homo sapiens
taatatttattgctt

SEQ ID NO: 3849327 - DNA, 16 bp, Homo sapiens
taatatttattgcttt

SEQ ID NO: 3849328 - DNA, 20 bp, Homo sapiens
taatatttattgctttataa

SEQ ID NO: 3849329 - DNA, 15 bp, Homo sapiens
taatatttgaacaaa

SEQ ID NO: 3849330 - DNA, 18 bp, Homo sapiens
taatatttgaacaaaaat

SEQ ID NO: 3849331 - DNA, 20 bp, Homo sapiens
taatatttgaacaaaaattg

SEQ ID NO: 3849332 - DNA, 19 bp, Homo sapiens
taatatttgtctgtgtgct

SEQ ID NO: 3849333 - DNA, 15 bp, Homo sapiens
taatcattgcctggt

SEQ ID NO: 3849334 - DNA, 19 bp, Homo sapiens
taatcccttcctctcccat

SEQ ID NO: 3849335 - DNA, 14 bp, Homo sapiens
taatccttccaggc

SEQ ID NO: 3849336 - DNA, 15 bp, Homo sapiens
taatctttttgtttt

SEQ ID NO: 3849337 - DNA, 22 bp, Homo sapiens
taatgatggcccattctacttg

SEQ ID NO: 3849338 - DNA, 18 bp, Homo sapiens
taatgtatttttgtaaat

SEQ ID NO: 3849339 - DNA, 11 bp, Homo sapiens
taatgtcttta

SEQ ID NO: 3849340 - DNA, 14 bp, Homo sapiens
taattaattaacat

SEQ ID NO: 3849341 - DNA, 19 bp, Homo sapiens
taattcatttattaagtat

SEQ ID NO: 3849342 - DNA, 22 bp, Homo sapiens
taattctttctttttccttcat

SEQ ID NO: 3849343 - DNA, 21 bp, Homo sapiens
taatttattttaatgtaaata

SEQ ID NO: 3849344 - DNA, 21 bp, Homo sapiens
tacaaatttttacttgaagta

SEQ ID NO: 3849345 - DNA, 23 bp, Homo sapiens
tacaacatattgtttcagtgttc

SEQ ID NO: 3849346 - DNA, 14 bp, Homo sapiens
tacaatgatttgta

SEQ ID NO: 3849347 - DNA, 13 bp, Homo sapiens
tacacacacacac

SEQ ID NO: 3849348 - DNA, 16 bp, Homo sapiens
tacacacgtgcaattt

SEQ ID NO: 3849349 - DNA, 17 bp, Homo sapiens
tacaccacactaaaaca

SEQ ID NO: 3849350 - DNA, 22 bp, Homo sapiens
tacacctggctgaggttcctct

SEQ ID NO: 3849351 - DNA, 18 bp, Homo sapiens
tacagaattgtgtctgca

SEQ ID NO: 3849352 - DNA, 16 bp, Homo sapiens
tacagagtaacaaaaa

SEQ ID NO: 3849353 - DNA, 23 bp, Homo sapiens
tacagccctggaggccgctgctg

SEQ ID NO: 3849354 - DNA, 12 bp, Homo sapiens
tacagtttcaaa

SEQ ID NO: 3849355 - DNA, 13 bp, Homo sapiens
tacagtttcaaaa

SEQ ID NO: 3849356 - DNA, 20 bp, Homo sapiens
tacataaagttctctgtaat

SEQ ID NO: 3849357 - DNA, 23 bp, Homo sapiens
tacataaagttctctgtaattac

SEQ ID NO: 3849358 - DNA, 14 bp, Homo sapiens
tacatattacaaga

SEQ ID NO: 3849359 - DNA, 18 bp, Homo sapiens
tacattaacatttaggaa

SEQ ID NO: 3849360 - DNA, 18 bp, Homo sapiens
taccaggccgtttgcttt

SEQ ID NO: 3849361 - DNA, 21 bp, Homo sapiens
tacccaaggatttttaaaact

SEQ ID NO: 3849362 - DNA, 17 bp, Homo sapiens
tacctcactttggtttt

SEQ ID NO: 3849363 - DNA, 20 bp, Homo sapiens
tacctcactttggttttggg

SEQ ID NO: 3849364 - DNA, 13 bp, Homo sapiens
tacctcctcaggg

SEQ ID NO: 3849365 - DNA, 17 bp, Homo sapiens
tacctcctcagggatgg

SEQ ID NO: 3849366 - DNA, 23 bp, Homo sapiens
tacctcctcagggatggccgttg

SEQ ID NO: 3849367 - DNA, 12 bp, Homo sapiens
taccttccagtc

SEQ ID NO: 3849368 - DNA, 19 bp, Homo sapiens
tacctttgacaaaggtaaa

SEQ ID NO: 3849369 - DNA, 23 bp, Homo sapiens
tacgaattatttttttaaacttc

SEQ ID NO: 3849370 - DNA, 21 bp, Homo sapiens
tacgtcttgagaaatactata

SEQ ID NO: 3849371 - DNA, 13 bp, Homo sapiens
tactaacagatta

SEQ ID NO: 3849372 - DNA, 23 bp, Homo sapiens
tactaacagattataataaattg

SEQ ID NO: 3849373 - DNA, 18 bp, Homo sapiens
tactacacactgctcatt

SEQ ID NO: 3849374 - DNA, 17 bp, Homo sapiens
tactatatatacaatat

SEQ ID NO: 3849375 - DNA, 14 bp, Homo sapiens
tactctccttttat

SEQ ID NO: 3849376 - DNA, 20 bp, Homo sapiens
tactgaaggaaaaacacaag

SEQ ID NO: 3849377 - DNA, 23 bp, Homo sapiens
tactgaaggaaaaacacaagcaa

SEQ ID NO: 3849378 - DNA, 16 bp, Homo sapiens
tactgaatgttagaag

SEQ ID NO: 3849379 - DNA, 12 bp, Homo sapiens
tactgcagggcc

SEQ ID NO: 3849380 - DNA, 14 bp, Homo sapiens
tactgcattttcac

SEQ ID NO: 3849381 - DNA, 16 bp, Homo sapiens
tactgcattttcacaa

SEQ ID NO: 3849382 - DNA, 18 bp, Homo sapiens
tactgcccctgccctgag

SEQ ID NO: 3849383 - DNA, 19 bp, Homo sapiens
tactggtgagggcaagagg

SEQ ID NO: 3849384 - DNA, 13 bp, Homo sapiens
tactgtagatttc

SEQ ID NO: 3849385 - DNA, 15 bp, Homo sapiens
tactgtagatttcag

SEQ ID NO: 3849386 - DNA, 17 bp, Homo sapiens
tactgtagatttcagta

SEQ ID NO: 3849387 - DNA, 21 bp, Homo sapiens
tacttctgagggcatcttggt

SEQ ID NO: 3849388 - DNA, 14 bp, Homo sapiens
tacttgctctggac

SEQ ID NO: 3849389 - DNA, 18 bp, Homo sapiens
tacttgctctggacctgc

SEQ ID NO: 3849390 - DNA, 13 bp, Homo sapiens
tactttgaatgtt

SEQ ID NO: 3849391 - DNA, 15 bp, Homo sapiens
tactttgaatgttgt

SEQ ID NO: 3849392 - DNA, 15 bp, Homo sapiens
tactttttgtaaatg

SEQ ID NO: 3849393 - DNA, 16 bp, Homo sapiens
tactttttgtaaatgc

SEQ ID NO: 3849394 - DNA, 17 bp, Homo sapiens
tagaaaataatgcaaat

SEQ ID NO: 3849395 - DNA, 15 bp, Homo sapiens
tcctcactgctccct

SEQ ID NO: 3849396 - DNA, 17 bp, Homo sapiens
tcctcactgctccctga

SEQ ID NO: 3849397 - DNA, 13 bp, Homo sapiens
tcctcagcttggg

SEQ ID NO: 3849398 - DNA, 21 bp, Homo sapiens
tcctcccacccaacttcccct

SEQ ID NO: 3849399 - DNA, 19 bp, Homo sapiens
tcctcccacccctccccac

SEQ ID NO: 3849400 - DNA, 16 bp, Homo sapiens
tcctcccctcacagcc

SEQ ID NO: 3849401 - DNA, 17 bp, Homo sapiens
tcctcccctcacagcct

SEQ ID NO: 3849402 - DNA, 21 bp, Homo sapiens
tcctcccctcacagcctctga

SEQ ID NO: 3849403 - DNA, 22 bp, Homo sapiens
tcctcccttccttttccctgct

SEQ ID NO: 3849404 - DNA, 18 bp, Homo sapiens
tcctccggggctcagccc

SEQ ID NO: 3849405 - DNA, 19 bp, Homo sapiens
tcctccggggctcagccct

SEQ ID NO: 3849406 - DNA, 22 bp, Homo sapiens
tcctccggggctcagccctgag

SEQ ID NO: 3849407 - DNA, 16 bp, Homo sapiens
tcctcctagctggagt

SEQ ID NO: 3849408 - DNA, 15 bp, Homo sapiens
tcctcctgagagctg

SEQ ID NO: 3849409 - DNA, 16 bp, Homo sapiens
tcctctagaagccaag

SEQ ID NO: 3849410 - DNA, 19 bp, Homo sapiens
tcctctagaagccaaggga

SEQ ID NO: 3849411 - DNA, 11 bp, Homo sapiens
tcctctgcctg

SEQ ID NO: 3849412 - DNA, 22 bp, Homo sapiens
tcctctggacggcaggctcact

SEQ ID NO: 3849413 - DNA, 14 bp, Homo sapiens
tcctcttccagagt

SEQ ID NO: 3849414 - DNA, 18 bp, Homo sapiens
tcctgaagggtgctcagt

SEQ ID NO: 3849415 - DNA, 15 bp, Homo sapiens
tcctgacctcaggtg

SEQ ID NO: 3849416 - DNA, 15 bp, Homo sapiens
tcctgagagctgttc

SEQ ID NO: 3849417 - DNA, 19 bp, Homo sapiens
tcctgatgccatggaatga

SEQ ID NO: 3849418 - DNA, 21 bp, Homo sapiens
tcctgattcccgcatggtttt

SEQ ID NO: 3849419 - DNA, 14 bp, Homo sapiens
tcctgcagcttatt

SEQ ID NO: 3849420 - DNA, 18 bp, Homo sapiens
tcctgcctactgcccctg

SEQ ID NO: 3849421 - DNA, 14 bp, Homo sapiens
tcctgcctcagcct

SEQ ID NO: 3849422 - DNA, 19 bp, Homo sapiens
tcctgcctgcccccacacc

SEQ ID NO: 3849423 - DNA, 15 bp, Homo sapiens
tcctgcgtcctcctc

SEQ ID NO: 3849424 - DNA, 21 bp, Homo sapiens
tcctgctagcacctccccaga

SEQ ID NO: 3849425 - DNA, 22 bp, Homo sapiens
tcctgctagcacctccccagac

SEQ ID NO: 3849426 - DNA, 13 bp, Homo sapiens
tcctgctctgccc

SEQ ID NO: 3849427 - DNA, 19 bp, Homo sapiens
tcctgcttgaactgctgcc

SEQ ID NO: 3849428 - DNA, 20 bp, Homo sapiens
tcctgcttgaactgctgcca

SEQ ID NO: 3849429 - DNA, 21 bp, Homo sapiens
tcctgggaaggaagcttggct

SEQ ID NO: 3849430 - DNA, 22 bp, Homo sapiens
tcctgggcaccccaggcagctc

SEQ ID NO: 3849431 - DNA, 18 bp, Homo sapiens
tcctggggatggccaggt

SEQ ID NO: 3849432 - DNA, 23 bp, Homo sapiens
tcctggggatggccaggtacaac

SEQ ID NO: 3849433 - DNA, 22 bp, Homo sapiens
tcctggtattgtaatattaaaa

SEQ ID NO: 3849434 - DNA, 19 bp, Homo sapiens
tcctgtctaaagtgggaaa

SEQ ID NO: 3849435 - DNA, 13 bp, Homo sapiens
tccttagcctggg

SEQ ID NO: 3849436 - DNA, 21 bp, Homo sapiens
tccttagcctgggcctcctcc

SEQ ID NO: 3849437 - DNA, 15 bp, Homo sapiens
tccttagtatcagtc

SEQ ID NO: 3849438 - DNA, 16 bp, Homo sapiens
tccttcaccaaagatc

SEQ ID NO: 3849439 - DNA, 12 bp, Homo sapiens
tccttcataatt

SEQ ID NO: 3849440 - DNA, 12 bp, Homo sapiens
tccttccaggcc

SEQ ID NO: 3849441 - DNA, 15 bp, Homo sapiens
tccttgggaggaagc

SEQ ID NO: 3849442 - DNA, 16 bp, Homo sapiens
tccttgggaggaagca

SEQ ID NO: 3849443 - DNA, 18 bp, Homo sapiens
tccttgggatgaagaggg

SEQ ID NO: 3849444 - DNA, 23 bp, Homo sapiens
tccttgtataaggagctttgctc

SEQ ID NO: 3849445 - DNA, 20 bp, Homo sapiens
tcctttccccagcccagggt

SEQ ID NO: 3849446 - DNA, 13 bp, Homo sapiens
tcctttgcatttc

SEQ ID NO: 3849447 - DNA, 13 bp, Homo sapiens
tcgaactcgggag

SEQ ID NO: 3849448 - DNA, 21 bp, Homo sapiens
tcgaactcgggagggaacatc

SEQ ID NO: 3849449 - DNA, 13 bp, Homo sapiens
tcgcacctgcctc

SEQ ID NO: 3849450 - DNA, 15 bp, Homo sapiens
tcgccaaactgtctc

SEQ ID NO: 3849451 - DNA, 18 bp, Homo sapiens
tcgccagctgatgactca

SEQ ID NO: 3849452 - DNA, 19 bp, Homo sapiens
tcgccagctgatgactcaa

SEQ ID NO: 3849453 - DNA, 15 bp, Homo sapiens
tcgcttttggtgcct

SEQ ID NO: 3849454 - DNA, 15 bp, Homo sapiens
tcggagtgtggcctg

SEQ ID NO: 3849455 - DNA, 18 bp, Homo sapiens
tcggagtgtggcctggat

SEQ ID NO: 3849456 - DNA, 18 bp, Homo sapiens
tcggccacaccccagact

SEQ ID NO: 3849457 - DNA, 23 bp, Homo sapiens
tcgggagggaacatcctgctgca

SEQ ID NO: 3849458 - DNA, 15 bp, Homo sapiens
tcggggcctgtgccg

SEQ ID NO: 3849459 - DNA, 20 bp, Homo sapiens
tcgtgttgtgttctttataa

SEQ ID NO: 3849460 - DNA, 17 bp, Homo sapiens
tcgttaggacaaggctg

SEQ ID NO: 3849461 - DNA, 21 bp, Homo sapiens
tcgttcctatacatttctgtt

SEQ ID NO: 3849462 - DNA, 13 bp, Homo sapiens
tctaaaatcagag

SEQ ID NO: 3849463 - DNA, 15 bp, Homo sapiens
tctaaattctttcat

SEQ ID NO: 3849464 - DNA, 12 bp, Homo sapiens
tctaagagaagt

SEQ ID NO: 3849465 - DNA, 23 bp, Homo sapiens
tctaagatgaatccaaatgtgaa

SEQ ID NO: 3849466 - DNA, 15 bp, Homo sapiens
tctaagtctgttatt

SEQ ID NO: 3849467 - DNA, 22 bp, Homo sapiens
tctaatgatggcccattctact

SEQ ID NO: 3849468 - DNA, 17 bp, Homo sapiens
tctaccaccacaccaaa

SEQ ID NO: 3849469 - DNA, 18 bp, Homo sapiens
tctaccaccacaccaaat

SEQ ID NO: 3849470 - DNA, 21 bp, Homo sapiens
tctaccctgttgcaaaggaaa

SEQ ID NO: 3849471 - DNA, 16 bp, Homo sapiens
tctacttgctctggac

SEQ ID NO: 3849472 - DNA, 18 bp, Homo sapiens
tctacttgctctggacct

SEQ ID NO: 3849473 - DNA, 19 bp, Homo sapiens
tctacttgctctggacctg

SEQ ID NO: 3849474 - DNA, 22 bp, Homo sapiens
tctacttgctctggacctgccc

SEQ ID NO: 3849475 - DNA, 21 bp, Homo sapiens
tctagaaaataatgcaaatgt

SEQ ID NO: 3849476 - DNA, 17 bp, Homo sapiens
tctagaagccaagggaa

SEQ ID NO: 3849477 - DNA, 20 bp, Homo sapiens
tctagaagccaagggaaagg

SEQ ID NO: 3849478 - DNA, 18 bp, Homo sapiens
tctagaatacatattaca

SEQ ID NO: 3849479 - DNA, 15 bp, Homo sapiens
tctaggtaaattaca

SEQ ID NO: 3849480 - DNA, 12 bp, Homo sapiens
tctagttcagaa

SEQ ID NO: 3849481 - DNA, 17 bp, Homo sapiens
tctatagactgactttt

SEQ ID NO: 3849482 - DNA, 12 bp, Homo sapiens
tctatatacttt

SEQ ID NO: 3849483 - DNA, 13 bp, Homo sapiens
tctatatgtctat

SEQ ID NO: 3849484 - DNA, 17 bp, Homo sapiens
tctatgcaattgtacaa

SEQ ID NO: 3849485 - DNA, 20 bp, Homo sapiens
tctatgcaattgtacaaaaa

SEQ ID NO: 3849486 - DNA, 20 bp, Homo sapiens
tctatggctcatgtctgaaa

SEQ ID NO: 3849487 - DNA, 23 bp, Homo sapiens
tctatttgctatctgaactaatt

SEQ ID NO: 3849488 - DNA, 12 bp, Homo sapiens
tctcaaccttgt

SEQ ID NO: 3849489 - DNA, 19 bp, Homo sapiens
tctcagccttcattaggag

SEQ ID NO: 3849490 - DNA, 19 bp, Homo sapiens
tctcaggctggtgggaggg

SEQ ID NO: 3849491 - DNA, 15 bp, Homo sapiens
tctcatcccaataaa

SEQ ID NO: 3849492 - DNA, 16 bp, Homo sapiens
tctcatgaagccctta

SEQ ID NO: 3849493 - DNA, 22 bp, Homo sapiens
tctcatgaagcccttagggaga

SEQ ID NO: 3849494 - DNA, 21 bp, Homo sapiens
tctcatgtctctttggggaga

SEQ ID NO: 3849495 - DNA, 17 bp, Homo sapiens
tctccatcctttctgcc

SEQ ID NO: 3849496 - DNA, 19 bp, Homo sapiens
tctccatcctttctgcctc

SEQ ID NO: 3849497 - DNA, 17 bp, Homo sapiens
tctcccaggtaccagct

SEQ ID NO: 3849498 - DNA, 13 bp, Homo sapiens
tctccgccagcct

SEQ ID NO: 3849499 - DNA, 14 bp, Homo sapiens
tctccgccagcctc

SEQ ID NO: 3849500 - DNA, 11 bp, Homo sapiens
tctcctctgtc

SEQ ID NO: 3849501 - DNA, 19 bp, Homo sapiens
tctcctgagggtcctgctg

SEQ ID NO: 3849502 - DNA, 17 bp, Homo sapiens
tctcctgcctcagcctc

SEQ ID NO: 3849503 - DNA, 11 bp, Homo sapiens
tctcctttgta

SEQ ID NO: 3849504 - DNA, 22 bp, Homo sapiens
tctctaagatgaatccaaatgt

SEQ ID NO: 3849505 - DNA, 23 bp, Homo sapiens
tctctaagatgaatccaaatgtg

SEQ ID NO: 3849506 - DNA, 20 bp, Homo sapiens
tctctagaagtgccatctca

SEQ ID NO: 3849507 - DNA, 22 bp, Homo sapiens
tctctccagagctcctgagtgg

SEQ ID NO: 3849508 - DNA, 16 bp, Homo sapiens
tctctgagctctgcat

SEQ ID NO: 3849509 - DNA, 15 bp, Homo sapiens
tctctgtctccaggc

SEQ ID NO: 3849510 - DNA, 16 bp, Homo sapiens
tctctttccttcttgc

SEQ ID NO: 3849511 - DNA, 21 bp, Homo sapiens
tctgaactaattcatttatta

SEQ ID NO: 3849512 - DNA, 12 bp, Homo sapiens
tctgaaggattt

SEQ ID NO: 3849513 - DNA, 13 bp, Homo sapiens
tctgacccctcct

SEQ ID NO: 3849514 - DNA, 16 bp, Homo sapiens
tctgacccctcctcac

SEQ ID NO: 3849515 - DNA, 15 bp, Homo sapiens
tctgagcttcagtat

SEQ ID NO: 3849516 - DNA, 22 bp, Homo sapiens
tctgcaccccttctctcctccc

SEQ ID NO: 3849517 - DNA, 15 bp, Homo sapiens
tctgcatttgtctat

SEQ ID NO: 3849518 - DNA, 14 bp, Homo sapiens
tctgccaaaatgta

SEQ ID NO: 3849519 - DNA, 16 bp, Homo sapiens
tctgccccccaagttc

SEQ ID NO: 3849520 - DNA, 12 bp, Homo sapiens
tctgcctctcaa

SEQ ID NO: 3849521 - DNA, 12 bp, Homo sapiens
tctgcctgagct

SEQ ID NO: 3849522 - DNA, 21 bp, Homo sapiens
tctgcgagtagttccacacag

SEQ ID NO: 3849523 - DNA, 16 bp, Homo sapiens
tctgcggaccccagct

SEQ ID NO: 3849524 - DNA, 14 bp, Homo sapiens
tctgctcagccctg

SEQ ID NO: 3849525 - DNA, 13 bp, Homo sapiens
tctgctctcagct

SEQ ID NO: 3849526 - DNA, 16 bp, Homo sapiens
tctgctctcagcttgt

SEQ ID NO: 3849527 - DNA, 16 bp, Homo sapiens
tctgcttttctgccct

SEQ ID NO: 3849528 - DNA, 11 bp, Homo sapiens
tggaggggtgt

SEQ ID NO: 3849529 - DNA, 20 bp, Homo sapiens
tggaggtgggagcaggagat

SEQ ID NO: 3849530 - DNA, 15 bp, Homo sapiens
tggaggttgaagcca

SEQ ID NO: 3849531 - DNA, 20 bp, Homo sapiens
tggaggttgcagtgagctga

SEQ ID NO: 3849532 - DNA, 15 bp, Homo sapiens
tggagtgcagtggct

SEQ ID NO: 3849533 - DNA, 17 bp, Homo sapiens
tggagtgccatggctgg

SEQ ID NO: 3849534 - DNA, 14 bp, Homo sapiens
tggagtttcatgtt

SEQ ID NO: 3849535 - DNA, 19 bp, Homo sapiens
tggatcaaatccagcctgc

SEQ ID NO: 3849536 - DNA, 15 bp, Homo sapiens
tggatggagcccagg

SEQ ID NO: 3849537 - DNA, 17 bp, Homo sapiens
tggatgggaggctcctg

SEQ ID NO: 3849538 - DNA, 23 bp, Homo sapiens
tggattagacaggttaaatatat

SEQ ID NO: 3849539 - DNA, 23 bp, Homo sapiens
tggattttcctgaagctgcttaa

SEQ ID NO: 3849540 - DNA, 24 bp, Homo sapiens
tggcaaacgctaaagagcccttgc

SEQ ID NO: 3849541 - DNA, 17 bp, Homo sapiens
tggcaccattcagactt

SEQ ID NO: 3849542 - DNA, 20 bp, Homo sapiens
tggcacccaccgtggaggag

SEQ ID NO: 3849543 - DNA, 17 bp, Homo sapiens
tggcagagacagtgggc

SEQ ID NO: 3849544 - DNA, 18 bp, Homo sapiens
tggcagagacagtgggca

SEQ ID NO: 3849545 - DNA, 13 bp, Homo sapiens
tggcagcataaag

SEQ ID NO: 3849546 - DNA, 23 bp, Homo sapiens
tggcagtgagtgagcctggctct

SEQ ID NO: 3849547 - DNA, 20 bp, Homo sapiens
tggcagtgtgcggagctgat

SEQ ID NO: 3849548 - DNA, 19 bp, Homo sapiens
tggcatgaaccccaggctg

SEQ ID NO: 3849549 - DNA, 20 bp, Homo sapiens
tggcatgttttgtcattgtt

SEQ ID NO: 3849550 - DNA, 16 bp, Homo sapiens
tggccagaagtcaagc

SEQ ID NO: 3849551 - DNA, 15 bp, Homo sapiens
tggcccaggctggcc

SEQ ID NO: 3849552 - DNA, 20 bp, Homo sapiens
tggcccaggctggcccccac

SEQ ID NO: 3849553 - DNA, 16 bp, Homo sapiens
tggcccccacccacct

SEQ ID NO: 3849554 - DNA, 18 bp, Homo sapiens
tggcccccacccaccttc

SEQ ID NO: 3849555 - DNA, 19 bp, Homo sapiens
tggccctgtccctcccacc

SEQ ID NO: 3849556 - DNA, 20 bp, Homo sapiens
tggccctgtccctcccacct

SEQ ID NO: 3849557 - DNA, 17 bp, Homo sapiens
tggccggggctgaagcc

SEQ ID NO: 3849558 - DNA, 18 bp, Homo sapiens
tggccggggctgaagcca

SEQ ID NO: 3849559 - DNA, 21 bp, Homo sapiens
tggccggggctgaagccacac

SEQ ID NO: 3849560 - DNA, 11 bp, Homo sapiens
tggcctgctgt

SEQ ID NO: 3849561 - DNA, 12 bp, Homo sapiens
tggcctgctgtg

SEQ ID NO: 3849562 - DNA, 18 bp, Homo sapiens
tggcctggatccatcctg

SEQ ID NO: 3849563 - DNA, 19 bp, Homo sapiens
tggcctggatccatcctgc

SEQ ID NO: 3849564 - DNA, 20 bp, Homo sapiens
tggcctggatccatcctgct

SEQ ID NO: 3849565 - DNA, 24 bp, Homo sapiens
tggcctggatccatcctgctagca

SEQ ID NO: 3849566 - DNA, 14 bp, Homo sapiens
tggccttaagtctt

SEQ ID NO: 3849567 - DNA, 21 bp, Homo sapiens
tggccttaagtctttttgaag

SEQ ID NO: 3849568 - DNA, 17 bp, Homo sapiens
tggctaggggagcaggg

SEQ ID NO: 3849569 - DNA, 21 bp, Homo sapiens
tggctcacgcctgtaatccca

SEQ ID NO: 3849570 - DNA, 12 bp, Homo sapiens
tggctcagaaaa

SEQ ID NO: 3849571 - DNA, 21 bp, Homo sapiens
tggctcatgcctgtaatccca

SEQ ID NO: 3849572 - DNA, 18 bp, Homo sapiens
tggctcctgaagggtgct

SEQ ID NO: 3849573 - DNA, 20 bp, Homo sapiens
tggctcctggggatggccag

SEQ ID NO: 3849574 - DNA, 21 bp, Homo sapiens
tggctcctggggatggccagg

SEQ ID NO: 3849575 - DNA, 13 bp, Homo sapiens
tggctctggagac

SEQ ID NO: 3849576 - DNA, 20 bp, Homo sapiens
tggctgaggttcctctgcct

SEQ ID NO: 3849577 - DNA, 21 bp, Homo sapiens
tggctgaggttcctctgcctg

SEQ ID NO: 3849578 - DNA, 24 bp, Homo sapiens
tggctgaggttcctctgcctgccc

SEQ ID NO: 3849579 - DNA, 22 bp, Homo sapiens
tggctgcactcaagaccctcga

SEQ ID NO: 3849580 - DNA, 14 bp, Homo sapiens
tggctgccagctat

SEQ ID NO: 3849581 - DNA, 22 bp, Homo sapiens
tggctgccccatttatccacct

SEQ ID NO: 3849582 - DNA, 19 bp, Homo sapiens
tggctggggggtctcagca

SEQ ID NO: 3849583 - DNA, 19 bp, Homo sapiens
tggctttgtgctgctgagt

SEQ ID NO: 3849584 - DNA, 16 bp, Homo sapiens
tggcttttagacagat

SEQ ID NO: 3849585 - DNA, 22 bp, Homo sapiens
tgggaaggaagcttggctgctc

SEQ ID NO: 3849586 - DNA, 17 bp, Homo sapiens
tgggaatgaggtgggag

SEQ ID NO: 3849587 - DNA, 17 bp, Homo sapiens
tgggacctgccaggcag

SEQ ID NO: 3849588 - DNA, 17 bp, Homo sapiens
tgggagcaatctggaaa

SEQ ID NO: 3849589 - DNA, 21 bp, Homo sapiens
tgggagccaccactcctgcct

SEQ ID NO: 3849590 - DNA, 23 bp, Homo sapiens
tgggagccaccactcctgcctgc

SEQ ID NO: 3849591 - DNA, 15 bp, Homo sapiens
tgggaggaagcagaa

SEQ ID NO: 3849592 - DNA, 21 bp, Homo sapiens
tgggaggaagcagaataaagc

SEQ ID NO: 3849593 - DNA, 23 bp, Homo sapiens
tgggaggaagcagaataaagcaa

SEQ ID NO: 3849594 - DNA, 15 bp, Homo sapiens
tgggaggagggagag

SEQ ID NO: 3849595 - DNA, 19 bp, Homo sapiens
tgggaggagggagagggag

SEQ ID NO: 3849596 - DNA, 13 bp, Homo sapiens
tgggaggctcctg

SEQ ID NO: 3849597 - DNA, 15 bp, Homo sapiens
tgggagggaggggga

SEQ ID NO: 3849598 - DNA, 23 bp, Homo sapiens
tgggaggggcgcccacctcccca

SEQ ID NO: 3849599 - DNA, 17 bp, Homo sapiens
tgggaggttgaagcaga

SEQ ID NO: 3849600 - DNA, 13 bp, Homo sapiens
tgggatttgcaaa

SEQ ID NO: 3849601 - DNA, 16 bp, Homo sapiens
tgggcaccccaggcag

SEQ ID NO: 3849602 - DNA, 20 bp, Homo sapiens
tgggcaccccaggcagctcc

SEQ ID NO: 3849603 - DNA, 18 bp, Homo sapiens
tgggcccttcctggctag

SEQ ID NO: 3849604 - DNA, 19 bp, Homo sapiens
tgggcccttcctggctagg

SEQ ID NO: 3849605 - DNA, 21 bp, Homo sapiens
tgggcctcttggaaaaagtga

SEQ ID NO: 3849606 - DNA, 21 bp, Homo sapiens
tgggcgcagctgaagcctgga

SEQ ID NO: 3849607 - DNA, 22 bp, Homo sapiens
tgggcgcagctgaagcctggac

SEQ ID NO: 3849608 - DNA, 12 bp, Homo sapiens
tgggctctgtgc

SEQ ID NO: 3849609 - DNA, 17 bp, Homo sapiens
tgggctctgtgcagtca

SEQ ID NO: 3849610 - DNA, 20 bp, Homo sapiens
tgggctgacatcaagtgtaa

SEQ ID NO: 3849611 - DNA, 10 bp, Homo sapiens
tgggctgcct

SEQ ID NO: 3849612 - DNA, 22 bp, Homo sapiens
tgggctgggcccttcctggcta

SEQ ID NO: 3849613 - DNA, 19 bp, Homo sapiens
tgggcttggcctgctgtga

SEQ ID NO: 3849614 - DNA, 23 bp, Homo sapiens
tggggagctggcctaggtgggag

SEQ ID NO: 3849615 - DNA, 14 bp, Homo sapiens
tggggatggccagg

SEQ ID NO: 3849616 - DNA, 19 bp, Homo sapiens
tggggcaacgacggtttca

SEQ ID NO: 3849617 - DNA, 13 bp, Homo sapiens
tggggcagcctcc

SEQ ID NO: 3849618 - DNA, 14 bp, Homo sapiens
tggggcatttgtaa

SEQ ID NO: 3849619 - DNA, 18 bp, Homo sapiens
tggggcatttgtaaaaag

SEQ ID NO: 3849620 - DNA, 20 bp, Homo sapiens
tggggccgattgggagaaag

SEQ ID NO: 3849621 - DNA, 19 bp, Homo sapiens
tggggctcagccctgagct

SEQ ID NO: 3849622 - DNA, 15 bp, Homo sapiens
tgggggctaggggag

SEQ ID NO: 3849623 - DNA, 19 bp, Homo sapiens
tgggggtggaggcttcctg

SEQ ID NO: 3849624 - DNA, 22 bp, Homo sapiens
tggggtagggtgagaagggcag

SEQ ID NO: 3849625 - DNA, 17 bp, Homo sapiens
tggggtcagcaggccca

SEQ ID NO: 3849626 - DNA, 18 bp, Homo sapiens
tggggtcagcaggcccag

SEQ ID NO: 3849627 - DNA, 19 bp, Homo sapiens
tgggtaaatcagggacagg

SEQ ID NO: 3849628 - DNA, 19 bp, Homo sapiens
tgggtgagatgctggagaa

SEQ ID NO: 3849629 - DNA, 12 bp, Homo sapiens
tgggttgtttaa

SEQ ID NO: 3849630 - DNA, 18 bp, Homo sapiens
tgggtttgccaagccctt

SEQ ID NO: 3849631 - DNA, 21 bp, Homo sapiens
tgggtttgccaagccctttgc

SEQ ID NO: 3849632 - DNA, 19 bp, Homo sapiens
tgggttttgtccattatta

SEQ ID NO: 3849633 - DNA, 15 bp, Homo sapiens
tggtaagacctctga

SEQ ID NO: 3849634 - DNA, 13 bp, Homo sapiens
tggtattgtaata

SEQ ID NO: 3849635 - DNA, 14 bp, Homo sapiens
tggtattgtaatat

SEQ ID NO: 3849636 - DNA, 21 bp, Homo sapiens
tggtctagaatggatttttcc

SEQ ID NO: 3849637 - DNA, 19 bp, Homo sapiens
tggtctcatctcctttgct

SEQ ID NO: 3849638 - DNA, 18 bp, Homo sapiens
tggtcttgaactcctgac

SEQ ID NO: 3849639 - DNA, 15 bp, Homo sapiens
tggtgaaatctgctc

SEQ ID NO: 3849640 - DNA, 13 bp, Homo sapiens
tggtgacccctgc

SEQ ID NO: 3849641 - DNA, 14 bp, Homo sapiens
tggtgagggcaaga

SEQ ID NO: 3849642 - DNA, 17 bp, Homo sapiens
tggtgattcctgggaag

SEQ ID NO: 3849643 - DNA, 15 bp, Homo sapiens
tggtgcctgagaggc

SEQ ID NO: 3849644 - DNA, 18 bp, Homo sapiens
tggtgcctgagaggcagg

SEQ ID NO: 3849645 - DNA, 19 bp, Homo sapiens
tggtgcctgagaggcaggc

SEQ ID NO: 3849646 - DNA, 16 bp, Homo sapiens
tggtgctaatgtgtct

SEQ ID NO: 3849647 - DNA, 21 bp, Homo sapiens
tggtgggaggggcgcccacct

SEQ ID NO: 3849648 - DNA, 20 bp, Homo sapiens
tggtggggcccccagcaccc

SEQ ID NO: 3849649 - DNA, 21 bp, Homo sapiens
tggtggggcccccagcaccct

SEQ ID NO: 3849650 - DNA, 14 bp, Homo sapiens
tggtgtttatgtga

SEQ ID NO: 3849651 - DNA, 22 bp, Homo sapiens
tggtgtttatgtgaacattcct

SEQ ID NO: 3849652 - DNA, 19 bp, Homo sapiens
tggttcattttttttccct

SEQ ID NO: 3849653 - DNA, 15 bp, Homo sapiens
tggttctacaaattt

SEQ ID NO: 3849654 - DNA, 21 bp, Homo sapiens
tggttttatactatattaact

SEQ ID NO: 3849655 - DNA, 23 bp, Homo sapiens
tggttttgttttcaatgaattaa

SEQ ID NO: 3849656 - DNA, 12 bp, Homo sapiens
tgtaaactaaag

SEQ ID NO: 3849657 - DNA, 17 bp, Homo sapiens
tgtaaagtctagaaaat

SEQ ID NO: 3849658 - DNA, 17 bp, Homo sapiens
tgtaaatagtttaacac

SEQ ID NO: 3849659 - DNA, 18 bp, Homo sapiens
ttttgtgggcttaattga

SEQ ID NO: 3849660 - DNA, 15 bp, Homo sapiens
tttttaaaactcaga

SEQ ID NO: 3849661 - DNA, 18 bp, Homo sapiens
tttttaaaactcagattt

SEQ ID NO: 3849662 - DNA, 23 bp, Homo sapiens
tttttaaacttcagttttactgc

SEQ ID NO: 3849663 - DNA, 18 bp, Homo sapiens
tttttaaagacttttatg

SEQ ID NO: 3849664 - DNA, 15 bp, Homo sapiens
tttttaaatcattca

SEQ ID NO: 3849665 - DNA, 19 bp, Homo sapiens
tttttaaatgttcatgtca

SEQ ID NO: 3849666 - DNA, 21 bp, Homo sapiens
tttttacgtaaacctgaaata

SEQ ID NO: 3849667 - DNA, 22 bp, Homo sapiens
tttttcattagaagttaccaaa

SEQ ID NO: 3849668 - DNA, 15 bp, Homo sapiens
tttttccttcataat

SEQ ID NO: 3849669 - DNA, 19 bp, Homo sapiens
tttttcctttataattctt

SEQ ID NO: 3849670 - DNA, 16 bp, Homo sapiens
tttttcttctgtattt

SEQ ID NO: 3849671 - DNA, 21 bp, Homo sapiens
tttttgccactgatttagcca

SEQ ID NO: 3849672 - DNA, 21 bp, Homo sapiens
tttttggcattcctctaatgt

SEQ ID NO: 3849673 - DNA, 20 bp, Homo sapiens
tttttggctttagacactgg

SEQ ID NO: 3849674 - DNA, 20 bp, Homo sapiens
ttttttatacaggatgatga

SEQ ID NO: 3849675 - DNA, 12 bp, Homo sapiens
ttttttctaaga

SEQ ID NO: 3849676 - DNA, 15 bp, Homo sapiens
ttttttctaagagaa

SEQ ID NO: 3849677 - DNA, 13 bp, Homo sapiens
tttttttaaactt

SEQ ID NO: 3849678 - DNA, 12 bp, Homo sapiens
tttttttccctt

SEQ ID NO: 3849679 - DNA, 11 bp, Homo sapiens
tttttttgcat

SEQ ID NO: 3849680 - DNA, 17 bp, Homo sapiens
tgccagtcctcctcagg

SEQ ID NO: 3849681 - DNA, 21 bp, Homo sapiens
tgccagtcctcctcaggagaa

SEQ ID NO: 3849682 - DNA, 19 bp, Homo sapiens
tgcccgggacccccgtctc

SEQ ID NO: 3849683 - DNA, 14 bp, Homo sapiens
tgccctgaggctgt

SEQ ID NO: 3849684 - DNA, 16 bp, Homo sapiens
tgccggagggagccct

SEQ ID NO: 3849685 - DNA, 21 bp, Homo sapiens
tgcctacgttggtgcaagtgt

SEQ ID NO: 3849686 - DNA, 19 bp, Homo sapiens
tgcctcccagctagactgt

SEQ ID NO: 3849687 - DNA, 18 bp, Homo sapiens
tgcctgggtctccacatc

SEQ ID NO: 3849688 - DNA, 14 bp, Homo sapiens
tgctatggagagga

SEQ ID NO: 3849689 - DNA, 14 bp, Homo sapiens
tgctgtgtgtgccc

SEQ ID NO: 3849690 - DNA, 15 bp, Homo sapiens
tggacggagagcctt

SEQ ID NO: 3849691 - DNA, 17 bp, Homo sapiens
tggacggagagccttgg

SEQ ID NO: 3849692 - DNA, 16 bp, Homo sapiens
tggagaattggccaga

SEQ ID NO: 3849693 - DNA, 14 bp, Homo sapiens
tggcaggtcccctg

SEQ ID NO: 3849694 - DNA, 19 bp, Homo sapiens
tggcaggtcccctgccctg

SEQ ID NO: 3849695 - DNA, 17 bp, Homo sapiens
tggcccagcctcttaac

SEQ ID NO: 3849696 - DNA, 16 bp, Homo sapiens
tggccccccagcgcag

SEQ ID NO: 3849697 - DNA, 18 bp, Homo sapiens
tggccccgaggctgggac

SEQ ID NO: 3849698 - DNA, 13 bp, Homo sapiens
tgggaggccctgg

SEQ ID NO: 3849699 - DNA, 23 bp, Homo sapiens
tgggccatatgtgctatggagag

SEQ ID NO: 3849700 - DNA, 16 bp, Homo sapiens
tggggctggtcctggg

SEQ ID NO: 3849701 - DNA, 15 bp, Homo sapiens
tgggggcccctcagg

SEQ ID NO: 3849702 - DNA, 19 bp, Homo sapiens
tgggggcccctcaggtcag

SEQ ID NO: 3849703 - DNA, 19 bp, Homo sapiens
tgggtttggggctggcccc

SEQ ID NO: 3849704 - DNA, 21 bp, Homo sapiens
tggtgagggagaacctctcca

SEQ ID NO: 3849705 - DNA, 23 bp, Homo sapiens
tgtaagccctttggggacaaggg

SEQ ID NO: 3849706 - DNA, 13 bp, Homo sapiens
tgtatgaggagag

SEQ ID NO: 3849707 - DNA, 15 bp, Homo sapiens
tgtatgaggagagct

SEQ ID NO: 3849708 - DNA, 16 bp, Homo sapiens
tgtcctcacatgcaga

SEQ ID NO: 3849709 - DNA, 16 bp, Homo sapiens
tgtcctcctggcacct

SEQ ID NO: 3849710 - DNA, 16 bp, Homo sapiens
tgtgctatggagagga

SEQ ID NO: 3849711 - DNA, 14 bp, Homo sapiens
tgtgggtgccagtc

SEQ ID NO: 3849712 - DNA, 20 bp, Homo sapiens
tgtggtgagggagaacctct

SEQ ID NO: 3849713 - DNA, 15 bp, Homo sapiens
ttatttctgcttcct

SEQ ID NO: 3849714 - DNA, 22 bp, Homo sapiens
ttcacaagtgagccctcttgcc

SEQ ID NO: 3849715 - DNA, 10 bp, Homo sapiens
ttcctggcat

SEQ ID NO: 3849716 - DNA, 15 bp, Homo sapiens
ttctcccttctgctc

SEQ ID NO: 3849717 - DNA, 19 bp, Homo sapiens
ttctctgtctgcctctcca

SEQ ID NO: 3849718 - DNA, 21 bp, Homo sapiens
ttcttggatggcgttctccta

SEQ ID NO: 3849719 - DNA, 14 bp, Homo sapiens
ttggattgcatctc

SEQ ID NO: 3849720 - DNA, 21 bp, Homo sapiens
ttgtggatagagcagcctgct

SEQ ID NO: 3849721 - DNA, 23 bp, Homo sapiens
ctgtcctcctggcacctgagtgt

SEQ ID NO: 3849722 - DNA, 14 bp, Homo sapiens
ctgtcttgcagtgg

SEQ ID NO: 3849723 - DNA, 23 bp, Homo sapiens
ctgtgctgggtgccttgcatgca

SEQ ID NO: 3849724 - DNA, 14 bp, Homo sapiens
ctgtggtgagggag

SEQ ID NO: 3849725 - DNA, 21 bp, Homo sapiens
ctgtggtgagggagaacctct

SEQ ID NO: 3849726 - DNA, 13 bp, Homo sapiens
ctgtgtggccctg

SEQ ID NO: 3849727 - DNA, 15 bp, Homo sapiens
cttcaggccccagga

SEQ ID NO: 3849728 - DNA, 20 bp, Homo sapiens
cttcctcctaccacccagcc

SEQ ID NO: 3849729 - DNA, 13 bp, Homo sapiens
cttctccaggcag

SEQ ID NO: 3849730 - DNA, 14 bp, Homo sapiens
cttgcaccccttcc

SEQ ID NO: 3849731 - DNA, 16 bp, Homo sapiens
cttggcctcactacca

SEQ ID NO: 3849732 - DNA, 18 bp, Homo sapiens
cttggcgagggcagcagg

SEQ ID NO: 3849733 - DNA, 15 bp, Homo sapiens
ctttcctgtcttcct

SEQ ID NO: 3849734 - DNA, 13 bp, Homo sapiens
ctttgcacctgca

SEQ ID NO: 3849735 - DNA, 14 bp, Homo sapiens
ctttgcacctgcaa

SEQ ID NO: 3849736 - DNA, 14 bp, Homo sapiens
gaaactctggagag

SEQ ID NO: 3849737 - DNA, 14 bp, Homo sapiens
gaaagagggagcag

SEQ ID NO: 3849738 - DNA, 19 bp, Homo sapiens
gaaagagggagcaggtgcc

SEQ ID NO: 3849739 - DNA, 21 bp, Homo sapiens
gaaattggcagttcctggcat

SEQ ID NO: 3849740 - DNA, 21 bp, Homo sapiens
gaaggaccaggctggggccag

SEQ ID NO: 3849741 - DNA, 21 bp, Homo sapiens
gacaaatcctaggctcctggg

SEQ ID NO: 3849742 - DNA, 20 bp, Homo sapiens
gacactgtgtggccctggac

SEQ ID NO: 3849743 - DNA, 16 bp, Homo sapiens
gacagcggtcccaggg

SEQ ID NO: 3849744 - DNA, 17 bp, Homo sapiens
gacagcggtcccagggg

SEQ ID NO: 3849745 - DNA, 23 bp, Homo sapiens
gacagtcattgtggatagagcag

SEQ ID NO: 3849746 - DNA, 14 bp, Homo sapiens
gacatggcctctgg

SEQ ID NO: 3849747 - DNA, 15 bp, Homo sapiens
gaccagagaagggaa

SEQ ID NO: 3849748 - DNA, 15 bp, Homo sapiens
gactgagctggggag

SEQ ID NO: 3849749 - DNA, 20 bp, Homo sapiens
gacttatctgatcttcctca

SEQ ID NO: 3849750 - DNA, 14 bp, Homo sapiens
gacttctcacttcc

SEQ ID NO: 3849751 - DNA, 17 bp, Homo sapiens
gagaattggccagagcc

SEQ ID NO: 3849752 - DNA, 17 bp, Homo sapiens
gagacagcggtcccagg

SEQ ID NO: 3849753 - DNA, 22 bp, Homo sapiens
gagacagcggtcccaggggcct

SEQ ID NO: 3849754 - DNA, 21 bp, Homo sapiens
gagagccttggcgagggcagc

SEQ ID NO: 3849755 - DNA, 20 bp, Homo sapiens
gagagcttcaggccccagga

SEQ ID NO: 3849756 - DNA, 17 bp, Homo sapiens
gagcaggtgcccccagg

SEQ ID NO: 3849757 - DNA, 20 bp, Homo sapiens
gagcaggtgcccccaggtga

SEQ ID NO: 3849758 - DNA, 15 bp, Homo sapiens
gagccctcttgccca

SEQ ID NO: 3849759 - DNA, 16 bp, Homo sapiens
gagccctcttgcccag

SEQ ID NO: 3849760 - DNA, 14 bp, Homo sapiens
gagctatgagccca

SEQ ID NO: 3849761 - DNA, 18 bp, Homo sapiens
gagctgtcctcctggcac

SEQ ID NO: 3849762 - DNA, 20 bp, Homo sapiens
gagctgtcctcctggcacct

SEQ ID NO: 3849763 - DNA, 19 bp, Homo sapiens
gaggcaggtgggtggtaag

SEQ ID NO: 3849764 - DNA, 12 bp, Homo sapiens
gaggccctggca

SEQ ID NO: 3849765 - DNA, 13 bp, Homo sapiens
gaggccctggcag

SEQ ID NO: 3849766 - DNA, 23 bp, Homo sapiens
gaggctgccggagggagccctga

SEQ ID NO: 3849767 - DNA, 17 bp, Homo sapiens
gagggaaactctggaga

SEQ ID NO: 3849768 - DNA, 19 bp, Homo sapiens
gagggaaactctggagagc

SEQ ID NO: 3849769 - DNA, 21 bp, Homo sapiens
gagggaaactctggagagcct

SEQ ID NO: 3849770 - DNA, 19 bp, Homo sapiens
gagggagccctgagcctgg

SEQ ID NO: 3849771 - DNA, 20 bp, Homo sapiens
gaggggctgcagcagaggcc

SEQ ID NO: 3849772 - DNA, 16 bp, Homo sapiens
gagtagctgcttcctg

SEQ ID NO: 3849773 - DNA, 19 bp, Homo sapiens
gagtgtacagacccctgcc

SEQ ID NO: 3849774 - DNA, 20 bp, Homo sapiens
gagtgtacagacccctgcct

SEQ ID NO: 3849775 - DNA, 21 bp, Homo sapiens
gatgggtttggggctggcccc

SEQ ID NO: 3849776 - DNA, 16 bp, Homo sapiens
gcacccggtcagtcag

SEQ ID NO: 3849777 - DNA, 16 bp, Homo sapiens
gcaggaaagagggagc

SEQ ID NO: 3849778 - DNA, 14 bp, Homo sapiens
gcagggtagagagg

SEQ ID NO: 3849779 - DNA, 14 bp, Homo sapiens
gcagttcctggcat

SEQ ID NO: 3849780 - DNA, 16 bp, Homo sapiens
gcccaggccagtgctg

SEQ ID NO: 3849781 - DNA, 17 bp, Homo sapiens
gccctgagcctggcagg

SEQ ID NO: 3849782 - DNA, 19 bp, Homo sapiens
gccctgagcctggcaggtc

SEQ ID NO: 3849783 - DNA, 17 bp, Homo sapiens
gccgcaatctggctcct

SEQ ID NO: 3849784 - DNA, 22 bp, Homo sapiens
gccgcaatctggctcctcctgg

SEQ ID NO: 3849785 - DNA, 21 bp, Homo sapiens
gccggagggagccctgagcct

SEQ ID NO: 3849786 - DNA, 20 bp, Homo sapiens
gcctgaaaaggaaggaccag

SEQ ID NO: 3849787 - DNA, 19 bp, Homo sapiens
gcctggcaggtcccctgcc

SEQ ID NO: 3849788 - DNA, 17 bp, Homo sapiens
gcctgggtctccacatc

SEQ ID NO: 3849789 - DNA, 22 bp, Homo sapiens
gcctgggtctccacatccccag

SEQ ID NO: 3849790 - DNA, 21 bp, Homo sapiens
gctcagctgccttcctggggc

SEQ ID NO: 3849791 - DNA, 18 bp, Homo sapiens
gctcccctagacatggcc

SEQ ID NO: 3849792 - DNA, 18 bp, Homo sapiens
gctcctgggaggccctgg

SEQ ID NO: 3849793 - DNA, 21 bp, Homo sapiens
gctcctgggaggccctggcag

SEQ ID NO: 3849794 - DNA, 22 bp, Homo sapiens
gctcctgggaggccctggcaga

SEQ ID NO: 3849795 - DNA, 19 bp, Homo sapiens
gctctttcctgtcttcctt

SEQ ID NO: 3849796 - DNA, 21 bp, Homo sapiens
gctgccggagggagccctgag

SEQ ID NO: 3849797 - DNA, 16 bp, Homo sapiens
gctgccttcctggggc

SEQ ID NO: 3849798 - DNA, 19 bp, Homo sapiens
gctgccttcctggggctgg

SEQ ID NO: 3849799 - DNA, 16 bp, Homo sapiens
gctgggtgccttgcat

SEQ ID NO: 3849800 - DNA, 13 bp, Homo sapiens
gctgtcctcctgg

SEQ ID NO: 3849801 - DNA, 15 bp, Homo sapiens
gctgtcctcctggca

SEQ ID NO: 3849802 - DNA, 16 bp, Homo sapiens
gctgtcctcctggcac

SEQ ID NO: 3849803 - DNA, 15 bp, Homo sapiens
gctgtgagcagctag

SEQ ID NO: 3849804 - DNA, 15 bp, Homo sapiens
gcttcaggccccagg

SEQ ID NO: 3849805 - DNA, 19 bp, Homo sapiens
gcttctcctgcagtggatg

SEQ ID NO: 3849806 - DNA, 15 bp, Homo sapiens
ggaaactctggagag

SEQ ID NO: 3849807 - DNA, 22 bp, Homo sapiens
ggaaggaccaggctggggccag

SEQ ID NO: 3849808 - DNA, 23 bp, Homo sapiens
ggacaagccacagcccctgcctg

SEQ ID NO: 3849809 - DNA, 15 bp, Homo sapiens
ggaccaggctggggc

SEQ ID NO: 3849810 - DNA, 23 bp, Homo sapiens
ggacccgtggagaattggccaga

SEQ ID NO: 3849811 - DNA, 18 bp, Homo sapiens
ggagcaggtgcccccagg

SEQ ID NO: 3849812 - DNA, 15 bp, Homo sapiens
ggagccactgggagg

SEQ ID NO: 3849813 - DNA, 23 bp, Homo sapiens
ggagccactgggagggggacccg

SEQ ID NO: 3849814 - DNA, 23 bp, Homo sapiens
ggaggaggctgccggagggagcc

SEQ ID NO: 3849815 - DNA, 12 bp, Homo sapiens
ggaggccctggc

SEQ ID NO: 3849816 - DNA, 17 bp, Homo sapiens
ggcaggtgggtggtaag

SEQ ID NO: 3849817 - DNA, 20 bp, Homo sapiens
aaaaactaaatgtgaaatcc

SEQ ID NO: 3849818 - DNA, 13 bp, Homo sapiens
aaactctggagag

SEQ ID NO: 3849819 - DNA, 13 bp, Homo sapiens
aaagagggagcag

SEQ ID NO: 3849820 - DNA, 23 bp, Homo sapiens
aaagagggagcaggtgcccccag

SEQ ID NO: 3849821 - DNA, 13 bp, Homo sapiens
aaaggaaggacca

SEQ ID NO: 3849822 - DNA, 20 bp, Homo sapiens
aaatgtgaaatccctaccat

SEQ ID NO: 3849823 - DNA, 20 bp, Homo sapiens
aaccccgtgacaaaggtaga

SEQ ID NO: 3849824 - DNA, 12 bp, Homo sapiens
aactctggagag

SEQ ID NO: 3849825 - DNA, 13 bp, Homo sapiens
aactctggagagc

SEQ ID NO: 3849826 - DNA, 23 bp, Homo sapiens
aagagggagcaggtgcccccagg

SEQ ID NO: 3849827 - DNA, 12 bp, Homo sapiens
aaggaaggacca

SEQ ID NO: 3849828 - DNA, 23 bp, Homo sapiens
aaggagtctgatgctcaacatcc

SEQ ID NO: 3849829 - DNA, 13 bp, Homo sapiens
aaggctgccctgg

SEQ ID NO: 3849830 - DNA, 16 bp, Homo sapiens
aagtgtgcatggctgg

SEQ ID NO: 3849831 - DNA, 21 bp, Homo sapiens
aataaatgctcatttgccaat

SEQ ID NO: 3849832 - DNA, 15 bp, Homo sapiens
acaagatccaggcag

SEQ ID NO: 3849833 - DNA, 15 bp, Homo sapiens
acatggctgggcctt

SEQ ID NO: 3849834 - DNA, 14 bp, Homo sapiens
accccgtccctcct

SEQ ID NO: 3849835 - DNA, 17 bp, Homo sapiens
accctgaatgtgtgccc

SEQ ID NO: 3849836 - DNA, 15 bp, Homo sapiens
acctccagagctgtc

SEQ ID NO: 3849837 - DNA, 15 bp, Homo sapiens
acgcttgtgaggccc

SEQ ID NO: 3849838 - DNA, 19 bp, Homo sapiens
actaagtctctagcctctt

SEQ ID NO: 3849839 - DNA, 22 bp, Homo sapiens
actcagtttcacaagtgagccc

SEQ ID NO: 3849840 - DNA, 14 bp, Homo sapiens
actctggagagcct

SEQ ID NO: 3849841 - DNA, 17 bp, Homo sapiens
actctggagagcctgca

SEQ ID NO: 3849842 - DNA, 16 bp, Homo sapiens
actgagtggggagtgt

SEQ ID NO: 3849843 - DNA, 20 bp, Homo sapiens
actgtgggggcccctcaggt

SEQ ID NO: 3849844 - DNA, 23 bp, Homo sapiens
actgtgggggcccctcaggtcag

SEQ ID NO: 3849845 - DNA, 13 bp, Homo sapiens
agaattggccaga

SEQ ID NO: 3849846 - DNA, 22 bp, Homo sapiens
agacaaatcctaggctcctggg

SEQ ID NO: 3849847 - DNA, 14 bp, Homo sapiens
agacagacctccag

SEQ ID NO: 3849848 - DNA, 16 bp, Homo sapiens
agacagaggcagggca

SEQ ID NO: 3849849 - DNA, 18 bp, Homo sapiens
agacagcggtcccagggg

SEQ ID NO: 3849850 - DNA, 18 bp, Homo sapiens
agacatggcctctggaaa

SEQ ID NO: 3849851 - DNA, 17 bp, Homo sapiens
agactcattgctggagg

SEQ ID NO: 3849852 - DNA, 17 bp, Homo sapiens
agagctgtcctcctggc

SEQ ID NO: 3849853 - DNA, 19 bp, Homo sapiens
agagctgtcctcctggcac

SEQ ID NO: 3849854 - DNA, 18 bp, Homo sapiens
agagcttcaggccccagg

SEQ ID NO: 3849855 - DNA, 20 bp, Homo sapiens
agagggaaactctggagagc

SEQ ID NO: 3849856 - DNA, 23 bp, Homo sapiens
agcacacacctatggctggctgg

SEQ ID NO: 3849857 - DNA, 17 bp, Homo sapiens
agcacccggtcagtcag

SEQ ID NO: 3849858 - DNA, 19 bp, Homo sapiens
agcatggatgtgtctcagg

SEQ ID NO: 3849859 - DNA, 17 bp, Homo sapiens
agccctcttgcccagca

SEQ ID NO: 3849860 - DNA, 17 bp, Homo sapiens
agccctgagcctggcag

SEQ ID NO: 3849861 - DNA, 23 bp, Homo sapiens
agccctttggggacaagggctgc

SEQ ID NO: 3849862 - DNA, 17 bp, Homo sapiens
agcctgctgctctcagg

SEQ ID NO: 3849863 - DNA, 14 bp, Homo sapiens
agcggtcccagggg

SEQ ID NO: 3849864 - DNA, 14 bp, Homo sapiens
agctatgagcccag

SEQ ID NO: 3849865 - DNA, 16 bp, Homo sapiens
agctatgagcccagca

SEQ ID NO: 3849866 - DNA, 15 bp, Homo sapiens
agctgtcctcctggc

SEQ ID NO: 3849867 - DNA, 17 bp, Homo sapiens
agcttcaggccccagga

SEQ ID NO: 3849868 - DNA, 21 bp, Homo sapiens
agcttccccttatcgtcccct

SEQ ID NO: 3849869 - DNA, 23 bp, Homo sapiens
aggagagcttcaggccccaggac

SEQ ID NO: 3849870 - DNA, 21 bp, Homo sapiens
aggaggggctgcagcagaggc

SEQ ID NO: 3849871 - DNA, 23 bp, Homo sapiens
aggaggggctgcagcagaggcct

SEQ ID NO: 3849872 - DNA, 17 bp, Homo sapiens
aggagtggcaggaaaga

SEQ ID NO: 3849873 - DNA, 17 bp, Homo sapiens
aggccagtgctgtgagc

SEQ ID NO: 3849874 - DNA, 19 bp, Homo sapiens
aggccagtgctgtgagcag

SEQ ID NO: 3849875 - DNA, 13 bp, Homo sapiens
aggccctggcaga

SEQ ID NO: 3849876 - DNA, 15 bp, Homo sapiens
aggcggggaggaggc

SEQ ID NO: 3849877 - DNA, 21 bp, Homo sapiens
aggctcctgggaggccctggc

SEQ ID NO: 3849878 - DNA, 22 bp, Homo sapiens
aggctcctgggaggccctggca

SEQ ID NO: 3849879 - DNA, 16 bp, Homo sapiens
aggctgccggagggag

SEQ ID NO: 3849880 - DNA, 17 bp, Homo sapiens
aggctgccggagggagc

SEQ ID NO: 3849881 - DNA, 22 bp, Homo sapiens
aggctgccggagggagccctga

SEQ ID NO: 3849882 - DNA, 12 bp, Homo sapiens
aggctgggacac

SEQ ID NO: 3849883 - DNA, 16 bp, Homo sapiens
aggctggggccagggg

SEQ ID NO: 3849884 - DNA, 16 bp, Homo sapiens
agggaaactctggaga

SEQ ID NO: 3849885 - DNA, 19 bp, Homo sapiens
agggaaactctggagagcc

SEQ ID NO: 3849886 - DNA, 12 bp, Homo sapiens
agggaactggga

SEQ ID NO: 3849887 - DNA, 20 bp, Homo sapiens
agggagcaggtgcccccagg

SEQ ID NO: 3849888 - DNA, 16 bp, Homo sapiens
agggagccctgagcct

SEQ ID NO: 3849889 - DNA, 14 bp, Homo sapiens
agggcagcagggta

SEQ ID NO: 3849890 - DNA, 14 bp, Homo sapiens
agggcagcatggag

SEQ ID NO: 3849891 - DNA, 15 bp, Homo sapiens
agggcagcatggaga

SEQ ID NO: 3849892 - DNA, 19 bp, Homo sapiens
aggggactgagctggggag

SEQ ID NO: 3849893 - DNA, 17 bp, Homo sapiens
aggtactgagtggggag

SEQ ID NO: 3849894 - DNA, 19 bp, Homo sapiens
aggtcccctgccctgaggc

SEQ ID NO: 3849895 - DNA, 14 bp, Homo sapiens
aggtgcccccaggt

SEQ ID NO: 3849896 - DNA, 21 bp, Homo sapiens
aggttcaaaggcagcaaggca

SEQ ID NO: 3849897 - DNA, 15 bp, Homo sapiens
aggttctgagctgtc

SEQ ID NO: 3849898 - DNA, 19 bp, Homo sapiens
agtgagccctcttgcccag

SEQ ID NO: 3849899 - DNA, 19 bp, Homo sapiens
agtttcacaagtgagccct

SEQ ID NO: 3849900 - DNA, 17 bp, Homo sapiens
ataaatccgcttctcct

SEQ ID NO: 3849901 - DNA, 21 bp, Homo sapiens
atagagcagcctgctgctctc

SEQ ID NO: 3849902 - DNA, 17 bp, Homo sapiens
atatgtgctatggagag

SEQ ID NO: 3849903 - DNA, 18 bp, Homo sapiens
atccaggcagaaggagat

SEQ ID NO: 3849904 - DNA, 21 bp, Homo sapiens
atccatcacccatctcactct

SEQ ID NO: 3849905 - DNA, 15 bp, Homo sapiens
atccgcttctcctgc

SEQ ID NO: 3849906 - DNA, 17 bp, Homo sapiens
atccgcttctcctgcag

SEQ ID NO: 3849907 - DNA, 21 bp, Homo sapiens
atccgcttctcctgcagtgga

SEQ ID NO: 3849908 - DNA, 11 bp, Homo sapiens
atcctggccca

SEQ ID NO: 3849909 - DNA, 17 bp, Homo sapiens
atcctggcccagcctct

SEQ ID NO: 3849910 - DNA, 19 bp, Homo sapiens
atgacttctccaggcagag

SEQ ID NO: 3849911 - DNA, 16 bp, Homo sapiens
atgtgctatggagagg

SEQ ID NO: 3849912 - DNA, 14 bp, Homo sapiens
attggccagagcct

SEQ ID NO: 3849913 - DNA, 14 bp, Homo sapiens
atttctgcttcctg

SEQ ID NO: 3849914 - DNA, 19 bp, Homo sapiens
caaatcctaggctcctggg

SEQ ID NO: 3849915 - DNA, 19 bp, Homo sapiens
caataaatccgcttctcct

SEQ ID NO: 3849916 - DNA, 16 bp, Homo sapiens
cacaagatccaggcag

SEQ ID NO: 3849917 - DNA, 12 bp, Homo sapiens
cacaagtgagcc

SEQ ID NO: 3849918 - DNA, 19 bp, Homo sapiens
cacacctatggctggctgg

SEQ ID NO: 3849919 - DNA, 20 bp, Homo sapiens
cacccatctcactctcccca

SEQ ID NO: 3849920 - DNA, 19 bp, Homo sapiens
caccccaacaaactcctct

SEQ ID NO: 3849921 - DNA, 18 bp, Homo sapiens
caccccgtccctcctctc

SEQ ID NO: 3849922 - DNA, 20 bp, Homo sapiens
cacctgcagcgctgggcccc

SEQ ID NO: 3849923 - DNA, 12 bp, Homo sapiens
cactcaataaat

SEQ ID NO: 3849924 - DNA, 13 bp, Homo sapiens
cactgagctgggt

SEQ ID NO: 3849925 - DNA, 14 bp, Homo sapiens
cactgtcttgcagt

SEQ ID NO: 3849926 - DNA, 16 bp, Homo sapiens
cactgtgcaccaggca

SEQ ID NO: 3849927 - DNA, 22 bp, Homo sapiens
cactgtgtggccctggacaagc

SEQ ID NO: 3849928 - DNA, 13 bp, Homo sapiens
cactttgagaggg

SEQ ID NO: 3849929 - DNA, 21 bp, Homo sapiens
cagacctccaggtccctaagc

SEQ ID NO: 3849930 - DNA, 18 bp, Homo sapiens
cagagctgtcctcctggc

SEQ ID NO: 3849931 - DNA, 15 bp, Homo sapiens
cagaggcagggcagc

SEQ ID NO: 3849932 - DNA, 18 bp, Homo sapiens
ctatgagcccagcatgga

SEQ ID NO: 3849933 - DNA, 14 bp, Homo sapiens
ctcacactgcacca

SEQ ID NO: 3849934 - DNA, 14 bp, Homo sapiens
ctcacatgcagagt

SEQ ID NO: 3849935 - DNA, 19 bp, Homo sapiens
ctcagtttcacaagtgagc

SEQ ID NO: 3849936 - DNA, 14 bp, Homo sapiens
ctcctctcccgcag

SEQ ID NO: 3849937 - DNA, 14 bp, Homo sapiens
ctcctggcacctga

SEQ ID NO: 3849938 - DNA, 19 bp, Homo sapiens
ctcctgggaggccctggca

SEQ ID NO: 3849939 - DNA, 23 bp, Homo sapiens
ctcctgggaggccctggcagaag

SEQ ID NO: 3849940 - DNA, 21 bp, Homo sapiens
ctccttccctctccagcctgc

SEQ ID NO: 3849941 - DNA, 19 bp, Homo sapiens
ctctctgtggcctccatgc

SEQ ID NO: 3849942 - DNA, 10 bp, Homo sapiens
ctctggagag

SEQ ID NO: 3849943 - DNA, 13 bp, Homo sapiens
ctctgtctgcctc

SEQ ID NO: 3849944 - DNA, 20 bp, Homo sapiens
ctctttctcccttctgctcc

SEQ ID NO: 3849945 - DNA, 23 bp, Homo sapiens
ctgagacaaatcctaggctcctg

SEQ ID NO: 3849946 - DNA, 14 bp, Homo sapiens
ctgagctggggagg

SEQ ID NO: 3849947 - DNA, 15 bp, Homo sapiens
ctgaggctgtgagca

SEQ ID NO: 3849948 - DNA, 13 bp, Homo sapiens
ctgcagcagaggc

SEQ ID NO: 3849949 - DNA, 21 bp, Homo sapiens
ctgccggagggagccctgagc

SEQ ID NO: 3849950 - DNA, 14 bp, Homo sapiens
ctgctgctctcagg

SEQ ID NO: 3849951 - DNA, 12 bp, Homo sapiens
ctgctgtgctgg

SEQ ID NO: 3849952 - DNA, 11 bp, Homo sapiens
ctggagagcct

SEQ ID NO: 3849953 - DNA, 16 bp, Homo sapiens
ctggctcctcctggaa

SEQ ID NO: 3849954 - DNA, 17 bp, Homo sapiens
ctggctcctcctggaaa

SEQ ID NO: 3849955 - DNA, 14 bp, Homo sapiens
ctgggaggccctgg

SEQ ID NO: 3849956 - DNA, 16 bp, Homo sapiens
ctgggagggggacccg

SEQ ID NO: 3849957 - DNA, 14 bp, Homo sapiens
ctggggctggtcct

SEQ ID NO: 3849958 - DNA, 15 bp, Homo sapiens
ctggggctggtcctg

SEQ ID NO: 3849959 - DNA, 22 bp, Homo sapiens
ctgtatctatctcacactgcac

SEQ ID NO: 3849960 - DNA, 14 bp, Homo sapiens
ctgtcctcctggca

SEQ ID NO: 3849961 - DNA, 15 bp, Homo sapiens
ctgtcctcctggcac

SEQ ID NO: 3849962 - DNA, 16 bp, Homo sapiens
ctgtcttgcagtggac

SEQ ID NO: 3849963 - DNA, 19 bp, Homo sapiens
ctgtgggggcccctcaggt

SEQ ID NO: 3849964 - DNA, 19 bp, Homo sapiens
ctgtgtggccctggacaag

SEQ ID NO: 3849965 - DNA, 12 bp, Homo sapiens
ctgttccttctc

SEQ ID NO: 3849966 - DNA, 18 bp, Homo sapiens
cttatctgatcttcctca

SEQ ID NO: 3849967 - DNA, 16 bp, Homo sapiens
cttctccaggcagagg

SEQ ID NO: 3849968 - DNA, 12 bp, Homo sapiens
cttctcctgcag

SEQ ID NO: 3849969 - DNA, 13 bp, Homo sapiens
cttctcctgcagt

SEQ ID NO: 3849970 - DNA, 22 bp, Homo sapiens
cttgcagtggacggagagcctt

SEQ ID NO: 3849971 - DNA, 22 bp, Homo sapiens
cttgtgaggcccgaggcagaag

SEQ ID NO: 3849972 - DNA, 23 bp, Homo sapiens
cttgtgaggcccgaggcagaagg

SEQ ID NO: 3849973 - DNA, 16 bp, Homo sapiens
cttttctcccacctcc

SEQ ID NO: 3849974 - DNA, 21 bp, Homo sapiens
ctttttggattgcatctcccc

SEQ ID NO: 3849975 - DNA, 21 bp, Homo sapiens
gaaaatttcccccacctgcag

SEQ ID NO: 3849976 - DNA, 12 bp, Homo sapiens
gaaactctggag

SEQ ID NO: 3849977 - DNA, 19 bp, Homo sapiens
gaaactctggagagcctgc

SEQ ID NO: 3849978 - DNA, 20 bp, Homo sapiens
gaaactctggagagcctgca

SEQ ID NO: 3849979 - DNA, 14 bp, Homo sapiens
gaagctcagctgcc

SEQ ID NO: 3849980 - DNA, 19 bp, Homo sapiens
gaaggaccaggctggggcc

SEQ ID NO: 3849981 - DNA, 14 bp, Homo sapiens
gaaggaggccactt

SEQ ID NO: 3849982 - DNA, 19 bp, Homo sapiens
gaaggaggccactttgaga

SEQ ID NO: 3849983 - DNA, 16 bp, Homo sapiens
gacagaggcagggcag

SEQ ID NO: 3849984 - DNA, 14 bp, Homo sapiens
gaccaggctggggc

SEQ ID NO: 3849985 - DNA, 15 bp, Homo sapiens
gaccaggctggggcc

SEQ ID NO: 3849986 - DNA, 21 bp, Homo sapiens
gaccaggctggggccagggga

SEQ ID NO: 3849987 - DNA, 14 bp, Homo sapiens
gacccctgccttgg

SEQ ID NO: 3849988 - DNA, 20 bp, Homo sapiens
gacgtgcgcgcccaggccag

SEQ ID NO: 3849989 - DNA, 16 bp, Homo sapiens
gactgagctggggagg

SEQ ID NO: 3849990 - DNA, 15 bp, Homo sapiens
gacttctccaggcag

SEQ ID NO: 3849991 - DNA, 13 bp, Homo sapiens
gagaacagctccc

SEQ ID NO: 3849992 - DNA, 22 bp, Homo sapiens
gagaaggttctgagctgtccca

SEQ ID NO: 3849993 - DNA, 22 bp, Homo sapiens
gagacaaatcctaggctcctgg

SEQ ID NO: 3849994 - DNA, 19 bp, Homo sapiens
gagagcttcaggccccagg

SEQ ID NO: 3849995 - DNA, 13 bp, Homo sapiens
gagagtcctggga

SEQ ID NO: 3849996 - DNA, 14 bp, Homo sapiens
gagagtcctgggag

SEQ ID NO: 3849997 - DNA, 16 bp, Homo sapiens
gagagtcctgggagcc

SEQ ID NO: 3849998 - DNA, 21 bp, Homo sapiens
gagcccacaagatccaggcag

SEQ ID NO: 3849999 - DNA, 18 bp, Homo sapiens
gagccctgagcctggcag

SEQ ID NO: 3850000 - DNA, 13 bp, Homo sapiens
gagccttggcgag

SEQ ID NO: 3850001 - DNA, 17 bp, Homo sapiens
gagctatgagcccagca

SEQ ID NO: 3850002 - DNA, 22 bp, Homo sapiens
gagctgtcctcctggcacctga

SEQ ID NO: 3850003 - DNA, 18 bp, Homo sapiens
gagcttcaggccccagga

SEQ ID NO: 3850004 - DNA, 23 bp, Homo sapiens
gaggcagggcagcatggagacag

SEQ ID NO: 3850005 - DNA, 15 bp, Homo sapiens
gaggccactttgaga

SEQ ID NO: 3850006 - DNA, 15 bp, Homo sapiens
gaggccctggcagaa

SEQ ID NO: 3850007 - DNA, 14 bp, Homo sapiens
gaggctgtgagcag

SEQ ID NO: 3850008 - DNA, 22 bp, Homo sapiens
gagggagcaggtgcccccaggt

SEQ ID NO: 3850009 - DNA, 21 bp, Homo sapiens
gagggagccctgagcctggca

SEQ ID NO: 3850010 - DNA, 22 bp, Homo sapiens
gaggtccaaaaaaggctgccct

SEQ ID NO: 3850011 - DNA, 15 bp, Homo sapiens
gagtcctgggagccc

SEQ ID NO: 3850012 - DNA, 15 bp, Homo sapiens
gagtggcaggaaaga

SEQ ID NO: 3850013 - DNA, 15 bp, Homo sapiens
gatagagcagcctgc

SEQ ID NO: 3850014 - DNA, 16 bp, Homo sapiens
gatagagcagcctgct

SEQ ID NO: 3850015 - DNA, 16 bp, Homo sapiens
gatcccctgcttctgg

SEQ ID NO: 3850016 - DNA, 18 bp, Homo sapiens
gatctgagtctagaaccc

SEQ ID NO: 3850017 - DNA, 18 bp, Homo sapiens
gatggccaaagcaaagga

SEQ ID NO: 3850018 - DNA, 14 bp, Homo sapiens
gattccaagtgatg

SEQ ID NO: 3850019 - DNA, 20 bp, Homo sapiens
gatttcctttctgtggtgag

SEQ ID NO: 3850020 - DNA, 18 bp, Homo sapiens
gcaatctggctcctcctg

SEQ ID NO: 3850021 - DNA, 20 bp, Homo sapiens
gcaatctggctcctcctgga

SEQ ID NO: 3850022 - DNA, 21 bp, Homo sapiens
gcaatctggctcctcctggaa

SEQ ID NO: 3850023 - DNA, 14 bp, Homo sapiens
gcaccccttcctcc

SEQ ID NO: 3850024 - DNA, 16 bp, Homo sapiens
gcagaggcctgaggag

SEQ ID NO: 3850025 - DNA, 15 bp, Homo sapiens
gcagagtagctgctt

SEQ ID NO: 3850026 - DNA, 17 bp, Homo sapiens
gcagagtagctgcttcc

SEQ ID NO: 3850027 - DNA, 19 bp, Homo sapiens
gcaggtgcccccaggtgag

SEQ ID NO: 3850028 - DNA, 16 bp, Homo sapiens
gcagtggacggagagc

SEQ ID NO: 3850029 - DNA, 17 bp, Homo sapiens
gcagtggacggagagcc

SEQ ID NO: 3850030 - DNA, 19 bp, Homo sapiens
gcatgtaaagatgctgtgt

SEQ ID NO: 3850031 - DNA, 22 bp, Homo sapiens
gccagaacacatggctgggcct

SEQ ID NO: 3850032 - DNA, 16 bp, Homo sapiens
gccagtcctcctcagg

SEQ ID NO: 3850033 - DNA, 22 bp, Homo sapiens
gcccaacccactgtcttgcagt

SEQ ID NO: 3850034 - DNA, 14 bp, Homo sapiens
gccccccagcgcag

SEQ ID NO: 3850035 - DNA, 17 bp, Homo sapiens
gccccgaggctgggaca

SEQ ID NO: 3850036 - DNA, 22 bp, Homo sapiens
gccccgaggctgggacactgtg

SEQ ID NO: 3850037 - DNA, 23 bp, Homo sapiens
gcccctgcctgggtctccacatc

SEQ ID NO: 3850038 - DNA, 15 bp, Homo sapiens
gccctgagcctggca

SEQ ID NO: 3850039 - DNA, 19 bp, Homo sapiens
gccctttaagagcacccgg

SEQ ID NO: 3850040 - DNA, 16 bp, Homo sapiens
gccgcaatctggctcc

SEQ ID NO: 3850041 - DNA, 17 bp, Homo sapiens
gcctacgttggtgcaag

SEQ ID NO: 3850042 - DNA, 15 bp, Homo sapiens
gcctcactaccagaa

SEQ ID NO: 3850043 - DNA, 21 bp, Homo sapiens
gcctgaaaaggaaggaccagg

SEQ ID NO: 3850044 - DNA, 22 bp, Homo sapiens
gcctgcacccaggtactgagtg

SEQ ID NO: 3850045 - DNA, 12 bp, Homo sapiens
gcctgtggcccc

SEQ ID NO: 3850046 - DNA, 22 bp, Homo sapiens
gcctttccagcccaacccactg

SEQ ID NO: 3850047 - DNA, 22 bp, Homo sapiens
gcgcagagtagctgcttcctgg

SEQ ID NO: 3850048 - DNA, 23 bp, Homo sapiens
gcgcagagtagctgcttcctgga

SEQ ID NO: 3850049 - DNA, 18 bp, Homo sapiens
gcgcccaggccagtgctg

SEQ ID NO: 3850050 - DNA, 22 bp, Homo sapiens
gcgcccaggccagtgctgtgag

SEQ ID NO: 3850051 - DNA, 15 bp, Homo sapiens
gcggggaggaggctg

SEQ ID NO: 3850052 - DNA, 16 bp, Homo sapiens
gctagtgacagccact

SEQ ID NO: 3850053 - DNA, 13 bp, Homo sapiens
gctatggagagga

SEQ ID NO: 3850054 - DNA, 14 bp, Homo sapiens
gctcactgagctgg

SEQ ID NO: 3850055 - DNA, 18 bp, Homo sapiens
gctcctaccactggacag

SEQ ID NO: 3850056 - DNA, 19 bp, Homo sapiens
gctcctgggaggccctggc

SEQ ID NO: 3850057 - DNA, 21 bp, Homo sapiens
gctctctgtggcctccatgcc

SEQ ID NO: 3850058 - DNA, 15 bp, Homo sapiens
gctgccggagggagc

SEQ ID NO: 3850059 - DNA, 14 bp, Homo sapiens
gctgcttcctggac

SEQ ID NO: 3850060 - DNA, 11 bp, Homo sapiens
gctggccccat

SEQ ID NO: 3850061 - DNA, 21 bp, Homo sapiens
gctgggcctttccagcccaac

SEQ ID NO: 3850062 - DNA, 14 bp, Homo sapiens
gctgtatgaggaga

SEQ ID NO: 3850063 - DNA, 22 bp, Homo sapiens
gcttcctggacgtgcgcgccca

SEQ ID NO: 3850064 - DNA, 14 bp, Homo sapiens
gcttcctgggggaa

SEQ ID NO: 3850065 - DNA, 12 bp, Homo sapiens
gcttctcctgca

SEQ ID NO: 3850066 - DNA, 13 bp, Homo sapiens
gcttctcctgcag

SEQ ID NO: 3850067 - DNA, 14 bp, Homo sapiens
ggaaattggcagtt

SEQ ID NO: 3850068 - DNA, 14 bp, Homo sapiens
ggaatctctgttcc

SEQ ID NO: 3850069 - DNA, 13 bp, Homo sapiens
ggaccagagaagg

SEQ ID NO: 3850070 - DNA, 19 bp, Homo sapiens
ggagaattggccagagcct

SEQ ID NO: 3850071 - DNA, 23 bp, Homo sapiens
ggagagccttggcgagggcagca

SEQ ID NO: 3850072 - DNA, 19 bp, Homo sapiens
ggagagcttcaggccccag

SEQ ID NO: 3850073 - DNA, 12 bp, Homo sapiens
ggagagtcctgg

SEQ ID NO: 3850074 - DNA, 13 bp, Homo sapiens
ggagccactggga

SEQ ID NO: 3850075 - DNA, 15 bp, Homo sapiens
ggagccctgagcctg

SEQ ID NO: 3850076 - DNA, 19 bp, Homo sapiens
ggagccctgagcctggcag

SEQ ID NO: 3850077 - DNA, 20 bp, Homo sapiens
ggagggaaattggcagttcc

SEQ ID NO: 3850078 - DNA, 14 bp, Homo sapiens
ggagggagccctga

SEQ ID NO: 3850079 - DNA, 20 bp, Homo sapiens
ggagggagccctgagcctgg

SEQ ID NO: 3850080 - DNA, 17 bp, Homo sapiens
ggatagagcagcctgct

SEQ ID NO: 3850081 - DNA, 18 bp, Homo sapiens
ggcagcaaggcagtgagc

SEQ ID NO: 3850082 - DNA, 14 bp, Homo sapiens
ggcagcatggagac

SEQ ID NO: 3850083 - DNA, 12 bp, Homo sapiens
ggcagttcctgg

SEQ ID NO: 3850084 - DNA, 14 bp, Homo sapiens
ggccctggacaagc

SEQ ID NO: 3850085 - DNA, 20 bp, Homo sapiens
ggctcctgggaggccctggc

SEQ ID NO: 3850086 - DNA, 14 bp, Homo sapiens
ggctgccggaggga

SEQ ID NO: 3850087 - DNA, 19 bp, Homo sapiens
ggctggccccatcctggcc

SEQ ID NO: 3850088 - DNA, 16 bp, Homo sapiens
gggaaactctggagag

SEQ ID NO: 3850089 - DNA, 18 bp, Homo sapiens
gggacaagggctgcttcc

SEQ ID NO: 3850090 - DNA, 22 bp, Homo sapiens
gggagcaggtgcccccaggtga

SEQ ID NO: 3850091 - DNA, 22 bp, Homo sapiens
gggccatatgtgctatggagag

SEQ ID NO: 3850092 - DNA, 18 bp, Homo sapiens
gggctgcagcagaggcct

SEQ ID NO: 3850093 - DNA, 20 bp, Homo sapiens
gggctggtcctgggagccac

SEQ ID NO: 3850094 - DNA, 22 bp, Homo sapiens
ggggagtgtacagacccctgcc

SEQ ID NO: 3850095 - DNA, 12 bp, Homo sapiens
ggggctggcccc

SEQ ID NO: 3850096 - DNA, 21 bp, Homo sapiens
ggggctggccccatcctggcc

SEQ ID NO: 3850097 - DNA, 19 bp, Homo sapiens
ggtgagacagcggtcccag

SEQ ID NO: 3850098 - DNA, 23 bp, Homo sapiens
ggtgccagtcctcctcaggagaa

SEQ ID NO: 3850099 - DNA, 23 bp, Homo sapiens
gtaagagggaaactctggagagc

SEQ ID NO: 3850100 - DNA, 16 bp, Homo sapiens
gtagctgcttcctgga

SEQ ID NO: 3850101 - DNA, 17 bp, Homo sapiens
gtagctgcttcctggac

SEQ ID NO: 3850102 - DNA, 23 bp, Homo sapiens
gtcttgcagtggacggagagcct

SEQ ID NO: 3850103 - DNA, 19 bp, Homo sapiens
gtgagcaggcggggaggag

SEQ ID NO: 3850104 - DNA, 15 bp, Homo sapiens
gtgcatgcccctgag

SEQ ID NO: 3850105 - DNA, 13 bp, Homo sapiens
gtgctatggagag

SEQ ID NO: 3850106 - DNA, 21 bp, Homo sapiens
gtggagaattggccagagcct

SEQ ID NO: 3850107 - DNA, 22 bp, Homo sapiens
gtggatagagcagcctgctgct

SEQ ID NO: 3850108 - DNA, 21 bp, Homo sapiens
gtggcaggaaagagggagcag

SEQ ID NO: 3850109 - DNA, 20 bp, Homo sapiens
gtggccaaagatttcctttc

SEQ ID NO: 3850110 - DNA, 13 bp, Homo sapiens
gtggccccgaggc

SEQ ID NO: 3850111 - DNA, 15 bp, Homo sapiens
gtggccctggacaag

SEQ ID NO: 3850112 - DNA, 22 bp, Homo sapiens
gtgtgccctatcttttctccca

SEQ ID NO: 3850113 - DNA, 23 bp, Homo sapiens
gtgtggccctggacaagccacag

SEQ ID NO: 3850114 - DNA, 13 bp, Homo sapiens
gtgtgggtgccag

SEQ ID NO: 3850115 - DNA, 17 bp, Homo sapiens
gtttggggctggcccca

SEQ ID NO: 3850116 - DNA, 21 bp, Homo sapiens
taagagggaaactctggagag

SEQ ID NO: 3850117 - DNA, 16 bp, Homo sapiens
taattgtgtcccctct

SEQ ID NO: 3850118 - DNA, 20 bp, Homo sapiens
tacagattcagaaaccaagg

SEQ ID NO: 3850119 - DNA, 18 bp, Homo sapiens
taccctgaatgtgtgccc

SEQ ID NO: 3850120 - DNA, 18 bp, Homo sapiens
taccttccttcaactgct

SEQ ID NO: 3850121 - DNA, 16 bp, Homo sapiens
tagacacttcttgaaa

SEQ ID NO: 3850122 - DNA, 13 bp, Homo sapiens
tagagcagcctgc

SEQ ID NO: 3850123 - DNA, 18 bp, Homo sapiens
tagaggctttgagaagct

SEQ ID NO: 3850124 - DNA, 12 bp, Homo sapiens
taggctcctggg

SEQ ID NO: 3850125 - DNA, 16 bp, Homo sapiens
tatctgatcttcctca

SEQ ID NO: 3850126 - DNA, 17 bp, Homo sapiens
tatgtgctatggagagg

SEQ ID NO: 3850127 - DNA, 22 bp, Homo sapiens
tcaccccaacaaactcctctag

SEQ ID NO: 3850128 - DNA, 11 bp, Homo sapiens
tcacttcccct

SEQ ID NO: 3850129 - DNA, 16 bp, Homo sapiens
tcaggcacctcatccc

SEQ ID NO: 3850130 - DNA, 21 bp, Homo sapiens
tcataccttgaacccccctcc

SEQ ID NO: 3850131 - DNA, 18 bp, Homo sapiens
tcatctatgctctttcct

SEQ ID NO: 3850132 - DNA, 14 bp, Homo sapiens
tcattttccacatg

SEQ ID NO: 3850133 - DNA, 14 bp, Homo sapiens
tccaaagcttcccc

SEQ ID NO: 3850134 - DNA, 15 bp, Homo sapiens
tccaaagcttcccct

SEQ ID NO: 3850135 - DNA, 17 bp, Homo sapiens
tccacatccccagctgt

SEQ ID NO: 3850136 - DNA, 24 bp, Homo sapiens
tccagagctgtcctcctggcacct

SEQ ID NO: 3850137 - DNA, 11 bp, Homo sapiens
tccagcctgct

SEQ ID NO: 3850138 - DNA, 23 bp, Homo sapiens
tccaggggtgccccagacccaga

SEQ ID NO: 3850139 - DNA, 18 bp, Homo sapiens
tccatgccttcaagactt

SEQ ID NO: 3850140 - DNA, 23 bp, Homo sapiens
tcccacctccttcctcctaccac

SEQ ID NO: 3850141 - DNA, 13 bp, Homo sapiens
tccccaacctgca

SEQ ID NO: 3850142 - DNA, 15 bp, Homo sapiens
tcccccacctgcagc

SEQ ID NO: 3850143 - DNA, 18 bp, Homo sapiens
tcccctgcttctggctcc

SEQ ID NO: 3850144 - DNA, 13 bp, Homo sapiens
tccctcctctccc

SEQ ID NO: 3850145 - DNA, 13 bp, Homo sapiens
tccgcccccatgc

SEQ ID NO: 3850146 - DNA, 17 bp, Homo sapiens
tccgcttctcctgcagt

SEQ ID NO: 3850147 - DNA, 16 bp, Homo sapiens
tcctcacatgcagagt

SEQ ID NO: 3850148 - DNA, 15 bp, Homo sapiens
tcctcaggagaaggg

SEQ ID NO: 3850149 - DNA, 19 bp, Homo sapiens
tcctgggaggccctggcag

SEQ ID NO: 3850150 - DNA, 16 bp, Homo sapiens
tctcacttccccttgc

SEQ ID NO: 3850151 - DNA, 20 bp, Homo sapiens
tcttaacctcttcttaccct

SEQ ID NO: 3850152 - DNA, 18 bp, Homo sapiens
tgaaaaggaaggaccagg

SEQ ID NO: 3850153 - DNA, 13 bp, Homo sapiens
tgaacccccctcc

SEQ ID NO: 3850154 - DNA, 22 bp, Homo sapiens
tgaagggttttgctatttccaa

SEQ ID NO: 3850155 - DNA, 16 bp, Homo sapiens
tgactttgcacctgca

SEQ ID NO: 3850156 - DNA, 23 bp, Homo sapiens
tgagacagcggtcccaggggcct

SEQ ID NO: 3850157 - DNA, 13 bp, Homo sapiens
tgagcctggcagg

SEQ ID NO: 3850158 - DNA, 19 bp, Homo sapiens
tgagggagaacctctccaa

SEQ ID NO: 3850159 - DNA, 22 bp, Homo sapiens
tgatcccctgcttctggctcct

SEQ ID NO: 3850160 - DNA, 18 bp, Homo sapiens
tgatggccaaagcaaagg

SEQ ID NO: 3850161 - DNA, 22 bp, Homo sapiens
tgcaataaatccgcttctcctg

SEQ ID NO: 3850162 - DNA, 17 bp, Homo sapiens
tgcagagttgtgcatgc

SEQ ID NO: 3850163 - DNA, 19 bp, Homo sapiens
tgcagtggacggagagcct

SEQ ID NO: 3850164 - DNA, 12 bp, Homo sapiens
tgcccccaggtg

SEQ ID NO: 3850165 - DNA, 17 bp, Homo sapiens
tgccctgaggctgtgag

SEQ ID NO: 3850166 - DNA, 17 bp, Homo sapiens
tgccctttaagagcacc

SEQ ID NO: 3850167 - DNA, 15 bp, Homo sapiens
tgccggagggagccc

SEQ ID NO: 3850168 - DNA, 17 bp, Homo sapiens
tgccggagggagccctg

SEQ ID NO: 3850169 - DNA, 15 bp, Homo sapiens
tgctgtgctgggtgc

SEQ ID NO: 3850170 - DNA, 14 bp, Homo sapiens
tgcttctggctcct

SEQ ID NO: 3850171 - DNA, 18 bp, Homo sapiens
tggatagagcagcctgct

SEQ ID NO: 3850172 - DNA, 17 bp, Homo sapiens
tggcaggaaagagggag

SEQ ID NO: 3850173 - DNA, 18 bp, Homo sapiens
tggcaggtcccctgccct

SEQ ID NO: 3850174 - DNA, 16 bp, Homo sapiens
tggcagttcctggcat

SEQ ID NO: 3850175 - DNA, 16 bp, Homo sapiens
tggccccatcctggcc

SEQ ID NO: 3850176 - DNA, 15 bp, Homo sapiens
tggccctggacaagc

SEQ ID NO: 3850177 - DNA, 20 bp, Homo sapiens
tggctcctaccactggacag

SEQ ID NO: 3850178 - DNA, 12 bp, Homo sapiens
tggctcctcctg

SEQ ID NO: 3850179 - DNA, 14 bp, Homo sapiens
tggctcctcctgga

SEQ ID NO: 3850180 - DNA, 15 bp, Homo sapiens
tgggaggccctggca

SEQ ID NO: 3850181 - DNA, 22 bp, Homo sapiens
tgggagggggacccgtggagaa

SEQ ID NO: 3850182 - DNA, 15 bp, Homo sapiens
tggggacaagggctg

SEQ ID NO: 3850183 - DNA, 16 bp, Homo sapiens
tggggacagagaaggt

SEQ ID NO: 3850184 - DNA, 13 bp, Homo sapiens
tggggctggcccc

SEQ ID NO: 3850185 - DNA, 13 bp, Homo sapiens
tgggtgaggggag

SEQ ID NO: 3850186 - DNA, 16 bp, Homo sapiens
tgggtggtaagaggga

SEQ ID NO: 3850187 - DNA, 20 bp, Homo sapiens
tgtggccccgaggctgggac

SEQ ID NO: 3850188 - DNA, 14 bp, Homo sapiens
ttcctggggctggt

SEQ ID NO: 3850189 - DNA, 22 bp, Homo sapiens
ttctcctatctaccttccttca

SEQ ID NO: 3850190 - DNA, 19 bp, Homo sapiens
ttctctccttccctctcca

SEQ ID NO: 3850191 - DNA, 24 bp, Homo sapiens
ttctggctcctaccactggacagt

SEQ ID NO: 3850192 - DNA, 23 bp, Homo sapiens
ttgatggccaaagcaaaggagag

SEQ ID NO: 3850193 - DNA, 16 bp, Homo sapiens
ttgcacctagacactt

SEQ ID NO: 3850194 - DNA, 17 bp, Homo sapiens
ttggcagttcctggcat

SEQ ID NO: 3850195 - DNA, 14 bp, Homo sapiens
ttggggctggcccc

SEQ ID NO: 3850196 - DNA, 22 bp, Homo sapiens
tttctcccacctccttcctcct

SEQ ID NO: 3850197 - DNA, 22 bp, Homo sapiens
cagagtagctgcttcctggacg

SEQ ID NO: 3850198 - DNA, 14 bp, Homo sapiens
cagccatgaagggt

SEQ ID NO: 3850199 - DNA, 16 bp, Homo sapiens
cagcccaacccactgt

SEQ ID NO: 3850200 - DNA, 16 bp, Homo sapiens
cagcccctgcctgggt

SEQ ID NO: 3850201 - DNA, 9 bp, Homo sapiens
cagcctgct

SEQ ID NO: 3850202 - DNA, 13 bp, Homo sapiens
cagcgcagagtag

SEQ ID NO: 3850203 - DNA, 16 bp, Homo sapiens
cagcgctgggccccaa

SEQ ID NO: 3850204 - DNA, 17 bp, Homo sapiens
cagctgccttcctgggg

SEQ ID NO: 3850205 - DNA, 17 bp, Homo sapiens
cagctgctgtgctgggt

SEQ ID NO: 3850206 - DNA, 15 bp, Homo sapiens
caggaaagagggagc

SEQ ID NO: 3850207 - DNA, 17 bp, Homo sapiens
caggaaagagggagcag

SEQ ID NO: 3850208 - DNA, 22 bp, Homo sapiens
caggaaagagggagcaggtgcc

SEQ ID NO: 3850209 - DNA, 17 bp, Homo sapiens
caggaccagagaaggga

SEQ ID NO: 3850210 - DNA, 16 bp, Homo sapiens
caggcatatgagtgcg

SEQ ID NO: 3850211 - DNA, 19 bp, Homo sapiens
caggccagtgctgtgagca

SEQ ID NO: 3850212 - DNA, 14 bp, Homo sapiens
cagggaactgggaa

SEQ ID NO: 3850213 - DNA, 16 bp, Homo sapiens
cagggcagcatggaga

SEQ ID NO: 3850214 - DNA, 18 bp, Homo sapiens
caggtcccctgccctgag

SEQ ID NO: 3850215 - DNA, 20 bp, Homo sapiens
caggtctgaagttggccccc

SEQ ID NO: 3850216 - DNA, 14 bp, Homo sapiens
caggtgcccccagg

SEQ ID NO: 3850217 - DNA, 18 bp, Homo sapiens
caggtgcccccaggtgag

SEQ ID NO: 3850218 - DNA, 20 bp, Homo sapiens
cagtgagctatgagcccagc

SEQ ID NO: 3850219 - DNA, 19 bp, Homo sapiens
cagtttcacaagtgagccc

SEQ ID NO: 3850220 - DNA, 14 bp, Homo sapiens
catcctggcccagc

SEQ ID NO: 3850221 - DNA, 18 bp, Homo sapiens
catcctggcccagcctct

SEQ ID NO: 3850222 - DNA, 17 bp, Homo sapiens
catctatgctctttcct

SEQ ID NO: 3850223 - DNA, 13 bp, Homo sapiens
catgcccctgagt

SEQ ID NO: 3850224 - DNA, 22 bp, Homo sapiens
catggcaaggggtctccttgga

SEQ ID NO: 3850225 - DNA, 15 bp, Homo sapiens
catggcctctggaaa

SEQ ID NO: 3850226 - DNA, 16 bp, Homo sapiens
catgtgggtcatacct

SEQ ID NO: 3850227 - DNA, 22 bp, Homo sapiens
cattatttctgcttcctggggg

SEQ ID NO: 3850228 - DNA, 18 bp, Homo sapiens
ccaaatgactttgcacct

SEQ ID NO: 3850229 - DNA, 23 bp, Homo sapiens
ccaagaaagacagtgtataagga

SEQ ID NO: 3850230 - DNA, 21 bp, Homo sapiens
ccaccccgtccctcctctccc

SEQ ID NO: 3850231 - DNA, 16 bp, Homo sapiens
ccactgtcttgcagtg

SEQ ID NO: 3850232 - DNA, 16 bp, Homo sapiens
ccactgtgcaccaggc

SEQ ID NO: 3850233 - DNA, 21 bp, Homo sapiens
ccagaagaagggtggagtcag

SEQ ID NO: 3850234 - DNA, 19 bp, Homo sapiens
ccagacagaggcagggcag

SEQ ID NO: 3850235 - DNA, 17 bp, Homo sapiens
ccagattggagtcagag

SEQ ID NO: 3850236 - DNA, 10 bp, Homo sapiens
ccagcctgct

SEQ ID NO: 3850237 - DNA, 14 bp, Homo sapiens
ccaggcagaggcag

SEQ ID NO: 3850238 - DNA, 21 bp, Homo sapiens
ccagtcctcctcaggagaagg

SEQ ID NO: 3850239 - DNA, 11 bp, Homo sapiens
ccatcctggcc

SEQ ID NO: 3850240 - DNA, 15 bp, Homo sapiens
cccacctccttcctc

SEQ ID NO: 3850241 - DNA, 12 bp, Homo sapiens
cccacctgcagc

SEQ ID NO: 3850242 - DNA, 18 bp, Homo sapiens
cccacttcggcgcagaaa

SEQ ID NO: 3850243 - DNA, 14 bp, Homo sapiens
cccaggtgagacag

SEQ ID NO: 3850244 - DNA, 16 bp, Homo sapiens
ccccaggtgagacagc

SEQ ID NO: 3850245 - DNA, 20 bp, Homo sapiens
ccccttatcgtcccctgtga

SEQ ID NO: 3850246 - DNA, 22 bp, Homo sapiens
ccccttcctccccaacctgcaa

SEQ ID NO: 3850247 - DNA, 16 bp, Homo sapiens
ccctctccagcctgct

SEQ ID NO: 3850248 - DNA, 21 bp, Homo sapiens
cccttcctccccaacctgcaa

SEQ ID NO: 3850249 - DNA, 14 bp, Homo sapiens
ccgaggctgggaca

SEQ ID NO: 3850250 - DNA, 15 bp, Homo sapiens
ccgcttctcctgcag

SEQ ID NO: 3850251 - DNA, 16 bp, Homo sapiens
ccgcttctcctgcagt

SEQ ID NO: 3850252 - DNA, 11 bp, Homo sapiens
ccgtccctcct

SEQ ID NO: 3850253 - DNA, 17 bp, Homo sapiens
ccgtgacaaaggtagag

SEQ ID NO: 3850254 - DNA, 19 bp, Homo sapiens
ccgtggagaattggccaga

SEQ ID NO: 3850255 - DNA, 14 bp, Homo sapiens
cctaggctcctggg

SEQ ID NO: 3850256 - DNA, 15 bp, Homo sapiens
cctcaggagaagggg

SEQ ID NO: 3850257 - DNA, 23 bp, Homo sapiens
cctccagagctgtcctcctggca

SEQ ID NO: 3850258 - DNA, 22 bp, Homo sapiens
cctccaggtccctaagctgggg

SEQ ID NO: 3850259 - DNA, 23 bp, Homo sapiens
cctccctcctcattctctcccta

SEQ ID NO: 3850260 - DNA, 15 bp, Homo sapiens
cctcctctcccgcag

SEQ ID NO: 3850261 - DNA, 15 bp, Homo sapiens
cctctcatctatgct

SEQ ID NO: 3850262 - DNA, 15 bp, Homo sapiens
cctctccagcctgct

SEQ ID NO: 3850263 - DNA, 17 bp, Homo sapiens
cctgaggagtggcagga

SEQ ID NO: 3850264 - DNA, 18 bp, Homo sapiens
cctgcagcgctgggcccc

SEQ ID NO: 3850265 - DNA, 14 bp, Homo sapiens
cctgcttctggctc

SEQ ID NO: 3850266 - DNA, 12 bp, Homo sapiens
cctggcacctga

SEQ ID NO: 3850267 - DNA, 18 bp, Homo sapiens
cctggcacctgagtgtcc

SEQ ID NO: 3850268 - DNA, 13 bp, Homo sapiens
cctgggagcccac

SEQ ID NO: 3850269 - DNA, 12 bp, Homo sapiens
cctgggaggccc

SEQ ID NO: 3850270 - DNA, 20 bp, Homo sapiens
cctgggaggccctggcagaa

SEQ ID NO: 3850271 - DNA, 15 bp, Homo sapiens
cctggggctggtcct

SEQ ID NO: 3850272 - DNA, 17 bp, Homo sapiens
cctgggggaaggatgca

SEQ ID NO: 3850273 - DNA, 23 bp, Homo sapiens
cctgtggccccgaggctgggaca

SEQ ID NO: 3850274 - DNA, 20 bp, Homo sapiens
ccttcctccccaacctgcaa

SEQ ID NO: 3850275 - DNA, 21 bp, Homo sapiens
ccttgaacccccctccgcccc

SEQ ID NO: 3850276 - DNA, 17 bp, Homo sapiens
cctttctgtggtgaggg

SEQ ID NO: 3850277 - DNA, 17 bp, Homo sapiens
cgcaatctggctcctcc

SEQ ID NO: 3850278 - DNA, 22 bp, Homo sapiens
cgcaatctggctcctcctggaa

SEQ ID NO: 3850279 - DNA, 15 bp, Homo sapiens
cgcttctcctgcagt

SEQ ID NO: 3850280 - DNA, 18 bp, Homo sapiens
cgcttctcctgcagtgga

SEQ ID NO: 3850281 - DNA, 17 bp, Homo sapiens
cggcctctacggccccg

SEQ ID NO: 3850282 - DNA, 17 bp, Homo sapiens
cgtgcgcgcccaggcca

SEQ ID NO: 3850283 - DNA, 18 bp, Homo sapiens
cgtgtgtgtatgctgtgt

SEQ ID NO: 3850284 - DNA, 21 bp, Homo sapiens
ctaataaaaattggagctcat

SEQ ID NO: 3850285 - DNA, 16 bp, Homo sapiens
ctacgttggtgcaagt

SEQ ID NO: 3850286 - DNA, 15 bp, Homo sapiens
ctagcctctttctcc

SEQ ID NO: 3850287 - DNA, 12 bp, Homo sapiens
ctaggctcctgg

SEQ ID NO: 3850288 - DNA, 13 bp, Homo sapiens
ctaggctcctggg

SEQ ID NO: 3850289 - DNA, 15 bp, Homo sapiens
ctaggctcctgggag

SEQ ID NO: 3850290 - DNA, 16 bp, Homo sapiens
ctatccattctctcct

SEQ ID NO: 3850291 - DNA, 18 bp, Homo sapiens
ctatccattctctccttc

SEQ ID NO: 3850292 - DNA, 21 bp, Homo sapiens
ctatccattctctccttccct

SEQ ID NO: 3850293 - DNA, 14 bp, Homo sapiens
ctatctcacactgc

SEQ ID NO: 3850294 - DNA, 23 bp, Homo sapiens
gcgttctcctatctaccttcctt

SEQ ID NO: 3850295 - DNA, 19 bp, Homo sapiens
gctatggagaggactctcc

SEQ ID NO: 3850296 - DNA, 22 bp, Homo sapiens
gctcagctgccttcctggggct

SEQ ID NO: 3850297 - DNA, 22 bp, Homo sapiens
gctcaggcatgcaaccatgggc

SEQ ID NO: 3850298 - DNA, 12 bp, Homo sapiens
gctcctcctgga

SEQ ID NO: 3850299 - DNA, 20 bp, Homo sapiens
gctgccggagggagccctga

SEQ ID NO: 3850300 - DNA, 18 bp, Homo sapiens
gctggccccatcctggcc

SEQ ID NO: 3850301 - DNA, 17 bp, Homo sapiens
gctggggacagagaagg

SEQ ID NO: 3850302 - DNA, 15 bp, Homo sapiens
gctggggagggaggc

SEQ ID NO: 3850303 - DNA, 13 bp, Homo sapiens
gctggtcctggga

SEQ ID NO: 3850304 - DNA, 14 bp, Homo sapiens
gctggtcctgggag

SEQ ID NO: 3850305 - DNA, 14 bp, Homo sapiens
gctgtcctcctggc

SEQ ID NO: 3850306 - DNA, 18 bp, Homo sapiens
gctgtcctcctggcacct

SEQ ID NO: 3850307 - DNA, 13 bp, Homo sapiens
gctgtgagcagct

SEQ ID NO: 3850308 - DNA, 22 bp, Homo sapiens
gctgtgagcagctagtggtggc

SEQ ID NO: 3850309 - DNA, 14 bp, Homo sapiens
gctgtgtgtgcccg

SEQ ID NO: 3850310 - DNA, 14 bp, Homo sapiens
gcttctggctccta

SEQ ID NO: 3850311 - DNA, 19 bp, Homo sapiens
ggaccaggctggggccagg

SEQ ID NO: 3850312 - DNA, 17 bp, Homo sapiens
ggacgcttgtgaggccc

SEQ ID NO: 3850313 - DNA, 13 bp, Homo sapiens
ggacggagagcct

SEQ ID NO: 3850314 - DNA, 16 bp, Homo sapiens
ggactgagctggggag

SEQ ID NO: 3850315 - DNA, 14 bp, Homo sapiens
ggagaattggccag

SEQ ID NO: 3850316 - DNA, 12 bp, Homo sapiens
ggagagcctgca

SEQ ID NO: 3850317 - DNA, 21 bp, Homo sapiens
ggagagcttcaggccccagga

SEQ ID NO: 3850318 - DNA, 17 bp, Homo sapiens
ggagcaggtgcccccag

SEQ ID NO: 3850319 - DNA, 21 bp, Homo sapiens
ggagcaggtgcccccaggtga

SEQ ID NO: 3850320 - DNA, 19 bp, Homo sapiens
ggagctcattttccacatg

SEQ ID NO: 3850321 - DNA, 22 bp, Homo sapiens
ggagctcattttccacatggca

SEQ ID NO: 3850322 - DNA, 14 bp, Homo sapiens
ggaggccctggcag

SEQ ID NO: 3850323 - DNA, 18 bp, Homo sapiens
ggagtggcaggaaagagg

SEQ ID NO: 3850324 - DNA, 18 bp, Homo sapiens
ggatagagcagcctgctg

SEQ ID NO: 3850325 - DNA, 22 bp, Homo sapiens
ggcagtgagctatgagcccagc

SEQ ID NO: 3850326 - DNA, 16 bp, Homo sapiens
ggccccatcctggccc

SEQ ID NO: 3850327 - DNA, 21 bp, Homo sapiens
ggctcctaccactggacagtc

SEQ ID NO: 3850328 - DNA, 15 bp, Homo sapiens
ggctcctcctggaaa

SEQ ID NO: 3850329 - DNA, 22 bp, Homo sapiens
ggctcctgggaggccctggcag

SEQ ID NO: 3850330 - DNA, 12 bp, Homo sapiens
ggctgaagggag

SEQ ID NO: 3850331 - DNA, 12 bp, Homo sapiens
ggctgccctggg

SEQ ID NO: 3850332 - DNA, 16 bp, Homo sapiens
ggctggtttctgccct

SEQ ID NO: 3850333 - DNA, 23 bp, Homo sapiens
gggaaattggcagttcctggcat

SEQ ID NO: 3850334 - DNA, 17 bp, Homo sapiens
gggaatgatgcaactgg

SEQ ID NO: 3850335 - DNA, 19 bp, Homo sapiens
gggagcaggtgcccccagg

SEQ ID NO: 3850336 - DNA, 20 bp, Homo sapiens
gggagtgtacagacccctgc

SEQ ID NO: 3850337 - DNA, 12 bp, Homo sapiens
gggccaggggac

SEQ ID NO: 3850338 - DNA, 20 bp, Homo sapiens
gggcctttgtcttgggtgag

SEQ ID NO: 3850339 - DNA, 15 bp, Homo sapiens
gggctggccccatcc

SEQ ID NO: 3850340 - DNA, 21 bp, Homo sapiens
gggctggccccatcctggccc

SEQ ID NO: 3850341 - DNA, 16 bp, Homo sapiens
gggctggtcctgggag

SEQ ID NO: 3850342 - DNA, 17 bp, Homo sapiens
gggctggtttctgccct

SEQ ID NO: 3850343 - DNA, 14 bp, Homo sapiens
ggggactgagctgg

SEQ ID NO: 3850344 - DNA, 13 bp, Homo sapiens
ggggcccctcagg

SEQ ID NO: 3850345 - DNA, 15 bp, Homo sapiens
gggggcccctcaggt

SEQ ID NO: 3850346 - DNA, 13 bp, Homo sapiens
gggtctccttgga

SEQ ID NO: 3850347 - DNA, 22 bp, Homo sapiens
gggtgaggggagatttgcacct

SEQ ID NO: 3850348 - DNA, 16 bp, Homo sapiens
ggtactgagtggggag

SEQ ID NO: 3850349 - DNA, 17 bp, Homo sapiens
ggtactgagtggggagt

SEQ ID NO: 3850350 - DNA, 20 bp, Homo sapiens
ggtccaaaaaaggctgccct

SEQ ID NO: 3850351 - DNA, 23 bp, Homo sapiens
ggtccaaaaaaggctgccctggg

SEQ ID NO: 3850352 - DNA, 13 bp, Homo sapiens
ggtcccctgccct

SEQ ID NO: 3850353 - DNA, 14 bp, Homo sapiens
gtacagacccctgc

SEQ ID NO: 3850354 - DNA, 16 bp, Homo sapiens
gtactgagtggggagt

SEQ ID NO: 3850355 - DNA, 19 bp, Homo sapiens
gtcagaaaccaaagtgacc

SEQ ID NO: 3850356 - DNA, 15 bp, Homo sapiens
gtcccctgccctgag

SEQ ID NO: 3850357 - DNA, 16 bp, Homo sapiens
gtcccctgccctgagg

SEQ ID NO: 3850358 - DNA, 14 bp, Homo sapiens
gtcctcacatgcag

SEQ ID NO: 3850359 - DNA, 16 bp, Homo sapiens
gtcctcacatgcagag

SEQ ID NO: 3850360 - DNA, 15 bp, Homo sapiens
gtcctcctggcacct

SEQ ID NO: 3850361 - DNA, 15 bp, Homo sapiens
gtctccgcctttcta

SEQ ID NO: 3850362 - DNA, 16 bp, Homo sapiens
gtctgaagttggcccc

SEQ ID NO: 3850363 - DNA, 12 bp, Homo sapiens
gtcttgcagtgg

SEQ ID NO: 3850364 - DNA, 16 bp, Homo sapiens
gtgctatggagaggac

SEQ ID NO: 3850365 - DNA, 19 bp, Homo sapiens
gtgggtgccagtcctcctc

SEQ ID NO: 3850366 - DNA, 15 bp, Homo sapiens
gtggtgagggagaac

SEQ ID NO: 3850367 - DNA, 17 bp, Homo sapiens
gtgtacagacccctgcc

SEQ ID NO: 3850368 - DNA, 20 bp, Homo sapiens
gtgtaccagctgctgtgctg

SEQ ID NO: 3850369 - DNA, 22 bp, Homo sapiens
gtgtaggaggggctgcagcaga

SEQ ID NO: 3850370 - DNA, 23 bp, Homo sapiens
gtgtatgctgtgtgtgcccggga

SEQ ID NO: 3850371 - DNA, 17 bp, Homo sapiens
taaaaattggagctcat

SEQ ID NO: 3850372 - DNA, 16 bp, Homo sapiens
taaatccgcttctcct

SEQ ID NO: 3850373 - DNA, 13 bp, Homo sapiens
taatccctccctc

SEQ ID NO: 3850374 - DNA, 21 bp, Homo sapiens
tacccatccatcacccatctc

SEQ ID NO: 3850375 - DNA, 15 bp, Homo sapiens
tagtatatggtggag

SEQ ID NO: 3850376 - DNA, 14 bp, Homo sapiens
tatgctctttcctg

SEQ ID NO: 3850377 - DNA, 19 bp, Homo sapiens
tcacccatctcactctccc

SEQ ID NO: 3850378 - DNA, 16 bp, Homo sapiens
tcactctccccagtcc

SEQ ID NO: 3850379 - DNA, 15 bp, Homo sapiens
tcagctgccttcctg

SEQ ID NO: 3850380 - DNA, 17 bp, Homo sapiens
tcagctgccttcctggg

SEQ ID NO: 3850381 - DNA, 13 bp, Homo sapiens
tcagtcagagaac

SEQ ID NO: 3850382 - DNA, 13 bp, Homo sapiens
tcatccccacccc

SEQ ID NO: 3850383 - DNA, 18 bp, Homo sapiens
tccaaaaaaggctgccct

SEQ ID NO: 3850384 - DNA, 16 bp, Homo sapiens
tccacatccccagctg

SEQ ID NO: 3850385 - DNA, 22 bp, Homo sapiens
tccagagctgtcctcctggcac

SEQ ID NO: 3850386 - DNA, 22 bp, Homo sapiens
tcccagctagactgtaagccct

SEQ ID NO: 3850387 - DNA, 15 bp, Homo sapiens
tccccaacctgcaat

SEQ ID NO: 3850388 - DNA, 21 bp, Homo sapiens
tcccctagacatggcctctgg

SEQ ID NO: 3850389 - DNA, 17 bp, Homo sapiens
tccctctccagcctgct

SEQ ID NO: 3850390 - DNA, 13 bp, Homo sapiens
tccgcttctcctg

SEQ ID NO: 3850391 - DNA, 16 bp, Homo sapiens
aaaaattggagctcat

SEQ ID NO: 3850392 - DNA, 15 bp, Homo sapiens
aaaggaaggaccagg

SEQ ID NO: 3850393 - DNA, 20 bp, Homo sapiens
aaatgacttctccaggcaga

SEQ ID NO: 3850394 - DNA, 15 bp, Homo sapiens
aacatcccttacctc

SEQ ID NO: 3850395 - DNA, 13 bp, Homo sapiens
aaggaaggaccag

SEQ ID NO: 3850396 - DNA, 18 bp, Homo sapiens
aaggaccaggctggggcc

SEQ ID NO: 3850397 - DNA, 14 bp, Homo sapiens
aaggctgccctggg

SEQ ID NO: 3850398 - DNA, 15 bp, Homo sapiens
aagtgatggaactcc

SEQ ID NO: 3850399 - DNA, 22 bp, Homo sapiens
aagtgtgcatggctggggactt

SEQ ID NO: 3850400 - DNA, 15 bp, Homo sapiens
aattggccagagcct

SEQ ID NO: 3850401 - DNA, 13 bp, Homo sapiens
acagacccctgcc

SEQ ID NO: 3850402 - DNA, 23 bp, Homo sapiens
accaggcactaagtctctagcct

SEQ ID NO: 3850403 - DNA, 14 bp, Homo sapiens
accatttctagcct

SEQ ID NO: 3850404 - DNA, 16 bp, Homo sapiens
acccactgtcttgcag

SEQ ID NO: 3850405 - DNA, 13 bp, Homo sapiens
acccactgtgcac

SEQ ID NO: 3850406 - DNA, 18 bp, Homo sapiens
accctgaatgtgtgccct

SEQ ID NO: 3850407 - DNA, 12 bp, Homo sapiens
acctccttcctc

SEQ ID NO: 3850408 - DNA, 17 bp, Homo sapiens
acgtgcgcgcccaggcc

SEQ ID NO: 3850409 - DNA, 23 bp, Homo sapiens
acgtgcgcgcccaggccagtgct

SEQ ID NO: 3850410 - DNA, 23 bp, Homo sapiens
actcagtttcacaagtgagccct

SEQ ID NO: 3850411 - DNA, 19 bp, Homo sapiens
actcctctagaagaagcca

SEQ ID NO: 3850412 - DNA, 13 bp, Homo sapiens
actctccccagtc

SEQ ID NO: 3850413 - DNA, 18 bp, Homo sapiens
actgggaacttaggggac

SEQ ID NO: 3850414 - DNA, 21 bp, Homo sapiens
actgggaacttaggggactga

SEQ ID NO: 3850415 - DNA, 23 bp, Homo sapiens
actgtcttgcagtggacggagag

SEQ ID NO: 3850416 - DNA, 21 bp, Homo sapiens
acttccccttgcaccccttcc

SEQ ID NO: 3850417 - DNA, 15 bp, Homo sapiens
agaacacatggctgg

SEQ ID NO: 3850418 - DNA, 21 bp, Homo sapiens
agaaggttctgagctgtccca

SEQ ID NO: 3850419 - DNA, 14 bp, Homo sapiens
agacagaggcaggg

SEQ ID NO: 3850420 - DNA, 15 bp, Homo sapiens
agacagcggtcccag

SEQ ID NO: 3850421 - DNA, 16 bp, Homo sapiens
agagcttcaggcccca

SEQ ID NO: 3850422 - DNA, 13 bp, Homo sapiens
agagtcctgggag

SEQ ID NO: 3850423 - DNA, 14 bp, Homo sapiens
agagtcctgggagc

SEQ ID NO: 3850424 - DNA, 16 bp, Homo sapiens
agagtcctgggagccc

SEQ ID NO: 3850425 - DNA, 14 bp, Homo sapiens
agattggagtcaga

SEQ ID NO: 3850426 - DNA, 16 bp, Homo sapiens
agcacccactgtgcac

SEQ ID NO: 3850427 - DNA, 19 bp, Homo sapiens
agcacccactgtgcaccag

SEQ ID NO: 3850428 - DNA, 17 bp, Homo sapiens
agcaggtgcccccaggt

SEQ ID NO: 3850429 - DNA, 18 bp, Homo sapiens
agccacagcccctgcctg

SEQ ID NO: 3850430 - DNA, 13 bp, Homo sapiens
agccactgggagg

SEQ ID NO: 3850431 - DNA, 20 bp, Homo sapiens
agcccacaagatccaggcag

SEQ ID NO: 3850432 - DNA, 15 bp, Homo sapiens
agcctctttctccct

SEQ ID NO: 3850433 - DNA, 17 bp, Homo sapiens
agcctggcaggtcccct

SEQ ID NO: 3850434 - DNA, 17 bp, Homo sapiens
agccttggcgagggcag

SEQ ID NO: 3850435 - DNA, 21 bp, Homo sapiens
agccttggcgagggcagcagg

SEQ ID NO: 3850436 - DNA, 17 bp, Homo sapiens
agcgcagagtagctgct

SEQ ID NO: 3850437 - DNA, 16 bp, Homo sapiens
agctggggagggaggc

SEQ ID NO: 3850438 - DNA, 14 bp, Homo sapiens
agctgtcctcctgg

SEQ ID NO: 3850439 - DNA, 16 bp, Homo sapiens
agctgtcctcctggca

SEQ ID NO: 3850440 - DNA, 16 bp, Homo sapiens
agcttcaggccccagg

SEQ ID NO: 3850441 - DNA, 13 bp, Homo sapiens
aggaaggaccagg

SEQ ID NO: 3850442 - DNA, 13 bp, Homo sapiens
aggagagcttcag

SEQ ID NO: 3850443 - DNA, 19 bp, Homo sapiens
aggagagcttcaggcccca

SEQ ID NO: 3850444 - DNA, 20 bp, Homo sapiens
aggagagcttcaggccccag

SEQ ID NO: 3850445 - DNA, 21 bp, Homo sapiens
aggagagcttcaggccccagg

SEQ ID NO: 3850446 - DNA, 22 bp, Homo sapiens
aggagagcttcaggccccagga

SEQ ID NO: 3850447 - DNA, 24 bp, Homo sapiens
aggagagcttcaggccccaggact

SEQ ID NO: 3850448 - DNA, 15 bp, Homo sapiens
aggagagtcctggga

SEQ ID NO: 3850449 - DNA, 18 bp, Homo sapiens
aggagagtcctgggagcc

SEQ ID NO: 3850450 - DNA, 21 bp, Homo sapiens
aggaggctgccggagggagcc

SEQ ID NO: 3850451 - DNA, 23 bp, Homo sapiens
aggcaggtgggtggtaagaggga

SEQ ID NO: 3850452 - DNA, 14 bp, Homo sapiens
aggccctggcagaa

SEQ ID NO: 3850453 - DNA, 23 bp, Homo sapiens
aggctcctgggaggccctggcag

SEQ ID NO: 3850454 - DNA, 14 bp, Homo sapiens
agggaaactctgga

SEQ ID NO: 3850455 - DNA, 17 bp, Homo sapiens
agggaaactctggagag

SEQ ID NO: 3850456 - DNA, 21 bp, Homo sapiens
agggagcaggtgcccccaggt

SEQ ID NO: 3850457 - DNA, 22 bp, Homo sapiens
agggccttgatttccagccgca

SEQ ID NO: 3850458 - DNA, 13 bp, Homo sapiens
agggctgaaggga

SEQ ID NO: 3850459 - DNA, 20 bp, Homo sapiens
aggggcctgaaaaggaagga

SEQ ID NO: 3850460 - DNA, 13 bp, Homo sapiens
aggggtggaggga

SEQ ID NO: 3850461 - DNA, 20 bp, Homo sapiens
aggtccaaaaaaggctgccc

SEQ ID NO: 3850462 - DNA, 16 bp, Homo sapiens
aggtcccctgccctga

SEQ ID NO: 3850463 - DNA, 18 bp, Homo sapiens
aggtcccctgccctgagg

SEQ ID NO: 3850464 - DNA, 13 bp, Homo sapiens
aggtgcccccagg

SEQ ID NO: 3850465 - DNA, 21 bp, Homo sapiens
aggtgcccccaggtgagacag

SEQ ID NO: 3850466 - DNA, 13 bp, Homo sapiens
agtcctcaggcag

SEQ ID NO: 3850467 - DNA, 19 bp, Homo sapiens
agtcctcctcaggagaagg

SEQ ID NO: 3850468 - DNA, 19 bp, Homo sapiens
agtgagctatgagcccagc

SEQ ID NO: 3850469 - DNA, 15 bp, Homo sapiens
agtggacggagagcc

SEQ ID NO: 3850470 - DNA, 21 bp, Homo sapiens
agtggcaggaaagagggagca

SEQ ID NO: 3850471 - DNA, 14 bp, Homo sapiens
agtgtgggtgccag

SEQ ID NO: 3850472 - DNA, 12 bp, Homo sapiens
cctgcctgggtc

SEQ ID NO: 3850473 - DNA, 13 bp, Homo sapiens
cctggcccagcct

SEQ ID NO: 3850474 - DNA, 18 bp, Homo sapiens
cctgggaggccctggcag

SEQ ID NO: 3850475 - DNA, 18 bp, Homo sapiens
ccttgatttccagccgca

SEQ ID NO: 3850476 - DNA, 16 bp, Homo sapiens
ccttggcgagggcagc

SEQ ID NO: 3850477 - DNA, 21 bp, Homo sapiens
ccttggcgagggcagcagggt

SEQ ID NO: 3850478 - DNA, 21 bp, Homo sapiens
cgcccaggccagtgctgtgag

SEQ ID NO: 3850479 - DNA, 22 bp, Homo sapiens
cgcccaggccagtgctgtgagc

SEQ ID NO: 3850480 - DNA, 18 bp, Homo sapiens
cgcccccatgctctctgt

SEQ ID NO: 3850481 - DNA, 20 bp, Homo sapiens
cggcctctacggccccgacg

SEQ ID NO: 3850482 - DNA, 21 bp, Homo sapiens
cgtgatcccctgcttctggct

SEQ ID NO: 3850483 - DNA, 18 bp, Homo sapiens
cgtggagaattggccaga

SEQ ID NO: 3850484 - DNA, 12 bp, Homo sapiens
ctaagctgggga

SEQ ID NO: 3850485 - DNA, 19 bp, Homo sapiens
ctaccagaagaagggtgga

SEQ ID NO: 3850486 - DNA, 19 bp, Homo sapiens
ctagtgacagccacttggc

SEQ ID NO: 3850487 - DNA, 21 bp, Homo sapiens
ctagtgacagccacttggcct

SEQ ID NO: 3850488 - DNA, 13 bp, Homo sapiens
ctagtgtgcaagt

SEQ ID NO: 3850489 - DNA, 16 bp, Homo sapiens
ctatctcacactgcac

SEQ ID NO: 3850490 - DNA, 20 bp, Homo sapiens
ctatggctggctgggcaagg

SEQ ID NO: 3850491 - DNA, 17 bp, Homo sapiens
ctcacttccccttgcac

SEQ ID NO: 3850492 - DNA, 20 bp, Homo sapiens
ctccagagctgtcctcctgg

SEQ ID NO: 3850493 - DNA, 21 bp, Homo sapiens
ctccagagctgtcctcctggc

SEQ ID NO: 3850494 - DNA, 16 bp, Homo sapiens
ctccaggcagaggcag

SEQ ID NO: 3850495 - DNA, 18 bp, Homo sapiens
ctcctcattctctcccta

SEQ ID NO: 3850496 - DNA, 18 bp, Homo sapiens
ctcctgggaggccctggc

SEQ ID NO: 3850497 - DNA, 20 bp, Homo sapiens
ctcctgggaggccctggcag

SEQ ID NO: 3850498 - DNA, 21 bp, Homo sapiens
ctctagaggttcaaaggcagc

SEQ ID NO: 3850499 - DNA, 15 bp, Homo sapiens
ctctggagagcctgc

SEQ ID NO: 3850500 - DNA, 13 bp, Homo sapiens
ctgagcctggcag

SEQ ID NO: 3850501 - DNA, 19 bp, Homo sapiens
ctgaggagtggcaggaaag

SEQ ID NO: 3850502 - DNA, 23 bp, Homo sapiens
ctgcaataaatccgcttctcctg

SEQ ID NO: 3850503 - DNA, 19 bp, Homo sapiens
ctgccggagggagccctga

SEQ ID NO: 3850504 - DNA, 23 bp, Homo sapiens
ctgcctgggtctccacatcccca

SEQ ID NO: 3850505 - DNA, 20 bp, Homo sapiens
ctgggacactgtgtggccct

SEQ ID NO: 3850506 - DNA, 21 bp, Homo sapiens
ctgggacactgtgtggccctg

SEQ ID NO: 3850507 - DNA, 18 bp, Homo sapiens
ctgggaggccctggcaga

SEQ ID NO: 3850508 - DNA, 18 bp, Homo sapiens
ctggggctggtcctggga

SEQ ID NO: 3850509 - DNA, 21 bp, Homo sapiens
ctggggctggtcctgggagcc

SEQ ID NO: 3850510 - DNA, 21 bp, Homo sapiens
ctgggtctccacatccccagc

SEQ ID NO: 3850511 - DNA, 14 bp, Homo sapiens
ctggtttctgccct

SEQ ID NO: 3850512 - DNA, 20 bp, Homo sapiens
ctgtatgaggagagcttcag

SEQ ID NO: 3850513 - DNA, 17 bp, Homo sapiens
ctgtcctcctggcacct

SEQ ID NO: 3850514 - DNA, 19 bp, Homo sapiens
ctgtcctcctggcacctga

SEQ ID NO: 3850515 - DNA, 15 bp, Homo sapiens
ctgtgcaccaggcac

SEQ ID NO: 3850516 - DNA, 19 bp, Homo sapiens
ctgtgctgggtgccttgca

SEQ ID NO: 3850517 - DNA, 22 bp, Homo sapiens
ctgtgggggcccctcaggtcag

SEQ ID NO: 3850518 - DNA, 18 bp, Homo sapiens
cttcctccccaacctgca

SEQ ID NO: 3850519 - DNA, 19 bp, Homo sapiens
cttcctccccaacctgcaa

SEQ ID NO: 3850520 - DNA, 20 bp, Homo sapiens
cttccttgaccaaagctctc

SEQ ID NO: 3850521 - DNA, 19 bp, Homo sapiens
cttctaaatttctaggcca

SEQ ID NO: 3850522 - DNA, 16 bp, Homo sapiens
cttctcctgcagtgga

SEQ ID NO: 3850523 - DNA, 22 bp, Homo sapiens
cttcttgaaaggagacactcag

SEQ ID NO: 3850524 - DNA, 14 bp, Homo sapiens
cttgaacccccctc

SEQ ID NO: 3850525 - DNA, 17 bp, Homo sapiens
cttgcaccccttcctcc

SEQ ID NO: 3850526 - DNA, 14 bp, Homo sapiens
cttgcatgcacgga

SEQ ID NO: 3850527 - DNA, 13 bp, Homo sapiens
cttggcgagggca

SEQ ID NO: 3850528 - DNA, 15 bp, Homo sapiens
cttggcgagggcagc

SEQ ID NO: 3850529 - DNA, 14 bp, Homo sapiens
cttgggtgagggga

SEQ ID NO: 3850530 - DNA, 15 bp, Homo sapiens
cttgggtgaggggag

SEQ ID NO: 3850531 - DNA, 20 bp, Homo sapiens
ctttgagagggctgaaggga

SEQ ID NO: 3850532 - DNA, 23 bp, Homo sapiens
cttttctcccacctccttcctcc

SEQ ID NO: 3850533 - DNA, 21 bp, Homo sapiens
cttttgtcctcacatgcagag

SEQ ID NO: 3850534 - DNA, 15 bp, Homo sapiens
gaaagagggagcagg

SEQ ID NO: 3850535 - DNA, 24 bp, Homo sapiens
gaacccccctccgcccccatgctc

SEQ ID NO: 3850536 - DNA, 21 bp, Homo sapiens
gaagttggccccccagcgcag

SEQ ID NO: 3850537 - DNA, 23 bp, Homo sapiens
gacaaatcctaggctcctgggag

SEQ ID NO: 3850538 - DNA, 22 bp, Homo sapiens
gacagcggtcccaggggcctga

SEQ ID NO: 3850539 - DNA, 12 bp, Homo sapiens
gactgtaagccc

SEQ ID NO: 3850540 - DNA, 21 bp, Homo sapiens
gactgtaagccctttggggac

SEQ ID NO: 3850541 - DNA, 17 bp, Homo sapiens
gacttctccaggcagag

SEQ ID NO: 3850542 - DNA, 20 bp, Homo sapiens
gagaaggttctgagctgtcc

SEQ ID NO: 3850543 - DNA, 19 bp, Homo sapiens
gagacagcggtcccagggg

SEQ ID NO: 3850544 - DNA, 12 bp, Homo sapiens
gagagtcctggg

SEQ ID NO: 3850545 - DNA, 14 bp, Homo sapiens
gagccctcttgccc

SEQ ID NO: 3850546 - DNA, 19 bp, Homo sapiens
gagccctgagcctggcagg

SEQ ID NO: 3850547 - DNA, 12 bp, Homo sapiens
gagcctgcaccc

SEQ ID NO: 3850548 - DNA, 21 bp, Homo sapiens
gagcctggcaggtcccctgcc

SEQ ID NO: 3850549 - DNA, 15 bp, Homo sapiens
gagctatgagcccag

SEQ ID NO: 3850550 - DNA, 18 bp, Homo sapiens
gaggccactttgagaggg

SEQ ID NO: 3850551 - DNA, 18 bp, Homo sapiens
gaggcccgaggcagaagg

SEQ ID NO: 3850552 - DNA, 11 bp, Homo sapiens
gaggccctggc

SEQ ID NO: 3850553 - DNA, 13 bp, Homo sapiens
gaggctgggacac

SEQ ID NO: 3850554 - DNA, 12 bp, Homo sapiens
gaggctgtgagc

SEQ ID NO: 3850555 - DNA, 15 bp, Homo sapiens
gaggctgtgagcagc

SEQ ID NO: 3850556 - DNA, 16 bp, Homo sapiens
gaggctgtgagcagct

SEQ ID NO: 3850557 - DNA, 18 bp, Homo sapiens
gagggaaactctggagag

SEQ ID NO: 3850558 - DNA, 20 bp, Homo sapiens
gagggaaactctggagagcc

SEQ ID NO: 3850559 - DNA, 22 bp, Homo sapiens
gagggaaactctggagagcctg

SEQ ID NO: 3850560 - DNA, 18 bp, Homo sapiens
gagggagccctgagcctg

SEQ ID NO: 3850561 - DNA, 22 bp, Homo sapiens
gagggagccctgagcctggcag

SEQ ID NO: 3850562 - DNA, 23 bp, Homo sapiens
gaggttcaaaggcagcaaggcag

SEQ ID NO: 3850563 - DNA, 12 bp, Homo sapiens
gagtcctgggag

SEQ ID NO: 3850564 - DNA, 13 bp, Homo sapiens
gagtcctgggagc

SEQ ID NO: 3850565 - DNA, 19 bp, Homo sapiens
gagttgtgcatgcccctga

SEQ ID NO: 3850566 - DNA, 23 bp, Homo sapiens
gatcacacacaccaaaccagaca

SEQ ID NO: 3850567 - DNA, 12 bp, Homo sapiens
gattgcatctcc

SEQ ID NO: 3850568 - DNA, 18 bp, Homo sapiens
agactcattgctggaggt

SEQ ID NO: 3850569 - DNA, 19 bp, Homo sapiens
agagaaggttctgagctgt

SEQ ID NO: 3850570 - DNA, 15 bp, Homo sapiens
agagattaactggga

SEQ ID NO: 3850571 - DNA, 12 bp, Homo sapiens
agagcagcctgc

SEQ ID NO: 3850572 - DNA, 20 bp, Homo sapiens
agagccttggcgagggcagc

SEQ ID NO: 3850573 - DNA, 17 bp, Homo sapiens
agagcttcaggccccag

SEQ ID NO: 3850574 - DNA, 19 bp, Homo sapiens
agagggaaactctggagag

SEQ ID NO: 3850575 - DNA, 14 bp, Homo sapiens
agagggctgaaggg

SEQ ID NO: 3850576 - DNA, 22 bp, Homo sapiens
agatgggtttggggctggcccc

SEQ ID NO: 3850577 - DNA, 21 bp, Homo sapiens
agcaaaggagagtcctgggag

SEQ ID NO: 3850578 - DNA, 21 bp, Homo sapiens
agcaaatattgttcttcccat

SEQ ID NO: 3850579 - DNA, 19 bp, Homo sapiens
agcacacacctatggctgg

SEQ ID NO: 3850580 - DNA, 23 bp, Homo sapiens
agccaagaatttctctctatgtc

SEQ ID NO: 3850581 - DNA, 21 bp, Homo sapiens
agcccacaagatccaggcaga

SEQ ID NO: 3850582 - DNA, 18 bp, Homo sapiens
agccctgagcctggcagg

SEQ ID NO: 3850583 - DNA, 21 bp, Homo sapiens
agccgcaatctggctcctcct

SEQ ID NO: 3850584 - DNA, 19 bp, Homo sapiens
agcctggcaggtcccctgc

SEQ ID NO: 3850585 - DNA, 21 bp, Homo sapiens
agcctgtggccccgaggctgg

SEQ ID NO: 3850586 - DNA, 23 bp, Homo sapiens
agcctgtggccccgaggctggga

SEQ ID NO: 3850587 - DNA, 14 bp, Homo sapiens
agctagtgacagcc

SEQ ID NO: 3850588 - DNA, 22 bp, Homo sapiens
agctagtggtggcttctccagc

SEQ ID NO: 3850589 - DNA, 17 bp, Homo sapiens
agctcattttccacatg

SEQ ID NO: 3850590 - DNA, 15 bp, Homo sapiens
agctgccttcctggg

SEQ ID NO: 3850591 - DNA, 18 bp, Homo sapiens
agctgccttcctggggct

SEQ ID NO: 3850592 - DNA, 15 bp, Homo sapiens
aggaaggaccaggct

SEQ ID NO: 3850593 - DNA, 23 bp, Homo sapiens
aggaaggaccaggctggggccag

SEQ ID NO: 3850594 - DNA, 15 bp, Homo sapiens
aggaccagagaaggg

SEQ ID NO: 3850595 - DNA, 20 bp, Homo sapiens
aggaccaggctggggccagg

SEQ ID NO: 3850596 - DNA, 22 bp, Homo sapiens
aggaccaggctggggccagggg

SEQ ID NO: 3850597 - DNA, 14 bp, Homo sapiens
aggactgtgggggc

SEQ ID NO: 3850598 - DNA, 14 bp, Homo sapiens
aggagagtcctggg

SEQ ID NO: 3850599 - DNA, 20 bp, Homo sapiens
aggaggccactttgagaggg

SEQ ID NO: 3850600 - DNA, 22 bp, Homo sapiens
aggcactaagtctctagcctct

SEQ ID NO: 3850601 - DNA, 19 bp, Homo sapiens
aggcagcaaggcagtgagc

SEQ ID NO: 3850602 - DNA, 16 bp, Homo sapiens
aggccactttgagagg

SEQ ID NO: 3850603 - DNA, 20 bp, Homo sapiens
aggccagtactactgctctc

SEQ ID NO: 3850604 - DNA, 14 bp, Homo sapiens
aggctcctgggagg

SEQ ID NO: 3850605 - DNA, 20 bp, Homo sapiens
agggaaactctggagagcct

SEQ ID NO: 3850606 - DNA, 23 bp, Homo sapiens
agggaaactctggagagcctgca

SEQ ID NO: 3850607 - DNA, 18 bp, Homo sapiens
agggaaatgacttctcca

SEQ ID NO: 3850608 - DNA, 22 bp, Homo sapiens
agggaaggaggccactttgaga

SEQ ID NO: 3850609 - DNA, 14 bp, Homo sapiens
agggagcaggtgcc

SEQ ID NO: 3850610 - DNA, 12 bp, Homo sapiens
agggagccctga

SEQ ID NO: 3850611 - DNA, 21 bp, Homo sapiens
agggagccctgagcctggcag

SEQ ID NO: 3850612 - DNA, 14 bp, Homo sapiens
agggctgaagggag

SEQ ID NO: 3850613 - DNA, 19 bp, Homo sapiens
agggctgaagggagggcct

SEQ ID NO: 3850614 - DNA, 20 bp, Homo sapiens
aggggactgagctggggagg

SEQ ID NO: 3850615 - DNA, 18 bp, Homo sapiens
aggtactgagtggggagt

SEQ ID NO: 3850616 - DNA, 21 bp, Homo sapiens
aggtgagacagcggtcccagg

SEQ ID NO: 3850617 - DNA, 22 bp, Homo sapiens
aggtgagacagcggtcccaggg

SEQ ID NO: 3850618 - DNA, 15 bp, Homo sapiens
agtagctgcttcctg

SEQ ID NO: 3850619 - DNA, 18 bp, Homo sapiens
agtagctgcttcctggac

SEQ ID NO: 3850620 - DNA, 14 bp, Homo sapiens
agtcctcaggcagc

SEQ ID NO: 3850621 - DNA, 18 bp, Homo sapiens
agtgacctccagagctgt

SEQ ID NO: 3850622 - DNA, 13 bp, Homo sapiens
agtgagccctctt

SEQ ID NO: 3850623 - DNA, 16 bp, Homo sapiens
agtggacggagagcct

SEQ ID NO: 3850624 - DNA, 17 bp, Homo sapiens
agtggacggagagcctt

SEQ ID NO: 3850625 - DNA, 18 bp, Homo sapiens
agtgtccttgctctagag

SEQ ID NO: 3850626 - DNA, 20 bp, Homo sapiens
atcccctgcttctggctcct

SEQ ID NO: 3850627 - DNA, 14 bp, Homo sapiens
atcctggcccagcc

SEQ ID NO: 3850628 - DNA, 21 bp, Homo sapiens
atctctgtaattgtgtcccct

SEQ ID NO: 3850629 - DNA, 16 bp, Homo sapiens
atctctgttccttctc

SEQ ID NO: 3850630 - DNA, 14 bp, Homo sapiens
atctgatcttcctc

SEQ ID NO: 3850631 - DNA, 16 bp, Homo sapiens
atctggctcctcctgg

SEQ ID NO: 3850632 - DNA, 12 bp, Homo sapiens
atgacttctcca

SEQ ID NO: 3850633 - DNA, 14 bp, Homo sapiens
atgcccctgagtgt

SEQ ID NO: 3850634 - DNA, 20 bp, Homo sapiens
atggccaaagcaaaggagag

SEQ ID NO: 3850635 - DNA, 23 bp, Homo sapiens
atggccaaagcaaaggagagtcc

SEQ ID NO: 3850636 - DNA, 20 bp, Homo sapiens
atgggtttggggctggcccc

SEQ ID NO: 3850637 - DNA, 17 bp, Homo sapiens
atgtgctatggagagga

SEQ ID NO: 3850638 - DNA, 17 bp, Homo sapiens
attatttctgcttcctg

SEQ ID NO: 3850639 - DNA, 17 bp, Homo sapiens
attggcagttcctggca

SEQ ID NO: 3850640 - DNA, 17 bp, Homo sapiens
atttcccccacctgcag

SEQ ID NO: 3850641 - DNA, 17 bp, Homo sapiens
caaaggagagtcctggg

SEQ ID NO: 3850642 - DNA, 21 bp, Homo sapiens
caaaggcagcaaggcagtgag

SEQ ID NO: 3850643 - DNA, 16 bp, Homo sapiens
caaaggcccccagcca

SEQ ID NO: 3850644 - DNA, 20 bp, Homo sapiens
caaagtgacctccagagctg

SEQ ID NO: 3850645 - DNA, 16 bp, Homo sapiens
caaccatgggcaccag

SEQ ID NO: 3850646 - DNA, 18 bp, Homo sapiens
caacccactgtcttgcag

SEQ ID NO: 3850647 - DNA, 10 bp, Homo sapiens
caacctgcaa

SEQ ID NO: 3850648 - DNA, 14 bp, Homo sapiens
caagtgtgcatggc

SEQ ID NO: 3850649 - DNA, 22 bp, Homo sapiens
cacaagtgagccctcttgccca

SEQ ID NO: 3850650 - DNA, 21 bp, Homo sapiens
caccaaaccagacagaggcag

SEQ ID NO: 3850651 - DNA, 13 bp, Homo sapiens
caccccttcctcc

SEQ ID NO: 3850652 - DNA, 21 bp, Homo sapiens
cactcagtttcacaagtgagc

SEQ ID NO: 3850653 - DNA, 20 bp, Homo sapiens
cactgtgtggccctggacaa

SEQ ID NO: 3850654 - DNA, 10 bp, Homo sapiens
cacttcccct

SEQ ID NO: 3850655 - DNA, 18 bp, Homo sapiens
cagacagaggcagggcag

SEQ ID NO: 3850656 - DNA, 19 bp, Homo sapiens
cagacagaggcagggcagc

SEQ ID NO: 3850657 - DNA, 13 bp, Homo sapiens
cagagcctgtggc

SEQ ID NO: 3850658 - DNA, 19 bp, Homo sapiens
cagagctgtcctcctggca

SEQ ID NO: 3850659 - DNA, 22 bp, Homo sapiens
cagagctgtcctcctggcacct

SEQ ID NO: 3850660 - DNA, 14 bp, Homo sapiens
cagaggcctgagga

SEQ ID NO: 3850661 - DNA, 15 bp, Homo sapiens
cagcaaggcagtgag

SEQ ID NO: 3850662 - DNA, 21 bp, Homo sapiens
cagcagcttttccaccccagg

SEQ ID NO: 3850663 - DNA, 18 bp, Homo sapiens
cagccgcaatctggctcc

SEQ ID NO: 3850664 - DNA, 18 bp, Homo sapiens
tccgcttctcctgcagtg

SEQ ID NO: 3850665 - DNA, 17 bp, Homo sapiens
tcctaggctcctgggag

SEQ ID NO: 3850666 - DNA, 14 bp, Homo sapiens
tcctgtctccgcct

SEQ ID NO: 3850667 - DNA, 13 bp, Homo sapiens
tccttccctctcc

SEQ ID NO: 3850668 - DNA, 17 bp, Homo sapiens
tcctttctgtggtgagg

SEQ ID NO: 3850669 - DNA, 15 bp, Homo sapiens
tcgttgatggccaaa

SEQ ID NO: 3850670 - DNA, 14 bp, Homo sapiens
tctcaaaagagatt

SEQ ID NO: 3850671 - DNA, 15 bp, Homo sapiens
tctccaggggtgccc

SEQ ID NO: 3850672 - DNA, 15 bp, Homo sapiens
tctcctgcagtggat

SEQ ID NO: 3850673 - DNA, 19 bp, Homo sapiens
tctctgtggcctccatgcc

SEQ ID NO: 3850674 - DNA, 12 bp, Homo sapiens
tctggagagcct

SEQ ID NO: 3850675 - DNA, 14 bp, Homo sapiens
tctgtctgtatcta

SEQ ID NO: 3850676 - DNA, 21 bp, Homo sapiens
tcttgcagtggacggagagcc

SEQ ID NO: 3850677 - DNA, 23 bp, Homo sapiens
tcttgcagtggacggagagcctt

SEQ ID NO: 3850678 - DNA, 14 bp, Homo sapiens
tcttgcctctagag

SEQ ID NO: 3850679 - DNA, 11 bp, Homo sapiens
tgacttctcca

SEQ ID NO: 3850680 - DNA, 20 bp, Homo sapiens
tgacttctccaggcagaggc

SEQ ID NO: 3850681 - DNA, 15 bp, Homo sapiens
tgactttgcacctgc

SEQ ID NO: 3850682 - DNA, 17 bp, Homo sapiens
tgactttgcacctgcaa

SEQ ID NO: 3850683 - DNA, 17 bp, Homo sapiens
tgagaagctcagctgcc

SEQ ID NO: 3850684 - DNA, 23 bp, Homo sapiens
tgagaagctcagctgccttcctg

SEQ ID NO: 3850685 - DNA, 18 bp, Homo sapiens
tgagcaggcggggaggag

SEQ ID NO: 3850686 - DNA, 12 bp, Homo sapiens
tgagcctggcag

SEQ ID NO: 3850687 - DNA, 20 bp, Homo sapiens
tgagcctggcaggtcccctg

SEQ ID NO: 3850688 - DNA, 17 bp, Homo sapiens
tgagctatgagcccagc

SEQ ID NO: 3850689 - DNA, 19 bp, Homo sapiens
tgaggtccaaaaaaggctg

SEQ ID NO: 3850690 - DNA, 21 bp, Homo sapiens
tgatcttcctcaaacttcaga

SEQ ID NO: 3850691 - DNA, 15 bp, Homo sapiens
tgcaagtgtgcatgg

SEQ ID NO: 3850692 - DNA, 16 bp, Homo sapiens
tgcaagtgtgcatggc

SEQ ID NO: 3850693 - DNA, 14 bp, Homo sapiens
tgcaccccttcctc

SEQ ID NO: 3850694 - DNA, 17 bp, Homo sapiens
tgcagtggacggagagc

SEQ ID NO: 3850695 - DNA, 14 bp, Homo sapiens
tgcatggctgggga

SEQ ID NO: 3850696 - DNA, 15 bp, Homo sapiens
tgcatggctggggac

SEQ ID NO: 3850697 - DNA, 21 bp, Homo sapiens
tgcccagcacacacctatggc

SEQ ID NO: 3850698 - DNA, 13 bp, Homo sapiens
tgcccccaggtga

SEQ ID NO: 3850699 - DNA, 23 bp, Homo sapiens
tgccctatcttttctcccacctc

SEQ ID NO: 3850700 - DNA, 11 bp, Homo sapiens
tggagagcctg

SEQ ID NO: 3850701 - DNA, 18 bp, Homo sapiens
tggagccaacacttgaac

SEQ ID NO: 3850702 - DNA, 19 bp, Homo sapiens
tggccccgaggctgggaca

SEQ ID NO: 3850703 - DNA, 10 bp, Homo sapiens
tgggagccac

SEQ ID NO: 3850704 - DNA, 17 bp, Homo sapiens
tgggaggccctggcaga

SEQ ID NO: 3850705 - DNA, 17 bp, Homo sapiens
tggggctggccccatcc

SEQ ID NO: 3850706 - DNA, 18 bp, Homo sapiens
tggggctggtcctgggag

SEQ ID NO: 3850707 - DNA, 19 bp, Homo sapiens
tggggctggtcctgggagc

SEQ ID NO: 3850708 - DNA, 13 bp, Homo sapiens
tggtcctgggagc

SEQ ID NO: 3850709 - DNA, 21 bp, Homo sapiens
tggtcctgggagccactggga

SEQ ID NO: 3850710 - DNA, 19 bp, Homo sapiens
tgtaccagctgctgtgctg

SEQ ID NO: 3850711 - DNA, 17 bp, Homo sapiens
tgtcccatactcccact

SEQ ID NO: 3850712 - DNA, 22 bp, Homo sapiens
tgtcttgcagtggacggagagc

SEQ ID NO: 3850713 - DNA, 21 bp, Homo sapiens
tgtgagcaggcggggaggagg

SEQ ID NO: 3850714 - DNA, 14 bp, Homo sapiens
tgtgcatgcccctg

SEQ ID NO: 3850715 - DNA, 22 bp, Homo sapiens
tgtgccaaatgactttgcacct

SEQ ID NO: 3850716 - DNA, 20 bp, Homo sapiens
tgtggatagagcagcctgct

SEQ ID NO: 3850717 - DNA, 21 bp, Homo sapiens
tgtggccccgaggctgggaca

SEQ ID NO: 3850718 - DNA, 15 bp, Homo sapiens
ttatctgatcttcct

SEQ ID NO: 3850719 - DNA, 14 bp, Homo sapiens
ttcaggccccagga

SEQ ID NO: 3850720 - DNA, 17 bp, Homo sapiens
ttccagcccaacccact

SEQ ID NO: 3850721 - DNA, 15 bp, Homo sapiens
ttcccccacctgcag

SEQ ID NO: 3850722 - DNA, 16 bp, Homo sapiens
ttggcagttcctggca

SEQ ID NO: 3850723 - DNA, 13 bp, Homo sapiens
tttccacatggca

SEQ ID NO: 3850724 - DNA, 19 bp, Homo sapiens
tttctcccacctccttcct

SEQ ID NO: 3850725 - DNA, 19 bp, Homo sapiens
gtgacctccagagctgtcc

SEQ ID NO: 3850726 - DNA, 15 bp, Homo sapiens
gtgagctatgagccc

SEQ ID NO: 3850727 - DNA, 23 bp, Homo sapiens
gtgccagtcctcctcaggagaag

SEQ ID NO: 3850728 - DNA, 12 bp, Homo sapiens
gtggacggagag

SEQ ID NO: 3850729 - DNA, 19 bp, Homo sapiens
gtggatagagcagcctgct

SEQ ID NO: 3850730 - DNA, 14 bp, Homo sapiens
gtgtcaaccagaga

SEQ ID NO: 3850731 - DNA, 22 bp, Homo sapiens
gttcttggatggcgttctccta

SEQ ID NO: 3850732 - DNA, 20 bp, Homo sapiens
taagagggaaactctggaga

SEQ ID NO: 3850733 - DNA, 18 bp, Homo sapiens
taccttgaacccccctcc

SEQ ID NO: 3850734 - DNA, 14 bp, Homo sapiens
tagagcagcctgct

SEQ ID NO: 3850735 - DNA, 13 bp, Homo sapiens
tagctgcttcctg

SEQ ID NO: 3850736 - DNA, 12 bp, Homo sapiens
taggaggggctg

SEQ ID NO: 3850737 - DNA, 14 bp, Homo sapiens
taggctcctgggag

SEQ ID NO: 3850738 - DNA, 13 bp, Homo sapiens
tatctaccttcct

SEQ ID NO: 3850739 - DNA, 21 bp, Homo sapiens
tcaaaagagattaactgggat

SEQ ID NO: 3850740 - DNA, 14 bp, Homo sapiens
tcacaagtgagccc

SEQ ID NO: 3850741 - DNA, 21 bp, Homo sapiens
tcactgagctgggtgtaggag

SEQ ID NO: 3850742 - DNA, 13 bp, Homo sapiens
tcaggccccagga

SEQ ID NO: 3850743 - DNA, 15 bp, Homo sapiens
tcagggaactgggaa

SEQ ID NO: 3850744 - DNA, 18 bp, Homo sapiens
tccagagctgtcctcctg

SEQ ID NO: 3850745 - DNA, 19 bp, Homo sapiens
tccaggcagaaggagatgg

SEQ ID NO: 3850746 - DNA, 16 bp, Homo sapiens
tcccacctccttcctc

SEQ ID NO: 3850747 - DNA, 19 bp, Homo sapiens
tcccacctccttcctccta

SEQ ID NO: 3850748 - DNA, 19 bp, Homo sapiens
tccccaacctgcaataaat

SEQ ID NO: 3850749 - DNA, 15 bp, Homo sapiens
tccccagtcctcagg

SEQ ID NO: 3850750 - DNA, 13 bp, Homo sapiens
tcccccacctgca

SEQ ID NO: 3850751 - DNA, 18 bp, Homo sapiens
tcccctagacatggcctc

SEQ ID NO: 3850752 - DNA, 16 bp, Homo sapiens
tcccttacctcctttc

SEQ ID NO: 3850753 - DNA, 15 bp, Homo sapiens
tccgcttctcctgca

SEQ ID NO: 3850754 - DNA, 21 bp, Homo sapiens
tcctaggctcctgggaggccc

SEQ ID NO: 3850755 - DNA, 14 bp, Homo sapiens
tcctcaggagaagg

SEQ ID NO: 3850756 - DNA, 23 bp, Homo sapiens
tcctcaggagaaggggaagggaa

SEQ ID NO: 3850757 - DNA, 12 bp, Homo sapiens
tcctcctggcac

SEQ ID NO: 3850758 - DNA, 16 bp, Homo sapiens
tcctggcacctgagtg

SEQ ID NO: 3850759 - DNA, 20 bp, Homo sapiens
tcctgggaggccctggcaga

SEQ ID NO: 3850760 - DNA, 21 bp, Homo sapiens
tcctggggctggtcctgggag

SEQ ID NO: 3850761 - DNA, 19 bp, Homo sapiens
tctatctcacactgcacca

SEQ ID NO: 3850762 - DNA, 12 bp, Homo sapiens
tctcccacctcc

SEQ ID NO: 3850763 - DNA, 17 bp, Homo sapiens
tctccccagtcctcagg

SEQ ID NO: 3850764 - DNA, 12 bp, Homo sapiens
tctccttccctc

SEQ ID NO: 3850765 - DNA, 23 bp, Homo sapiens
tctcttttgtcctcacatgcaga

SEQ ID NO: 3850766 - DNA, 15 bp, Homo sapiens
tctgaagttggcccc

SEQ ID NO: 3850767 - DNA, 16 bp, Homo sapiens
tctgaagttggccccc

SEQ ID NO: 3850768 - DNA, 14 bp, Homo sapiens
tctgatcttcctca

SEQ ID NO: 3850769 - DNA, 19 bp, Homo sapiens
tctgcatataataagcact

SEQ ID NO: 3850770 - DNA, 22 bp, Homo sapiens
tctgccctttaagagcacccgg

SEQ ID NO: 3850771 - DNA, 18 bp, Homo sapiens
tctggagagcctgcaccc

SEQ ID NO: 3850772 - DNA, 22 bp, Homo sapiens
tctggctcctaccactggacag

SEQ ID NO: 3850773 - DNA, 19 bp, Homo sapiens
tcttgcagtggacggagag

SEQ ID NO: 3850774 - DNA, 18 bp, Homo sapiens
tctttctcccttctgctc

SEQ ID NO: 3850775 - DNA, 18 bp, Homo sapiens
tcttttctcccacctcct

SEQ ID NO: 3850776 - DNA, 21 bp, Homo sapiens
tgacctccagagctgtcctcc

SEQ ID NO: 3850777 - DNA, 23 bp, Homo sapiens
tgacctccagagctgtcctcctg

SEQ ID NO: 3850778 - DNA, 14 bp, Homo sapiens
tgactttgcacctg

SEQ ID NO: 3850779 - DNA, 23 bp, Homo sapiens
tgagcaggcggggaggaggctgc

SEQ ID NO: 3850780 - DNA, 16 bp, Homo sapiens
tgagctggggagggag

SEQ ID NO: 3850781 - DNA, 17 bp, Homo sapiens
tgagtgtccttgctcta

SEQ ID NO: 3850782 - DNA, 22 bp, Homo sapiens
tgcaaccatgggcaccaggcaa

SEQ ID NO: 3850783 - DNA, 14 bp, Homo sapiens
tgcaagtgtgcatg

SEQ ID NO: 3850784 - DNA, 23 bp, Homo sapiens
tgcaccaagcacccactgtgcac

SEQ ID NO: 3850785 - DNA, 15 bp, Homo sapiens
tgcaccccttcctcc

SEQ ID NO: 3850786 - DNA, 11 bp, Homo sapiens
tgcacctgcaa

SEQ ID NO: 3850787 - DNA, 21 bp, Homo sapiens
tgcagcagaggcctgaggagt

SEQ ID NO: 3850788 - DNA, 22 bp, Homo sapiens
tgcagcagaggcctgaggagtg

SEQ ID NO: 3850789 - DNA, 21 bp, Homo sapiens
tgcagcgctgggccccaaggc

SEQ ID NO: 3850790 - DNA, 16 bp, Homo sapiens
tgcagtggacggagag

SEQ ID NO: 3850791 - DNA, 17 bp, Homo sapiens
tgcatgcccctgagtgt

SEQ ID NO: 3850792 - DNA, 14 bp, Homo sapiens
tgccagtcctcctc

SEQ ID NO: 3850793 - DNA, 11 bp, Homo sapiens
tgcccccaggt

SEQ ID NO: 3850794 - DNA, 13 bp, Homo sapiens
tgcgcgcccaggc

SEQ ID NO: 3850795 - DNA, 13 bp, Homo sapiens
tgctatggagagg

SEQ ID NO: 3850796 - DNA, 19 bp, Homo sapiens
tgctggaggtagagaggtg

SEQ ID NO: 3850797 - DNA, 14 bp, Homo sapiens
tggacggagagcct

SEQ ID NO: 3850798 - DNA, 12 bp, Homo sapiens
tggagagcctgc

SEQ ID NO: 3850799 - DNA, 13 bp, Homo sapiens
tggagagcctgca

SEQ ID NO: 3850800 - DNA, 22 bp, Homo sapiens
tggagctcattttccacatggc

SEQ ID NO: 3850801 - DNA, 20 bp, Homo sapiens
tggcaaggggtctccttgga

SEQ ID NO: 3850802 - DNA, 24 bp, Homo sapiens
tggccaaagcaaaggagagtcctg

SEQ ID NO: 3850803 - DNA, 13 bp, Homo sapiens
tggcctctggaaa

SEQ ID NO: 3850804 - DNA, 14 bp, Homo sapiens
tgggacccgggcct

SEQ ID NO: 3850805 - DNA, 14 bp, Homo sapiens
tgggaggccctggc

SEQ ID NO: 3850806 - DNA, 12 bp, Homo sapiens
tggggccagggg

SEQ ID NO: 3850807 - DNA, 14 bp, Homo sapiens
tggtggcttctcca

SEQ ID NO: 3850808 - DNA, 13 bp, Homo sapiens
tggtttctgccct

SEQ ID NO: 3850809 - DNA, 13 bp, Homo sapiens
tgtcctcacatgc

SEQ ID NO: 3850810 - DNA, 14 bp, Homo sapiens
tgtcctcctggcac

SEQ ID NO: 3850811 - DNA, 13 bp, Homo sapiens
tgtcttgcagtgg

SEQ ID NO: 3850812 - DNA, 22 bp, Homo sapiens
tgtgaggcccgaggcagaaggg

SEQ ID NO: 3850813 - DNA, 22 bp, Homo sapiens
tgtggatagagcagcctgctgc

SEQ ID NO: 3850814 - DNA, 13 bp, Homo sapiens
tgtggtgagggag

SEQ ID NO: 3850815 - DNA, 18 bp, Homo sapiens
tgtgtcccctctcatcta

SEQ ID NO: 3850816 - DNA, 14 bp, Homo sapiens
tgtgtggccctgga

SEQ ID NO: 3850817 - DNA, 22 bp, Homo sapiens
tgttccttctctgtctgcctct

SEQ ID NO: 3850818 - DNA, 17 bp, Homo sapiens
tgttgggtgtcttgcct

SEQ ID NO: 3850819 - DNA, 19 bp, Homo sapiens
ttctcccacctccttcctc

SEQ ID NO: 3850820 - DNA, 21 bp, Homo sapiens
ttctcccttctgctcccatcc

SEQ ID NO: 3850821 - DNA, 15 bp, Homo sapiens
ttctcttttgtcctc

SEQ ID NO: 3850822 - DNA, 11 bp, Homo sapiens
catcctggccc

SEQ ID NO: 3850823 - DNA, 21 bp, Homo sapiens
catctatgctctttcctgtct

SEQ ID NO: 3850824 - DNA, 19 bp, Homo sapiens
catgctctctgtggcctcc

SEQ ID NO: 3850825 - DNA, 13 bp, Homo sapiens
catggcctctgga

SEQ ID NO: 3850826 - DNA, 11 bp, Homo sapiens
ccacctgcagc

SEQ ID NO: 3850827 - DNA, 14 bp, Homo sapiens
ccactgtcttgcag

SEQ ID NO: 3850828 - DNA, 15 bp, Homo sapiens
ccactgtcttgcagt

SEQ ID NO: 3850829 - DNA, 18 bp, Homo sapiens
ccactgtcttgcagtgga

SEQ ID NO: 3850830 - DNA, 16 bp, Homo sapiens
ggccagtgctgtgagc

SEQ ID NO: 3850831 - DNA, 22 bp, Homo sapiens
ggccatatgtgctatggagagg

SEQ ID NO: 3850832 - DNA, 18 bp, Homo sapiens
ggccccatcctggcccag

SEQ ID NO: 3850833 - DNA, 19 bp, Homo sapiens
ggctcctaccactggacag

SEQ ID NO: 3850834 - DNA, 12 bp, Homo sapiens
ggctcctgggag

SEQ ID NO: 3850835 - DNA, 19 bp, Homo sapiens
ggctcctgggaggccctgg

SEQ ID NO: 3850836 - DNA, 23 bp, Homo sapiens
ggctcctgggaggccctggcaga

SEQ ID NO: 3850837 - DNA, 24 bp, Homo sapiens
ggctcctgggaggccctggcagaa

SEQ ID NO: 3850838 - DNA, 16 bp, Homo sapiens
ggctgcagcagaggcc

SEQ ID NO: 3850839 - DNA, 13 bp, Homo sapiens
ggctgccctgggc

SEQ ID NO: 3850840 - DNA, 15 bp, Homo sapiens
ggctgccctgggcca

SEQ ID NO: 3850841 - DNA, 21 bp, Homo sapiens
ggctgccggagggagccctga

SEQ ID NO: 3850842 - DNA, 24 bp, Homo sapiens
ggctgccggagggagccctgagcc

SEQ ID NO: 3850843 - DNA, 21 bp, Homo sapiens
ggctggccccatcctggccca

SEQ ID NO: 3850844 - DNA, 13 bp, Homo sapiens
ggctggctgggca

SEQ ID NO: 3850845 - DNA, 18 bp, Homo sapiens
ggctggggacttctcact

SEQ ID NO: 3850846 - DNA, 18 bp, Homo sapiens
gggaaactctggagagcc

SEQ ID NO: 3850847 - DNA, 13 bp, Homo sapiens
gggacagagaagg

SEQ ID NO: 3850848 - DNA, 20 bp, Homo sapiens
gggagcaggtgcccccaggt

SEQ ID NO: 3850849 - DNA, 15 bp, Homo sapiens
gggcccaccccgtcc

SEQ ID NO: 3850850 - DNA, 22 bp, Homo sapiens
gggctgcagcagaggcctgagg

SEQ ID NO: 3850851 - DNA, 14 bp, Homo sapiens
ggggaagggaagga

SEQ ID NO: 3850852 - DNA, 18 bp, Homo sapiens
ggggctggtttctgccct

SEQ ID NO: 3850853 - DNA, 20 bp, Homo sapiens
gggtgccttgcatgcacgga

SEQ ID NO: 3850854 - DNA, 23 bp, Homo sapiens
ggtaagagggaaactctggagag

SEQ ID NO: 3850855 - DNA, 15 bp, Homo sapiens
ggtcccctgccctga

SEQ ID NO: 3850856 - DNA, 16 bp, Homo sapiens
ggtcccctgccctgag

SEQ ID NO: 3850857 - DNA, 19 bp, Homo sapiens
ggtgccagtcctcctcagg

SEQ ID NO: 3850858 - DNA, 22 bp, Homo sapiens
gtaagagggaaactctggagag

SEQ ID NO: 3850859 - DNA, 13 bp, Homo sapiens
gtaccagctgctg

SEQ ID NO: 3850860 - DNA, 15 bp, Homo sapiens
gtaccagctgctgtg

SEQ ID NO: 3850861 - DNA, 23 bp, Homo sapiens
gtaccagctgctgtgctgggtgc

SEQ ID NO: 3850862 - DNA, 12 bp, Homo sapiens
gtaggaggggct

SEQ ID NO: 3850863 - DNA, 22 bp, Homo sapiens
gtatctatctcacactgcacca

SEQ ID NO: 3850864 - DNA, 21 bp, Homo sapiens
gtcctcctggcacctgagtgt

SEQ ID NO: 3850865 - DNA, 12 bp, Homo sapiens
gtcctgggagcc

SEQ ID NO: 3850866 - DNA, 11 bp, Homo sapiens
gtctccacatc

SEQ ID NO: 3850867 - DNA, 19 bp, Homo sapiens
gtctccaggggtgccccag

SEQ ID NO: 3850868 - DNA, 18 bp, Homo sapiens
gtgacagccacttggcct

SEQ ID NO: 3850869 - DNA, 19 bp, Homo sapiens
gtgagacagcggtcccagg

SEQ ID NO: 3850870 - DNA, 18 bp, Homo sapiens
gtgagccctcttgcccag

SEQ ID NO: 3850871 - DNA, 19 bp, Homo sapiens
gtgaggcccgaggcagaag

SEQ ID NO: 3850872 - DNA, 12 bp, Homo sapiens
gtgcccccaggt

SEQ ID NO: 3850873 - DNA, 13 bp, Homo sapiens
gtgcccccaggtg

SEQ ID NO: 3850874 - DNA, 16 bp, Homo sapiens
gtgcgcgcccaggcca

SEQ ID NO: 3850875 - DNA, 14 bp, Homo sapiens
gtgctatggagagg

SEQ ID NO: 3850876 - DNA, 15 bp, Homo sapiens
gtggacggagagcct

SEQ ID NO: 3850877 - DNA, 17 bp, Homo sapiens
gtggagaattggccaga

SEQ ID NO: 3850878 - DNA, 14 bp, Homo sapiens
gtggatagagcagc

SEQ ID NO: 3850879 - DNA, 22 bp, Homo sapiens
gtggtaagagggaaactctgga

SEQ ID NO: 3850880 - DNA, 21 bp, Homo sapiens
gtgtgccctatcttttctccc

SEQ ID NO: 3850881 - DNA, 23 bp, Homo sapiens
gtgtgggtgccagtcctcctcag

SEQ ID NO: 3850882 - DNA, 11 bp, Homo sapiens
gttcctggcat

SEQ ID NO: 3850883 - DNA, 16 bp, Homo sapiens
gttctcttttgtcctc

SEQ ID NO: 3850884 - DNA, 21 bp, Homo sapiens
gttgtgcatgcccctgagtgt

SEQ ID NO: 3850885 - DNA, 17 bp, Homo sapiens
taaatccgcttctcctg

SEQ ID NO: 3850886 - DNA, 22 bp, Homo sapiens
taagagggaaactctggagagc

SEQ ID NO: 3850887 - DNA, 17 bp, Homo sapiens
taattgtgtcccctctc

SEQ ID NO: 3850888 - DNA, 16 bp, Homo sapiens
taccttgaacccccct

SEQ ID NO: 3850889 - DNA, 15 bp, Homo sapiens
tatccattctctcct

SEQ ID NO: 3850890 - DNA, 22 bp, Homo sapiens
tatccattctctccttccctct

SEQ ID NO: 3850891 - DNA, 13 bp, Homo sapiens
tcaaccagagaac

SEQ ID NO: 3850892 - DNA, 22 bp, Homo sapiens
tcaaccagagaacagctcccct

SEQ ID NO: 3850893 - DNA, 12 bp, Homo sapiens
tcaactgctctg

SEQ ID NO: 3850894 - DNA, 21 bp, Homo sapiens
tcacgtgtgtgtatgctgtgt

SEQ ID NO: 3850895 - DNA, 14 bp, Homo sapiens
tcaggccccaggac

SEQ ID NO: 3850896 - DNA, 14 bp, Homo sapiens
tcagggaactggga

SEQ ID NO: 3850897 - DNA, 23 bp, Homo sapiens
tcaggtcagctcactgagctggg

SEQ ID NO: 3850898 - DNA, 16 bp, Homo sapiens
tcattgctggaggtag

SEQ ID NO: 3850899 - DNA, 21 bp, Homo sapiens
tcattgctggaggtagagagg

SEQ ID NO: 3850900 - DNA, 14 bp, Homo sapiens
tccccaacctgcaa

SEQ ID NO: 3850901 - DNA, 16 bp, Homo sapiens
tccccaccccacctca

SEQ ID NO: 3850902 - DNA, 15 bp, Homo sapiens
tccccttatcgtccc

SEQ ID NO: 3850903 - DNA, 19 bp, Homo sapiens
tccctctccagcctgctgt

SEQ ID NO: 3850904 - DNA, 19 bp, Homo sapiens
tccgcttctcctgcagtgg

SEQ ID NO: 3850905 - DNA, 16 bp, Homo sapiens
tcctaccactggacag

SEQ ID NO: 3850906 - DNA, 17 bp, Homo sapiens
tcctaccactggacagt

SEQ ID NO: 3850907 - DNA, 20 bp, Homo sapiens
tcctaccactggacagtcat

SEQ ID NO: 3850908 - DNA, 15 bp, Homo sapiens
tcctaggctcctggg

SEQ ID NO: 3850909 - DNA, 18 bp, Homo sapiens
tcctaggctcctgggagg

SEQ ID NO: 3850910 - DNA, 15 bp, Homo sapiens
tcctcacatgcagag

SEQ ID NO: 3850911 - DNA, 17 bp, Homo sapiens
tcctccccaacctgcaa

SEQ ID NO: 3850912 - DNA, 13 bp, Homo sapiens
tcctcctggcacc

SEQ ID NO: 3850913 - DNA, 18 bp, Homo sapiens
tcctcctggcacctgagt

SEQ ID NO: 3850914 - DNA, 9 bp, Homo sapiens
tcctgggag

SEQ ID NO: 3850915 - DNA, 11 bp, Homo sapiens
tcctgtctccg

SEQ ID NO: 3850916 - DNA, 18 bp, Homo sapiens
tcctttctgtggtgaggg

SEQ ID NO: 3850917 - DNA, 13 bp, Homo sapiens
tctcacttcccct

SEQ ID NO: 3850918 - DNA, 22 bp, Homo sapiens
tctccaaagaggaagcaggcat

SEQ ID NO: 3850919 - DNA, 14 bp, Homo sapiens
tctccttccctctc

SEQ ID NO: 3850920 - DNA, 14 bp, Homo sapiens
tctctgtggcctcc

SEQ ID NO: 3850921 - DNA, 15 bp, Homo sapiens
tctggctcctaccac

SEQ ID NO: 3850922 - DNA, 21 bp, Homo sapiens
tcttaccctgaatgtgtgccc

SEQ ID NO: 3850923 - DNA, 20 bp, Homo sapiens
tgacctccagagctgtcctc

SEQ ID NO: 3850924 - DNA, 20 bp, Homo sapiens
tgacgcatgtaaagatgctg

SEQ ID NO: 3850925 - DNA, 23 bp, Homo sapiens
tgagacaaatcctaggctcctgg

SEQ ID NO: 3850926 - DNA, 18 bp, Homo sapiens
agagggaaactctggaga

SEQ ID NO: 3850927 - DNA, 19 bp, Homo sapiens
agagggctgaagggagggc

SEQ ID NO: 3850928 - DNA, 16 bp, Homo sapiens
agattggagtcagagg

SEQ ID NO: 3850929 - DNA, 22 bp, Homo sapiens
agcaggcggggaggaggctgcc

SEQ ID NO: 3850930 - DNA, 16 bp, Homo sapiens
agcaggtgcccccagg

SEQ ID NO: 3850931 - DNA, 18 bp, Homo sapiens
agcaggtgcccccaggtg

SEQ ID NO: 3850932 - DNA, 13 bp, Homo sapiens
aaaaggctgccct

SEQ ID NO: 3850933 - DNA, 16 bp, Homo sapiens
aaaaggctgccctggg

SEQ ID NO: 3850934 - DNA, 21 bp, Homo sapiens
aaagcaaaggagagtcctggg

SEQ ID NO: 3850935 - DNA, 17 bp, Homo sapiens
aaagtctcacaggtagt

SEQ ID NO: 3850936 - DNA, 23 bp, Homo sapiens
aacagctcccctagacatggcct

SEQ ID NO: 3850937 - DNA, 12 bp, Homo sapiens
aacccccctccg

SEQ ID NO: 3850938 - DNA, 17 bp, Homo sapiens
aagactcattgctggag

SEQ ID NO: 3850939 - DNA, 18 bp, Homo sapiens
aagactcattgctggagg

SEQ ID NO: 3850940 - DNA, 20 bp, Homo sapiens
aagagcacccggtcagtcag

SEQ ID NO: 3850941 - DNA, 18 bp, Homo sapiens
aagagggaaactctggag

SEQ ID NO: 3850942 - DNA, 22 bp, Homo sapiens
aagatttcctttctgtggtgag

SEQ ID NO: 3850943 - DNA, 14 bp, Homo sapiens
aaggaaggaccagg

SEQ ID NO: 3850944 - DNA, 16 bp, Homo sapiens
aaggctaagggactgg

SEQ ID NO: 3850945 - DNA, 23 bp, Homo sapiens
aataaaaattggagctcattttc

SEQ ID NO: 3850946 - DNA, 17 bp, Homo sapiens
aatctttggtggccaaa

SEQ ID NO: 3850947 - DNA, 19 bp, Homo sapiens
aatgacttctccaggcaga

SEQ ID NO: 3850948 - DNA, 14 bp, Homo sapiens
aatttcccccacct

SEQ ID NO: 3850949 - DNA, 20 bp, Homo sapiens
acaaatcctaggctcctggg

SEQ ID NO: 3850950 - DNA, 16 bp, Homo sapiens
acaagatccaggcaga

SEQ ID NO: 3850951 - DNA, 20 bp, Homo sapiens
acaagatccaggcagaagga

SEQ ID NO: 3850952 - DNA, 16 bp, Homo sapiens
acagaggcagggcagc

SEQ ID NO: 3850953 - DNA, 14 bp, Homo sapiens
acagcggtcccagg

SEQ ID NO: 3850954 - DNA, 16 bp, Homo sapiens
acagcggtcccagggg

SEQ ID NO: 3850955 - DNA, 15 bp, Homo sapiens
accagacagaggcag

SEQ ID NO: 3850956 - DNA, 16 bp, Homo sapiens
acccactgtgcaccag

SEQ ID NO: 3850957 - DNA, 22 bp, Homo sapiens
acccagagattagcctcccact

SEQ ID NO: 3850958 - DNA, 21 bp, Homo sapiens
acctcatccccaccccacctc

SEQ ID NO: 3850959 - DNA, 15 bp, Homo sapiens
actaagtctctagcc

SEQ ID NO: 3850960 - DNA, 11 bp, Homo sapiens
actctggagag

SEQ ID NO: 3850961 - DNA, 12 bp, Homo sapiens
actctggagagc

SEQ ID NO: 3850962 - DNA, 14 bp, Homo sapiens
acttccccttgcac

SEQ ID NO: 3850963 - DNA, 15 bp, Homo sapiens
actttgcacctgcaa

SEQ ID NO: 3850964 - DNA, 15 bp, Homo sapiens
agaagctcagctgcc

SEQ ID NO: 3850965 - DNA, 17 bp, Homo sapiens
agaagggtggagtcaga

SEQ ID NO: 3850966 - DNA, 16 bp, Homo sapiens
agaattggccagagcc

SEQ ID NO: 3850967 - DNA, 15 bp, Homo sapiens
agacatggcctctgg

SEQ ID NO: 3850968 - DNA, 17 bp, Homo sapiens
ctgccggagggagccct

SEQ ID NO: 3850969 - DNA, 15 bp, Homo sapiens
ctgcttcctggggga

SEQ ID NO: 3850970 - DNA, 14 bp, Homo sapiens
ctggagagcctgca

SEQ ID NO: 3850971 - DNA, 15 bp, Homo sapiens
ctggcacctgagtgt

SEQ ID NO: 3850972 - DNA, 23 bp, Homo sapiens
ctggcacctgagtgtccttgctc

SEQ ID NO: 3850973 - DNA, 19 bp, Homo sapiens
ctggcaggtcccctgccct

SEQ ID NO: 3850974 - DNA, 20 bp, Homo sapiens
ctggcaggtcccctgccctg

SEQ ID NO: 3850975 - DNA, 17 bp, Homo sapiens
ctggccccatcctggcc

SEQ ID NO: 3850976 - DNA, 12 bp, Homo sapiens
ctggctcctcct

SEQ ID NO: 3850977 - DNA, 22 bp, Homo sapiens
ctgggacactgtgtggccctgg

SEQ ID NO: 3850978 - DNA, 20 bp, Homo sapiens
ctgggagggggacccgtgga

SEQ ID NO: 3850979 - DNA, 21 bp, Homo sapiens
ctgggccatatgtgctatgga

SEQ ID NO: 3850980 - DNA, 15 bp, Homo sapiens
ctggggacagagaag

SEQ ID NO: 3850981 - DNA, 16 bp, Homo sapiens
ctggggacttctcact

SEQ ID NO: 3850982 - DNA, 13 bp, Homo sapiens
ctggggagggagg

SEQ ID NO: 3850983 - DNA, 17 bp, Homo sapiens
ctggggctggtcctggg

SEQ ID NO: 3850984 - DNA, 19 bp, Homo sapiens
ctggggctggtcctgggag

SEQ ID NO: 3850985 - DNA, 21 bp, Homo sapiens
ctgggggaaggatgcagaagg

SEQ ID NO: 3850986 - DNA, 18 bp, Homo sapiens
ctgggtgccttgcatgca

SEQ ID NO: 3850987 - DNA, 15 bp, Homo sapiens
ctggtcctgggagcc

SEQ ID NO: 3850988 - DNA, 21 bp, Homo sapiens
ctgtcttgcagtggacggaga

SEQ ID NO: 3850989 - DNA, 16 bp, Homo sapiens
ctgtggtgagggagaa

SEQ ID NO: 3850990 - DNA, 14 bp, Homo sapiens
cttcaggccccagg

SEQ ID NO: 3850991 - DNA, 12 bp, Homo sapiens
cttccccttgca

SEQ ID NO: 3850992 - DNA, 13 bp, Homo sapiens
cttcctcctacca

SEQ ID NO: 3850993 - DNA, 12 bp, Homo sapiens
cttcctggggct

SEQ ID NO: 3850994 - DNA, 14 bp, Homo sapiens
cttccttcaactgc

SEQ ID NO: 3850995 - DNA, 19 bp, Homo sapiens
cttctcacttccccttgca

SEQ ID NO: 3850996 - DNA, 20 bp, Homo sapiens
cttctcacttccccttgcac

SEQ ID NO: 3850997 - DNA, 22 bp, Homo sapiens
cttctccagcctttttcaggga

SEQ ID NO: 3850998 - DNA, 15 bp, Homo sapiens
cttctcctgcagtgg

SEQ ID NO: 3850999 - DNA, 16 bp, Homo sapiens
cttgcaccccttcctc

SEQ ID NO: 3851000 - DNA, 22 bp, Homo sapiens
cttgccaagactcattgctgga

SEQ ID NO: 3851001 - DNA, 18 bp, Homo sapiens
cttggatggcgttctcct

SEQ ID NO: 3851002 - DNA, 24 bp, Homo sapiens
cttggcgagggcagcagggtagag

SEQ ID NO: 3851003 - DNA, 18 bp, Homo sapiens
cttgtgaggcccgaggca

SEQ ID NO: 3851004 - DNA, 18 bp, Homo sapiens
cttgtgtaccagctgctg

SEQ ID NO: 3851005 - DNA, 12 bp, Homo sapiens
ctttgagaagct

SEQ ID NO: 3851006 - DNA, 20 bp, Homo sapiens
ctttgagaagctcagctgcc

SEQ ID NO: 3851007 - DNA, 18 bp, Homo sapiens
gaaagagggagcaggtgc

SEQ ID NO: 3851008 - DNA, 20 bp, Homo sapiens
gaaatgacttctccaggcag

SEQ ID NO: 3851009 - DNA, 16 bp, Homo sapiens
gaaggatgcagaagga

SEQ ID NO: 3851010 - DNA, 19 bp, Homo sapiens
gacgcatgtaaagatgctg

SEQ ID NO: 3851011 - DNA, 19 bp, Homo sapiens
gacggagagccttggcgag

SEQ ID NO: 3851012 - DNA, 16 bp, Homo sapiens
gactcattgctggagg

SEQ ID NO: 3851013 - DNA, 18 bp, Homo sapiens
gactgagctggggaggga

SEQ ID NO: 3851014 - DNA, 18 bp, Homo sapiens
gacttatctgatcttcct

SEQ ID NO: 3851015 - DNA, 19 bp, Homo sapiens
gacttatctgatcttcctc

SEQ ID NO: 3851016 - DNA, 18 bp, Homo sapiens
gacttctccaggcagagg

SEQ ID NO: 3851017 - DNA, 14 bp, Homo sapiens
gactttgcacctgc

SEQ ID NO: 3851018 - DNA, 16 bp, Homo sapiens
gagaagctcagctgcc

SEQ ID NO: 3851019 - DNA, 18 bp, Homo sapiens
gagacagcggtcccaggg

SEQ ID NO: 3851020 - DNA, 23 bp, Homo sapiens
gagatgggtttggggctggcccc

SEQ ID NO: 3851021 - DNA, 16 bp, Homo sapiens
gagcagctagtggtgg

SEQ ID NO: 3851022 - DNA, 17 bp, Homo sapiens
gagcaggcggggaggag

SEQ ID NO: 3851023 - DNA, 18 bp, Homo sapiens
gagcaggtgcccccaggt

SEQ ID NO: 3851024 - DNA, 19 bp, Homo sapiens
gagccctcttgcccagcac

SEQ ID NO: 3851025 - DNA, 23 bp, Homo sapiens
gagctcattttccacatggcaag

SEQ ID NO: 3851026 - DNA, 12 bp, Homo sapiens
gagctggggagg

SEQ ID NO: 3851027 - DNA, 16 bp, Homo sapiens
gagctgtcctcctggc

SEQ ID NO: 3851028 - DNA, 13 bp, Homo sapiens
gaggcagggcagc

SEQ ID NO: 3851029 - DNA, 21 bp, Homo sapiens
gaggcagggcagcatggagac

SEQ ID NO: 3851030 - DNA, 19 bp, Homo sapiens
gaggctgccggagggagcc

SEQ ID NO: 3851031 - DNA, 12 bp, Homo sapiens
gaggctgggaca

SEQ ID NO: 3851032 - DNA, 17 bp, Homo sapiens
gagggagccctgagcct

SEQ ID NO: 3851033 - DNA, 21 bp, Homo sapiens
gaggtcaaaaaaggattccaa

SEQ ID NO: 3851034 - DNA, 21 bp, Homo sapiens
gaggtccaaaaaaggctgccc

SEQ ID NO: 3851035 - DNA, 13 bp, Homo sapiens
gagtctagaaccc

SEQ ID NO: 3851036 - DNA, 20 bp, Homo sapiens
gatcccctgcttctggctcc

SEQ ID NO: 3851037 - DNA, 20 bp, Homo sapiens
gatcttcctcaaacttcaga

SEQ ID NO: 3851038 - DNA, 14 bp, Homo sapiens
gcaaggcgctcagg

SEQ ID NO: 3851039 - DNA, 22 bp, Homo sapiens
gcacacacctatggctggctgg

SEQ ID NO: 3851040 - DNA, 22 bp, Homo sapiens
gcacccactgtgcaccaggcac

SEQ ID NO: 3851041 - DNA, 19 bp, Homo sapiens
gcacccaggtactgagtgg

SEQ ID NO: 3851042 - DNA, 19 bp, Homo sapiens
gcagaaaacaaaagccctt

SEQ ID NO: 3851043 - DNA, 16 bp, Homo sapiens
gcaggtgcccccaggt

SEQ ID NO: 3851044 - DNA, 18 bp, Homo sapiens
gcaggtgcccccaggtga

SEQ ID NO: 3851045 - DNA, 13 bp, Homo sapiens
gcagttcctggca

SEQ ID NO: 3851046 - DNA, 20 bp, Homo sapiens
gcatctcttgtgtaccagct

SEQ ID NO: 3851047 - DNA, 21 bp, Homo sapiens
gccactgggagggggacccgt

SEQ ID NO: 3851048 - DNA, 15 bp, Homo sapiens
gccagtcctcctcag

SEQ ID NO: 3851049 - DNA, 22 bp, Homo sapiens
gccatatgtgctatggagagga

SEQ ID NO: 3851050 - DNA, 14 bp, Homo sapiens
gccccaggactgtg

SEQ ID NO: 3851051 - DNA, 14 bp, Homo sapiens
gccccatcctggcc

SEQ ID NO: 3851052 - DNA, 16 bp, Homo sapiens
gccccatcctggccca

SEQ ID NO: 3851053 - DNA, 17 bp, Homo sapiens
gccccatcctggcccag

SEQ ID NO: 3851054 - DNA, 15 bp, Homo sapiens
gcccctgcctgggtc

SEQ ID NO: 3851055 - DNA, 16 bp, Homo sapiens
gccctgagcctggcag

SEQ ID NO: 3851056 - DNA, 18 bp, Homo sapiens
gccctgagcctggcaggt

SEQ ID NO: 3851057 - DNA, 12 bp, Homo sapiens
gccctggcagaa

SEQ ID NO: 3851058 - DNA, 23 bp, Homo sapiens
gccgcaatctggctcctcctgga

SEQ ID NO: 3851059 - DNA, 14 bp, Homo sapiens
gcctctttctccct

SEQ ID NO: 3851060 - DNA, 16 bp, Homo sapiens
gcctgaaaaggaagga

SEQ ID NO: 3851061 - DNA, 19 bp, Homo sapiens
gcctgaggagtggcaggaa

SEQ ID NO: 3851062 - DNA, 23 bp, Homo sapiens
gcctgtggccccgaggctgggac

SEQ ID NO: 3851063 - DNA, 13 bp, Homo sapiens
gcggtcccagggg

SEQ ID NO: 3851064 - DNA, 15 bp, Homo sapiens
atattgttcttccca

SEQ ID NO: 3851065 - DNA, 14 bp, Homo sapiens
atcctaggctcctg

SEQ ID NO: 3851066 - DNA, 14 bp, Homo sapiens
atctggctcctcct

SEQ ID NO: 3851067 - DNA, 14 bp, Homo sapiens
atgcctcccagcta

SEQ ID NO: 3851068 - DNA, 15 bp, Homo sapiens
atgtgctatggagag

SEQ ID NO: 3851069 - DNA, 14 bp, Homo sapiens
attctctccttccc

SEQ ID NO: 3851070 - DNA, 15 bp, Homo sapiens
attctctccttccct

SEQ ID NO: 3851071 - DNA, 24 bp, Homo sapiens
atttccagccgcaatctggctcct

SEQ ID NO: 3851072 - DNA, 22 bp, Homo sapiens
caaaaaaggctgccctgggcca

SEQ ID NO: 3851073 - DNA, 13 bp, Homo sapiens
caaagcttcccct

SEQ ID NO: 3851074 - DNA, 16 bp, Homo sapiens
caaaggagagtcctgg

SEQ ID NO: 3851075 - DNA, 17 bp, Homo sapiens
caaaggcagcaaggcag

SEQ ID NO: 3851076 - DNA, 18 bp, Homo sapiens
caaatcctaggctcctgg

SEQ ID NO: 3851077 - DNA, 21 bp, Homo sapiens
caaatcctaggctcctgggag

SEQ ID NO: 3851078 - DNA, 21 bp, Homo sapiens
caaatgactttgcacctgcaa

SEQ ID NO: 3851079 - DNA, 18 bp, Homo sapiens
caagactcattgctggag

SEQ ID NO: 3851080 - DNA, 10 bp, Homo sapiens
caagtgagcc

SEQ ID NO: 3851081 - DNA, 13 bp, Homo sapiens
caagtgagccctc

SEQ ID NO: 3851082 - DNA, 20 bp, Homo sapiens
caagtgtgcatggctgggga

SEQ ID NO: 3851083 - DNA, 21 bp, Homo sapiens
caatctggctcctcctggaaa

SEQ ID NO: 3851084 - DNA, 14 bp, Homo sapiens
cacatccccagctg

SEQ ID NO: 3851085 - DNA, 20 bp, Homo sapiens
cacatggcaaggggtctcct

SEQ ID NO: 3851086 - DNA, 14 bp, Homo sapiens
cacccactgtgcac

SEQ ID NO: 3851087 - DNA, 13 bp, Homo sapiens
cacctccttcctc

SEQ ID NO: 3851088 - DNA, 21 bp, Homo sapiens
cactgagacaaatcctaggct

SEQ ID NO: 3851089 - DNA, 14 bp, Homo sapiens
cactgagctgggtg

SEQ ID NO: 3851090 - DNA, 22 bp, Homo sapiens
cactttgagagggctgaaggga

SEQ ID NO: 3851091 - DNA, 19 bp, Homo sapiens
cagaaggagtctgatgctc

SEQ ID NO: 3851092 - DNA, 17 bp, Homo sapiens
cagagaacagctcccct

SEQ ID NO: 3851093 - DNA, 21 bp, Homo sapiens
cagagcctgtggccccgaggc

SEQ ID NO: 3851094 - DNA, 20 bp, Homo sapiens
cagagctgtcctcctggcac

SEQ ID NO: 3851095 - DNA, 14 bp, Homo sapiens
cagaggcagggcag

SEQ ID NO: 3851096 - DNA, 21 bp, Homo sapiens
cagagtagctgcttcctggac

SEQ ID NO: 3851097 - DNA, 16 bp, Homo sapiens
cagagttgtgcatgcc

SEQ ID NO: 3851098 - DNA, 22 bp, Homo sapiens
cagagttgtgcatgcccctgag

SEQ ID NO: 3851099 - DNA, 16 bp, Homo sapiens
cagcaaggcagtgagc

SEQ ID NO: 3851100 - DNA, 18 bp, Homo sapiens
cagcagaggcctgaggag

SEQ ID NO: 3851101 - DNA, 17 bp, Homo sapiens
cagcagggtagagagga

SEQ ID NO: 3851102 - DNA, 15 bp, Homo sapiens
cagccacttggcctc

SEQ ID NO: 3851103 - DNA, 18 bp, Homo sapiens
cagcccgtgatcccctgc

SEQ ID NO: 3851104 - DNA, 19 bp, Homo sapiens
cagcccgtgatcccctgct

SEQ ID NO: 3851105 - DNA, 18 bp, Homo sapiens
cagcgctgggccccaagg

SEQ ID NO: 3851106 - DNA, 15 bp, Homo sapiens
cagcggtcccagggg

SEQ ID NO: 3851107 - DNA, 21 bp, Homo sapiens
cagctagtggtggcttctcca

SEQ ID NO: 3851108 - DNA, 14 bp, Homo sapiens
cagctcccctagac

SEQ ID NO: 3851109 - DNA, 23 bp, Homo sapiens
caggactgtgggggcccctcagg

SEQ ID NO: 3851110 - DNA, 19 bp, Homo sapiens
caggctggggccaggggac

SEQ ID NO: 3851111 - DNA, 13 bp, Homo sapiens
cagggaactggga

SEQ ID NO: 3851112 - DNA, 15 bp, Homo sapiens
caggtcccctgccct

SEQ ID NO: 3851113 - DNA, 15 bp, Homo sapiens
caggtgcccccaggt

SEQ ID NO: 3851114 - DNA, 14 bp, Homo sapiens
cagtcctcaggcag

SEQ ID NO: 3851115 - DNA, 14 bp, Homo sapiens
cagtcctcctcagg

SEQ ID NO: 3851116 - DNA, 18 bp, Homo sapiens
cagtcctcctcaggagaa

SEQ ID NO: 3851117 - DNA, 13 bp, Homo sapiens
cagtggacggaga

SEQ ID NO: 3851118 - DNA, 16 bp, Homo sapiens
cagtggacggagagcc

SEQ ID NO: 3851119 - DNA, 17 bp, Homo sapiens
cagtggacggagagcct

SEQ ID NO: 3851120 - DNA, 12 bp, Homo sapiens
cagttcctggca

SEQ ID NO: 3851121 - DNA, 20 bp, Homo sapiens
catatgtgctatggagagga

SEQ ID NO: 3851122 - DNA, 15 bp, Homo sapiens
catgcccctgagtgt

SEQ ID NO: 3851123 - DNA, 13 bp, Homo sapiens
cattatttctgct

SEQ ID NO: 3851124 - DNA, 23 bp, Homo sapiens
catttcattatttctgcttcctg

SEQ ID NO: 3851125 - DNA, 18 bp, Homo sapiens
ccaccccgtccctcctct

SEQ ID NO: 3851126 - DNA, 18 bp, Homo sapiens
ccagagaacagctcccct

SEQ ID NO: 3851127 - DNA, 13 bp, Homo sapiens
ccagagattagcc

SEQ ID NO: 3851128 - DNA, 21 bp, Homo sapiens
ccagagctgtcctcctggcac

SEQ ID NO: 3851129 - DNA, 21 bp, Homo sapiens
ccagcctgctgtataagtaac

SEQ ID NO: 3851130 - DNA, 20 bp, Homo sapiens
ccagctgctgtgctgggtgc

SEQ ID NO: 3851131 - DNA, 21 bp, Homo sapiens
ccaggcactaagtctctagcc

SEQ ID NO: 3851132 - DNA, 14 bp, Homo sapiens
ccaggccagtgctg

SEQ ID NO: 3851133 - DNA, 16 bp, Homo sapiens
ccaggctggggccagg

SEQ ID NO: 3851134 - DNA, 18 bp, Homo sapiens
ccaggggaccttcctgtc

SEQ ID NO: 3851135 - DNA, 15 bp, Homo sapiens
ccaggggtggaggga

SEQ ID NO: 3851136 - DNA, 14 bp, Homo sapiens
ccaggtactgagtg

SEQ ID NO: 3851137 - DNA, 20 bp, Homo sapiens
ccaggtactgagtggggagt

SEQ ID NO: 3851138 - DNA, 23 bp, Homo sapiens
ccaggtgagacagcggtcccagg

SEQ ID NO: 3851139 - DNA, 20 bp, Homo sapiens
ccatatgtgctatggagagg

SEQ ID NO: 3851140 - DNA, 14 bp, Homo sapiens
ccatgggcaccagg

SEQ ID NO: 3851141 - DNA, 22 bp, Homo sapiens
ccccacctgcagcgctgggccc

SEQ ID NO: 3851142 - DNA, 20 bp, Homo sapiens
ccccagctgtatgaggagag

SEQ ID NO: 3851143 - DNA, 13 bp, Homo sapiens
cccccacctgcag

SEQ ID NO: 3851144 - DNA, 14 bp, Homo sapiens
cccctgcttctggc

SEQ ID NO: 3851145 - DNA, 16 bp, Homo sapiens
cccgaggctgggacac

SEQ ID NO: 3851146 - DNA, 19 bp, Homo sapiens
cccgaggctgggacactgt

SEQ ID NO: 3851147 - DNA, 21 bp, Homo sapiens
ccctaagctggggacagagaa

SEQ ID NO: 3851148 - DNA, 12 bp, Homo sapiens
ccctgagcctgg

SEQ ID NO: 3851149 - DNA, 14 bp, Homo sapiens
ccctgagcctggca

SEQ ID NO: 3851150 - DNA, 16 bp, Homo sapiens
ccctgaggctgtgagc

SEQ ID NO: 3851151 - DNA, 22 bp, Homo sapiens
ccctgggccatatgtgctatgg

SEQ ID NO: 3851152 - DNA, 15 bp, Homo sapiens
ccgaggctgggacac

SEQ ID NO: 3851153 - DNA, 15 bp, Homo sapiens
cctaccacccagccc

SEQ ID NO: 3851154 - DNA, 17 bp, Homo sapiens
cctaggctcctgggagg

SEQ ID NO: 3851155 - DNA, 14 bp, Homo sapiens
cctcaaacttcaga

SEQ ID NO: 3851156 - DNA, 21 bp, Homo sapiens
cctcatccccaccccacctca

SEQ ID NO: 3851157 - DNA, 15 bp, Homo sapiens
cctcctggcacctga

SEQ ID NO: 3851158 - DNA, 13 bp, Homo sapiens
cctctacggcccc

SEQ ID NO: 3851159 - DNA, 16 bp, Homo sapiens
cctctttctcccttct

SEQ ID NO: 3851160 - DNA, 14 bp, Homo sapiens
cctgagcctggcag

SEQ ID NO: 3851161 - DNA, 22 bp, Homo sapiens
ttctcttttgtcctcacatgca

SEQ ID NO: 3851162 - DNA, 15 bp, Homo sapiens
tttctcccttctgct

SEQ ID NO: 3851163 - DNA, 16 bp, Homo sapiens
tttggggctggcccca

SEQ ID NO: 3851164 - DNA, 14 bp, Homo sapiens
aaattggagctcat

SEQ ID NO: 3851165 - DNA, 22 bp, Homo sapiens
aaattggagctcattttccaca

SEQ ID NO: 3851166 - DNA, 14 bp, Homo sapiens
aacaaaagcccttt

SEQ ID NO: 3851167 - DNA, 17 bp, Homo sapiens
aacacatggctgggcct

SEQ ID NO: 3851168 - DNA, 18 bp, Homo sapiens
aactgggattaagtgaga

SEQ ID NO: 3851169 - DNA, 22 bp, Homo sapiens
aagacagtgtataaggaacatc

SEQ ID NO: 3851170 - DNA, 23 bp, Homo sapiens
aagccctttgtgggacccgggcc

SEQ ID NO: 3851171 - DNA, 19 bp, Homo sapiens
aagctcagctgccttcctg

SEQ ID NO: 3851172 - DNA, 19 bp, Homo sapiens
aataaaaattggagctcat

SEQ ID NO: 3851173 - DNA, 19 bp, Homo sapiens
aatctggctcctcctggaa

SEQ ID NO: 3851174 - DNA, 17 bp, Homo sapiens
aattggagctcattttc

SEQ ID NO: 3851175 - DNA, 18 bp, Homo sapiens
aatttcccccacctgcag

SEQ ID NO: 3851176 - DNA, 19 bp, Homo sapiens
acaatgcctcccagctaga

SEQ ID NO: 3851177 - DNA, 14 bp, Homo sapiens
acagacccctgcct

SEQ ID NO: 3851178 - DNA, 19 bp, Homo sapiens
accagagaacagctcccct

SEQ ID NO: 3851179 - DNA, 13 bp, Homo sapiens
acctccttcctcc

SEQ ID NO: 3851180 - DNA, 14 bp, Homo sapiens
acggagagccttgg

SEQ ID NO: 3851181 - DNA, 14 bp, Homo sapiens
acgtgcgcgcccag

SEQ ID NO: 3851182 - DNA, 15 bp, Homo sapiens
actcattgctggagg

SEQ ID NO: 3851183 - DNA, 18 bp, Homo sapiens
actccaggggtggaggga

SEQ ID NO: 3851184 - DNA, 13 bp, Homo sapiens
actgagctgggga

SEQ ID NO: 3851185 - DNA, 15 bp, Homo sapiens
actgagctggggagg

SEQ ID NO: 3851186 - DNA, 16 bp, Homo sapiens
actgtgcaccaggcac

SEQ ID NO: 3851187 - DNA, 22 bp, Homo sapiens
actgtgggggcccctcaggtca

SEQ ID NO: 3851188 - DNA, 21 bp, Homo sapiens
actgtgtggccctggacaagc

SEQ ID NO: 3851189 - DNA, 14 bp, Homo sapiens
acttctccaggcag

SEQ ID NO: 3851190 - DNA, 16 bp, Homo sapiens
agacagcggtcccagg

SEQ ID NO: 3851191 - DNA, 16 bp, Homo sapiens
agacatggcctctgga

SEQ ID NO: 3851192 - DNA, 13 bp, Homo sapiens
agagcagcctgct

SEQ ID NO: 3851193 - DNA, 19 bp, Homo sapiens
agagcttcaggccccagga

SEQ ID NO: 3851194 - DNA, 17 bp, Homo sapiens
agagggaaactctggag

SEQ ID NO: 3851195 - DNA, 19 bp, Homo sapiens
agcaggtgcccccaggtga

SEQ ID NO: 3851196 - DNA, 18 bp, Homo sapiens
agcatggagacaggtaga

SEQ ID NO: 3851197 - DNA, 18 bp, Homo sapiens
agcccgtgatcccctgct

SEQ ID NO: 3851198 - DNA, 23 bp, Homo sapiens
agcccgtgatcccctgcttctgg

SEQ ID NO: 3851199 - DNA, 15 bp, Homo sapiens
agccctcttgcccag

SEQ ID NO: 3851200 - DNA, 18 bp, Homo sapiens
agccctcttgcccagcac

SEQ ID NO: 3851201 - DNA, 16 bp, Homo sapiens
agccctgagcctggca

SEQ ID NO: 3851202 - DNA, 16 bp, Homo sapiens
agcctctattgcccag

SEQ ID NO: 3851203 - DNA, 24 bp, Homo sapiens
agcctcttaacctcttcttaccct

SEQ ID NO: 3851204 - DNA, 23 bp, Homo sapiens
agccttggcgagggcagcagggt

SEQ ID NO: 3851205 - DNA, 15 bp, Homo sapiens
agctcactgagctgg

SEQ ID NO: 3851206 - DNA, 15 bp, Homo sapiens
agctgcttcctggac

SEQ ID NO: 3851207 - DNA, 17 bp, Homo sapiens
agctggggacagagaag

SEQ ID NO: 3851208 - DNA, 17 bp, Homo sapiens
agctgtcctcctggcac

SEQ ID NO: 3851209 - DNA, 21 bp, Homo sapiens
aggaaagagggagcaggtgcc

SEQ ID NO: 3851210 - DNA, 22 bp, Homo sapiens
aggaatctctgttccttctctg

SEQ ID NO: 3851211 - DNA, 18 bp, Homo sapiens
aggaggctgccggaggga

SEQ ID NO: 3851212 - DNA, 19 bp, Homo sapiens
aggaggggctgcagcagag

SEQ ID NO: 3851213 - DNA, 18 bp, Homo sapiens
aggagtggcaggaaagag

SEQ ID NO: 3851214 - DNA, 12 bp, Homo sapiens
aggcagggcagc

SEQ ID NO: 3851215 - DNA, 20 bp, Homo sapiens
aggcagggcagcatggagac

SEQ ID NO: 3851216 - DNA, 12 bp, Homo sapiens
aggcccccagcc

SEQ ID NO: 3851217 - DNA, 12 bp, Homo sapiens
aggccctggcag

SEQ ID NO: 3851218 - DNA, 13 bp, Homo sapiens
aggctcctgggag

SEQ ID NO: 3851219 - DNA, 15 bp, Homo sapiens
aggctcctgggaggc

SEQ ID NO: 3851220 - DNA, 17 bp, Homo sapiens
aggctcctgggaggccc

SEQ ID NO: 3851221 - DNA, 13 bp, Homo sapiens
aggctgccctggg

SEQ ID NO: 3851222 - DNA, 11 bp, Homo sapiens
aggctgtgagc

SEQ ID NO: 3851223 - DNA, 22 bp, Homo sapiens
agggaaactctggagagcctgc

SEQ ID NO: 3851224 - DNA, 13 bp, Homo sapiens
agggaactgggaa

SEQ ID NO: 3851225 - DNA, 17 bp, Homo sapiens
agggagcaggtgccccc

SEQ ID NO: 3851226 - DNA, 17 bp, Homo sapiens
agggagccctgagcctg

SEQ ID NO: 3851227 - DNA, 22 bp, Homo sapiens
agggagccctgagcctggcagg

SEQ ID NO: 3851228 - DNA, 21 bp, Homo sapiens
aggggcctgaaaaggaaggac

SEQ ID NO: 3851229 - DNA, 15 bp, Homo sapiens
aggggtctccttgga

SEQ ID NO: 3851230 - DNA, 12 bp, Homo sapiens
aggggtggaggg

SEQ ID NO: 3851231 - DNA, 13 bp, Homo sapiens
agggtggagtcag

SEQ ID NO: 3851232 - DNA, 21 bp, Homo sapiens
aggtccaaaaaaggctgccct

SEQ ID NO: 3851233 - DNA, 14 bp, Homo sapiens
aggtcccctgccct

SEQ ID NO: 3851234 - DNA, 17 bp, Homo sapiens
aggtgcccccaggtgag

SEQ ID NO: 3851235 - DNA, 17 bp, Homo sapiens
agtagctgcttcctgga

SEQ ID NO: 3851236 - DNA, 21 bp, Homo sapiens
agtcattgtggatagagcagc

SEQ ID NO: 3851237 - DNA, 16 bp, Homo sapiens
agtggtggcttctcca

SEQ ID NO: 3851238 - DNA, 20 bp, Homo sapiens
agtttcacaagtgagccctc

SEQ ID NO: 3851239 - DNA, 16 bp, Homo sapiens
atacaatgcctcccag

SEQ ID NO: 3851240 - DNA, 15 bp, Homo sapiens
atagagcagcctgct

SEQ ID NO: 3851241 - DNA, 15 bp, Homo sapiens
atccccaccccacct

SEQ ID NO: 3851242 - DNA, 11 bp, Homo sapiens
atccctccctc

SEQ ID NO: 3851243 - DNA, 13 bp, Homo sapiens
atccgcttctcct

SEQ ID NO: 3851244 - DNA, 13 bp, Homo sapiens
atctaccttcctt

SEQ ID NO: 3851245 - DNA, 12 bp, Homo sapiens
atctcactctcc

SEQ ID NO: 3851246 - DNA, 17 bp, Homo sapiens
atgacttctccaggcag

SEQ ID NO: 3851247 - DNA, 20 bp, Homo sapiens
atgagtgtgggtgccagtcc

SEQ ID NO: 3851248 - DNA, 18 bp, Homo sapiens
attggcagttcctggcat

SEQ ID NO: 3851249 - DNA, 12 bp, Homo sapiens
attgttcttccc

SEQ ID NO: 3851250 - DNA, 13 bp, Homo sapiens
atttctgcttcct

SEQ ID NO: 3851251 - DNA, 12 bp, Homo sapiens
attttccacatg

SEQ ID NO: 3851252 - DNA, 19 bp, Homo sapiens
caaaggagagtcctgggag

SEQ ID NO: 3851253 - DNA, 19 bp, Homo sapiens
caaatattgttcttcccat

SEQ ID NO: 3851254 - DNA, 15 bp, Homo sapiens
caacatcccttacct

SEQ ID NO: 3851255 - DNA, 22 bp, Homo sapiens
caacccactgtcttgcagtgga

SEQ ID NO: 3851256 - DNA, 14 bp, Homo sapiens
caagatccaggcag

SEQ ID NO: 3851257 - DNA, 21 bp, Homo sapiens
caagatccaggcagaaggaga

SEQ ID NO: 3851258 - DNA, 12 bp, Homo sapiens
caaggcagtgag

SEQ ID NO: 3851259 - DNA, 17 bp, Homo sapiens
caaggggtctccttgga

SEQ ID NO: 3851260 - DNA, 15 bp, Homo sapiens
caagtgtgcatggct

SEQ ID NO: 3851261 - DNA, 21 bp, Homo sapiens
cacacacctatggctggctgg

SEQ ID NO: 3851262 - DNA, 17 bp, Homo sapiens
cacctatggctggctgg

SEQ ID NO: 3851263 - DNA, 17 bp, Homo sapiens
cacctgagtgtccttgc

SEQ ID NO: 3851264 - DNA, 14 bp, Homo sapiens
cactgggaggggga

SEQ ID NO: 3851265 - DNA, 17 bp, Homo sapiens
cactgtcttgcagtgga

SEQ ID NO: 3851266 - DNA, 16 bp, Homo sapiens
cagacagaggcagggc

SEQ ID NO: 3851267 - DNA, 17 bp, Homo sapiens
cagagctgtcctcctgg

SEQ ID NO: 3851268 - DNA, 16 bp, Homo sapiens
cagaggcagggcagca

SEQ ID NO: 3851269 - DNA, 19 bp, Homo sapiens
cagccacttggcctcacta

SEQ ID NO: 3851270 - DNA, 15 bp, Homo sapiens
cagcccaacccactg

SEQ ID NO: 3851271 - DNA, 19 bp, Homo sapiens
cagccctatccattctctc

SEQ ID NO: 3851272 - DNA, 19 bp, Homo sapiens
cagcgctgggccccaaggc

SEQ ID NO: 3851273 - DNA, 15 bp, Homo sapiens
cagctgccttcctgg

SEQ ID NO: 3851274 - DNA, 18 bp, Homo sapiens
cagctgccttcctggggc

SEQ ID NO: 3851275 - DNA, 17 bp, Homo sapiens
cagctgtatgaggagag

SEQ ID NO: 3851276 - DNA, 21 bp, Homo sapiens
caggaaagagggagcaggtgc

SEQ ID NO: 3851277 - DNA, 14 bp, Homo sapiens
caggaccagagaag

SEQ ID NO: 3851278 - DNA, 12 bp, Homo sapiens
caggccccagga

SEQ ID NO: 3851279 - DNA, 13 bp, Homo sapiens
caggccccaggac

SEQ ID NO: 3851280 - DNA, 19 bp, Homo sapiens
caggggtggagggaaattg

SEQ ID NO: 3851281 - DNA, 18 bp, Homo sapiens
caggtactgagtggggag

SEQ ID NO: 3851282 - DNA, 16 bp, Homo sapiens
caggtgcccccaggtg

SEQ ID NO: 3851283 - DNA, 18 bp, Homo sapiens
catatgtgctatggagag

SEQ ID NO: 3851284 - DNA, 20 bp, Homo sapiens
ccagacagaggcagggcagc

SEQ ID NO: 3851285 - DNA, 23 bp, Homo sapiens
ccagccgcaatctggctcctcct

SEQ ID NO: 3851286 - DNA, 16 bp, Homo sapiens
ccagctgtatgaggag

SEQ ID NO: 3851287 - DNA, 13 bp, Homo sapiens
ccaggtgagacag

SEQ ID NO: 3851288 - DNA, 15 bp, Homo sapiens
ccagtcctcctcagg

SEQ ID NO: 3851289 - DNA, 22 bp, Homo sapiens
ccatccaagaaagacagtgtat

SEQ ID NO: 3851290 - DNA, 13 bp, Homo sapiens
ccatgctctctgt

SEQ ID NO: 3851291 - DNA, 15 bp, Homo sapiens
cccactgtcttgcag

SEQ ID NO: 3851292 - DNA, 14 bp, Homo sapiens
cccagcgcagagta

SEQ ID NO: 3851293 - DNA, 21 bp, Homo sapiens
cccatgctctctgtggcctcc

SEQ ID NO: 3851294 - DNA, 13 bp, Homo sapiens
ccccaacctgcaa

SEQ ID NO: 3851295 - DNA, 20 bp, Homo sapiens
ccccaatagctagtgacagc

SEQ ID NO: 3851296 - DNA, 15 bp, Homo sapiens
ccccagtcctcaggc

SEQ ID NO: 3851297 - DNA, 12 bp, Homo sapiens
cccccacctgca

SEQ ID NO: 3851298 - DNA, 23 bp, Homo sapiens
cccccacctgcagcgctgggccc

SEQ ID NO: 3851299 - DNA, 21 bp, Homo sapiens
cccctagacatggcctctgga

SEQ ID NO: 3851300 - DNA, 15 bp, Homo sapiens
ccctgagcctggcag

SEQ ID NO: 3851301 - DNA, 15 bp, Homo sapiens
ccctgaggctgtgag

SEQ ID NO: 3851302 - DNA, 15 bp, Homo sapiens
ccctgcttctggctc

SEQ ID NO: 3851303 - DNA, 18 bp, Homo sapiens
cccttgcaccccttcctc

SEQ ID NO: 3851304 - DNA, 15 bp, Homo sapiens
ccgcaatctggctcc

SEQ ID NO: 3851305 - DNA, 18 bp, Homo sapiens
ccggagggagccctgagc

SEQ ID NO: 3851306 - DNA, 18 bp, Homo sapiens
cctacgttggtgcaagtg

SEQ ID NO: 3851307 - DNA, 16 bp, Homo sapiens
cctagacatggcctct

SEQ ID NO: 3851308 - DNA, 19 bp, Homo sapiens
cctatcttttctcccacct

SEQ ID NO: 3851309 - DNA, 11 bp, Homo sapiens
cctcctggcac

SEQ ID NO: 3851310 - DNA, 12 bp, Homo sapiens
cctccttcctcc

SEQ ID NO: 3851311 - DNA, 20 bp, Homo sapiens
cctctagaggctttgagaag

SEQ ID NO: 3851312 - DNA, 14 bp, Homo sapiens
cctgaaaaggaagg

SEQ ID NO: 3851313 - DNA, 15 bp, Homo sapiens
cctgaaaaggaagga

SEQ ID NO: 3851314 - DNA, 20 bp, Homo sapiens
cctgaaaaggaaggaccagg

SEQ ID NO: 3851315 - DNA, 15 bp, Homo sapiens
cctgagcctggcagg

SEQ ID NO: 3851316 - DNA, 12 bp, Homo sapiens
cctgccctgagg

SEQ ID NO: 3851317 - DNA, 15 bp, Homo sapiens
cctggcacctgagtg

SEQ ID NO: 3851318 - DNA, 15 bp, Homo sapiens
cctggcaggtcccct

SEQ ID NO: 3851319 - DNA, 18 bp, Homo sapiens
cctggcaggtcccctgcc

SEQ ID NO: 3851320 - DNA, 12 bp, Homo sapiens
cctggcccagcc

SEQ ID NO: 3851321 - DNA, 16 bp, Homo sapiens
cctgggagccactggg

SEQ ID NO: 3851322 - DNA, 19 bp, Homo sapiens
cctgggaggccctggcaga

SEQ ID NO: 3851323 - DNA, 19 bp, Homo sapiens
ccttcctccccaacctgca

SEQ ID NO: 3851324 - DNA, 21 bp, Homo sapiens
ccttcctcctaccacccagcc

SEQ ID NO: 3851325 - DNA, 21 bp, Homo sapiens
cgcaatctggctcctcctgga

SEQ ID NO: 3851326 - DNA, 15 bp, Homo sapiens
cggagggagccctga

SEQ ID NO: 3851327 - DNA, 16 bp, Homo sapiens
cggggaggaggctgcc

SEQ ID NO: 3851328 - DNA, 14 bp, Homo sapiens
cgtgatcccctgct

SEQ ID NO: 3851329 - DNA, 15 bp, Homo sapiens
cgtgcgcgcccaggc

SEQ ID NO: 3851330 - DNA, 19 bp, Homo sapiens
cgtggagaattggccagag

SEQ ID NO: 3851331 - DNA, 12 bp, Homo sapiens
cgttggtgcaag

SEQ ID NO: 3851332 - DNA, 18 bp, Homo sapiens
ctagaggctttgagaagc

SEQ ID NO: 3851333 - DNA, 14 bp, Homo sapiens
ctagtgtgcaagtg

SEQ ID NO: 3851334 - DNA, 15 bp, Homo sapiens
ctagtgtgcaagtgt

SEQ ID NO: 3851335 - DNA, 16 bp, Homo sapiens
ctcaacatcccttacc

SEQ ID NO: 3851336 - DNA, 13 bp, Homo sapiens
ctcactctcccca

SEQ ID NO: 3851337 - DNA, 22 bp, Homo sapiens
ctcactctccccagtcctcagg

SEQ ID NO: 3851338 - DNA, 15 bp, Homo sapiens
ctcacttccccttgc

SEQ ID NO: 3851339 - DNA, 19 bp, Homo sapiens
ctcacttccccttgcaccc

SEQ ID NO: 3851340 - DNA, 19 bp, Homo sapiens
ctccagagctgtcctcctg

SEQ ID NO: 3851341 - DNA, 23 bp, Homo sapiens
ctccagagctgtcctcctggcac

SEQ ID NO: 3851342 - DNA, 12 bp, Homo sapiens
ctccagcctgct

SEQ ID NO: 3851343 - DNA, 14 bp, Homo sapiens
ctcccacctccttc

SEQ ID NO: 3851344 - DNA, 16 bp, Homo sapiens
ctcccacctccttcct

SEQ ID NO: 3851345 - DNA, 14 bp, Homo sapiens
ctccccaacctgca

SEQ ID NO: 3851346 - DNA, 15 bp, Homo sapiens
ctccccaacctgcaa

SEQ ID NO: 3851347 - DNA, 19 bp, Homo sapiens
ctccccagtcctcaggcag

SEQ ID NO: 3851348 - DNA, 15 bp, Homo sapiens
ctcctctcccgcagg

SEQ ID NO: 3851349 - DNA, 22 bp, Homo sapiens
ctcctgggaggccctggcagaa

SEQ ID NO: 3851350 - DNA, 14 bp, Homo sapiens
ctctccagcctgct

SEQ ID NO: 3851351 - DNA, 12 bp, Homo sapiens
ctctggagagcc

SEQ ID NO: 3851352 - DNA, 16 bp, Homo sapiens
ctctggagagcctgca

SEQ ID NO: 3851353 - DNA, 13 bp, Homo sapiens
ctctgtggcctcc

SEQ ID NO: 3851354 - DNA, 15 bp, Homo sapiens
ctctgttccttctct

SEQ ID NO: 3851355 - DNA, 13 bp, Homo sapiens
ctcttgcccagca

SEQ ID NO: 3851356 - DNA, 23 bp, Homo sapiens
ctgagcctggcaggtcccctgcc

SEQ ID NO: 3851357 - DNA, 12 bp, Homo sapiens
ctgagctgggga

SEQ ID NO: 3851358 - DNA, 18 bp, Homo sapiens
ctgagctggggagggagg

SEQ ID NO: 3851359 - DNA, 19 bp, Homo sapiens
ctgcagcagaggcctgagg

SEQ ID NO: 3851360 - DNA, 21 bp, Homo sapiens
ctgcagcagaggcctgaggag

SEQ ID NO: 3851361 - DNA, 16 bp, Homo sapiens
ctgccttcctggggct

SEQ ID NO: 3851362 - DNA, 15 bp, Homo sapiens
ctgcttctggctcct

SEQ ID NO: 3851363 - DNA, 16 bp, Homo sapiens
ctggaggtagagaggt

SEQ ID NO: 3851364 - DNA, 13 bp, Homo sapiens
ctggctcctcctg

SEQ ID NO: 3851365 - DNA, 15 bp, Homo sapiens
ctggctcctcctgga

SEQ ID NO: 3851366 - DNA, 15 bp, Homo sapiens
ctgggaggccctggc

SEQ ID NO: 3851367 - DNA, 17 bp, Homo sapiens
ctgggaggccctggcag

SEQ ID NO: 3851368 - DNA, 19 bp, Homo sapiens
ctgggaggccctggcagaa

SEQ ID NO: 3851369 - DNA, 21 bp, Homo sapiens
ctgggagggggacccgtggag

SEQ ID NO: 3851370 - DNA, 13 bp, Homo sapiens
ctggggccagggg

SEQ ID NO: 3851371 - DNA, 22 bp, Homo sapiens
tgagacagcggtcccaggggcc

SEQ ID NO: 3851372 - DNA, 17 bp, Homo sapiens
tgagcagctagtggtgg

SEQ ID NO: 3851373 - DNA, 14 bp, Homo sapiens
tgagctatgagccc

SEQ ID NO: 3851374 - DNA, 12 bp, Homo sapiens
tgagctggggag

SEQ ID NO: 3851375 - DNA, 12 bp, Homo sapiens
tgatcttcctca

SEQ ID NO: 3851376 - DNA, 21 bp, Homo sapiens
tgcaagtgtgttcatccccaa

SEQ ID NO: 3851377 - DNA, 16 bp, Homo sapiens
tgcagagttgtgcatg

SEQ ID NO: 3851378 - DNA, 20 bp, Homo sapiens
tgcagcagaggcctgaggag

SEQ ID NO: 3851379 - DNA, 21 bp, Homo sapiens
tgccaaatgactttgcacctg

SEQ ID NO: 3851380 - DNA, 13 bp, Homo sapiens
tgccagtcctcct

SEQ ID NO: 3851381 - DNA, 15 bp, Homo sapiens
tgccagtcctcctca

SEQ ID NO: 3851382 - DNA, 11 bp, Homo sapiens
gatttgcacct

SEQ ID NO: 3851383 - DNA, 20 bp, Homo sapiens
gcaaaggagagtcctgggag

SEQ ID NO: 3851384 - DNA, 17 bp, Homo sapiens
gcaatctggctcctcct

SEQ ID NO: 3851385 - DNA, 15 bp, Homo sapiens
gcacccactgtgcac

SEQ ID NO: 3851386 - DNA, 17 bp, Homo sapiens
gcaccccttcctcccca

SEQ ID NO: 3851387 - DNA, 18 bp, Homo sapiens
gcagaggcctgaggagtg

SEQ ID NO: 3851388 - DNA, 21 bp, Homo sapiens
gcagagtagctgcttcctgga

SEQ ID NO: 3851389 - DNA, 19 bp, Homo sapiens
gcaggaaagagggagcagg

SEQ ID NO: 3851390 - DNA, 15 bp, Homo sapiens
gcaggtgcccccagg

SEQ ID NO: 3851391 - DNA, 23 bp, Homo sapiens
gcaggtgcccccaggtgagacag

SEQ ID NO: 3851392 - DNA, 20 bp, Homo sapiens
gcagtgagctatgagcccag

SEQ ID NO: 3851393 - DNA, 18 bp, Homo sapiens
gcagtggacggagagcct

SEQ ID NO: 3851394 - DNA, 21 bp, Homo sapiens
gcatctcttgtgtaccagctg

SEQ ID NO: 3851395 - DNA, 14 bp, Homo sapiens
gcatggctggggac

SEQ ID NO: 3851396 - DNA, 21 bp, Homo sapiens
gccaagactcattgctggagg

SEQ ID NO: 3851397 - DNA, 14 bp, Homo sapiens
gccacttggcctca

SEQ ID NO: 3851398 - DNA, 23 bp, Homo sapiens
gccagagcctgtggccccgaggc

SEQ ID NO: 3851399 - DNA, 15 bp, Homo sapiens
gccagtgctgtgagc

SEQ ID NO: 3851400 - DNA, 15 bp, Homo sapiens
gcccagattggagtc

SEQ ID NO: 3851401 - DNA, 18 bp, Homo sapiens
gcccaggccagtgctgtg

SEQ ID NO: 3851402 - DNA, 15 bp, Homo sapiens
gccccatcctggccc

SEQ ID NO: 3851403 - DNA, 21 bp, Homo sapiens
gcccccatgctctctgtggcc

SEQ ID NO: 3851404 - DNA, 16 bp, Homo sapiens
gccccccagcgcagag

SEQ ID NO: 3851405 - DNA, 15 bp, Homo sapiens
gccgcaatctggctc

SEQ ID NO: 3851406 - DNA, 20 bp, Homo sapiens
gcctacgttggtgcaagtgt

SEQ ID NO: 3851407 - DNA, 12 bp, Homo sapiens
gcctcccagcta

SEQ ID NO: 3851408 - DNA, 16 bp, Homo sapiens
gcctggcaggtcccct

SEQ ID NO: 3851409 - DNA, 14 bp, Homo sapiens
gcgagggcagcagg

SEQ ID NO: 3851410 - DNA, 12 bp, Homo sapiens
gcgcagagtagc

SEQ ID NO: 3851411 - DNA, 13 bp, Homo sapiens
gcgctcaggcatg

SEQ ID NO: 3851412 - DNA, 18 bp, Homo sapiens
gctagactgtaagccctt

SEQ ID NO: 3851413 - DNA, 17 bp, Homo sapiens
gctatgagcccagcatg

SEQ ID NO: 3851414 - DNA, 24 bp, Homo sapiens
gctcccctagacatggcctctgga

SEQ ID NO: 3851415 - DNA, 17 bp, Homo sapiens
gctctcaggaccagaga

SEQ ID NO: 3851416 - DNA, 18 bp, Homo sapiens
gctctttcctgtcttcct

SEQ ID NO: 3851417 - DNA, 11 bp, Homo sapiens
gctgccctggg

SEQ ID NO: 3851418 - DNA, 17 bp, Homo sapiens
gctgccggagggagccc

SEQ ID NO: 3851419 - DNA, 22 bp, Homo sapiens
gctgccggagggagccctgagc

SEQ ID NO: 3851420 - DNA, 17 bp, Homo sapiens
gctgctgtgctgggtgc

SEQ ID NO: 3851421 - DNA, 16 bp, Homo sapiens
gctggaggtagagagg

SEQ ID NO: 3851422 - DNA, 21 bp, Homo sapiens
gctggccccatcctggcccag

SEQ ID NO: 3851423 - DNA, 22 bp, Homo sapiens
gctggccccatcctggcccagc

SEQ ID NO: 3851424 - DNA, 12 bp, Homo sapiens
gctggggccagg

SEQ ID NO: 3851425 - DNA, 15 bp, Homo sapiens
gctggtttctgccct

SEQ ID NO: 3851426 - DNA, 21 bp, Homo sapiens
gctgtgagcaggcggggagga

SEQ ID NO: 3851427 - DNA, 17 bp, Homo sapiens
gctgtgtgtgcccggga

SEQ ID NO: 3851428 - DNA, 16 bp, Homo sapiens
gcttcaggccccagga

SEQ ID NO: 3851429 - DNA, 16 bp, Homo sapiens
gcttctcctgcagtgg

SEQ ID NO: 3851430 - DNA, 18 bp, Homo sapiens
ggaaactctggagagcct

SEQ ID NO: 3851431 - DNA, 19 bp, Homo sapiens
ggaaggaccaggctggggc

SEQ ID NO: 3851432 - DNA, 14 bp, Homo sapiens
ggacaagggctgct

SEQ ID NO: 3851433 - DNA, 22 bp, Homo sapiens
ggaccaggctggggccagggga

SEQ ID NO: 3851434 - DNA, 21 bp, Homo sapiens
ggactgtgggggcccctcagg

SEQ ID NO: 3851435 - DNA, 20 bp, Homo sapiens
ggagagcttcaggccccagg

SEQ ID NO: 3851436 - DNA, 15 bp, Homo sapiens
ggagagtcctgggag

SEQ ID NO: 3851437 - DNA, 19 bp, Homo sapiens
ggagcaggtgcccccaggt

SEQ ID NO: 3851438 - DNA, 20 bp, Homo sapiens
ggagccactgggagggggac

SEQ ID NO: 3851439 - DNA, 18 bp, Homo sapiens
ggagccctgagcctggca

SEQ ID NO: 3851440 - DNA, 22 bp, Homo sapiens
ggaggggctgcagcagaggcct

SEQ ID NO: 3851441 - DNA, 13 bp, Homo sapiens
ggatagagcagcc

SEQ ID NO: 3851442 - DNA, 15 bp, Homo sapiens
ggcagaaggagatgg

SEQ ID NO: 3851443 - DNA, 20 bp, Homo sapiens
ggcagatctgagtctagaac

SEQ ID NO: 3851444 - DNA, 15 bp, Homo sapiens
ggcagcagcttttcc

SEQ ID NO: 3851445 - DNA, 17 bp, Homo sapiens
ggcagcatggagacagg

SEQ ID NO: 3851446 - DNA, 11 bp, Homo sapiens
ggcagggcagc

SEQ ID NO: 3851447 - DNA, 15 bp, Homo sapiens
ggcagttcctggcat

SEQ ID NO: 3851448 - DNA, 21 bp, Homo sapiens
ggccatatgtgctatggagag

SEQ ID NO: 3851449 - DNA, 17 bp, Homo sapiens
ggccctggcagaagcca

SEQ ID NO: 3851450 - DNA, 22 bp, Homo sapiens
ggcctgaaaaggaaggaccagg

SEQ ID NO: 3851451 - DNA, 16 bp, Homo sapiens
ggctcctgggaggccc

SEQ ID NO: 3851452 - DNA, 22 bp, Homo sapiens
ggctgccggagggagccctgag

SEQ ID NO: 3851453 - DNA, 11 bp, Homo sapiens
ggctggcccca

SEQ ID NO: 3851454 - DNA, 20 bp, Homo sapiens
ggctggccccatcctggccc

SEQ ID NO: 3851455 - DNA, 19 bp, Homo sapiens
ggctgggcaaggcgctcag

SEQ ID NO: 3851456 - DNA, 15 bp, Homo sapiens
ggctggtcctgggag

SEQ ID NO: 3851457 - DNA, 13 bp, Homo sapiens
gggacccgggcct

SEQ ID NO: 3851458 - DNA, 13 bp, Homo sapiens
gggactgagctgg

SEQ ID NO: 3851459 - DNA, 17 bp, Homo sapiens
gggactgagctggggag

SEQ ID NO: 3851460 - DNA, 21 bp, Homo sapiens
gggcagcagggtagagaggac

SEQ ID NO: 3851461 - DNA, 12 bp, Homo sapiens
gggcccctcagg

SEQ ID NO: 3851462 - DNA, 15 bp, Homo sapiens
gggctgcagcagagg

SEQ ID NO: 3851463 - DNA, 18 bp, Homo sapiens
ggggactgagctggggag

SEQ ID NO: 3851464 - DNA, 23 bp, Homo sapiens
ggggcctgaaaaggaaggaccag

SEQ ID NO: 3851465 - DNA, 18 bp, Homo sapiens
ggggctgcagcagaggcc

SEQ ID NO: 3851466 - DNA, 19 bp, Homo sapiens
gggtctccacatccccagc

SEQ ID NO: 3851467 - DNA, 20 bp, Homo sapiens
ggtaagagggaaactctgga

SEQ ID NO: 3851468 - DNA, 20 bp, Homo sapiens
ggtgagacagcggtcccagg

SEQ ID NO: 3851469 - DNA, 17 bp, Homo sapiens
ggtttggggctggcccc

SEQ ID NO: 3851470 - DNA, 21 bp, Homo sapiens
gtaagagggaaactctggaga

SEQ ID NO: 3851471 - DNA, 18 bp, Homo sapiens
gtatgaggagagcttcag

SEQ ID NO: 3851472 - DNA, 13 bp, Homo sapiens
gtcctcctggcac

SEQ ID NO: 3851473 - DNA, 10 bp, Homo sapiens
gtcctgggag

SEQ ID NO: 3851474 - DNA, 17 bp, Homo sapiens
gtctccacatccccagc

SEQ ID NO: 3851475 - DNA, 18 bp, Homo sapiens
gtctccgcctttctaatc

SEQ ID NO: 3851476 - DNA, 12 bp, Homo sapiens
gtctgcctctcc

SEQ ID NO: 3851477 - DNA, 20 bp, Homo sapiens
gtcttgcagtggacggagag

SEQ ID NO: 3851478 - DNA, 19 bp, Homo sapiens
cagccgcaatctggctcct

SEQ ID NO: 3851479 - DNA, 24 bp, Homo sapiens
cagccgcaatctggctcctcctgg

SEQ ID NO: 3851480 - DNA, 14 bp, Homo sapiens
cagcctgctgctct

SEQ ID NO: 3851481 - DNA, 23 bp, Homo sapiens
cagcgcagagtagctgcttcctg

SEQ ID NO: 3851482 - DNA, 16 bp, Homo sapiens
cagctgtatgaggaga

SEQ ID NO: 3851483 - DNA, 16 bp, Homo sapiens
caggaaagagggagca

SEQ ID NO: 3851484 - DNA, 18 bp, Homo sapiens
caggagaaggggaaggga

SEQ ID NO: 3851485 - DNA, 18 bp, Homo sapiens
caggcatatgagtgcgca

SEQ ID NO: 3851486 - DNA, 18 bp, Homo sapiens
caggctggggccagggga

SEQ ID NO: 3851487 - DNA, 14 bp, Homo sapiens
cagggtagagagga

SEQ ID NO: 3851488 - DNA, 14 bp, Homo sapiens
caggtactgagtgg

SEQ ID NO: 3851489 - DNA, 21 bp, Homo sapiens
caggtagtatatggtggagcc

SEQ ID NO: 3851490 - DNA, 22 bp, Homo sapiens
caggtagtatatggtggagcca

SEQ ID NO: 3851491 - DNA, 19 bp, Homo sapiens
caggtcccctgccctgagg

SEQ ID NO: 3851492 - DNA, 20 bp, Homo sapiens
caggtcccctgccctgaggc

SEQ ID NO: 3851493 - DNA, 17 bp, Homo sapiens
caggtgcccccaggtga

SEQ ID NO: 3851494 - DNA, 16 bp, Homo sapiens
cagtcctcctcaggag

SEQ ID NO: 3851495 - DNA, 16 bp, Homo sapiens
cagtgagctatgagcc

SEQ ID NO: 3851496 - DNA, 14 bp, Homo sapiens
cagtggacggagag

SEQ ID NO: 3851497 - DNA, 18 bp, Homo sapiens
cagtggacggagagcctt

SEQ ID NO: 3851498 - DNA, 13 bp, Homo sapiens
cagttcctggcat

SEQ ID NO: 3851499 - DNA, 12 bp, Homo sapiens
catcctggccca

SEQ ID NO: 3851500 - DNA, 20 bp, Homo sapiens
catctatgctctttcctgtc

SEQ ID NO: 3851501 - DNA, 19 bp, Homo sapiens
catgatttttccactgaga

SEQ ID NO: 3851502 - DNA, 14 bp, Homo sapiens
catggcctctggaa

SEQ ID NO: 3851503 - DNA, 12 bp, Homo sapiens
catggctgggga

SEQ ID NO: 3851504 - DNA, 16 bp, Homo sapiens
catgggcaccaggcaa

SEQ ID NO: 3851505 - DNA, 15 bp, Homo sapiens
ccaaaaaaggctgcc

SEQ ID NO: 3851506 - DNA, 13 bp, Homo sapiens
ccacatccccagc

SEQ ID NO: 3851507 - DNA, 11 bp, Homo sapiens
ccactggacag

SEQ ID NO: 3851508 - DNA, 15 bp, Homo sapiens
ccactttgagagggc

SEQ ID NO: 3851509 - DNA, 21 bp, Homo sapiens
ccagaacacatggctgggcct

SEQ ID NO: 3851510 - DNA, 14 bp, Homo sapiens
ccagacagaggcag

SEQ ID NO: 3851511 - DNA, 16 bp, Homo sapiens
ccagagctgtcctcct

SEQ ID NO: 3851512 - DNA, 15 bp, Homo sapiens
ccagcgcagagtagc

SEQ ID NO: 3851513 - DNA, 16 bp, Homo sapiens
ccaggggaccttcctg

SEQ ID NO: 3851514 - DNA, 18 bp, Homo sapiens
ccaggtactgagtgggga

SEQ ID NO: 3851515 - DNA, 19 bp, Homo sapiens
ccagtgctgtgagcaggcg

SEQ ID NO: 3851516 - DNA, 13 bp, Homo sapiens
ccatcctggccca

SEQ ID NO: 3851517 - DNA, 16 bp, Homo sapiens
ccatcctggcccagcc

SEQ ID NO: 3851518 - DNA, 19 bp, Homo sapiens
cccaatagctagtgacagc

SEQ ID NO: 3851519 - DNA, 19 bp, Homo sapiens
cccagcacacacctatggc

SEQ ID NO: 3851520 - DNA, 18 bp, Homo sapiens
cccaggtgagacagcggt

SEQ ID NO: 3851521 - DNA, 16 bp, Homo sapiens
cccagtcctcaggcag

SEQ ID NO: 3851522 - DNA, 17 bp, Homo sapiens
cccagtcctcaggcagc

SEQ ID NO: 3851523 - DNA, 13 bp, Homo sapiens
ccccacctgcagc

SEQ ID NO: 3851524 - DNA, 18 bp, Homo sapiens
ccccagtcctcaggcagc

SEQ ID NO: 3851525 - DNA, 14 bp, Homo sapiens
cccccacctgcagc

SEQ ID NO: 3851526 - DNA, 17 bp, Homo sapiens
cccggtcagtcagagaa

SEQ ID NO: 3851527 - DNA, 22 bp, Homo sapiens
ccctagacatggcctctggaaa

SEQ ID NO: 3851528 - DNA, 16 bp, Homo sapiens
ccctgagcctggcagg

SEQ ID NO: 3851529 - DNA, 16 bp, Homo sapiens
ccctgcttctggctcc

SEQ ID NO: 3851530 - DNA, 20 bp, Homo sapiens
cccttcctccccaacctgca

SEQ ID NO: 3851531 - DNA, 14 bp, Homo sapiens
ccgcttctcctgca

SEQ ID NO: 3851532 - DNA, 17 bp, Homo sapiens
ccgcttctcctgcagtg

SEQ ID NO: 3851533 - DNA, 13 bp, Homo sapiens
cctcacatgcaga

SEQ ID NO: 3851534 - DNA, 21 bp, Homo sapiens
cctcaggtcagctcactgagc

SEQ ID NO: 3851535 - DNA, 20 bp, Homo sapiens
cctccagagctgtcctcctg

SEQ ID NO: 3851536 - DNA, 22 bp, Homo sapiens
cctccagagctgtcctcctggc

SEQ ID NO: 3851537 - DNA, 16 bp, Homo sapiens
cctccccaacctgcaa

SEQ ID NO: 3851538 - DNA, 14 bp, Homo sapiens
cctcctcaggagaa

SEQ ID NO: 3851539 - DNA, 17 bp, Homo sapiens
cctgggaggccctggca

SEQ ID NO: 3851540 - DNA, 19 bp, Homo sapiens
cctggggctggtcctggga

SEQ ID NO: 3851541 - DNA, 21 bp, Homo sapiens
cctggggctggtcctgggagc

SEQ ID NO: 3851542 - DNA, 18 bp, Homo sapiens
cctgggggaaggatgcag

SEQ ID NO: 3851543 - DNA, 18 bp, Homo sapiens
cctttctgtggtgaggga

SEQ ID NO: 3851544 - DNA, 20 bp, Homo sapiens
cctttctgtggtgagggaga

SEQ ID NO: 3851545 - DNA, 13 bp, Homo sapiens
cgaggctgggaca

SEQ ID NO: 3851546 - DNA, 14 bp, Homo sapiens
cgaggctgggacac

SEQ ID NO: 3851547 - DNA, 17 bp, Homo sapiens
cgcatgtaaagatgctg

SEQ ID NO: 3851548 - DNA, 18 bp, Homo sapiens
cgcccaggccagtgctgt

SEQ ID NO: 3851549 - DNA, 14 bp, Homo sapiens
cgtgtgtgtatgct

SEQ ID NO: 3851550 - DNA, 14 bp, Homo sapiens
ctaatccctccctc

SEQ ID NO: 3851551 - DNA, 22 bp, Homo sapiens
ctaccttccttcaactgctctg

SEQ ID NO: 3851552 - DNA, 17 bp, Homo sapiens
ctagacatggcctctgg

SEQ ID NO: 3851553 - DNA, 16 bp, Homo sapiens
ctaggctcctgggagg

SEQ ID NO: 3851554 - DNA, 16 bp, Homo sapiens
ctatctaccttccttc

SEQ ID NO: 3851555 - DNA, 13 bp, Homo sapiens
ctatgagcccagc

SEQ ID NO: 3851556 - DNA, 21 bp, Homo sapiens
ctcactctccccagtcctcag

SEQ ID NO: 3851557 - DNA, 15 bp, Homo sapiens
ctcaggtcagctcac

SEQ ID NO: 3851558 - DNA, 12 bp, Homo sapiens
ctcatctatgct

SEQ ID NO: 3851559 - DNA, 22 bp, Homo sapiens
ctccagagctgtcctcctggca

SEQ ID NO: 3851560 - DNA, 13 bp, Homo sapiens
ctccaggcagagg

SEQ ID NO: 3851561 - DNA, 23 bp, Homo sapiens
ctccaggtccctaagctggggac

SEQ ID NO: 3851562 - DNA, 22 bp, Homo sapiens
ctccctaataaaaattggagct

SEQ ID NO: 3851563 - DNA, 13 bp, Homo sapiens
ctcctcaggagaa

SEQ ID NO: 3851564 - DNA, 13 bp, Homo sapiens
ctcctcctggaaa

SEQ ID NO: 3851565 - DNA, 13 bp, Homo sapiens
ctcctgcagtgga

SEQ ID NO: 3851566 - DNA, 12 bp, Homo sapiens
ctcctgggaggc

SEQ ID NO: 3851567 - DNA, 21 bp, Homo sapiens
ctcctgggaggccctggcaga

SEQ ID NO: 3851568 - DNA, 16 bp, Homo sapiens
ctgaagttggcccccc

SEQ ID NO: 3851569 - DNA, 22 bp, Homo sapiens
ctgagcctggcaggtcccctgc

SEQ ID NO: 3851570 - DNA, 22 bp, Homo sapiens
ctgcaataaatccgcttctcct

SEQ ID NO: 3851571 - DNA, 19 bp, Homo sapiens
ctgcaccaagcacccactg

SEQ ID NO: 3851572 - DNA, 20 bp, Homo sapiens
ctgcaccaagcacccactgt

SEQ ID NO: 3851573 - DNA, 18 bp, Homo sapiens
ctgccctgaggctgtgag

SEQ ID NO: 3851574 - DNA, 14 bp, Homo sapiens
ctgccggagggagc

SEQ ID NO: 3851575 - DNA, 20 bp, Homo sapiens
cagaaggaaaagagtaatgg

SEQ ID NO: 3851576 - DNA, 17 bp, Homo sapiens
cagggaacacattcctt

SEQ ID NO: 3851577 - DNA, 17 bp, Homo sapiens
catagagttctggatgt

SEQ ID NO: 3851578 - DNA, 17 bp, Homo sapiens
cattacagaccatggat

SEQ ID NO: 3851579 - DNA, 21 bp, Homo sapiens
ccaaaacacattttccatatt

SEQ ID NO: 3851580 - DNA, 18 bp, Homo sapiens
ccaacatctccagctgga

SEQ ID NO: 3851581 - DNA, 20 bp, Homo sapiens
ccacagggaacacattcctt

SEQ ID NO: 3851582 - DNA, 15 bp, Homo sapiens
ccagagaaaggaaag

SEQ ID NO: 3851583 - DNA, 12 bp, Homo sapiens
ccagctggatcc

SEQ ID NO: 3851584 - DNA, 17 bp, Homo sapiens
cctggggcaaagctgtg

SEQ ID NO: 3851585 - DNA, 13 bp, Homo sapiens
ctacataatctct

SEQ ID NO: 3851586 - DNA, 13 bp, Homo sapiens
ctagactgtgaag

SEQ ID NO: 3851587 - DNA, 15 bp, Homo sapiens
ctatgcaagagaaat

SEQ ID NO: 3851588 - DNA, 15 bp, Homo sapiens
ctccagctggatccc

SEQ ID NO: 3851589 - DNA, 22 bp, Homo sapiens
ctctttaggagaaattatagtt

SEQ ID NO: 3851590 - DNA, 22 bp, Homo sapiens
ctggaaattaattttctcttta

SEQ ID NO: 3851591 - DNA, 16 bp, Homo sapiens
gaaagccagaaggaaa

SEQ ID NO: 3851592 - DNA, 17 bp, Homo sapiens
gacgaagtgtaaactaa

SEQ ID NO: 3851593 - DNA, 13 bp, Homo sapiens
gattataagacaa

SEQ ID NO: 3851594 - DNA, 17 bp, Homo sapiens
gcaccggctgcccacag

SEQ ID NO: 3851595 - DNA, 14 bp, Homo sapiens
gcttttcaaaccag

SEQ ID NO: 3851596 - DNA, 17 bp, Homo sapiens
ggaaagccagaaggaaa

SEQ ID NO: 3851597 - DNA, 13 bp, Homo sapiens
ggatctaactgtt

SEQ ID NO: 3851598 - DNA, 18 bp, Homo sapiens
gtaaagcgggaaggacat

SEQ ID NO: 3851599 - DNA, 16 bp, Homo sapiens
gtatgtttatgttaat

SEQ ID NO: 3851600 - DNA, 19 bp, Homo sapiens
gtattttctagactgtgaa

SEQ ID NO: 3851601 - DNA, 23 bp, Homo sapiens
gtcactcttttgggatctaactg

SEQ ID NO: 3851602 - DNA, 13 bp, Homo sapiens
gtgaagtcacatt

SEQ ID NO: 3851603 - DNA, 20 bp, Homo sapiens
gtgttgtctctttcctacaa

SEQ ID NO: 3851604 - DNA, 16 bp, Homo sapiens
gttacattaggaagat

SEQ ID NO: 3851605 - DNA, 22 bp, Homo sapiens
gttactggaagacgaagtgtaa

SEQ ID NO: 3851606 - DNA, 21 bp, Homo sapiens
gttatccttgttcctgttaca

SEQ ID NO: 3851607 - DNA, 20 bp, Homo sapiens
taaaagatttttttaactta

SEQ ID NO: 3851608 - DNA, 18 bp, Homo sapiens
taaagcgggaaggacatt

SEQ ID NO: 3851609 - DNA, 13 bp, Homo sapiens
tacaatatttagc

SEQ ID NO: 3851610 - DNA, 18 bp, Homo sapiens
tacataatctctggaaat

SEQ ID NO: 3851611 - DNA, 21 bp, Homo sapiens
tacccaaaacacattttccat

SEQ ID NO: 3851612 - DNA, 14 bp, Homo sapiens
tagcattattagtt

SEQ ID NO: 3851613 - DNA, 19 bp, Homo sapiens
tatgttgtattaactgggt

SEQ ID NO: 3851614 - DNA, 20 bp, Homo sapiens
tattagtttgttatgtgtgt

SEQ ID NO: 3851615 - DNA, 19 bp, Homo sapiens
tcaaaccagagaaaggaaa

SEQ ID NO: 3851616 - DNA, 12 bp, Homo sapiens
tcacattagtgt

SEQ ID NO: 3851617 - DNA, 16 bp, Homo sapiens
tcacattagtgtgttg

SEQ ID NO: 3851618 - DNA, 15 bp, Homo sapiens
tcagttcaaatgtta

SEQ ID NO: 3851619 - DNA, 12 bp, Homo sapiens
tccatgatgtta

SEQ ID NO: 3851620 - DNA, 22 bp, Homo sapiens
tcccagggaaatatcagccttg

SEQ ID NO: 3851621 - DNA, 22 bp, Homo sapiens
tctaactgttgttactggaaga

SEQ ID NO: 3851622 - DNA, 21 bp, Homo sapiens
tctctttcctacaagttaacc

SEQ ID NO: 3851623 - DNA, 21 bp, Homo sapiens
tctttaggagaaattatagtt

SEQ ID NO: 3851624 - DNA, 16 bp, Homo sapiens
tgaagattcagttcaa

SEQ ID NO: 3851625 - DNA, 18 bp, Homo sapiens
tgatgttacattaggaag

SEQ ID NO: 3851626 - DNA, 17 bp, Homo sapiens
tgcactacataatctct

SEQ ID NO: 3851627 - DNA, 16 bp, Homo sapiens
tgctttggttaatctc

SEQ ID NO: 3851628 - DNA, 15 bp, Homo sapiens
tgcttttcaaaccag

SEQ ID NO: 3851629 - DNA, 17 bp, Homo sapiens
tgcttttcaaaccagag

SEQ ID NO: 3851630 - DNA, 22 bp, Homo sapiens
tgcttttcaaaccagagaaagg

SEQ ID NO: 3851631 - DNA, 20 bp, Homo sapiens
tggatatgttgtattaactg

SEQ ID NO: 3851632 - DNA, 14 bp, Homo sapiens
tgtgtttcagccac

SEQ ID NO: 3851633 - DNA, 23 bp, Homo sapiens
ttaactgggtacccaaaacacat

SEQ ID NO: 3851634 - DNA, 18 bp, Homo sapiens
ttacagaccatggatatg

SEQ ID NO: 3851635 - DNA, 13 bp, Homo sapiens
ttacattaggaag

SEQ ID NO: 3851636 - DNA, 23 bp, Homo sapiens
ttactggaagacgaagtgtaaac

SEQ ID NO: 3851637 - DNA, 21 bp, Homo sapiens
ttccatgatgttacattagga

SEQ ID NO: 3851638 - DNA, 17 bp, Homo sapiens
ttctgattataagacaa

SEQ ID NO: 3851639 - DNA, 13 bp, Homo sapiens
ttctggatgtaaa

SEQ ID NO: 3851640 - DNA, 19 bp, Homo sapiens
ttggatggtgaagtcacat

SEQ ID NO: 3851641 - DNA, 17 bp, Homo sapiens
ttgggatctaactgttg

SEQ ID NO: 3851642 - DNA, 20 bp, Homo sapiens
tttaggagaaattatagtta

SEQ ID NO: 3851643 - DNA, 13 bp, Homo sapiens
tttccatatttgg

SEQ ID NO: 3851644 - DNA, 16 bp, Homo sapiens
tttctgattataagac

SEQ ID NO: 3851645 - DNA, 20 bp, Homo sapiens
tttctgattataagacaatg

SEQ ID NO: 3851646 - DNA, 18 bp, Homo sapiens
ttttgggatctaactgtt

SEQ ID NO: 3851647 - DNA, 22 bp, Homo sapiens
aaaagagtaatggtattttcta

SEQ ID NO: 3851648 - DNA, 17 bp, Homo sapiens
aaaagtagttagccaat

SEQ ID NO: 3851649 - DNA, 20 bp, Homo sapiens
aaagaataaataagattgct

SEQ ID NO: 3851650 - DNA, 21 bp, Homo sapiens
aaaggaaagccagaaggaaaa

SEQ ID NO: 3851651 - DNA, 15 bp, Homo sapiens
aacacattcctttgc

SEQ ID NO: 3851652 - DNA, 22 bp, Homo sapiens
aacacattttccatatttggat

SEQ ID NO: 3851653 - DNA, 15 bp, Homo sapiens
aactatgcaagagaa

SEQ ID NO: 3851654 - DNA, 19 bp, Homo sapiens
aagagtaatggtattttct

SEQ ID NO: 3851655 - DNA, 21 bp, Homo sapiens
aaggacattacagaccatgga

SEQ ID NO: 3851656 - DNA, 23 bp, Homo sapiens
aaggacattacagaccatggata

SEQ ID NO: 3851657 - DNA, 15 bp, Homo sapiens
aagtcacattagtgt

SEQ ID NO: 3851658 - DNA, 21 bp, Homo sapiens
aatgctgctttggttaatctc

SEQ ID NO: 3851659 - DNA, 16 bp, Homo sapiens
aatggtattttctaga

SEQ ID NO: 3851660 - DNA, 20 bp, Homo sapiens
aattaattttctctttagga

SEQ ID NO: 3851661 - DNA, 16 bp, Homo sapiens
aattttaatttctgat

SEQ ID NO: 3851662 - DNA, 18 bp, Homo sapiens
aattttctctttaggaga

SEQ ID NO: 3851663 - DNA, 12 bp, Homo sapiens
acacattccttt

SEQ ID NO: 3851664 - DNA, 20 bp, Homo sapiens
acacattttccatatttgga

SEQ ID NO: 3851665 - DNA, 22 bp, Homo sapiens
acacattttccatatttggatg

SEQ ID NO: 3851666 - DNA, 15 bp, Homo sapiens
acagaccatggatat

SEQ ID NO: 3851667 - DNA, 21 bp, Homo sapiens
acagaccatggatatgttgta

SEQ ID NO: 3851668 - DNA, 22 bp, Homo sapiens
acagaccatggatatgttgtat

SEQ ID NO: 3851669 - DNA, 12 bp, Homo sapiens
acataatctctg

SEQ ID NO: 3851670 - DNA, 15 bp, Homo sapiens
acataatctctggaa

SEQ ID NO: 3851671 - DNA, 17 bp, Homo sapiens
acattttccatatttgg

SEQ ID NO: 3851672 - DNA, 23 bp, Homo sapiens
accagttgcactacataatctct

SEQ ID NO: 3851673 - DNA, 13 bp, Homo sapiens
acccaaaacacat

SEQ ID NO: 3851674 - DNA, 15 bp, Homo sapiens
acccaaaacacattt

SEQ ID NO: 3851675 - DNA, 14 bp, Homo sapiens
actacataatctct

SEQ ID NO: 3851676 - DNA, 20 bp, Homo sapiens
actacataatctctggaaat

SEQ ID NO: 3851677 - DNA, 21 bp, Homo sapiens
actacataatctctggaaatt

SEQ ID NO: 3851678 - DNA, 13 bp, Homo sapiens
actcttttgggat

SEQ ID NO: 3851679 - DNA, 21 bp, Homo sapiens
actcttttgggatctaactgt

SEQ ID NO: 3851680 - DNA, 17 bp, Homo sapiens
actgggtacccaaaaca

SEQ ID NO: 3851681 - DNA, 21 bp, Homo sapiens
actgggtacccaaaacacatt

SEQ ID NO: 3851682 - DNA, 12 bp, Homo sapiens
actgttgttact

SEQ ID NO: 3851683 - DNA, 22 bp, Homo sapiens
agaccatggatatgttgtatta

SEQ ID NO: 3851684 - DNA, 15 bp, Homo sapiens
agagttctggatgta

SEQ ID NO: 3851685 - DNA, 14 bp, Homo sapiens
agccagaaggaaaa

SEQ ID NO: 3851686 - DNA, 15 bp, Homo sapiens
agcgggaaggacatt

SEQ ID NO: 3851687 - DNA, 20 bp, Homo sapiens
aggaaaagagtaatggtatt

SEQ ID NO: 3851688 - DNA, 18 bp, Homo sapiens
aggaagatatcatgaaag

SEQ ID NO: 3851689 - DNA, 19 bp, Homo sapiens
agggaacacattcctttgc

SEQ ID NO: 3851690 - DNA, 13 bp, Homo sapiens
agtagttagccaa

SEQ ID NO: 3851691 - DNA, 15 bp, Homo sapiens
agttaaccagttgca

SEQ ID NO: 3851692 - DNA, 11 bp, Homo sapiens
agttagccaat

SEQ ID NO: 3851693 - DNA, 16 bp, Homo sapiens
agtttgttatgtgtgt

SEQ ID NO: 3851694 - DNA, 21 bp, Homo sapiens
agtttgttatgtgtgtatgtt

SEQ ID NO: 3851695 - DNA, 18 bp, Homo sapiens
atatgttgtattaactgg

SEQ ID NO: 3851696 - DNA, 15 bp, Homo sapiens
atcactgaaaactat

SEQ ID NO: 3851697 - DNA, 19 bp, Homo sapiens
atgctgctttggttaatct

SEQ ID NO: 3851698 - DNA, 22 bp, Homo sapiens
atggatatgttgtattaactgg

SEQ ID NO: 3851699 - DNA, 17 bp, Homo sapiens
atggtgaagtcacatta

SEQ ID NO: 3851700 - DNA, 22 bp, Homo sapiens
atggtgaagtcacattagtgtg

SEQ ID NO: 3851701 - DNA, 19 bp, Homo sapiens
atgtaaagcgggaaggaca

SEQ ID NO: 3851702 - DNA, 14 bp, Homo sapiens
atgttgtattaact

SEQ ID NO: 3851703 - DNA, 19 bp, Homo sapiens
atgttgtattaactgggta

SEQ ID NO: 3851704 - DNA, 17 bp, Homo sapiens
attaactgggtacccaa

SEQ ID NO: 3851705 - DNA, 23 bp, Homo sapiens
attaactgggtacccaaaacaca

SEQ ID NO: 3851706 - DNA, 21 bp, Homo sapiens
attaattttctctttaggaga

SEQ ID NO: 3851707 - DNA, 12 bp, Homo sapiens
attataagacaa

SEQ ID NO: 3851708 - DNA, 12 bp, Homo sapiens
attttaatttct

SEQ ID NO: 3851709 - DNA, 14 bp, Homo sapiens
attttaatttctga

SEQ ID NO: 3851710 - DNA, 18 bp, Homo sapiens
caaaccagagaaaggaaa

SEQ ID NO: 3851711 - DNA, 17 bp, Homo sapiens
caaatgttatccttgtt

SEQ ID NO: 3851712 - DNA, 19 bp, Homo sapiens
cacagcgggagaacgcagt

SEQ ID NO: 3851713 - DNA, 18 bp, Homo sapiens
cacattagtgtgttgtct

SEQ ID NO: 3851714 - DNA, 16 bp, Homo sapiens
cactgaaaactatgca

SEQ ID NO: 3851715 - DNA, 20 bp, Homo sapiens
cagaccatggatatgttgta

SEQ ID NO: 3851716 - DNA, 16 bp, Homo sapiens
cataatctctggaaat

SEQ ID NO: 3851717 - DNA, 21 bp, Homo sapiens
catagagttctggatgtaaag

SEQ ID NO: 3851718 - DNA, 14 bp, Homo sapiens
catatttggatggt

SEQ ID NO: 3851719 - DNA, 17 bp, Homo sapiens
catctccagctggatcc

SEQ ID NO: 3851720 - DNA, 22 bp, Homo sapiens
cattacagaccatggatatgtt

SEQ ID NO: 3851721 - DNA, 23 bp, Homo sapiens
cattagtgtgttgtctctttcct

SEQ ID NO: 3851722 - DNA, 22 bp, Homo sapiens
ccacagggaacacattcctttg

SEQ ID NO: 3851723 - DNA, 14 bp, Homo sapiens
ccagagaaaggaaa

SEQ ID NO: 3851724 - DNA, 23 bp, Homo sapiens
ccatggatatgttgtattaactg

SEQ ID NO: 3851725 - DNA, 21 bp, Homo sapiens
cctacaagttaaccagttgca

SEQ ID NO: 3851726 - DNA, 17 bp, Homo sapiens
cctataacctgtaggaa

SEQ ID NO: 3851727 - DNA, 15 bp, Homo sapiens
ctacataatctctgg

SEQ ID NO: 3851728 - DNA, 13 bp, Homo sapiens
ctctttaggagaa

SEQ ID NO: 3851729 - DNA, 23 bp, Homo sapiens
ctctttaggagaaattatagtta

SEQ ID NO: 3851730 - DNA, 17 bp, Homo sapiens
ctctttcctacaagtta

SEQ ID NO: 3851731 - DNA, 12 bp, Homo sapiens
ctggatgtaaag

SEQ ID NO: 3851732 - DNA, 19 bp, Homo sapiens
ctgggtacccaaaacacat

SEQ ID NO: 3851733 - DNA, 20 bp, Homo sapiens
ctgggtacccaaaacacatt

SEQ ID NO: 3851734 - DNA, 21 bp, Homo sapiens
ctgtaggaaaccgacgaaaaa

SEQ ID NO: 3851735 - DNA, 13 bp, Homo sapiens
ctgttgttactgg

SEQ ID NO: 3851736 - DNA, 20 bp, Homo sapiens
cttaaaaagtagttagccaa

SEQ ID NO: 3851737 - DNA, 18 bp, Homo sapiens
cttttcaaaccagagaaa

SEQ ID NO: 3851738 - DNA, 15 bp, Homo sapiens
gaaaccgacgaaaaa

SEQ ID NO: 3851739 - DNA, 16 bp, Homo sapiens
gaaattatagttaggc

SEQ ID NO: 3851740 - DNA, 16 bp, Homo sapiens
gagttctggatgtaaa

SEQ ID NO: 3851741 - DNA, 18 bp, Homo sapiens
gatctaactgttgttact

SEQ ID NO: 3851742 - DNA, 18 bp, Homo sapiens
gatggtgaagtcacatta

SEQ ID NO: 3851743 - DNA, 18 bp, Homo sapiens
gatgttacattaggaaga

SEQ ID NO: 3851744 - DNA, 15 bp, Homo sapiens
gattgctatggttta

SEQ ID NO: 3851745 - DNA, 16 bp, Homo sapiens
gcgcctctcctggggc

SEQ ID NO: 3851746 - DNA, 20 bp, Homo sapiens
gctgctttggttaatctctt

SEQ ID NO: 3851747 - DNA, 22 bp, Homo sapiens
ggacattacagaccatggatat

SEQ ID NO: 3851748 - DNA, 21 bp, Homo sapiens
ggatatgttgtattaactggg

SEQ ID NO: 3851749 - DNA, 21 bp, Homo sapiens
gggctttgcttttcaaaccag

SEQ ID NO: 3851750 - DNA, 14 bp, Homo sapiens
ggtacccaaaacac

SEQ ID NO: 3851751 - DNA, 19 bp, Homo sapiens
gtaaagcgggaaggacatt

SEQ ID NO: 3851752 - DNA, 16 bp, Homo sapiens
gtacccaaaacacatt

SEQ ID NO: 3851753 - DNA, 16 bp, Homo sapiens
gttaattttaatttct

SEQ ID NO: 3851754 - DNA, 23 bp, Homo sapiens
gttactggaagacgaagtgtaaa

SEQ ID NO: 3851755 - DNA, 15 bp, Homo sapiens
taaaaagtagttagc

SEQ ID NO: 3851756 - DNA, 23 bp, Homo sapiens
taactgggtacccaaaacacatt

SEQ ID NO: 3851757 - DNA, 13 bp, Homo sapiens
taatctctggaaa

SEQ ID NO: 3851758 - DNA, 14 bp, Homo sapiens
taatctctggaaat

SEQ ID NO: 3851759 - DNA, 16 bp, Homo sapiens
taattttctctttagg

SEQ ID NO: 3851760 - DNA, 21 bp, Homo sapiens
taattttctctttaggagaaa

SEQ ID NO: 3851761 - DNA, 20 bp, Homo sapiens
aaaagtcactcttttgggat

SEQ ID NO: 3851762 - DNA, 17 bp, Homo sapiens
aaaccagagaaaggaaa

SEQ ID NO: 3851763 - DNA, 16 bp, Homo sapiens
aaactatgcaagagaa

SEQ ID NO: 3851764 - DNA, 18 bp, Homo sapiens
aaagatttttttaactta

SEQ ID NO: 3851765 - DNA, 16 bp, Homo sapiens
aaagcgggaaggacat

SEQ ID NO: 3851766 - DNA, 17 bp, Homo sapiens
aaagcgggaaggacatt

SEQ ID NO: 3851767 - DNA, 22 bp, Homo sapiens
aaattatagttaggcttccatg

SEQ ID NO: 3851768 - DNA, 17 bp, Homo sapiens
aaccagttgcactacat

SEQ ID NO: 3851769 - DNA, 21 bp, Homo sapiens
aactgggtacccaaaacacat

SEQ ID NO: 3851770 - DNA, 15 bp, Homo sapiens
aagagtaatggtatt

SEQ ID NO: 3851771 - DNA, 16 bp, Homo sapiens
aagttaaccagttgca

SEQ ID NO: 3851772 - DNA, 21 bp, Homo sapiens
aatttctgattataagacaat

SEQ ID NO: 3851773 - DNA, 20 bp, Homo sapiens
aattttctctttaggagaaa

SEQ ID NO: 3851774 - DNA, 11 bp, Homo sapiens
acacattcctt

SEQ ID NO: 3851775 - DNA, 19 bp, Homo sapiens
acagggaacacattccttt

SEQ ID NO: 3851776 - DNA, 14 bp, Homo sapiens
acataatctctgga

SEQ ID NO: 3851777 - DNA, 20 bp, Homo sapiens
acattagtgtgttgtctctt

SEQ ID NO: 3851778 - DNA, 16 bp, Homo sapiens
accagttgcactacat

SEQ ID NO: 3851779 - DNA, 17 bp, Homo sapiens
accatggatatgttgta

SEQ ID NO: 3851780 - DNA, 21 bp, Homo sapiens
accgacgaaaaagtcactctt

SEQ ID NO: 3851781 - DNA, 19 bp, Homo sapiens
actcttttgggatctaact

SEQ ID NO: 3851782 - DNA, 12 bp, Homo sapiens
agaaggaaaaga

SEQ ID NO: 3851783 - DNA, 15 bp, Homo sapiens
agacgaagtgtaaac

SEQ ID NO: 3851784 - DNA, 19 bp, Homo sapiens
agcattattagtttgttat

SEQ ID NO: 3851785 - DNA, 19 bp, Homo sapiens
agtaatggtattttctaga

SEQ ID NO: 3851786 - DNA, 14 bp, Homo sapiens
agttctggatgtaa

SEQ ID NO: 3851787 - DNA, 15 bp, Homo sapiens
atatcatgaaagaat

SEQ ID NO: 3851788 - DNA, 21 bp, Homo sapiens
atctaactgttgttactggaa

SEQ ID NO: 3851789 - DNA, 14 bp, Homo sapiens
atctcttctaaatg

SEQ ID NO: 3851790 - DNA, 16 bp, Homo sapiens
atgctgctttggttaa

SEQ ID NO: 3851791 - DNA, 18 bp, Homo sapiens
atggtattttctagactg

SEQ ID NO: 3851792 - DNA, 13 bp, Homo sapiens
atgttgtattaac

SEQ ID NO: 3851793 - DNA, 16 bp, Homo sapiens
atgttgtattaactgg

SEQ ID NO: 3851794 - DNA, 17 bp, Homo sapiens
atgttgtattaactggg

SEQ ID NO: 3851795 - DNA, 16 bp, Homo sapiens
attaattttctcttta

SEQ ID NO: 3851796 - DNA, 22 bp, Homo sapiens
attagtgtgttgtctctttcct

SEQ ID NO: 3851797 - DNA, 17 bp, Homo sapiens
atttctgattataagac

SEQ ID NO: 3851798 - DNA, 16 bp, Homo sapiens
attttccatatttgga

SEQ ID NO: 3851799 - DNA, 18 bp, Homo sapiens
attttctagactgtgaag

SEQ ID NO: 3851800 - DNA, 19 bp, Homo sapiens
attttctagactgtgaaga

SEQ ID NO: 3851801 - DNA, 15 bp, Homo sapiens
attttctctttagga

SEQ ID NO: 3851802 - DNA, 16 bp, Homo sapiens
cacattagtgtgttgt

SEQ ID NO: 3851803 - DNA, 19 bp, Homo sapiens
cacattttccatatttgga

SEQ ID NO: 3851804 - DNA, 16 bp, Homo sapiens
cactacataatctctg

SEQ ID NO: 3851805 - DNA, 12 bp, Homo sapiens
aaaacacatttt

SEQ ID NO: 3851806 - DNA, 18 bp, Homo sapiens
aaaacacattttccatat

SEQ ID NO: 3851807 - DNA, 17 bp, Homo sapiens
aaaactatgcaagagaa

SEQ ID NO: 3851808 - DNA, 20 bp, Homo sapiens
aaacacattttccatatttg

SEQ ID NO: 3851809 - DNA, 16 bp, Homo sapiens
aagacgaagtgtaaac

SEQ ID NO: 3851810 - DNA, 13 bp, Homo sapiens
aagattcagttca

SEQ ID NO: 3851811 - DNA, 24 bp, Homo sapiens
aagattcagttcaaatgttatcct

SEQ ID NO: 3851812 - DNA, 14 bp, Homo sapiens
aaggaaaagagtaa

SEQ ID NO: 3851813 - DNA, 20 bp, Homo sapiens
aaggaaagccagaaggaaaa

SEQ ID NO: 3851814 - DNA, 19 bp, Homo sapiens
acagaccatggatatgttg

SEQ ID NO: 3851815 - DNA, 18 bp, Homo sapiens
acattacagaccatggat

SEQ ID NO: 3851816 - DNA, 19 bp, Homo sapiens
acattaggaagatatcatg

SEQ ID NO: 3851817 - DNA, 18 bp, Homo sapiens
accatggatatgttgtat

SEQ ID NO: 3851818 - DNA, 19 bp, Homo sapiens
acctataacctgtaggaaa

SEQ ID NO: 3851819 - DNA, 21 bp, Homo sapiens
actgaaaactatgcaagagaa

SEQ ID NO: 3851820 - DNA, 18 bp, Homo sapiens
actgttgttactggaaga

SEQ ID NO: 3851821 - DNA, 21 bp, Homo sapiens
acttaaaaagtagttagccaa

SEQ ID NO: 3851822 - DNA, 22 bp, Homo sapiens
agaaaggaaagccagaaggaaa

SEQ ID NO: 3851823 - DNA, 20 bp, Homo sapiens
agacaatgctgctttggtta

SEQ ID NO: 3851824 - DNA, 15 bp, Homo sapiens
agccacactgaaccc

SEQ ID NO: 3851825 - DNA, 13 bp, Homo sapiens
agccagaaggaaa

SEQ ID NO: 3851826 - DNA, 13 bp, Homo sapiens
aggaaaagagtaa

SEQ ID NO: 3851827 - DNA, 22 bp, Homo sapiens
aggaaaccgacgaaaaagtcac

SEQ ID NO: 3851828 - DNA, 20 bp, Homo sapiens
aggaagatatcatgaaagaa

SEQ ID NO: 3851829 - DNA, 17 bp, Homo sapiens
agggcctcccagcccaa

SEQ ID NO: 3851830 - DNA, 17 bp, Homo sapiens
agttaggcttccatgat

SEQ ID NO: 3851831 - DNA, 13 bp, Homo sapiens
agttgcactacat

SEQ ID NO: 3851832 - DNA, 14 bp, Homo sapiens
ataatctctggaaa

SEQ ID NO: 3851833 - DNA, 16 bp, Homo sapiens
ataatctctggaaatt

SEQ ID NO: 3851834 - DNA, 18 bp, Homo sapiens
atatgcaatcactgaaaa

SEQ ID NO: 3851835 - DNA, 22 bp, Homo sapiens
atatgcaatcactgaaaactat

SEQ ID NO: 3851836 - DNA, 14 bp, Homo sapiens
atctaactgttgtt

SEQ ID NO: 3851837 - DNA, 23 bp, Homo sapiens
atggatatgttgtattaactggg

SEQ ID NO: 3851838 - DNA, 20 bp, Homo sapiens
atgtaaagcgggaaggacat

SEQ ID NO: 3851839 - DNA, 21 bp, Homo sapiens
atgtaaagcgggaaggacatt

SEQ ID NO: 3851840 - DNA, 12 bp, Homo sapiens
atgttacattag

SEQ ID NO: 3851841 - DNA, 15 bp, Homo sapiens
atgttgtattaactg

SEQ ID NO: 3851842 - DNA, 18 bp, Homo sapiens
attaactgggtacccaaa

SEQ ID NO: 3851843 - DNA, 21 bp, Homo sapiens
attaactgggtacccaaaaca

SEQ ID NO: 3851844 - DNA, 13 bp, Homo sapiens
attttaatttctg

SEQ ID NO: 3851845 - DNA, 15 bp, Homo sapiens
attttccatatttgg

SEQ ID NO: 3851846 - DNA, 18 bp, Homo sapiens
attttccatatttggatg

SEQ ID NO: 3851847 - DNA, 22 bp, Homo sapiens
attttccatatttggatggtga

SEQ ID NO: 3851848 - DNA, 17 bp, Homo sapiens
caagttaaccagttgca

SEQ ID NO: 3851849 - DNA, 19 bp, Homo sapiens
caagttaaccagttgcact

SEQ ID NO: 3851850 - DNA, 16 bp, Homo sapiens
caatatgcaatcactg

SEQ ID NO: 3851851 - DNA, 16 bp, Homo sapiens
caatcactgaaaacta

SEQ ID NO: 3851852 - DNA, 23 bp, Homo sapiens
caatcactgaaaactatgcaaga

SEQ ID NO: 3851853 - DNA, 23 bp, Homo sapiens
caatgctgctttggttaatctct

SEQ ID NO: 3851854 - DNA, 17 bp, Homo sapiens
cactacataatctctgg

SEQ ID NO: 3851855 - DNA, 20 bp, Homo sapiens
cactacataatctctggaaa

SEQ ID NO: 3851856 - DNA, 13 bp, Homo sapiens
cactgaaaactat

SEQ ID NO: 3851857 - DNA, 19 bp, Homo sapiens
cagaaggaaaagagtaatg

SEQ ID NO: 3851858 - DNA, 11 bp, Homo sapiens
ccaaaacacat

SEQ ID NO: 3851859 - DNA, 19 bp, Homo sapiens
ccaattacacacagcggga

SEQ ID NO: 3851860 - DNA, 14 bp, Homo sapiens
ctacataatctctg

SEQ ID NO: 3851861 - DNA, 13 bp, Homo sapiens
ctccagctggatc

SEQ ID NO: 3851862 - DNA, 11 bp, Homo sapiens
ctctttaggag

SEQ ID NO: 3851863 - DNA, 14 bp, Homo sapiens
ctctttaggagaaa

SEQ ID NO: 3851864 - DNA, 15 bp, Homo sapiens
ctgattataagacaa

SEQ ID NO: 3851865 - DNA, 16 bp, Homo sapiens
ctgattataagacaat

SEQ ID NO: 3851866 - DNA, 17 bp, Homo sapiens
ctgattataagacaatg

SEQ ID NO: 3851867 - DNA, 16 bp, Homo sapiens
ctggaaattaattttc

SEQ ID NO: 3851868 - DNA, 13 bp, Homo sapiens
ctgggtacccaaa

SEQ ID NO: 3851869 - DNA, 16 bp, Homo sapiens
ctgggtacccaaaaca

SEQ ID NO: 3851870 - DNA, 22 bp, Homo sapiens
ctgggtacccaaaacacatttt

SEQ ID NO: 3851871 - DNA, 22 bp, Homo sapiens
cttccatgatgttacattagga

SEQ ID NO: 3851872 - DNA, 12 bp, Homo sapiens
ctttaggagaaa

SEQ ID NO: 3851873 - DNA, 13 bp, Homo sapiens
gaacacattcctt

SEQ ID NO: 3851874 - DNA, 17 bp, Homo sapiens
gaagacgaagtgtaaac

SEQ ID NO: 3851875 - DNA, 23 bp, Homo sapiens
gaagtcacattagtgtgttgtct

SEQ ID NO: 3851876 - DNA, 20 bp, Homo sapiens
gacctataacctgtaggaaa

SEQ ID NO: 3851877 - DNA, 13 bp, Homo sapiens
gagtaatggtatt

SEQ ID NO: 3851878 - DNA, 17 bp, Homo sapiens
gatatgttgtattaact

SEQ ID NO: 3851879 - DNA, 15 bp, Homo sapiens
gatctaactgttgtt

SEQ ID NO: 3851880 - DNA, 20 bp, Homo sapiens
gatgtaaagcgggaaggaca

SEQ ID NO: 3851881 - DNA, 21 bp, Homo sapiens
gatgtaaagcgggaaggacat

SEQ ID NO: 3851882 - DNA, 16 bp, Homo sapiens
gatgttacattaggaa

SEQ ID NO: 3851883 - DNA, 19 bp, Homo sapiens
gcactacataatctctgga

SEQ ID NO: 3851884 - DNA, 17 bp, Homo sapiens
gcctcccagcccaacat

SEQ ID NO: 3851885 - DNA, 14 bp, Homo sapiens
gcgcctctcctggg

SEQ ID NO: 3851886 - DNA, 16 bp, Homo sapiens
gctttggttaatctct

SEQ ID NO: 3851887 - DNA, 21 bp, Homo sapiens
ggaagtgccaaagcctggggc

SEQ ID NO: 3851888 - DNA, 14 bp, Homo sapiens
ggatgtaaagcggg

SEQ ID NO: 3851889 - DNA, 15 bp, Homo sapiens
ggcctcccagcccaa

SEQ ID NO: 3851890 - DNA, 23 bp, Homo sapiens
gggcaactgcagtgaccaggggc

SEQ ID NO: 3851891 - DNA, 12 bp, Homo sapiens
ggttaatctctt

SEQ ID NO: 3851892 - DNA, 15 bp, Homo sapiens
gtacccaaaacacat

SEQ ID NO: 3851893 - DNA, 18 bp, Homo sapiens
gtattttctagactgtga

SEQ ID NO: 3851894 - DNA, 17 bp, Homo sapiens
gtgccaaagcctggggc

SEQ ID NO: 3851895 - DNA, 14 bp, Homo sapiens
gttctggatgtaaa

SEQ ID NO: 3851896 - DNA, 14 bp, Homo sapiens
gttgtattaactgg

SEQ ID NO: 3851897 - DNA, 16 bp, Homo sapiens
taaagcgggaaggaca

SEQ ID NO: 3851898 - DNA, 17 bp, Homo sapiens
taaagcgggaaggacat

SEQ ID NO: 3851899 - DNA, 18 bp, Homo sapiens
taatggtattttctagac

SEQ ID NO: 3851900 - DNA, 20 bp, Homo sapiens
taattttctctttaggagaa

SEQ ID NO: 3851901 - DNA, 16 bp, Homo sapiens
tacagaccatggatat

SEQ ID NO: 3851902 - DNA, 17 bp, Homo sapiens
tacataatctctggaaa

SEQ ID NO: 3851903 - DNA, 14 bp, Homo sapiens
tcatgaaagaataa

SEQ ID NO: 3851904 - DNA, 18 bp, Homo sapiens
tcctacaagttaaccagt

SEQ ID NO: 3851905 - DNA, 17 bp, Homo sapiens
tctgattataagacaat

SEQ ID NO: 3851906 - DNA, 22 bp, Homo sapiens
tctttaggagaaattatagtta

SEQ ID NO: 3851907 - DNA, 16 bp, Homo sapiens
tctttcctacaagtta

SEQ ID NO: 3851908 - DNA, 18 bp, Homo sapiens
tgggtacccaaaacacat

SEQ ID NO: 3851909 - DNA, 12 bp, Homo sapiens
tggttaatctct

SEQ ID NO: 3851910 - DNA, 18 bp, Homo sapiens
tggtttaattatatttgc

SEQ ID NO: 3851911 - DNA, 17 bp, Homo sapiens
tgtatgtttatgttaat

SEQ ID NO: 3851912 - DNA, 19 bp, Homo sapiens
tgtattaactgggtaccca

SEQ ID NO: 3851913 - DNA, 19 bp, Homo sapiens
tgttacattaggaagatat

SEQ ID NO: 3851914 - DNA, 12 bp, Homo sapiens
tgtttatgttaa

SEQ ID NO: 3851915 - DNA, 20 bp, Homo sapiens
ttaaaagatttttttaactt

SEQ ID NO: 3851916 - DNA, 22 bp, Homo sapiens
ttaactgggtacccaaaacaca

SEQ ID NO: 3851917 - DNA, 18 bp, Homo sapiens
ttaattttctctttagga

SEQ ID NO: 3851918 - DNA, 20 bp, Homo sapiens
ttaattttctctttaggaga

SEQ ID NO: 3851919 - DNA, 21 bp, Homo sapiens
ttactggaagacgaagtgtaa

SEQ ID NO: 3851920 - DNA, 15 bp, Homo sapiens
ttaggaagatatcat

SEQ ID NO: 3851921 - DNA, 22 bp, Homo sapiens
ttaggaagatatcatgaaagaa

SEQ ID NO: 3851922 - DNA, 21 bp, Homo sapiens
ttatagttaggcttccatgat

SEQ ID NO: 3851923 - DNA, 22 bp, Homo sapiens
ttatatttgctttttaaaagat

SEQ ID NO: 3851924 - DNA, 17 bp, Homo sapiens
ttcctacaagttaacca

SEQ ID NO: 3851925 - DNA, 15 bp, Homo sapiens
ttcctgttacaatat

SEQ ID NO: 3851926 - DNA, 20 bp, Homo sapiens
ttggatggtgaagtcacatt

SEQ ID NO: 3851927 - DNA, 15 bp, Homo sapiens
ttgggatctaactgt

SEQ ID NO: 3851928 - DNA, 16 bp, Homo sapiens
ttgggatctaactgtt

SEQ ID NO: 3851929 - DNA, 23 bp, Homo sapiens
tttaggagaaattatagttaggc

SEQ ID NO: 3851930 - DNA, 18 bp, Homo sapiens
tttcctacaagttaacca

SEQ ID NO: 3851931 - DNA, 14 bp, Homo sapiens
aaaagagtaatggt

SEQ ID NO: 3851932 - DNA, 21 bp, Homo sapiens
aaagccagaaggaaaagagta

SEQ ID NO: 3851933 - DNA, 13 bp, Homo sapiens
aacacattccttt

SEQ ID NO: 3851934 - DNA, 22 bp, Homo sapiens
aactgggtacccaaaacacatt

SEQ ID NO: 3851935 - DNA, 16 bp, Homo sapiens
aactgttgttactgga

SEQ ID NO: 3851936 - DNA, 19 bp, Homo sapiens
aactgttgttactggaaga

SEQ ID NO: 3851937 - DNA, 17 bp, Homo sapiens
aagattcagttcaaatg

SEQ ID NO: 3851938 - DNA, 14 bp, Homo sapiens
aagtgtaaactaag

SEQ ID NO: 3851939 - DNA, 21 bp, Homo sapiens
aattaattttctctttaggag

SEQ ID NO: 3851940 - DNA, 13 bp, Homo sapiens
aattttaatttct

SEQ ID NO: 3851941 - DNA, 22 bp, Homo sapiens
acaatatttagcattattagtt

SEQ ID NO: 3851942 - DNA, 16 bp, Homo sapiens
acataatctctggaaa

SEQ ID NO: 3851943 - DNA, 15 bp, Homo sapiens
acattacagaccatg

SEQ ID NO: 3851944 - DNA, 20 bp, Homo sapiens
acattttccatatttggatg

SEQ ID NO: 3851945 - DNA, 17 bp, Homo sapiens
actacataatctctgga

SEQ ID NO: 3851946 - DNA, 19 bp, Homo sapiens
actacataatctctggaaa

SEQ ID NO: 3851947 - DNA, 23 bp, Homo sapiens
actgggtacccaaaacacatttt

SEQ ID NO: 3851948 - DNA, 15 bp, Homo sapiens
actgttgttactgga

SEQ ID NO: 3851949 - DNA, 17 bp, Homo sapiens
agatatcatgaaagaat

SEQ ID NO: 3851950 - DNA, 21 bp, Homo sapiens
agtcactcttttgggatctaa

SEQ ID NO: 3851951 - DNA, 19 bp, Homo sapiens
agttgcactacataatctc

SEQ ID NO: 3851952 - DNA, 13 bp, Homo sapiens
agtttgttatgtg

SEQ ID NO: 3851953 - DNA, 23 bp, Homo sapiens
ataagacaatgctgctttggtta

SEQ ID NO: 3851954 - DNA, 22 bp, Homo sapiens
atatcagccttgggcaactgca

SEQ ID NO: 3851955 - DNA, 17 bp, Homo sapiens
atatcatgaaagaataa

SEQ ID NO: 3851956 - DNA, 19 bp, Homo sapiens
atctaactgttgttactgg

SEQ ID NO: 3851957 - DNA, 18 bp, Homo sapiens
atgatgttacattaggaa

SEQ ID NO: 3851958 - DNA, 20 bp, Homo sapiens
atggatatgttgtattaact

SEQ ID NO: 3851959 - DNA, 21 bp, Homo sapiens
atggatatgttgtattaactg

SEQ ID NO: 3851960 - DNA, 18 bp, Homo sapiens
atggtgaagtcacattag

SEQ ID NO: 3851961 - DNA, 15 bp, Homo sapiens
atgttacattaggaa

SEQ ID NO: 3851962 - DNA, 22 bp, Homo sapiens
attaactgggtacccaaaacac

SEQ ID NO: 3851963 - DNA, 14 bp, Homo sapiens
attacagaccatgg

SEQ ID NO: 3851964 - DNA, 19 bp, Homo sapiens
attacagaccatggatatg

SEQ ID NO: 3851965 - DNA, 15 bp, Homo sapiens
attagtgtgttgtct

SEQ ID NO: 3851966 - DNA, 13 bp, Homo sapiens
attataagacaat

SEQ ID NO: 3851967 - DNA, 17 bp, Homo sapiens
attttccatatttggat

SEQ ID NO: 3851968 - DNA, 17 bp, Homo sapiens
attttctctttaggaga

SEQ ID NO: 3851969 - DNA, 12 bp, Homo sapiens
caaaacacattt

SEQ ID NO: 3851970 - DNA, 17 bp, Homo sapiens
caacatctccagctgga

SEQ ID NO: 3851971 - DNA, 22 bp, Homo sapiens
cagttgcactacataatctctg

SEQ ID NO: 3851972 - DNA, 22 bp, Homo sapiens
catggatatgttgtattaactg

SEQ ID NO: 3851973 - DNA, 23 bp, Homo sapiens
catggatatgttgtattaactgg

SEQ ID NO: 3851974 - DNA, 16 bp, Homo sapiens
cattacagaccatgga

SEQ ID NO: 3851975 - DNA, 21 bp, Homo sapiens
cattagtgtgttgtctctttc

SEQ ID NO: 3851976 - DNA, 18 bp, Homo sapiens
cattattagtttgttatg

SEQ ID NO: 3851977 - DNA, 18 bp, Homo sapiens
cattttccatatttggat

SEQ ID NO: 3851978 - DNA, 17 bp, Homo sapiens
ccacagggcctcccagc

SEQ ID NO: 3851979 - DNA, 14 bp, Homo sapiens
ccatggatatgttg

SEQ ID NO: 3851980 - DNA, 14 bp, Homo sapiens
cctgttacaatatt

SEQ ID NO: 3851981 - DNA, 18 bp, Homo sapiens
ctacaagttaaccagttg

SEQ ID NO: 3851982 - DNA, 21 bp, Homo sapiens
ctcttttgggatctaactgtt

SEQ ID NO: 3851983 - DNA, 21 bp, Homo sapiens
ctgacctataacctgtaggaa

SEQ ID NO: 3851984 - DNA, 18 bp, Homo sapiens
ctgggtacccaaaacaca

SEQ ID NO: 3851985 - DNA, 18 bp, Homo sapiens
cttgggcaactgcagtga

SEQ ID NO: 3851986 - DNA, 18 bp, Homo sapiens
ctttgcttttcaaaccag

SEQ ID NO: 3851987 - DNA, 14 bp, Homo sapiens
ctttggttaatctc

SEQ ID NO: 3851988 - DNA, 16 bp, Homo sapiens
ctttggttaatctctt

SEQ ID NO: 3851989 - DNA, 15 bp, Homo sapiens
gaaaaagtcactctt

SEQ ID NO: 3851990 - DNA, 15 bp, Homo sapiens
gaaggaaaagagtaa

SEQ ID NO: 3851991 - DNA, 21 bp, Homo sapiens
gacattacagaccatggatat

SEQ ID NO: 3851992 - DNA, 18 bp, Homo sapiens
gagaaattatagttaggc

SEQ ID NO: 3851993 - DNA, 18 bp, Homo sapiens
gatatgttgtattaactg

SEQ ID NO: 3851994 - DNA, 13 bp, Homo sapiens
gatttttttaact

SEQ ID NO: 3851995 - DNA, 22 bp, Homo sapiens
gcccacagggaacacattcctt

SEQ ID NO: 3851996 - DNA, 20 bp, Homo sapiens
ggatatgttgtattaactgg

SEQ ID NO: 3851997 - DNA, 12 bp, Homo sapiens
ggatctaactgt

SEQ ID NO: 3851998 - DNA, 21 bp, Homo sapiens
ggatctaactgttgttactgg

SEQ ID NO: 3851999 - DNA, 12 bp, Homo sapiens
gggagaacgcag

SEQ ID NO: 3852000 - DNA, 14 bp, Homo sapiens
gggcaaagctgtgt

SEQ ID NO: 3852001 - DNA, 15 bp, Homo sapiens
gggcaactgcagtga

SEQ ID NO: 3852002 - DNA, 22 bp, Homo sapiens
ggttcagcgcctctcctggggc

SEQ ID NO: 3852003 - DNA, 13 bp, Homo sapiens
gtacccaaaacac

SEQ ID NO: 3852004 - DNA, 17 bp, Homo sapiens
gtacccaaaacacattt

SEQ ID NO: 3852005 - DNA, 14 bp, Homo sapiens
gtattaactgggta

SEQ ID NO: 3852006 - DNA, 22 bp, Homo sapiens
gtctctttcctacaagttaacc

SEQ ID NO: 3852007 - DNA, 13 bp, Homo sapiens
gttgttactggaa

SEQ ID NO: 3852008 - DNA, 19 bp, Homo sapiens
taaaagatttttttaactt

SEQ ID NO: 3852009 - DNA, 14 bp, Homo sapiens
taaataagattgct

SEQ ID NO: 3852010 - DNA, 22 bp, Homo sapiens
taactgggtacccaaaacacat

SEQ ID NO: 3852011 - DNA, 22 bp, Homo sapiens
taatttctgattataagacaat

SEQ ID NO: 3852012 - DNA, 15 bp, Homo sapiens
tacaagttaaccagt

SEQ ID NO: 3852013 - DNA, 19 bp, Homo sapiens
tacataatctctggaaatt

SEQ ID NO: 3852014 - DNA, 14 bp, Homo sapiens
tacccaaaacacat

SEQ ID NO: 3852015 - DNA, 18 bp, Homo sapiens
tacccaaaacacattttc

SEQ ID NO: 3852016 - DNA, 21 bp, Homo sapiens
tactggaagacgaagtgtaaa

SEQ ID NO: 3852017 - DNA, 12 bp, Homo sapiens
tagactgtgaag

SEQ ID NO: 3852018 - DNA, 14 bp, Homo sapiens
tataagacaatgct

SEQ ID NO: 3852019 - DNA, 19 bp, Homo sapiens
tatgttaattttaatttct

SEQ ID NO: 3852020 - DNA, 15 bp, Homo sapiens
tatgttgtattaact

SEQ ID NO: 3852021 - DNA, 17 bp, Homo sapiens
tatgttgtattaactgg

SEQ ID NO: 3852022 - DNA, 16 bp, Homo sapiens
tatgtttatgttaatt

SEQ ID NO: 3852023 - DNA, 13 bp, Homo sapiens
tattaactgggta

SEQ ID NO: 3852024 - DNA, 19 bp, Homo sapiens
tattaactgggtacccaaa

SEQ ID NO: 3852025 - DNA, 22 bp, Homo sapiens
tcactcttttgggatctaactg

SEQ ID NO: 3852026 - DNA, 23 bp, Homo sapiens
tcactcttttgggatctaactgt

SEQ ID NO: 3852027 - DNA, 20 bp, Homo sapiens
tccagctggatcccagggaa

SEQ ID NO: 3852028 - DNA, 18 bp, Homo sapiens
tccatatttggatggtga

SEQ ID NO: 3852029 - DNA, 12 bp, Homo sapiens
tctctttcctac

SEQ ID NO: 3852030 - DNA, 23 bp, Homo sapiens
tctctttcctacaagttaaccag

SEQ ID NO: 3852031 - DNA, 12 bp, Homo sapiens
tctggatgtaaa

SEQ ID NO: 3852032 - DNA, 19 bp, Homo sapiens
tcttttgggatctaactgt

SEQ ID NO: 3852033 - DNA, 16 bp, Homo sapiens
tgaagtcacattagtg

SEQ ID NO: 3852034 - DNA, 17 bp, Homo sapiens
tgaagtcacattagtgt

SEQ ID NO: 3852035 - DNA, 16 bp, Homo sapiens
tgccaaagcctggggc

SEQ ID NO: 3852036 - DNA, 20 bp, Homo sapiens
tgctgctttggttaatctct

SEQ ID NO: 3852037 - DNA, 21 bp, Homo sapiens
tggatatgttgtattaactgg

SEQ ID NO: 3852038 - DNA, 23 bp, Homo sapiens
tggatatgttgtattaactgggt

SEQ ID NO: 3852039 - DNA, 22 bp, Homo sapiens
tggatgtaaagcgggaaggaca

SEQ ID NO: 3852040 - DNA, 15 bp, Homo sapiens
tgggatctaactgtt

SEQ ID NO: 3852041 - DNA, 18 bp, Homo sapiens
tgtaaagcgggaaggaca

SEQ ID NO: 3852042 - DNA, 12 bp, Homo sapiens
tgtattaactgg

SEQ ID NO: 3852043 - DNA, 19 bp, Homo sapiens
tgttaattttaatttctga

SEQ ID NO: 3852044 - DNA, 13 bp, Homo sapiens
tgttacattagga

SEQ ID NO: 3852045 - DNA, 15 bp, Homo sapiens
tgttgtattaactgg

SEQ ID NO: 3852046 - DNA, 17 bp, Homo sapiens
tgttgtattaactgggt

SEQ ID NO: 3852047 - DNA, 23 bp, Homo sapiens
tgttgtctctttcctacaagtta

SEQ ID NO: 3852048 - DNA, 13 bp, Homo sapiens
ttaacttaaaaag

SEQ ID NO: 3852049 - DNA, 12 bp, Homo sapiens
ttacattaggaa

SEQ ID NO: 3852050 - DNA, 14 bp, Homo sapiens
ttacattaggaaga

SEQ ID NO: 3852051 - DNA, 12 bp, Homo sapiens
ttaggaagatat

SEQ ID NO: 3852052 - DNA, 15 bp, Homo sapiens
ttcaaaccagagaaa

SEQ ID NO: 3852053 - DNA, 21 bp, Homo sapiens
ttcaaaccagagaaaggaaag

SEQ ID NO: 3852054 - DNA, 17 bp, Homo sapiens
ttctctttaggagaaat

SEQ ID NO: 3852055 - DNA, 15 bp, Homo sapiens
ttctggatgtaaagc

SEQ ID NO: 3852056 - DNA, 19 bp, Homo sapiens
ttgcactacataatctctg

SEQ ID NO: 3852057 - DNA, 13 bp, Homo sapiens
ttgtattaactgg

SEQ ID NO: 3852058 - DNA, 14 bp, Homo sapiens
ttgtattaactggg

SEQ ID NO: 3852059 - DNA, 15 bp, Homo sapiens
tttccatatttggat

SEQ ID NO: 3852060 - DNA, 16 bp, Homo sapiens
tttcctacaagttaac

SEQ ID NO: 3852061 - DNA, 14 bp, Homo sapiens
tttctctttaggag

SEQ ID NO: 3852062 - DNA, 14 bp, Homo sapiens
tttggttaatctct

SEQ ID NO: 3852063 - DNA, 15 bp, Homo sapiens
tttggttaatctctt

SEQ ID NO: 3852064 - DNA, 20 bp, Homo sapiens
ttttgggatctaactgttgt

SEQ ID NO: 3852065 - DNA, 13 bp, Homo sapiens
tacataatctctg

SEQ ID NO: 3852066 - DNA, 15 bp, Homo sapiens
tacccaaaacacatt

SEQ ID NO: 3852067 - DNA, 16 bp, Homo sapiens
tagagttctggatgta

SEQ ID NO: 3852068 - DNA, 19 bp, Homo sapiens
tagagttctggatgtaaag

SEQ ID NO: 3852069 - DNA, 13 bp, Homo sapiens
taggcttccatga

SEQ ID NO: 3852070 - DNA, 14 bp, Homo sapiens
tataacctgtagga

SEQ ID NO: 3852071 - DNA, 14 bp, Homo sapiens
tatcatgaaagaat

SEQ ID NO: 3852072 - DNA, 17 bp, Homo sapiens
tatgcaatcactgaaaa

SEQ ID NO: 3852073 - DNA, 18 bp, Homo sapiens
tatgttgtattaactggg

SEQ ID NO: 3852074 - DNA, 18 bp, Homo sapiens
tatttagcattattagtt

SEQ ID NO: 3852075 - DNA, 17 bp, Homo sapiens
tattttctagactgtga

SEQ ID NO: 3852076 - DNA, 20 bp, Homo sapiens
tcaaaccagagaaaggaaag

SEQ ID NO: 3852077 - DNA, 21 bp, Homo sapiens
tcactcttttgggatctaact

SEQ ID NO: 3852078 - DNA, 14 bp, Homo sapiens
tcactgaaaactat

SEQ ID NO: 3852079 - DNA, 15 bp, Homo sapiens
tcactgaaaactatg

SEQ ID NO: 3852080 - DNA, 19 bp, Homo sapiens
tcatgaaagaataaataag

SEQ ID NO: 3852081 - DNA, 15 bp, Homo sapiens
tccatgatgttacat

SEQ ID NO: 3852082 - DNA, 17 bp, Homo sapiens
tctaactgttgttactg

SEQ ID NO: 3852083 - DNA, 14 bp, Homo sapiens
tctagactgtgaag

SEQ ID NO: 3852084 - DNA, 12 bp, Homo sapiens
tctctttaggag

SEQ ID NO: 3852085 - DNA, 13 bp, Homo sapiens
tctctttaggaga

SEQ ID NO: 3852086 - DNA, 15 bp, Homo sapiens
tctttcctacaagtt

SEQ ID NO: 3852087 - DNA, 18 bp, Homo sapiens
tcttttgggatctaactg

SEQ ID NO: 3852088 - DNA, 22 bp, Homo sapiens
tcttttgggatctaactgttgt

SEQ ID NO: 3852089 - DNA, 16 bp, Homo sapiens
tgaaagaataaataag

SEQ ID NO: 3852090 - DNA, 14 bp, Homo sapiens
tgaagtcacattag

SEQ ID NO: 3852091 - DNA, 16 bp, Homo sapiens
tgattataagacaatg

SEQ ID NO: 3852092 - DNA, 20 bp, Homo sapiens
tgcaatcactgaaaactatg

SEQ ID NO: 3852093 - DNA, 16 bp, Homo sapiens
tgcactacataatctc

SEQ ID NO: 3852094 - DNA, 13 bp, Homo sapiens
tgctttggttaat

SEQ ID NO: 3852095 - DNA, 12 bp, Homo sapiens
tggaaattaatt

SEQ ID NO: 3852096 - DNA, 19 bp, Homo sapiens
tggatatgttgtattaact

SEQ ID NO: 3852097 - DNA, 17 bp, Homo sapiens
tggatggtgaagtcaca

SEQ ID NO: 3852098 - DNA, 16 bp, Homo sapiens
tgggcaactgcagtga

SEQ ID NO: 3852099 - DNA, 19 bp, Homo sapiens
tgtaaagcgggaaggacat

SEQ ID NO: 3852100 - DNA, 20 bp, Homo sapiens
tgtaaagcgggaaggacatt

SEQ ID NO: 3852101 - DNA, 16 bp, Homo sapiens
tgttatccttgttcct

SEQ ID NO: 3852102 - DNA, 12 bp, Homo sapiens
tgttgttactgg

SEQ ID NO: 3852103 - DNA, 14 bp, Homo sapiens
ttaattatatttgc

SEQ ID NO: 3852104 - DNA, 20 bp, Homo sapiens
ttcaaaccagagaaaggaaa

SEQ ID NO: 3852105 - DNA, 13 bp, Homo sapiens
ttccatatttgga

SEQ ID NO: 3852106 - DNA, 17 bp, Homo sapiens
ttccatgatgttacatt

SEQ ID NO: 3852107 - DNA, 16 bp, Homo sapiens
ttctagactgtgaaga

SEQ ID NO: 3852108 - DNA, 22 bp, Homo sapiens
ttctagactgtgaagattcagt

SEQ ID NO: 3852109 - DNA, 12 bp, Homo sapiens
ttctctttagga

SEQ ID NO: 3852110 - DNA, 15 bp, Homo sapiens
ttctctttaggagaa

SEQ ID NO: 3852111 - DNA, 14 bp, Homo sapiens
ttctggatgtaaag

SEQ ID NO: 3852112 - DNA, 18 bp, Homo sapiens
ttggatggtgaagtcaca

SEQ ID NO: 3852113 - DNA, 22 bp, Homo sapiens
tttatgttaattttaatttctg

SEQ ID NO: 3852114 - DNA, 12 bp, Homo sapiens
aaaaaaataata

SEQ ID NO: 3852115 - DNA, 11 bp, Homo sapiens
aaaaaaatata

SEQ ID NO: 3852116 - DNA, 12 bp, Homo sapiens
aaaaaaatatat

SEQ ID NO: 3852117 - DNA, 12 bp, Homo sapiens
aaaaaaattgca

SEQ ID NO: 3852118 - DNA, 20 bp, Homo sapiens
aaaaaatacaccacgaattt

SEQ ID NO: 3852119 - DNA, 11 bp, Homo sapiens
aaaaaattaag

SEQ ID NO: 3852120 - DNA, 12 bp, Homo sapiens
aaaaaattgcac

SEQ ID NO: 3852121 - DNA, 12 bp, Homo sapiens
aaaaacacagca

SEQ ID NO: 3852122 - DNA, 13 bp, Homo sapiens
aaaaacacagcaa

SEQ ID NO: 3852123 - DNA, 18 bp, Homo sapiens
aaaaacacagcaagggtg

SEQ ID NO: 3852124 - DNA, 12 bp, Homo sapiens
aaaaacactagt

SEQ ID NO: 3852125 - DNA, 13 bp, Homo sapiens
aaaaacaggaaaa

SEQ ID NO: 3852126 - DNA, 17 bp, Homo sapiens
aaaaaccaatgattcat

SEQ ID NO: 3852127 - DNA, 22 bp, Homo sapiens
aaaaaccagaatcataattttc

SEQ ID NO: 3852128 - DNA, 13 bp, Homo sapiens
aaaaactttcatt

SEQ ID NO: 3852129 - DNA, 14 bp, Homo sapiens
aaaaagaagtaggg

SEQ ID NO: 3852130 - DNA, 18 bp, Homo sapiens
aaaaagctcatattttgt

SEQ ID NO: 3852131 - DNA, 20 bp, Homo sapiens
aaaaaggctagtttattttg

SEQ ID NO: 3852132 - DNA, 22 bp, Homo sapiens
aaaaaggtgtgtcaaagatttt

SEQ ID NO: 3852133 - DNA, 13 bp, Homo sapiens
aaaaagtattttt

SEQ ID NO: 3852134 - DNA, 14 bp, Homo sapiens
aaaaagtatttttt

SEQ ID NO: 3852135 - DNA, 20 bp, Homo sapiens
aaaaagtatttttttaagtt

SEQ ID NO: 3852136 - DNA, 13 bp, Homo sapiens
aaaaagtggctaa

SEQ ID NO: 3852137 - DNA, 12 bp, Homo sapiens
aaaaataaaatg

SEQ ID NO: 3852138 - DNA, 15 bp, Homo sapiens
aaaaataaactagtt

SEQ ID NO: 3852139 - DNA, 20 bp, Homo sapiens
aaaaatactatgaaatgaaa

SEQ ID NO: 3852140 - DNA, 22 bp, Homo sapiens
aaaaatagtaagcctccctcct

SEQ ID NO: 3852141 - DNA, 11 bp, Homo sapiens
aaaaatatata

SEQ ID NO: 3852142 - DNA, 15 bp, Homo sapiens
aaaaatattttctga

SEQ ID NO: 3852143 - DNA, 13 bp, Homo sapiens
aaaaatctagttt

SEQ ID NO: 3852144 - DNA, 16 bp, Homo sapiens
aaaaatctagtttttt

SEQ ID NO: 3852145 - DNA, 16 bp, Homo sapiens
aaaaatcttgggcaag

SEQ ID NO: 3852146 - DNA, 13 bp, Homo sapiens
aaaaatggtaatt

SEQ ID NO: 3852147 - DNA, 17 bp, Homo sapiens
aacagagcgggcctctt

SEQ ID NO: 3852148 - DNA, 22 bp, Homo sapiens
aacagataccatactcatttct

SEQ ID NO: 3852149 - DNA, 18 bp, Homo sapiens
aacagatgataaatattt

SEQ ID NO: 3852150 - DNA, 21 bp, Homo sapiens
aacagcagaggttcttttaaa

SEQ ID NO: 3852151 - DNA, 9 bp, Homo sapiens
aacagcagc

SEQ ID NO: 3852152 - DNA, 22 bp, Homo sapiens
aacagccaaataaaacctcagg

SEQ ID NO: 3852153 - DNA, 16 bp, Homo sapiens
aacagccaacaggtgg

SEQ ID NO: 3852154 - DNA, 14 bp, Homo sapiens
aacagcccatttta

SEQ ID NO: 3852155 - DNA, 17 bp, Homo sapiens
aacagcttgaccagacc

SEQ ID NO: 3852156 - DNA, 11 bp, Homo sapiens
aacaggaaaaa

SEQ ID NO: 3852157 - DNA, 10 bp, Homo sapiens
aacaggaagc

SEQ ID NO: 3852158 - DNA, 14 bp, Homo sapiens
aacaggcaagtgaa

SEQ ID NO: 3852159 - DNA, 15 bp, Homo sapiens
aacagggaaggcagg

SEQ ID NO: 3852160 - DNA, 14 bp, Homo sapiens
aacaggtggagaaa

SEQ ID NO: 3852161 - DNA, 16 bp, Homo sapiens
aacaggttttataatt

SEQ ID NO: 3852162 - DNA, 16 bp, Homo sapiens
aacagtaacacatctt

SEQ ID NO: 3852163 - DNA, 22 bp, Homo sapiens
aacagtagttttgaaactagaa

SEQ ID NO: 3852164 - DNA, 13 bp, Homo sapiens
aacagtcatttaa

SEQ ID NO: 3852165 - DNA, 14 bp, Homo sapiens
aacagtctcaggaa

SEQ ID NO: 3852166 - DNA, 17 bp, Homo sapiens
aacagtctcaggaaatc

SEQ ID NO: 3852167 - DNA, 19 bp, Homo sapiens
aacagtctcaggaaatcaa

SEQ ID NO: 3852168 - DNA, 12 bp, Homo sapiens
aacagtgcctgc

SEQ ID NO: 3852169 - DNA, 14 bp, Homo sapiens
aacataaaatacaa

SEQ ID NO: 3852170 - DNA, 14 bp, Homo sapiens
aacataaaatctgt

SEQ ID NO: 3852171 - DNA, 16 bp, Homo sapiens
aacataaaatctgtga

SEQ ID NO: 3852172 - DNA, 14 bp, Homo sapiens
aacataaagcaaat

SEQ ID NO: 3852173 - DNA, 17 bp, Homo sapiens
aacataattcttgtata

SEQ ID NO: 3852174 - DNA, 18 bp, Homo sapiens
aacatacccttctttaaa

SEQ ID NO: 3852175 - DNA, 19 bp, Homo sapiens
aacatacccttctttaaat

SEQ ID NO: 3852176 - DNA, 15 bp, Homo sapiens
aacatatcaattcaa

SEQ ID NO: 3852177 - DNA, 17 bp, Homo sapiens
aacatatcaattcaaca

SEQ ID NO: 3852178 - DNA, 22 bp, Homo sapiens
aacatatgtattaagccaaaca

SEQ ID NO: 3852179 - DNA, 17 bp, Homo sapiens
aacatcactgaaatgct

SEQ ID NO: 3852180 - DNA, 11 bp, Homo sapiens
aacatccagaa

SEQ ID NO: 3852181 - DNA, 12 bp, Homo sapiens
aacatccagaag

SEQ ID NO: 3852182 - DNA, 22 bp, Homo sapiens
aacatccatgtcctatgtgtga

SEQ ID NO: 3852183 - DNA, 22 bp, Homo sapiens
aacatcctttctattgaaaaat

SEQ ID NO: 3852184 - DNA, 22 bp, Homo sapiens
aacatctattataaaaccatgt

SEQ ID NO: 3852185 - DNA, 21 bp, Homo sapiens
aacatctcgagccccctggat

SEQ ID NO: 3852186 - DNA, 14 bp, Homo sapiens
aacatgatgtgaga

SEQ ID NO: 3852187 - DNA, 20 bp, Homo sapiens
aacatgcacatttatatata

SEQ ID NO: 3852188 - DNA, 20 bp, Homo sapiens
aacatggttttgaaatgctt

SEQ ID NO: 3852189 - DNA, 14 bp, Homo sapiens
aacattaaaagaag

SEQ ID NO: 3852190 - DNA, 15 bp, Homo sapiens
aacattaaacactgt

SEQ ID NO: 3852191 - DNA, 14 bp, Homo sapiens
aacattaaatgtct

SEQ ID NO: 3852192 - DNA, 18 bp, Homo sapiens
aacattaacatctattat

SEQ ID NO: 3852193 - DNA, 23 bp, Homo sapiens
aacattcatccagttgcaataaa

SEQ ID NO: 3852194 - DNA, 17 bp, Homo sapiens
aacattgacttcttggt

SEQ ID NO: 3852195 - DNA, 19 bp, Homo sapiens
aacattgacttcttggttt

SEQ ID NO: 3852196 - DNA, 19 bp, Homo sapiens
aacattgttgctccctgtg

SEQ ID NO: 3852197 - DNA, 20 bp, Homo sapiens
aacattgttgctccctgtga

SEQ ID NO: 3852198 - DNA, 22 bp, Homo sapiens
aacatttacaataaatattctg

SEQ ID NO: 3852199 - DNA, 24 bp, Homo sapiens
aacatttacaataaatattctgca

SEQ ID NO: 3852200 - DNA, 20 bp, Homo sapiens
aacatttcttatgattttta

SEQ ID NO: 3852201 - DNA, 12 bp, Homo sapiens
aaccaaagccag

SEQ ID NO: 3852202 - DNA, 13 bp, Homo sapiens
aaccaaaggacat

SEQ ID NO: 3852203 - DNA, 16 bp, Homo sapiens
aaccaaaggacattat

SEQ ID NO: 3852204 - DNA, 20 bp, Homo sapiens
aaccaagcttcagagcctag

SEQ ID NO: 3852205 - DNA, 18 bp, Homo sapiens
aaccaatgattcataaca

SEQ ID NO: 3852206 - DNA, 23 bp, Homo sapiens
aaccaatgattcataacaatgta

SEQ ID NO: 3852207 - DNA, 14 bp, Homo sapiens
aaccacaactgaca

SEQ ID NO: 3852208 - DNA, 17 bp, Homo sapiens
aaccacactgttgagtt

SEQ ID NO: 3852209 - DNA, 14 bp, Homo sapiens
aaccactgaacatt

SEQ ID NO: 3852210 - DNA, 14 bp, Homo sapiens
aaccactgcaacgg

SEQ ID NO: 3852211 - DNA, 14 bp, Homo sapiens
aaccactgtacata

SEQ ID NO: 3852212 - DNA, 14 bp, Homo sapiens
aaccagaatcataa

SEQ ID NO: 3852213 - DNA, 15 bp, Homo sapiens
aaccagaatcataat

SEQ ID NO: 3852214 - DNA, 17 bp, Homo sapiens
aaccagaatcataattt

SEQ ID NO: 3852215 - DNA, 18 bp, Homo sapiens
aaccagaatcataatttt

SEQ ID NO: 3852216 - DNA, 11 bp, Homo sapiens
aaccagagccc

SEQ ID NO: 3852217 - DNA, 16 bp, Homo sapiens
aaccagcagaaaagtg

SEQ ID NO: 3852218 - DNA, 18 bp, Homo sapiens
aaccagcagaaaagtgct

SEQ ID NO: 3852219 - DNA, 16 bp, Homo sapiens
aaccagcattttacta

SEQ ID NO: 3852220 - DNA, 17 bp, Homo sapiens
aaccagcattttactac

SEQ ID NO: 3852221 - DNA, 15 bp, Homo sapiens
aaccaggactctgcc

SEQ ID NO: 3852222 - DNA, 16 bp, Homo sapiens
aaccaggactctgccc

SEQ ID NO: 3852223 - DNA, 15 bp, Homo sapiens
aaccagtacttctaa

SEQ ID NO: 3852224 - DNA, 20 bp, Homo sapiens
aaccagtatggaagggaggg

SEQ ID NO: 3852225 - DNA, 21 bp, Homo sapiens
aaccagtatggaagggagggg

SEQ ID NO: 3852226 - DNA, 18 bp, Homo sapiens
aaccataacaacttcata

SEQ ID NO: 3852227 - DNA, 22 bp, Homo sapiens
aaccatccctgatgtctgtctg

SEQ ID NO: 3852228 - DNA, 16 bp, Homo sapiens
aaccatgcagcttcat

SEQ ID NO: 3852229 - DNA, 21 bp, Homo sapiens
aaccatgcagcttcatcaatt

SEQ ID NO: 3852230 - DNA, 23 bp, Homo sapiens
aaccatgcagcttcatcaatttt

SEQ ID NO: 3852231 - DNA, 22 bp, Homo sapiens
aacccaaataaatgtgtaaatg

SEQ ID NO: 3852232 - DNA, 18 bp, Homo sapiens
aacccaagtccaagcata

SEQ ID NO: 3852233 - DNA, 17 bp, Homo sapiens
aaaatattttataattt

SEQ ID NO: 3852234 - DNA, 17 bp, Homo sapiens
aaaatcacaagcaataa

SEQ ID NO: 3852235 - DNA, 19 bp, Homo sapiens
aaaatcacaagcaataatt

SEQ ID NO: 3852236 - DNA, 20 bp, Homo sapiens
aaaatcagttatattcttta

SEQ ID NO: 3852237 - DNA, 19 bp, Homo sapiens
aaaatcatgaaaagaggaa

SEQ ID NO: 3852238 - DNA, 17 bp, Homo sapiens
aaaatcattccctttcc

SEQ ID NO: 3852239 - DNA, 10 bp, Homo sapiens
aaaatcattt

SEQ ID NO: 3852240 - DNA, 11 bp, Homo sapiens
aaaatcatttc

SEQ ID NO: 3852241 - DNA, 12 bp, Homo sapiens
aaaatcatttct

SEQ ID NO: 3852242 - DNA, 20 bp, Homo sapiens
aaaatccttgcttatgacat

SEQ ID NO: 3852243 - DNA, 12 bp, Homo sapiens
aaaatctagttt

SEQ ID NO: 3852244 - DNA, 15 bp, Homo sapiens
aaaatctgatttaat

SEQ ID NO: 3852245 - DNA, 16 bp, Homo sapiens
aaaatctgatttaatg

SEQ ID NO: 3852246 - DNA, 20 bp, Homo sapiens
aaaatctgatttaatgtttt

SEQ ID NO: 3852247 - DNA, 21 bp, Homo sapiens
aaaatctgatttaatgttttc

SEQ ID NO: 3852248 - DNA, 13 bp, Homo sapiens
aaaatctggaaat

SEQ ID NO: 3852249 - DNA, 16 bp, Homo sapiens
aaaatctggaaatctg

SEQ ID NO: 3852250 - DNA, 17 bp, Homo sapiens
aaaatgaaaataagtga

SEQ ID NO: 3852251 - DNA, 19 bp, Homo sapiens
aaaatgaaagcatgtctca

SEQ ID NO: 3852252 - DNA, 22 bp, Homo sapiens
aaaatgaaagcatgtctcaata

SEQ ID NO: 3852253 - DNA, 16 bp, Homo sapiens
aaaatgaggacatgtt

SEQ ID NO: 3852254 - DNA, 16 bp, Homo sapiens
aaaatgattgtaaaat

SEQ ID NO: 3852255 - DNA, 20 bp, Homo sapiens
aaaatgattgtaaaatagct

SEQ ID NO: 3852256 - DNA, 15 bp, Homo sapiens
aaaatgcaaaataaa

SEQ ID NO: 3852257 - DNA, 17 bp, Homo sapiens
aaaatgcagtccagaat

SEQ ID NO: 3852258 - DNA, 19 bp, Homo sapiens
aaaatggccatttgctttt

SEQ ID NO: 3852259 - DNA, 16 bp, Homo sapiens
aaaatgtgacccagat

SEQ ID NO: 3852260 - DNA, 22 bp, Homo sapiens
aaaatgttcatcaattcccatt

SEQ ID NO: 3852261 - DNA, 20 bp, Homo sapiens
aaaattctgtaggttctgtg

SEQ ID NO: 3852262 - DNA, 10 bp, Homo sapiens
aaaattgcac

SEQ ID NO: 3852263 - DNA, 13 bp, Homo sapiens
aaaattgcacaat

SEQ ID NO: 3852264 - DNA, 15 bp, Homo sapiens
aaaattgcacaattt

SEQ ID NO: 3852265 - DNA, 13 bp, Homo sapiens
aaaattgtataga

SEQ ID NO: 3852266 - DNA, 15 bp, Homo sapiens
aaaattgtatagaga

SEQ ID NO: 3852267 - DNA, 16 bp, Homo sapiens
aaaattgtatagagat

SEQ ID NO: 3852268 - DNA, 21 bp, Homo sapiens
aaaattgtatagagatatgca

SEQ ID NO: 3852269 - DNA, 21 bp, Homo sapiens
aaaattgtcaaatgtcattat

SEQ ID NO: 3852270 - DNA, 23 bp, Homo sapiens
aaaattttacttttgttctgtat

SEQ ID NO: 3852271 - DNA, 14 bp, Homo sapiens
aaacaaaaagacag

SEQ ID NO: 3852272 - DNA, 12 bp, Homo sapiens
aaacaaaacaac

SEQ ID NO: 3852273 - DNA, 14 bp, Homo sapiens
aaacaaaatatctg

SEQ ID NO: 3852274 - DNA, 21 bp, Homo sapiens
aaacaaaatatctgacatctt

SEQ ID NO: 3852275 - DNA, 20 bp, Homo sapiens
aaacaaggggctgttacata

SEQ ID NO: 3852276 - DNA, 20 bp, Homo sapiens
aaacacaaaagttagctgag

SEQ ID NO: 3852277 - DNA, 16 bp, Homo sapiens
aaacacaccgatgcac

SEQ ID NO: 3852278 - DNA, 22 bp, Homo sapiens
aaacacactgtaaatatccaca

SEQ ID NO: 3852279 - DNA, 17 bp, Homo sapiens
aaacacagggttttgta

SEQ ID NO: 3852280 - DNA, 17 bp, Homo sapiens
aaacacctccccagccc

SEQ ID NO: 3852281 - DNA, 21 bp, Homo sapiens
aaacacgtgtctataatggaa

SEQ ID NO: 3852282 - DNA, 13 bp, Homo sapiens
aaacactgaatca

SEQ ID NO: 3852283 - DNA, 13 bp, Homo sapiens
aaacagaaacaaa

SEQ ID NO: 3852284 - DNA, 21 bp, Homo sapiens
aaacagaaacaaaaacactaa

SEQ ID NO: 3852285 - DNA, 22 bp, Homo sapiens
aaacagacaaaaacagcctcac

SEQ ID NO: 3852286 - DNA, 18 bp, Homo sapiens
aaacagagagagacagag

SEQ ID NO: 3852287 - DNA, 14 bp, Homo sapiens
aaacagataccata

SEQ ID NO: 3852288 - DNA, 19 bp, Homo sapiens
aaacagataccatactcat

SEQ ID NO: 3852289 - DNA, 12 bp, Homo sapiens
aaacagatataa

SEQ ID NO: 3852290 - DNA, 18 bp, Homo sapiens
aaacagatgataaatatt

SEQ ID NO: 3852291 - DNA, 14 bp, Homo sapiens
aaacagccaaataa

SEQ ID NO: 3852292 - DNA, 11 bp, Homo sapiens
aaacagcctgg

SEQ ID NO: 3852293 - DNA, 16 bp, Homo sapiens
aaacaggagacaggaa

SEQ ID NO: 3852294 - DNA, 18 bp, Homo sapiens
aaacaggggatcaaagtt

SEQ ID NO: 3852295 - DNA, 20 bp, Homo sapiens
aaacagtctcaggaaatcaa

SEQ ID NO: 3852296 - DNA, 18 bp, Homo sapiens
aaacagtgcctgctgaat

SEQ ID NO: 3852297 - DNA, 18 bp, Homo sapiens
aaacataaaatatacaaa

SEQ ID NO: 3852298 - DNA, 15 bp, Homo sapiens
aaacatgacactgac

SEQ ID NO: 3852299 - DNA, 17 bp, Homo sapiens
aaacatgacactgacct

SEQ ID NO: 3852300 - DNA, 22 bp, Homo sapiens
aaacatgtggcaacctgttctt

SEQ ID NO: 3852301 - DNA, 18 bp, Homo sapiens
aaaccaaaacagaacaat

SEQ ID NO: 3852302 - DNA, 13 bp, Homo sapiens
aaaccaaagccag

SEQ ID NO: 3852303 - DNA, 17 bp, Homo sapiens
aaaccaaaggacattat

SEQ ID NO: 3852304 - DNA, 23 bp, Homo sapiens
aaaccaaaggacattatgtgtgc

SEQ ID NO: 3852305 - DNA, 14 bp, Homo sapiens
aaaccaagatagat

SEQ ID NO: 3852306 - DNA, 13 bp, Homo sapiens
aaattgtgatgtt

SEQ ID NO: 3852307 - DNA, 15 bp, Homo sapiens
aaattgtgatgtttt

SEQ ID NO: 3852308 - DNA, 18 bp, Homo sapiens
aaattgtgatgttttgtt

SEQ ID NO: 3852309 - DNA, 14 bp, Homo sapiens
aaattgttcctgat

SEQ ID NO: 3852310 - DNA, 22 bp, Homo sapiens
aaattgtttggcttcctcctga

SEQ ID NO: 3852311 - DNA, 19 bp, Homo sapiens
aaatttcaaaagacatgtt

SEQ ID NO: 3852312 - DNA, 21 bp, Homo sapiens
aaatttcaaaagacatgttgt

SEQ ID NO: 3852313 - DNA, 21 bp, Homo sapiens
aaatttgccaccactagagct

SEQ ID NO: 3852314 - DNA, 22 bp, Homo sapiens
aaatttgccaccactagagctg

SEQ ID NO: 3852315 - DNA, 18 bp, Homo sapiens
aaatttgttgaaattatg

SEQ ID NO: 3852316 - DNA, 23 bp, Homo sapiens
aaattttaaggccacggccttgt

SEQ ID NO: 3852317 - DNA, 16 bp, Homo sapiens
aaattttagagcatac

SEQ ID NO: 3852318 - DNA, 13 bp, Homo sapiens
aaattttattcct

SEQ ID NO: 3852319 - DNA, 14 bp, Homo sapiens
aaattttctagact

SEQ ID NO: 3852320 - DNA, 18 bp, Homo sapiens
aaattttctagactttct

SEQ ID NO: 3852321 - DNA, 12 bp, Homo sapiens
aaattttgaatg

SEQ ID NO: 3852322 - DNA, 17 bp, Homo sapiens
aaattttgtttcagaat

SEQ ID NO: 3852323 - DNA, 19 bp, Homo sapiens
aaatttttatcttactttt

SEQ ID NO: 3852324 - DNA, 15 bp, Homo sapiens
aaatttttatttttc

SEQ ID NO: 3852325 - DNA, 13 bp, Homo sapiens
aaatttttcctgc

SEQ ID NO: 3852326 - DNA, 20 bp, Homo sapiens
aaatttttctagaagatatc

SEQ ID NO: 3852327 - DNA, 21 bp, Homo sapiens
aaatttttctcagtttgtata

SEQ ID NO: 3852328 - DNA, 19 bp, Homo sapiens
aaattttttgatgtcagcc

SEQ ID NO: 3852329 - DNA, 14 bp, Homo sapiens
aacaaaacaacaac

SEQ ID NO: 3852330 - DNA, 15 bp, Homo sapiens
aacaaaagagagaat

SEQ ID NO: 3852331 - DNA, 12 bp, Homo sapiens
aacaaaatagaa

SEQ ID NO: 3852332 - DNA, 12 bp, Homo sapiens
aacaaaatatct

SEQ ID NO: 3852333 - DNA, 22 bp, Homo sapiens
aacaaaatcacaagcaataatt

SEQ ID NO: 3852334 - DNA, 18 bp, Homo sapiens
aacaaatatttatatatt

SEQ ID NO: 3852335 - DNA, 15 bp, Homo sapiens
aacaaatcactgtat

SEQ ID NO: 3852336 - DNA, 13 bp, Homo sapiens
aacaaatcttcaa

SEQ ID NO: 3852337 - DNA, 12 bp, Homo sapiens
aacaacaacaat

SEQ ID NO: 3852338 - DNA, 16 bp, Homo sapiens
aacaacaacaataaca

SEQ ID NO: 3852339 - DNA, 14 bp, Homo sapiens
aacaacaacaatac

SEQ ID NO: 3852340 - DNA, 14 bp, Homo sapiens
aacaacaaggaccc

SEQ ID NO: 3852341 - DNA, 12 bp, Homo sapiens
aacaacaataac

SEQ ID NO: 3852342 - DNA, 20 bp, Homo sapiens
aacaacaatggtttacatga

SEQ ID NO: 3852343 - DNA, 14 bp, Homo sapiens
aacaaccatcctgc

SEQ ID NO: 3852344 - DNA, 17 bp, Homo sapiens
aacaactaatcaagagt

SEQ ID NO: 3852345 - DNA, 18 bp, Homo sapiens
aacaactatttataaact

SEQ ID NO: 3852346 - DNA, 13 bp, Homo sapiens
aacaagaaagaaa

SEQ ID NO: 3852347 - DNA, 17 bp, Homo sapiens
aacaagaaagaaacgta

SEQ ID NO: 3852348 - DNA, 17 bp, Homo sapiens
aacaagatctttcagga

SEQ ID NO: 3852349 - DNA, 22 bp, Homo sapiens
aacaaggaccctgttttccaca

SEQ ID NO: 3852350 - DNA, 22 bp, Homo sapiens
aacaaggttcttctaaaattga

SEQ ID NO: 3852351 - DNA, 21 bp, Homo sapiens
aacaagtcacagctgcagctg

SEQ ID NO: 3852352 - DNA, 15 bp, Homo sapiens
aacaataaaacatta

SEQ ID NO: 3852353 - DNA, 15 bp, Homo sapiens
aacaataacaacaat

SEQ ID NO: 3852354 - DNA, 18 bp, Homo sapiens
aacaatacaacaagaaca

SEQ ID NO: 3852355 - DNA, 20 bp, Homo sapiens
aacaatacaacaagaacaac

SEQ ID NO: 3852356 - DNA, 23 bp, Homo sapiens
aacaatacaacaagaacaacaac

SEQ ID NO: 3852357 - DNA, 14 bp, Homo sapiens
aacaatagctattg

SEQ ID NO: 3852358 - DNA, 21 bp, Homo sapiens
aacaatagctattgcatgtaa

SEQ ID NO: 3852359 - DNA, 12 bp, Homo sapiens
aacaatggagat

SEQ ID NO: 3852360 - DNA, 13 bp, Homo sapiens
aacaattttaatg

SEQ ID NO: 3852361 - DNA, 20 bp, Homo sapiens
aacacaaagagaaaaagaaa

SEQ ID NO: 3852362 - DNA, 23 bp, Homo sapiens
aacacaagacaccttttgtattt

SEQ ID NO: 3852363 - DNA, 14 bp, Homo sapiens
aacacaagccacag

SEQ ID NO: 3852364 - DNA, 16 bp, Homo sapiens
aacacaagtcctgtga

SEQ ID NO: 3852365 - DNA, 12 bp, Homo sapiens
aacacacctggt

SEQ ID NO: 3852366 - DNA, 12 bp, Homo sapiens
aacacactgtaa

SEQ ID NO: 3852367 - DNA, 14 bp, Homo sapiens
aacacactgtaaat

SEQ ID NO: 3852368 - DNA, 22 bp, Homo sapiens
aacacactgtaaatatccacag

SEQ ID NO: 3852369 - DNA, 20 bp, Homo sapiens
aacacagcaagggtgatggg

SEQ ID NO: 3852370 - DNA, 16 bp, Homo sapiens
aacacagctgctgaag

SEQ ID NO: 3852371 - DNA, 21 bp, Homo sapiens
aacacagctgctgaagaggca

SEQ ID NO: 3852372 - DNA, 22 bp, Homo sapiens
aacacagctgctgaagaggcaa

SEQ ID NO: 3852373 - DNA, 17 bp, Homo sapiens
aacacagggttttgtat

SEQ ID NO: 3852374 - DNA, 17 bp, Homo sapiens
aacacatactagaaagc

SEQ ID NO: 3852375 - DNA, 15 bp, Homo sapiens
aacacattacttgca

SEQ ID NO: 3852376 - DNA, 22 bp, Homo sapiens
aacacattacttgcacaagctt

SEQ ID NO: 3852377 - DNA, 11 bp, Homo sapiens
aacacccactg

SEQ ID NO: 3852378 - DNA, 13 bp, Homo sapiens
aacacccactggc

SEQ ID NO: 3852379 - DNA, 16 bp, Homo sapiens
aacacccactggccag

SEQ ID NO: 3852380 - DNA, 17 bp, Homo sapiens
aacacccactggccagt

SEQ ID NO: 3852381 - DNA, 20 bp, Homo sapiens
aacacccagtctgttcccca

SEQ ID NO: 3852382 - DNA, 18 bp, Homo sapiens
aacacctccttgctttgc

SEQ ID NO: 3852383 - DNA, 15 bp, Homo sapiens
aacacctgacacatc

SEQ ID NO: 3852384 - DNA, 20 bp, Homo sapiens
aacaccttcttggcttctgg

SEQ ID NO: 3852385 - DNA, 22 bp, Homo sapiens
aacacctttgttttgcactgac

SEQ ID NO: 3852386 - DNA, 15 bp, Homo sapiens
aacacgagcaggcta

SEQ ID NO: 3852387 - DNA, 14 bp, Homo sapiens
aacacggcagctgt

SEQ ID NO: 3852388 - DNA, 15 bp, Homo sapiens
aacactaaaaataaa

SEQ ID NO: 3852389 - DNA, 16 bp, Homo sapiens
aacactcagaagcctg

SEQ ID NO: 3852390 - DNA, 19 bp, Homo sapiens
aacactcagaagcctgggg

SEQ ID NO: 3852391 - DNA, 19 bp, Homo sapiens
aacactccaccccctccag

SEQ ID NO: 3852392 - DNA, 20 bp, Homo sapiens
aacactccaccccctccagc

SEQ ID NO: 3852393 - DNA, 14 bp, Homo sapiens
aacccacctgctga

SEQ ID NO: 3852394 - DNA, 11 bp, Homo sapiens
aacccagagag

SEQ ID NO: 3852395 - DNA, 16 bp, Homo sapiens
aacccagcaacagaaa

SEQ ID NO: 3852396 - DNA, 16 bp, Homo sapiens
aacccagccctggggt

SEQ ID NO: 3852397 - DNA, 12 bp, Homo sapiens
aacccaggaggt

SEQ ID NO: 3852398 - DNA, 17 bp, Homo sapiens
aacccatcttccccgga

SEQ ID NO: 3852399 - DNA, 19 bp, Homo sapiens
aaccccaacgcacaggaaa

SEQ ID NO: 3852400 - DNA, 16 bp, Homo sapiens
aaccccaggcatccca

SEQ ID NO: 3852401 - DNA, 23 bp, Homo sapiens
aaccccagttctgctcctctcca

SEQ ID NO: 3852402 - DNA, 21 bp, Homo sapiens
aacccccacatttacctcgag

SEQ ID NO: 3852403 - DNA, 16 bp, Homo sapiens
aacccccagtgccaca

SEQ ID NO: 3852404 - DNA, 18 bp, Homo sapiens
aacccccgctccagatct

SEQ ID NO: 3852405 - DNA, 21 bp, Homo sapiens
aacccctacatgaaacagaaa

SEQ ID NO: 3852406 - DNA, 17 bp, Homo sapiens
aacccgtggaggctgct

SEQ ID NO: 3852407 - DNA, 15 bp, Homo sapiens
aaccctctcttccct

SEQ ID NO: 3852408 - DNA, 22 bp, Homo sapiens
aaccctgcccacttcagcccag

SEQ ID NO: 3852409 - DNA, 23 bp, Homo sapiens
aaccctgcccacttcagcccagc

SEQ ID NO: 3852410 - DNA, 16 bp, Homo sapiens
aaccctgctttttgac

SEQ ID NO: 3852411 - DNA, 20 bp, Homo sapiens
aaccctgttttatactgtac

SEQ ID NO: 3852412 - DNA, 11 bp, Homo sapiens
aaccgtggccc

SEQ ID NO: 3852413 - DNA, 13 bp, Homo sapiens
aacctaagcaaaa

SEQ ID NO: 3852414 - DNA, 18 bp, Homo sapiens
aacctaccaccccttcct

SEQ ID NO: 3852415 - DNA, 20 bp, Homo sapiens
aacctagaacttcaaaatgt

SEQ ID NO: 3852416 - DNA, 18 bp, Homo sapiens
aacctagtactctctgct

SEQ ID NO: 3852417 - DNA, 15 bp, Homo sapiens
aacctcaatgccctg

SEQ ID NO: 3852418 - DNA, 14 bp, Homo sapiens
aacctcagggacaa

SEQ ID NO: 3852419 - DNA, 20 bp, Homo sapiens
aacctcagggacaacatttt

SEQ ID NO: 3852420 - DNA, 17 bp, Homo sapiens
aacctcatggtcatgga

SEQ ID NO: 3852421 - DNA, 17 bp, Homo sapiens
aacctctctaagccaca

SEQ ID NO: 3852422 - DNA, 20 bp, Homo sapiens
aacctgacagatgtcagccg

SEQ ID NO: 3852423 - DNA, 22 bp, Homo sapiens
aacctgcccctccccagccctt

SEQ ID NO: 3852424 - DNA, 22 bp, Homo sapiens
aacctgcctccaagatttcaga

SEQ ID NO: 3852425 - DNA, 14 bp, Homo sapiens
aacctgcctgtgca

SEQ ID NO: 3852426 - DNA, 19 bp, Homo sapiens
aacctgcctgtgcatgacc

SEQ ID NO: 3852427 - DNA, 20 bp, Homo sapiens
aacctgctctcctcttgcca

SEQ ID NO: 3852428 - DNA, 19 bp, Homo sapiens
aacctggagagctagaacc

SEQ ID NO: 3852429 - DNA, 16 bp, Homo sapiens
aacctggagatgatga

SEQ ID NO: 3852430 - DNA, 18 bp, Homo sapiens
aacctggagatgatgatg

SEQ ID NO: 3852431 - DNA, 22 bp, Homo sapiens
aacctggagggctagaatctgg

SEQ ID NO: 3852432 - DNA, 20 bp, Homo sapiens
aacctggaggggctagaacc

SEQ ID NO: 3852433 - DNA, 12 bp, Homo sapiens
aacctggccttc

SEQ ID NO: 3852434 - DNA, 16 bp, Homo sapiens
aacctggtggcaccag

SEQ ID NO: 3852435 - DNA, 22 bp, Homo sapiens
aacctgtgcagtcccgtggagg

SEQ ID NO: 3852436 - DNA, 22 bp, Homo sapiens
aaccttcatgatgaattacttc

SEQ ID NO: 3852437 - DNA, 11 bp, Homo sapiens
aacgaatgaag

SEQ ID NO: 3852438 - DNA, 19 bp, Homo sapiens
aacgagcactggccagaga

SEQ ID NO: 3852439 - DNA, 18 bp, Homo sapiens
aacgcaaagggctgaaag

SEQ ID NO: 3852440 - DNA, 20 bp, Homo sapiens
aacgcaaagggctgaaagcc

SEQ ID NO: 3852441 - DNA, 19 bp, Homo sapiens
aacgcactttataaaagca

SEQ ID NO: 3852442 - DNA, 16 bp, Homo sapiens
aacgcagccctgcttt

SEQ ID NO: 3852443 - DNA, 20 bp, Homo sapiens
aacgcaggcccccaggtgcc

SEQ ID NO: 3852444 - DNA, 11 bp, Homo sapiens
aacgcctgagc

SEQ ID NO: 3852445 - DNA, 13 bp, Homo sapiens
aacgcctgagccc

SEQ ID NO: 3852446 - DNA, 18 bp, Homo sapiens
aacgcctgagcccaggga

SEQ ID NO: 3852447 - DNA, 19 bp, Homo sapiens
aacgcctgagcccagggag

SEQ ID NO: 3852448 - DNA, 14 bp, Homo sapiens
aacggaagaagaga

SEQ ID NO: 3852449 - DNA, 23 bp, Homo sapiens
aacggaagggttggtgggctggc

SEQ ID NO: 3852450 - DNA, 14 bp, Homo sapiens
aacggctccaggat

SEQ ID NO: 3852451 - DNA, 18 bp, Homo sapiens
aacgggaaagaatataaa

SEQ ID NO: 3852452 - DNA, 21 bp, Homo sapiens
aacgtaatgattatatgacaa

SEQ ID NO: 3852453 - DNA, 13 bp, Homo sapiens
aactaacaaccaa

SEQ ID NO: 3852454 - DNA, 23 bp, Homo sapiens
aactaagcagtccctgagaccat

SEQ ID NO: 3852455 - DNA, 21 bp, Homo sapiens
aactaagttttttacttccac

SEQ ID NO: 3852456 - DNA, 15 bp, Homo sapiens
aactaataaaagcat

SEQ ID NO: 3852457 - DNA, 14 bp, Homo sapiens
aactaatcaagagt

SEQ ID NO: 3852458 - DNA, 21 bp, Homo sapiens
aactaatttaaaccagcagaa

SEQ ID NO: 3852459 - DNA, 20 bp, Homo sapiens
aactacaaagctgaagaaaa

SEQ ID NO: 3852460 - DNA, 13 bp, Homo sapiens
aactactgtaatt

SEQ ID NO: 3852461 - DNA, 20 bp, Homo sapiens
aactagatctcctatttttc

SEQ ID NO: 3852462 - DNA, 23 bp, Homo sapiens
aactagatctcctatttttcaga

SEQ ID NO: 3852463 - DNA, 16 bp, Homo sapiens
aactagtttccagtgg

SEQ ID NO: 3852464 - DNA, 16 bp, Homo sapiens
aactataaactactgt

SEQ ID NO: 3852465 - DNA, 18 bp, Homo sapiens
aactataaactactgtaa

SEQ ID NO: 3852466 - DNA, 19 bp, Homo sapiens
aactataaactactgtaat

SEQ ID NO: 3852467 - DNA, 13 bp, Homo sapiens
aactatattttct

SEQ ID NO: 3852468 - DNA, 16 bp, Homo sapiens
aactatcaatatttaa

SEQ ID NO: 3852469 - DNA, 21 bp, Homo sapiens
aactatccaattaaaattaag

SEQ ID NO: 3852470 - DNA, 18 bp, Homo sapiens
aactatcttggtgaattt

SEQ ID NO: 3852471 - DNA, 18 bp, Homo sapiens
aactatgatatggtaaaa

SEQ ID NO: 3852472 - DNA, 20 bp, Homo sapiens
aactatggttcccaataaaa

SEQ ID NO: 3852473 - DNA, 23 bp, Homo sapiens
aactatggttcccaataaaagtg

SEQ ID NO: 3852474 - DNA, 12 bp, Homo sapiens
aactattgaatt

SEQ ID NO: 3852475 - DNA, 19 bp, Homo sapiens
aactatttgtctttcagga

SEQ ID NO: 3852476 - DNA, 16 bp, Homo sapiens
aactcaccatgtaaaa

SEQ ID NO: 3852477 - DNA, 17 bp, Homo sapiens
aactcacgatgaaattg

SEQ ID NO: 3852478 - DNA, 22 bp, Homo sapiens
aactcacgatgaaattgaacct

SEQ ID NO: 3852479 - DNA, 13 bp, Homo sapiens
actatcacataca

SEQ ID NO: 3852480 - DNA, 14 bp, Homo sapiens
actatcacatacaa

SEQ ID NO: 3852481 - DNA, 22 bp, Homo sapiens
actatcacatacaatttgcact

SEQ ID NO: 3852482 - DNA, 16 bp, Homo sapiens
actatctgtgaagtta

SEQ ID NO: 3852483 - DNA, 22 bp, Homo sapiens
actatctttttgcttacagttt

SEQ ID NO: 3852484 - DNA, 14 bp, Homo sapiens
actatgatcacagt

SEQ ID NO: 3852485 - DNA, 17 bp, Homo sapiens
actatgatcacagtgac

SEQ ID NO: 3852486 - DNA, 16 bp, Homo sapiens
actatgcacaatttaa

SEQ ID NO: 3852487 - DNA, 14 bp, Homo sapiens
actatgctgaagag

SEQ ID NO: 3852488 - DNA, 19 bp, Homo sapiens
actatggtatgctggccag

SEQ ID NO: 3852489 - DNA, 15 bp, Homo sapiens
actatggttcccaat

SEQ ID NO: 3852490 - DNA, 17 bp, Homo sapiens
actatggttcccaataa

SEQ ID NO: 3852491 - DNA, 21 bp, Homo sapiens
actatggttcccaataaaagt

SEQ ID NO: 3852492 - DNA, 14 bp, Homo sapiens
actatgtgatgtta

SEQ ID NO: 3852493 - DNA, 18 bp, Homo sapiens
actattaagagcaataaa

SEQ ID NO: 3852494 - DNA, 15 bp, Homo sapiens
acgtggggagggtgg

SEQ ID NO: 3852495 - DNA, 17 bp, Homo sapiens
acgtgtctttagaactc

SEQ ID NO: 3852496 - DNA, 21 bp, Homo sapiens
acgttctatataaggaggaaa

SEQ ID NO: 3852497 - DNA, 14 bp, Homo sapiens
acgttctccagccc

SEQ ID NO: 3852498 - DNA, 17 bp, Homo sapiens
acgttctccagcccaca

SEQ ID NO: 3852499 - DNA, 19 bp, Homo sapiens
acgttctccagcccacacc

SEQ ID NO: 3852500 - DNA, 22 bp, Homo sapiens
acgttctccagcccacacccct

SEQ ID NO: 3852501 - DNA, 12 bp, Homo sapiens
acgtttccatca

SEQ ID NO: 3852502 - DNA, 11 bp, Homo sapiens
actaaaagaat

SEQ ID NO: 3852503 - DNA, 13 bp, Homo sapiens
actaaactttacc

SEQ ID NO: 3852504 - DNA, 12 bp, Homo sapiens
actaaagagaca

SEQ ID NO: 3852505 - DNA, 13 bp, Homo sapiens
actaaagagacat

SEQ ID NO: 3852506 - DNA, 22 bp, Homo sapiens
actaaagatatcagagctctta

SEQ ID NO: 3852507 - DNA, 21 bp, Homo sapiens
actaaattgtatacattttgt

SEQ ID NO: 3852508 - DNA, 15 bp, Homo sapiens
actaacactcagaag

SEQ ID NO: 3852509 - DNA, 19 bp, Homo sapiens
actaacactcagaagcctg

SEQ ID NO: 3852510 - DNA, 21 bp, Homo sapiens
actaacactcagaagcctggg

SEQ ID NO: 3852511 - DNA, 18 bp, Homo sapiens
actaacataaaatctgtg

SEQ ID NO: 3852512 - DNA, 17 bp, Homo sapiens
actaactatcaaataga

SEQ ID NO: 3852513 - DNA, 14 bp, Homo sapiens
actaacttgtcttt

SEQ ID NO: 3852514 - DNA, 16 bp, Homo sapiens
actaagccacaagaaa

SEQ ID NO: 3852515 - DNA, 23 bp, Homo sapiens
actaagccctcgaaccaaggcag

SEQ ID NO: 3852516 - DNA, 22 bp, Homo sapiens
actaataaaagcataaatgcaa

SEQ ID NO: 3852517 - DNA, 19 bp, Homo sapiens
actaatagagacacagaga

SEQ ID NO: 3852518 - DNA, 19 bp, Homo sapiens
actaatctgggaagggaag

SEQ ID NO: 3852519 - DNA, 17 bp, Homo sapiens
actaattaaaatctgga

SEQ ID NO: 3852520 - DNA, 19 bp, Homo sapiens
actaattaaaatctggaaa

SEQ ID NO: 3852521 - DNA, 20 bp, Homo sapiens
actaattaaaatctggaaat

SEQ ID NO: 3852522 - DNA, 12 bp, Homo sapiens
actaatttaaac

SEQ ID NO: 3852523 - DNA, 14 bp, Homo sapiens
actaatttaaacca

SEQ ID NO: 3852524 - DNA, 15 bp, Homo sapiens
actaatttaaaccag

SEQ ID NO: 3852525 - DNA, 16 bp, Homo sapiens
actaatttaaaccagc

SEQ ID NO: 3852526 - DNA, 18 bp, Homo sapiens
actaatttaaaccagcag

SEQ ID NO: 3852527 - DNA, 14 bp, Homo sapiens
actacactaataaa

SEQ ID NO: 3852528 - DNA, 20 bp, Homo sapiens
actacagaataatgtgttaa

SEQ ID NO: 3852529 - DNA, 22 bp, Homo sapiens
actacagtgacaaattgtaact

SEQ ID NO: 3852530 - DNA, 20 bp, Homo sapiens
actacccgagcccagctaca

SEQ ID NO: 3852531 - DNA, 21 bp, Homo sapiens
actacccgagcccagctacat

SEQ ID NO: 3852532 - DNA, 13 bp, Homo sapiens
actaccctccaga

SEQ ID NO: 3852533 - DNA, 16 bp, Homo sapiens
actactgctgcaaagt

SEQ ID NO: 3852534 - DNA, 20 bp, Homo sapiens
actactgctgcaaagtgcaa

SEQ ID NO: 3852535 - DNA, 16 bp, Homo sapiens
actacttcttggaaaa

SEQ ID NO: 3852536 - DNA, 17 bp, Homo sapiens
actactttgtgttttca

SEQ ID NO: 3852537 - DNA, 14 bp, Homo sapiens
actactttttatac

SEQ ID NO: 3852538 - DNA, 23 bp, Homo sapiens
actactttttatactccatacat

SEQ ID NO: 3852539 - DNA, 23 bp, Homo sapiens
actagaacctggagggctagaac

SEQ ID NO: 3852540 - DNA, 17 bp, Homo sapiens
actagaatttgtatttt

SEQ ID NO: 3852541 - DNA, 20 bp, Homo sapiens
actagaatttgtattttgct

SEQ ID NO: 3852542 - DNA, 17 bp, Homo sapiens
actagagctgggaaaca

SEQ ID NO: 3852543 - DNA, 22 bp, Homo sapiens
actagagctgggaaacagggag

SEQ ID NO: 3852544 - DNA, 23 bp, Homo sapiens
actagagctgggaaacagggagc

SEQ ID NO: 3852545 - DNA, 15 bp, Homo sapiens
actagaggcagggag

SEQ ID NO: 3852546 - DNA, 22 bp, Homo sapiens
actagatctcctatttttcaga

SEQ ID NO: 3852547 - DNA, 15 bp, Homo sapiens
actagatggcgagca

SEQ ID NO: 3852548 - DNA, 11 bp, Homo sapiens
actagcaggca

SEQ ID NO: 3852549 - DNA, 16 bp, Homo sapiens
actagccaaggctagt

SEQ ID NO: 3852550 - DNA, 21 bp, Homo sapiens
actagccatgataactgcaat

SEQ ID NO: 3852551 - DNA, 23 bp, Homo sapiens
actagctagaagtgggccaggac

SEQ ID NO: 3852552 - DNA, 14 bp, Homo sapiens
actaggttctaggt

SEQ ID NO: 3852553 - DNA, 19 bp, Homo sapiens
actagtattgtccatatca

SEQ ID NO: 3852554 - DNA, 18 bp, Homo sapiens
actagtttaattaactat

SEQ ID NO: 3852555 - DNA, 13 bp, Homo sapiens
actagtttccagt

SEQ ID NO: 3852556 - DNA, 17 bp, Homo sapiens
actagttttgtgccagc

SEQ ID NO: 3852557 - DNA, 13 bp, Homo sapiens
actataaacatta

SEQ ID NO: 3852558 - DNA, 18 bp, Homo sapiens
actataaactactgtaat

SEQ ID NO: 3852559 - DNA, 22 bp, Homo sapiens
actataactgtcatctagcccc

SEQ ID NO: 3852560 - DNA, 14 bp, Homo sapiens
actatacaacaatg

SEQ ID NO: 3852561 - DNA, 14 bp, Homo sapiens
actatagcccaggt

SEQ ID NO: 3852562 - DNA, 18 bp, Homo sapiens
actatatacatgtgtgta

SEQ ID NO: 3852563 - DNA, 14 bp, Homo sapiens
acgattttgcacaa

SEQ ID NO: 3852564 - DNA, 17 bp, Homo sapiens
acgcaaagggctgaaag

SEQ ID NO: 3852565 - DNA, 17 bp, Homo sapiens
acgcaacccttgctgct

SEQ ID NO: 3852566 - DNA, 17 bp, Homo sapiens
acgcaagggagaagaaa

SEQ ID NO: 3852567 - DNA, 21 bp, Homo sapiens
acgcaagggagaagaaatcca

SEQ ID NO: 3852568 - DNA, 22 bp, Homo sapiens
acgcaagggagaagaaatccat

SEQ ID NO: 3852569 - DNA, 20 bp, Homo sapiens
acgcaagggcatcaggcact

SEQ ID NO: 3852570 - DNA, 21 bp, Homo sapiens
acgcaagggcatcaggcactg

SEQ ID NO: 3852571 - DNA, 21 bp, Homo sapiens
acgcaattgtgggatgtcctc

SEQ ID NO: 3852572 - DNA, 17 bp, Homo sapiens
acgcacagccaaggact

SEQ ID NO: 3852573 - DNA, 18 bp, Homo sapiens
acgcacatagagatatgc

SEQ ID NO: 3852574 - DNA, 21 bp, Homo sapiens
acgcacatagagatatgcaca

SEQ ID NO: 3852575 - DNA, 19 bp, Homo sapiens
acgcacgcaacccttgctg

SEQ ID NO: 3852576 - DNA, 15 bp, Homo sapiens
acgcagaggcggaaa

SEQ ID NO: 3852577 - DNA, 11 bp, Homo sapiens
acgcagcagct

SEQ ID NO: 3852578 - DNA, 12 bp, Homo sapiens
acgcagcagctg

SEQ ID NO: 3852579 - DNA, 21 bp, Homo sapiens
acgcagcagctgggacccctc

SEQ ID NO: 3852580 - DNA, 22 bp, Homo sapiens
acgcagcagctgggacccctcc

SEQ ID NO: 3852581 - DNA, 19 bp, Homo sapiens
acgcagccctgggggccag

SEQ ID NO: 3852582 - DNA, 22 bp, Homo sapiens
acgcagccctgggggccagctg

SEQ ID NO: 3852583 - DNA, 23 bp, Homo sapiens
acgcagccctgggggccagctgg

SEQ ID NO: 3852584 - DNA, 17 bp, Homo sapiens
acgcaggaactcccagc

SEQ ID NO: 3852585 - DNA, 22 bp, Homo sapiens
acgcaggcccccaggtgccagt

SEQ ID NO: 3852586 - DNA, 14 bp, Homo sapiens
acgcatcctgcagt

SEQ ID NO: 3852587 - DNA, 23 bp, Homo sapiens
acgcccctccctcctctggccca

SEQ ID NO: 3852588 - DNA, 19 bp, Homo sapiens
acgccctgcgttggagcca

SEQ ID NO: 3852589 - DNA, 22 bp, Homo sapiens
acgccctgcgttggagccactc

SEQ ID NO: 3852590 - DNA, 14 bp, Homo sapiens
acgcctcctggcca

SEQ ID NO: 3852591 - DNA, 20 bp, Homo sapiens
acgcctgagcccagggaggc

SEQ ID NO: 3852592 - DNA, 21 bp, Homo sapiens
acgcctgagcccagggaggcc

SEQ ID NO: 3852593 - DNA, 20 bp, Homo sapiens
acgcctgtaatcccagcact

SEQ ID NO: 3852594 - DNA, 21 bp, Homo sapiens
acgcctgtaatcccagcactt

SEQ ID NO: 3852595 - DNA, 12 bp, Homo sapiens
acgcgcacacac

SEQ ID NO: 3852596 - DNA, 15 bp, Homo sapiens
acgcgcacacacacc

SEQ ID NO: 3852597 - DNA, 21 bp, Homo sapiens
acgctcccccgcagtccccag

SEQ ID NO: 3852598 - DNA, 12 bp, Homo sapiens
acgctctggaca

SEQ ID NO: 3852599 - DNA, 14 bp, Homo sapiens
acgctgtcctctcg

SEQ ID NO: 3852600 - DNA, 21 bp, Homo sapiens
acgctgtcctctcgagcccag

SEQ ID NO: 3852601 - DNA, 14 bp, Homo sapiens
acgcttccagacca

SEQ ID NO: 3852602 - DNA, 19 bp, Homo sapiens
acgcttccagaccacctgc

SEQ ID NO: 3852603 - DNA, 23 bp, Homo sapiens
acgcttccagaccacctgccagc

SEQ ID NO: 3852604 - DNA, 17 bp, Homo sapiens
acgctttgggagaatgt

SEQ ID NO: 3852605 - DNA, 19 bp, Homo sapiens
acgcttttgggaaaactgg

SEQ ID NO: 3852606 - DNA, 16 bp, Homo sapiens
acggagagtgcttggg

SEQ ID NO: 3852607 - DNA, 14 bp, Homo sapiens
acggagatgtttca

SEQ ID NO: 3852608 - DNA, 18 bp, Homo sapiens
acggagccccaggcctct

SEQ ID NO: 3852609 - DNA, 21 bp, Homo sapiens
acggagccccaggcctctgtg

SEQ ID NO: 3852610 - DNA, 21 bp, Homo sapiens
acggatccatgtagcaggact

SEQ ID NO: 3852611 - DNA, 16 bp, Homo sapiens
acggatgcacacacag

SEQ ID NO: 3852612 - DNA, 19 bp, Homo sapiens
acggcacctgggccctggg

SEQ ID NO: 3852613 - DNA, 20 bp, Homo sapiens
acggcacctgggccctgggg

SEQ ID NO: 3852614 - DNA, 20 bp, Homo sapiens
acggcagagaccccaggatc

SEQ ID NO: 3852615 - DNA, 12 bp, Homo sapiens
acggccaccctc

SEQ ID NO: 3852616 - DNA, 23 bp, Homo sapiens
acggcttagacttcgactcagga

SEQ ID NO: 3852617 - DNA, 14 bp, Homo sapiens
acgggagcctcctc

SEQ ID NO: 3852618 - DNA, 16 bp, Homo sapiens
acgggcagtagctgtg

SEQ ID NO: 3852619 - DNA, 15 bp, Homo sapiens
acgggcctcagtttc

SEQ ID NO: 3852620 - DNA, 17 bp, Homo sapiens
acgggcctcagtttccc

SEQ ID NO: 3852621 - DNA, 19 bp, Homo sapiens
acggtcctttaggcagcct

SEQ ID NO: 3852622 - DNA, 20 bp, Homo sapiens
acggtcctttaggcagcctg

SEQ ID NO: 3852623 - DNA, 21 bp, Homo sapiens
acggtcctttaggcagcctgc

SEQ ID NO: 3852624 - DNA, 14 bp, Homo sapiens
acggtgaaatccag

SEQ ID NO: 3852625 - DNA, 15 bp, Homo sapiens
acggtgaaatccagg

SEQ ID NO: 3852626 - DNA, 16 bp, Homo sapiens
acggtgaaatccaggt

SEQ ID NO: 3852627 - DNA, 18 bp, Homo sapiens
acggtgaaatccaggtct

SEQ ID NO: 3852628 - DNA, 18 bp, Homo sapiens
acggtgcgtggctgtggc

SEQ ID NO: 3852629 - DNA, 20 bp, Homo sapiens
acggtgctcgcttctcctcc

SEQ ID NO: 3852630 - DNA, 19 bp, Homo sapiens
actttctcttcatactttt

SEQ ID NO: 3852631 - DNA, 19 bp, Homo sapiens
actttctgttgccacaacc

SEQ ID NO: 3852632 - DNA, 15 bp, Homo sapiens
actttgatctctgct

SEQ ID NO: 3852633 - DNA, 19 bp, Homo sapiens
actggccagagagggccca

SEQ ID NO: 3852634 - DNA, 20 bp, Homo sapiens
actggccagagagggcccag

SEQ ID NO: 3852635 - DNA, 23 bp, Homo sapiens
actggccagtcctagagctcctg

SEQ ID NO: 3852636 - DNA, 12 bp, Homo sapiens
actggccccacc

SEQ ID NO: 3852637 - DNA, 14 bp, Homo sapiens
actggctcacccct

SEQ ID NO: 3852638 - DNA, 16 bp, Homo sapiens
actggctggggcagag

SEQ ID NO: 3852639 - DNA, 15 bp, Homo sapiens
actgggatcgcacct

SEQ ID NO: 3852640 - DNA, 13 bp, Homo sapiens
actgggcaatgat

SEQ ID NO: 3852641 - DNA, 16 bp, Homo sapiens
actggggatgtgggag

SEQ ID NO: 3852642 - DNA, 18 bp, Homo sapiens
actggggatgtgggaggg

SEQ ID NO: 3852643 - DNA, 15 bp, Homo sapiens
actgggtagtagcta

SEQ ID NO: 3852644 - DNA, 16 bp, Homo sapiens
actgggttctagaacc

SEQ ID NO: 3852645 - DNA, 20 bp, Homo sapiens
actggtcctgtgtgcagtga

SEQ ID NO: 3852646 - DNA, 21 bp, Homo sapiens
actggtggcccgacagcctgg

SEQ ID NO: 3852647 - DNA, 22 bp, Homo sapiens
actggtggcccgacagcctggc

SEQ ID NO: 3852648 - DNA, 16 bp, Homo sapiens
actggttgtgaataat

SEQ ID NO: 3852649 - DNA, 17 bp, Homo sapiens
actgtaaatacaaaata

SEQ ID NO: 3852650 - DNA, 11 bp, Homo sapiens
actgtaaatca

SEQ ID NO: 3852651 - DNA, 12 bp, Homo sapiens
actgtaaatcac

SEQ ID NO: 3852652 - DNA, 17 bp, Homo sapiens
actgtaaatcacttgta

SEQ ID NO: 3852653 - DNA, 19 bp, Homo sapiens
actgtaaatcacttgtaaa

SEQ ID NO: 3852654 - DNA, 14 bp, Homo sapiens
actgtaattttgtt

SEQ ID NO: 3852655 - DNA, 18 bp, Homo sapiens
actgtaattttgtttgta

SEQ ID NO: 3852656 - DNA, 21 bp, Homo sapiens
actgtaattttgtttgtaatc

SEQ ID NO: 3852657 - DNA, 22 bp, Homo sapiens
actgtaattttgtttgtaatcc

SEQ ID NO: 3852658 - DNA, 20 bp, Homo sapiens
actgtacatagatgtatcat

SEQ ID NO: 3852659 - DNA, 22 bp, Homo sapiens
actgtactgagacattacagtt

SEQ ID NO: 3852660 - DNA, 17 bp, Homo sapiens
actgtacttaataaatt

SEQ ID NO: 3852661 - DNA, 18 bp, Homo sapiens
actgtacttaataaattc

SEQ ID NO: 3852662 - DNA, 22 bp, Homo sapiens
actgtatctctaatacagtgtg

SEQ ID NO: 3852663 - DNA, 14 bp, Homo sapiens
actgtcagagctgt

SEQ ID NO: 3852664 - DNA, 21 bp, Homo sapiens
actgtcagctcccctcggaga

SEQ ID NO: 3852665 - DNA, 13 bp, Homo sapiens
actgtccctcaaa

SEQ ID NO: 3852666 - DNA, 20 bp, Homo sapiens
actgtccgcctctgcccgca

SEQ ID NO: 3852667 - DNA, 22 bp, Homo sapiens
actgtccgcctctgcccgcaga

SEQ ID NO: 3852668 - DNA, 17 bp, Homo sapiens
actgtcgctgcttcgtg

SEQ ID NO: 3852669 - DNA, 19 bp, Homo sapiens
actgtctcaagagggcact

SEQ ID NO: 3852670 - DNA, 16 bp, Homo sapiens
actgtgccctgccttc

SEQ ID NO: 3852671 - DNA, 17 bp, Homo sapiens
actgtgccctgccttca

SEQ ID NO: 3852672 - DNA, 18 bp, Homo sapiens
actgtgccctgccttcag

SEQ ID NO: 3852673 - DNA, 16 bp, Homo sapiens
actgtgcttacagtga

SEQ ID NO: 3852674 - DNA, 18 bp, Homo sapiens
actgtgcttacagtgact

SEQ ID NO: 3852675 - DNA, 14 bp, Homo sapiens
actgtggccagagc

SEQ ID NO: 3852676 - DNA, 15 bp, Homo sapiens
actgtggccagagct

SEQ ID NO: 3852677 - DNA, 17 bp, Homo sapiens
actgtggccagagctgg

SEQ ID NO: 3852678 - DNA, 17 bp, Homo sapiens
actgtggctttggcaga

SEQ ID NO: 3852679 - DNA, 14 bp, Homo sapiens
actgtgtgaagaaa

SEQ ID NO: 3852680 - DNA, 18 bp, Homo sapiens
actgtgtgaagaaatgga

SEQ ID NO: 3852681 - DNA, 14 bp, Homo sapiens
actgtgttcattag

SEQ ID NO: 3852682 - DNA, 14 bp, Homo sapiens
actgttacttttta

SEQ ID NO: 3852683 - DNA, 22 bp, Homo sapiens
actgttactttttagtctttta

SEQ ID NO: 3852684 - DNA, 21 bp, Homo sapiens
actgttgaaaattattttaaa

SEQ ID NO: 3852685 - DNA, 18 bp, Homo sapiens
actgttgagttggacaca

SEQ ID NO: 3852686 - DNA, 20 bp, Homo sapiens
actgtttggctgacatgact

SEQ ID NO: 3852687 - DNA, 13 bp, Homo sapiens
acttaaaaaaatg

SEQ ID NO: 3852688 - DNA, 17 bp, Homo sapiens
acttaaaaaaatgacag

SEQ ID NO: 3852689 - DNA, 22 bp, Homo sapiens
acttaaaaaaatgacagatgtt

SEQ ID NO: 3852690 - DNA, 23 bp, Homo sapiens
acttaaaaaacttgtaaatgctg

SEQ ID NO: 3852691 - DNA, 14 bp, Homo sapiens
acttaaaagattca

SEQ ID NO: 3852692 - DNA, 20 bp, Homo sapiens
acttaaattttaagcttgaa

SEQ ID NO: 3852693 - DNA, 17 bp, Homo sapiens
acttaacggctccagga

SEQ ID NO: 3852694 - DNA, 19 bp, Homo sapiens
acttaacggctccaggatt

SEQ ID NO: 3852695 - DNA, 21 bp, Homo sapiens
acttaactgtgtgaagaaatg

SEQ ID NO: 3852696 - DNA, 15 bp, Homo sapiens
acttaagagaaatgg

SEQ ID NO: 3852697 - DNA, 17 bp, Homo sapiens
acttaagagaaatggca

SEQ ID NO: 3852698 - DNA, 13 bp, Homo sapiens
acttaataaattc

SEQ ID NO: 3852699 - DNA, 15 bp, Homo sapiens
acttagaataaaatt

SEQ ID NO: 3852700 - DNA, 16 bp, Homo sapiens
acttagaataaaattg

SEQ ID NO: 3852701 - DNA, 22 bp, Homo sapiens
acttagaataaaattgtaaaat

SEQ ID NO: 3852702 - DNA, 13 bp, Homo sapiens
acttagcccaaga

SEQ ID NO: 3852703 - DNA, 21 bp, Homo sapiens
acttagcccaagaggtctgag

SEQ ID NO: 3852704 - DNA, 23 bp, Homo sapiens
acttagccgtccatggcaccagc

SEQ ID NO: 3852705 - DNA, 17 bp, Homo sapiens
acttatatcatcagcat

SEQ ID NO: 3852706 - DNA, 22 bp, Homo sapiens
acttatatcatcagcatacctt

SEQ ID NO: 3852707 - DNA, 20 bp, Homo sapiens
acttatcaaaagacagcact

SEQ ID NO: 3852708 - DNA, 16 bp, Homo sapiens
acttatgctagtttat

SEQ ID NO: 3852709 - DNA, 16 bp, Homo sapiens
acttatttttgacagt

SEQ ID NO: 3852710 - DNA, 22 bp, Homo sapiens
acttcaagtgcatgctctctgc

SEQ ID NO: 3852711 - DNA, 13 bp, Homo sapiens
acttcacactgca

SEQ ID NO: 3852712 - DNA, 19 bp, Homo sapiens
agaagtgggccaggacagg

SEQ ID NO: 3852713 - DNA, 23 bp, Homo sapiens
agaagtgggccaggacaggcccg

SEQ ID NO: 3852714 - DNA, 23 bp, Homo sapiens
agaagtttctggccctggctgac

SEQ ID NO: 3852715 - DNA, 15 bp, Homo sapiens
agaagtttgtcaagt

SEQ ID NO: 3852716 - DNA, 17 bp, Homo sapiens
agaataaagttctgagt

SEQ ID NO: 3852717 - DNA, 20 bp, Homo sapiens
agaataagaaaacaatcaca

SEQ ID NO: 3852718 - DNA, 21 bp, Homo sapiens
agaataagagaaagaaaatga

SEQ ID NO: 3852719 - DNA, 15 bp, Homo sapiens
agaataagtgctgtt

SEQ ID NO: 3852720 - DNA, 20 bp, Homo sapiens
agaataagtgctgtttgaga

SEQ ID NO: 3852721 - DNA, 21 bp, Homo sapiens
agaataagtgctgtttgagat

SEQ ID NO: 3852722 - DNA, 12 bp, Homo sapiens
agaatacagaaa

SEQ ID NO: 3852723 - DNA, 16 bp, Homo sapiens
agaatagatgctgact

SEQ ID NO: 3852724 - DNA, 20 bp, Homo sapiens
agaatatcaagatgattctg

SEQ ID NO: 3852725 - DNA, 14 bp, Homo sapiens
agaatatggacaaa

SEQ ID NO: 3852726 - DNA, 12 bp, Homo sapiens
agaatattcagg

SEQ ID NO: 3852727 - DNA, 15 bp, Homo sapiens
agaatatttcaaatg

SEQ ID NO: 3852728 - DNA, 21 bp, Homo sapiens
agaatatttcaaatgaacacg

SEQ ID NO: 3852729 - DNA, 19 bp, Homo sapiens
agaatcagggcaggcttgc

SEQ ID NO: 3852730 - DNA, 22 bp, Homo sapiens
agaatcagggcaggcttgccac

SEQ ID NO: 3852731 - DNA, 16 bp, Homo sapiens
agaatcataattttca

SEQ ID NO: 3852732 - DNA, 12 bp, Homo sapiens
agaatccctgca

SEQ ID NO: 3852733 - DNA, 21 bp, Homo sapiens
agaatcctaggctccacccca

SEQ ID NO: 3852734 - DNA, 21 bp, Homo sapiens
agaatcctgcctctccccaaa

SEQ ID NO: 3852735 - DNA, 20 bp, Homo sapiens
agaatctgaagctattgatg

SEQ ID NO: 3852736 - DNA, 17 bp, Homo sapiens
agaatctgctgttgcca

SEQ ID NO: 3852737 - DNA, 13 bp, Homo sapiens
agaatctggagag

SEQ ID NO: 3852738 - DNA, 16 bp, Homo sapiens
agaatctggagagcta

SEQ ID NO: 3852739 - DNA, 14 bp, Homo sapiens
agaatcttgtattt

SEQ ID NO: 3852740 - DNA, 21 bp, Homo sapiens
agaatgagggaaattgctatt

SEQ ID NO: 3852741 - DNA, 20 bp, Homo sapiens
agaatgatatccagtaagca

SEQ ID NO: 3852742 - DNA, 13 bp, Homo sapiens
agaatgatttcat

SEQ ID NO: 3852743 - DNA, 11 bp, Homo sapiens
agaatgcacac

SEQ ID NO: 3852744 - DNA, 16 bp, Homo sapiens
agaatgtgattccttt

SEQ ID NO: 3852745 - DNA, 20 bp, Homo sapiens
agaatgtgattccttttgat

SEQ ID NO: 3852746 - DNA, 23 bp, Homo sapiens
agaatgttactttggaatgacta

SEQ ID NO: 3852747 - DNA, 13 bp, Homo sapiens
agaattatatcta

SEQ ID NO: 3852748 - DNA, 17 bp, Homo sapiens
agaattatatctaattt

SEQ ID NO: 3852749 - DNA, 23 bp, Homo sapiens
agaattatatctaatttatacaa

SEQ ID NO: 3852750 - DNA, 14 bp, Homo sapiens
agaattatttttgt

SEQ ID NO: 3852751 - DNA, 16 bp, Homo sapiens
agaattatttttgtgt

SEQ ID NO: 3852752 - DNA, 21 bp, Homo sapiens
agaattatttttgtgtttcta

SEQ ID NO: 3852753 - DNA, 14 bp, Homo sapiens
agaattccaaggag

SEQ ID NO: 3852754 - DNA, 15 bp, Homo sapiens
agaattcccagctgt

SEQ ID NO: 3852755 - DNA, 17 bp, Homo sapiens
agaattcctgaagccag

SEQ ID NO: 3852756 - DNA, 19 bp, Homo sapiens
agaattcctgaagccagat

SEQ ID NO: 3852757 - DNA, 17 bp, Homo sapiens
agaattcttcaggtgga

SEQ ID NO: 3852758 - DNA, 16 bp, Homo sapiens
agaattgaacccagga

SEQ ID NO: 3852759 - DNA, 14 bp, Homo sapiens
agaattgggaagct

SEQ ID NO: 3852760 - DNA, 19 bp, Homo sapiens
agaattgtccatgtgcttc

SEQ ID NO: 3852761 - DNA, 23 bp, Homo sapiens
agaattgtgcaaatggaagacaa

SEQ ID NO: 3852762 - DNA, 19 bp, Homo sapiens
agaatttgtattttgctta

SEQ ID NO: 3852763 - DNA, 20 bp, Homo sapiens
agaattttcagaccccagcg

SEQ ID NO: 3852764 - DNA, 21 bp, Homo sapiens
agaattttcagaccccagcgg

SEQ ID NO: 3852765 - DNA, 12 bp, Homo sapiens
agaattttgtat

SEQ ID NO: 3852766 - DNA, 17 bp, Homo sapiens
agaatttttaatgactt

SEQ ID NO: 3852767 - DNA, 16 bp, Homo sapiens
agacaaaaacagcctc

SEQ ID NO: 3852768 - DNA, 22 bp, Homo sapiens
agacaaaaacagcctcacagaa

SEQ ID NO: 3852769 - DNA, 14 bp, Homo sapiens
agacaaaccactgt

SEQ ID NO: 3852770 - DNA, 13 bp, Homo sapiens
agacaagaaatcc

SEQ ID NO: 3852771 - DNA, 18 bp, Homo sapiens
agacaagaaatccctgtt

SEQ ID NO: 3852772 - DNA, 14 bp, Homo sapiens
agacaagcaacagg

SEQ ID NO: 3852773 - DNA, 12 bp, Homo sapiens
agacaagccctg

SEQ ID NO: 3852774 - DNA, 16 bp, Homo sapiens
agacaagccctggcaa

SEQ ID NO: 3852775 - DNA, 19 bp, Homo sapiens
agacaagtaatcactaacc

SEQ ID NO: 3852776 - DNA, 19 bp, Homo sapiens
agacaatccactctcagga

SEQ ID NO: 3852777 - DNA, 20 bp, Homo sapiens
agacaatccccacataccat

SEQ ID NO: 3852778 - DNA, 19 bp, Homo sapiens
agacacagagtggagccct

SEQ ID NO: 3852779 - DNA, 13 bp, Homo sapiens
agacacagataca

SEQ ID NO: 3852780 - DNA, 18 bp, Homo sapiens
agacacatcaaatgcccc

SEQ ID NO: 3852781 - DNA, 18 bp, Homo sapiens
agacacattctcctgtgc

SEQ ID NO: 3852782 - DNA, 17 bp, Homo sapiens
agacacctgcacctccc

SEQ ID NO: 3852783 - DNA, 21 bp, Homo sapiens
agacacctgcacctcccccca

SEQ ID NO: 3852784 - DNA, 19 bp, Homo sapiens
agacaccttttgtatttaa

SEQ ID NO: 3852785 - DNA, 19 bp, Homo sapiens
agacactcccagggacaag

SEQ ID NO: 3852786 - DNA, 20 bp, Homo sapiens
agacactgccacacagggtc

SEQ ID NO: 3852787 - DNA, 20 bp, Homo sapiens
agacacttctaaatgaagtg

SEQ ID NO: 3852788 - DNA, 15 bp, Homo sapiens
agacacttgccttct

SEQ ID NO: 3852789 - DNA, 16 bp, Homo sapiens
agacagaaacagagag

SEQ ID NO: 3852790 - DNA, 17 bp, Homo sapiens
agacagaaacagagaga

SEQ ID NO: 3852791 - DNA, 18 bp, Homo sapiens
agacagaaacagagagag

SEQ ID NO: 3852792 - DNA, 12 bp, Homo sapiens
agacagagacag

SEQ ID NO: 3852793 - DNA, 13 bp, Homo sapiens
agacagagagaga

SEQ ID NO: 3852794 - DNA, 10 bp, Homo sapiens
agacagagcc

SEQ ID NO: 3852795 - DNA, 14 bp, Homo sapiens
agacagagccccca

SEQ ID NO: 3852796 - DNA, 21 bp, Homo sapiens
agacaggaaaatcctctggct

SEQ ID NO: 3852797 - DNA, 14 bp, Homo sapiens
agacaggaaagaat

SEQ ID NO: 3852798 - DNA, 18 bp, Homo sapiens
agaaatagacagtatatt

SEQ ID NO: 3852799 - DNA, 20 bp, Homo sapiens
agaaatagcctgcgctgttt

SEQ ID NO: 3852800 - DNA, 22 bp, Homo sapiens
acttcaggttgttctgtataaa

SEQ ID NO: 3852801 - DNA, 18 bp, Homo sapiens
acttcatatatgaggact

SEQ ID NO: 3852802 - DNA, 23 bp, Homo sapiens
acttcatggcctttgataaatgt

SEQ ID NO: 3852803 - DNA, 17 bp, Homo sapiens
acttcatttggtgctgg

SEQ ID NO: 3852804 - DNA, 21 bp, Homo sapiens
acttccacagaatacaagcca

SEQ ID NO: 3852805 - DNA, 17 bp, Homo sapiens
acttccataatctggac

SEQ ID NO: 3852806 - DNA, 13 bp, Homo sapiens
acttccctgggaa

SEQ ID NO: 3852807 - DNA, 13 bp, Homo sapiens
acttcctggggcc

SEQ ID NO: 3852808 - DNA, 12 bp, Homo sapiens
acttcctgtgta

SEQ ID NO: 3852809 - DNA, 17 bp, Homo sapiens
acttcggggctgggaag

SEQ ID NO: 3852810 - DNA, 19 bp, Homo sapiens
acttctaagtaaaaccaca

SEQ ID NO: 3852811 - DNA, 15 bp, Homo sapiens
acttctaatatattt

SEQ ID NO: 3852812 - DNA, 20 bp, Homo sapiens
acttctcaggacacaggcct

SEQ ID NO: 3852813 - DNA, 22 bp, Homo sapiens
acttctccagacccaccacacc

SEQ ID NO: 3852814 - DNA, 21 bp, Homo sapiens
acttctgtcttcacaacagat

SEQ ID NO: 3852815 - DNA, 16 bp, Homo sapiens
acttcttaaaggcctg

SEQ ID NO: 3852816 - DNA, 18 bp, Homo sapiens
acttcttaaaggcctgga

SEQ ID NO: 3852817 - DNA, 14 bp, Homo sapiens
acttcttggaaaaa

SEQ ID NO: 3852818 - DNA, 15 bp, Homo sapiens
acttcttggaaaaaa

SEQ ID NO: 3852819 - DNA, 23 bp, Homo sapiens
acttcttggtttggggagaaata

SEQ ID NO: 3852820 - DNA, 22 bp, Homo sapiens
acttctttcctctccaattgta

SEQ ID NO: 3852821 - DNA, 18 bp, Homo sapiens
acttgaaataccagtgaa

SEQ ID NO: 3852822 - DNA, 15 bp, Homo sapiens
acttgaagcaagctt

SEQ ID NO: 3852823 - DNA, 14 bp, Homo sapiens
acttgaatctgtta

SEQ ID NO: 3852824 - DNA, 21 bp, Homo sapiens
acttgaatctgttactgaaat

SEQ ID NO: 3852825 - DNA, 22 bp, Homo sapiens
acttgaatctgttactgaaatg

SEQ ID NO: 3852826 - DNA, 22 bp, Homo sapiens
acttgacaacatcccacagtgg

SEQ ID NO: 3852827 - DNA, 14 bp, Homo sapiens
acttgagctgtata

SEQ ID NO: 3852828 - DNA, 15 bp, Homo sapiens
acttgagctgtatat

SEQ ID NO: 3852829 - DNA, 16 bp, Homo sapiens
acttgagctgtatata

SEQ ID NO: 3852830 - DNA, 15 bp, Homo sapiens
acttgaggacacatg

SEQ ID NO: 3852831 - DNA, 16 bp, Homo sapiens
acttgaggacacatgt

SEQ ID NO: 3852832 - DNA, 18 bp, Homo sapiens
acttgaggattttgagta

SEQ ID NO: 3852833 - DNA, 14 bp, Homo sapiens
acttgcacaagctt

SEQ ID NO: 3852834 - DNA, 16 bp, Homo sapiens
acttgcacaagcttgt

SEQ ID NO: 3852835 - DNA, 15 bp, Homo sapiens
acttgcacatctctg

SEQ ID NO: 3852836 - DNA, 19 bp, Homo sapiens
acttgcacatctctgcagt

SEQ ID NO: 3852837 - DNA, 18 bp, Homo sapiens
acttgcgtcctgcagagg

SEQ ID NO: 3852838 - DNA, 19 bp, Homo sapiens
acttgcttagtatggttct

SEQ ID NO: 3852839 - DNA, 18 bp, Homo sapiens
acttggaaaaagaaagaa

SEQ ID NO: 3852840 - DNA, 22 bp, Homo sapiens
acttggaaaaatccagaaagaa

SEQ ID NO: 3852841 - DNA, 23 bp, Homo sapiens
acttggaactgaagggggcggcc

SEQ ID NO: 3852842 - DNA, 23 bp, Homo sapiens
acttggagagggacgaagaaagg

SEQ ID NO: 3852843 - DNA, 16 bp, Homo sapiens
acttggagcccgtgca

SEQ ID NO: 3852844 - DNA, 17 bp, Homo sapiens
acttggagtggagagga

SEQ ID NO: 3852845 - DNA, 22 bp, Homo sapiens
acttgggagcttgtatatactt

SEQ ID NO: 3852846 - DNA, 13 bp, Homo sapiens
acttgggcacccc

SEQ ID NO: 3852847 - DNA, 21 bp, Homo sapiens
acttgggcacccccagcctgg

SEQ ID NO: 3852848 - DNA, 14 bp, Homo sapiens
acttggggaccaga

SEQ ID NO: 3852849 - DNA, 20 bp, Homo sapiens
acttggggtcaccaccctcc

SEQ ID NO: 3852850 - DNA, 14 bp, Homo sapiens
acttgtaaatacac

SEQ ID NO: 3852851 - DNA, 15 bp, Homo sapiens
acttgtaaatacacc

SEQ ID NO: 3852852 - DNA, 16 bp, Homo sapiens
acttgtaaatacacca

SEQ ID NO: 3852853 - DNA, 14 bp, Homo sapiens
acttgtaagttgct

SEQ ID NO: 3852854 - DNA, 14 bp, Homo sapiens
acttgtacaaaata

SEQ ID NO: 3852855 - DNA, 18 bp, Homo sapiens
acttgtagaaatctgtaa

SEQ ID NO: 3852856 - DNA, 15 bp, Homo sapiens
acttgtataaatgta

SEQ ID NO: 3852857 - DNA, 19 bp, Homo sapiens
acttgtataaatgtatata

SEQ ID NO: 3852858 - DNA, 21 bp, Homo sapiens
acttgtataaatgtatataca

SEQ ID NO: 3852859 - DNA, 15 bp, Homo sapiens
acttgtcctatgtca

SEQ ID NO: 3852860 - DNA, 15 bp, Homo sapiens
acttgtctgaggcct

SEQ ID NO: 3852861 - DNA, 17 bp, Homo sapiens
acttgtctgaggcctca

SEQ ID NO: 3852862 - DNA, 20 bp, Homo sapiens
acttgtctgaggcctcatcc

SEQ ID NO: 3852863 - DNA, 21 bp, Homo sapiens
acttgtgtactgataaaatac

SEQ ID NO: 3852864 - DNA, 23 bp, Homo sapiens
acttgtgtatgatccaagtattt

SEQ ID NO: 3852865 - DNA, 22 bp, Homo sapiens
acttgtgtctctgtgcttttaa

SEQ ID NO: 3852866 - DNA, 15 bp, Homo sapiens
acttgttcacaggtt

SEQ ID NO: 3852867 - DNA, 15 bp, Homo sapiens
actttaaaagatgaa

SEQ ID NO: 3852868 - DNA, 15 bp, Homo sapiens
actttaaagtctttc

SEQ ID NO: 3852869 - DNA, 20 bp, Homo sapiens
actttaaccctctcttccct

SEQ ID NO: 3852870 - DNA, 21 bp, Homo sapiens
actttacaggaggttgtggat

SEQ ID NO: 3852871 - DNA, 17 bp, Homo sapiens
actttacccaaaaacta

SEQ ID NO: 3852872 - DNA, 19 bp, Homo sapiens
actttagagtagcatgaga

SEQ ID NO: 3852873 - DNA, 21 bp, Homo sapiens
actttagagtagcatgagaga

SEQ ID NO: 3852874 - DNA, 17 bp, Homo sapiens
actttagtatttttact

SEQ ID NO: 3852875 - DNA, 14 bp, Homo sapiens
actttataaaagca

SEQ ID NO: 3852876 - DNA, 15 bp, Homo sapiens
actttatacagaact

SEQ ID NO: 3852877 - DNA, 21 bp, Homo sapiens
actttcaggtactaaatacct

SEQ ID NO: 3852878 - DNA, 17 bp, Homo sapiens
actttcctacaaaatgg

SEQ ID NO: 3852879 - DNA, 21 bp, Homo sapiens
actttcctattttcttttcca

SEQ ID NO: 3852880 - DNA, 17 bp, Homo sapiens
actttctacacctgttg

SEQ ID NO: 3852881 - DNA, 16 bp, Homo sapiens
agagtggttgttgcca

SEQ ID NO: 3852882 - DNA, 19 bp, Homo sapiens
agagtggttgttgccaact

SEQ ID NO: 3852883 - DNA, 15 bp, Homo sapiens
agagtgtgcagactg

SEQ ID NO: 3852884 - DNA, 17 bp, Homo sapiens
agagtgtgcagactgat

SEQ ID NO: 3852885 - DNA, 20 bp, Homo sapiens
agagtgtgggaagggagagc

SEQ ID NO: 3852886 - DNA, 14 bp, Homo sapiens
agagtgttcctgtt

SEQ ID NO: 3852887 - DNA, 14 bp, Homo sapiens
agagttcatcccag

SEQ ID NO: 3852888 - DNA, 22 bp, Homo sapiens
agagttccacaaatctatatta

SEQ ID NO: 3852889 - DNA, 14 bp, Homo sapiens
agagttctgctcta

SEQ ID NO: 3852890 - DNA, 17 bp, Homo sapiens
agagttggctcaggcag

SEQ ID NO: 3852891 - DNA, 21 bp, Homo sapiens
agagtttaactttgggcccag

SEQ ID NO: 3852892 - DNA, 18 bp, Homo sapiens
agataaaatatcctcagg

SEQ ID NO: 3852893 - DNA, 20 bp, Homo sapiens
agataaagacagctgacaga

SEQ ID NO: 3852894 - DNA, 13 bp, Homo sapiens
agataaagatgat

SEQ ID NO: 3852895 - DNA, 16 bp, Homo sapiens
agataaagatgatcta

SEQ ID NO: 3852896 - DNA, 13 bp, Homo sapiens
agataaagccaga

SEQ ID NO: 3852897 - DNA, 13 bp, Homo sapiens
agataaagtggtt

SEQ ID NO: 3852898 - DNA, 23 bp, Homo sapiens
agataatctagaacacaggcaaa

SEQ ID NO: 3852899 - DNA, 14 bp, Homo sapiens
agatacactcctgc

SEQ ID NO: 3852900 - DNA, 15 bp, Homo sapiens
agatacatagatgga

SEQ ID NO: 3852901 - DNA, 18 bp, Homo sapiens
agatacatagatggacca

SEQ ID NO: 3852902 - DNA, 17 bp, Homo sapiens
agatacatggggaactg

SEQ ID NO: 3852903 - DNA, 17 bp, Homo sapiens
agatacggttgcttcac

SEQ ID NO: 3852904 - DNA, 18 bp, Homo sapiens
agatagaaagcaataaaa

SEQ ID NO: 3852905 - DNA, 19 bp, Homo sapiens
agatagaaagcaataaaaa

SEQ ID NO: 3852906 - DNA, 20 bp, Homo sapiens
agatagacagtgctgccctg

SEQ ID NO: 3852907 - DNA, 15 bp, Homo sapiens
agataggtaaatacc

SEQ ID NO: 3852908 - DNA, 19 bp, Homo sapiens
agataggtttgagttcaaa

SEQ ID NO: 3852909 - DNA, 17 bp, Homo sapiens
agatatataactttaga

SEQ ID NO: 3852910 - DNA, 13 bp, Homo sapiens
agatatatatcat

SEQ ID NO: 3852911 - DNA, 14 bp, Homo sapiens
agatatatttttca

SEQ ID NO: 3852912 - DNA, 22 bp, Homo sapiens
agatatgcacacacagatgcac

SEQ ID NO: 3852913 - DNA, 12 bp, Homo sapiens
agatatttttgt

SEQ ID NO: 3852914 - DNA, 17 bp, Homo sapiens
agatatttttgtacgtt

SEQ ID NO: 3852915 - DNA, 23 bp, Homo sapiens
agatatttttgtacgttatatat

SEQ ID NO: 3852916 - DNA, 21 bp, Homo sapiens
agatattttttcagaaatatg

SEQ ID NO: 3852917 - DNA, 14 bp, Homo sapiens
agatcaaatttcac

SEQ ID NO: 3852918 - DNA, 14 bp, Homo sapiens
agatcaattaattc

SEQ ID NO: 3852919 - DNA, 17 bp, Homo sapiens
agatcaggaagagaagg

SEQ ID NO: 3852920 - DNA, 19 bp, Homo sapiens
agatcaggaagagaaggag

SEQ ID NO: 3852921 - DNA, 21 bp, Homo sapiens
agatccatttggacaaaatgg

SEQ ID NO: 3852922 - DNA, 20 bp, Homo sapiens
agatcccatccatcagctcc

SEQ ID NO: 3852923 - DNA, 14 bp, Homo sapiens
agatcccatgtcac

SEQ ID NO: 3852924 - DNA, 15 bp, Homo sapiens
agatcccgcctcttc

SEQ ID NO: 3852925 - DNA, 17 bp, Homo sapiens
agatcctctgctgactc

SEQ ID NO: 3852926 - DNA, 14 bp, Homo sapiens
agatcgcttgagcc

SEQ ID NO: 3852927 - DNA, 18 bp, Homo sapiens
agatcgcttgagcccagg

SEQ ID NO: 3852928 - DNA, 20 bp, Homo sapiens
agatcgcttgagcccaggag

SEQ ID NO: 3852929 - DNA, 17 bp, Homo sapiens
agatcgtattaattatc

SEQ ID NO: 3852930 - DNA, 21 bp, Homo sapiens
agatcgtgccgttactctcca

SEQ ID NO: 3852931 - DNA, 14 bp, Homo sapiens
agatctagaaagtg

SEQ ID NO: 3852932 - DNA, 19 bp, Homo sapiens
agatctcctatttttcaga

SEQ ID NO: 3852933 - DNA, 19 bp, Homo sapiens
agatctgatggtgagctgg

SEQ ID NO: 3852934 - DNA, 23 bp, Homo sapiens
agatctgatggtgagctgggaag

SEQ ID NO: 3852935 - DNA, 18 bp, Homo sapiens
agatctgcctgggcctgt

SEQ ID NO: 3852936 - DNA, 21 bp, Homo sapiens
agatctgcctgggcctgtgca

SEQ ID NO: 3852937 - DNA, 22 bp, Homo sapiens
agatctgcctgggcctgtgcag

SEQ ID NO: 3852938 - DNA, 13 bp, Homo sapiens
agatctgcttctt

SEQ ID NO: 3852939 - DNA, 23 bp, Homo sapiens
agatctgcttcttcatcttgaca

SEQ ID NO: 3852940 - DNA, 17 bp, Homo sapiens
agatgaaagaggaggtt

SEQ ID NO: 3852941 - DNA, 23 bp, Homo sapiens
agatgaaagaggaggtttggggt

SEQ ID NO: 3852942 - DNA, 15 bp, Homo sapiens
agatgaagagaagct

SEQ ID NO: 3852943 - DNA, 19 bp, Homo sapiens
agatgagatttgccagcac

SEQ ID NO: 3852944 - DNA, 16 bp, Homo sapiens
agatgataaatattta

SEQ ID NO: 3852945 - DNA, 21 bp, Homo sapiens
agatgatcgtgcctataaata

SEQ ID NO: 3852946 - DNA, 14 bp, Homo sapiens
agatgatctctcca

SEQ ID NO: 3852947 - DNA, 11 bp, Homo sapiens
agatgatgatg

SEQ ID NO: 3852948 - DNA, 14 bp, Homo sapiens
agatgatgatgatg

SEQ ID NO: 3852949 - DNA, 14 bp, Homo sapiens
agatgcaacctcac

SEQ ID NO: 3852950 - DNA, 13 bp, Homo sapiens
agatgcaagatat

SEQ ID NO: 3852951 - DNA, 23 bp, Homo sapiens
agatgcacacacaccgatgctga

SEQ ID NO: 3852952 - DNA, 18 bp, Homo sapiens
agatgcatgcgcaggctc

SEQ ID NO: 3852953 - DNA, 16 bp, Homo sapiens
agatgccacacctgct

SEQ ID NO: 3852954 - DNA, 16 bp, Homo sapiens
agatgcctccaccgct

SEQ ID NO: 3852955 - DNA, 15 bp, Homo sapiens
agcacaggcagctgg

SEQ ID NO: 3852956 - DNA, 12 bp, Homo sapiens
agcacaggggcc

SEQ ID NO: 3852957 - DNA, 19 bp, Homo sapiens
agcacagtctgatgacaca

SEQ ID NO: 3852958 - DNA, 19 bp, Homo sapiens
agcacatgcgtatatgtgc

SEQ ID NO: 3852959 - DNA, 23 bp, Homo sapiens
agcacatgcgtatatgtgcgtct

SEQ ID NO: 3852960 - DNA, 20 bp, Homo sapiens
agcaccagcttctccaggct

SEQ ID NO: 3852961 - DNA, 14 bp, Homo sapiens
agcaccaggcacga

SEQ ID NO: 3852962 - DNA, 23 bp, Homo sapiens
agcaccaggcacgaacccacctg

SEQ ID NO: 3852963 - DNA, 20 bp, Homo sapiens
agcacccaggctccatgggg

SEQ ID NO: 3852964 - DNA, 23 bp, Homo sapiens
agcacccaggctccatggggaag

SEQ ID NO: 3852965 - DNA, 13 bp, Homo sapiens
agcaccccctcat

SEQ ID NO: 3852966 - DNA, 18 bp, Homo sapiens
agcaccctcccccgcagc

SEQ ID NO: 3852967 - DNA, 14 bp, Homo sapiens
agcaccctctcctg

SEQ ID NO: 3852968 - DNA, 19 bp, Homo sapiens
agcctcctcctgaccacgg

SEQ ID NO: 3852969 - DNA, 12 bp, Homo sapiens
agcctcctctgc

SEQ ID NO: 3852970 - DNA, 22 bp, Homo sapiens
agcctcctctgcttgcatcact

SEQ ID NO: 3852971 - DNA, 17 bp, Homo sapiens
agcctcctgacctgagg

SEQ ID NO: 3852972 - DNA, 19 bp, Homo sapiens
agcctcgcaacccgtgcca

SEQ ID NO: 3852973 - DNA, 14 bp, Homo sapiens
agcctctccaggaa

SEQ ID NO: 3852974 - DNA, 17 bp, Homo sapiens
agcctctcccggctgcc

SEQ ID NO: 3852975 - DNA, 19 bp, Homo sapiens
agcctctcccggctgcctg

SEQ ID NO: 3852976 - DNA, 13 bp, Homo sapiens
agcctctgccctg

SEQ ID NO: 3852977 - DNA, 14 bp, Homo sapiens
agcctctgccctgc

SEQ ID NO: 3852978 - DNA, 19 bp, Homo sapiens
agcctctgccctgcctccc

SEQ ID NO: 3852979 - DNA, 16 bp, Homo sapiens
agcctctgggccaaga

SEQ ID NO: 3852980 - DNA, 22 bp, Homo sapiens
agcctcttagtgattgtgtctg

SEQ ID NO: 3852981 - DNA, 21 bp, Homo sapiens
agcctgaattttgttgctgtt

SEQ ID NO: 3852982 - DNA, 17 bp, Homo sapiens
agcctgagtctcctgtg

SEQ ID NO: 3852983 - DNA, 13 bp, Homo sapiens
agcctgatggcca

SEQ ID NO: 3852984 - DNA, 19 bp, Homo sapiens
agcctgatggccaaggggg

SEQ ID NO: 3852985 - DNA, 23 bp, Homo sapiens
agcctgatggccaagggggtgga

SEQ ID NO: 3852986 - DNA, 17 bp, Homo sapiens
agccagccgccctgggc

SEQ ID NO: 3852987 - DNA, 15 bp, Homo sapiens
agccagcctgggact

SEQ ID NO: 3852988 - DNA, 23 bp, Homo sapiens
agccagcctgggactcccagtga

SEQ ID NO: 3852989 - DNA, 11 bp, Homo sapiens
agccagctctc

SEQ ID NO: 3852990 - DNA, 18 bp, Homo sapiens
agccaggagtctgtgctc

SEQ ID NO: 3852991 - DNA, 12 bp, Homo sapiens
agccaggctctg

SEQ ID NO: 3852992 - DNA, 17 bp, Homo sapiens
agccagggccaggggtc

SEQ ID NO: 3852993 - DNA, 19 bp, Homo sapiens
agccaggggctgctcatca

SEQ ID NO: 3852994 - DNA, 23 bp, Homo sapiens
agccaggggctgctcatcaccca

SEQ ID NO: 3852995 - DNA, 18 bp, Homo sapiens
agccaggtaatgagggac

SEQ ID NO: 3852996 - DNA, 23 bp, Homo sapiens
agccaggttagcctttgccctgt

SEQ ID NO: 3852997 - DNA, 18 bp, Homo sapiens
agccagtgaaggagccac

SEQ ID NO: 3852998 - DNA, 19 bp, Homo sapiens
agccatgaggagttgctgt

SEQ ID NO: 3852999 - DNA, 20 bp, Homo sapiens
agccatgaggagttgctgtt

SEQ ID NO: 3853000 - DNA, 19 bp, Homo sapiens
agctacttaagagaaatgg

SEQ ID NO: 3853001 - DNA, 15 bp, Homo sapiens
agctagaaatatgat

SEQ ID NO: 3853002 - DNA, 18 bp, Homo sapiens
agctagaacctggagagc

SEQ ID NO: 3853003 - DNA, 15 bp, Homo sapiens
agctagaaggccaca

SEQ ID NO: 3853004 - DNA, 16 bp, Homo sapiens
agctagaaggccacat

SEQ ID NO: 3853005 - DNA, 15 bp, Homo sapiens
agctagaagtgggcc

SEQ ID NO: 3853006 - DNA, 21 bp, Homo sapiens
agctagaagtgggccaggaca

SEQ ID NO: 3853007 - DNA, 22 bp, Homo sapiens
agctagaagtgggccaggacag

SEQ ID NO: 3853008 - DNA, 24 bp, Homo sapiens
agctagaagtgggccaggacaggc

SEQ ID NO: 3853009 - DNA, 21 bp, Homo sapiens
agctagccaactcctccttgc

SEQ ID NO: 3853010 - DNA, 14 bp, Homo sapiens
agctagcgctgccg

SEQ ID NO: 3853011 - DNA, 18 bp, Homo sapiens
agctagcgctgccgcacc

SEQ ID NO: 3853012 - DNA, 21 bp, Homo sapiens
agctagcgctgccgcacccca

SEQ ID NO: 3853013 - DNA, 17 bp, Homo sapiens
agctaggactgaggagt

SEQ ID NO: 3853014 - DNA, 17 bp, Homo sapiens
agctagttcgtagcttt

SEQ ID NO: 3853015 - DNA, 20 bp, Homo sapiens
agctatcagaagaccacaaa

SEQ ID NO: 3853016 - DNA, 17 bp, Homo sapiens
agctatgcgcaatgtgg

SEQ ID NO: 3853017 - DNA, 18 bp, Homo sapiens
agctatgcgcaatgtggc

SEQ ID NO: 3853018 - DNA, 16 bp, Homo sapiens
agctattgatgtttcc

SEQ ID NO: 3853019 - DNA, 13 bp, Homo sapiens
agctattgcatgt

SEQ ID NO: 3853020 - DNA, 20 bp, Homo sapiens
agctattgcatgtaaaatgc

SEQ ID NO: 3853021 - DNA, 15 bp, Homo sapiens
agctcacaagcccag

SEQ ID NO: 3853022 - DNA, 17 bp, Homo sapiens
agctcacaagcccaggc

SEQ ID NO: 3853023 - DNA, 18 bp, Homo sapiens
agctcacaagcccaggct

SEQ ID NO: 3853024 - DNA, 19 bp, Homo sapiens
agctcacaagcccaggctg

SEQ ID NO: 3853025 - DNA, 21 bp, Homo sapiens
agctcacaagcccaggctgga

SEQ ID NO: 3853026 - DNA, 20 bp, Homo sapiens
agctcacaaggcagcaaggc

SEQ ID NO: 3853027 - DNA, 15 bp, Homo sapiens
agctcacctctgaag

SEQ ID NO: 3853028 - DNA, 13 bp, Homo sapiens
agctcagcctccc

SEQ ID NO: 3853029 - DNA, 16 bp, Homo sapiens
agctcagcctccccct

SEQ ID NO: 3853030 - DNA, 20 bp, Homo sapiens
agctcagctttttgtctttt

SEQ ID NO: 3853031 - DNA, 13 bp, Homo sapiens
agctcaggaggcg

SEQ ID NO: 3853032 - DNA, 20 bp, Homo sapiens
agctcaggaggcgaataaat

SEQ ID NO: 3853033 - DNA, 21 bp, Homo sapiens
agctcaggcatttgaggctgt

SEQ ID NO: 3853034 - DNA, 15 bp, Homo sapiens
agctcatattttgta

SEQ ID NO: 3853035 - DNA, 14 bp, Homo sapiens
agctccaacagctt

SEQ ID NO: 3853036 - DNA, 17 bp, Homo sapiens
agctccaacagcttgac

SEQ ID NO: 3853037 - DNA, 21 bp, Homo sapiens
agctccacggtgcgtggctgt

SEQ ID NO: 3853038 - DNA, 23 bp, Homo sapiens
agctccacggtgcgtggctgtgg

SEQ ID NO: 3853039 - DNA, 16 bp, Homo sapiens
agctccagtttccaag

SEQ ID NO: 3853040 - DNA, 15 bp, Homo sapiens
agctccatctccact

SEQ ID NO: 3853041 - DNA, 16 bp, Homo sapiens
agctccatctccactc

SEQ ID NO: 3853042 - DNA, 21 bp, Homo sapiens
agctccatctccactccagat

SEQ ID NO: 3853043 - DNA, 13 bp, Homo sapiens
agctcccacccca

SEQ ID NO: 3853044 - DNA, 15 bp, Homo sapiens
agctcccaccccacc

SEQ ID NO: 3853045 - DNA, 20 bp, Homo sapiens
agctcccatagcgctggctc

SEQ ID NO: 3853046 - DNA, 22 bp, Homo sapiens
agctcccccttcccagtagctc

SEQ ID NO: 3853047 - DNA, 20 bp, Homo sapiens
agctcccttcccctgcctgg

SEQ ID NO: 3853048 - DNA, 22 bp, Homo sapiens
agctccgctaagacctccccac

SEQ ID NO: 3853049 - DNA, 14 bp, Homo sapiens
agctcctctccttg

SEQ ID NO: 3853050 - DNA, 20 bp, Homo sapiens
agctcctctccttgggctcc

SEQ ID NO: 3853051 - DNA, 21 bp, Homo sapiens
agctcctctccttgggctcct

SEQ ID NO: 3853052 - DNA, 24 bp, Homo sapiens
agctcctctccttgggctcctggc

SEQ ID NO: 3853053 - DNA, 17 bp, Homo sapiens
agctcctctgctgctcc

SEQ ID NO: 3853054 - DNA, 18 bp, Homo sapiens
agctcctctgtctcgagc

SEQ ID NO: 3853055 - DNA, 13 bp, Homo sapiens
agctcctgtccct

SEQ ID NO: 3853056 - DNA, 19 bp, Homo sapiens
agctcctgtccctacccac

SEQ ID NO: 3853057 - DNA, 12 bp, Homo sapiens
agctcctgtcct

SEQ ID NO: 3853058 - DNA, 13 bp, Homo sapiens
agctcctgtcctc

SEQ ID NO: 3853059 - DNA, 15 bp, Homo sapiens
agctcctgtcctccc

SEQ ID NO: 3853060 - DNA, 16 bp, Homo sapiens
agctcctgtcctccca

SEQ ID NO: 3853061 - DNA, 17 bp, Homo sapiens
agctcctgtcctcccat

SEQ ID NO: 3853062 - DNA, 21 bp, Homo sapiens
agctcctgtcctcccatcccc

SEQ ID NO: 3853063 - DNA, 22 bp, Homo sapiens
agctccttttgtccccagggcc

SEQ ID NO: 3853064 - DNA, 13 bp, Homo sapiens
agctcgctaaagt

SEQ ID NO: 3853065 - DNA, 20 bp, Homo sapiens
agctctattaagatttccaa

SEQ ID NO: 3853066 - DNA, 22 bp, Homo sapiens
agctctattaagatttccaagt

SEQ ID NO: 3853067 - DNA, 13 bp, Homo sapiens
agctctccctctg

SEQ ID NO: 3853068 - DNA, 14 bp, Homo sapiens
agctctccctctgg

SEQ ID NO: 3853069 - DNA, 23 bp, Homo sapiens
agctctccctctggccctgcctt

SEQ ID NO: 3853070 - DNA, 18 bp, Homo sapiens
agctctccggtctctctc

SEQ ID NO: 3853071 - DNA, 12 bp, Homo sapiens
agctctctgtat

SEQ ID NO: 3853072 - DNA, 17 bp, Homo sapiens
agctctctgtataaaca

SEQ ID NO: 3853073 - DNA, 21 bp, Homo sapiens
agctctgaatctgataggaaa

SEQ ID NO: 3853074 - DNA, 10 bp, Homo sapiens
agctctgaga

SEQ ID NO: 3853075 - DNA, 19 bp, Homo sapiens
agctctgagaggccctgga

SEQ ID NO: 3853076 - DNA, 20 bp, Homo sapiens
agctctgagaggccctggat

SEQ ID NO: 3853077 - DNA, 13 bp, Homo sapiens
agctctgcatgtg

SEQ ID NO: 3853078 - DNA, 16 bp, Homo sapiens
agctctgcatgtgtgt

SEQ ID NO: 3853079 - DNA, 15 bp, Homo sapiens
agctctggaccagcc

SEQ ID NO: 3853080 - DNA, 12 bp, Homo sapiens
agctctgtggcc

SEQ ID NO: 3853081 - DNA, 13 bp, Homo sapiens
agctctgtggcct

SEQ ID NO: 3853082 - DNA, 14 bp, Homo sapiens
agctctgtggcctg

SEQ ID NO: 3853083 - DNA, 14 bp, Homo sapiens
agctcttcaagctg

SEQ ID NO: 3853084 - DNA, 21 bp, Homo sapiens
agctcttccttactcccaggc

SEQ ID NO: 3853085 - DNA, 17 bp, Homo sapiens
agctcttctatttaaaa

SEQ ID NO: 3853086 - DNA, 12 bp, Homo sapiens
aggcccagggag

SEQ ID NO: 3853087 - DNA, 21 bp, Homo sapiens
aggccccaaggggtttctgtt

SEQ ID NO: 3853088 - DNA, 16 bp, Homo sapiens
aggccccatgacctcc

SEQ ID NO: 3853089 - DNA, 15 bp, Homo sapiens
aggcccccaggtgcc

SEQ ID NO: 3853090 - DNA, 18 bp, Homo sapiens
aggccccgcttgtccagc

SEQ ID NO: 3853091 - DNA, 21 bp, Homo sapiens
aggccccgcttgtccagcgcc

SEQ ID NO: 3853092 - DNA, 12 bp, Homo sapiens
aggcccctgagg

SEQ ID NO: 3853093 - DNA, 15 bp, Homo sapiens
aggcccctgaggact

SEQ ID NO: 3853094 - DNA, 20 bp, Homo sapiens
aggcccctgaggactggaga

SEQ ID NO: 3853095 - DNA, 17 bp, Homo sapiens
aggcccctggacaagca

SEQ ID NO: 3853096 - DNA, 16 bp, Homo sapiens
aggcccgacagagaga

SEQ ID NO: 3853097 - DNA, 15 bp, Homo sapiens
aggcccgagcagctg

SEQ ID NO: 3853098 - DNA, 18 bp, Homo sapiens
aggcccgagcagctgagc

SEQ ID NO: 3853099 - DNA, 22 bp, Homo sapiens
aggcccgagcagctgagcaggg

SEQ ID NO: 3853100 - DNA, 19 bp, Homo sapiens
aggcccggcccagcctagg

SEQ ID NO: 3853101 - DNA, 15 bp, Homo sapiens
aggcccggggctggc

SEQ ID NO: 3853102 - DNA, 14 bp, Homo sapiens
aggccctccctgac

SEQ ID NO: 3853103 - DNA, 22 bp, Homo sapiens
aggcccttattttcaagaaact

SEQ ID NO: 3853104 - DNA, 17 bp, Homo sapiens
aggcccttcctctccac

SEQ ID NO: 3853105 - DNA, 19 bp, Homo sapiens
aggcccttcctctccactg

SEQ ID NO: 3853106 - DNA, 22 bp, Homo sapiens
aggcccttgtcctgccagctgc

SEQ ID NO: 3853107 - DNA, 20 bp, Homo sapiens
aggccgctgttcacccacag

SEQ ID NO: 3853108 - DNA, 21 bp, Homo sapiens
aggccgttccccttggcttcc

SEQ ID NO: 3853109 - DNA, 17 bp, Homo sapiens
aggcctaaaagtaaaca

SEQ ID NO: 3853110 - DNA, 20 bp, Homo sapiens
aggcctcacacccagagggt

SEQ ID NO: 3853111 - DNA, 16 bp, Homo sapiens
aggcctcatccctcgg

SEQ ID NO: 3853112 - DNA, 18 bp, Homo sapiens
aggcctcatctcctttat

SEQ ID NO: 3853113 - DNA, 16 bp, Homo sapiens
aggcctccagcctctc

SEQ ID NO: 3853114 - DNA, 13 bp, Homo sapiens
aggcctccctcaa

SEQ ID NO: 3853115 - DNA, 17 bp, Homo sapiens
aggcctcgtaccagcca

SEQ ID NO: 3853116 - DNA, 19 bp, Homo sapiens
aggcctcgtaccagccagg

SEQ ID NO: 3853117 - DNA, 15 bp, Homo sapiens
aggcctctgtgtcct

SEQ ID NO: 3853118 - DNA, 20 bp, Homo sapiens
aggcctctgtgtccttccct

SEQ ID NO: 3853119 - DNA, 22 bp, Homo sapiens
aggcctctgtgtccttccctgc

SEQ ID NO: 3853120 - DNA, 23 bp, Homo sapiens
aggcctcttggacctctgctctg

SEQ ID NO: 3853121 - DNA, 24 bp, Homo sapiens
aggcctcttggacctctgctctga

SEQ ID NO: 3853122 - DNA, 14 bp, Homo sapiens
aggcctcttgtgct

SEQ ID NO: 3853123 - DNA, 21 bp, Homo sapiens
aggcctcttgtgctcacgctc

SEQ ID NO: 3853124 - DNA, 17 bp, Homo sapiens
aggcctgatgctgcccc

SEQ ID NO: 3853125 - DNA, 17 bp, Homo sapiens
aggcctgccctcaggga

SEQ ID NO: 3853126 - DNA, 18 bp, Homo sapiens
aggcctggaaccagggag

SEQ ID NO: 3853127 - DNA, 22 bp, Homo sapiens
aggcctggaaccagggaggaga

SEQ ID NO: 3853128 - DNA, 16 bp, Homo sapiens
aggcctggccaggcac

SEQ ID NO: 3853129 - DNA, 12 bp, Homo sapiens
aggcctggcctt

SEQ ID NO: 3853130 - DNA, 17 bp, Homo sapiens
aggcctgggacccagct

SEQ ID NO: 3853131 - DNA, 20 bp, Homo sapiens
aggcctgggacccagctact

SEQ ID NO: 3853132 - DNA, 22 bp, Homo sapiens
aggcctgtgtagctgtgacctg

SEQ ID NO: 3853133 - DNA, 12 bp, Homo sapiens
aggcctgtgtgt

SEQ ID NO: 3853134 - DNA, 15 bp, Homo sapiens
aggcgaataaatgtt

SEQ ID NO: 3853135 - DNA, 16 bp, Homo sapiens
aggcgaataaatgttc

SEQ ID NO: 3853136 - DNA, 19 bp, Homo sapiens
aggcgaataaatgttcaaa

SEQ ID NO: 3853137 - DNA, 14 bp, Homo sapiens
aggcgagtgccagg

SEQ ID NO: 3853138 - DNA, 18 bp, Homo sapiens
aggcgagtgccaggactc

SEQ ID NO: 3853139 - DNA, 21 bp, Homo sapiens
aggcgcagcccgaagcccagt

SEQ ID NO: 3853140 - DNA, 14 bp, Homo sapiens
aggcgcatgtgcca

SEQ ID NO: 3853141 - DNA, 22 bp, Homo sapiens
aggcgccccaacccgtggaggc

SEQ ID NO: 3853142 - DNA, 15 bp, Homo sapiens
aggcgctggacagag

SEQ ID NO: 3853143 - DNA, 12 bp, Homo sapiens
aggcggaaacct

SEQ ID NO: 3853144 - DNA, 15 bp, Homo sapiens
aggcggaaaccttgc

SEQ ID NO: 3853145 - DNA, 15 bp, Homo sapiens
aggcggagagtacag

SEQ ID NO: 3853146 - DNA, 15 bp, Homo sapiens
aggcggctccaggtc

SEQ ID NO: 3853147 - DNA, 15 bp, Homo sapiens
aggcgggagatggac

SEQ ID NO: 3853148 - DNA, 16 bp, Homo sapiens
aggcggtcatgtgtgc

SEQ ID NO: 3853149 - DNA, 18 bp, Homo sapiens
aggcggtcatgtgtgcat

SEQ ID NO: 3853150 - DNA, 19 bp, Homo sapiens
aggcgtcaacgtgcatttt

SEQ ID NO: 3853151 - DNA, 18 bp, Homo sapiens
aggcgtgcaaggggctca

SEQ ID NO: 3853152 - DNA, 19 bp, Homo sapiens
aggcgtgcaaggggctcag

SEQ ID NO: 3853153 - DNA, 14 bp, Homo sapiens
aggcgttggtgcca

SEQ ID NO: 3853154 - DNA, 18 bp, Homo sapiens
aggctaatttttatattt

SEQ ID NO: 3853155 - DNA, 17 bp, Homo sapiens
aggctactgtcagctcc

SEQ ID NO: 3853156 - DNA, 20 bp, Homo sapiens
aggctacttcggggctggga

SEQ ID NO: 3853157 - DNA, 19 bp, Homo sapiens
aggctagaacctggcaagc

SEQ ID NO: 3853158 - DNA, 20 bp, Homo sapiens
aggctagagtgcagtggcat

SEQ ID NO: 3853159 - DNA, 18 bp, Homo sapiens
aggctattattttcactg

SEQ ID NO: 3853160 - DNA, 19 bp, Homo sapiens
aggctattattttcactgt

SEQ ID NO: 3853161 - DNA, 15 bp, Homo sapiens
aggctatttctacat

SEQ ID NO: 3853162 - DNA, 15 bp, Homo sapiens
aggctcaacaataaa

SEQ ID NO: 3853163 - DNA, 13 bp, Homo sapiens
aggctcaagaggc

SEQ ID NO: 3853164 - DNA, 16 bp, Homo sapiens
aggctcaagaggccca

SEQ ID NO: 3853165 - DNA, 18 bp, Homo sapiens
aggctcaagaggcccagg

SEQ ID NO: 3853166 - DNA, 22 bp, Homo sapiens
aggctcaagaggcccagggagc

SEQ ID NO: 3853167 - DNA, 22 bp, Homo sapiens
aggctccaccccatccagttca

SEQ ID NO: 3853168 - DNA, 13 bp, Homo sapiens
aggctccatgggg

SEQ ID NO: 3853169 - DNA, 14 bp, Homo sapiens
aggctccatgggga

SEQ ID NO: 3853170 - DNA, 14 bp, Homo sapiens
aggctccattagga

SEQ ID NO: 3853171 - DNA, 15 bp, Homo sapiens
aggctccttcatgtg

SEQ ID NO: 3853172 - DNA, 10 bp, Homo sapiens
aggactggct

SEQ ID NO: 3853173 - DNA, 17 bp, Homo sapiens
aggacttaacggctcca

SEQ ID NO: 3853174 - DNA, 20 bp, Homo sapiens
aggacttaacggctccagga

SEQ ID NO: 3853175 - DNA, 13 bp, Homo sapiens
aggacttctgcag

SEQ ID NO: 3853176 - DNA, 13 bp, Homo sapiens
aggacttgtgtct

SEQ ID NO: 3853177 - DNA, 13 bp, Homo sapiens
aggagaaaaacaa

SEQ ID NO: 3853178 - DNA, 14 bp, Homo sapiens
aggagaaacagaga

SEQ ID NO: 3853179 - DNA, 14 bp, Homo sapiens
aggagaaataaact

SEQ ID NO: 3853180 - DNA, 16 bp, Homo sapiens
aggagaaatgcatcca

SEQ ID NO: 3853181 - DNA, 16 bp, Homo sapiens
aggagaagcagcctcc

SEQ ID NO: 3853182 - DNA, 16 bp, Homo sapiens
aggagaaggaaggaga

SEQ ID NO: 3853183 - DNA, 18 bp, Homo sapiens
aggagaatccaagcgagg

SEQ ID NO: 3853184 - DNA, 18 bp, Homo sapiens
aggagacaagaaatccag

SEQ ID NO: 3853185 - DNA, 22 bp, Homo sapiens
aggagacactgtgctataaatc

SEQ ID NO: 3853186 - DNA, 14 bp, Homo sapiens
aggagaccctggaa

SEQ ID NO: 3853187 - DNA, 15 bp, Homo sapiens
aggagactcacctct

SEQ ID NO: 3853188 - DNA, 16 bp, Homo sapiens
aggagactcacctctg

SEQ ID NO: 3853189 - DNA, 19 bp, Homo sapiens
aggagactcacctctgcct

SEQ ID NO: 3853190 - DNA, 16 bp, Homo sapiens
aggagagaagaaagtg

SEQ ID NO: 3853191 - DNA, 22 bp, Homo sapiens
aggagagactgaaagcagcagc

SEQ ID NO: 3853192 - DNA, 14 bp, Homo sapiens
aggagagccagccc

SEQ ID NO: 3853193 - DNA, 15 bp, Homo sapiens
aggagagccagccct

SEQ ID NO: 3853194 - DNA, 23 bp, Homo sapiens
aggagaggaaaaacgatcgctgt

SEQ ID NO: 3853195 - DNA, 22 bp, Homo sapiens
aggagagttcaagcctgtggga

SEQ ID NO: 3853196 - DNA, 20 bp, Homo sapiens
aggagatataaaatctagat

SEQ ID NO: 3853197 - DNA, 14 bp, Homo sapiens
aggagattttcctt

SEQ ID NO: 3853198 - DNA, 18 bp, Homo sapiens
aggagattttccttccta

SEQ ID NO: 3853199 - DNA, 20 bp, Homo sapiens
aggagcaaaacgcctctttt

SEQ ID NO: 3853200 - DNA, 16 bp, Homo sapiens
agcgtggggtagcaga

SEQ ID NO: 3853201 - DNA, 23 bp, Homo sapiens
agcgtttagtttctagaggcctc

SEQ ID NO: 3853202 - DNA, 15 bp, Homo sapiens
agctaaaacctgagc

SEQ ID NO: 3853203 - DNA, 13 bp, Homo sapiens
agctaacagggaa

SEQ ID NO: 3853204 - DNA, 16 bp, Homo sapiens
agctaacagggaaggc

SEQ ID NO: 3853205 - DNA, 18 bp, Homo sapiens
agctaacagggaaggcag

SEQ ID NO: 3853206 - DNA, 18 bp, Homo sapiens
agctaagctaggaatgaa

SEQ ID NO: 3853207 - DNA, 16 bp, Homo sapiens
agctaatcagcattct

SEQ ID NO: 3853208 - DNA, 17 bp, Homo sapiens
agctaatctgtagggct

SEQ ID NO: 3853209 - DNA, 16 bp, Homo sapiens
agctaatgaagctatt

SEQ ID NO: 3853210 - DNA, 20 bp, Homo sapiens
agctacactattgcattgtt

SEQ ID NO: 3853211 - DNA, 21 bp, Homo sapiens
agctacactattgcattgttc

SEQ ID NO: 3853212 - DNA, 16 bp, Homo sapiens
agctacattcctcagc

SEQ ID NO: 3853213 - DNA, 18 bp, Homo sapiens
agctacattcctcagctg

SEQ ID NO: 3853214 - DNA, 24 bp, Homo sapiens
agctacattcctcagctgccaagc

SEQ ID NO: 3853215 - DNA, 18 bp, Homo sapiens
agctacctgtgtggacag

SEQ ID NO: 3853216 - DNA, 17 bp, Homo sapiens
agctactcaggaggctg

SEQ ID NO: 3853217 - DNA, 14 bp, Homo sapiens
agctactctgtcca

SEQ ID NO: 3853218 - DNA, 20 bp, Homo sapiens
agctactctgtccaggccac

SEQ ID NO: 3853219 - DNA, 21 bp, Homo sapiens
agctactctgtccaggccact

SEQ ID NO: 3853220 - DNA, 18 bp, Homo sapiens
agctacttaagagaaatg

SEQ ID NO: 3853221 - DNA, 19 bp, Homo sapiens
agggagttgctcactcagg

SEQ ID NO: 3853222 - DNA, 20 bp, Homo sapiens
agggataatagacacatcaa

SEQ ID NO: 3853223 - DNA, 14 bp, Homo sapiens
agggatcacagggc

SEQ ID NO: 3853224 - DNA, 18 bp, Homo sapiens
agggatgagagtggctta

SEQ ID NO: 3853225 - DNA, 16 bp, Homo sapiens
agggatgccacccagc

SEQ ID NO: 3853226 - DNA, 16 bp, Homo sapiens
agggatgggggatggg

SEQ ID NO: 3853227 - DNA, 22 bp, Homo sapiens
agggatgtgaattgcctgcaga

SEQ ID NO: 3853228 - DNA, 16 bp, Homo sapiens
agggatgttctagccc

SEQ ID NO: 3853229 - DNA, 20 bp, Homo sapiens
agggattagggagagaagat

SEQ ID NO: 3853230 - DNA, 14 bp, Homo sapiens
agggcaagggccat

SEQ ID NO: 3853231 - DNA, 17 bp, Homo sapiens
agggcaaggggtttcca

SEQ ID NO: 3853232 - DNA, 15 bp, Homo sapiens
agggcaatcttgtcc

SEQ ID NO: 3853233 - DNA, 16 bp, Homo sapiens
agggcactggtggccc

SEQ ID NO: 3853234 - DNA, 20 bp, Homo sapiens
agggcagaaggggaagatac

SEQ ID NO: 3853235 - DNA, 12 bp, Homo sapiens
agggcagagcca

SEQ ID NO: 3853236 - DNA, 13 bp, Homo sapiens
agggcagagccat

SEQ ID NO: 3853237 - DNA, 21 bp, Homo sapiens
agggcagagccatgggcctgg

SEQ ID NO: 3853238 - DNA, 22 bp, Homo sapiens
agggcagagggaatgttccctg

SEQ ID NO: 3853239 - DNA, 14 bp, Homo sapiens
agggcagcagccag

SEQ ID NO: 3853240 - DNA, 15 bp, Homo sapiens
agggcagcagccagc

SEQ ID NO: 3853241 - DNA, 17 bp, Homo sapiens
agggcagcagccagccc

SEQ ID NO: 3853242 - DNA, 23 bp, Homo sapiens
agggcagcagccagccctgcctg

SEQ ID NO: 3853243 - DNA, 15 bp, Homo sapiens
agggcagccaggggc

SEQ ID NO: 3853244 - DNA, 21 bp, Homo sapiens
agggcagccaggggctgctca

SEQ ID NO: 3853245 - DNA, 16 bp, Homo sapiens
agggcagggaaactgg

SEQ ID NO: 3853246 - DNA, 17 bp, Homo sapiens
agggcagggacaggata

SEQ ID NO: 3853247 - DNA, 17 bp, Homo sapiens
agggcagtacctgggaa

SEQ ID NO: 3853248 - DNA, 20 bp, Homo sapiens
agggcagtgacaagtggagg

SEQ ID NO: 3853249 - DNA, 12 bp, Homo sapiens
agggcagtgaga

SEQ ID NO: 3853250 - DNA, 14 bp, Homo sapiens
agggcagttcgcag

SEQ ID NO: 3853251 - DNA, 16 bp, Homo sapiens
agggcatcaggcactg

SEQ ID NO: 3853252 - DNA, 18 bp, Homo sapiens
agggcatccgcagcccag

SEQ ID NO: 3853253 - DNA, 19 bp, Homo sapiens
agggcatccgcagcccagg

SEQ ID NO: 3853254 - DNA, 13 bp, Homo sapiens
agggcattttaaa

SEQ ID NO: 3853255 - DNA, 19 bp, Homo sapiens
agggccacatcccactgcc

SEQ ID NO: 3853256 - DNA, 15 bp, Homo sapiens
agggccacgtgccag

SEQ ID NO: 3853257 - DNA, 16 bp, Homo sapiens
agggccagaaggaggg

SEQ ID NO: 3853258 - DNA, 18 bp, Homo sapiens
agggccagaaggagggca

SEQ ID NO: 3853259 - DNA, 22 bp, Homo sapiens
agggccagaaggagggcagagc

SEQ ID NO: 3853260 - DNA, 23 bp, Homo sapiens
agggccagccctacatcttcagc

SEQ ID NO: 3853261 - DNA, 15 bp, Homo sapiens
agggccaggagagag

SEQ ID NO: 3853262 - DNA, 16 bp, Homo sapiens
agggccaggagagaga

SEQ ID NO: 3853263 - DNA, 18 bp, Homo sapiens
agggccaggagagagatc

SEQ ID NO: 3853264 - DNA, 12 bp, Homo sapiens
agggccaggcag

SEQ ID NO: 3853265 - DNA, 11 bp, Homo sapiens
agggcccctcc

SEQ ID NO: 3853266 - DNA, 13 bp, Homo sapiens
agggcccctccct

SEQ ID NO: 3853267 - DNA, 16 bp, Homo sapiens
agggcccctccctctg

SEQ ID NO: 3853268 - DNA, 22 bp, Homo sapiens
agggccggggaactggccaagc

SEQ ID NO: 3853269 - DNA, 16 bp, Homo sapiens
agggcctactgccacc

SEQ ID NO: 3853270 - DNA, 23 bp, Homo sapiens
agggcctgagtgctttaccttta

SEQ ID NO: 3853271 - DNA, 15 bp, Homo sapiens
agggcctgggggcag

SEQ ID NO: 3853272 - DNA, 15 bp, Homo sapiens
agggccttgcccaga

SEQ ID NO: 3853273 - DNA, 23 bp, Homo sapiens
agggccttgcccagagatgcctc

SEQ ID NO: 3853274 - DNA, 22 bp, Homo sapiens
agggcgcccattcgtctgtccc

SEQ ID NO: 3853275 - DNA, 23 bp, Homo sapiens
agggcgtcgctggacaacccaga

SEQ ID NO: 3853276 - DNA, 16 bp, Homo sapiens
agggcgtgactcaccc

SEQ ID NO: 3853277 - DNA, 17 bp, Homo sapiens
agggcgtgactcaccca

SEQ ID NO: 3853278 - DNA, 21 bp, Homo sapiens
agggctaagagctagcgctgc

SEQ ID NO: 3853279 - DNA, 22 bp, Homo sapiens
agggctaagagctagcgctgcc

SEQ ID NO: 3853280 - DNA, 19 bp, Homo sapiens
agggctaccctcccccagg

SEQ ID NO: 3853281 - DNA, 21 bp, Homo sapiens
agggctagaacctagaagggc

SEQ ID NO: 3853282 - DNA, 18 bp, Homo sapiens
agggctagaacctggaag

SEQ ID NO: 3853283 - DNA, 20 bp, Homo sapiens
agggctagaacctggagagc

SEQ ID NO: 3853284 - DNA, 18 bp, Homo sapiens
agggctagaacctggagg

SEQ ID NO: 3853285 - DNA, 22 bp, Homo sapiens
agggctagaacctggagggctg

SEQ ID NO: 3853286 - DNA, 21 bp, Homo sapiens
agggctagaacctggaggggc

SEQ ID NO: 3853287 - DNA, 18 bp, Homo sapiens
agggctagaacctggcag

SEQ ID NO: 3853288 - DNA, 14 bp, Homo sapiens
agggctatggcaag

SEQ ID NO: 3853289 - DNA, 13 bp, Homo sapiens
agggctccagcat

SEQ ID NO: 3853290 - DNA, 20 bp, Homo sapiens
agggctccagcatccagcct

SEQ ID NO: 3853291 - DNA, 16 bp, Homo sapiens
agggctccctcctgga

SEQ ID NO: 3853292 - DNA, 19 bp, Homo sapiens
agggctccctcctggagca

SEQ ID NO: 3853293 - DNA, 11 bp, Homo sapiens
agggctctgag

SEQ ID NO: 3853294 - DNA, 14 bp, Homo sapiens
agggctgaaagcca

SEQ ID NO: 3853295 - DNA, 15 bp, Homo sapiens
agggctgacctgcct

SEQ ID NO: 3853296 - DNA, 16 bp, Homo sapiens
agggctgacctgcctc

SEQ ID NO: 3853297 - DNA, 23 bp, Homo sapiens
agggctgccactaacctgtagaa

SEQ ID NO: 3853298 - DNA, 22 bp, Homo sapiens
agggctgcccctgtaggttgct

SEQ ID NO: 3853299 - DNA, 22 bp, Homo sapiens
agggctggaatctggagagcta

SEQ ID NO: 3853300 - DNA, 13 bp, Homo sapiens
agggctggaccta

SEQ ID NO: 3853301 - DNA, 22 bp, Homo sapiens
agggctggacctatgtcctaag

SEQ ID NO: 3853302 - DNA, 20 bp, Homo sapiens
agggctgtagacttactttc

SEQ ID NO: 3853303 - DNA, 19 bp, Homo sapiens
agggctgttggacagctgc

SEQ ID NO: 3853304 - DNA, 22 bp, Homo sapiens
agggctgttggacagctgcttg

SEQ ID NO: 3853305 - DNA, 13 bp, Homo sapiens
aggggaaaatgaa

SEQ ID NO: 3853306 - DNA, 17 bp, Homo sapiens
aggggaataatagaaga

SEQ ID NO: 3853307 - DNA, 17 bp, Homo sapiens
atacataacttgatata

SEQ ID NO: 3853308 - DNA, 16 bp, Homo sapiens
atacatacacatacat

SEQ ID NO: 3853309 - DNA, 19 bp, Homo sapiens
atacatacacttgtataaa

SEQ ID NO: 3853310 - DNA, 16 bp, Homo sapiens
atacatacatacatat

SEQ ID NO: 3853311 - DNA, 13 bp, Homo sapiens
atacatagtcaca

SEQ ID NO: 3853312 - DNA, 16 bp, Homo sapiens
atacatagtcacaaaa

SEQ ID NO: 3853313 - DNA, 18 bp, Homo sapiens
atacatagtcacaaaaat

SEQ ID NO: 3853314 - DNA, 16 bp, Homo sapiens
atacatatatatatac

SEQ ID NO: 3853315 - DNA, 23 bp, Homo sapiens
atacatatatatatacacataca

SEQ ID NO: 3853316 - DNA, 19 bp, Homo sapiens
atacatatatatctgataa

SEQ ID NO: 3853317 - DNA, 16 bp, Homo sapiens
atacatatcagaaaag

SEQ ID NO: 3853318 - DNA, 21 bp, Homo sapiens
atacatatcagaaaagtagaa

SEQ ID NO: 3853319 - DNA, 22 bp, Homo sapiens
atacatatcagaaaagtagaat

SEQ ID NO: 3853320 - DNA, 22 bp, Homo sapiens
atacatatgtagactatataca

SEQ ID NO: 3853321 - DNA, 23 bp, Homo sapiens
atacatatgtagactatatacat

SEQ ID NO: 3853322 - DNA, 15 bp, Homo sapiens
atacatattataaat

SEQ ID NO: 3853323 - DNA, 17 bp, Homo sapiens
atacatattataaataa

SEQ ID NO: 3853324 - DNA, 23 bp, Homo sapiens
atacatattataaataaatgcca

SEQ ID NO: 3853325 - DNA, 12 bp, Homo sapiens
atacatggggaa

SEQ ID NO: 3853326 - DNA, 22 bp, Homo sapiens
atacatgtgtgtatatatgtgt

SEQ ID NO: 3853327 - DNA, 21 bp, Homo sapiens
atacatgttcatcgtatttcc

SEQ ID NO: 3853328 - DNA, 17 bp, Homo sapiens
atacattccctatcaaa

SEQ ID NO: 3853329 - DNA, 22 bp, Homo sapiens
atacattttgttatagaatact

SEQ ID NO: 3853330 - DNA, 12 bp, Homo sapiens
ataccaaatatt

SEQ ID NO: 3853331 - DNA, 14 bp, Homo sapiens
ataccaaatatttt

SEQ ID NO: 3853332 - DNA, 16 bp, Homo sapiens
ataccaaatattttag

SEQ ID NO: 3853333 - DNA, 14 bp, Homo sapiens
ataccaagtattta

SEQ ID NO: 3853334 - DNA, 22 bp, Homo sapiens
ataccagtactcagtatagcat

SEQ ID NO: 3853335 - DNA, 19 bp, Homo sapiens
ataccagtgaaccaaagag

SEQ ID NO: 3853336 - DNA, 19 bp, Homo sapiens
ataccatactcatttctaa

SEQ ID NO: 3853337 - DNA, 12 bp, Homo sapiens
ataccatcactg

SEQ ID NO: 3853338 - DNA, 16 bp, Homo sapiens
ataccatcactgagtg

SEQ ID NO: 3853339 - DNA, 19 bp, Homo sapiens
atacccagtgtttggggtg

SEQ ID NO: 3853340 - DNA, 19 bp, Homo sapiens
atacccattcttcagtgcc

SEQ ID NO: 3853341 - DNA, 22 bp, Homo sapiens
atacccattcttcagtgcctag

SEQ ID NO: 3853342 - DNA, 12 bp, Homo sapiens
ataccctccccc

SEQ ID NO: 3853343 - DNA, 18 bp, Homo sapiens
atacccttctttaaatca

SEQ ID NO: 3853344 - DNA, 16 bp, Homo sapiens
atacctataatgtgtg

SEQ ID NO: 3853345 - DNA, 19 bp, Homo sapiens
atacctataatgtgtgtat

SEQ ID NO: 3853346 - DNA, 18 bp, Homo sapiens
atacctcaacctatggta

SEQ ID NO: 3853347 - DNA, 14 bp, Homo sapiens
atacctctgaccaa

SEQ ID NO: 3853348 - DNA, 15 bp, Homo sapiens
ataccttggactgac

SEQ ID NO: 3853349 - DNA, 20 bp, Homo sapiens
atacctttggaaaaatcttg

SEQ ID NO: 3853350 - DNA, 14 bp, Homo sapiens
atacggttgcttca

SEQ ID NO: 3853351 - DNA, 13 bp, Homo sapiens
atactaaaaatca

SEQ ID NO: 3853352 - DNA, 13 bp, Homo sapiens
atactaaaatatg

SEQ ID NO: 3853353 - DNA, 12 bp, Homo sapiens
atactaaagtgt

SEQ ID NO: 3853354 - DNA, 12 bp, Homo sapiens
atactatacaac

SEQ ID NO: 3853355 - DNA, 15 bp, Homo sapiens
atactatacaacaat

SEQ ID NO: 3853356 - DNA, 16 bp, Homo sapiens
atactatacaacaatg

SEQ ID NO: 3853357 - DNA, 15 bp, Homo sapiens
atactatatgataaa

SEQ ID NO: 3853358 - DNA, 14 bp, Homo sapiens
atactcatttctaa

SEQ ID NO: 3853359 - DNA, 19 bp, Homo sapiens
atactcatttctaaaagaa

SEQ ID NO: 3853360 - DNA, 21 bp, Homo sapiens
atactcatttctaaaagaata

SEQ ID NO: 3853361 - DNA, 20 bp, Homo sapiens
atactccaagcttcaagtga

SEQ ID NO: 3853362 - DNA, 17 bp, Homo sapiens
atactctagaacatgca

SEQ ID NO: 3853363 - DNA, 19 bp, Homo sapiens
atactctagaacatgcaca

SEQ ID NO: 3853364 - DNA, 21 bp, Homo sapiens
atactctagaacatgcacatt

SEQ ID NO: 3853365 - DNA, 22 bp, Homo sapiens
atactctagaacatgcacattt

SEQ ID NO: 3853366 - DNA, 14 bp, Homo sapiens
atactgtacataga

SEQ ID NO: 3853367 - DNA, 14 bp, Homo sapiens
atacttaagcaaaa

SEQ ID NO: 3853368 - DNA, 19 bp, Homo sapiens
atacttgagctgtatatat

SEQ ID NO: 3853369 - DNA, 15 bp, Homo sapiens
atactttttttcaca

SEQ ID NO: 3853370 - DNA, 15 bp, Homo sapiens
atagaaaagatgaga

SEQ ID NO: 3853371 - DNA, 13 bp, Homo sapiens
atagaaacatgac

SEQ ID NO: 3853372 - DNA, 14 bp, Homo sapiens
atagaaacatgaca

SEQ ID NO: 3853373 - DNA, 21 bp, Homo sapiens
atagaaacatgacactgacct

SEQ ID NO: 3853374 - DNA, 21 bp, Homo sapiens
atagaaactcaccatgtaaaa

SEQ ID NO: 3853375 - DNA, 21 bp, Homo sapiens
atagaaagctgtttatttatt

SEQ ID NO: 3853376 - DNA, 16 bp, Homo sapiens
atagaaagtgccagaa

SEQ ID NO: 3853377 - DNA, 13 bp, Homo sapiens
atagaatactttt

SEQ ID NO: 3853378 - DNA, 16 bp, Homo sapiens
atagaatgttactttg

SEQ ID NO: 3853379 - DNA, 14 bp, Homo sapiens
atagacacatcaaa

SEQ ID NO: 3853380 - DNA, 15 bp, Homo sapiens
atagacacatcaaat

SEQ ID NO: 3853381 - DNA, 20 bp, Homo sapiens
atagacagcacttggctcct

SEQ ID NO: 3853382 - DNA, 22 bp, Homo sapiens
atagacagtagccaagttatat

SEQ ID NO: 3853383 - DNA, 15 bp, Homo sapiens
atagactaaatgaaa

SEQ ID NO: 3853384 - DNA, 22 bp, Homo sapiens
atagagtgactccaagaacaat

SEQ ID NO: 3853385 - DNA, 19 bp, Homo sapiens
atagatcctaggtgctgga

SEQ ID NO: 3853386 - DNA, 19 bp, Homo sapiens
atagatgcaagatatttat

SEQ ID NO: 3853387 - DNA, 21 bp, Homo sapiens
atagatgcaagatatttatat

SEQ ID NO: 3853388 - DNA, 23 bp, Homo sapiens
atagatggaccagtagacaactg

SEQ ID NO: 3853389 - DNA, 13 bp, Homo sapiens
atagatgtgcaag

SEQ ID NO: 3853390 - DNA, 19 bp, Homo sapiens
atagattaatggcactgat

SEQ ID NO: 3853391 - DNA, 19 bp, Homo sapiens
atagatttgattatttcct

SEQ ID NO: 3853392 - DNA, 16 bp, Homo sapiens
atagcattgaacattt

SEQ ID NO: 3853393 - DNA, 20 bp, Homo sapiens
atattataataatgttctct

SEQ ID NO: 3853394 - DNA, 21 bp, Homo sapiens
atattatggcaagtgatatca

SEQ ID NO: 3853395 - DNA, 22 bp, Homo sapiens
atattatggtgtaatgcacaat

SEQ ID NO: 3853396 - DNA, 13 bp, Homo sapiens
atattatttaaat

SEQ ID NO: 3853397 - DNA, 13 bp, Homo sapiens
atattcaataaag

SEQ ID NO: 3853398 - DNA, 15 bp, Homo sapiens
atattcaataaagct

SEQ ID NO: 3853399 - DNA, 17 bp, Homo sapiens
atattcagagaatatca

SEQ ID NO: 3853400 - DNA, 21 bp, Homo sapiens
atattcatgtaataaatctga

SEQ ID NO: 3853401 - DNA, 20 bp, Homo sapiens
atattccaccattcacattt

SEQ ID NO: 3853402 - DNA, 17 bp, Homo sapiens
atattctctaagatata

SEQ ID NO: 3853403 - DNA, 13 bp, Homo sapiens
atattctggaaaa

SEQ ID NO: 3853404 - DNA, 21 bp, Homo sapiens
atattctggaaaaaaaatata

SEQ ID NO: 3853405 - DNA, 15 bp, Homo sapiens
atattgaatatatca

SEQ ID NO: 3853406 - DNA, 17 bp, Homo sapiens
atattggcatggatttc

SEQ ID NO: 3853407 - DNA, 15 bp, Homo sapiens
atattggtattcact

SEQ ID NO: 3853408 - DNA, 14 bp, Homo sapiens
atattgtatattct

SEQ ID NO: 3853409 - DNA, 15 bp, Homo sapiens
atattgtatattctg

SEQ ID NO: 3853410 - DNA, 13 bp, Homo sapiens
atattgtatgtaa

SEQ ID NO: 3853411 - DNA, 18 bp, Homo sapiens
atattgtatgtaagtaat

SEQ ID NO: 3853412 - DNA, 16 bp, Homo sapiens
atattgtcagatattt

SEQ ID NO: 3853413 - DNA, 19 bp, Homo sapiens
atatttaagccttttgtgt

SEQ ID NO: 3853414 - DNA, 15 bp, Homo sapiens
atatttaagtatata

SEQ ID NO: 3853415 - DNA, 20 bp, Homo sapiens
atatttaagtatatagtata

SEQ ID NO: 3853416 - DNA, 16 bp, Homo sapiens
atatttaggcaagaga

SEQ ID NO: 3853417 - DNA, 15 bp, Homo sapiens
atatttatatatatt

SEQ ID NO: 3853418 - DNA, 17 bp, Homo sapiens
atatttatattgtatat

SEQ ID NO: 3853419 - DNA, 19 bp, Homo sapiens
atatttattttttttaagt

SEQ ID NO: 3853420 - DNA, 16 bp, Homo sapiens
atatttgaaattttat

SEQ ID NO: 3853421 - DNA, 23 bp, Homo sapiens
atatttgattgtaaaaacaaaaa

SEQ ID NO: 3853422 - DNA, 14 bp, Homo sapiens
atatttggaaagag

SEQ ID NO: 3853423 - DNA, 15 bp, Homo sapiens
atatttggaaagaga

SEQ ID NO: 3853424 - DNA, 12 bp, Homo sapiens
atatttgtacat

SEQ ID NO: 3853425 - DNA, 13 bp, Homo sapiens
atatttgtacata

SEQ ID NO: 3853426 - DNA, 22 bp, Homo sapiens
atatttgtatcacaaatcttaa

SEQ ID NO: 3853427 - DNA, 13 bp, Homo sapiens
atattttagcctt

SEQ ID NO: 3853428 - DNA, 19 bp, Homo sapiens
atattttcttccaagcaaa

SEQ ID NO: 3853429 - DNA, 14 bp, Homo sapiens
atattttgtatata

SEQ ID NO: 3853430 - DNA, 14 bp, Homo sapiens
atatttttatagac

SEQ ID NO: 3853431 - DNA, 13 bp, Homo sapiens
atatttttcaacc

SEQ ID NO: 3853432 - DNA, 18 bp, Homo sapiens
atatttttcaaccagcat

SEQ ID NO: 3853433 - DNA, 21 bp, Homo sapiens
atatttttggttgtcaatatt

SEQ ID NO: 3853434 - DNA, 15 bp, Homo sapiens
atattttttaaagtc

SEQ ID NO: 3853435 - DNA, 15 bp, Homo sapiens
atcaaaaataaacta

SEQ ID NO: 3853436 - DNA, 17 bp, Homo sapiens
atcaaaaataaactagt

SEQ ID NO: 3853437 - DNA, 18 bp, Homo sapiens
atcaaaacatatcaattc

SEQ ID NO: 3853438 - DNA, 15 bp, Homo sapiens
atcaaaagctgcttg

SEQ ID NO: 3853439 - DNA, 16 bp, Homo sapiens
atcaaaataaattgaa

SEQ ID NO: 3853440 - DNA, 15 bp, Homo sapiens
atcaaacttgtgctg

SEQ ID NO: 3853441 - DNA, 22 bp, Homo sapiens
atcaaagttcctgttcacctta

SEQ ID NO: 3853442 - DNA, 16 bp, Homo sapiens
atcaaatatgcaaagc

SEQ ID NO: 3853443 - DNA, 20 bp, Homo sapiens
atcaaatgctgtagaatgct

SEQ ID NO: 3853444 - DNA, 20 bp, Homo sapiens
atcaaatttcacgtcgtctt

SEQ ID NO: 3853445 - DNA, 22 bp, Homo sapiens
atcaaatttcacgtcgtcttct

SEQ ID NO: 3853446 - DNA, 16 bp, Homo sapiens
atcaacttgaagcaag

SEQ ID NO: 3853447 - DNA, 16 bp, Homo sapiens
atcaacttgtgtactg

SEQ ID NO: 3853448 - DNA, 12 bp, Homo sapiens
atcaagaaagtc

SEQ ID NO: 3853449 - DNA, 14 bp, Homo sapiens
atcaagaatattca

SEQ ID NO: 3853450 - DNA, 19 bp, Homo sapiens
atcaagaatattcaaatgt

SEQ ID NO: 3853451 - DNA, 13 bp, Homo sapiens
atcaagcccttta

SEQ ID NO: 3853452 - DNA, 17 bp, Homo sapiens
atcaagctagaaggcca

SEQ ID NO: 3853453 - DNA, 15 bp, Homo sapiens
atcaaggaatcctga

SEQ ID NO: 3853454 - DNA, 14 bp, Homo sapiens
atcaagtccagagc

SEQ ID NO: 3853455 - DNA, 15 bp, Homo sapiens
atcaagtccagagcc

SEQ ID NO: 3853456 - DNA, 22 bp, Homo sapiens
atcaatcatctgtgtgaaaatg

SEQ ID NO: 3853457 - DNA, 18 bp, Homo sapiens
atcaatgaagatttttaa

SEQ ID NO: 3853458 - DNA, 19 bp, Homo sapiens
atcaatggaaacagggcag

SEQ ID NO: 3853459 - DNA, 20 bp, Homo sapiens
atcaatggaaacagggcagt

SEQ ID NO: 3853460 - DNA, 14 bp, Homo sapiens
atcaattaattctt

SEQ ID NO: 3853461 - DNA, 13 bp, Homo sapiens
atcaatttcccag

SEQ ID NO: 3853462 - DNA, 14 bp, Homo sapiens
atcaatttcccaga

SEQ ID NO: 3853463 - DNA, 16 bp, Homo sapiens
atcaatttcccagaag

SEQ ID NO: 3853464 - DNA, 15 bp, Homo sapiens
atcaatttttataca

SEQ ID NO: 3853465 - DNA, 18 bp, Homo sapiens
atcaatttttatacatat

SEQ ID NO: 3853466 - DNA, 19 bp, Homo sapiens
atcaatttttatacatatc

SEQ ID NO: 3853467 - DNA, 21 bp, Homo sapiens
atcacaagcaataattaggat

SEQ ID NO: 3853468 - DNA, 21 bp, Homo sapiens
atcacagatgggtattaaact

SEQ ID NO: 3853469 - DNA, 18 bp, Homo sapiens
atcacaggggcggggcag

SEQ ID NO: 3853470 - DNA, 20 bp, Homo sapiens
atcacagtggcgagaggaga

SEQ ID NO: 3853471 - DNA, 19 bp, Homo sapiens
atcacatacaatttgcact

SEQ ID NO: 3853472 - DNA, 21 bp, Homo sapiens
atcacatacaatttgcactgt

SEQ ID NO: 3853473 - DNA, 21 bp, Homo sapiens
atcaccccttgaagccttttt

SEQ ID NO: 3853474 - DNA, 16 bp, Homo sapiens
atcaccctctgggcag

SEQ ID NO: 3853475 - DNA, 19 bp, Homo sapiens
atcacctactcacacaggc

SEQ ID NO: 3853476 - DNA, 14 bp, Homo sapiens
atcacctctcttca

SEQ ID NO: 3853477 - DNA, 20 bp, Homo sapiens
atcactgattgggtgccatg

SEQ ID NO: 3853478 - DNA, 14 bp, Homo sapiens
atcacttactcagt

SEQ ID NO: 3853479 - DNA, 23 bp, Homo sapiens
ataggtgctacaaaaacacagca

SEQ ID NO: 3853480 - DNA, 20 bp, Homo sapiens
ataggttgccaataatacac

SEQ ID NO: 3853481 - DNA, 18 bp, Homo sapiens
atagtaaaagataacaag

SEQ ID NO: 3853482 - DNA, 20 bp, Homo sapiens
atagtaagcctccctcctcg

SEQ ID NO: 3853483 - DNA, 14 bp, Homo sapiens
atagtactggcatg

SEQ ID NO: 3853484 - DNA, 18 bp, Homo sapiens
atagtaggaccaatgttg

SEQ ID NO: 3853485 - DNA, 14 bp, Homo sapiens
atagtagtcaatta

SEQ ID NO: 3853486 - DNA, 19 bp, Homo sapiens
atagtagtcaattagtaca

SEQ ID NO: 3853487 - DNA, 20 bp, Homo sapiens
atagtagtcaattagtacag

SEQ ID NO: 3853488 - DNA, 21 bp, Homo sapiens
atagtagtcaattagtacagt

SEQ ID NO: 3853489 - DNA, 16 bp, Homo sapiens
atagtatatctggaca

SEQ ID NO: 3853490 - DNA, 14 bp, Homo sapiens
atagtattgaaagt

SEQ ID NO: 3853491 - DNA, 15 bp, Homo sapiens
atagtattgaaagtg

SEQ ID NO: 3853492 - DNA, 19 bp, Homo sapiens
atagtcaaaccataaactt

SEQ ID NO: 3853493 - DNA, 20 bp, Homo sapiens
atagtcaaaccataaacttc

SEQ ID NO: 3853494 - DNA, 22 bp, Homo sapiens
atagtcaagaaaaattattgta

SEQ ID NO: 3853495 - DNA, 15 bp, Homo sapiens
atagtcacaaaaatg

SEQ ID NO: 3853496 - DNA, 13 bp, Homo sapiens
atagtccaatatt

SEQ ID NO: 3853497 - DNA, 17 bp, Homo sapiens
atagtccaatatttggc

SEQ ID NO: 3853498 - DNA, 21 bp, Homo sapiens
atagtccccatcagcaccatg

SEQ ID NO: 3853499 - DNA, 14 bp, Homo sapiens
atagtgctatatat

SEQ ID NO: 3853500 - DNA, 16 bp, Homo sapiens
atagtgctatatatat

SEQ ID NO: 3853501 - DNA, 14 bp, Homo sapiens
atagtgtaaaataa

SEQ ID NO: 3853502 - DNA, 23 bp, Homo sapiens
atagttaaaagactgcagctgct

SEQ ID NO: 3853503 - DNA, 22 bp, Homo sapiens
atagttatttacttgaaagatg

SEQ ID NO: 3853504 - DNA, 14 bp, Homo sapiens
atagtttattgaca

SEQ ID NO: 3853505 - DNA, 13 bp, Homo sapiens
atagtttgtacat

SEQ ID NO: 3853506 - DNA, 15 bp, Homo sapiens
atagtttgtacatgc

SEQ ID NO: 3853507 - DNA, 22 bp, Homo sapiens
atataaaaagaaaagataaaga

SEQ ID NO: 3853508 - DNA, 14 bp, Homo sapiens
atataaaaatatat

SEQ ID NO: 3853509 - DNA, 17 bp, Homo sapiens
atataaaaatatatata

SEQ ID NO: 3853510 - DNA, 13 bp, Homo sapiens
atataaaacacat

SEQ ID NO: 3853511 - DNA, 21 bp, Homo sapiens
atataaaatagttgtccatat

SEQ ID NO: 3853512 - DNA, 12 bp, Homo sapiens
atataaacttgt

SEQ ID NO: 3853513 - DNA, 13 bp, Homo sapiens
atataaacttgtg

SEQ ID NO: 3853514 - DNA, 15 bp, Homo sapiens
atataaatgcatgat

SEQ ID NO: 3853515 - DNA, 23 bp, Homo sapiens
atataaatgcatgattttataca

SEQ ID NO: 3853516 - DNA, 18 bp, Homo sapiens
atataaatggctggtttt

SEQ ID NO: 3853517 - DNA, 12 bp, Homo sapiens
atataaattaag

SEQ ID NO: 3853518 - DNA, 15 bp, Homo sapiens
atataacaaccttta

SEQ ID NO: 3853519 - DNA, 14 bp, Homo sapiens
atatacaaacatgt

SEQ ID NO: 3853520 - DNA, 16 bp, Homo sapiens
atatacacatacatac

SEQ ID NO: 3853521 - DNA, 16 bp, Homo sapiens
atatacacatatacct

SEQ ID NO: 3853522 - DNA, 16 bp, Homo sapiens
atatacatacacttgt

SEQ ID NO: 3853523 - DNA, 13 bp, Homo sapiens
atatacatatata

SEQ ID NO: 3853524 - DNA, 14 bp, Homo sapiens
atatacatatatat

SEQ ID NO: 3853525 - DNA, 23 bp, Homo sapiens
atatacatatatatatacacata

SEQ ID NO: 3853526 - DNA, 16 bp, Homo sapiens
atatacatgtgtgtat

SEQ ID NO: 3853527 - DNA, 17 bp, Homo sapiens
atatacatgtgtgtata

SEQ ID NO: 3853528 - DNA, 18 bp, Homo sapiens
atatacatgtgtgtatat

SEQ ID NO: 3853529 - DNA, 21 bp, Homo sapiens
atatacatgtgtgtatatatg

SEQ ID NO: 3853530 - DNA, 22 bp, Homo sapiens
atatacatgtgtgtatatatgt

SEQ ID NO: 3853531 - DNA, 18 bp, Homo sapiens
atatacattctttatctt

SEQ ID NO: 3853532 - DNA, 12 bp, Homo sapiens
atatacatttca

SEQ ID NO: 3853533 - DNA, 17 bp, Homo sapiens
atatacctataatgtgt

SEQ ID NO: 3853534 - DNA, 20 bp, Homo sapiens
atatacctataatgtgtgta

SEQ ID NO: 3853535 - DNA, 19 bp, Homo sapiens
atatagcagcaaaaatata

SEQ ID NO: 3853536 - DNA, 23 bp, Homo sapiens
atatagcgtgggttatcagttaa

SEQ ID NO: 3853537 - DNA, 16 bp, Homo sapiens
atataggttgtgcaaa

SEQ ID NO: 3853538 - DNA, 23 bp, Homo sapiens
atatagtaactactttttatact

SEQ ID NO: 3853539 - DNA, 13 bp, Homo sapiens
atatagtatattt

SEQ ID NO: 3853540 - DNA, 18 bp, Homo sapiens
atatagtatatttatact

SEQ ID NO: 3853541 - DNA, 15 bp, Homo sapiens
atatataaaaatata

SEQ ID NO: 3853542 - DNA, 13 bp, Homo sapiens
atatataaatata

SEQ ID NO: 3853543 - DNA, 15 bp, Homo sapiens
atatatacacataca

SEQ ID NO: 3853544 - DNA, 14 bp, Homo sapiens
atatatataaatat

SEQ ID NO: 3853545 - DNA, 14 bp, Homo sapiens
atatatatacacat

SEQ ID NO: 3853546 - DNA, 13 bp, Homo sapiens
atatatatattta

SEQ ID NO: 3853547 - DNA, 22 bp, Homo sapiens
atatatatctgataaaattgtg

SEQ ID NO: 3853548 - DNA, 14 bp, Homo sapiens
atatatatgtatat

SEQ ID NO: 3853549 - DNA, 16 bp, Homo sapiens
atatatatgtatatgt

SEQ ID NO: 3853550 - DNA, 17 bp, Homo sapiens
atatatatgtgcagtat

SEQ ID NO: 3853551 - DNA, 22 bp, Homo sapiens
atgcactgacccttccagacat

SEQ ID NO: 3853552 - DNA, 13 bp, Homo sapiens
atgcactggccac

SEQ ID NO: 3853553 - DNA, 18 bp, Homo sapiens
atgcagactcctcagatc

SEQ ID NO: 3853554 - DNA, 21 bp, Homo sapiens
atgcagaggggtgctgctcct

SEQ ID NO: 3853555 - DNA, 23 bp, Homo sapiens
atgcagaggtaaaagtgtgagca

SEQ ID NO: 3853556 - DNA, 17 bp, Homo sapiens
atgcagattcctgggcc

SEQ ID NO: 3853557 - DNA, 21 bp, Homo sapiens
atgcagattcctgggcctgtc

SEQ ID NO: 3853558 - DNA, 22 bp, Homo sapiens
atgcagattcctgggcctgtcc

SEQ ID NO: 3853559 - DNA, 19 bp, Homo sapiens
atgcagcctcttccccacc

SEQ ID NO: 3853560 - DNA, 12 bp, Homo sapiens
atgcagcttcat

SEQ ID NO: 3853561 - DNA, 18 bp, Homo sapiens
atgcagcttcatcaattt

SEQ ID NO: 3853562 - DNA, 21 bp, Homo sapiens
atgcagcttcatcaattttta

SEQ ID NO: 3853563 - DNA, 23 bp, Homo sapiens
atgcagggaagagggcagtacct

SEQ ID NO: 3853564 - DNA, 14 bp, Homo sapiens
atgcagggtattgc

SEQ ID NO: 3853565 - DNA, 16 bp, Homo sapiens
atgcagtattgccaca

SEQ ID NO: 3853566 - DNA, 20 bp, Homo sapiens
atgcagtattgccacaatgc

SEQ ID NO: 3853567 - DNA, 16 bp, Homo sapiens
atgcagtccagaataa

SEQ ID NO: 3853568 - DNA, 21 bp, Homo sapiens
atgcagtccagaataagtgct

SEQ ID NO: 3853569 - DNA, 14 bp, Homo sapiens
atgcataaatgcat

SEQ ID NO: 3853570 - DNA, 14 bp, Homo sapiens
atgcatcagaaagg

SEQ ID NO: 3853571 - DNA, 15 bp, Homo sapiens
atgcatcagaaaggg

SEQ ID NO: 3853572 - DNA, 14 bp, Homo sapiens
atgcatccattcct

SEQ ID NO: 3853573 - DNA, 11 bp, Homo sapiens
atgcatgattt

SEQ ID NO: 3853574 - DNA, 15 bp, Homo sapiens
atgcatgattttata

SEQ ID NO: 3853575 - DNA, 19 bp, Homo sapiens
atgcatgattttatacata

SEQ ID NO: 3853576 - DNA, 22 bp, Homo sapiens
atgcatgattttatacatagtc

SEQ ID NO: 3853577 - DNA, 17 bp, Homo sapiens
atgcatgcgcaggctca

SEQ ID NO: 3853578 - DNA, 18 bp, Homo sapiens
atgcatgcgcaggctcat

SEQ ID NO: 3853579 - DNA, 23 bp, Homo sapiens
atgcatggaaacctgaaaaaaag

SEQ ID NO: 3853580 - DNA, 14 bp, Homo sapiens
atgcatgtaaggtc

SEQ ID NO: 3853581 - DNA, 15 bp, Homo sapiens
atgcatttccacact

SEQ ID NO: 3853582 - DNA, 16 bp, Homo sapiens
atgcatttccacactg

SEQ ID NO: 3853583 - DNA, 18 bp, Homo sapiens
atgccaaagcaaaagaag

SEQ ID NO: 3853584 - DNA, 15 bp, Homo sapiens
atgccaacaccttct

SEQ ID NO: 3853585 - DNA, 13 bp, Homo sapiens
atgccaacatacc

SEQ ID NO: 3853586 - DNA, 14 bp, Homo sapiens
atgccaccctctcc

SEQ ID NO: 3853587 - DNA, 19 bp, Homo sapiens
atgccaccctgttttcagc

SEQ ID NO: 3853588 - DNA, 13 bp, Homo sapiens
atgccactgccag

SEQ ID NO: 3853589 - DNA, 14 bp, Homo sapiens
atgccactgccagg

SEQ ID NO: 3853590 - DNA, 16 bp, Homo sapiens
atgccactgccaggca

SEQ ID NO: 3853591 - DNA, 17 bp, Homo sapiens
atgccactgccaggcac

SEQ ID NO: 3853592 - DNA, 21 bp, Homo sapiens
atgccactgctttccagcctg

SEQ ID NO: 3853593 - DNA, 23 bp, Homo sapiens
atgccatgtttagattccaggat

SEQ ID NO: 3853594 - DNA, 14 bp, Homo sapiens
atgccctggatcca

SEQ ID NO: 3853595 - DNA, 22 bp, Homo sapiens
atgccgaacctatacccattct

SEQ ID NO: 3853596 - DNA, 21 bp, Homo sapiens
atgcctaatatttaggcaaga

SEQ ID NO: 3853597 - DNA, 17 bp, Homo sapiens
atgcctcagtttcccca

SEQ ID NO: 3853598 - DNA, 16 bp, Homo sapiens
atgcctctcccacgat

SEQ ID NO: 3853599 - DNA, 14 bp, Homo sapiens
atgcctctgaggcc

SEQ ID NO: 3853600 - DNA, 20 bp, Homo sapiens
atgcctctgaggccagcctg

SEQ ID NO: 3853601 - DNA, 20 bp, Homo sapiens
atgcctggcccccctccagg

SEQ ID NO: 3853602 - DNA, 21 bp, Homo sapiens
atgcctggcccccctccaggc

SEQ ID NO: 3853603 - DNA, 16 bp, Homo sapiens
atgcctggtctttcct

SEQ ID NO: 3853604 - DNA, 18 bp, Homo sapiens
atgcctggtctttcctct

SEQ ID NO: 3853605 - DNA, 22 bp, Homo sapiens
atgccttgagtctttaatccca

SEQ ID NO: 3853606 - DNA, 14 bp, Homo sapiens
atgcctttagatgt

SEQ ID NO: 3853607 - DNA, 17 bp, Homo sapiens
atgcctttagatgtgag

SEQ ID NO: 3853608 - DNA, 20 bp, Homo sapiens
atgcgaaaacttgaatctgt

SEQ ID NO: 3853609 - DNA, 21 bp, Homo sapiens
atgcgcaagggcaaaccattt

SEQ ID NO: 3853610 - DNA, 16 bp, Homo sapiens
atgcgcaatgtggcat

SEQ ID NO: 3853611 - DNA, 12 bp, Homo sapiens
atgcgcaggctc

SEQ ID NO: 3853612 - DNA, 18 bp, Homo sapiens
atgcgtatatgtgcgtct

SEQ ID NO: 3853613 - DNA, 17 bp, Homo sapiens
atgcgtcccaagcagcc

SEQ ID NO: 3853614 - DNA, 19 bp, Homo sapiens
atgctaaatgcaaacactg

SEQ ID NO: 3853615 - DNA, 19 bp, Homo sapiens
atgctaagaaatgctgaaa

SEQ ID NO: 3853616 - DNA, 12 bp, Homo sapiens
atgctagtttat

SEQ ID NO: 3853617 - DNA, 18 bp, Homo sapiens
atgctattgttgtgggct

SEQ ID NO: 3853618 - DNA, 19 bp, Homo sapiens
atgctattgttgtgggctt

SEQ ID NO: 3853619 - DNA, 17 bp, Homo sapiens
atgctatttctggcctc

SEQ ID NO: 3853620 - DNA, 18 bp, Homo sapiens
atgctatttctggcctca

SEQ ID NO: 3853621 - DNA, 21 bp, Homo sapiens
atgctcatacttggacagtta

SEQ ID NO: 3853622 - DNA, 11 bp, Homo sapiens
atgctccaggg

SEQ ID NO: 3853623 - DNA, 13 bp, Homo sapiens
atgctcctagttt

SEQ ID NO: 3853624 - DNA, 22 bp, Homo sapiens
atgctcctagtttgacctcaca

SEQ ID NO: 3853625 - DNA, 21 bp, Homo sapiens
atgctcgtgtgatttcctaca

SEQ ID NO: 3853626 - DNA, 15 bp, Homo sapiens
atgctctacttcttt

SEQ ID NO: 3853627 - DNA, 13 bp, Homo sapiens
atgctctctgcag

SEQ ID NO: 3853628 - DNA, 15 bp, Homo sapiens
atgctgaatgaatcc

SEQ ID NO: 3853629 - DNA, 12 bp, Homo sapiens
atgctggccagc

SEQ ID NO: 3853630 - DNA, 13 bp, Homo sapiens
atgctggccagca

SEQ ID NO: 3853631 - DNA, 20 bp, Homo sapiens
atgctggccagcaccctctc

SEQ ID NO: 3853632 - DNA, 21 bp, Homo sapiens
atgctgtctccataatgccac

SEQ ID NO: 3853633 - DNA, 22 bp, Homo sapiens
atgctgtctccataatgccact

SEQ ID NO: 3853634 - DNA, 15 bp, Homo sapiens
atgctgtgctctttg

SEQ ID NO: 3853635 - DNA, 18 bp, Homo sapiens
atgctgtgctctttgaag

SEQ ID NO: 3853636 - DNA, 14 bp, Homo sapiens
atgctgttgcctca

SEQ ID NO: 3853637 - DNA, 16 bp, Homo sapiens
atgctgttgcctcatc

SEQ ID NO: 3853638 - DNA, 17 bp, Homo sapiens
atgctgttgcctcatct

SEQ ID NO: 3853639 - DNA, 17 bp, Homo sapiens
atgcttaaaatatgtat

SEQ ID NO: 3853640 - DNA, 21 bp, Homo sapiens
atgcttaaaatatgtatgtct

SEQ ID NO: 3853641 - DNA, 16 bp, Homo sapiens
atgcttcaagtgttgc

SEQ ID NO: 3853642 - DNA, 18 bp, Homo sapiens
atgcttcagttgtacttc

SEQ ID NO: 3853643 - DNA, 22 bp, Homo sapiens
atgctttcctaaagtctctgct

SEQ ID NO: 3853644 - DNA, 14 bp, Homo sapiens
atgctttctccttt

SEQ ID NO: 3853645 - DNA, 15 bp, Homo sapiens
atgctttctcctttt

SEQ ID NO: 3853646 - DNA, 15 bp, Homo sapiens
atgctttgggaggcc

SEQ ID NO: 3853647 - DNA, 20 bp, Homo sapiens
atgctttgggaggccaaggc

SEQ ID NO: 3853648 - DNA, 21 bp, Homo sapiens
atgctttgggaggccaaggca

SEQ ID NO: 3853649 - DNA, 16 bp, Homo sapiens
atgctttttgaatgtt

SEQ ID NO: 3853650 - DNA, 22 bp, Homo sapiens
atgctttttgaatgttatttgt

SEQ ID NO: 3853651 - DNA, 15 bp, Homo sapiens
atggaaaagcccagt

SEQ ID NO: 3853652 - DNA, 18 bp, Homo sapiens
atggaaccttccctccaa

SEQ ID NO: 3853653 - DNA, 21 bp, Homo sapiens
atggaaccttccctccaaatt

SEQ ID NO: 3853654 - DNA, 14 bp, Homo sapiens
atggaagagaaatc

SEQ ID NO: 3853655 - DNA, 16 bp, Homo sapiens
atggaagattttaaat

SEQ ID NO: 3853656 - DNA, 17 bp, Homo sapiens
atggaagtggcagtgaa

SEQ ID NO: 3853657 - DNA, 18 bp, Homo sapiens
atggaagtggcagtgaaa

SEQ ID NO: 3853658 - DNA, 16 bp, Homo sapiens
atggaatacagtgtta

SEQ ID NO: 3853659 - DNA, 20 bp, Homo sapiens
atggaatagaaaagatgaga

SEQ ID NO: 3853660 - DNA, 12 bp, Homo sapiens
atggaatttgta

SEQ ID NO: 3853661 - DNA, 17 bp, Homo sapiens
atggacacattttctcc

SEQ ID NO: 3853662 - DNA, 23 bp, Homo sapiens
atggacaccccttatccaggact

SEQ ID NO: 3853663 - DNA, 22 bp, Homo sapiens
atggacccacgaacgctcttag

SEQ ID NO: 3853664 - DNA, 19 bp, Homo sapiens
atggacccctcccttgctc

SEQ ID NO: 3853665 - DNA, 14 bp, Homo sapiens
atggaccctcgcag

SEQ ID NO: 3853666 - DNA, 17 bp, Homo sapiens
atggaccctcgcagcag

SEQ ID NO: 3853667 - DNA, 19 bp, Homo sapiens
atggaccgggtgggcctgg

SEQ ID NO: 3853668 - DNA, 20 bp, Homo sapiens
atggaccgggtgggcctggc

SEQ ID NO: 3853669 - DNA, 18 bp, Homo sapiens
atggactctgggtttcat

SEQ ID NO: 3853670 - DNA, 14 bp, Homo sapiens
atggacttcaaatt

SEQ ID NO: 3853671 - DNA, 23 bp, Homo sapiens
atggacttttgggggttggatgg

SEQ ID NO: 3853672 - DNA, 14 bp, Homo sapiens
atggagaaaccctg

SEQ ID NO: 3853673 - DNA, 14 bp, Homo sapiens
atggagactcctgc

SEQ ID NO: 3853674 - DNA, 13 bp, Homo sapiens
atggagagagggg

SEQ ID NO: 3853675 - DNA, 15 bp, Homo sapiens
atggagagaggggaa

SEQ ID NO: 3853676 - DNA, 18 bp, Homo sapiens
atggagagccctgggacc

SEQ ID NO: 3853677 - DNA, 20 bp, Homo sapiens
atggagagctagaacccggc

SEQ ID NO: 3853678 - DNA, 16 bp, Homo sapiens
atggagaggcggcctc

SEQ ID NO: 3853679 - DNA, 18 bp, Homo sapiens
atggagaggcggcctcgt

SEQ ID NO: 3853680 - DNA, 20 bp, Homo sapiens
atggagaggcggcctcgtgc

SEQ ID NO: 3853681 - DNA, 23 bp, Homo sapiens
atggagcctggcacaggactgat

SEQ ID NO: 3853682 - DNA, 14 bp, Homo sapiens
atggagcttgtaca

SEQ ID NO: 3853683 - DNA, 15 bp, Homo sapiens
atggagcttgtacat

SEQ ID NO: 3853684 - DNA, 16 bp, Homo sapiens
atggagcttgtacata

SEQ ID NO: 3853685 - DNA, 17 bp, Homo sapiens
atggagcttgtacatat

SEQ ID NO: 3853686 - DNA, 16 bp, Homo sapiens
atggaggaaaaccaag

SEQ ID NO: 3853687 - DNA, 12 bp, Homo sapiens
atggaggagaaa

SEQ ID NO: 3853688 - DNA, 12 bp, Homo sapiens
atggaggcaggc

SEQ ID NO: 3853689 - DNA, 18 bp, Homo sapiens
atggaggcaggctccccc

SEQ ID NO: 3853690 - DNA, 20 bp, Homo sapiens
atggaggcaggctccccctg

SEQ ID NO: 3853691 - DNA, 22 bp, Homo sapiens
atggaggcaggctccccctgcc

SEQ ID NO: 3853692 - DNA, 13 bp, Homo sapiens
atggagggagcca

SEQ ID NO: 3853693 - DNA, 22 bp, Homo sapiens
atggagggtggggccgggtgaa

SEQ ID NO: 3853694 - DNA, 16 bp, Homo sapiens
atggagtgagcagtag

SEQ ID NO: 3853695 - DNA, 19 bp, Homo sapiens
atggagtgtgcgtgtgtgc

SEQ ID NO: 3853696 - DNA, 18 bp, Homo sapiens
atggatcccaattcattt

SEQ ID NO: 3853697 - DNA, 13 bp, Homo sapiens
atggatgctgggg

SEQ ID NO: 3853698 - DNA, 14 bp, Homo sapiens
atggatgctgggga

SEQ ID NO: 3853699 - DNA, 20 bp, Homo sapiens
atggatttctgtcttctcta

SEQ ID NO: 3853700 - DNA, 15 bp, Homo sapiens
atggatttgaagcaa

SEQ ID NO: 3853701 - DNA, 21 bp, Homo sapiens
atggcaaagcggttgcttctg

SEQ ID NO: 3853702 - DNA, 14 bp, Homo sapiens
atggcaagtgatat

SEQ ID NO: 3853703 - DNA, 23 bp, Homo sapiens
atggcaagttttgatatgagtat

SEQ ID NO: 3853704 - DNA, 15 bp, Homo sapiens
atggcaattttgtaa

SEQ ID NO: 3853705 - DNA, 16 bp, Homo sapiens
atggcaattttgtaac

SEQ ID NO: 3853706 - DNA, 22 bp, Homo sapiens
atggcaccaacgggaccccctg

SEQ ID NO: 3853707 - DNA, 17 bp, Homo sapiens
atggcaccagccccctg

SEQ ID NO: 3853708 - DNA, 20 bp, Homo sapiens
atggcagatgtaggagggac

SEQ ID NO: 3853709 - DNA, 18 bp, Homo sapiens
atggcagtgttcctattt

SEQ ID NO: 3853710 - DNA, 15 bp, Homo sapiens
atggcatgatttata

SEQ ID NO: 3853711 - DNA, 21 bp, Homo sapiens
atggccaccccgtgccacccg

SEQ ID NO: 3853712 - DNA, 18 bp, Homo sapiens
atggcccttcccactgga

SEQ ID NO: 3853713 - DNA, 12 bp, Homo sapiens
atggccttccct

SEQ ID NO: 3853714 - DNA, 18 bp, Homo sapiens
atggcgattccctctcac

SEQ ID NO: 3853715 - DNA, 20 bp, Homo sapiens
atggcgattccctctcaccc

SEQ ID NO: 3853716 - DNA, 15 bp, Homo sapiens
atggcgcgggaggca

SEQ ID NO: 3853717 - DNA, 18 bp, Homo sapiens
atggcgcgggaggcacca

SEQ ID NO: 3853718 - DNA, 17 bp, Homo sapiens
atggcgtaatgggcctg

SEQ ID NO: 3853719 - DNA, 20 bp, Homo sapiens
atggcgtaatgggcctgccc

SEQ ID NO: 3853720 - DNA, 21 bp, Homo sapiens
atggcgtaatgggcctgccca

SEQ ID NO: 3853721 - DNA, 16 bp, Homo sapiens
atggctataaatatat

SEQ ID NO: 3853722 - DNA, 19 bp, Homo sapiens
atggctataggtgctacaa

SEQ ID NO: 3853723 - DNA, 14 bp, Homo sapiens
atggctatatggca

SEQ ID NO: 3853724 - DNA, 12 bp, Homo sapiens
atggctcaggca

SEQ ID NO: 3853725 - DNA, 16 bp, Homo sapiens
atggctcaggcaagcc

SEQ ID NO: 3853726 - DNA, 19 bp, Homo sapiens
atggctcaggcaagcccct

SEQ ID NO: 3853727 - DNA, 18 bp, Homo sapiens
atggctgactttgctctt

SEQ ID NO: 3853728 - DNA, 14 bp, Homo sapiens
atggctgtaaacta

SEQ ID NO: 3853729 - DNA, 17 bp, Homo sapiens
atggctgtaaactataa

SEQ ID NO: 3853730 - DNA, 15 bp, Homo sapiens
atggctgtgcctctg

SEQ ID NO: 3853731 - DNA, 16 bp, Homo sapiens
atggctgtgcctctgc

SEQ ID NO: 3853732 - DNA, 18 bp, Homo sapiens
atggctgtgcctctgcct

SEQ ID NO: 3853733 - DNA, 14 bp, Homo sapiens
atggcttaatgttt

SEQ ID NO: 3853734 - DNA, 16 bp, Homo sapiens
atggcttaatgtttat

SEQ ID NO: 3853735 - DNA, 21 bp, Homo sapiens
atggcttaatgtttattcctg

SEQ ID NO: 3853736 - DNA, 21 bp, Homo sapiens
atggcttataaatgtgtattc

SEQ ID NO: 3853737 - DNA, 16 bp, Homo sapiens
atggcttggggagcag

SEQ ID NO: 3853738 - DNA, 14 bp, Homo sapiens
atgggaaagcattg

SEQ ID NO: 3853739 - DNA, 14 bp, Homo sapiens
atgggaagacatga

SEQ ID NO: 3853740 - DNA, 19 bp, Homo sapiens
atgggaagatggtagcaga

SEQ ID NO: 3853741 - DNA, 22 bp, Homo sapiens
atgggaagccatattcacacct

SEQ ID NO: 3853742 - DNA, 13 bp, Homo sapiens
atgggaccaggga

SEQ ID NO: 3853743 - DNA, 15 bp, Homo sapiens
atgggagatggtcag

SEQ ID NO: 3853744 - DNA, 20 bp, Homo sapiens
atgggagctggttagaaatg

SEQ ID NO: 3853745 - DNA, 21 bp, Homo sapiens
atgggagctggttagaaatgc

SEQ ID NO: 3853746 - DNA, 20 bp, Homo sapiens
atgggcaattctgacttctc

SEQ ID NO: 3853747 - DNA, 16 bp, Homo sapiens
atgggcacatgaggag

SEQ ID NO: 3853748 - DNA, 11 bp, Homo sapiens
atgggcagtgc

SEQ ID NO: 3853749 - DNA, 17 bp, Homo sapiens
atgggcagtgcctcctg

SEQ ID NO: 3853750 - DNA, 18 bp, Homo sapiens
atgggcagtgcctcctgg

SEQ ID NO: 3853751 - DNA, 16 bp, Homo sapiens
atgggcattgggctga

SEQ ID NO: 3853752 - DNA, 21 bp, Homo sapiens
atgggcattgggctgacacct

SEQ ID NO: 3853753 - DNA, 21 bp, Homo sapiens
atgggccaattaaaatatata

SEQ ID NO: 3853754 - DNA, 14 bp, Homo sapiens
atgggcctgcccaa

SEQ ID NO: 3853755 - DNA, 13 bp, Homo sapiens
atgggcctgctgc

SEQ ID NO: 3853756 - DNA, 12 bp, Homo sapiens
atgggcctgggc

SEQ ID NO: 3853757 - DNA, 17 bp, Homo sapiens
atgggcctgggcctgct

SEQ ID NO: 3853758 - DNA, 15 bp, Homo sapiens
atgggccttgctttg

SEQ ID NO: 3853759 - DNA, 21 bp, Homo sapiens
atgggccttgctttgggcttt

SEQ ID NO: 3853760 - DNA, 22 bp, Homo sapiens
atgggccttgctttgggctttg

SEQ ID NO: 3853761 - DNA, 21 bp, Homo sapiens
atgggctagtgtgagtggcag

SEQ ID NO: 3853762 - DNA, 23 bp, Homo sapiens
atgggctagtgtgagtggcagcc

SEQ ID NO: 3853763 - DNA, 23 bp, Homo sapiens
atgggcttggacttcctggggcc

SEQ ID NO: 3853764 - DNA, 11 bp, Homo sapiens
atggggagaaa

SEQ ID NO: 3853765 - DNA, 13 bp, Homo sapiens
atggggagaaagg

SEQ ID NO: 3853766 - DNA, 22 bp, Homo sapiens
atggggagaaagggcaaattat

SEQ ID NO: 3853767 - DNA, 17 bp, Homo sapiens
atgggggcactgaggac

SEQ ID NO: 3853768 - DNA, 19 bp, Homo sapiens
atgggtctggctgagctga

SEQ ID NO: 3853769 - DNA, 15 bp, Homo sapiens
atgggtgatatcctg

SEQ ID NO: 3853770 - DNA, 15 bp, Homo sapiens
atgggtgctggcaga

SEQ ID NO: 3853771 - DNA, 20 bp, Homo sapiens
atgggtgtgcccttggggta

SEQ ID NO: 3853772 - DNA, 14 bp, Homo sapiens
atggtaattgttgc

SEQ ID NO: 3853773 - DNA, 19 bp, Homo sapiens
atggtataatggttgactg

SEQ ID NO: 3853774 - DNA, 14 bp, Homo sapiens
atggtatgagctga

SEQ ID NO: 3853775 - DNA, 16 bp, Homo sapiens
atggtatgctggccag

SEQ ID NO: 3853776 - DNA, 14 bp, Homo sapiens
atggtctaaaaata

SEQ ID NO: 3853777 - DNA, 23 bp, Homo sapiens
atggtctctcgggccccccacac

SEQ ID NO: 3853778 - DNA, 16 bp, Homo sapiens
atggtgacacacagca

SEQ ID NO: 3853779 - DNA, 17 bp, Homo sapiens
atggtgacacacagcag

SEQ ID NO: 3853780 - DNA, 13 bp, Homo sapiens
atggtgagctggg

SEQ ID NO: 3853781 - DNA, 22 bp, Homo sapiens
atggtgaggaagccccaagcca

SEQ ID NO: 3853782 - DNA, 20 bp, Homo sapiens
atggtgctcacgactcttcc

SEQ ID NO: 3853783 - DNA, 23 bp, Homo sapiens
atggtgcttgttaatgctttctg

SEQ ID NO: 3853784 - DNA, 23 bp, Homo sapiens
atggtggaagggggtgtgcgtgc

SEQ ID NO: 3853785 - DNA, 17 bp, Homo sapiens
atggtgggaaccctccc

SEQ ID NO: 3853786 - DNA, 19 bp, Homo sapiens
atggtgggaaccctcccca

SEQ ID NO: 3853787 - DNA, 22 bp, Homo sapiens
atggtggtttgtcatatattca

SEQ ID NO: 3853788 - DNA, 20 bp, Homo sapiens
atggtgttgccctgagtgga

SEQ ID NO: 3853789 - DNA, 16 bp, Homo sapiens
atggttcccaataaaa

SEQ ID NO: 3853790 - DNA, 19 bp, Homo sapiens
atggttcccaataaaagtg

SEQ ID NO: 3853791 - DNA, 15 bp, Homo sapiens
atggttgccttaaag

SEQ ID NO: 3853792 - DNA, 18 bp, Homo sapiens
atggttgccttaaagaaa

SEQ ID NO: 3853793 - DNA, 18 bp, Homo sapiens
atggttgtctgtttttgt

SEQ ID NO: 3853794 - DNA, 23 bp, Homo sapiens
atggtttacatgaacacagctgc

SEQ ID NO: 3853795 - DNA, 22 bp, Homo sapiens
atggtttgactcccgaacatca

SEQ ID NO: 3853796 - DNA, 14 bp, Homo sapiens
atgtaaaatgcagt

SEQ ID NO: 3853797 - DNA, 18 bp, Homo sapiens
atgtaaaatgcagtccag

SEQ ID NO: 3853798 - DNA, 23 bp, Homo sapiens
atgtaaaatgcagtccagaataa

SEQ ID NO: 3853799 - DNA, 23 bp, Homo sapiens
atgtaaacataattcttgtatat

SEQ ID NO: 3853800 - DNA, 17 bp, Homo sapiens
atgtaaagtatgtaaac

SEQ ID NO: 3853801 - DNA, 18 bp, Homo sapiens
atgtaaagtatgtaaaca

SEQ ID NO: 3853802 - DNA, 12 bp, Homo sapiens
atgtaaatagtg

SEQ ID NO: 3853803 - DNA, 20 bp, Homo sapiens
atgtaacaggtaaccacaat

SEQ ID NO: 3853804 - DNA, 15 bp, Homo sapiens
atgtaactattgaat

SEQ ID NO: 3853805 - DNA, 16 bp, Homo sapiens
atgtaacttttgtaag

SEQ ID NO: 3853806 - DNA, 18 bp, Homo sapiens
atgtaacttttgtaagac

SEQ ID NO: 3853807 - DNA, 21 bp, Homo sapiens
atgtaagggaaactgccagca

SEQ ID NO: 3853808 - DNA, 22 bp, Homo sapiens
atgtaagggaaactgccagcaa

SEQ ID NO: 3853809 - DNA, 22 bp, Homo sapiens
atctatcaatagtcaagaaaaa

SEQ ID NO: 3853810 - DNA, 14 bp, Homo sapiens
atctatctgccttt

SEQ ID NO: 3853811 - DNA, 16 bp, Homo sapiens
atctatgcaattttta

SEQ ID NO: 3853812 - DNA, 22 bp, Homo sapiens
atctatgcaatttttaaactag

SEQ ID NO: 3853813 - DNA, 23 bp, Homo sapiens
atctatgcaatttttaaactagt

SEQ ID NO: 3853814 - DNA, 20 bp, Homo sapiens
atctatggccctgcaaaaat

SEQ ID NO: 3853815 - DNA, 21 bp, Homo sapiens
atctattcagacaagcaacag

SEQ ID NO: 3853816 - DNA, 22 bp, Homo sapiens
atctattcagacaagcaacagg

SEQ ID NO: 3853817 - DNA, 15 bp, Homo sapiens
atctcaaaactgcac

SEQ ID NO: 3853818 - DNA, 20 bp, Homo sapiens
atctcaaaactgcactgtca

SEQ ID NO: 3853819 - DNA, 14 bp, Homo sapiens
atctcactgcccag

SEQ ID NO: 3853820 - DNA, 14 bp, Homo sapiens
atctcaggtgccac

SEQ ID NO: 3853821 - DNA, 23 bp, Homo sapiens
atctcataggttgccaataatac

SEQ ID NO: 3853822 - DNA, 12 bp, Homo sapiens
atctccaaggac

SEQ ID NO: 3853823 - DNA, 19 bp, Homo sapiens
atctccacagtcaaagaag

SEQ ID NO: 3853824 - DNA, 20 bp, Homo sapiens
atctccaggattgaagagca

SEQ ID NO: 3853825 - DNA, 14 bp, Homo sapiens
atctccccactcta

SEQ ID NO: 3853826 - DNA, 21 bp, Homo sapiens
atctccccaggcctccagcct

SEQ ID NO: 3853827 - DNA, 22 bp, Homo sapiens
atctcctcctatttatgaaaac

SEQ ID NO: 3853828 - DNA, 17 bp, Homo sapiens
atctcgagccccctgga

SEQ ID NO: 3853829 - DNA, 18 bp, Homo sapiens
atctcgtgccagggcagg

SEQ ID NO: 3853830 - DNA, 22 bp, Homo sapiens
atctcgtttttcttcttaagac

SEQ ID NO: 3853831 - DNA, 15 bp, Homo sapiens
atctctaatatggca

SEQ ID NO: 3853832 - DNA, 22 bp, Homo sapiens
atctctaatatggcaaaaatgg

SEQ ID NO: 3853833 - DNA, 14 bp, Homo sapiens
atctctaccccaaa

SEQ ID NO: 3853834 - DNA, 14 bp, Homo sapiens
atctctatttaata

SEQ ID NO: 3853835 - DNA, 21 bp, Homo sapiens
atctctcaggagcacaggcag

SEQ ID NO: 3853836 - DNA, 22 bp, Homo sapiens
atctctcaggagcacaggcagc

SEQ ID NO: 3853837 - DNA, 23 bp, Homo sapiens
atctctcaggagcacaggcagct

SEQ ID NO: 3853838 - DNA, 23 bp, Homo sapiens
atctctctgcctatttattgggg

SEQ ID NO: 3853839 - DNA, 13 bp, Homo sapiens
atctctctggggc

SEQ ID NO: 3853840 - DNA, 11 bp, Homo sapiens
atctctcttcc

SEQ ID NO: 3853841 - DNA, 13 bp, Homo sapiens
atctctgaaagca

SEQ ID NO: 3853842 - DNA, 13 bp, Homo sapiens
atctgaaaggcac

SEQ ID NO: 3853843 - DNA, 18 bp, Homo sapiens
atctgaacacagtttagt

SEQ ID NO: 3853844 - DNA, 19 bp, Homo sapiens
atctgaacacatactagaa

SEQ ID NO: 3853845 - DNA, 18 bp, Homo sapiens
atctgaagctattgatgt

SEQ ID NO: 3853846 - DNA, 15 bp, Homo sapiens
atctgaaggagattt

SEQ ID NO: 3853847 - DNA, 21 bp, Homo sapiens
atctgagatctccctccaggg

SEQ ID NO: 3853848 - DNA, 13 bp, Homo sapiens
atctgagtgtgga

SEQ ID NO: 3853849 - DNA, 18 bp, Homo sapiens
atctgataaaattgtgat

SEQ ID NO: 3853850 - DNA, 22 bp, Homo sapiens
atctgataaaattgtgatgttt

SEQ ID NO: 3853851 - DNA, 17 bp, Homo sapiens
atctgataggaaaagaa

SEQ ID NO: 3853852 - DNA, 19 bp, Homo sapiens
atctgatcgggataacaaa

SEQ ID NO: 3853853 - DNA, 11 bp, Homo sapiens
atctgatttaa

SEQ ID NO: 3853854 - DNA, 19 bp, Homo sapiens
atctgcactgggtgtggcc

SEQ ID NO: 3853855 - DNA, 19 bp, Homo sapiens
atctgcagctctttcttct

SEQ ID NO: 3853856 - DNA, 20 bp, Homo sapiens
atctgcagctctttcttctt

SEQ ID NO: 3853857 - DNA, 16 bp, Homo sapiens
atctgcattccccgct

SEQ ID NO: 3853858 - DNA, 14 bp, Homo sapiens
atctgcatttataa

SEQ ID NO: 3853859 - DNA, 19 bp, Homo sapiens
atctgcatttataaatgtg

SEQ ID NO: 3853860 - DNA, 20 bp, Homo sapiens
atctgcatttataaatgtgt

SEQ ID NO: 3853861 - DNA, 13 bp, Homo sapiens
atctgcctggcct

SEQ ID NO: 3853862 - DNA, 14 bp, Homo sapiens
atctgcctggcctg

SEQ ID NO: 3853863 - DNA, 23 bp, Homo sapiens
atctgcctggcctggctccccac

SEQ ID NO: 3853864 - DNA, 15 bp, Homo sapiens
atctgctcagcaggc

SEQ ID NO: 3853865 - DNA, 18 bp, Homo sapiens
atctgctcagcaggccct

SEQ ID NO: 3853866 - DNA, 14 bp, Homo sapiens
atctgctgttgcca

SEQ ID NO: 3853867 - DNA, 17 bp, Homo sapiens
atctgctgttgccatag

SEQ ID NO: 3853868 - DNA, 20 bp, Homo sapiens
atctgctgttgccatagccc

SEQ ID NO: 3853869 - DNA, 13 bp, Homo sapiens
atctggaaatctg

SEQ ID NO: 3853870 - DNA, 15 bp, Homo sapiens
atctggagagctaga

SEQ ID NO: 3853871 - DNA, 22 bp, Homo sapiens
atctggagagctagaacctgga

SEQ ID NO: 3853872 - DNA, 12 bp, Homo sapiens
atctggcagggt

SEQ ID NO: 3853873 - DNA, 13 bp, Homo sapiens
atctggctcctgt

SEQ ID NO: 3853874 - DNA, 16 bp, Homo sapiens
atctgggaagatttct

SEQ ID NO: 3853875 - DNA, 20 bp, Homo sapiens
atctgggaccctttccttcc

SEQ ID NO: 3853876 - DNA, 20 bp, Homo sapiens
atctgggaggcagaacaggc

SEQ ID NO: 3853877 - DNA, 20 bp, Homo sapiens
atctgggaggtctccactga

SEQ ID NO: 3853878 - DNA, 14 bp, Homo sapiens
atctgggtccttgc

SEQ ID NO: 3853879 - DNA, 16 bp, Homo sapiens
atctggttagataatg

SEQ ID NO: 3853880 - DNA, 15 bp, Homo sapiens
atctgtagggctgga

SEQ ID NO: 3853881 - DNA, 20 bp, Homo sapiens
atctgtatatacaataacat

SEQ ID NO: 3853882 - DNA, 17 bp, Homo sapiens
atctgtcatctctctgg

SEQ ID NO: 3853883 - DNA, 13 bp, Homo sapiens
atctgtccaagga

SEQ ID NO: 3853884 - DNA, 13 bp, Homo sapiens
atctgtgaattaa

SEQ ID NO: 3853885 - DNA, 15 bp, Homo sapiens
atctgtgtgaaaatg

SEQ ID NO: 3853886 - DNA, 17 bp, Homo sapiens
atctgtgtgaaaatggg

SEQ ID NO: 3853887 - DNA, 16 bp, Homo sapiens
atctgtgttgtctctc

SEQ ID NO: 3853888 - DNA, 15 bp, Homo sapiens
atctgttttgtatat

SEQ ID NO: 3853889 - DNA, 15 bp, Homo sapiens
atcttaaatgacagt

SEQ ID NO: 3853890 - DNA, 22 bp, Homo sapiens
atcttacaggtatcaggcacag

SEQ ID NO: 3853891 - DNA, 15 bp, Homo sapiens
atcttacatctgcag

SEQ ID NO: 3853892 - DNA, 12 bp, Homo sapiens
atcttcaaggtg

SEQ ID NO: 3853893 - DNA, 12 bp, Homo sapiens
atcttcacatag

SEQ ID NO: 3853894 - DNA, 16 bp, Homo sapiens
atgacttctgccccag

SEQ ID NO: 3853895 - DNA, 13 bp, Homo sapiens
atgactttttata

SEQ ID NO: 3853896 - DNA, 21 bp, Homo sapiens
atgagaacaagtcacagctgc

SEQ ID NO: 3853897 - DNA, 18 bp, Homo sapiens
atgagagaatcacacaag

SEQ ID NO: 3853898 - DNA, 18 bp, Homo sapiens
atgagattgttttatcat

SEQ ID NO: 3853899 - DNA, 16 bp, Homo sapiens
atgagatttgccagca

SEQ ID NO: 3853900 - DNA, 19 bp, Homo sapiens
atgagatttgccagcacag

SEQ ID NO: 3853901 - DNA, 23 bp, Homo sapiens
atgagcctgtaatcctcagctga

SEQ ID NO: 3853902 - DNA, 15 bp, Homo sapiens
atgagctctgaacaa

SEQ ID NO: 3853903 - DNA, 13 bp, Homo sapiens
atgagctgagggg

SEQ ID NO: 3853904 - DNA, 14 bp, Homo sapiens
atgaggagttgctg

SEQ ID NO: 3853905 - DNA, 13 bp, Homo sapiens
atgaggcagagga

SEQ ID NO: 3853906 - DNA, 22 bp, Homo sapiens
atgaggcctcttggacctctgc

SEQ ID NO: 3853907 - DNA, 23 bp, Homo sapiens
atgaggcctcttggacctctgct

SEQ ID NO: 3853908 - DNA, 22 bp, Homo sapiens
atgagggagggggcgctcagga

SEQ ID NO: 3853909 - DNA, 17 bp, Homo sapiens
atgagggcagcagccag

SEQ ID NO: 3853910 - DNA, 19 bp, Homo sapiens
atgagggcagcagccagcc

SEQ ID NO: 3853911 - DNA, 21 bp, Homo sapiens
atgaggggcttcctgggtcct

SEQ ID NO: 3853912 - DNA, 11 bp, Homo sapiens
atgagggtcag

SEQ ID NO: 3853913 - DNA, 16 bp, Homo sapiens
atgagggtcagggcag

SEQ ID NO: 3853914 - DNA, 14 bp, Homo sapiens
atgagggtgactgt

SEQ ID NO: 3853915 - DNA, 17 bp, Homo sapiens
atgagtatacaatatat

SEQ ID NO: 3853916 - DNA, 20 bp, Homo sapiens
atgagtcagacatttggtat

SEQ ID NO: 3853917 - DNA, 19 bp, Homo sapiens
atgagtggatggatggaca

SEQ ID NO: 3853918 - DNA, 21 bp, Homo sapiens
atgagtggatggatggacaga

SEQ ID NO: 3853919 - DNA, 23 bp, Homo sapiens
atgagttgttttcagactcagac

SEQ ID NO: 3853920 - DNA, 12 bp, Homo sapiens
atgataaatatt

SEQ ID NO: 3853921 - DNA, 23 bp, Homo sapiens
atgataatcaattattacattta

SEQ ID NO: 3853922 - DNA, 22 bp, Homo sapiens
atgatatgtaaacataattctt

SEQ ID NO: 3853923 - DNA, 20 bp, Homo sapiens
atgatattttgtctcctacc

SEQ ID NO: 3853924 - DNA, 17 bp, Homo sapiens
atgatccaagtatttta

SEQ ID NO: 3853925 - DNA, 18 bp, Homo sapiens
atgatctactcagaaatt

SEQ ID NO: 3853926 - DNA, 12 bp, Homo sapiens
atgatctccctg

SEQ ID NO: 3853927 - DNA, 23 bp, Homo sapiens
atgatctctccacggtagcactt

SEQ ID NO: 3853928 - DNA, 22 bp, Homo sapiens
atgatctgtatttaatggtttt

SEQ ID NO: 3853929 - DNA, 17 bp, Homo sapiens
atgatgaaaataataaa

SEQ ID NO: 3853930 - DNA, 21 bp, Homo sapiens
atgatgatctttaaaatacac

SEQ ID NO: 3853931 - DNA, 16 bp, Homo sapiens
atgatgatgatgatga

SEQ ID NO: 3853932 - DNA, 16 bp, Homo sapiens
atgatgattaaacacc

SEQ ID NO: 3853933 - DNA, 17 bp, Homo sapiens
atgatgattaaacacct

SEQ ID NO: 3853934 - DNA, 19 bp, Homo sapiens
atgatgattaaacacctga

SEQ ID NO: 3853935 - DNA, 21 bp, Homo sapiens
atgatgattccttgagcattt

SEQ ID NO: 3853936 - DNA, 14 bp, Homo sapiens
atgatgtccagaag

SEQ ID NO: 3853937 - DNA, 15 bp, Homo sapiens
atgatgtttcacata

SEQ ID NO: 3853938 - DNA, 15 bp, Homo sapiens
atgattaaacacctg

SEQ ID NO: 3853939 - DNA, 20 bp, Homo sapiens
atgattaaacacctgacaca

SEQ ID NO: 3853940 - DNA, 22 bp, Homo sapiens
atgattaaacacctgacacatc

SEQ ID NO: 3853941 - DNA, 15 bp, Homo sapiens
atgattcataacaat

SEQ ID NO: 3853942 - DNA, 13 bp, Homo sapiens
atgattggattat

SEQ ID NO: 3853943 - DNA, 18 bp, Homo sapiens
atgattgtaaaatagctt

SEQ ID NO: 3853944 - DNA, 16 bp, Homo sapiens
atgatttacagagaag

SEQ ID NO: 3853945 - DNA, 20 bp, Homo sapiens
atgatttatagtttgtacat

SEQ ID NO: 3853946 - DNA, 18 bp, Homo sapiens
atgatttatatatggcat

SEQ ID NO: 3853947 - DNA, 20 bp, Homo sapiens
atgatttcatgctatctctg

SEQ ID NO: 3853948 - DNA, 21 bp, Homo sapiens
atgatttcatgctatctctgt

SEQ ID NO: 3853949 - DNA, 19 bp, Homo sapiens
atgattttatacatagtca

SEQ ID NO: 3853950 - DNA, 16 bp, Homo sapiens
atgattttatttgaca

SEQ ID NO: 3853951 - DNA, 18 bp, Homo sapiens
atgattttatttgacaaa

SEQ ID NO: 3853952 - DNA, 11 bp, Homo sapiens
atgatttttag

SEQ ID NO: 3853953 - DNA, 22 bp, Homo sapiens
atgattttttaaaagaaattta

SEQ ID NO: 3853954 - DNA, 18 bp, Homo sapiens
atgcaaaaaatcttccaa

SEQ ID NO: 3853955 - DNA, 11 bp, Homo sapiens
atgcaaaaatc

SEQ ID NO: 3853956 - DNA, 18 bp, Homo sapiens
atgcaaaataaatgtttt

SEQ ID NO: 3853957 - DNA, 13 bp, Homo sapiens
atgcaaaatgaaa

SEQ ID NO: 3853958 - DNA, 14 bp, Homo sapiens
atgcaaacagttct

SEQ ID NO: 3853959 - DNA, 13 bp, Homo sapiens
atgcaaagcactg

SEQ ID NO: 3853960 - DNA, 15 bp, Homo sapiens
atgcaaagcactgac

SEQ ID NO: 3853961 - DNA, 19 bp, Homo sapiens
atgcaacaaatatttatat

SEQ ID NO: 3853962 - DNA, 17 bp, Homo sapiens
atgcaagtgagaagctg

SEQ ID NO: 3853963 - DNA, 15 bp, Homo sapiens
atgcaataatgtgca

SEQ ID NO: 3853964 - DNA, 18 bp, Homo sapiens
atgcaatgaaacagatga

SEQ ID NO: 3853965 - DNA, 21 bp, Homo sapiens
atgcaatgaaacagatgataa

SEQ ID NO: 3853966 - DNA, 19 bp, Homo sapiens
atgcaatttattaaaatga

SEQ ID NO: 3853967 - DNA, 15 bp, Homo sapiens
atgcaatttttaaac

SEQ ID NO: 3853968 - DNA, 17 bp, Homo sapiens
atgcacaatttagaaaa

SEQ ID NO: 3853969 - DNA, 19 bp, Homo sapiens
atgcacacaaacacctcct

SEQ ID NO: 3853970 - DNA, 14 bp, Homo sapiens
atgcacacacacag

SEQ ID NO: 3853971 - DNA, 23 bp, Homo sapiens
atgcacaccaaaaaaatacttga

SEQ ID NO: 3853972 - DNA, 21 bp, Homo sapiens
atgcacacgcacatagagata

SEQ ID NO: 3853973 - DNA, 20 bp, Homo sapiens
atgcacactagcctctccag

SEQ ID NO: 3853974 - DNA, 15 bp, Homo sapiens
atgcacagctgcttg

SEQ ID NO: 3853975 - DNA, 21 bp, Homo sapiens
atgcacatccattcccaagaa

SEQ ID NO: 3853976 - DNA, 16 bp, Homo sapiens
atgcacatttatatat

SEQ ID NO: 3853977 - DNA, 16 bp, Homo sapiens
atgcacgaccttggga

SEQ ID NO: 3853978 - DNA, 18 bp, Homo sapiens
atgcacggcggcagggtg

SEQ ID NO: 3853979 - DNA, 18 bp, Homo sapiens
caacagagaaggcaggaa

SEQ ID NO: 3853980 - DNA, 22 bp, Homo sapiens
caacagctcaagtcttccctga

SEQ ID NO: 3853981 - DNA, 12 bp, Homo sapiens
caacagctcaga

SEQ ID NO: 3853982 - DNA, 21 bp, Homo sapiens
caacagcttgaccagacctag

SEQ ID NO: 3853983 - DNA, 21 bp, Homo sapiens
caacaggtggcaggaccagga

SEQ ID NO: 3853984 - DNA, 13 bp, Homo sapiens
caacaggttttat

SEQ ID NO: 3853985 - DNA, 17 bp, Homo sapiens
caacatcccattgccct

SEQ ID NO: 3853986 - DNA, 18 bp, Homo sapiens
caacatcccattgccctg

SEQ ID NO: 3853987 - DNA, 17 bp, Homo sapiens
caacatcttctctcttt

SEQ ID NO: 3853988 - DNA, 22 bp, Homo sapiens
caacatttatttcaaactattg

SEQ ID NO: 3853989 - DNA, 16 bp, Homo sapiens
caaccaaccaaccaac

SEQ ID NO: 3853990 - DNA, 13 bp, Homo sapiens
caaaacttaacat

SEQ ID NO: 3853991 - DNA, 16 bp, Homo sapiens
caaaacttcctgtttg

SEQ ID NO: 3853992 - DNA, 12 bp, Homo sapiens
caaaagaagtaa

SEQ ID NO: 3853993 - DNA, 15 bp, Homo sapiens
caaaagaatcagaaa

SEQ ID NO: 3853994 - DNA, 20 bp, Homo sapiens
caaaagacagcactacagat

SEQ ID NO: 3853995 - DNA, 14 bp, Homo sapiens
attgcatttctgct

SEQ ID NO: 3853996 - DNA, 15 bp, Homo sapiens
attgcatttctgctc

SEQ ID NO: 3853997 - DNA, 22 bp, Homo sapiens
attgccacaatgcctctcccac

SEQ ID NO: 3853998 - DNA, 14 bp, Homo sapiens
attgccccagagcc

SEQ ID NO: 3853999 - DNA, 19 bp, Homo sapiens
attgccccagagccccact

SEQ ID NO: 3854000 - DNA, 15 bp, Homo sapiens
atttaattcataatt

SEQ ID NO: 3854001 - DNA, 18 bp, Homo sapiens
atttaattcataattaga

SEQ ID NO: 3854002 - DNA, 19 bp, Homo sapiens
atttaatttttacatgacc

SEQ ID NO: 3854003 - DNA, 17 bp, Homo sapiens
atttacaataaatattc

SEQ ID NO: 3854004 - DNA, 19 bp, Homo sapiens
atttaccagggatgtagat

SEQ ID NO: 3854005 - DNA, 22 bp, Homo sapiens
atttactcattcatttattcat

SEQ ID NO: 3854006 - DNA, 19 bp, Homo sapiens
atttacttaatgggtacaa

SEQ ID NO: 3854007 - DNA, 14 bp, Homo sapiens
atttacttgtagaa

SEQ ID NO: 3854008 - DNA, 19 bp, Homo sapiens
atttacttgtagaaatctg

SEQ ID NO: 3854009 - DNA, 13 bp, Homo sapiens
atttagaaaacat

SEQ ID NO: 3854010 - DNA, 13 bp, Homo sapiens
atttagatatgca

SEQ ID NO: 3854011 - DNA, 21 bp, Homo sapiens
atttagtcacaccatcttaaa

SEQ ID NO: 3854012 - DNA, 20 bp, Homo sapiens
atttagtgatattgtgggta

SEQ ID NO: 3854013 - DNA, 18 bp, Homo sapiens
atttagttgaaaaatcta

SEQ ID NO: 3854014 - DNA, 19 bp, Homo sapiens
atttagttttatggcatga

SEQ ID NO: 3854015 - DNA, 22 bp, Homo sapiens
atttagttttatggcatgattt

SEQ ID NO: 3854016 - DNA, 15 bp, Homo sapiens
atttataaaattaga

SEQ ID NO: 3854017 - DNA, 19 bp, Homo sapiens
atttataaaattagaaagc

SEQ ID NO: 3854018 - DNA, 17 bp, Homo sapiens
atttataagcagattta

SEQ ID NO: 3854019 - DNA, 21 bp, Homo sapiens
atttatacaaaataatttaac

SEQ ID NO: 3854020 - DNA, 10 bp, Homo sapiens
atttatactc

SEQ ID NO: 3854021 - DNA, 16 bp, Homo sapiens
atttatagtttgtaca

SEQ ID NO: 3854022 - DNA, 22 bp, Homo sapiens
atttatagtttgtacatgcatt

SEQ ID NO: 3854023 - DNA, 17 bp, Homo sapiens
atttatatatcagttat

SEQ ID NO: 3854024 - DNA, 15 bp, Homo sapiens
atttatatatggcat

SEQ ID NO: 3854025 - DNA, 17 bp, Homo sapiens
atttatatatggcatat

SEQ ID NO: 3854026 - DNA, 18 bp, Homo sapiens
atttatatatggcatatt

SEQ ID NO: 3854027 - DNA, 20 bp, Homo sapiens
atttatatatggcatattta

SEQ ID NO: 3854028 - DNA, 12 bp, Homo sapiens
atttatatgtta

SEQ ID NO: 3854029 - DNA, 19 bp, Homo sapiens
atttatattgtatattctg

SEQ ID NO: 3854030 - DNA, 17 bp, Homo sapiens
atttatatttgaaattt

SEQ ID NO: 3854031 - DNA, 12 bp, Homo sapiens
atttatatttgg

SEQ ID NO: 3854032 - DNA, 16 bp, Homo sapiens
atttatatttggaaag

SEQ ID NO: 3854033 - DNA, 18 bp, Homo sapiens
atttatatttggaaagag

SEQ ID NO: 3854034 - DNA, 18 bp, Homo sapiens
atttatcctgaaatttca

SEQ ID NO: 3854035 - DNA, 21 bp, Homo sapiens
atttatcctgaaatttcagat

SEQ ID NO: 3854036 - DNA, 18 bp, Homo sapiens
atttatgatcacttggaa

SEQ ID NO: 3854037 - DNA, 20 bp, Homo sapiens
atttatgcttaaaatatgta

SEQ ID NO: 3854038 - DNA, 17 bp, Homo sapiens
atttatggcttataaat

SEQ ID NO: 3854039 - DNA, 14 bp, Homo sapiens
atttatggtttctg

SEQ ID NO: 3854040 - DNA, 21 bp, Homo sapiens
atttattaaaatgattgtaaa

SEQ ID NO: 3854041 - DNA, 15 bp, Homo sapiens
atttattaagtctgg

SEQ ID NO: 3854042 - DNA, 16 bp, Homo sapiens
atttattaagtctggg

SEQ ID NO: 3854043 - DNA, 16 bp, Homo sapiens
atttattagctgtaaa

SEQ ID NO: 3854044 - DNA, 15 bp, Homo sapiens
atttattcactgtaa

SEQ ID NO: 3854045 - DNA, 16 bp, Homo sapiens
atttattcactgtaag

SEQ ID NO: 3854046 - DNA, 18 bp, Homo sapiens
atttattcactgtaagtt

SEQ ID NO: 3854047 - DNA, 13 bp, Homo sapiens
atttattcattca

SEQ ID NO: 3854048 - DNA, 18 bp, Homo sapiens
atttattgaagaaacaga

SEQ ID NO: 3854049 - DNA, 13 bp, Homo sapiens
atttattggggtg

SEQ ID NO: 3854050 - DNA, 17 bp, Homo sapiens
atttattgtcattactg

SEQ ID NO: 3854051 - DNA, 18 bp, Homo sapiens
atttcaaaagacatgttg

SEQ ID NO: 3854052 - DNA, 15 bp, Homo sapiens
atttcaaatgaacac

SEQ ID NO: 3854053 - DNA, 11 bp, Homo sapiens
atttcaaatgg

SEQ ID NO: 3854054 - DNA, 15 bp, Homo sapiens
atttcaacaagaata

SEQ ID NO: 3854055 - DNA, 19 bp, Homo sapiens
atttcaacatatcattttt

SEQ ID NO: 3854056 - DNA, 17 bp, Homo sapiens
atttcaactccagaagt

SEQ ID NO: 3854057 - DNA, 21 bp, Homo sapiens
atttcaagaaaaaataaatgg

SEQ ID NO: 3854058 - DNA, 15 bp, Homo sapiens
atttcaagaccttct

SEQ ID NO: 3854059 - DNA, 14 bp, Homo sapiens
atttcaattctcaa

SEQ ID NO: 3854060 - DNA, 15 bp, Homo sapiens
atttcaattctcaaa

SEQ ID NO: 3854061 - DNA, 18 bp, Homo sapiens
atttcacattaatggtct

SEQ ID NO: 3854062 - DNA, 22 bp, Homo sapiens
atttcacattaatggtctaaaa

SEQ ID NO: 3854063 - DNA, 20 bp, Homo sapiens
atttcacgtcgtcttctgta

SEQ ID NO: 3854064 - DNA, 19 bp, Homo sapiens
atttcaggatactctgtca

SEQ ID NO: 3854065 - DNA, 22 bp, Homo sapiens
atttcaggatactctgtcagat

SEQ ID NO: 3854066 - DNA, 16 bp, Homo sapiens
atttcaggcattttgt

SEQ ID NO: 3854067 - DNA, 19 bp, Homo sapiens
atttcaggggtcgtcacca

SEQ ID NO: 3854068 - DNA, 22 bp, Homo sapiens
atttcaggggtcgtcaccacct

SEQ ID NO: 3854069 - DNA, 16 bp, Homo sapiens
atttcagttacttacc

SEQ ID NO: 3854070 - DNA, 20 bp, Homo sapiens
atttcataaggcctgccctc

SEQ ID NO: 3854071 - DNA, 15 bp, Homo sapiens
atttcatctactaca

SEQ ID NO: 3854072 - DNA, 21 bp, Homo sapiens
atttcattttgtaacaaatga

SEQ ID NO: 3854073 - DNA, 15 bp, Homo sapiens
atttccaaataaaat

SEQ ID NO: 3854074 - DNA, 18 bp, Homo sapiens
atttccaaataaaatgag

SEQ ID NO: 3854075 - DNA, 17 bp, Homo sapiens
atttccaaatgaatgac

SEQ ID NO: 3854076 - DNA, 13 bp, Homo sapiens
atttccaggcccc

SEQ ID NO: 3854077 - DNA, 22 bp, Homo sapiens
atttccaggcccctgaggactg

SEQ ID NO: 3854078 - DNA, 15 bp, Homo sapiens
atttccccaccccac

SEQ ID NO: 3854079 - DNA, 13 bp, Homo sapiens
atttcctatttta

SEQ ID NO: 3854080 - DNA, 16 bp, Homo sapiens
atttcctattttaaaa

SEQ ID NO: 3854081 - DNA, 19 bp, Homo sapiens
atttcctattttaaaacca

SEQ ID NO: 3854082 - DNA, 23 bp, Homo sapiens
atttcctccatggtggaaggggg

SEQ ID NO: 3854083 - DNA, 17 bp, Homo sapiens
atttcctcccccagtta

SEQ ID NO: 3854084 - DNA, 22 bp, Homo sapiens
atttcctgtataatttaacagt

SEQ ID NO: 3854085 - DNA, 17 bp, Homo sapiens
atttctaaaatataaga

SEQ ID NO: 3854086 - DNA, 21 bp, Homo sapiens
atttctacatagtaactctta

SEQ ID NO: 3854087 - DNA, 22 bp, Homo sapiens
attttatacatagtcacaaaaa

SEQ ID NO: 3854088 - DNA, 23 bp, Homo sapiens
attttatacatagtcacaaaaat

SEQ ID NO: 3854089 - DNA, 14 bp, Homo sapiens
attttatctgtgtt

SEQ ID NO: 3854090 - DNA, 15 bp, Homo sapiens
attttattaaagcaa

SEQ ID NO: 3854091 - DNA, 15 bp, Homo sapiens
caaggactgcaggga

SEQ ID NO: 3854092 - DNA, 19 bp, Homo sapiens
caaggagaaacagagacag

SEQ ID NO: 3854093 - DNA, 19 bp, Homo sapiens
caaggagctgatttccagg

SEQ ID NO: 3854094 - DNA, 22 bp, Homo sapiens
caaggagctgatttccaggccc

SEQ ID NO: 3854095 - DNA, 19 bp, Homo sapiens
caaggagttccatgaagac

SEQ ID NO: 3854096 - DNA, 21 bp, Homo sapiens
caaggagttccatgaagacca

SEQ ID NO: 3854097 - DNA, 16 bp, Homo sapiens
caaggcacttgtcact

SEQ ID NO: 3854098 - DNA, 14 bp, Homo sapiens
caaggcccgagcag

SEQ ID NO: 3854099 - DNA, 17 bp, Homo sapiens
caaggcccgagcagctg

SEQ ID NO: 3854100 - DNA, 21 bp, Homo sapiens
caaggcccgagcagctgagca

SEQ ID NO: 3854101 - DNA, 20 bp, Homo sapiens
caaggccgctgttcacccac

SEQ ID NO: 3854102 - DNA, 22 bp, Homo sapiens
caaggccgctgttcacccacag

SEQ ID NO: 3854103 - DNA, 20 bp, Homo sapiens
caaggctgaccaagagagaa

SEQ ID NO: 3854104 - DNA, 22 bp, Homo sapiens
caaggctgggcacctctagtgc

SEQ ID NO: 3854105 - DNA, 17 bp, Homo sapiens
caagggaagaaacactc

SEQ ID NO: 3854106 - DNA, 13 bp, Homo sapiens
caagggaaggaag

SEQ ID NO: 3854107 - DNA, 18 bp, Homo sapiens
caagggagaagaaatcca

SEQ ID NO: 3854108 - DNA, 19 bp, Homo sapiens
caagggagaagaaatccat

SEQ ID NO: 3854109 - DNA, 20 bp, Homo sapiens
caagggagaagaaatccata

SEQ ID NO: 3854110 - DNA, 22 bp, Homo sapiens
caagggcaaaccatttcaaatg

SEQ ID NO: 3854111 - DNA, 23 bp, Homo sapiens
caagggctccagcatccagcctg

SEQ ID NO: 3854112 - DNA, 15 bp, Homo sapiens
caaggggaacgcaga

SEQ ID NO: 3854113 - DNA, 13 bp, Homo sapiens
caagggtccagaa

SEQ ID NO: 3854114 - DNA, 21 bp, Homo sapiens
caaggtctccttactctgagc

SEQ ID NO: 3854115 - DNA, 23 bp, Homo sapiens
caaggtctccttactctgagccc

SEQ ID NO: 3854116 - DNA, 15 bp, Homo sapiens
caaggttccctctga

SEQ ID NO: 3854117 - DNA, 17 bp, Homo sapiens
caaggttccctctgaga

SEQ ID NO: 3854118 - DNA, 15 bp, Homo sapiens
caaggttcttctaaa

SEQ ID NO: 3854119 - DNA, 17 bp, Homo sapiens
caaggttttggagtcag

SEQ ID NO: 3854120 - DNA, 23 bp, Homo sapiens
caagtaatataatggaagagaaa

SEQ ID NO: 3854121 - DNA, 13 bp, Homo sapiens
caagtactgctgt

SEQ ID NO: 3854122 - DNA, 16 bp, Homo sapiens
caagtactgctgtaaa

SEQ ID NO: 3854123 - DNA, 16 bp, Homo sapiens
caagtatgaataaaga

SEQ ID NO: 3854124 - DNA, 20 bp, Homo sapiens
caagtattaggggtaatata

SEQ ID NO: 3854125 - DNA, 20 bp, Homo sapiens
caagtattttatctgtgttg

SEQ ID NO: 3854126 - DNA, 20 bp, Homo sapiens
caagtcaacactcttcttga

SEQ ID NO: 3854127 - DNA, 12 bp, Homo sapiens
caagtcacagct

SEQ ID NO: 3854128 - DNA, 13 bp, Homo sapiens
caagtcacagctg

SEQ ID NO: 3854129 - DNA, 15 bp, Homo sapiens
caagtcacagctgca

SEQ ID NO: 3854130 - DNA, 17 bp, Homo sapiens
caagtcacagctgcagc

SEQ ID NO: 3854131 - DNA, 23 bp, Homo sapiens
caagtcacagctgcagctgggcc

SEQ ID NO: 3854132 - DNA, 22 bp, Homo sapiens
caagtcatgatggagacttcag

SEQ ID NO: 3854133 - DNA, 19 bp, Homo sapiens
caagtccaacctgcctgtg

SEQ ID NO: 3854134 - DNA, 14 bp, Homo sapiens
caagtccaagcata

SEQ ID NO: 3854135 - DNA, 19 bp, Homo sapiens
caagtctggatctgggacc

SEQ ID NO: 3854136 - DNA, 14 bp, Homo sapiens
caagtcttccctga

SEQ ID NO: 3854137 - DNA, 15 bp, Homo sapiens
caagtcttccctgat

SEQ ID NO: 3854138 - DNA, 14 bp, Homo sapiens
caagtgaagaaaag

SEQ ID NO: 3854139 - DNA, 15 bp, Homo sapiens
caagtgacatctctt

SEQ ID NO: 3854140 - DNA, 16 bp, Homo sapiens
caagtgacatctcttt

SEQ ID NO: 3854141 - DNA, 14 bp, Homo sapiens
caagtgagagagca

SEQ ID NO: 3854142 - DNA, 14 bp, Homo sapiens
caagtgatatatgt

SEQ ID NO: 3854143 - DNA, 19 bp, Homo sapiens
caagtgatatatgtattta

SEQ ID NO: 3854144 - DNA, 17 bp, Homo sapiens
caagtgatatcacctct

SEQ ID NO: 3854145 - DNA, 18 bp, Homo sapiens
caagtgcctcttgttgca

SEQ ID NO: 3854146 - DNA, 20 bp, Homo sapiens
caagtgggggcagagggcag

SEQ ID NO: 3854147 - DNA, 16 bp, Homo sapiens
caagtgtatatcagaa

SEQ ID NO: 3854148 - DNA, 20 bp, Homo sapiens
caagttatattgaatatatc

SEQ ID NO: 3854149 - DNA, 20 bp, Homo sapiens
caagttattgtacagctgtt

SEQ ID NO: 3854150 - DNA, 17 bp, Homo sapiens
caagttcaatctgtttt

SEQ ID NO: 3854151 - DNA, 22 bp, Homo sapiens
caagttcagggaagcaggcaga

SEQ ID NO: 3854152 - DNA, 13 bp, Homo sapiens
caagttccagctg

SEQ ID NO: 3854153 - DNA, 21 bp, Homo sapiens
caagtttcccgccaggaggtc

SEQ ID NO: 3854154 - DNA, 13 bp, Homo sapiens
caataaaaaaaag

SEQ ID NO: 3854155 - DNA, 20 bp, Homo sapiens
caataaaaaaaagaaatgaa

SEQ ID NO: 3854156 - DNA, 19 bp, Homo sapiens
caataaaagtgactctcag

SEQ ID NO: 3854157 - DNA, 17 bp, Homo sapiens
caataaacatagcttgt

SEQ ID NO: 3854158 - DNA, 17 bp, Homo sapiens
caataaacctcttttct

SEQ ID NO: 3854159 - DNA, 11 bp, Homo sapiens
caataaagctg

SEQ ID NO: 3854160 - DNA, 17 bp, Homo sapiens
caataaagctgctgaga

SEQ ID NO: 3854161 - DNA, 14 bp, Homo sapiens
caataaagctggac

SEQ ID NO: 3854162 - DNA, 13 bp, Homo sapiens
caataaatattct

SEQ ID NO: 3854163 - DNA, 11 bp, Homo sapiens
caataaatgct

SEQ ID NO: 3854164 - DNA, 14 bp, Homo sapiens
caataaatgctgaa

SEQ ID NO: 3854165 - DNA, 16 bp, Homo sapiens
caataaatgctgaatg

SEQ ID NO: 3854166 - DNA, 10 bp, Homo sapiens
caataacaac

SEQ ID NO: 3854167 - DNA, 13 bp, Homo sapiens
caataacaacaat

SEQ ID NO: 3854168 - DNA, 14 bp, Homo sapiens
caataacaacaatg

SEQ ID NO: 3854169 - DNA, 15 bp, Homo sapiens
caataacaacaatgg

SEQ ID NO: 3854170 - DNA, 17 bp, Homo sapiens
caataaggtcaatgcca

SEQ ID NO: 3854171 - DNA, 17 bp, Homo sapiens
caataagttccatgtta

SEQ ID NO: 3854172 - DNA, 20 bp, Homo sapiens
caataatgtgcaaattttgc

SEQ ID NO: 3854173 - DNA, 17 bp, Homo sapiens
caataattaatgtgtgt

SEQ ID NO: 3854174 - DNA, 17 bp, Homo sapiens
caataattaggatctat

SEQ ID NO: 3854175 - DNA, 22 bp, Homo sapiens
caataattaggatctatgcaat

SEQ ID NO: 3854176 - DNA, 23 bp, Homo sapiens
caataattaggatctatgcaatt

SEQ ID NO: 3854177 - DNA, 16 bp, Homo sapiens
caatacaacaagaaca

SEQ ID NO: 3854178 - DNA, 20 bp, Homo sapiens
caatagctattgcatgtaaa

SEQ ID NO: 3854179 - DNA, 22 bp, Homo sapiens
caatagtccccatcagcaccat

SEQ ID NO: 3854180 - DNA, 17 bp, Homo sapiens
caatatataaaaatata

SEQ ID NO: 3854181 - DNA, 12 bp, Homo sapiens
caatatctttaa

SEQ ID NO: 3854182 - DNA, 11 bp, Homo sapiens
caatatgctta

SEQ ID NO: 3854183 - DNA, 12 bp, Homo sapiens
caatatgcttac

SEQ ID NO: 3854184 - DNA, 15 bp, Homo sapiens
caatatgtaaatagt

SEQ ID NO: 3854185 - DNA, 16 bp, Homo sapiens
caatattcaataaagc

SEQ ID NO: 3854186 - DNA, 17 bp, Homo sapiens
caatatttactcatcag

SEQ ID NO: 3854187 - DNA, 12 bp, Homo sapiens
caatcagcactg

SEQ ID NO: 3854188 - DNA, 13 bp, Homo sapiens
caatcagcactga

SEQ ID NO: 3854189 - DNA, 14 bp, Homo sapiens
caatcagcactgaa

SEQ ID NO: 3854190 - DNA, 15 bp, Homo sapiens
caatcagcactgaaa

SEQ ID NO: 3854191 - DNA, 15 bp, Homo sapiens
caatcatctgtgtga

SEQ ID NO: 3854192 - DNA, 17 bp, Homo sapiens
caatcatctgtgtgaaa

SEQ ID NO: 3854193 - DNA, 14 bp, Homo sapiens
caatcattttaaga

SEQ ID NO: 3854194 - DNA, 14 bp, Homo sapiens
caatccactctcag

SEQ ID NO: 3854195 - DNA, 15 bp, Homo sapiens
caatccactctcagg

SEQ ID NO: 3854196 - DNA, 19 bp, Homo sapiens
caatccaggtgggagagac

SEQ ID NO: 3854197 - DNA, 21 bp, Homo sapiens
caatccatgttagtttttact

SEQ ID NO: 3854198 - DNA, 18 bp, Homo sapiens
caatcccaaaagtcacca

SEQ ID NO: 3854199 - DNA, 18 bp, Homo sapiens
caatcctgaagaaaccac

SEQ ID NO: 3854200 - DNA, 14 bp, Homo sapiens
caatccttgttcag

SEQ ID NO: 3854201 - DNA, 18 bp, Homo sapiens
caatctccagggctgccc

SEQ ID NO: 3854202 - DNA, 18 bp, Homo sapiens
caatctgggactttcact

SEQ ID NO: 3854203 - DNA, 15 bp, Homo sapiens
caatgaaacagatga

SEQ ID NO: 3854204 - DNA, 22 bp, Homo sapiens
caatgaaacagatgataaatat

SEQ ID NO: 3854205 - DNA, 23 bp, Homo sapiens
caatgaaatacacaagtaaacat

SEQ ID NO: 3854206 - DNA, 15 bp, Homo sapiens
caatgacagggatgc

SEQ ID NO: 3854207 - DNA, 13 bp, Homo sapiens
caatgagctgtat

SEQ ID NO: 3854208 - DNA, 16 bp, Homo sapiens
caatgagctgtatctg

SEQ ID NO: 3854209 - DNA, 14 bp, Homo sapiens
caatgatgtccaga

SEQ ID NO: 3854210 - DNA, 13 bp, Homo sapiens
caatgcaaagtaa

SEQ ID NO: 3854211 - DNA, 14 bp, Homo sapiens
caatgccaagataa

SEQ ID NO: 3854212 - DNA, 15 bp, Homo sapiens
caatgccctgccatt

SEQ ID NO: 3854213 - DNA, 16 bp, Homo sapiens
caatgccctgccatta

SEQ ID NO: 3854214 - DNA, 16 bp, Homo sapiens
caatgcctctcccacg

SEQ ID NO: 3854215 - DNA, 13 bp, Homo sapiens
caatgctttggga

SEQ ID NO: 3854216 - DNA, 22 bp, Homo sapiens
caatgctttgggaggccaaggc

SEQ ID NO: 3854217 - DNA, 23 bp, Homo sapiens
caatgctttgggaggccaaggca

SEQ ID NO: 3854218 - DNA, 17 bp, Homo sapiens
caatggaaacagggcag

SEQ ID NO: 3854219 - DNA, 17 bp, Homo sapiens
caatggacttcaaattg

SEQ ID NO: 3854220 - DNA, 20 bp, Homo sapiens
caatggagactgtctcaaga

SEQ ID NO: 3854221 - DNA, 17 bp, Homo sapiens
caatggagttcagagat

SEQ ID NO: 3854222 - DNA, 14 bp, Homo sapiens
caatggcagctaga

SEQ ID NO: 3854223 - DNA, 17 bp, Homo sapiens
caatggcagctagactg

SEQ ID NO: 3854224 - DNA, 16 bp, Homo sapiens
caatggctaattccca

SEQ ID NO: 3854225 - DNA, 19 bp, Homo sapiens
caatggctaattcccagag

SEQ ID NO: 3854226 - DNA, 22 bp, Homo sapiens
caatggctatatggcaagaaag

SEQ ID NO: 3854227 - DNA, 15 bp, Homo sapiens
caatggctgtaaact

SEQ ID NO: 3854228 - DNA, 23 bp, Homo sapiens
caatgggagggggctccatggag

SEQ ID NO: 3854229 - DNA, 18 bp, Homo sapiens
caatgggcactgggatga

SEQ ID NO: 3854230 - DNA, 19 bp, Homo sapiens
caatgggcactgggatgag

SEQ ID NO: 3854231 - DNA, 17 bp, Homo sapiens
caatgggtaaccattaa

SEQ ID NO: 3854232 - DNA, 17 bp, Homo sapiens
caatggtgttgccctga

SEQ ID NO: 3854233 - DNA, 22 bp, Homo sapiens
caatgtatgtgaaagtgtaaaa

SEQ ID NO: 3854234 - DNA, 19 bp, Homo sapiens
caatgtgaatcagacccta

SEQ ID NO: 3854235 - DNA, 17 bp, Homo sapiens
caatgtgaccaggggtg

SEQ ID NO: 3854236 - DNA, 13 bp, Homo sapiens
caatgtgctctcg

SEQ ID NO: 3854237 - DNA, 17 bp, Homo sapiens
caatgttgttttaagac

SEQ ID NO: 3854238 - DNA, 18 bp, Homo sapiens
caatgtttttaaaaatct

SEQ ID NO: 3854239 - DNA, 12 bp, Homo sapiens
caattaaaatat

SEQ ID NO: 3854240 - DNA, 16 bp, Homo sapiens
caattaaaatatatat

SEQ ID NO: 3854241 - DNA, 22 bp, Homo sapiens
caattaaaatatatataaatat

SEQ ID NO: 3854242 - DNA, 20 bp, Homo sapiens
caattaaaattaaggtctgg

SEQ ID NO: 3854243 - DNA, 12 bp, Homo sapiens
caattatattgt

SEQ ID NO: 3854244 - DNA, 22 bp, Homo sapiens
caattatgcactggccacccaa

SEQ ID NO: 3854245 - DNA, 15 bp, Homo sapiens
caattattacattta

SEQ ID NO: 3854246 - DNA, 20 bp, Homo sapiens
caattattacatttatacat

SEQ ID NO: 3854247 - DNA, 19 bp, Homo sapiens
caattattgtacactaaca

SEQ ID NO: 3854248 - DNA, 17 bp, Homo sapiens
caattcaggactggctc

SEQ ID NO: 3854249 - DNA, 17 bp, Homo sapiens
caattcatttcacttta

SEQ ID NO: 3854250 - DNA, 18 bp, Homo sapiens
caattggctcctccatct

SEQ ID NO: 3854251 - DNA, 14 bp, Homo sapiens
caattgtaaaaaaa

SEQ ID NO: 3854252 - DNA, 14 bp, Homo sapiens
caattgtattttat

SEQ ID NO: 3854253 - DNA, 22 bp, Homo sapiens
caatttagaaaacattcatcca

SEQ ID NO: 3854254 - DNA, 22 bp, Homo sapiens
caatttattaaaatgattgtaa

SEQ ID NO: 3854255 - DNA, 14 bp, Homo sapiens
caatttcccagaag

SEQ ID NO: 3854256 - DNA, 15 bp, Homo sapiens
caatttcccagaagg

SEQ ID NO: 3854257 - DNA, 16 bp, Homo sapiens
caatttcctttatatt

SEQ ID NO: 3854258 - DNA, 19 bp, Homo sapiens
caatttgtatatcatgaaa

SEQ ID NO: 3854259 - DNA, 13 bp, Homo sapiens
caatttttaaact

SEQ ID NO: 3854260 - DNA, 14 bp, Homo sapiens
caatttttaaacta

SEQ ID NO: 3854261 - DNA, 17 bp, Homo sapiens
caatttttaaactagta

SEQ ID NO: 3854262 - DNA, 19 bp, Homo sapiens
caatttttaaactagtaat

SEQ ID NO: 3854263 - DNA, 17 bp, Homo sapiens
cacagtcctcacagcct

SEQ ID NO: 3854264 - DNA, 18 bp, Homo sapiens
cacagtctcagtccagat

SEQ ID NO: 3854265 - DNA, 21 bp, Homo sapiens
cacagtctcagtccagatgcc

SEQ ID NO: 3854266 - DNA, 13 bp, Homo sapiens
cacagtctcccat

SEQ ID NO: 3854267 - DNA, 11 bp, Homo sapiens
cacagtgaccc

SEQ ID NO: 3854268 - DNA, 17 bp, Homo sapiens
cacagtgacccttccca

SEQ ID NO: 3854269 - DNA, 17 bp, Homo sapiens
cacagtgcatctcagcc

SEQ ID NO: 3854270 - DNA, 18 bp, Homo sapiens
cacagtgcatctcagccc

SEQ ID NO: 3854271 - DNA, 17 bp, Homo sapiens
cacagtgctgcttctct

SEQ ID NO: 3854272 - DNA, 18 bp, Homo sapiens
cacagtggcgagaggaga

SEQ ID NO: 3854273 - DNA, 13 bp, Homo sapiens
cacagtgggaact

SEQ ID NO: 3854274 - DNA, 19 bp, Homo sapiens
cacagtgggaactctgaca

SEQ ID NO: 3854275 - DNA, 13 bp, Homo sapiens
cacagtgggtggc

SEQ ID NO: 3854276 - DNA, 10 bp, Homo sapiens
cacagtgttt

SEQ ID NO: 3854277 - DNA, 17 bp, Homo sapiens
cacagttggctggatga

SEQ ID NO: 3854278 - DNA, 22 bp, Homo sapiens
cacagttggctggatgaaattt

SEQ ID NO: 3854279 - DNA, 20 bp, Homo sapiens
cacagttgtctattctgagc

SEQ ID NO: 3854280 - DNA, 24 bp, Homo sapiens
cacagttgtctattctgagccttg

SEQ ID NO: 3854281 - DNA, 15 bp, Homo sapiens
cacagttttctgaga

SEQ ID NO: 3854282 - DNA, 16 bp, Homo sapiens
cacagttttctgagaa

SEQ ID NO: 3854283 - DNA, 17 bp, Homo sapiens
cacagttttctgagaaa

SEQ ID NO: 3854284 - DNA, 19 bp, Homo sapiens
cacagttttctgagaaaga

SEQ ID NO: 3854285 - DNA, 22 bp, Homo sapiens
cacagttttgaaagaaaaatac

SEQ ID NO: 3854286 - DNA, 13 bp, Homo sapiens
cacataatttgaa

SEQ ID NO: 3854287 - DNA, 13 bp, Homo sapiens
cacatacaacaca

SEQ ID NO: 3854288 - DNA, 22 bp, Homo sapiens
cacatacaacacaaagagaaaa

SEQ ID NO: 3854289 - DNA, 16 bp, Homo sapiens
cacatacaatttgcac

SEQ ID NO: 3854290 - DNA, 12 bp, Homo sapiens
cacatacataca

SEQ ID NO: 3854291 - DNA, 22 bp, Homo sapiens
cacatacatacacatacataca

SEQ ID NO: 3854292 - DNA, 16 bp, Homo sapiens
cacatagagatatgca

SEQ ID NO: 3854293 - DNA, 13 bp, Homo sapiens
cacatagattaat

SEQ ID NO: 3854294 - DNA, 21 bp, Homo sapiens
cacatagattaatggcactga

SEQ ID NO: 3854295 - DNA, 22 bp, Homo sapiens
cacatagctacccaaaagagaa

SEQ ID NO: 3854296 - DNA, 14 bp, Homo sapiens
cacatatacctata

SEQ ID NO: 3854297 - DNA, 18 bp, Homo sapiens
cacatatacctataatgt

SEQ ID NO: 3854298 - DNA, 15 bp, Homo sapiens
cacatatggcacaac

SEQ ID NO: 3854299 - DNA, 17 bp, Homo sapiens
cacatatggcacaactg

SEQ ID NO: 3854300 - DNA, 16 bp, Homo sapiens
cacatatgggtgctgg

SEQ ID NO: 3854301 - DNA, 18 bp, Homo sapiens
cacatatgggtgctggca

SEQ ID NO: 3854302 - DNA, 23 bp, Homo sapiens
cacatcagcttgccctgttaaaa

SEQ ID NO: 3854303 - DNA, 15 bp, Homo sapiens
cacatccaactcctg

SEQ ID NO: 3854304 - DNA, 17 bp, Homo sapiens
cacatccaatgcatagt

SEQ ID NO: 3854305 - DNA, 14 bp, Homo sapiens
cacatccattccca

SEQ ID NO: 3854306 - DNA, 22 bp, Homo sapiens
cacatccattcccaagaaatgc

SEQ ID NO: 3854307 - DNA, 21 bp, Homo sapiens
cacatcccggcctcttccacc

SEQ ID NO: 3854308 - DNA, 21 bp, Homo sapiens
cacatccctgggcctgctgct

SEQ ID NO: 3854309 - DNA, 16 bp, Homo sapiens
cacatctaatgtctct

SEQ ID NO: 3854310 - DNA, 13 bp, Homo sapiens
cacatctctgaaa

SEQ ID NO: 3854311 - DNA, 19 bp, Homo sapiens
cacatgcatcatcagccta

SEQ ID NO: 3854312 - DNA, 22 bp, Homo sapiens
cacatgtcaccgtggaccttcc

SEQ ID NO: 3854313 - DNA, 12 bp, Homo sapiens
cacatgtccagt

SEQ ID NO: 3854314 - DNA, 16 bp, Homo sapiens
cacatgtttacagaac

SEQ ID NO: 3854315 - DNA, 20 bp, Homo sapiens
cacattacatcatcctcctt

SEQ ID NO: 3854316 - DNA, 14 bp, Homo sapiens
cacattacttgcac

SEQ ID NO: 3854317 - DNA, 20 bp, Homo sapiens
cacattacttgcacaagctt

SEQ ID NO: 3854318 - DNA, 22 bp, Homo sapiens
cacattacttgcacaagcttgt

SEQ ID NO: 3854319 - DNA, 14 bp, Homo sapiens
cacattcaggaaga

SEQ ID NO: 3854320 - DNA, 13 bp, Homo sapiens
cacattcctggcc

SEQ ID NO: 3854321 - DNA, 19 bp, Homo sapiens
cacacagtctcagtccaga

SEQ ID NO: 3854322 - DNA, 23 bp, Homo sapiens
cacacatagattaatggcactga

SEQ ID NO: 3854323 - DNA, 13 bp, Homo sapiens
cacacatatacat

SEQ ID NO: 3854324 - DNA, 14 bp, Homo sapiens
cacacatatacata

SEQ ID NO: 3854325 - DNA, 15 bp, Homo sapiens
cacacatatacatat

SEQ ID NO: 3854326 - DNA, 19 bp, Homo sapiens
cacacatatacatatatat

SEQ ID NO: 3854327 - DNA, 14 bp, Homo sapiens
cacaccactgccct

SEQ ID NO: 3854328 - DNA, 15 bp, Homo sapiens
cacaccactgccctg

SEQ ID NO: 3854329 - DNA, 19 bp, Homo sapiens
cacaccactgccctgcctg

SEQ ID NO: 3854330 - DNA, 12 bp, Homo sapiens
cacacccagagg

SEQ ID NO: 3854331 - DNA, 22 bp, Homo sapiens
cacacccagagggtagggcagc

SEQ ID NO: 3854332 - DNA, 14 bp, Homo sapiens
cacaccctgtttta

SEQ ID NO: 3854333 - DNA, 14 bp, Homo sapiens
cacacctcacgctc

SEQ ID NO: 3854334 - DNA, 16 bp, Homo sapiens
cacacctcacgctctg

SEQ ID NO: 3854335 - DNA, 22 bp, Homo sapiens
cacacctctggatccctggagg

SEQ ID NO: 3854336 - DNA, 12 bp, Homo sapiens
cacacctctggg

SEQ ID NO: 3854337 - DNA, 21 bp, Homo sapiens
cacacctgtaatcccagcact

SEQ ID NO: 3854338 - DNA, 14 bp, Homo sapiens
cacacgcacataga

SEQ ID NO: 3854339 - DNA, 20 bp, Homo sapiens
cacacgcaggaactcccagc

SEQ ID NO: 3854340 - DNA, 15 bp, Homo sapiens
cacacggatgcacag

SEQ ID NO: 3854341 - DNA, 13 bp, Homo sapiens
cacacgtgctcgc

SEQ ID NO: 3854342 - DNA, 18 bp, Homo sapiens
cacacgtgctcgcagcct

SEQ ID NO: 3854343 - DNA, 22 bp, Homo sapiens
cacacgtgctcgcagcctggcg

SEQ ID NO: 3854344 - DNA, 17 bp, Homo sapiens
cacactagcctctccag

SEQ ID NO: 3854345 - DNA, 16 bp, Homo sapiens
cacactccccgcctgt

SEQ ID NO: 3854346 - DNA, 19 bp, Homo sapiens
cacactccccgcctgtcct

SEQ ID NO: 3854347 - DNA, 19 bp, Homo sapiens
cacactgcaagagccttgg

SEQ ID NO: 3854348 - DNA, 15 bp, Homo sapiens
cacactggtgactgc

SEQ ID NO: 3854349 - DNA, 16 bp, Homo sapiens
cacactgtaaacccct

SEQ ID NO: 3854350 - DNA, 14 bp, Homo sapiens
cacactgtaaatat

SEQ ID NO: 3854351 - DNA, 16 bp, Homo sapiens
cacactgtcagagctg

SEQ ID NO: 3854352 - DNA, 17 bp, Homo sapiens
cacacttcaggctcttc

SEQ ID NO: 3854353 - DNA, 22 bp, Homo sapiens
cacacttcaggctcttctcctt

SEQ ID NO: 3854354 - DNA, 14 bp, Homo sapiens
cacacttctcagga

SEQ ID NO: 3854355 - DNA, 21 bp, Homo sapiens
cacacttcttgaaacagcctg

SEQ ID NO: 3854356 - DNA, 12 bp, Homo sapiens
cacagaaatata

SEQ ID NO: 3854357 - DNA, 18 bp, Homo sapiens
cacagaaatatatataca

SEQ ID NO: 3854358 - DNA, 23 bp, Homo sapiens
cacagaagccaggagcaaatgtt

SEQ ID NO: 3854359 - DNA, 15 bp, Homo sapiens
cacagactccctccc

SEQ ID NO: 3854360 - DNA, 16 bp, Homo sapiens
cacagacttctggaag

SEQ ID NO: 3854361 - DNA, 18 bp, Homo sapiens
cacagacttctggaaggc

SEQ ID NO: 3854362 - DNA, 21 bp, Homo sapiens
cacagacttctggaaggctgg

SEQ ID NO: 3854363 - DNA, 23 bp, Homo sapiens
cacagacttctggaaggctggct

SEQ ID NO: 3854364 - DNA, 12 bp, Homo sapiens
cacagagatatg

SEQ ID NO: 3854365 - DNA, 20 bp, Homo sapiens
cacagagatatgcacacaca

SEQ ID NO: 3854366 - DNA, 13 bp, Homo sapiens
cacagaggaagag

SEQ ID NO: 3854367 - DNA, 15 bp, Homo sapiens
cacagaggaagagca

SEQ ID NO: 3854368 - DNA, 18 bp, Homo sapiens
cacagaggcttcttcaga

SEQ ID NO: 3854369 - DNA, 19 bp, Homo sapiens
cacagagtggagccctcag

SEQ ID NO: 3854370 - DNA, 14 bp, Homo sapiens
cacagatacatggg

SEQ ID NO: 3854371 - DNA, 14 bp, Homo sapiens
cacagatatgcaca

SEQ ID NO: 3854372 - DNA, 22 bp, Homo sapiens
cacagatgtgggctttgatttc

SEQ ID NO: 3854373 - DNA, 18 bp, Homo sapiens
cacagcacccaggctcca

SEQ ID NO: 3854374 - DNA, 19 bp, Homo sapiens
cacagcacccaggctccat

SEQ ID NO: 3854375 - DNA, 13 bp, Homo sapiens
cacagcagcactg

SEQ ID NO: 3854376 - DNA, 15 bp, Homo sapiens
cacagcagcactgca

SEQ ID NO: 3854377 - DNA, 11 bp, Homo sapiens
cacagcagccc

SEQ ID NO: 3854378 - DNA, 18 bp, Homo sapiens
cacagcagccccccagca

SEQ ID NO: 3854379 - DNA, 17 bp, Homo sapiens
cacagcagtatgaatga

SEQ ID NO: 3854380 - DNA, 19 bp, Homo sapiens
cacagcagtatgaatgatg

SEQ ID NO: 3854381 - DNA, 23 bp, Homo sapiens
cacagcccaagaggactgagact

SEQ ID NO: 3854382 - DNA, 13 bp, Homo sapiens
cacagccccacag

SEQ ID NO: 3854383 - DNA, 16 bp, Homo sapiens
cacagccccacagcac

SEQ ID NO: 3854384 - DNA, 20 bp, Homo sapiens
cacagccccacagcacccag

SEQ ID NO: 3854385 - DNA, 17 bp, Homo sapiens
cacagcccgggtgtgcc

SEQ ID NO: 3854386 - DNA, 11 bp, Homo sapiens
cacagccctgg

SEQ ID NO: 3854387 - DNA, 14 bp, Homo sapiens
cacagcctctgcct

SEQ ID NO: 3854388 - DNA, 18 bp, Homo sapiens
cacagcggggaagctggg

SEQ ID NO: 3854389 - DNA, 15 bp, Homo sapiens
cacagcgtccctagc

SEQ ID NO: 3854390 - DNA, 15 bp, Homo sapiens
cacagctcccacccc

SEQ ID NO: 3854391 - DNA, 20 bp, Homo sapiens
cacagctctccggtctctct

SEQ ID NO: 3854392 - DNA, 16 bp, Homo sapiens
cacagctctgtagaaa

SEQ ID NO: 3854393 - DNA, 18 bp, Homo sapiens
cacagctgagagactttt

SEQ ID NO: 3854394 - DNA, 19 bp, Homo sapiens
cacagctgagagactttta

SEQ ID NO: 3854395 - DNA, 13 bp, Homo sapiens
cacagctgcagct

SEQ ID NO: 3854396 - DNA, 16 bp, Homo sapiens
cacagctgcagctggg

SEQ ID NO: 3854397 - DNA, 17 bp, Homo sapiens
cacagctgcagctgggc

SEQ ID NO: 3854398 - DNA, 18 bp, Homo sapiens
cacagctgcagctgggcc

SEQ ID NO: 3854399 - DNA, 21 bp, Homo sapiens
cacagctgcagctgggcccca

SEQ ID NO: 3854400 - DNA, 17 bp, Homo sapiens
cacagctgcttgtcctg

SEQ ID NO: 3854401 - DNA, 12 bp, Homo sapiens
cacaggaaaagg

SEQ ID NO: 3854402 - DNA, 15 bp, Homo sapiens
cacaggagacactgt

SEQ ID NO: 3854403 - DNA, 15 bp, Homo sapiens
cacaggagcagacag

SEQ ID NO: 3854404 - DNA, 16 bp, Homo sapiens
cacaggagctacctgt

SEQ ID NO: 3854405 - DNA, 12 bp, Homo sapiens
cacaggaggggg

SEQ ID NO: 3854406 - DNA, 22 bp, Homo sapiens
cacaggagggggtcgtggagag

SEQ ID NO: 3854407 - DNA, 17 bp, Homo sapiens
cacaggcatttcctggg

SEQ ID NO: 3854408 - DNA, 14 bp, Homo sapiens
caggaagagagaga

SEQ ID NO: 3854409 - DNA, 19 bp, Homo sapiens
caggaaggatggcaagcac

SEQ ID NO: 3854410 - DNA, 14 bp, Homo sapiens
caggaaggcagctg

SEQ ID NO: 3854411 - DNA, 18 bp, Homo sapiens
caggaaggcagctgctct

SEQ ID NO: 3854412 - DNA, 15 bp, Homo sapiens
caggaatctgccatt

SEQ ID NO: 3854413 - DNA, 17 bp, Homo sapiens
caggaatgtgtggcaga

SEQ ID NO: 3854414 - DNA, 18 bp, Homo sapiens
caggaatgttaaagtcag

SEQ ID NO: 3854415 - DNA, 12 bp, Homo sapiens
caggacacaggc

SEQ ID NO: 3854416 - DNA, 19 bp, Homo sapiens
caggacacaggcctgtgta

SEQ ID NO: 3854417 - DNA, 19 bp, Homo sapiens
caggacacatcccggcctc

SEQ ID NO: 3854418 - DNA, 11 bp, Homo sapiens
caggacacctg

SEQ ID NO: 3854419 - DNA, 14 bp, Homo sapiens
caggacacctgccc

SEQ ID NO: 3854420 - DNA, 16 bp, Homo sapiens
caggacacctgcccca

SEQ ID NO: 3854421 - DNA, 19 bp, Homo sapiens
caggacacctgccccagcg

SEQ ID NO: 3854422 - DNA, 12 bp, Homo sapiens
caggacaggacc

SEQ ID NO: 3854423 - DNA, 13 bp, Homo sapiens
caggacaggagac

SEQ ID NO: 3854424 - DNA, 13 bp, Homo sapiens
caggacaggcccg

SEQ ID NO: 3854425 - DNA, 13 bp, Homo sapiens
caggacatggggc

SEQ ID NO: 3854426 - DNA, 15 bp, Homo sapiens
caggacatggggcat

SEQ ID NO: 3854427 - DNA, 18 bp, Homo sapiens
caggacatggggcataga

SEQ ID NO: 3854428 - DNA, 16 bp, Homo sapiens
caggaccacaaaaatg

SEQ ID NO: 3854429 - DNA, 13 bp, Homo sapiens
caggaccaggact

SEQ ID NO: 3854430 - DNA, 24 bp, Homo sapiens
caggacccaggccctccatgggct

SEQ ID NO: 3854431 - DNA, 14 bp, Homo sapiens
caggacccaggccg

SEQ ID NO: 3854432 - DNA, 21 bp, Homo sapiens
caggacccaggccgcctgcca

SEQ ID NO: 3854433 - DNA, 17 bp, Homo sapiens
caggactatagcccagg

SEQ ID NO: 3854434 - DNA, 16 bp, Homo sapiens
caggactccccaggcc

SEQ ID NO: 3854435 - DNA, 18 bp, Homo sapiens
caggactccccaggccag

SEQ ID NO: 3854436 - DNA, 20 bp, Homo sapiens
caggactccccaggccaggc

SEQ ID NO: 3854437 - DNA, 13 bp, Homo sapiens
caggactctgcct

SEQ ID NO: 3854438 - DNA, 15 bp, Homo sapiens
caggactctgcctcc

SEQ ID NO: 3854439 - DNA, 19 bp, Homo sapiens
caggactgaattgtcccca

SEQ ID NO: 3854440 - DNA, 20 bp, Homo sapiens
caggactgaattgtccccag

SEQ ID NO: 3854441 - DNA, 14 bp, Homo sapiens
caggactgtgactc

SEQ ID NO: 3854442 - DNA, 20 bp, Homo sapiens
caggacttaacggctccagg

SEQ ID NO: 3854443 - DNA, 23 bp, Homo sapiens
caggacttggtctgatttcagga

SEQ ID NO: 3854444 - DNA, 23 bp, Homo sapiens
caggactttgatgcatttccaca

SEQ ID NO: 3854445 - DNA, 14 bp, Homo sapiens
caggagaagaaaga

SEQ ID NO: 3854446 - DNA, 20 bp, Homo sapiens
caggagagagatctagaaag

SEQ ID NO: 3854447 - DNA, 15 bp, Homo sapiens
caggagagccagccc

SEQ ID NO: 3854448 - DNA, 21 bp, Homo sapiens
caggagagccagccctccctg

SEQ ID NO: 3854449 - DNA, 16 bp, Homo sapiens
caggagcacaggcagc

SEQ ID NO: 3854450 - DNA, 16 bp, Homo sapiens
caggagcagacagaga

SEQ ID NO: 3854451 - DNA, 18 bp, Homo sapiens
caggagcaggaacagaga

SEQ ID NO: 3854452 - DNA, 19 bp, Homo sapiens
caggagcaggaacagagac

SEQ ID NO: 3854453 - DNA, 21 bp, Homo sapiens
caggagcaggaacagagactc

SEQ ID NO: 3854454 - DNA, 17 bp, Homo sapiens
caggagctacctgtgtg

SEQ ID NO: 3854455 - DNA, 18 bp, Homo sapiens
caggagctacctgtgtgg

SEQ ID NO: 3854456 - DNA, 13 bp, Homo sapiens
caggagctcagcc

SEQ ID NO: 3854457 - DNA, 14 bp, Homo sapiens
caggagctgagtca

SEQ ID NO: 3854458 - DNA, 20 bp, Homo sapiens
caggagctgagtcacctcct

SEQ ID NO: 3854459 - DNA, 14 bp, Homo sapiens
caggagctggagga

SEQ ID NO: 3854460 - DNA, 16 bp, Homo sapiens
caggaggcctggcctt

SEQ ID NO: 3854461 - DNA, 16 bp, Homo sapiens
caggaggcgaataaat

SEQ ID NO: 3854462 - DNA, 19 bp, Homo sapiens
caggaggcgaataaatgtt

SEQ ID NO: 3854463 - DNA, 14 bp, Homo sapiens
caggaggcgcagcc

SEQ ID NO: 3854464 - DNA, 18 bp, Homo sapiens
caggaggcgcagcccgaa

SEQ ID NO: 3854465 - DNA, 15 bp, Homo sapiens
caggaggctgaggca

SEQ ID NO: 3854466 - DNA, 18 bp, Homo sapiens
caggaggctgaggcagaa

SEQ ID NO: 3854467 - DNA, 24 bp, Homo sapiens
caggagggacaaaggagcctgtga

SEQ ID NO: 3854468 - DNA, 23 bp, Homo sapiens
caggagggggtcgtggagagcta

SEQ ID NO: 3854469 - DNA, 15 bp, Homo sapiens
caggaggtcctcctc

SEQ ID NO: 3854470 - DNA, 22 bp, Homo sapiens
caggaggtggctatggccaccc

SEQ ID NO: 3854471 - DNA, 21 bp, Homo sapiens
caggaggttggtgactgaaac

SEQ ID NO: 3854472 - DNA, 14 bp, Homo sapiens
caggagtagctgag

SEQ ID NO: 3854473 - DNA, 14 bp, Homo sapiens
caggagtctgtgct

SEQ ID NO: 3854474 - DNA, 15 bp, Homo sapiens
caggagtctgtgctc

SEQ ID NO: 3854475 - DNA, 12 bp, Homo sapiens
caggagttctga

SEQ ID NO: 3854476 - DNA, 13 bp, Homo sapiens
caggagttctgaa

SEQ ID NO: 3854477 - DNA, 20 bp, Homo sapiens
caggagtttgagacaagccc

SEQ ID NO: 3854478 - DNA, 23 bp, Homo sapiens
caggagtttgagacaagccctgg

SEQ ID NO: 3854479 - DNA, 18 bp, Homo sapiens
caggatactctgtcagat

SEQ ID NO: 3854480 - DNA, 20 bp, Homo sapiens
caggatccctcccagatcct

SEQ ID NO: 3854481 - DNA, 15 bp, Homo sapiens
caggatccgctgcca

SEQ ID NO: 3854482 - DNA, 18 bp, Homo sapiens
caggatccgctgccacca

SEQ ID NO: 3854483 - DNA, 20 bp, Homo sapiens
caggatcctattctcaccag

SEQ ID NO: 3854484 - DNA, 22 bp, Homo sapiens
caggatcctattctcaccagga

SEQ ID NO: 3854485 - DNA, 21 bp, Homo sapiens
caggatgaggaacctcaaact

SEQ ID NO: 3854486 - DNA, 15 bp, Homo sapiens
caggattgaagagca

SEQ ID NO: 3854487 - DNA, 20 bp, Homo sapiens
caggcaaaacacgcaagggc

SEQ ID NO: 3854488 - DNA, 20 bp, Homo sapiens
caggcaagcccctcagccct

SEQ ID NO: 3854489 - DNA, 18 bp, Homo sapiens
caggcaagtgaagaaaag

SEQ ID NO: 3854490 - DNA, 18 bp, Homo sapiens
caggcacacagcagcccc

SEQ ID NO: 3854491 - DNA, 23 bp, Homo sapiens
caggcacaggcaggaagagagag

SEQ ID NO: 3854492 - DNA, 15 bp, Homo sapiens
caggcaccccctgga

SEQ ID NO: 3854493 - DNA, 16 bp, Homo sapiens
caggcaccccctggag

SEQ ID NO: 3854494 - DNA, 18 bp, Homo sapiens
cagctcttcactcagcca

SEQ ID NO: 3854495 - DNA, 15 bp, Homo sapiens
cagctcttggcattt

SEQ ID NO: 3854496 - DNA, 19 bp, Homo sapiens
cagctcttggcattttcct

SEQ ID NO: 3854497 - DNA, 21 bp, Homo sapiens
cagctgacacataatttgaat

SEQ ID NO: 3854498 - DNA, 16 bp, Homo sapiens
cagctgacctttgtca

SEQ ID NO: 3854499 - DNA, 16 bp, Homo sapiens
cagctgagagccctgc

SEQ ID NO: 3854500 - DNA, 13 bp, Homo sapiens
cagctgagcaggg

SEQ ID NO: 3854501 - DNA, 14 bp, Homo sapiens
cagctgagcagggc

SEQ ID NO: 3854502 - DNA, 20 bp, Homo sapiens
cagctgaggctgggggcggg

SEQ ID NO: 3854503 - DNA, 23 bp, Homo sapiens
cagctgattttgtcactgtcttc

SEQ ID NO: 3854504 - DNA, 20 bp, Homo sapiens
cagctgcacattcctggccc

SEQ ID NO: 3854505 - DNA, 14 bp, Homo sapiens
cagctgcagctggg

SEQ ID NO: 3854506 - DNA, 15 bp, Homo sapiens
cagctgcagctgggc

SEQ ID NO: 3854507 - DNA, 13 bp, Homo sapiens
cagctgccaagca

SEQ ID NO: 3854508 - DNA, 11 bp, Homo sapiens
cagctgcctgg

SEQ ID NO: 3854509 - DNA, 10 bp, Homo sapiens
cagctgcctt

SEQ ID NO: 3854510 - DNA, 14 bp, Homo sapiens
cagctgctacaaga

SEQ ID NO: 3854511 - DNA, 16 bp, Homo sapiens
cagctgctctgcccct

SEQ ID NO: 3854512 - DNA, 20 bp, Homo sapiens
cagctgctctgccccttggg

SEQ ID NO: 3854513 - DNA, 22 bp, Homo sapiens
cagctgctcttagtgcccgcct

SEQ ID NO: 3854514 - DNA, 20 bp, Homo sapiens
cagctgctgaagttctgagc

SEQ ID NO: 3854515 - DNA, 13 bp, Homo sapiens
cagctgcttgtcc

SEQ ID NO: 3854516 - DNA, 17 bp, Homo sapiens
cagctgcttgtcctgct

SEQ ID NO: 3854517 - DNA, 16 bp, Homo sapiens
cagctggagaagaccc

SEQ ID NO: 3854518 - DNA, 21 bp, Homo sapiens
cagctggatgagacttccaaa

SEQ ID NO: 3854519 - DNA, 12 bp, Homo sapiens
cagctggcctct

SEQ ID NO: 3854520 - DNA, 14 bp, Homo sapiens
cagctggctctcca

SEQ ID NO: 3854521 - DNA, 16 bp, Homo sapiens
cagctgggacccctcc

SEQ ID NO: 3854522 - DNA, 18 bp, Homo sapiens
cagctgggactacaggcg

SEQ ID NO: 3854523 - DNA, 13 bp, Homo sapiens
cagctgggcccca

SEQ ID NO: 3854524 - DNA, 19 bp, Homo sapiens
cagctgggccccacctact

SEQ ID NO: 3854525 - DNA, 19 bp, Homo sapiens
cagctgggccccatgctct

SEQ ID NO: 3854526 - DNA, 13 bp, Homo sapiens
cagctgggccggc

SEQ ID NO: 3854527 - DNA, 14 bp, Homo sapiens
cagctgggccggcc

SEQ ID NO: 3854528 - DNA, 18 bp, Homo sapiens
cagctgggccggccagcc

SEQ ID NO: 3854529 - DNA, 20 bp, Homo sapiens
cagctgggccggccagcctt

SEQ ID NO: 3854530 - DNA, 17 bp, Homo sapiens
cagctggtccagggcct

SEQ ID NO: 3854531 - DNA, 15 bp, Homo sapiens
cagctgtagccatgg

SEQ ID NO: 3854532 - DNA, 20 bp, Homo sapiens
cagctgtagccatggctcag

SEQ ID NO: 3854533 - DNA, 17 bp, Homo sapiens
cagctgtagctcccgag

SEQ ID NO: 3854534 - DNA, 18 bp, Homo sapiens
cagctgtagctcccgagc

SEQ ID NO: 3854535 - DNA, 21 bp, Homo sapiens
cagctgtcatggaaaagccca

SEQ ID NO: 3854536 - DNA, 22 bp, Homo sapiens
cagctgtcatggaaaagcccag

SEQ ID NO: 3854537 - DNA, 16 bp, Homo sapiens
cagctgtcattcagga

SEQ ID NO: 3854538 - DNA, 21 bp, Homo sapiens
cagctgtcccctctccctggg

SEQ ID NO: 3854539 - DNA, 13 bp, Homo sapiens
cagctgtccctgt

SEQ ID NO: 3854540 - DNA, 17 bp, Homo sapiens
cagctgtgcctcgctcc

SEQ ID NO: 3854541 - DNA, 15 bp, Homo sapiens
cagctgtttctggaa

SEQ ID NO: 3854542 - DNA, 22 bp, Homo sapiens
cagcttatgggatccttgtctt

SEQ ID NO: 3854543 - DNA, 14 bp, Homo sapiens
cagcttcatcaatt

SEQ ID NO: 3854544 - DNA, 15 bp, Homo sapiens
cagcttcatcaattt

SEQ ID NO: 3854545 - DNA, 19 bp, Homo sapiens
cagcttcatcaatttttat

SEQ ID NO: 3854546 - DNA, 22 bp, Homo sapiens
cagcttcatcaatttttataca

SEQ ID NO: 3854547 - DNA, 15 bp, Homo sapiens
cagcttcctggtgta

SEQ ID NO: 3854548 - DNA, 12 bp, Homo sapiens
cagcttcctgtc

SEQ ID NO: 3854549 - DNA, 13 bp, Homo sapiens
cagcttcctgtgg

SEQ ID NO: 3854550 - DNA, 22 bp, Homo sapiens
cagcttcctgtgggccaggagc

SEQ ID NO: 3854551 - DNA, 15 bp, Homo sapiens
cagcttctccaggct

SEQ ID NO: 3854552 - DNA, 17 bp, Homo sapiens
cagcttgaccagaccta

SEQ ID NO: 3854553 - DNA, 12 bp, Homo sapiens
cagcttgtagcc

SEQ ID NO: 3854554 - DNA, 16 bp, Homo sapiens
cagcttgtagccagcc

SEQ ID NO: 3854555 - DNA, 15 bp, Homo sapiens
cagctttacatgcaa

SEQ ID NO: 3854556 - DNA, 13 bp, Homo sapiens
cagctttcagagc

SEQ ID NO: 3854557 - DNA, 14 bp, Homo sapiens
cagctttcctgtat

SEQ ID NO: 3854558 - DNA, 17 bp, Homo sapiens
cagcttttaataaaatt

SEQ ID NO: 3854559 - DNA, 17 bp, Homo sapiens
cagcttttgcagaagca

SEQ ID NO: 3854560 - DNA, 11 bp, Homo sapiens
caggaaaaaaa

SEQ ID NO: 3854561 - DNA, 20 bp, Homo sapiens
caggaaaactgacagaggag

SEQ ID NO: 3854562 - DNA, 14 bp, Homo sapiens
caggaaaaggcctg

SEQ ID NO: 3854563 - DNA, 15 bp, Homo sapiens
caggaaaaggcctgg

SEQ ID NO: 3854564 - DNA, 16 bp, Homo sapiens
caggaaaaggcctggg

SEQ ID NO: 3854565 - DNA, 21 bp, Homo sapiens
caggaaaaggcctggggtgac

SEQ ID NO: 3854566 - DNA, 15 bp, Homo sapiens
caggaaaccctggct

SEQ ID NO: 3854567 - DNA, 17 bp, Homo sapiens
caggaaagccctccccc

SEQ ID NO: 3854568 - DNA, 21 bp, Homo sapiens
caggaaatcaaatatgcaaag

SEQ ID NO: 3854569 - DNA, 23 bp, Homo sapiens
caggaaatcaaatatgcaaagca

SEQ ID NO: 3854570 - DNA, 13 bp, Homo sapiens
caggaacagagac

SEQ ID NO: 3854571 - DNA, 15 bp, Homo sapiens
caggaacagagactc

SEQ ID NO: 3854572 - DNA, 20 bp, Homo sapiens
caggaacctgtactgggtta

SEQ ID NO: 3854573 - DNA, 14 bp, Homo sapiens
caggaacgagcact

SEQ ID NO: 3854574 - DNA, 18 bp, Homo sapiens
caggaacgagcactggcc

SEQ ID NO: 3854575 - DNA, 22 bp, Homo sapiens
caggaacgagcactggccagag

SEQ ID NO: 3854576 - DNA, 15 bp, Homo sapiens
caggaactcccagca

SEQ ID NO: 3854577 - DNA, 15 bp, Homo sapiens
caggaagaaacccca

SEQ ID NO: 3854578 - DNA, 17 bp, Homo sapiens
caggaagaaaccccaag

SEQ ID NO: 3854579 - DNA, 23 bp, Homo sapiens
caggaagaaaccccaagcagcat

SEQ ID NO: 3854580 - DNA, 13 bp, Homo sapiens
caggaagagagag

SEQ ID NO: 3854581 - DNA, 20 bp, Homo sapiens
cagagctgttggcctcgcct

SEQ ID NO: 3854582 - DNA, 22 bp, Homo sapiens
cagagctgttggcctcgcctgg

SEQ ID NO: 3854583 - DNA, 23 bp, Homo sapiens
cagagctgttggcctcgcctggg

SEQ ID NO: 3854584 - DNA, 19 bp, Homo sapiens
cagagcttattggccactg

SEQ ID NO: 3854585 - DNA, 14 bp, Homo sapiens
cagaggaagagcag

SEQ ID NO: 3854586 - DNA, 19 bp, Homo sapiens
cagaggaatctacctgtgg

SEQ ID NO: 3854587 - DNA, 20 bp, Homo sapiens
cagaggaatctacctgtggt

SEQ ID NO: 3854588 - DNA, 21 bp, Homo sapiens
cagaggaggcagaataagaaa

SEQ ID NO: 3854589 - DNA, 16 bp, Homo sapiens
cagaggagtccagggc

SEQ ID NO: 3854590 - DNA, 19 bp, Homo sapiens
cagaggagtccagggcggg

SEQ ID NO: 3854591 - DNA, 20 bp, Homo sapiens
cagaggagtccagggcggga

SEQ ID NO: 3854592 - DNA, 14 bp, Homo sapiens
cagaggccaaggag

SEQ ID NO: 3854593 - DNA, 16 bp, Homo sapiens
cagaggcggaaacctt

SEQ ID NO: 3854594 - DNA, 17 bp, Homo sapiens
cagaggcggaaaccttg

SEQ ID NO: 3854595 - DNA, 22 bp, Homo sapiens
cagaggcggaaaccttgcagca

SEQ ID NO: 3854596 - DNA, 16 bp, Homo sapiens
cagaggctaagatgag

SEQ ID NO: 3854597 - DNA, 20 bp, Homo sapiens
cagaggctggaggcagggcc

SEQ ID NO: 3854598 - DNA, 15 bp, Homo sapiens
cagaggcttcttcag

SEQ ID NO: 3854599 - DNA, 16 bp, Homo sapiens
cagaggcttcttcaga

SEQ ID NO: 3854600 - DNA, 23 bp, Homo sapiens
cagagggaatgttccctgcaccc

SEQ ID NO: 3854601 - DNA, 17 bp, Homo sapiens
cagagggcagaggctgg

SEQ ID NO: 3854602 - DNA, 18 bp, Homo sapiens
cagagggcagaggctgga

SEQ ID NO: 3854603 - DNA, 15 bp, Homo sapiens
cagaggggcagccgc

SEQ ID NO: 3854604 - DNA, 21 bp, Homo sapiens
cagaggggcagccgctaggag

SEQ ID NO: 3854605 - DNA, 18 bp, Homo sapiens
cagagggtagggcagcag

SEQ ID NO: 3854606 - DNA, 14 bp, Homo sapiens
cagaggtgagcaga

SEQ ID NO: 3854607 - DNA, 18 bp, Homo sapiens
cagaggtgagcagaggag

SEQ ID NO: 3854608 - DNA, 19 bp, Homo sapiens
cagaggttatctgcctggc

SEQ ID NO: 3854609 - DNA, 20 bp, Homo sapiens
cagaggttatctgcctggcc

SEQ ID NO: 3854610 - DNA, 21 bp, Homo sapiens
cagaggttatctgcctggcct

SEQ ID NO: 3854611 - DNA, 22 bp, Homo sapiens
cagaggttatctgcctggcctg

SEQ ID NO: 3854612 - DNA, 23 bp, Homo sapiens
cagaggttatctgcctggcctgg

SEQ ID NO: 3854613 - DNA, 16 bp, Homo sapiens
cagaggtttcttgaat

SEQ ID NO: 3854614 - DNA, 22 bp, Homo sapiens
cagaggttttaggaaacctggc

SEQ ID NO: 3854615 - DNA, 18 bp, Homo sapiens
cagagtcagaggagaaga

SEQ ID NO: 3854616 - DNA, 19 bp, Homo sapiens
cagagtcagaggagaagag

SEQ ID NO: 3854617 - DNA, 23 bp, Homo sapiens
cagagtcagaggagaagagacat

SEQ ID NO: 3854618 - DNA, 14 bp, Homo sapiens
cagagtctgagccc

SEQ ID NO: 3854619 - DNA, 15 bp, Homo sapiens
cagagtctgagcccc

SEQ ID NO: 3854620 - DNA, 20 bp, Homo sapiens
cagagtgaaagggctatggc

SEQ ID NO: 3854621 - DNA, 23 bp, Homo sapiens
cagagtgaaagggctatggcaag

SEQ ID NO: 3854622 - DNA, 22 bp, Homo sapiens
cagagtgaggatgtgttttgca

SEQ ID NO: 3854623 - DNA, 23 bp, Homo sapiens
cagagtgaggatgtgttttgcac

SEQ ID NO: 3854624 - DNA, 17 bp, Homo sapiens
cagagtggcccctcacc

SEQ ID NO: 3854625 - DNA, 19 bp, Homo sapiens
cagagtgtgcagactgatg

SEQ ID NO: 3854626 - DNA, 16 bp, Homo sapiens
cagagttattgaatct

SEQ ID NO: 3854627 - DNA, 22 bp, Homo sapiens
cagagttccacaaatctatatt

SEQ ID NO: 3854628 - DNA, 23 bp, Homo sapiens
cagagtttagaggaaaaaaatga

SEQ ID NO: 3854629 - DNA, 14 bp, Homo sapiens
cagataaagacagc

SEQ ID NO: 3854630 - DNA, 19 bp, Homo sapiens
cagataatcagcctcttaa

SEQ ID NO: 3854631 - DNA, 21 bp, Homo sapiens
cagataccatactcatttcta

SEQ ID NO: 3854632 - DNA, 19 bp, Homo sapiens
cagatagacagtgctgccc

SEQ ID NO: 3854633 - DNA, 21 bp, Homo sapiens
cagatagacagtgctgccctg

SEQ ID NO: 3854634 - DNA, 16 bp, Homo sapiens
cagatagccagacaca

SEQ ID NO: 3854635 - DNA, 18 bp, Homo sapiens
cagatagccagacacatg

SEQ ID NO: 3854636 - DNA, 14 bp, Homo sapiens
cagatatacacatg

SEQ ID NO: 3854637 - DNA, 18 bp, Homo sapiens
cagatatatttttcacag

SEQ ID NO: 3854638 - DNA, 15 bp, Homo sapiens
cagatatgatatgta

SEQ ID NO: 3854639 - DNA, 18 bp, Homo sapiens
cagatatgatatgtaaac

SEQ ID NO: 3854640 - DNA, 22 bp, Homo sapiens
cagatatgcacacacatggatg

SEQ ID NO: 3854641 - DNA, 15 bp, Homo sapiens
cagatattttttcag

SEQ ID NO: 3854642 - DNA, 20 bp, Homo sapiens
cagatccaccctatccctgt

SEQ ID NO: 3854643 - DNA, 22 bp, Homo sapiens
cagatcccatccatcagctccc

SEQ ID NO: 3854644 - DNA, 18 bp, Homo sapiens
cagatcctactcttcctt

SEQ ID NO: 3854645 - DNA, 17 bp, Homo sapiens
cagatctgcactgggtg

SEQ ID NO: 3854646 - DNA, 12 bp, Homo sapiens
cagatctgcctg

SEQ ID NO: 3854647 - DNA, 23 bp, Homo sapiens
cagatcttgacagtatatttgaa

SEQ ID NO: 3854648 - DNA, 16 bp, Homo sapiens
cagatgcaacctcact

SEQ ID NO: 3854649 - DNA, 19 bp, Homo sapiens
cagatgcaacctcactatg

SEQ ID NO: 3854650 - DNA, 15 bp, Homo sapiens
cagatgcacacacag

SEQ ID NO: 3854651 - DNA, 16 bp, Homo sapiens
cagatggaggtgccat

SEQ ID NO: 3854652 - DNA, 17 bp, Homo sapiens
cagatgggtattaaact

SEQ ID NO: 3854653 - DNA, 18 bp, Homo sapiens
cagatggtcacacagaga

SEQ ID NO: 3854654 - DNA, 24 bp, Homo sapiens
cagatgtaggagggactgtcgctg

SEQ ID NO: 3854655 - DNA, 19 bp, Homo sapiens
cagattcccagagcaaaat

SEQ ID NO: 3854656 - DNA, 15 bp, Homo sapiens
cagattcctgggcct

SEQ ID NO: 3854657 - DNA, 20 bp, Homo sapiens
cagatttagtgaaagctaga

SEQ ID NO: 3854658 - DNA, 16 bp, Homo sapiens
cagatttttgggctcc

SEQ ID NO: 3854659 - DNA, 15 bp, Homo sapiens
cagcaaaaatataaa

SEQ ID NO: 3854660 - DNA, 16 bp, Homo sapiens
cagcaaaccaggactc

SEQ ID NO: 3854661 - DNA, 21 bp, Homo sapiens
cagcaacacaagctggaagca

SEQ ID NO: 3854662 - DNA, 10 bp, Homo sapiens
cagcaactcc

SEQ ID NO: 3854663 - DNA, 11 bp, Homo sapiens
cagcaactccc

SEQ ID NO: 3854664 - DNA, 13 bp, Homo sapiens
cagcaactcccac

SEQ ID NO: 3854665 - DNA, 21 bp, Homo sapiens
cagcaagccggccccccctct

SEQ ID NO: 3854666 - DNA, 14 bp, Homo sapiens
cagcaaggcccgag

SEQ ID NO: 3854667 - DNA, 16 bp, Homo sapiens
cagcaaggcccgagca

SEQ ID NO: 3854668 - DNA, 19 bp, Homo sapiens
cagcaaggcccgagcagct

SEQ ID NO: 3854669 - DNA, 21 bp, Homo sapiens
cagcaaggcccgagcagctga

SEQ ID NO: 3854670 - DNA, 22 bp, Homo sapiens
cagcaaggcccgagcagctgag

SEQ ID NO: 3854671 - DNA, 19 bp, Homo sapiens
cagcaagggtgatgggaaa

SEQ ID NO: 3854672 - DNA, 17 bp, Homo sapiens
cagcaatagggtgcagt

SEQ ID NO: 3854673 - DNA, 15 bp, Homo sapiens
cagcaatatgtaaat

SEQ ID NO: 3854674 - DNA, 18 bp, Homo sapiens
cagcaatgatgtccagaa

SEQ ID NO: 3854675 - DNA, 15 bp, Homo sapiens
cagcacaccccaagg

SEQ ID NO: 3854676 - DNA, 17 bp, Homo sapiens
cagcacaccccaaggga

SEQ ID NO: 3854677 - DNA, 18 bp, Homo sapiens
cagcacaggggccccaga

SEQ ID NO: 3854678 - DNA, 20 bp, Homo sapiens
cagcacaggggccccagatc

SEQ ID NO: 3854679 - DNA, 20 bp, Homo sapiens
cagcacatagcactgggaac

SEQ ID NO: 3854680 - DNA, 22 bp, Homo sapiens
cagcaccaattgtacattccct

SEQ ID NO: 3854681 - DNA, 13 bp, Homo sapiens
cagcaccatggag

SEQ ID NO: 3854682 - DNA, 15 bp, Homo sapiens
cagcacccaggctcc

SEQ ID NO: 3854683 - DNA, 19 bp, Homo sapiens
cagcacccaggctccatgg

SEQ ID NO: 3854684 - DNA, 11 bp, Homo sapiens
cagcaccctcc

SEQ ID NO: 3854685 - DNA, 18 bp, Homo sapiens
cagcaccctcccccgcag

SEQ ID NO: 3854686 - DNA, 19 bp, Homo sapiens
cagcaccctctcctggggg

SEQ ID NO: 3854687 - DNA, 12 bp, Homo sapiens
cagcaccctggg

SEQ ID NO: 3854688 - DNA, 18 bp, Homo sapiens
cagcactaaggccgtgtc

SEQ ID NO: 3854689 - DNA, 21 bp, Homo sapiens
cagcactaaggccgtgtctct

SEQ ID NO: 3854690 - DNA, 23 bp, Homo sapiens
cagcactcagaaaagaaaaccat

SEQ ID NO: 3854691 - DNA, 12 bp, Homo sapiens
cagcactgaaaa

SEQ ID NO: 3854692 - DNA, 14 bp, Homo sapiens
cagcactgatttca

SEQ ID NO: 3854693 - DNA, 20 bp, Homo sapiens
cagcagagttattgaatctt

SEQ ID NO: 3854694 - DNA, 22 bp, Homo sapiens
cagcagagttattgaatcttaa

SEQ ID NO: 3854695 - DNA, 10 bp, Homo sapiens
cagcagccag

SEQ ID NO: 3854696 - DNA, 12 bp, Homo sapiens
cagcagccagcc

SEQ ID NO: 3854697 - DNA, 14 bp, Homo sapiens
cagcagccagccct

SEQ ID NO: 3854698 - DNA, 17 bp, Homo sapiens
cagcagccagccctgcc

SEQ ID NO: 3854699 - DNA, 18 bp, Homo sapiens
cagcagccagccctgcct

SEQ ID NO: 3854700 - DNA, 20 bp, Homo sapiens
cagcagccagccctgcctgg

SEQ ID NO: 3854701 - DNA, 22 bp, Homo sapiens
cagcagccagccctgcctggag

SEQ ID NO: 3854702 - DNA, 13 bp, Homo sapiens
cagcagcccagct

SEQ ID NO: 3854703 - DNA, 16 bp, Homo sapiens
cagcagcccagcttcc

SEQ ID NO: 3854704 - DNA, 19 bp, Homo sapiens
cagcagcccagcttcctgg

SEQ ID NO: 3854705 - DNA, 21 bp, Homo sapiens
cagcagcccagcttcctggtg

SEQ ID NO: 3854706 - DNA, 19 bp, Homo sapiens
cagcagcccatggcctctg

SEQ ID NO: 3854707 - DNA, 17 bp, Homo sapiens
cagcagccccccagcac

SEQ ID NO: 3854708 - DNA, 18 bp, Homo sapiens
cagcagccccccagcact

SEQ ID NO: 3854709 - DNA, 17 bp, Homo sapiens
cagcagccccctgcccg

SEQ ID NO: 3854710 - DNA, 24 bp, Homo sapiens
cagcagccctaaggatctctcagg

SEQ ID NO: 3854711 - DNA, 16 bp, Homo sapiens
cagcagctaggactga

SEQ ID NO: 3854712 - DNA, 19 bp, Homo sapiens
cagcagctaggactgagga

SEQ ID NO: 3854713 - DNA, 22 bp, Homo sapiens
cagcagctaggactgaggagtg

SEQ ID NO: 3854714 - DNA, 23 bp, Homo sapiens
cagcagctaggactgaggagtgg

SEQ ID NO: 3854715 - DNA, 17 bp, Homo sapiens
cagcagctgcgggtctg

SEQ ID NO: 3854716 - DNA, 13 bp, Homo sapiens
cagcagctgggcc

SEQ ID NO: 3854717 - DNA, 19 bp, Homo sapiens
cagcagctgggccggccag

SEQ ID NO: 3854718 - DNA, 17 bp, Homo sapiens
cagcaggaacctgtact

SEQ ID NO: 3854719 - DNA, 15 bp, Homo sapiens
cagcaggtgcaagag

SEQ ID NO: 3854720 - DNA, 18 bp, Homo sapiens
cagcaggtgcaagagaca

SEQ ID NO: 3854721 - DNA, 12 bp, Homo sapiens
cagcagtcttct

SEQ ID NO: 3854722 - DNA, 15 bp, Homo sapiens
cagcagtgagcttct

SEQ ID NO: 3854723 - DNA, 16 bp, Homo sapiens
cagcagtgtcatcaga

SEQ ID NO: 3854724 - DNA, 13 bp, Homo sapiens
cagcagtgttccc

SEQ ID NO: 3854725 - DNA, 14 bp, Homo sapiens
cagcagtgttcccc

SEQ ID NO: 3854726 - DNA, 20 bp, Homo sapiens
cagcagttccatgaagacac

SEQ ID NO: 3854727 - DNA, 17 bp, Homo sapiens
cagcagttgaaaagact

SEQ ID NO: 3854728 - DNA, 20 bp, Homo sapiens
cagcagttgaaaagactcca

SEQ ID NO: 3854729 - DNA, 16 bp, Homo sapiens
cagcatacctgctggt

SEQ ID NO: 3854730 - DNA, 14 bp, Homo sapiens
cagcataccttgga

SEQ ID NO: 3854731 - DNA, 18 bp, Homo sapiens
cagcatatttatagcaat

SEQ ID NO: 3854732 - DNA, 18 bp, Homo sapiens
cagcatccagcctgtgtg

SEQ ID NO: 3854733 - DNA, 16 bp, Homo sapiens
cagcatcctgcttcct

SEQ ID NO: 3854734 - DNA, 12 bp, Homo sapiens
cagcatgtacaa

SEQ ID NO: 3854735 - DNA, 17 bp, Homo sapiens
cagcattattcctccag

SEQ ID NO: 3854736 - DNA, 20 bp, Homo sapiens
cagcattcagcacaccccaa

SEQ ID NO: 3854737 - DNA, 21 bp, Homo sapiens
cagcattcagcacaccccaag

SEQ ID NO: 3854738 - DNA, 14 bp, Homo sapiens
cagcattctcactc

SEQ ID NO: 3854739 - DNA, 13 bp, Homo sapiens
cagcattttacta

SEQ ID NO: 3854740 - DNA, 21 bp, Homo sapiens
cagcattttcacattttgcct

SEQ ID NO: 3854741 - DNA, 12 bp, Homo sapiens
cagccaaacaca

SEQ ID NO: 3854742 - DNA, 17 bp, Homo sapiens
cagccaaacacagagcg

SEQ ID NO: 3854743 - DNA, 20 bp, Homo sapiens
cagccaaataaaacctcagg

SEQ ID NO: 3854744 - DNA, 13 bp, Homo sapiens
cagccaactcatt

SEQ ID NO: 3854745 - DNA, 18 bp, Homo sapiens
cagccacacttctcagga

SEQ ID NO: 3854746 - DNA, 12 bp, Homo sapiens
cagccaccctga

SEQ ID NO: 3854747 - DNA, 18 bp, Homo sapiens
cagccaccctgaggagtc

SEQ ID NO: 3854748 - DNA, 19 bp, Homo sapiens
cagccaccctgaggagtct

SEQ ID NO: 3854749 - DNA, 21 bp, Homo sapiens
cagccaccctgaggagtctga

SEQ ID NO: 3854750 - DNA, 17 bp, Homo sapiens
cagccacctaaaaacat

SEQ ID NO: 3854751 - DNA, 13 bp, Homo sapiens
cagccacttggtt

SEQ ID NO: 3854752 - DNA, 18 bp, Homo sapiens
cagccagactggcacagt

SEQ ID NO: 3854753 - DNA, 13 bp, Homo sapiens
cagccagccagtc

SEQ ID NO: 3854754 - DNA, 12 bp, Homo sapiens
cagccagcccag

SEQ ID NO: 3854755 - DNA, 14 bp, Homo sapiens
cagccagcccagcc

SEQ ID NO: 3854756 - DNA, 13 bp, Homo sapiens
cagccagccctgc

SEQ ID NO: 3854757 - DNA, 19 bp, Homo sapiens
cagccagccctgcctggag

SEQ ID NO: 3854758 - DNA, 22 bp, Homo sapiens
cagccagccctgcctggaggac

SEQ ID NO: 3854759 - DNA, 19 bp, Homo sapiens
cagccagccgccctgggct

SEQ ID NO: 3854760 - DNA, 15 bp, Homo sapiens
cagccagggccaggg

SEQ ID NO: 3854761 - DNA, 13 bp, Homo sapiens
cagccaggggctg

SEQ ID NO: 3854762 - DNA, 15 bp, Homo sapiens
cagccaggggctgct

SEQ ID NO: 3854763 - DNA, 18 bp, Homo sapiens
cagccaggggctgctcat

SEQ ID NO: 3854764 - DNA, 23 bp, Homo sapiens
cagccaggttagcctttgccctg

SEQ ID NO: 3854765 - DNA, 15 bp, Homo sapiens
cagccagtcttgcct

SEQ ID NO: 3854766 - DNA, 16 bp, Homo sapiens
cagccagtcttgccta

SEQ ID NO: 3854767 - DNA, 19 bp, Homo sapiens
cagccatcacaaggggaac

SEQ ID NO: 3854768 - DNA, 22 bp, Homo sapiens
cagccatgaccagttctggcca

SEQ ID NO: 3854769 - DNA, 13 bp, Homo sapiens
cagccatgcctca

SEQ ID NO: 3854770 - DNA, 13 bp, Homo sapiens
cagccatgtttgg

SEQ ID NO: 3854771 - DNA, 14 bp, Homo sapiens
cagcccacacccct

SEQ ID NO: 3854772 - DNA, 20 bp, Homo sapiens
cagcccacacccctccaaag

SEQ ID NO: 3854773 - DNA, 19 bp, Homo sapiens
cagcccacatagtgatggt

SEQ ID NO: 3854774 - DNA, 15 bp, Homo sapiens
cagcccagcttcctg

SEQ ID NO: 3854775 - DNA, 16 bp, Homo sapiens
cagcccagcttcctgg

SEQ ID NO: 3854776 - DNA, 19 bp, Homo sapiens
cagcccaggtcctcccggg

SEQ ID NO: 3854777 - DNA, 23 bp, Homo sapiens
cagcccattctctctcctgtcca

SEQ ID NO: 3854778 - DNA, 17 bp, Homo sapiens
cagccccaaaccagggt

SEQ ID NO: 3854779 - DNA, 12 bp, Homo sapiens
cagccccacagc

SEQ ID NO: 3854780 - DNA, 19 bp, Homo sapiens
cagccccacagcacccagg

SEQ ID NO: 3854781 - DNA, 22 bp, Homo sapiens
cagccccacagcacccaggctc

SEQ ID NO: 3854782 - DNA, 24 bp, Homo sapiens
cagccccacagcacccaggctcca

SEQ ID NO: 3854783 - DNA, 22 bp, Homo sapiens
cagcccccactttcctacaaaa

SEQ ID NO: 3854784 - DNA, 19 bp, Homo sapiens
cagccccctaagagagcac

SEQ ID NO: 3854785 - DNA, 14 bp, Homo sapiens
cagccccctggatg

SEQ ID NO: 3854786 - DNA, 14 bp, Homo sapiens
cagcccctcctctg

SEQ ID NO: 3854787 - DNA, 16 bp, Homo sapiens
cagcccctcctctgcc

SEQ ID NO: 3854788 - DNA, 23 bp, Homo sapiens
cagcccctcctctgccacctccc

SEQ ID NO: 3854789 - DNA, 16 bp, Homo sapiens
cagcccgaagcccagt

SEQ ID NO: 3854790 - DNA, 14 bp, Homo sapiens
cagcccggcctgct

SEQ ID NO: 3854791 - DNA, 21 bp, Homo sapiens
cagcccggcctgctcccagca

SEQ ID NO: 3854792 - DNA, 23 bp, Homo sapiens
cagcccggcctgctcccagcagc

SEQ ID NO: 3854793 - DNA, 19 bp, Homo sapiens
cagcccgtgaagcagtgcc

SEQ ID NO: 3854794 - DNA, 20 bp, Homo sapiens
caggcccctgaggactggag

SEQ ID NO: 3854795 - DNA, 18 bp, Homo sapiens
caggcccgacagagagat

SEQ ID NO: 3854796 - DNA, 19 bp, Homo sapiens
caggcccggcgcggtggct

SEQ ID NO: 3854797 - DNA, 14 bp, Homo sapiens
caggcccggggctg

SEQ ID NO: 3854798 - DNA, 23 bp, Homo sapiens
caggcccggggggaccaggatga

SEQ ID NO: 3854799 - DNA, 16 bp, Homo sapiens
caggccctccctgact

SEQ ID NO: 3854800 - DNA, 15 bp, Homo sapiens
caggcccttcctctc

SEQ ID NO: 3854801 - DNA, 19 bp, Homo sapiens
caggcccttcctctccact

SEQ ID NO: 3854802 - DNA, 18 bp, Homo sapiens
caggccgttccccttggc

SEQ ID NO: 3854803 - DNA, 20 bp, Homo sapiens
caggccgttccccttggctt

SEQ ID NO: 3854804 - DNA, 19 bp, Homo sapiens
caggcctaatctcatacct

SEQ ID NO: 3854805 - DNA, 13 bp, Homo sapiens
caggcctccagcc

SEQ ID NO: 3854806 - DNA, 16 bp, Homo sapiens
caggcctccagcctct

SEQ ID NO: 3854807 - DNA, 19 bp, Homo sapiens
caggcctccagcctctccc

SEQ ID NO: 3854808 - DNA, 12 bp, Homo sapiens
caggcctctgtg

SEQ ID NO: 3854809 - DNA, 22 bp, Homo sapiens
caggcctctgtgtccttccctg

SEQ ID NO: 3854810 - DNA, 11 bp, Homo sapiens
caggcctggga

SEQ ID NO: 3854811 - DNA, 16 bp, Homo sapiens
caggcctgggacccag

SEQ ID NO: 3854812 - DNA, 17 bp, Homo sapiens
caggcctgggacccagc

SEQ ID NO: 3854813 - DNA, 24 bp, Homo sapiens
caggcctgggacccagctactctg

SEQ ID NO: 3854814 - DNA, 20 bp, Homo sapiens
caggcctgtgtagctgtgac

SEQ ID NO: 3854815 - DNA, 23 bp, Homo sapiens
caggcctgtgtagctgtgacctg

SEQ ID NO: 3854816 - DNA, 17 bp, Homo sapiens
caggcgccccttccccc

SEQ ID NO: 3854817 - DNA, 23 bp, Homo sapiens
caggcgctggacagaggggcagg

SEQ ID NO: 3854818 - DNA, 17 bp, Homo sapiens
caggcgttggtgccact

SEQ ID NO: 3854819 - DNA, 18 bp, Homo sapiens
caggcgttggtgccactt

SEQ ID NO: 3854820 - DNA, 15 bp, Homo sapiens
caggctagaacctgg

SEQ ID NO: 3854821 - DNA, 20 bp, Homo sapiens
caggctatttgttcagagag

SEQ ID NO: 3854822 - DNA, 15 bp, Homo sapiens
caggctcagactctg

SEQ ID NO: 3854823 - DNA, 14 bp, Homo sapiens
caggctccatgggg

SEQ ID NO: 3854824 - DNA, 18 bp, Homo sapiens
caggctccatggggaagt

SEQ ID NO: 3854825 - DNA, 16 bp, Homo sapiens
caggctctgcctggag

SEQ ID NO: 3854826 - DNA, 12 bp, Homo sapiens
caggctctggga

SEQ ID NO: 3854827 - DNA, 13 bp, Homo sapiens
caggctctgggct

SEQ ID NO: 3854828 - DNA, 22 bp, Homo sapiens
caggctctgggctcagggctgg

SEQ ID NO: 3854829 - DNA, 21 bp, Homo sapiens
caggctcttcctggacctgag

SEQ ID NO: 3854830 - DNA, 17 bp, Homo sapiens
caggctgcactgcagtg

SEQ ID NO: 3854831 - DNA, 22 bp, Homo sapiens
caggctgtaagcattctgagct

SEQ ID NO: 3854832 - DNA, 23 bp, Homo sapiens
caggctgtaagcattctgagctg

SEQ ID NO: 3854833 - DNA, 17 bp, Homo sapiens
caggctgttctgcactg

SEQ ID NO: 3854834 - DNA, 18 bp, Homo sapiens
caggctgttctgcactga

SEQ ID NO: 3854835 - DNA, 19 bp, Homo sapiens
caggctgttctgcactgaa

SEQ ID NO: 3854836 - DNA, 22 bp, Homo sapiens
caggctgttctgcactgaaaag

SEQ ID NO: 3854837 - DNA, 22 bp, Homo sapiens
caggcttcaccctgaatggttc

SEQ ID NO: 3854838 - DNA, 21 bp, Homo sapiens
caggcttcggacagtgcccat

SEQ ID NO: 3854839 - DNA, 16 bp, Homo sapiens
cagggaaatggagggt

SEQ ID NO: 3854840 - DNA, 21 bp, Homo sapiens
cagggaaatggagggtggggc

SEQ ID NO: 3854841 - DNA, 19 bp, Homo sapiens
cagggaaccctgcttgcac

SEQ ID NO: 3854842 - DNA, 22 bp, Homo sapiens
cagggaaccctgcttgcacttt

SEQ ID NO: 3854843 - DNA, 22 bp, Homo sapiens
cagggaagagcagaacggagcc

SEQ ID NO: 3854844 - DNA, 13 bp, Homo sapiens
cagggaaggcagg

SEQ ID NO: 3854845 - DNA, 15 bp, Homo sapiens
cagggaaggcaggca

SEQ ID NO: 3854846 - DNA, 18 bp, Homo sapiens
cagggaaggcaggcaggg

SEQ ID NO: 3854847 - DNA, 14 bp, Homo sapiens
cagggacagagaca

SEQ ID NO: 3854848 - DNA, 17 bp, Homo sapiens
cagggacagagacacct

SEQ ID NO: 3854849 - DNA, 18 bp, Homo sapiens
cagggacagagacacctg

SEQ ID NO: 3854850 - DNA, 20 bp, Homo sapiens
cagggacagagacacctgca

SEQ ID NO: 3854851 - DNA, 18 bp, Homo sapiens
cagggactgttcctgtct

SEQ ID NO: 3854852 - DNA, 17 bp, Homo sapiens
cagggagcaactctcca

SEQ ID NO: 3854853 - DNA, 15 bp, Homo sapiens
caccactccattccc

SEQ ID NO: 3854854 - DNA, 14 bp, Homo sapiens
caccactctggcag

SEQ ID NO: 3854855 - DNA, 18 bp, Homo sapiens
caccactctggcagccac

SEQ ID NO: 3854856 - DNA, 14 bp, Homo sapiens
caccactgccctgc

SEQ ID NO: 3854857 - DNA, 21 bp, Homo sapiens
caccactgccctgcctgccca

SEQ ID NO: 3854858 - DNA, 23 bp, Homo sapiens
caccagaggctgcagaaggccaa

SEQ ID NO: 3854859 - DNA, 23 bp, Homo sapiens
caccagatgcaacctcactatgg

SEQ ID NO: 3854860 - DNA, 16 bp, Homo sapiens
caccagccccctggat

SEQ ID NO: 3854861 - DNA, 20 bp, Homo sapiens
caccagccccctggatgggc

SEQ ID NO: 3854862 - DNA, 24 bp, Homo sapiens
caccagccccctggatgggcattg

SEQ ID NO: 3854863 - DNA, 14 bp, Homo sapiens
caccagcccttccc

SEQ ID NO: 3854864 - DNA, 19 bp, Homo sapiens
caccagcccttccctgctt

SEQ ID NO: 3854865 - DNA, 20 bp, Homo sapiens
caccagcccttccctgcttt

SEQ ID NO: 3854866 - DNA, 14 bp, Homo sapiens
caccagctctgtgg

SEQ ID NO: 3854867 - DNA, 16 bp, Homo sapiens
caccagctctgtggcc

SEQ ID NO: 3854868 - DNA, 18 bp, Homo sapiens
caccagctctgtggcctg

SEQ ID NO: 3854869 - DNA, 21 bp, Homo sapiens
caccagctctgtggcctgtgt

SEQ ID NO: 3854870 - DNA, 20 bp, Homo sapiens
caccagctgccaaaatcgta

SEQ ID NO: 3854871 - DNA, 13 bp, Homo sapiens
caccagctgctct

SEQ ID NO: 3854872 - DNA, 19 bp, Homo sapiens
caccagctgctctgcccct

SEQ ID NO: 3854873 - DNA, 11 bp, Homo sapiens
caccaggatga

SEQ ID NO: 3854874 - DNA, 21 bp, Homo sapiens
caccaggatggcccttcccac

SEQ ID NO: 3854875 - DNA, 12 bp, Homo sapiens
caccatatgcaa

SEQ ID NO: 3854876 - DNA, 14 bp, Homo sapiens
caccatcacacatg

SEQ ID NO: 3854877 - DNA, 17 bp, Homo sapiens
caccatcaccctctggg

SEQ ID NO: 3854878 - DNA, 21 bp, Homo sapiens
caccatcctgcagcctcctcc

SEQ ID NO: 3854879 - DNA, 18 bp, Homo sapiens
caccatggaggcaggctc

SEQ ID NO: 3854880 - DNA, 22 bp, Homo sapiens
caccatggaggcaggctccccc

SEQ ID NO: 3854881 - DNA, 23 bp, Homo sapiens
caccatggaggcaggctccccct

SEQ ID NO: 3854882 - DNA, 19 bp, Homo sapiens
caccatgtttgagctcaga

SEQ ID NO: 3854883 - DNA, 20 bp, Homo sapiens
caccattcacatttgatgta

SEQ ID NO: 3854884 - DNA, 14 bp, Homo sapiens
cacccaaaagtcaa

SEQ ID NO: 3854885 - DNA, 23 bp, Homo sapiens
cacccaaaagtcaaaaggtgcct

SEQ ID NO: 3854886 - DNA, 17 bp, Homo sapiens
cacccaacagctcagag

SEQ ID NO: 3854887 - DNA, 20 bp, Homo sapiens
cacccaacagctcagagatg

SEQ ID NO: 3854888 - DNA, 22 bp, Homo sapiens
cacccaagtccaggcccaagga

SEQ ID NO: 3854889 - DNA, 13 bp, Homo sapiens
cacccacagggct

SEQ ID NO: 3854890 - DNA, 23 bp, Homo sapiens
cacccacgtgagagaatctgcct

SEQ ID NO: 3854891 - DNA, 11 bp, Homo sapiens
cacccactggc

SEQ ID NO: 3854892 - DNA, 16 bp, Homo sapiens
cacccactggccagtc

SEQ ID NO: 3854893 - DNA, 19 bp, Homo sapiens
cacccactgtccgcctctg

SEQ ID NO: 3854894 - DNA, 21 bp, Homo sapiens
cacccagaaattccttcccac

SEQ ID NO: 3854895 - DNA, 21 bp, Homo sapiens
cacccagagggtagggcagca

SEQ ID NO: 3854896 - DNA, 22 bp, Homo sapiens
cacccagagggtagggcagcag

SEQ ID NO: 3854897 - DNA, 10 bp, Homo sapiens
cacccagccc

SEQ ID NO: 3854898 - DNA, 22 bp, Homo sapiens
cacccagcccattctctctcct

SEQ ID NO: 3854899 - DNA, 22 bp, Homo sapiens
cacccaggctctggagccagag

SEQ ID NO: 3854900 - DNA, 13 bp, Homo sapiens
cacccaggctgca

SEQ ID NO: 3854901 - DNA, 17 bp, Homo sapiens
cacccaggctgcactgc

SEQ ID NO: 3854902 - DNA, 15 bp, Homo sapiens
cacccagggctccct

SEQ ID NO: 3854903 - DNA, 21 bp, Homo sapiens
cacccagggctccctcctgga

SEQ ID NO: 3854904 - DNA, 14 bp, Homo sapiens
cacccagtcctggc

SEQ ID NO: 3854905 - DNA, 13 bp, Homo sapiens
cacccagtgctgc

SEQ ID NO: 3854906 - DNA, 16 bp, Homo sapiens
cacccagtgctgccat

SEQ ID NO: 3854907 - DNA, 18 bp, Homo sapiens
cacccagtgctgccatgc

SEQ ID NO: 3854908 - DNA, 21 bp, Homo sapiens
cacccagtgctgccatgccac

SEQ ID NO: 3854909 - DNA, 23 bp, Homo sapiens
catccctgggcctgctgctgaga

SEQ ID NO: 3854910 - DNA, 14 bp, Homo sapiens
catcccttcctccc

SEQ ID NO: 3854911 - DNA, 16 bp, Homo sapiens
catcccttcctcccca

SEQ ID NO: 3854912 - DNA, 19 bp, Homo sapiens
catccggagaattgcctct

SEQ ID NO: 3854913 - DNA, 20 bp, Homo sapiens
catccggagaattgcctcta

SEQ ID NO: 3854914 - DNA, 20 bp, Homo sapiens
catccgggacgcttccagac

SEQ ID NO: 3854915 - DNA, 19 bp, Homo sapiens
catcctaagtgggaagtga

SEQ ID NO: 3854916 - DNA, 20 bp, Homo sapiens
catcctccttataagcccag

SEQ ID NO: 3854917 - DNA, 12 bp, Homo sapiens
catcctggcctc

SEQ ID NO: 3854918 - DNA, 11 bp, Homo sapiens
catccttaaag

SEQ ID NO: 3854919 - DNA, 19 bp, Homo sapiens
catcgaacaaactgatgcg

SEQ ID NO: 3854920 - DNA, 22 bp, Homo sapiens
catcggaggctgggcccctggg

SEQ ID NO: 3854921 - DNA, 13 bp, Homo sapiens
catcgggctgagg

SEQ ID NO: 3854922 - DNA, 21 bp, Homo sapiens
catcgtagaagagatgtggca

SEQ ID NO: 3854923 - DNA, 16 bp, Homo sapiens
catcgtccttcctctc

SEQ ID NO: 3854924 - DNA, 13 bp, Homo sapiens
catcgtgaccctt

SEQ ID NO: 3854925 - DNA, 16 bp, Homo sapiens
catcgtgacccttcag

SEQ ID NO: 3854926 - DNA, 14 bp, Homo sapiens
catctaagctgcag

SEQ ID NO: 3854927 - DNA, 15 bp, Homo sapiens
catctaagctgcagc

SEQ ID NO: 3854928 - DNA, 16 bp, Homo sapiens
catctaagctgcagct

SEQ ID NO: 3854929 - DNA, 23 bp, Homo sapiens
catctaagctgcagcttcctgtc

SEQ ID NO: 3854930 - DNA, 22 bp, Homo sapiens
catctaatgtctcttcctctgt

SEQ ID NO: 3854931 - DNA, 15 bp, Homo sapiens
catctactacagggt

SEQ ID NO: 3854932 - DNA, 21 bp, Homo sapiens
catctcaaatccttgagcact

SEQ ID NO: 3854933 - DNA, 16 bp, Homo sapiens
catctcactgcccagt

SEQ ID NO: 3854934 - DNA, 13 bp, Homo sapiens
catctcaggtgcc

SEQ ID NO: 3854935 - DNA, 19 bp, Homo sapiens
catctcaggtgccactccc

SEQ ID NO: 3854936 - DNA, 14 bp, Homo sapiens
catctccactccag

SEQ ID NO: 3854937 - DNA, 23 bp, Homo sapiens
catctccatttcacacaggtcct

SEQ ID NO: 3854938 - DNA, 14 bp, Homo sapiens
catctccccaggcc

SEQ ID NO: 3854939 - DNA, 19 bp, Homo sapiens
catctccccaggcctccag

SEQ ID NO: 3854940 - DNA, 15 bp, Homo sapiens
catctccctcccaca

SEQ ID NO: 3854941 - DNA, 16 bp, Homo sapiens
catctcgagccccctg

SEQ ID NO: 3854942 - DNA, 18 bp, Homo sapiens
catctcgagccccctgga

SEQ ID NO: 3854943 - DNA, 19 bp, Homo sapiens
catctctaattggaagaaa

SEQ ID NO: 3854944 - DNA, 14 bp, Homo sapiens
catctctctggggc

SEQ ID NO: 3854945 - DNA, 13 bp, Homo sapiens
catctgaaagcca

SEQ ID NO: 3854946 - DNA, 18 bp, Homo sapiens
catctgagcaagagctgg

SEQ ID NO: 3854947 - DNA, 23 bp, Homo sapiens
catctgcaccctcgatgaagccc

SEQ ID NO: 3854948 - DNA, 18 bp, Homo sapiens
catctgcttggttggctg

SEQ ID NO: 3854949 - DNA, 15 bp, Homo sapiens
catctgtgtgaaaat

SEQ ID NO: 3854950 - DNA, 17 bp, Homo sapiens
catctgttatcctgcta

SEQ ID NO: 3854951 - DNA, 17 bp, Homo sapiens
catcttaaatgacagtg

SEQ ID NO: 3854952 - DNA, 20 bp, Homo sapiens
catcttatttacttgtagaa

SEQ ID NO: 3854953 - DNA, 13 bp, Homo sapiens
catcttcagctcc

SEQ ID NO: 3854954 - DNA, 16 bp, Homo sapiens
catcttcagctcccat

SEQ ID NO: 3854955 - DNA, 17 bp, Homo sapiens
catcttcagctcccata

SEQ ID NO: 3854956 - DNA, 14 bp, Homo sapiens
catcttcctgctgc

SEQ ID NO: 3854957 - DNA, 17 bp, Homo sapiens
catcttcctgctgctgt

SEQ ID NO: 3854958 - DNA, 18 bp, Homo sapiens
catcttcctgctgctgta

SEQ ID NO: 3854959 - DNA, 13 bp, Homo sapiens
catcttctcagtg

SEQ ID NO: 3854960 - DNA, 17 bp, Homo sapiens
catcttctctctttttt

SEQ ID NO: 3854961 - DNA, 13 bp, Homo sapiens
catcttgacatgt

SEQ ID NO: 3854962 - DNA, 18 bp, Homo sapiens
catcttgccccctcatct

SEQ ID NO: 3854963 - DNA, 20 bp, Homo sapiens
catctttcctccaaactcct

SEQ ID NO: 3854964 - DNA, 14 bp, Homo sapiens
catctttctttgga

SEQ ID NO: 3854965 - DNA, 21 bp, Homo sapiens
catctttttcctccctttccc

SEQ ID NO: 3854966 - DNA, 19 bp, Homo sapiens
catgaaaaacacggcagct

SEQ ID NO: 3854967 - DNA, 20 bp, Homo sapiens
catgaagtgtgtttccttca

SEQ ID NO: 3854968 - DNA, 18 bp, Homo sapiens
catgaattcttatgctta

SEQ ID NO: 3854969 - DNA, 12 bp, Homo sapiens
catgacatgtta

SEQ ID NO: 3854970 - DNA, 15 bp, Homo sapiens
catgacttttccatg

SEQ ID NO: 3854971 - DNA, 16 bp, Homo sapiens
catgagaagagggcct

SEQ ID NO: 3854972 - DNA, 15 bp, Homo sapiens
catatcggaggtggt

SEQ ID NO: 3854973 - DNA, 20 bp, Homo sapiens
catatcggaggtggtggagg

SEQ ID NO: 3854974 - DNA, 13 bp, Homo sapiens
catatgacatgcc

SEQ ID NO: 3854975 - DNA, 18 bp, Homo sapiens
catatgacatgccaccct

SEQ ID NO: 3854976 - DNA, 19 bp, Homo sapiens
catatgacatgccaccctc

SEQ ID NO: 3854977 - DNA, 13 bp, Homo sapiens
catatgtaaaata

SEQ ID NO: 3854978 - DNA, 17 bp, Homo sapiens
catatgtagactatata

SEQ ID NO: 3854979 - DNA, 19 bp, Homo sapiens
catatgtagactatataca

SEQ ID NO: 3854980 - DNA, 21 bp, Homo sapiens
catatgtagactatatacatg

SEQ ID NO: 3854981 - DNA, 23 bp, Homo sapiens
catatgtagactatatacatgtg

SEQ ID NO: 3854982 - DNA, 13 bp, Homo sapiens
catatgtagccct

SEQ ID NO: 3854983 - DNA, 15 bp, Homo sapiens
catatgtagccctca

SEQ ID NO: 3854984 - DNA, 20 bp, Homo sapiens
catatgtctgcttctgtcca

SEQ ID NO: 3854985 - DNA, 17 bp, Homo sapiens
catatgtgaatatggac

SEQ ID NO: 3854986 - DNA, 13 bp, Homo sapiens
catattataaata

SEQ ID NO: 3854987 - DNA, 14 bp, Homo sapiens
catattataaataa

SEQ ID NO: 3854988 - DNA, 16 bp, Homo sapiens
catattataaataaat

SEQ ID NO: 3854989 - DNA, 17 bp, Homo sapiens
catattataaataaatg

SEQ ID NO: 3854990 - DNA, 21 bp, Homo sapiens
catattataaataaatgccaa

SEQ ID NO: 3854991 - DNA, 16 bp, Homo sapiens
catattgaatgtttcc

SEQ ID NO: 3854992 - DNA, 20 bp, Homo sapiens
catattggaaaggtcattgt

SEQ ID NO: 3854993 - DNA, 17 bp, Homo sapiens
catattggcatggattt

SEQ ID NO: 3854994 - DNA, 18 bp, Homo sapiens
catattgtatgtaagtaa

SEQ ID NO: 3854995 - DNA, 14 bp, Homo sapiens
catatttaaagaca

SEQ ID NO: 3854996 - DNA, 22 bp, Homo sapiens
catatttatagcaatccatgtt

SEQ ID NO: 3854997 - DNA, 14 bp, Homo sapiens
catatttctttggc

SEQ ID NO: 3854998 - DNA, 14 bp, Homo sapiens
catcaccatgcatg

SEQ ID NO: 3854999 - DNA, 16 bp, Homo sapiens
catcacccagtcctgg

SEQ ID NO: 3855000 - DNA, 21 bp, Homo sapiens
catcaccctctgggcagctgt

SEQ ID NO: 3855001 - DNA, 19 bp, Homo sapiens
catcaccgacgcgtctcct

SEQ ID NO: 3855002 - DNA, 22 bp, Homo sapiens
catcacctttttgacttttcca

SEQ ID NO: 3855003 - DNA, 14 bp, Homo sapiens
catcactccctgga

SEQ ID NO: 3855004 - DNA, 17 bp, Homo sapiens
catcactccctggatgt

SEQ ID NO: 3855005 - DNA, 14 bp, Homo sapiens
catcacttggggtc

SEQ ID NO: 3855006 - DNA, 15 bp, Homo sapiens
catcacttgtacaaa

SEQ ID NO: 3855007 - DNA, 17 bp, Homo sapiens
catcagcatacctttat

SEQ ID NO: 3855008 - DNA, 18 bp, Homo sapiens
catcagcatacctttatt

SEQ ID NO: 3855009 - DNA, 20 bp, Homo sapiens
catcagcatacctttattgt

SEQ ID NO: 3855010 - DNA, 11 bp, Homo sapiens
catcagctccc

SEQ ID NO: 3855011 - DNA, 13 bp, Homo sapiens
catcaggcactgg

SEQ ID NO: 3855012 - DNA, 17 bp, Homo sapiens
catcaggcactggtggc

SEQ ID NO: 3855013 - DNA, 12 bp, Homo sapiens
catcagggtggg

SEQ ID NO: 3855014 - DNA, 23 bp, Homo sapiens
catcagggtgggccactctcccc

SEQ ID NO: 3855015 - DNA, 21 bp, Homo sapiens
catcagtcattcccacgcttg

SEQ ID NO: 3855016 - DNA, 16 bp, Homo sapiens
catcatatgacatgcc

SEQ ID NO: 3855017 - DNA, 23 bp, Homo sapiens
catcatcaggcttggaatgaatt

SEQ ID NO: 3855018 - DNA, 13 bp, Homo sapiens
catcatcccagct

SEQ ID NO: 3855019 - DNA, 14 bp, Homo sapiens
catcatcctcctta

SEQ ID NO: 3855020 - DNA, 22 bp, Homo sapiens
catcatgcctctgaggccagcc

SEQ ID NO: 3855021 - DNA, 14 bp, Homo sapiens
catccaaggagaaa

SEQ ID NO: 3855022 - DNA, 15 bp, Homo sapiens
catccaatgcatagt

SEQ ID NO: 3855023 - DNA, 14 bp, Homo sapiens
catccacccagtgc

SEQ ID NO: 3855024 - DNA, 16 bp, Homo sapiens
catccacccagtgctg

SEQ ID NO: 3855025 - DNA, 18 bp, Homo sapiens
catccacccagtgctgcc

SEQ ID NO: 3855026 - DNA, 19 bp, Homo sapiens
catccacccagtgctgcca

SEQ ID NO: 3855027 - DNA, 12 bp, Homo sapiens
catccagcctgt

SEQ ID NO: 3855028 - DNA, 14 bp, Homo sapiens
catccagcctgtgt

SEQ ID NO: 3855029 - DNA, 22 bp, Homo sapiens
catccaggaggaataagctccc

SEQ ID NO: 3855030 - DNA, 18 bp, Homo sapiens
catccagttgcaataaaa

SEQ ID NO: 3855031 - DNA, 20 bp, Homo sapiens
catccagttgcaataaaata

SEQ ID NO: 3855032 - DNA, 21 bp, Homo sapiens
catccagttgcaataaaatag

SEQ ID NO: 3855033 - DNA, 21 bp, Homo sapiens
catccagtttgttctccgggt

SEQ ID NO: 3855034 - DNA, 18 bp, Homo sapiens
catgtttctgggtgggtg

SEQ ID NO: 3855035 - DNA, 19 bp, Homo sapiens
catgtttgagctcagaccc

SEQ ID NO: 3855036 - DNA, 23 bp, Homo sapiens
catgtttgagctcagacccccac

SEQ ID NO: 3855037 - DNA, 12 bp, Homo sapiens
catgttttgtat

SEQ ID NO: 3855038 - DNA, 17 bp, Homo sapiens
catgtttttgttttctt

SEQ ID NO: 3855039 - DNA, 16 bp, Homo sapiens
cattaaacactgtaat

SEQ ID NO: 3855040 - DNA, 17 bp, Homo sapiens
cattaaacactgtaatc

SEQ ID NO: 3855041 - DNA, 18 bp, Homo sapiens
cattaaacactgtaatct

SEQ ID NO: 3855042 - DNA, 13 bp, Homo sapiens
cattaaatccgca

SEQ ID NO: 3855043 - DNA, 18 bp, Homo sapiens
cattaagacacacctctg

SEQ ID NO: 3855044 - DNA, 12 bp, Homo sapiens
cattaattatta

SEQ ID NO: 3855045 - DNA, 13 bp, Homo sapiens
cattaattattaa

SEQ ID NO: 3855046 - DNA, 16 bp, Homo sapiens
cattaattattaatac

SEQ ID NO: 3855047 - DNA, 19 bp, Homo sapiens
cattaattattattgctgt

SEQ ID NO: 3855048 - DNA, 17 bp, Homo sapiens
cattacatggctgtggt

SEQ ID NO: 3855049 - DNA, 20 bp, Homo sapiens
cattacatgtttaaattgta

SEQ ID NO: 3855050 - DNA, 17 bp, Homo sapiens
cattactgcctttggaa

SEQ ID NO: 3855051 - DNA, 18 bp, Homo sapiens
cattacttgcacaagctt

SEQ ID NO: 3855052 - DNA, 23 bp, Homo sapiens
cattacttgcacaagcttgtata

SEQ ID NO: 3855053 - DNA, 21 bp, Homo sapiens
ccaagagagacattgcctcca

SEQ ID NO: 3855054 - DNA, 20 bp, Homo sapiens
ccaagagagggccatgcaat

SEQ ID NO: 3855055 - DNA, 20 bp, Homo sapiens
ccaagagcacattcttaaag

SEQ ID NO: 3855056 - DNA, 18 bp, Homo sapiens
ccaagagcatcatgcctc

SEQ ID NO: 3855057 - DNA, 21 bp, Homo sapiens
ccaagagcatcatgcctctga

SEQ ID NO: 3855058 - DNA, 22 bp, Homo sapiens
ccaagagcatcatgcctctgag

SEQ ID NO: 3855059 - DNA, 17 bp, Homo sapiens
ccaagaggactgagact

SEQ ID NO: 3855060 - DNA, 15 bp, Homo sapiens
ccaagaggtctgagc

SEQ ID NO: 3855061 - DNA, 12 bp, Homo sapiens
ccaagaggtggg

SEQ ID NO: 3855062 - DNA, 17 bp, Homo sapiens
ccaagatgggcacatga

SEQ ID NO: 3855063 - DNA, 21 bp, Homo sapiens
ccaagatgggcacatgaggag

SEQ ID NO: 3855064 - DNA, 24 bp, Homo sapiens
ccaagatgggcacatgaggagggt

SEQ ID NO: 3855065 - DNA, 21 bp, Homo sapiens
ccaagattggcctgaggctgc

SEQ ID NO: 3855066 - DNA, 20 bp, Homo sapiens
ccaagcaaaggtgaagagac

SEQ ID NO: 3855067 - DNA, 18 bp, Homo sapiens
ccaagcagcattcagcac

SEQ ID NO: 3855068 - DNA, 11 bp, Homo sapiens
ccaagcagcca

SEQ ID NO: 3855069 - DNA, 12 bp, Homo sapiens
ccaagcagccag

SEQ ID NO: 3855070 - DNA, 18 bp, Homo sapiens
ccaagccattcacttccc

SEQ ID NO: 3855071 - DNA, 21 bp, Homo sapiens
ccaagccccttggccctctcc

SEQ ID NO: 3855072 - DNA, 17 bp, Homo sapiens
ccaagccgtggcttccc

SEQ ID NO: 3855073 - DNA, 23 bp, Homo sapiens
ccaagccgtggcttcccgctcag

SEQ ID NO: 3855074 - DNA, 14 bp, Homo sapiens
ccaagcctctgccc

SEQ ID NO: 3855075 - DNA, 13 bp, Homo sapiens
ccaagcctggtct

SEQ ID NO: 3855076 - DNA, 13 bp, Homo sapiens
ccaagctcacagt

SEQ ID NO: 3855077 - DNA, 14 bp, Homo sapiens
ccaagctccatctc

SEQ ID NO: 3855078 - DNA, 22 bp, Homo sapiens
ccaagctgaggtgcccaggaga

SEQ ID NO: 3855079 - DNA, 23 bp, Homo sapiens
ccaagctgaggtgcccaggagaa

SEQ ID NO: 3855080 - DNA, 21 bp, Homo sapiens
ccaagctgttccacttctcta

SEQ ID NO: 3855081 - DNA, 17 bp, Homo sapiens
ccaagctgttttcttct

SEQ ID NO: 3855082 - DNA, 19 bp, Homo sapiens
ccaagcttcaagtgatata

SEQ ID NO: 3855083 - DNA, 17 bp, Homo sapiens
ccaagcttcagagccta

SEQ ID NO: 3855084 - DNA, 23 bp, Homo sapiens
ccaagctttcttctacaaccaga

SEQ ID NO: 3855085 - DNA, 14 bp, Homo sapiens
ccaaggaccaggtt

SEQ ID NO: 3855086 - DNA, 17 bp, Homo sapiens
ccaaggactctggcctc

SEQ ID NO: 3855087 - DNA, 19 bp, Homo sapiens
ccaaggagaaacagagaca

SEQ ID NO: 3855088 - DNA, 21 bp, Homo sapiens
ccaaggagctgatttccaggc

SEQ ID NO: 3855089 - DNA, 15 bp, Homo sapiens
ccaaggcagcctcca

SEQ ID NO: 3855090 - DNA, 17 bp, Homo sapiens
ccaaggcagcctccaga

SEQ ID NO: 3855091 - DNA, 18 bp, Homo sapiens
ccaaggcagcctccagag

SEQ ID NO: 3855092 - DNA, 20 bp, Homo sapiens
ccaaggcagcctccagagcc

SEQ ID NO: 3855093 - DNA, 23 bp, Homo sapiens
ccaaggcagcctccagagccagc

SEQ ID NO: 3855094 - DNA, 14 bp, Homo sapiens
ccaagggacaaccc

SEQ ID NO: 3855095 - DNA, 16 bp, Homo sapiens
ccaagggacaacccca

SEQ ID NO: 3855096 - DNA, 20 bp, Homo sapiens
ccaagggacaaccccatcat

SEQ ID NO: 3855097 - DNA, 22 bp, Homo sapiens
ccaaggggcccacaaaggggag

SEQ ID NO: 3855098 - DNA, 22 bp, Homo sapiens
ccaaggggtctgtatatacatt

SEQ ID NO: 3855099 - DNA, 19 bp, Homo sapiens
ccaagggtatgggaagcca

SEQ ID NO: 3855100 - DNA, 20 bp, Homo sapiens
ccaagggtatgggaagccat

SEQ ID NO: 3855101 - DNA, 19 bp, Homo sapiens
ccaaggtcttcagccatca

SEQ ID NO: 3855102 - DNA, 21 bp, Homo sapiens
ccaagtattttatctgtgttg

SEQ ID NO: 3855103 - DNA, 20 bp, Homo sapiens
ccaagtcaacactcttcttg

SEQ ID NO: 3855104 - DNA, 21 bp, Homo sapiens
ccaagtcaacactcttcttga

SEQ ID NO: 3855105 - DNA, 23 bp, Homo sapiens
ccaagtcaacactcttcttgagc

SEQ ID NO: 3855106 - DNA, 22 bp, Homo sapiens
ccaagtcttcagcgagaccctt

SEQ ID NO: 3855107 - DNA, 11 bp, Homo sapiens
ccaagtgccat

SEQ ID NO: 3855108 - DNA, 16 bp, Homo sapiens
ccaagtgccatcccac

SEQ ID NO: 3855109 - DNA, 16 bp, Homo sapiens
ccaagtgggggcagag

SEQ ID NO: 3855110 - DNA, 20 bp, Homo sapiens
ccaagttcctgcactccaga

SEQ ID NO: 3855111 - DNA, 11 bp, Homo sapiens
ccaataaaagt

SEQ ID NO: 3855112 - DNA, 24 bp, Homo sapiens
ccaataactaatgctaagaaatgc

SEQ ID NO: 3855113 - DNA, 21 bp, Homo sapiens
ccaatccaggtgggagagaca

SEQ ID NO: 3855114 - DNA, 14 bp, Homo sapiens
ccaatcccgtgaaa

SEQ ID NO: 3855115 - DNA, 18 bp, Homo sapiens
ccaatcccgtgaaagaat

SEQ ID NO: 3855116 - DNA, 14 bp, Homo sapiens
ccaatcctggcagg

SEQ ID NO: 3855117 - DNA, 21 bp, Homo sapiens
ccaatctgctcagcaggccct

SEQ ID NO: 3855118 - DNA, 17 bp, Homo sapiens
catgagaagagggcctg

SEQ ID NO: 3855119 - DNA, 22 bp, Homo sapiens
catgagaagagggcctgtggga

SEQ ID NO: 3855120 - DNA, 20 bp, Homo sapiens
catgagaataagagaaagaa

SEQ ID NO: 3855121 - DNA, 16 bp, Homo sapiens
catgagcaattctcct

SEQ ID NO: 3855122 - DNA, 17 bp, Homo sapiens
catgagggatcacaggg

SEQ ID NO: 3855123 - DNA, 20 bp, Homo sapiens
catgagggatcacagggccc

SEQ ID NO: 3855124 - DNA, 15 bp, Homo sapiens
catgagtggatggat

SEQ ID NO: 3855125 - DNA, 15 bp, Homo sapiens
catgatattttcaga

SEQ ID NO: 3855126 - DNA, 13 bp, Homo sapiens
catgatctccctg

SEQ ID NO: 3855127 - DNA, 15 bp, Homo sapiens
catgatctccctgcc

SEQ ID NO: 3855128 - DNA, 17 bp, Homo sapiens
catgatctccctgccgc

SEQ ID NO: 3855129 - DNA, 15 bp, Homo sapiens
catgatctcggctta

SEQ ID NO: 3855130 - DNA, 18 bp, Homo sapiens
catgatgagctcctcttc

SEQ ID NO: 3855131 - DNA, 16 bp, Homo sapiens
catgattcatgccaat

SEQ ID NO: 3855132 - DNA, 19 bp, Homo sapiens
catgatttagggaagcagg

SEQ ID NO: 3855133 - DNA, 22 bp, Homo sapiens
catgatttagggaagcagggac

SEQ ID NO: 3855134 - DNA, 12 bp, Homo sapiens
catgatttatat

SEQ ID NO: 3855135 - DNA, 18 bp, Homo sapiens
catgatttatatatggca

SEQ ID NO: 3855136 - DNA, 11 bp, Homo sapiens
catgattttac

SEQ ID NO: 3855137 - DNA, 13 bp, Homo sapiens
catgattttacag

SEQ ID NO: 3855138 - DNA, 14 bp, Homo sapiens
catgattttacaga

SEQ ID NO: 3855139 - DNA, 11 bp, Homo sapiens
catgattttat

SEQ ID NO: 3855140 - DNA, 16 bp, Homo sapiens
ccacccccgccacggc

SEQ ID NO: 3855141 - DNA, 15 bp, Homo sapiens
ccacccccgctgggg

SEQ ID NO: 3855142 - DNA, 18 bp, Homo sapiens
ccaccccctccccagggg

SEQ ID NO: 3855143 - DNA, 18 bp, Homo sapiens
ccacccccttcagtgccc

SEQ ID NO: 3855144 - DNA, 16 bp, Homo sapiens
ccaccccgtgccaccc

SEQ ID NO: 3855145 - DNA, 15 bp, Homo sapiens
ccaccccttcctgtc

SEQ ID NO: 3855146 - DNA, 22 bp, Homo sapiens
ccaccctcaaatgtcagagcta

SEQ ID NO: 3855147 - DNA, 15 bp, Homo sapiens
ccaccctctccatgc

SEQ ID NO: 3855148 - DNA, 15 bp, Homo sapiens
ccaccctgaggagtc

SEQ ID NO: 3855149 - DNA, 12 bp, Homo sapiens
ccaccctggccc

SEQ ID NO: 3855150 - DNA, 15 bp, Homo sapiens
ccaccctggcccgcc

SEQ ID NO: 3855151 - DNA, 21 bp, Homo sapiens
ccaccgaagaggaagcaagaa

SEQ ID NO: 3855152 - DNA, 16 bp, Homo sapiens
ccaccgcagaaggaag

SEQ ID NO: 3855153 - DNA, 14 bp, Homo sapiens
ccaccgctgcctaa

SEQ ID NO: 3855154 - DNA, 13 bp, Homo sapiens
ccaccgggccact

SEQ ID NO: 3855155 - DNA, 20 bp, Homo sapiens
ccaccgggccactccttcct

SEQ ID NO: 3855156 - DNA, 23 bp, Homo sapiens
ccaccgggctgggagctctgcag

SEQ ID NO: 3855157 - DNA, 16 bp, Homo sapiens
ccacctaggccactcc

SEQ ID NO: 3855158 - DNA, 18 bp, Homo sapiens
ccacctcactcctgttac

SEQ ID NO: 3855159 - DNA, 16 bp, Homo sapiens
ccacctcagccttgga

SEQ ID NO: 3855160 - DNA, 23 bp, Homo sapiens
ccacctccacccccgccacggcc

SEQ ID NO: 3855161 - DNA, 14 bp, Homo sapiens
ccacctcccacccc

SEQ ID NO: 3855162 - DNA, 17 bp, Homo sapiens
ccacctcccctatccac

SEQ ID NO: 3855163 - DNA, 19 bp, Homo sapiens
ccacctcccctatccaccc

SEQ ID NO: 3855164 - DNA, 22 bp, Homo sapiens
ccacctcccctatccacccagc

SEQ ID NO: 3855165 - DNA, 23 bp, Homo sapiens
ccacctctcaatattcaataaag

SEQ ID NO: 3855166 - DNA, 13 bp, Homo sapiens
ccacctctgctgc

SEQ ID NO: 3855167 - DNA, 16 bp, Homo sapiens
ccacctcttctcttcc

SEQ ID NO: 3855168 - DNA, 13 bp, Homo sapiens
ccacctgccagcc

SEQ ID NO: 3855169 - DNA, 14 bp, Homo sapiens
ccacctgccagcca

SEQ ID NO: 3855170 - DNA, 15 bp, Homo sapiens
ccacctgccagccat

SEQ ID NO: 3855171 - DNA, 14 bp, Homo sapiens
ccacctgcccaacc

SEQ ID NO: 3855172 - DNA, 19 bp, Homo sapiens
ccacctgttaaaatgtaca

SEQ ID NO: 3855173 - DNA, 19 bp, Homo sapiens
ccaccttcccagctctccc

SEQ ID NO: 3855174 - DNA, 15 bp, Homo sapiens
ccaccttccccagac

SEQ ID NO: 3855175 - DNA, 12 bp, Homo sapiens
ccaccttccctc

SEQ ID NO: 3855176 - DNA, 15 bp, Homo sapiens
ccaccttccctcttt

SEQ ID NO: 3855177 - DNA, 13 bp, Homo sapiens
ccaccttgctctt

SEQ ID NO: 3855178 - DNA, 18 bp, Homo sapiens
ccaccttggactcctccc

SEQ ID NO: 3855179 - DNA, 20 bp, Homo sapiens
ccacctttgggatcagcctc

SEQ ID NO: 3855180 - DNA, 21 bp, Homo sapiens
ccacctttgggatcagcctcc

SEQ ID NO: 3855181 - DNA, 20 bp, Homo sapiens
ccacgaagctgtgaactcag

SEQ ID NO: 3855182 - DNA, 23 bp, Homo sapiens
ccacgaatttgctggggaatctc

SEQ ID NO: 3855183 - DNA, 18 bp, Homo sapiens
ccacgactgttgtacaag

SEQ ID NO: 3855184 - DNA, 22 bp, Homo sapiens
ccacgagtaagatattatttaa

SEQ ID NO: 3855185 - DNA, 21 bp, Homo sapiens
ccacgagtcacctgcaagccc

SEQ ID NO: 3855186 - DNA, 20 bp, Homo sapiens
ccacgatgtcaaggactcct

SEQ ID NO: 3855187 - DNA, 14 bp, Homo sapiens
ccacgcacacatgg

SEQ ID NO: 3855188 - DNA, 16 bp, Homo sapiens
ccacgctcaggcccgg

SEQ ID NO: 3855189 - DNA, 11 bp, Homo sapiens
ccacgctgtcc

SEQ ID NO: 3855190 - DNA, 18 bp, Homo sapiens
ccacggacgtttccatca

SEQ ID NO: 3855191 - DNA, 14 bp, Homo sapiens
ccacggccaccctc

SEQ ID NO: 3855192 - DNA, 21 bp, Homo sapiens
ccacggccaccctccttcccg

SEQ ID NO: 3855193 - DNA, 13 bp, Homo sapiens
ccacgggcctcag

SEQ ID NO: 3855194 - DNA, 16 bp, Homo sapiens
ccacggggagggggac

SEQ ID NO: 3855195 - DNA, 21 bp, Homo sapiens
ccacggtgcgtggctgtggca

SEQ ID NO: 3855196 - DNA, 22 bp, Homo sapiens
ccacgtccccctggggcttctc

SEQ ID NO: 3855197 - DNA, 13 bp, Homo sapiens
ccacgtctgccag

SEQ ID NO: 3855198 - DNA, 17 bp, Homo sapiens
ccacgtctgccaggccc

SEQ ID NO: 3855199 - DNA, 16 bp, Homo sapiens
ccacgtggtgtccctg

SEQ ID NO: 3855200 - DNA, 20 bp, Homo sapiens
ccactcaaattaatctttct

SEQ ID NO: 3855201 - DNA, 14 bp, Homo sapiens
ccactcacacttgg

SEQ ID NO: 3855202 - DNA, 16 bp, Homo sapiens
ccactcaccagtgtcc

SEQ ID NO: 3855203 - DNA, 15 bp, Homo sapiens
ccactcactccagcc

SEQ ID NO: 3855204 - DNA, 21 bp, Homo sapiens
ccactcatgttgttcccacac

SEQ ID NO: 3855205 - DNA, 20 bp, Homo sapiens
ccactccagacccctggctt

SEQ ID NO: 3855206 - DNA, 22 bp, Homo sapiens
ccactccagacccctggctttt

SEQ ID NO: 3855207 - DNA, 11 bp, Homo sapiens
ccactccagcc

SEQ ID NO: 3855208 - DNA, 15 bp, Homo sapiens
ccactccagccctgt

SEQ ID NO: 3855209 - DNA, 13 bp, Homo sapiens
ccactccattccc

SEQ ID NO: 3855210 - DNA, 14 bp, Homo sapiens
ccactccattccca

SEQ ID NO: 3855211 - DNA, 17 bp, Homo sapiens
ccactcccccacctgac

SEQ ID NO: 3855212 - DNA, 13 bp, Homo sapiens
ccactcctgtccc

SEQ ID NO: 3855213 - DNA, 16 bp, Homo sapiens
ccactccttcctgccc

SEQ ID NO: 3855214 - DNA, 20 bp, Homo sapiens
ccactcgggaggctgagaca

SEQ ID NO: 3855215 - DNA, 14 bp, Homo sapiens
ccactctcaggagg

SEQ ID NO: 3855216 - DNA, 13 bp, Homo sapiens
ccactctcccctc

SEQ ID NO: 3855217 - DNA, 13 bp, Homo sapiens
ccactctcggggc

SEQ ID NO: 3855218 - DNA, 18 bp, Homo sapiens
ccactctcggggcccttg

SEQ ID NO: 3855219 - DNA, 13 bp, Homo sapiens
ccactctgctctg

SEQ ID NO: 3855220 - DNA, 14 bp, Homo sapiens
ccactctgctctga

SEQ ID NO: 3855221 - DNA, 15 bp, Homo sapiens
ccactctgctctgat

SEQ ID NO: 3855222 - DNA, 13 bp, Homo sapiens
ccactctggcagc

SEQ ID NO: 3855223 - DNA, 14 bp, Homo sapiens
ccactctggcagcc

SEQ ID NO: 3855224 - DNA, 22 bp, Homo sapiens
ccactctggcagccacacttct

SEQ ID NO: 3855225 - DNA, 13 bp, Homo sapiens
ccactctttgcta

SEQ ID NO: 3855226 - DNA, 14 bp, Homo sapiens
ccactgcaggcccc

SEQ ID NO: 3855227 - DNA, 21 bp, Homo sapiens
catggatttctgtcttctcta

SEQ ID NO: 3855228 - DNA, 18 bp, Homo sapiens
catggcaccagccccctg

SEQ ID NO: 3855229 - DNA, 20 bp, Homo sapiens
catggcaccagccccctgga

SEQ ID NO: 3855230 - DNA, 20 bp, Homo sapiens
catggccaaatcgcagtgat

SEQ ID NO: 3855231 - DNA, 12 bp, Homo sapiens
catggccctggg

SEQ ID NO: 3855232 - DNA, 14 bp, Homo sapiens
catggccttccctc

SEQ ID NO: 3855233 - DNA, 13 bp, Homo sapiens
catggcgaggctg

SEQ ID NO: 3855234 - DNA, 17 bp, Homo sapiens
catggcgtaatgggcct

SEQ ID NO: 3855235 - DNA, 19 bp, Homo sapiens
catggcgtaatgggcctgc

SEQ ID NO: 3855236 - DNA, 21 bp, Homo sapiens
catggcgtaatgggcctgccc

SEQ ID NO: 3855237 - DNA, 22 bp, Homo sapiens
catggcgtaatgggcctgccca

SEQ ID NO: 3855238 - DNA, 13 bp, Homo sapiens
catggctcaggca

SEQ ID NO: 3855239 - DNA, 14 bp, Homo sapiens
catggctgtgagga

SEQ ID NO: 3855240 - DNA, 15 bp, Homo sapiens
catggcttagaaatc

SEQ ID NO: 3855241 - DNA, 19 bp, Homo sapiens
catggcttggggagcagag

SEQ ID NO: 3855242 - DNA, 20 bp, Homo sapiens
catggcttggggagcagagt

SEQ ID NO: 3855243 - DNA, 20 bp, Homo sapiens
catgggaaatgtcaacaagt

SEQ ID NO: 3855244 - DNA, 15 bp, Homo sapiens
catgggactgtgcct

SEQ ID NO: 3855245 - DNA, 17 bp, Homo sapiens
catgggactgtgccttt

SEQ ID NO: 3855246 - DNA, 21 bp, Homo sapiens
catgggaggtgaaaggggcac

SEQ ID NO: 3855247 - DNA, 23 bp, Homo sapiens
ccagagcattacgtgagccaggt

SEQ ID NO: 3855248 - DNA, 13 bp, Homo sapiens
ccagagccactac

SEQ ID NO: 3855249 - DNA, 13 bp, Homo sapiens
ccagagccagcct

SEQ ID NO: 3855250 - DNA, 16 bp, Homo sapiens
ccagagccagcctggg

SEQ ID NO: 3855251 - DNA, 18 bp, Homo sapiens
ccagagccagcctgggac

SEQ ID NO: 3855252 - DNA, 17 bp, Homo sapiens
ccagagcccaagtgcca

SEQ ID NO: 3855253 - DNA, 10 bp, Homo sapiens
ccagagcccc

SEQ ID NO: 3855254 - DNA, 18 bp, Homo sapiens
ccagagccccacacggag

SEQ ID NO: 3855255 - DNA, 19 bp, Homo sapiens
ccagagccccacacggagg

SEQ ID NO: 3855256 - DNA, 16 bp, Homo sapiens
ccagagccccccacaa

SEQ ID NO: 3855257 - DNA, 21 bp, Homo sapiens
ccagagccccccacaatgatg

SEQ ID NO: 3855258 - DNA, 14 bp, Homo sapiens
ccagagcctggggc

SEQ ID NO: 3855259 - DNA, 16 bp, Homo sapiens
ccagagcctggggctc

SEQ ID NO: 3855260 - DNA, 20 bp, Homo sapiens
ccagagcctggggctctaac

SEQ ID NO: 3855261 - DNA, 14 bp, Homo sapiens
ccagagctggaagg

SEQ ID NO: 3855262 - DNA, 18 bp, Homo sapiens
ccagagctggaaggcagg

SEQ ID NO: 3855263 - DNA, 21 bp, Homo sapiens
ccagagctgggaggcatggcc

SEQ ID NO: 3855264 - DNA, 17 bp, Homo sapiens
ccagagcttattggcca

SEQ ID NO: 3855265 - DNA, 16 bp, Homo sapiens
ccagagcttcccagga

SEQ ID NO: 3855266 - DNA, 19 bp, Homo sapiens
ccagagctttgttttatat

SEQ ID NO: 3855267 - DNA, 17 bp, Homo sapiens
ccagaggaacctgaggc

SEQ ID NO: 3855268 - DNA, 15 bp, Homo sapiens
ccagaggccaaggag

SEQ ID NO: 3855269 - DNA, 19 bp, Homo sapiens
ccagagggtagggcagcag

SEQ ID NO: 3855270 - DNA, 22 bp, Homo sapiens
ccagaggtgacccaatgctcct

SEQ ID NO: 3855271 - DNA, 21 bp, Homo sapiens
ccagaggttatctgcctggcc

SEQ ID NO: 3855272 - DNA, 22 bp, Homo sapiens
ccagaggttatctgcctggcct

SEQ ID NO: 3855273 - DNA, 17 bp, Homo sapiens
ccagagtcagaggagaa

SEQ ID NO: 3855274 - DNA, 21 bp, Homo sapiens
ccagagtgaaagggctatggc

SEQ ID NO: 3855275 - DNA, 22 bp, Homo sapiens
ccagagtgaaagggctatggca

SEQ ID NO: 3855276 - DNA, 17 bp, Homo sapiens
ccagagtggagtctgag

SEQ ID NO: 3855277 - DNA, 20 bp, Homo sapiens
ccagagtggagtctgagtct

SEQ ID NO: 3855278 - DNA, 21 bp, Homo sapiens
ccagagtggagtctgagtctg

SEQ ID NO: 3855279 - DNA, 18 bp, Homo sapiens
ccagagtgtgcagactga

SEQ ID NO: 3855280 - DNA, 18 bp, Homo sapiens
ccagagtgtgggaaggga

SEQ ID NO: 3855281 - DNA, 22 bp, Homo sapiens
ccagagttccacaaatctatat

SEQ ID NO: 3855282 - DNA, 23 bp, Homo sapiens
ccagagttccacaaatctatatt

SEQ ID NO: 3855283 - DNA, 24 bp, Homo sapiens
ccagagttccacaaatctatatta

SEQ ID NO: 3855284 - DNA, 21 bp, Homo sapiens
ccagatattgcactaggtcaa

SEQ ID NO: 3855285 - DNA, 14 bp, Homo sapiens
ccagatcctcacaa

SEQ ID NO: 3855286 - DNA, 18 bp, Homo sapiens
ccagatcgatcctggatt

SEQ ID NO: 3855287 - DNA, 13 bp, Homo sapiens
ccagatctgcctg

SEQ ID NO: 3855288 - DNA, 15 bp, Homo sapiens
ccagatctgcctggg

SEQ ID NO: 3855289 - DNA, 20 bp, Homo sapiens
ccagatctgcctgggcctgt

SEQ ID NO: 3855290 - DNA, 24 bp, Homo sapiens
ccagatctgcctgggcctgtgcag

SEQ ID NO: 3855291 - DNA, 21 bp, Homo sapiens
ccagatgccttcctgtctttc

SEQ ID NO: 3855292 - DNA, 21 bp, Homo sapiens
ccagcaaagagtgggctgcat

SEQ ID NO: 3855293 - DNA, 15 bp, Homo sapiens
ccagcaacacagagc

SEQ ID NO: 3855294 - DNA, 20 bp, Homo sapiens
ccagcaacatctcgagcccc

SEQ ID NO: 3855295 - DNA, 17 bp, Homo sapiens
ccagcaactctgactct

SEQ ID NO: 3855296 - DNA, 17 bp, Homo sapiens
ccagcaatatgtaaata

SEQ ID NO: 3855297 - DNA, 17 bp, Homo sapiens
ccagcacaggggcccca

SEQ ID NO: 3855298 - DNA, 18 bp, Homo sapiens
ccagcacaggggccccag

SEQ ID NO: 3855299 - DNA, 22 bp, Homo sapiens
ccagcacaggggccccagatct

SEQ ID NO: 3855300 - DNA, 16 bp, Homo sapiens
ccagcaccctctcctg

SEQ ID NO: 3855301 - DNA, 20 bp, Homo sapiens
ccagcactaaggccgtgtct

SEQ ID NO: 3855302 - DNA, 22 bp, Homo sapiens
ccagcactaaggccgtgtctct

SEQ ID NO: 3855303 - DNA, 10 bp, Homo sapiens
ccagcactga

SEQ ID NO: 3855304 - DNA, 21 bp, Homo sapiens
ccagcactttgggaggccaag

SEQ ID NO: 3855305 - DNA, 13 bp, Homo sapiens
ccagcagaaaagt

SEQ ID NO: 3855306 - DNA, 22 bp, Homo sapiens
ccagcagaaaagtgcttagaaa

SEQ ID NO: 3855307 - DNA, 16 bp, Homo sapiens
ccagcagacttgagtc

SEQ ID NO: 3855308 - DNA, 12 bp, Homo sapiens
ccagcagctgcg

SEQ ID NO: 3855309 - DNA, 23 bp, Homo sapiens
ccagcagctgggccggccagcct

SEQ ID NO: 3855310 - DNA, 20 bp, Homo sapiens
ccagcagtggtattaatact

SEQ ID NO: 3855311 - DNA, 17 bp, Homo sapiens
ccagcatccagcctgtg

SEQ ID NO: 3855312 - DNA, 13 bp, Homo sapiens
ccagcatgtacaa

SEQ ID NO: 3855313 - DNA, 21 bp, Homo sapiens
ccagccactcgggaggctgag

SEQ ID NO: 3855314 - DNA, 22 bp, Homo sapiens
ccagccagcaatgatgtccaga

SEQ ID NO: 3855315 - DNA, 18 bp, Homo sapiens
ccagccaggatcccaagc

SEQ ID NO: 3855316 - DNA, 22 bp, Homo sapiens
ccagccaggatcccaagcgtcc

SEQ ID NO: 3855317 - DNA, 14 bp, Homo sapiens
ccagccagtcttgc

SEQ ID NO: 3855318 - DNA, 12 bp, Homo sapiens
ccagcccacacc

SEQ ID NO: 3855319 - DNA, 17 bp, Homo sapiens
ccagcccacacccctcc

SEQ ID NO: 3855320 - DNA, 16 bp, Homo sapiens
ccagcccagcccagct

SEQ ID NO: 3855321 - DNA, 13 bp, Homo sapiens
ccagcccagctgg

SEQ ID NO: 3855322 - DNA, 19 bp, Homo sapiens
ccagcccattctctctcct

SEQ ID NO: 3855323 - DNA, 16 bp, Homo sapiens
ccagccccaggggtgc

SEQ ID NO: 3855324 - DNA, 13 bp, Homo sapiens
ccagccccctgga

SEQ ID NO: 3855325 - DNA, 14 bp, Homo sapiens
ccagccccctggat

SEQ ID NO: 3855326 - DNA, 22 bp, Homo sapiens
ccagccccctggatgggcattg

SEQ ID NO: 3855327 - DNA, 14 bp, Homo sapiens
ccagcccggcctgc

SEQ ID NO: 3855328 - DNA, 19 bp, Homo sapiens
ccagcccggcctgctccca

SEQ ID NO: 3855329 - DNA, 9 bp, Homo sapiens
ccagcccta

SEQ ID NO: 3855330 - DNA, 15 bp, Homo sapiens
ccagccctccctgtc

SEQ ID NO: 3855331 - DNA, 16 bp, Homo sapiens
ccagccctccctgtcc

SEQ ID NO: 3855332 - DNA, 18 bp, Homo sapiens
ccagccctccctgtcctc

SEQ ID NO: 3855333 - DNA, 12 bp, Homo sapiens
ccaggagcaaat

SEQ ID NO: 3855334 - DNA, 19 bp, Homo sapiens
ccaggagcaaatgtttctg

SEQ ID NO: 3855335 - DNA, 14 bp, Homo sapiens
ccaggagcccagag

SEQ ID NO: 3855336 - DNA, 17 bp, Homo sapiens
ccaggagcctgtgcctc

SEQ ID NO: 3855337 - DNA, 14 bp, Homo sapiens
ccaggagctcagcc

SEQ ID NO: 3855338 - DNA, 21 bp, Homo sapiens
ccaggagctgagtcacctcct

SEQ ID NO: 3855339 - DNA, 16 bp, Homo sapiens
ccaggaggctgcggcc

SEQ ID NO: 3855340 - DNA, 17 bp, Homo sapiens
ccaggagggacaaagga

SEQ ID NO: 3855341 - DNA, 24 bp, Homo sapiens
ccaggagggacaaaggagcctgtg

SEQ ID NO: 3855342 - DNA, 15 bp, Homo sapiens
ccaggaggggcctct

SEQ ID NO: 3855343 - DNA, 18 bp, Homo sapiens
ccaggaggggcctctgaa

SEQ ID NO: 3855344 - DNA, 20 bp, Homo sapiens
ccaggaggttggtgactgaa

SEQ ID NO: 3855345 - DNA, 13 bp, Homo sapiens
ccaggagtctgtg

SEQ ID NO: 3855346 - DNA, 23 bp, Homo sapiens
ccaggagttgacgcatcctgcag

SEQ ID NO: 3855347 - DNA, 21 bp, Homo sapiens
ccaggatccctcccagatcct

SEQ ID NO: 3855348 - DNA, 16 bp, Homo sapiens
ccaggatcctgcagga

SEQ ID NO: 3855349 - DNA, 17 bp, Homo sapiens
ccaggatcctgcaggaa

SEQ ID NO: 3855350 - DNA, 20 bp, Homo sapiens
ccaggatggcccttcccact

SEQ ID NO: 3855351 - DNA, 23 bp, Homo sapiens
ccaggattttaacaaaagcaaga

SEQ ID NO: 3855352 - DNA, 13 bp, Homo sapiens
ccaggcacccttc

SEQ ID NO: 3855353 - DNA, 21 bp, Homo sapiens
ccaggcacccttctttcctct

SEQ ID NO: 3855354 - DNA, 14 bp, Homo sapiens
ccaggcacctggcc

SEQ ID NO: 3855355 - DNA, 15 bp, Homo sapiens
ccaggcacctggcct

SEQ ID NO: 3855356 - DNA, 20 bp, Homo sapiens
ccaggcacgaacccacctgc

SEQ ID NO: 3855357 - DNA, 22 bp, Homo sapiens
ccaggcacgaacccacctgctg

SEQ ID NO: 3855358 - DNA, 23 bp, Homo sapiens
ccaggcacgaacccacctgctga

SEQ ID NO: 3855359 - DNA, 18 bp, Homo sapiens
ccaggcactgctgcccag

SEQ ID NO: 3855360 - DNA, 17 bp, Homo sapiens
ccaggcaggccctgcct

SEQ ID NO: 3855361 - DNA, 18 bp, Homo sapiens
ccaggcaggccctgcctt

SEQ ID NO: 3855362 - DNA, 16 bp, Homo sapiens
ccaggcaggggtggga

SEQ ID NO: 3855363 - DNA, 19 bp, Homo sapiens
ccaggcaggggtgggagag

SEQ ID NO: 3855364 - DNA, 19 bp, Homo sapiens
ccaggcaggtgcctggaca

SEQ ID NO: 3855365 - DNA, 16 bp, Homo sapiens
ccaggcatcccatccc

SEQ ID NO: 3855366 - DNA, 13 bp, Homo sapiens
ccaggcatgctgg

SEQ ID NO: 3855367 - DNA, 17 bp, Homo sapiens
ccaggcatgctggcctc

SEQ ID NO: 3855368 - DNA, 14 bp, Homo sapiens
ccaggccaccagga

SEQ ID NO: 3855369 - DNA, 16 bp, Homo sapiens
ccaggccactgtggcc

SEQ ID NO: 3855370 - DNA, 18 bp, Homo sapiens
ccaggccactgtggccag

SEQ ID NO: 3855371 - DNA, 19 bp, Homo sapiens
ccaggccactgtggccaga

SEQ ID NO: 3855372 - DNA, 13 bp, Homo sapiens
ccaggcccatctc

SEQ ID NO: 3855373 - DNA, 19 bp, Homo sapiens
ccaggcccatctcaggtgc

SEQ ID NO: 3855374 - DNA, 15 bp, Homo sapiens
ccaggccccatgacc

SEQ ID NO: 3855375 - DNA, 18 bp, Homo sapiens
ccaggccccatgacctcc

SEQ ID NO: 3855376 - DNA, 20 bp, Homo sapiens
ccaggccccatgacctccag

SEQ ID NO: 3855377 - DNA, 23 bp, Homo sapiens
ccaggccccatgacctccagctt

SEQ ID NO: 3855378 - DNA, 12 bp, Homo sapiens
ccaggcccctga

SEQ ID NO: 3855379 - DNA, 16 bp, Homo sapiens
ccaggcccctgaggac

SEQ ID NO: 3855380 - DNA, 22 bp, Homo sapiens
ccaggcccctgaggactggaga

SEQ ID NO: 3855381 - DNA, 21 bp, Homo sapiens
ccaggcccggggctggcggct

SEQ ID NO: 3855382 - DNA, 14 bp, Homo sapiens
ccaggccctccatg

SEQ ID NO: 3855383 - DNA, 16 bp, Homo sapiens
ccaggccctccatggg

SEQ ID NO: 3855384 - DNA, 14 bp, Homo sapiens
ccaggccgcctgcc

SEQ ID NO: 3855385 - DNA, 15 bp, Homo sapiens
ccaggccgcctgcca

SEQ ID NO: 3855386 - DNA, 20 bp, Homo sapiens
ccaggccgttccccttggct

SEQ ID NO: 3855387 - DNA, 14 bp, Homo sapiens
ccaggcctccagcc

SEQ ID NO: 3855388 - DNA, 15 bp, Homo sapiens
ccaggcctccagcct

SEQ ID NO: 3855389 - DNA, 21 bp, Homo sapiens
ccaggcctccagcctctcccg

SEQ ID NO: 3855390 - DNA, 13 bp, Homo sapiens
ccaggcctctgtg

SEQ ID NO: 3855391 - DNA, 15 bp, Homo sapiens
ccaggcctctgtgtc

SEQ ID NO: 3855392 - DNA, 17 bp, Homo sapiens
ccaggcctctgtgtcct

SEQ ID NO: 3855393 - DNA, 19 bp, Homo sapiens
ccaggcgccccttccccct

SEQ ID NO: 3855394 - DNA, 17 bp, Homo sapiens
ccaggcgggagatggac

SEQ ID NO: 3855395 - DNA, 15 bp, Homo sapiens
ccaggcgggcggcac

SEQ ID NO: 3855396 - DNA, 16 bp, Homo sapiens
ccaggcgttggtgcca

SEQ ID NO: 3855397 - DNA, 18 bp, Homo sapiens
ccaggcgttggtgccact

SEQ ID NO: 3855398 - DNA, 15 bp, Homo sapiens
ccaggctccatgggg

SEQ ID NO: 3855399 - DNA, 16 bp, Homo sapiens
ccaggctccatgggga

SEQ ID NO: 3855400 - DNA, 18 bp, Homo sapiens
ccaggctccatggggaag

SEQ ID NO: 3855401 - DNA, 13 bp, Homo sapiens
ccaggctctgcct

SEQ ID NO: 3855402 - DNA, 22 bp, Homo sapiens
ccaggctctgcctggaggatcc

SEQ ID NO: 3855403 - DNA, 20 bp, Homo sapiens
ccaggctctggagccagaga

SEQ ID NO: 3855404 - DNA, 13 bp, Homo sapiens
ccaggctctggga

SEQ ID NO: 3855405 - DNA, 15 bp, Homo sapiens
ccaggctctgggaag

SEQ ID NO: 3855406 - DNA, 20 bp, Homo sapiens
ccaggctcttcctggacctg

SEQ ID NO: 3855407 - DNA, 14 bp, Homo sapiens
ccaggctgcactgc

SEQ ID NO: 3855408 - DNA, 15 bp, Homo sapiens
ccaggctgcactgca

SEQ ID NO: 3855409 - DNA, 16 bp, Homo sapiens
ccaggctgcactgcag

SEQ ID NO: 3855410 - DNA, 18 bp, Homo sapiens
ccaggctgcactgcagtg

SEQ ID NO: 3855411 - DNA, 21 bp, Homo sapiens
ccaggctgctcttgaattcct

SEQ ID NO: 3855412 - DNA, 22 bp, Homo sapiens
ccaggctgtaagcattctgagc

SEQ ID NO: 3855413 - DNA, 16 bp, Homo sapiens
ccaggcttcaccctga

SEQ ID NO: 3855414 - DNA, 23 bp, Homo sapiens
ccagggaagaaggtttgaaagat

SEQ ID NO: 3855415 - DNA, 13 bp, Homo sapiens
ccagggcagcctc

SEQ ID NO: 3855416 - DNA, 20 bp, Homo sapiens
ccagggcatccgcagcccag

SEQ ID NO: 3855417 - DNA, 21 bp, Homo sapiens
ccagggcatccgcagcccagg

SEQ ID NO: 3855418 - DNA, 22 bp, Homo sapiens
ccagggccacgtgccaggcccg

SEQ ID NO: 3855419 - DNA, 17 bp, Homo sapiens
ccagggcccctccctct

SEQ ID NO: 3855420 - DNA, 21 bp, Homo sapiens
ccagggcccctccctctgccc

SEQ ID NO: 3855421 - DNA, 23 bp, Homo sapiens
ccagggcccctccctctgcccca

SEQ ID NO: 3855422 - DNA, 12 bp, Homo sapiens
ccagggccctaa

SEQ ID NO: 3855423 - DNA, 22 bp, Homo sapiens
ccagggcctactgccacccgct

SEQ ID NO: 3855424 - DNA, 16 bp, Homo sapiens
ccagggcctgggggca

SEQ ID NO: 3855425 - DNA, 19 bp, Homo sapiens
ccagggcctgggggcagtg

SEQ ID NO: 3855426 - DNA, 15 bp, Homo sapiens
ccagggcctgtctca

SEQ ID NO: 3855427 - DNA, 18 bp, Homo sapiens
ccagggctccctcctgga

SEQ ID NO: 3855428 - DNA, 16 bp, Homo sapiens
ccagggctgcccctgt

SEQ ID NO: 3855429 - DNA, 18 bp, Homo sapiens
ccagggcttttcccagga

SEQ ID NO: 3855430 - DNA, 13 bp, Homo sapiens
ccaggggaccaca

SEQ ID NO: 3855431 - DNA, 18 bp, Homo sapiens
ccaggggaccacacctcc

SEQ ID NO: 3855432 - DNA, 14 bp, Homo sapiens
ccaggggctgctca

SEQ ID NO: 3855433 - DNA, 17 bp, Homo sapiens
ccaggggtctccctgga

SEQ ID NO: 3855434 - DNA, 20 bp, Homo sapiens
ccaggggtgatttcagagag

SEQ ID NO: 3855435 - DNA, 14 bp, Homo sapiens
ccagggtccgcacc

SEQ ID NO: 3855436 - DNA, 14 bp, Homo sapiens
ccagggtcttgggc

SEQ ID NO: 3855437 - DNA, 15 bp, Homo sapiens
ccagggtgagagctg

SEQ ID NO: 3855438 - DNA, 16 bp, Homo sapiens
ccagggtgagagctgc

SEQ ID NO: 3855439 - DNA, 20 bp, Homo sapiens
ccagggttgaaaagttatga

SEQ ID NO: 3855440 - DNA, 21 bp, Homo sapiens
ccaggtactgatcctgtttct

SEQ ID NO: 3855441 - DNA, 23 bp, Homo sapiens
ccaggtcctcccgggagcacaga

SEQ ID NO: 3855442 - DNA, 22 bp, Homo sapiens
ccaggtcctctgatacccagag

SEQ ID NO: 3855443 - DNA, 13 bp, Homo sapiens
ccaggtcctggtg

SEQ ID NO: 3855444 - DNA, 19 bp, Homo sapiens
ccaggtcctggtggggcag

SEQ ID NO: 3855445 - DNA, 21 bp, Homo sapiens
ccaggtcctggtggggcagct

SEQ ID NO: 3855446 - DNA, 13 bp, Homo sapiens
ccaggtctccctg

SEQ ID NO: 3855447 - DNA, 20 bp, Homo sapiens
ccaggtctccctggatcaga

SEQ ID NO: 3855448 - DNA, 12 bp, Homo sapiens
ccaggtgccagt

SEQ ID NO: 3855449 - DNA, 16 bp, Homo sapiens
ccaggtggctgaccca

SEQ ID NO: 3855450 - DNA, 16 bp, Homo sapiens
ccaggtgggagagaca

SEQ ID NO: 3855451 - DNA, 24 bp, Homo sapiens
ccaggttagcctttgccctgtcac

SEQ ID NO: 3855452 - DNA, 14 bp, Homo sapiens
ccagtacttctaag

SEQ ID NO: 3855453 - DNA, 15 bp, Homo sapiens
ccagtacttctaaga

SEQ ID NO: 3855454 - DNA, 13 bp, Homo sapiens
ccagtagtcagaa

SEQ ID NO: 3855455 - DNA, 20 bp, Homo sapiens
ccagtatggaagggaggggt

SEQ ID NO: 3855456 - DNA, 12 bp, Homo sapiens
ccagtattcttg

SEQ ID NO: 3855457 - DNA, 14 bp, Homo sapiens
ccagtattcttgtc

SEQ ID NO: 3855458 - DNA, 22 bp, Homo sapiens
ccagtcccagaaccacactgtt

SEQ ID NO: 3855459 - DNA, 18 bp, Homo sapiens
ccagtccccctgccccag

SEQ ID NO: 3855460 - DNA, 22 bp, Homo sapiens
ccagtccccgtgccccgcctcc

SEQ ID NO: 3855461 - DNA, 12 bp, Homo sapiens
ccagtccctggg

SEQ ID NO: 3855462 - DNA, 15 bp, Homo sapiens
ccagtccctggggga

SEQ ID NO: 3855463 - DNA, 23 bp, Homo sapiens
ccagtccctgggggaagccctgg

SEQ ID NO: 3855464 - DNA, 20 bp, Homo sapiens
ccagtccgccaaacactcca

SEQ ID NO: 3855465 - DNA, 21 bp, Homo sapiens
ccagtccgccaaacactccac

SEQ ID NO: 3855466 - DNA, 14 bp, Homo sapiens
ccagtcctagagct

SEQ ID NO: 3855467 - DNA, 17 bp, Homo sapiens
ccagtcctagagctcct

SEQ ID NO: 3855468 - DNA, 18 bp, Homo sapiens
ccagtcctagagctcctg

SEQ ID NO: 3855469 - DNA, 20 bp, Homo sapiens
ccagtcctagagctcctgtc

SEQ ID NO: 3855470 - DNA, 21 bp, Homo sapiens
ccagtcctagagctcctgtcc

SEQ ID NO: 3855471 - DNA, 16 bp, Homo sapiens
ccagtctgttccccat

SEQ ID NO: 3855472 - DNA, 13 bp, Homo sapiens
ccagtcttgccta

SEQ ID NO: 3855473 - DNA, 15 bp, Homo sapiens
ccagtgaaccaaaga

SEQ ID NO: 3855474 - DNA, 17 bp, Homo sapiens
ccagtgaaggagccacg

SEQ ID NO: 3855475 - DNA, 14 bp, Homo sapiens
ccagtgacctgacc

SEQ ID NO: 3855476 - DNA, 22 bp, Homo sapiens
ccagtgacctgctgggtaaact

SEQ ID NO: 3855477 - DNA, 12 bp, Homo sapiens
ccagtgactttt

SEQ ID NO: 3855478 - DNA, 15 bp, Homo sapiens
ccagtgatgtgctgg

SEQ ID NO: 3855479 - DNA, 13 bp, Homo sapiens
ccagtgccacaga

SEQ ID NO: 3855480 - DNA, 15 bp, Homo sapiens
ccagtgccacagaga

SEQ ID NO: 3855481 - DNA, 18 bp, Homo sapiens
ccagtgccacagagaaga

SEQ ID NO: 3855482 - DNA, 20 bp, Homo sapiens
ccagtgccttacctcctgcc

SEQ ID NO: 3855483 - DNA, 12 bp, Homo sapiens
ccagtgctgcca

SEQ ID NO: 3855484 - DNA, 13 bp, Homo sapiens
ccagtgctgccat

SEQ ID NO: 3855485 - DNA, 17 bp, Homo sapiens
ccagtgctgccatgcca

SEQ ID NO: 3855486 - DNA, 18 bp, Homo sapiens
ccagtgctgccatgccac

SEQ ID NO: 3855487 - DNA, 19 bp, Homo sapiens
ccagtgctgccatgccact

SEQ ID NO: 3855488 - DNA, 21 bp, Homo sapiens
ccagtgctgccatgccactgc

SEQ ID NO: 3855489 - DNA, 23 bp, Homo sapiens
ccagtgctgccatgccactgcca

SEQ ID NO: 3855490 - DNA, 16 bp, Homo sapiens
ccagtgggacagagga

SEQ ID NO: 3855491 - DNA, 20 bp, Homo sapiens
ccagtgggaggtgagaccac

SEQ ID NO: 3855492 - DNA, 20 bp, Homo sapiens
ccagtgtaaagaataaatga

SEQ ID NO: 3855493 - DNA, 17 bp, Homo sapiens
ccagtgtaaggcatagg

SEQ ID NO: 3855494 - DNA, 22 bp, Homo sapiens
ccagtgtcccctccactgtcac

SEQ ID NO: 3855495 - DNA, 17 bp, Homo sapiens
ccagtgttggctgtgtg

SEQ ID NO: 3855496 - DNA, 21 bp, Homo sapiens
ccagtgttggctgtgtgacag

SEQ ID NO: 3855497 - DNA, 21 bp, Homo sapiens
ccagttaaggaccgtggccct

SEQ ID NO: 3855498 - DNA, 14 bp, Homo sapiens
ccagttatggctat

SEQ ID NO: 3855499 - DNA, 21 bp, Homo sapiens
ccagttatggctataggtgct

SEQ ID NO: 3855500 - DNA, 13 bp, Homo sapiens
ccagttctgctcc

SEQ ID NO: 3855501 - DNA, 17 bp, Homo sapiens
ccagttctgctcctctc

SEQ ID NO: 3855502 - DNA, 16 bp, Homo sapiens
cccagggcctgggggc

SEQ ID NO: 3855503 - DNA, 18 bp, Homo sapiens
cccagggcctgggggcag

SEQ ID NO: 3855504 - DNA, 17 bp, Homo sapiens
cccaggggaaaatgaag

SEQ ID NO: 3855505 - DNA, 17 bp, Homo sapiens
cccaggggaccacacct

SEQ ID NO: 3855506 - DNA, 14 bp, Homo sapiens
cccaggggtgcctg

SEQ ID NO: 3855507 - DNA, 21 bp, Homo sapiens
cccaggtctccctggatcaga

SEQ ID NO: 3855508 - DNA, 17 bp, Homo sapiens
cccaggtgccaccaata

SEQ ID NO: 3855509 - DNA, 20 bp, Homo sapiens
cccaggtgccaccaataaaa

SEQ ID NO: 3855510 - DNA, 21 bp, Homo sapiens
cccaggtgccaccaataaaaa

SEQ ID NO: 3855511 - DNA, 19 bp, Homo sapiens
cccaggtggctgacccagt

SEQ ID NO: 3855512 - DNA, 24 bp, Homo sapiens
cccagtagtcagaagcaggttctt

SEQ ID NO: 3855513 - DNA, 21 bp, Homo sapiens
cccagtcccagaaccacactg

SEQ ID NO: 3855514 - DNA, 14 bp, Homo sapiens
cccagtccctgggg

SEQ ID NO: 3855515 - DNA, 23 bp, Homo sapiens
cccagtccctgggggaagccctg

SEQ ID NO: 3855516 - DNA, 21 bp, Homo sapiens
cccagtccgccaaacactcca

SEQ ID NO: 3855517 - DNA, 15 bp, Homo sapiens
cccagtcctggccat

SEQ ID NO: 3855518 - DNA, 24 bp, Homo sapiens
cccagtctacgttctccagcccac

SEQ ID NO: 3855519 - DNA, 16 bp, Homo sapiens
cccagtgacctgaccg

SEQ ID NO: 3855520 - DNA, 14 bp, Homo sapiens
cccagaggcctctc

SEQ ID NO: 3855521 - DNA, 17 bp, Homo sapiens
cccagagggtagggcag

SEQ ID NO: 3855522 - DNA, 18 bp, Homo sapiens
cccagaggttatctgcct

SEQ ID NO: 3855523 - DNA, 19 bp, Homo sapiens
cccagaggttatctgcctg

SEQ ID NO: 3855524 - DNA, 15 bp, Homo sapiens
cccagatctgcctgg

SEQ ID NO: 3855525 - DNA, 17 bp, Homo sapiens
cccagatctgcctgggc

SEQ ID NO: 3855526 - DNA, 21 bp, Homo sapiens
cccagatctgcctgggcctgt

SEQ ID NO: 3855527 - DNA, 23 bp, Homo sapiens
cccagatctgcctgggcctgtgc

SEQ ID NO: 3855528 - DNA, 13 bp, Homo sapiens
cccagatgctggg

SEQ ID NO: 3855529 - DNA, 15 bp, Homo sapiens
cccagatgctgggga

SEQ ID NO: 3855530 - DNA, 22 bp, Homo sapiens
cccagcaacacaagctggaagc

SEQ ID NO: 3855531 - DNA, 18 bp, Homo sapiens
cccagcacttgtgttgtc

SEQ ID NO: 3855532 - DNA, 15 bp, Homo sapiens
cccagcagctgggcc

SEQ ID NO: 3855533 - DNA, 13 bp, Homo sapiens
cccagcatgtaca

SEQ ID NO: 3855534 - DNA, 14 bp, Homo sapiens
cccagccatggtga

SEQ ID NO: 3855535 - DNA, 16 bp, Homo sapiens
cccagcccaaagctgt

SEQ ID NO: 3855536 - DNA, 16 bp, Homo sapiens
cccagcccagctggtg

SEQ ID NO: 3855537 - DNA, 15 bp, Homo sapiens
ccatgtccaatggag

SEQ ID NO: 3855538 - DNA, 17 bp, Homo sapiens
ccatgtcctatgtgtga

SEQ ID NO: 3855539 - DNA, 22 bp, Homo sapiens
ccatgtgcatggaaatgtcctc

SEQ ID NO: 3855540 - DNA, 18 bp, Homo sapiens
ccatgtggccccaggtgc

SEQ ID NO: 3855541 - DNA, 14 bp, Homo sapiens
ccatgtgtcccctc

SEQ ID NO: 3855542 - DNA, 16 bp, Homo sapiens
ccatgtgtcccctcac

SEQ ID NO: 3855543 - DNA, 18 bp, Homo sapiens
ccatgtgtcccctcactc

SEQ ID NO: 3855544 - DNA, 18 bp, Homo sapiens
ccatgttagtttttactt

SEQ ID NO: 3855545 - DNA, 12 bp, Homo sapiens
ccatgttccctt

SEQ ID NO: 3855546 - DNA, 19 bp, Homo sapiens
ccatgttgcatgcctatgt

SEQ ID NO: 3855547 - DNA, 17 bp, Homo sapiens
ccatgtttgagctcaga

SEQ ID NO: 3855548 - DNA, 14 bp, Homo sapiens
ccatgtttgtaaaa

SEQ ID NO: 3855549 - DNA, 15 bp, Homo sapiens
ccatgtttgtaaaac

SEQ ID NO: 3855550 - DNA, 14 bp, Homo sapiens
ccattcacttcccc

SEQ ID NO: 3855551 - DNA, 13 bp, Homo sapiens
ccattcctcaggg

SEQ ID NO: 3855552 - DNA, 16 bp, Homo sapiens
ccattcctcagggaca

SEQ ID NO: 3855553 - DNA, 19 bp, Homo sapiens
ccattcgtctgtcccagag

SEQ ID NO: 3855554 - DNA, 20 bp, Homo sapiens
ccattctctctcctgtccaa

SEQ ID NO: 3855555 - DNA, 16 bp, Homo sapiens
ccattctgaccatttc

SEQ ID NO: 3855556 - DNA, 20 bp, Homo sapiens
ccattcttcctagttttctc

SEQ ID NO: 3855557 - DNA, 13 bp, Homo sapiens
ccattgacctcag

SEQ ID NO: 3855558 - DNA, 18 bp, Homo sapiens
ccattgacctcagctgca

SEQ ID NO: 3855559 - DNA, 23 bp, Homo sapiens
ccattgacttgcacatctctgca

SEQ ID NO: 3855560 - DNA, 14 bp, Homo sapiens
ccattgccctggtt

SEQ ID NO: 3855561 - DNA, 15 bp, Homo sapiens
ccattgtcttccaac

SEQ ID NO: 3855562 - DNA, 16 bp, Homo sapiens
ccattgtcttccaacc

SEQ ID NO: 3855563 - DNA, 17 bp, Homo sapiens
ccattgtcttccaaccc

SEQ ID NO: 3855564 - DNA, 14 bp, Homo sapiens
ccatttaattcata

SEQ ID NO: 3855565 - DNA, 12 bp, Homo sapiens
ccatttcaaatg

SEQ ID NO: 3855566 - DNA, 13 bp, Homo sapiens
ccatttcaaatgg

SEQ ID NO: 3855567 - DNA, 19 bp, Homo sapiens
ccatttctcaatcagtgca

SEQ ID NO: 3855568 - DNA, 23 bp, Homo sapiens
ccatttctcaatcagtgcagtga

SEQ ID NO: 3855569 - DNA, 19 bp, Homo sapiens
ccattttcttgcctgaggc

SEQ ID NO: 3855570 - DNA, 22 bp, Homo sapiens
cccaaaacctttccccagacac

SEQ ID NO: 3855571 - DNA, 22 bp, Homo sapiens
cccaaaagtcaaaaggtgcctg

SEQ ID NO: 3855572 - DNA, 22 bp, Homo sapiens
cccaaacattaatcaccaaagt

SEQ ID NO: 3855573 - DNA, 20 bp, Homo sapiens
cccaaactgtgccctgcctt

SEQ ID NO: 3855574 - DNA, 19 bp, Homo sapiens
cccaaataaatgtgtaaat

SEQ ID NO: 3855575 - DNA, 17 bp, Homo sapiens
cccaacacaatctttcc

SEQ ID NO: 3855576 - DNA, 15 bp, Homo sapiens
cccaacagcaccaat

SEQ ID NO: 3855577 - DNA, 21 bp, Homo sapiens
cccaacccaattcaggactgg

SEQ ID NO: 3855578 - DNA, 21 bp, Homo sapiens
cccaaccccgcggtgctctgg

SEQ ID NO: 3855579 - DNA, 13 bp, Homo sapiens
cccaacccgtgga

SEQ ID NO: 3855580 - DNA, 17 bp, Homo sapiens
cccaacccgtggaggct

SEQ ID NO: 3855581 - DNA, 19 bp, Homo sapiens
cccaacccgtggaggctgc

SEQ ID NO: 3855582 - DNA, 22 bp, Homo sapiens
cccaacccgtggaggctgctcg

SEQ ID NO: 3855583 - DNA, 17 bp, Homo sapiens
cccaacctaagattgtg

SEQ ID NO: 3855584 - DNA, 15 bp, Homo sapiens
cccaacctcaatgcc

SEQ ID NO: 3855585 - DNA, 13 bp, Homo sapiens
cccaacctgctct

SEQ ID NO: 3855586 - DNA, 14 bp, Homo sapiens
cccaacctgctctc

SEQ ID NO: 3855587 - DNA, 23 bp, Homo sapiens
cccaacctgctctcctcttgcca

SEQ ID NO: 3855588 - DNA, 16 bp, Homo sapiens
cccaacgcacaggaaa

SEQ ID NO: 3855589 - DNA, 15 bp, Homo sapiens
cccaactccttccag

SEQ ID NO: 3855590 - DNA, 18 bp, Homo sapiens
cccaactccttccagcta

SEQ ID NO: 3855591 - DNA, 16 bp, Homo sapiens
cccaactgctctgccc

SEQ ID NO: 3855592 - DNA, 15 bp, Homo sapiens
cccaagagatgaaga

SEQ ID NO: 3855593 - DNA, 18 bp, Homo sapiens
cccaagaggtctgagccc

SEQ ID NO: 3855594 - DNA, 13 bp, Homo sapiens
cccaagcagccag

SEQ ID NO: 3855595 - DNA, 14 bp, Homo sapiens
cccaagcagccagc

SEQ ID NO: 3855596 - DNA, 12 bp, Homo sapiens
cccaagcagccg

SEQ ID NO: 3855597 - DNA, 18 bp, Homo sapiens
cccaagcctctgccccaa

SEQ ID NO: 3855598 - DNA, 23 bp, Homo sapiens
cccaagcctctgccccaaggggc

SEQ ID NO: 3855599 - DNA, 15 bp, Homo sapiens
cccaaggaggaaaaa

SEQ ID NO: 3855600 - DNA, 22 bp, Homo sapiens
cccaaggaggaaaaacagacaa

SEQ ID NO: 3855601 - DNA, 20 bp, Homo sapiens
cccaaggggacttgtgccag

SEQ ID NO: 3855602 - DNA, 18 bp, Homo sapiens
cccaaggggcccacaaag

SEQ ID NO: 3855603 - DNA, 11 bp, Homo sapiens
cccaagtgcca

SEQ ID NO: 3855604 - DNA, 19 bp, Homo sapiens
cccaagtgggggcagaggg

SEQ ID NO: 3855605 - DNA, 23 bp, Homo sapiens
cccaagtgggggcagagggcaga

SEQ ID NO: 3855606 - DNA, 14 bp, Homo sapiens
cccaataaagctgg

SEQ ID NO: 3855607 - DNA, 16 bp, Homo sapiens
cccaataaagctggac

SEQ ID NO: 3855608 - DNA, 17 bp, Homo sapiens
cccaatcttgacacggt

SEQ ID NO: 3855609 - DNA, 20 bp, Homo sapiens
cccaatgcacatccattccc

SEQ ID NO: 3855610 - DNA, 14 bp, Homo sapiens
cccaatgctcctgg

SEQ ID NO: 3855611 - DNA, 13 bp, Homo sapiens
cccaattcatttc

SEQ ID NO: 3855612 - DNA, 18 bp, Homo sapiens
cccaattttgcagggagc

SEQ ID NO: 3855613 - DNA, 20 bp, Homo sapiens
cccacaaaggggagaagggc

SEQ ID NO: 3855614 - DNA, 20 bp, Homo sapiens
cccacaaataatgaacagca

SEQ ID NO: 3855615 - DNA, 21 bp, Homo sapiens
cccacaagccttactcacctc

SEQ ID NO: 3855616 - DNA, 22 bp, Homo sapiens
cccacaagccttactcacctct

SEQ ID NO: 3855617 - DNA, 11 bp, Homo sapiens
cccacacatgt

SEQ ID NO: 3855618 - DNA, 16 bp, Homo sapiens
cccacacctccctact

SEQ ID NO: 3855619 - DNA, 22 bp, Homo sapiens
cccacacggaggcatctgcacc

SEQ ID NO: 3855620 - DNA, 20 bp, Homo sapiens
cccacacgtgctcgcagcct

SEQ ID NO: 3855621 - DNA, 15 bp, Homo sapiens
cccacagcacccagg

SEQ ID NO: 3855622 - DNA, 19 bp, Homo sapiens
cccacagcacccaggctcc

SEQ ID NO: 3855623 - DNA, 15 bp, Homo sapiens
ccccgacagcccagc

SEQ ID NO: 3855624 - DNA, 14 bp, Homo sapiens
ccccgcagcccgtg

SEQ ID NO: 3855625 - DNA, 18 bp, Homo sapiens
ccccgcagtccccagccc

SEQ ID NO: 3855626 - DNA, 21 bp, Homo sapiens
ccccgccacggccaccctcct

SEQ ID NO: 3855627 - DNA, 16 bp, Homo sapiens
ccccgcggtgctctgg

SEQ ID NO: 3855628 - DNA, 18 bp, Homo sapiens
ccccgcggtgctctggcg

SEQ ID NO: 3855629 - DNA, 15 bp, Homo sapiens
ccccgctccagatct

SEQ ID NO: 3855630 - DNA, 15 bp, Homo sapiens
ccccgctgggggtgg

SEQ ID NO: 3855631 - DNA, 15 bp, Homo sapiens
ccccgcttgtccagc

SEQ ID NO: 3855632 - DNA, 18 bp, Homo sapiens
ccccgcttgtccagcgcc

SEQ ID NO: 3855633 - DNA, 24 bp, Homo sapiens
ccccggctgcttccttctgcaccc

SEQ ID NO: 3855634 - DNA, 14 bp, Homo sapiens
ccccggggctggca

SEQ ID NO: 3855635 - DNA, 15 bp, Homo sapiens
ccccggtcccttgag

SEQ ID NO: 3855636 - DNA, 24 bp, Homo sapiens
ccccggtcccttgagacctcagcc

SEQ ID NO: 3855637 - DNA, 21 bp, Homo sapiens
ccccgtctggggttcagcccc

SEQ ID NO: 3855638 - DNA, 17 bp, Homo sapiens
cccctaacctggcttat

SEQ ID NO: 3855639 - DNA, 17 bp, Homo sapiens
cccctaagagagcacct

SEQ ID NO: 3855640 - DNA, 14 bp, Homo sapiens
cccctatccaccca

SEQ ID NO: 3855641 - DNA, 20 bp, Homo sapiens
cccctatccacccagcccat

SEQ ID NO: 3855642 - DNA, 12 bp, Homo sapiens
cccctcactctg

SEQ ID NO: 3855643 - DNA, 17 bp, Homo sapiens
cccctcagcccttgccc

SEQ ID NO: 3855644 - DNA, 23 bp, Homo sapiens
cccctcatggagaaacatcctaa

SEQ ID NO: 3855645 - DNA, 23 bp, Homo sapiens
cccctccaatcccaccaaccctc

SEQ ID NO: 3855646 - DNA, 13 bp, Homo sapiens
cccctccagaccc

SEQ ID NO: 3855647 - DNA, 15 bp, Homo sapiens
cccctccagaccctg

SEQ ID NO: 3855648 - DNA, 19 bp, Homo sapiens
cccctccagaccctgcctg

SEQ ID NO: 3855649 - DNA, 17 bp, Homo sapiens
cccctccctctgcccca

SEQ ID NO: 3855650 - DNA, 15 bp, Homo sapiens
cccctcccttcaacc

SEQ ID NO: 3855651 - DNA, 12 bp, Homo sapiens
cccctcccttgc

SEQ ID NO: 3855652 - DNA, 14 bp, Homo sapiens
cccctcctctgcca

SEQ ID NO: 3855653 - DNA, 18 bp, Homo sapiens
cccctcgctgctgctact

SEQ ID NO: 3855654 - DNA, 17 bp, Homo sapiens
cccctcgtcctgtccca

SEQ ID NO: 3855655 - DNA, 18 bp, Homo sapiens
cccctcgtcctgtcccag

SEQ ID NO: 3855656 - DNA, 17 bp, Homo sapiens
cccctcgtgtgactctc

SEQ ID NO: 3855657 - DNA, 19 bp, Homo sapiens
cccctcgtgtgactctctt

SEQ ID NO: 3855658 - DNA, 14 bp, Homo sapiens
cccctctccctggg

SEQ ID NO: 3855659 - DNA, 22 bp, Homo sapiens
cccctctgtcatcactccctgg

SEQ ID NO: 3855660 - DNA, 11 bp, Homo sapiens
cccctctgtgt

SEQ ID NO: 3855661 - DNA, 16 bp, Homo sapiens
cccctctgtgtcctct

SEQ ID NO: 3855662 - DNA, 16 bp, Homo sapiens
cccctcttttggcctt

SEQ ID NO: 3855663 - DNA, 16 bp, Homo sapiens
cccctgaggactggag

SEQ ID NO: 3855664 - DNA, 15 bp, Homo sapiens
cccctgccagtgcct

SEQ ID NO: 3855665 - DNA, 16 bp, Homo sapiens
cccctgccagtgcctt

SEQ ID NO: 3855666 - DNA, 17 bp, Homo sapiens
cccctgccagtgcctta

SEQ ID NO: 3855667 - DNA, 13 bp, Homo sapiens
cccctgcctgggt

SEQ ID NO: 3855668 - DNA, 14 bp, Homo sapiens
cccctgcctgggtt

SEQ ID NO: 3855669 - DNA, 15 bp, Homo sapiens
cccctggactgggag

SEQ ID NO: 3855670 - DNA, 14 bp, Homo sapiens
cccctggccctgcc

SEQ ID NO: 3855671 - DNA, 18 bp, Homo sapiens
cccctggcttttcactgc

SEQ ID NO: 3855672 - DNA, 20 bp, Homo sapiens
cccctggcttttcactgctg

SEQ ID NO: 3855673 - DNA, 22 bp, Homo sapiens
cccctggcttttcactgctggc

SEQ ID NO: 3855674 - DNA, 23 bp, Homo sapiens
cccctggcttttcactgctggct

SEQ ID NO: 3855675 - DNA, 20 bp, Homo sapiens
cccctgggcatcttctggct

SEQ ID NO: 3855676 - DNA, 22 bp, Homo sapiens
cccctgggcatcttctggcttg

SEQ ID NO: 3855677 - DNA, 14 bp, Homo sapiens
cccctgggcctgga

SEQ ID NO: 3855678 - DNA, 20 bp, Homo sapiens
cccctggggcttctcctgac

SEQ ID NO: 3855679 - DNA, 16 bp, Homo sapiens
cccctgtacccagctc

SEQ ID NO: 3855680 - DNA, 17 bp, Homo sapiens
cccctgtggcagaccgg

SEQ ID NO: 3855681 - DNA, 22 bp, Homo sapiens
ccccttaagggttgaaggcagt

SEQ ID NO: 3855682 - DNA, 19 bp, Homo sapiens
ccccttactacttcttgga

SEQ ID NO: 3855683 - DNA, 14 bp, Homo sapiens
ccccttatccagga

SEQ ID NO: 3855684 - DNA, 14 bp, Homo sapiens
ccccttcagtgccc

SEQ ID NO: 3855685 - DNA, 12 bp, Homo sapiens
ccccttccccat

SEQ ID NO: 3855686 - DNA, 12 bp, Homo sapiens
ccccttccccct

SEQ ID NO: 3855687 - DNA, 14 bp, Homo sapiens
ccccttctgtgtca

SEQ ID NO: 3855688 - DNA, 20 bp, Homo sapiens
ccccttgccaaattccatgt

SEQ ID NO: 3855689 - DNA, 17 bp, Homo sapiens
ccccttgcccttgccct

SEQ ID NO: 3855690 - DNA, 18 bp, Homo sapiens
ccccttgcccttgccctg

SEQ ID NO: 3855691 - DNA, 21 bp, Homo sapiens
ccccttgcccttgccctgacc

SEQ ID NO: 3855692 - DNA, 23 bp, Homo sapiens
ccccttgcccttgccctgacctc

SEQ ID NO: 3855693 - DNA, 22 bp, Homo sapiens
ccccttgctctcccctgccctg

SEQ ID NO: 3855694 - DNA, 16 bp, Homo sapiens
ccccttgtcctctccc

SEQ ID NO: 3855695 - DNA, 15 bp, Homo sapiens
ccccttttgcctggc

SEQ ID NO: 3855696 - DNA, 18 bp, Homo sapiens
ccccttttgcctggctgt

SEQ ID NO: 3855697 - DNA, 20 bp, Homo sapiens
ccccttttgcctggctgtgg

SEQ ID NO: 3855698 - DNA, 16 bp, Homo sapiens
cccgaaagctgagacc

SEQ ID NO: 3855699 - DNA, 17 bp, Homo sapiens
cccgaagcccaggctga

SEQ ID NO: 3855700 - DNA, 21 bp, Homo sapiens
cccgaagcccaggctgaagag

SEQ ID NO: 3855701 - DNA, 23 bp, Homo sapiens
cccgaaggttatggtcaatccca

SEQ ID NO: 3855702 - DNA, 14 bp, Homo sapiens
cccgacactgctgc

SEQ ID NO: 3855703 - DNA, 14 bp, Homo sapiens
cccgaccccgagtc

SEQ ID NO: 3855704 - DNA, 15 bp, Homo sapiens
cccgactagcaggca

SEQ ID NO: 3855705 - DNA, 20 bp, Homo sapiens
cccgagaaaacaaacccagg

SEQ ID NO: 3855706 - DNA, 22 bp, Homo sapiens
cccgagctactctcttgccagc

SEQ ID NO: 3855707 - DNA, 14 bp, Homo sapiens
cccgcagtccccag

SEQ ID NO: 3855708 - DNA, 19 bp, Homo sapiens
cccgcagtccccagccctt

SEQ ID NO: 3855709 - DNA, 19 bp, Homo sapiens
cccgccacggccaccctcc

SEQ ID NO: 3855710 - DNA, 14 bp, Homo sapiens
cccgctcagccctc

SEQ ID NO: 3855711 - DNA, 12 bp, Homo sapiens
cccgctccagat

SEQ ID NO: 3855712 - DNA, 12 bp, Homo sapiens
cccgctctggac

SEQ ID NO: 3855713 - DNA, 12 bp, Homo sapiens
cccgctgcccaa

SEQ ID NO: 3855714 - DNA, 17 bp, Homo sapiens
cccgcttattctcctcc

SEQ ID NO: 3855715 - DNA, 22 bp, Homo sapiens
cccgcttattctcctccctgtt

SEQ ID NO: 3855716 - DNA, 18 bp, Homo sapiens
cccggagcacagccctgg

SEQ ID NO: 3855717 - DNA, 18 bp, Homo sapiens
cccggagcaggggtctga

SEQ ID NO: 3855718 - DNA, 19 bp, Homo sapiens
cccggagtaatcaggcagc

SEQ ID NO: 3855719 - DNA, 18 bp, Homo sapiens
cccggatgtgtgtctcac

SEQ ID NO: 3855720 - DNA, 18 bp, Homo sapiens
cccggccagggcctggtg

SEQ ID NO: 3855721 - DNA, 14 bp, Homo sapiens
cccggcccagagac

SEQ ID NO: 3855722 - DNA, 18 bp, Homo sapiens
cccggcctcagcacccct

SEQ ID NO: 3855723 - DNA, 19 bp, Homo sapiens
cccggcctccactccccca

SEQ ID NO: 3855724 - DNA, 17 bp, Homo sapiens
cccggcctgctcccagc

SEQ ID NO: 3855725 - DNA, 20 bp, Homo sapiens
cccggcctgctcccagcagc

SEQ ID NO: 3855726 - DNA, 21 bp, Homo sapiens
cccggcctgctcccagcagcc

SEQ ID NO: 3855727 - DNA, 13 bp, Homo sapiens
cccggctgcctgc

SEQ ID NO: 3855728 - DNA, 17 bp, Homo sapiens
cccgggctctggccacc

SEQ ID NO: 3855729 - DNA, 17 bp, Homo sapiens
cccgggtgcctcagagc

SEQ ID NO: 3855730 - DNA, 23 bp, Homo sapiens
cccgggtgcctcagagcaggctc

SEQ ID NO: 3855731 - DNA, 20 bp, Homo sapiens
cccgggtgtgcctgccctgg

SEQ ID NO: 3855732 - DNA, 22 bp, Homo sapiens
cccggtcccttgagacctcagc

SEQ ID NO: 3855733 - DNA, 21 bp, Homo sapiens
cccgtctggggttcagcccct

SEQ ID NO: 3855734 - DNA, 17 bp, Homo sapiens
cccgtgcagtacaggca

SEQ ID NO: 3855735 - DNA, 16 bp, Homo sapiens
cccgtgtggcttacaa

SEQ ID NO: 3855736 - DNA, 19 bp, Homo sapiens
cccgttctgctggcctgga

SEQ ID NO: 3855737 - DNA, 12 bp, Homo sapiens
ccctaaaataaa

SEQ ID NO: 3855738 - DNA, 13 bp, Homo sapiens
ccctaaaataaaa

SEQ ID NO: 3855739 - DNA, 22 bp, Homo sapiens
ccctaacgggggtgcggcagga

SEQ ID NO: 3855740 - DNA, 17 bp, Homo sapiens
ccctaagaaaccccagg

SEQ ID NO: 3855741 - DNA, 19 bp, Homo sapiens
ccctaaggatctctcagga

SEQ ID NO: 3855742 - DNA, 15 bp, Homo sapiens
ccctacacctccctc

SEQ ID NO: 3855743 - DNA, 19 bp, Homo sapiens
ccctacatcttcagctccc

SEQ ID NO: 3855744 - DNA, 20 bp, Homo sapiens
ccctacatcttcagctccca

SEQ ID NO: 3855745 - DNA, 24 bp, Homo sapiens
ccctacatcttcagctcccatagc

SEQ ID NO: 3855746 - DNA, 14 bp, Homo sapiens
ccctactgagaaac

SEQ ID NO: 3855747 - DNA, 19 bp, Homo sapiens
ccctacttcttttgctctt

SEQ ID NO: 3855748 - DNA, 21 bp, Homo sapiens
ccctaggctgagctggcattg

SEQ ID NO: 3855749 - DNA, 11 bp, Homo sapiens
ccctatcaaaa

SEQ ID NO: 3855750 - DNA, 20 bp, Homo sapiens
ccctatcaaaacatatcaat

SEQ ID NO: 3855751 - DNA, 15 bp, Homo sapiens
ccctcaaaccctgtg

SEQ ID NO: 3855752 - DNA, 18 bp, Homo sapiens
ccctcaaatgacccaaag

SEQ ID NO: 3855753 - DNA, 20 bp, Homo sapiens
ccctcaaatgacccaaagac

SEQ ID NO: 3855754 - DNA, 15 bp, Homo sapiens
ccctcaaatgtcaga

SEQ ID NO: 3855755 - DNA, 13 bp, Homo sapiens
ccctcaccaggat

SEQ ID NO: 3855756 - DNA, 14 bp, Homo sapiens
ccctcacctgggcc

SEQ ID NO: 3855757 - DNA, 19 bp, Homo sapiens
ccctcacctgggcctttcc

SEQ ID NO: 3855758 - DNA, 16 bp, Homo sapiens
ccctcactctggcctc

SEQ ID NO: 3855759 - DNA, 15 bp, Homo sapiens
ccctcactctgtcag

SEQ ID NO: 3855760 - DNA, 18 bp, Homo sapiens
ccctcagatgatctctcc

SEQ ID NO: 3855761 - DNA, 18 bp, Homo sapiens
ccctcagtcagttcccgg

SEQ ID NO: 3855762 - DNA, 23 bp, Homo sapiens
ccctcagtttttcggtgggacag

SEQ ID NO: 3855763 - DNA, 17 bp, Homo sapiens
ccctcattcaggaaaac

SEQ ID NO: 3855764 - DNA, 12 bp, Homo sapiens
ccctcattcccc

SEQ ID NO: 3855765 - DNA, 13 bp, Homo sapiens
ccctccaaagccc

SEQ ID NO: 3855766 - DNA, 18 bp, Homo sapiens
ccctccacgcctcctggc

SEQ ID NO: 3855767 - DNA, 15 bp, Homo sapiens
ccctccagaccctgc

SEQ ID NO: 3855768 - DNA, 22 bp, Homo sapiens
ccctccagaccctgcctgagcc

SEQ ID NO: 3855769 - DNA, 14 bp, Homo sapiens
ccctccaggcatgc

SEQ ID NO: 3855770 - DNA, 15 bp, Homo sapiens
ccctccaggcatgct

SEQ ID NO: 3855771 - DNA, 19 bp, Homo sapiens
ccctccaggcatgctggcc

SEQ ID NO: 3855772 - DNA, 23 bp, Homo sapiens
ccctcccaacctcaatgccctgc

SEQ ID NO: 3855773 - DNA, 19 bp, Homo sapiens
ccctccccacacctcccta

SEQ ID NO: 3855774 - DNA, 16 bp, Homo sapiens
ccctccccacagtcct

SEQ ID NO: 3855775 - DNA, 17 bp, Homo sapiens
ccctccccacagtcctc

SEQ ID NO: 3855776 - DNA, 13 bp, Homo sapiens
ccctccccagggg

SEQ ID NO: 3855777 - DNA, 14 bp, Homo sapiens
ccctccccagggga

SEQ ID NO: 3855778 - DNA, 16 bp, Homo sapiens
ccctccccgcaccccc

SEQ ID NO: 3855779 - DNA, 16 bp, Homo sapiens
ccctcccctgccccca

SEQ ID NO: 3855780 - DNA, 15 bp, Homo sapiens
ccctccctctgcccc

SEQ ID NO: 3855781 - DNA, 21 bp, Homo sapiens
ccctccctgactccctgtggg

SEQ ID NO: 3855782 - DNA, 14 bp, Homo sapiens
ccctcctcaccccg

SEQ ID NO: 3855783 - DNA, 13 bp, Homo sapiens
ccctcctctgcca

SEQ ID NO: 3855784 - DNA, 17 bp, Homo sapiens
ccctcctggagcatccc

SEQ ID NO: 3855785 - DNA, 14 bp, Homo sapiens
ccctccttcccttc

SEQ ID NO: 3855786 - DNA, 15 bp, Homo sapiens
ccctccttcccttct

SEQ ID NO: 3855787 - DNA, 19 bp, Homo sapiens
ccctccttgctctgcaggc

SEQ ID NO: 3855788 - DNA, 20 bp, Homo sapiens
ccctccttgctctgcaggca

SEQ ID NO: 3855789 - DNA, 18 bp, Homo sapiens
ccctcgaaccaaggcagc

SEQ ID NO: 3855790 - DNA, 20 bp, Homo sapiens
ccctcgaaccaaggcagcct

SEQ ID NO: 3855791 - DNA, 24 bp, Homo sapiens
ccctcgaaccaaggcagcctccag

SEQ ID NO: 3855792 - DNA, 17 bp, Homo sapiens
ccctcgctgctgctact

SEQ ID NO: 3855793 - DNA, 21 bp, Homo sapiens
ccctcgctgctgctactaccc

SEQ ID NO: 3855794 - DNA, 23 bp, Homo sapiens
ccctcggaagccgtctgactcca

SEQ ID NO: 3855795 - DNA, 14 bp, Homo sapiens
ccctcggacccacc

SEQ ID NO: 3855796 - DNA, 24 bp, Homo sapiens
ccctcgtccacaggggcaggcctg

SEQ ID NO: 3855797 - DNA, 14 bp, Homo sapiens
ccctcttttggcct

SEQ ID NO: 3855798 - DNA, 15 bp, Homo sapiens
ccctgaaaacccaga

SEQ ID NO: 3855799 - DNA, 18 bp, Homo sapiens
ccctgaacctcagtttcc

SEQ ID NO: 3855800 - DNA, 17 bp, Homo sapiens
ccctgaaggttcctgag

SEQ ID NO: 3855801 - DNA, 20 bp, Homo sapiens
ccctgaatggttccatgcct

SEQ ID NO: 3855802 - DNA, 14 bp, Homo sapiens
ccctgacctcccag

SEQ ID NO: 3855803 - DNA, 20 bp, Homo sapiens
ccctgacctcccagccctat

SEQ ID NO: 3855804 - DNA, 16 bp, Homo sapiens
ccctgactccctgtgg

SEQ ID NO: 3855805 - DNA, 10 bp, Homo sapiens
ccctgagact

SEQ ID NO: 3855806 - DNA, 15 bp, Homo sapiens
ccctgagactccaga

SEQ ID NO: 3855807 - DNA, 13 bp, Homo sapiens
ccctgagctttgg

SEQ ID NO: 3855808 - DNA, 12 bp, Homo sapiens
ccctgaggactg

SEQ ID NO: 3855809 - DNA, 16 bp, Homo sapiens
ccctgaggactggaga

SEQ ID NO: 3855810 - DNA, 18 bp, Homo sapiens
ccctgaggactggagacc

SEQ ID NO: 3855811 - DNA, 13 bp, Homo sapiens
ccctgaggagtct

SEQ ID NO: 3855812 - DNA, 14 bp, Homo sapiens
ccctgaggagtctg

SEQ ID NO: 3855813 - DNA, 16 bp, Homo sapiens
ccctgaggagtctgag

SEQ ID NO: 3855814 - DNA, 19 bp, Homo sapiens
ccctgaggagtctgaggtc

SEQ ID NO: 3855815 - DNA, 19 bp, Homo sapiens
ccctgagtcaactggagca

SEQ ID NO: 3855816 - DNA, 16 bp, Homo sapiens
ccctgagtcaccagga

SEQ ID NO: 3855817 - DNA, 20 bp, Homo sapiens
ccctgagtggatctccaagg

SEQ ID NO: 3855818 - DNA, 19 bp, Homo sapiens
ccctgcagcttgtagccag

SEQ ID NO: 3855819 - DNA, 14 bp, Homo sapiens
ccctgccacctgtc

SEQ ID NO: 3855820 - DNA, 17 bp, Homo sapiens
ccctgccacctgtctgt

SEQ ID NO: 3855821 - DNA, 21 bp, Homo sapiens
ccctgccaggaggctgcggcc

SEQ ID NO: 3855822 - DNA, 20 bp, Homo sapiens
ccctgcccacttcagcccag

SEQ ID NO: 3855823 - DNA, 21 bp, Homo sapiens
ccctgcccacttcagcccagc

SEQ ID NO: 3855824 - DNA, 16 bp, Homo sapiens
ccctgcccccatctcc

SEQ ID NO: 3855825 - DNA, 23 bp, Homo sapiens
ccctgcccccatctccccaggcc

SEQ ID NO: 3855826 - DNA, 23 bp, Homo sapiens
ccctgcccctcccttcaaccatt

SEQ ID NO: 3855827 - DNA, 14 bp, Homo sapiens
ccctgccgcctcaa

SEQ ID NO: 3855828 - DNA, 16 bp, Homo sapiens
ccctgcctcatccacc

SEQ ID NO: 3855829 - DNA, 17 bp, Homo sapiens
ccctgcctcatccacca

SEQ ID NO: 3855830 - DNA, 15 bp, Homo sapiens
ccctgcctgagccca

SEQ ID NO: 3855831 - DNA, 13 bp, Homo sapiens
ccctgcctgccca

SEQ ID NO: 3855832 - DNA, 14 bp, Homo sapiens
ccctgcctgcccac

SEQ ID NO: 3855833 - DNA, 12 bp, Homo sapiens
ccctgcctggag

SEQ ID NO: 3855834 - DNA, 13 bp, Homo sapiens
ccctgcctggagg

SEQ ID NO: 3855835 - DNA, 24 bp, Homo sapiens
ccctgcctggaggacctgagcctg

SEQ ID NO: 3855836 - DNA, 12 bp, Homo sapiens
ccctgcctgggt

SEQ ID NO: 3855837 - DNA, 22 bp, Homo sapiens
ccctgcgtcctgacgccctgcg

SEQ ID NO: 3855838 - DNA, 16 bp, Homo sapiens
ccctgcgttggagcca

SEQ ID NO: 3855839 - DNA, 22 bp, Homo sapiens
ccctgctactcctgtgctctgg

SEQ ID NO: 3855840 - DNA, 14 bp, Homo sapiens
ccctgctcctccca

SEQ ID NO: 3855841 - DNA, 20 bp, Homo sapiens
ccctgctgccgcctcccagc

SEQ ID NO: 3855842 - DNA, 22 bp, Homo sapiens
ccctgctgccgcctcccagcct

SEQ ID NO: 3855843 - DNA, 17 bp, Homo sapiens
ccctgcttacctgacgg

SEQ ID NO: 3855844 - DNA, 19 bp, Homo sapiens
ccctgctttgggctgccct

SEQ ID NO: 3855845 - DNA, 20 bp, Homo sapiens
ccctgctttgggctgccctg

SEQ ID NO: 3855846 - DNA, 9 bp, Homo sapiens
ccctggaat

SEQ ID NO: 3855847 - DNA, 19 bp, Homo sapiens
ccctggaattcagcaccct

SEQ ID NO: 3855848 - DNA, 23 bp, Homo sapiens
ccctggaattcagcaccctgggt

SEQ ID NO: 3855849 - DNA, 19 bp, Homo sapiens
ccctggagtcccctgggcc

SEQ ID NO: 3855850 - DNA, 23 bp, Homo sapiens
ccctggagtcccctgggcctgga

SEQ ID NO: 3855851 - DNA, 15 bp, Homo sapiens
ccctggatcagaaca

SEQ ID NO: 3855852 - DNA, 17 bp, Homo sapiens
ccctggatcagaacagg

SEQ ID NO: 3855853 - DNA, 17 bp, Homo sapiens
ccctggatgggcattgg

SEQ ID NO: 3855854 - DNA, 21 bp, Homo sapiens
ccctggatgggcattgggctg

SEQ ID NO: 3855855 - DNA, 18 bp, Homo sapiens
ccctggatgtcccctgtc

SEQ ID NO: 3855856 - DNA, 21 bp, Homo sapiens
ccctggatgtgtggggcatgg

SEQ ID NO: 3855857 - DNA, 22 bp, Homo sapiens
ccctggccggcccaggcctcca

SEQ ID NO: 3855858 - DNA, 15 bp, Homo sapiens
ccctggcctgtggag

SEQ ID NO: 3855859 - DNA, 19 bp, Homo sapiens
ccctggctctcagaaggta

SEQ ID NO: 3855860 - DNA, 19 bp, Homo sapiens
ccctggctgaccccaaaga

SEQ ID NO: 3855861 - DNA, 16 bp, Homo sapiens
ccctggcttgcttgcc

SEQ ID NO: 3855862 - DNA, 19 bp, Homo sapiens
ccctggcttgtaactccac

SEQ ID NO: 3855863 - DNA, 18 bp, Homo sapiens
ccccacattggacttcct

SEQ ID NO: 3855864 - DNA, 20 bp, Homo sapiens
ccccacatttacctcgaggc

SEQ ID NO: 3855865 - DNA, 23 bp, Homo sapiens
ccccaccacgatgtggccctggc

SEQ ID NO: 3855866 - DNA, 17 bp, Homo sapiens
ccccacccccttcagtg

SEQ ID NO: 3855867 - DNA, 21 bp, Homo sapiens
ccccacccccttcagtgccca

SEQ ID NO: 3855868 - DNA, 22 bp, Homo sapiens
ccccaccctcaaaccctgtggg

SEQ ID NO: 3855869 - DNA, 18 bp, Homo sapiens
ccccacctcatgcctggc

SEQ ID NO: 3855870 - DNA, 11 bp, Homo sapiens
ccccacctggg

SEQ ID NO: 3855871 - DNA, 13 bp, Homo sapiens
ccccaccttcccc

SEQ ID NO: 3855872 - DNA, 14 bp, Homo sapiens
ccccaccttgccaa

SEQ ID NO: 3855873 - DNA, 17 bp, Homo sapiens
ccccacgagggtcagga

SEQ ID NO: 3855874 - DNA, 19 bp, Homo sapiens
ccccacgagtcacctgcaa

SEQ ID NO: 3855875 - DNA, 21 bp, Homo sapiens
ccccacgagtcacctgcaagc

SEQ ID NO: 3855876 - DNA, 18 bp, Homo sapiens
ccccactcaccagtgtcc

SEQ ID NO: 3855877 - DNA, 13 bp, Homo sapiens
ccccactctgctc

SEQ ID NO: 3855878 - DNA, 16 bp, Homo sapiens
ccccagaaggcaggga

SEQ ID NO: 3855879 - DNA, 12 bp, Homo sapiens
ccccagacacat

SEQ ID NO: 3855880 - DNA, 21 bp, Homo sapiens
ccccagagccactacctttgt

SEQ ID NO: 3855881 - DNA, 22 bp, Homo sapiens
ccccagagccactacctttgtc

SEQ ID NO: 3855882 - DNA, 19 bp, Homo sapiens
ccccagagccccactcccg

SEQ ID NO: 3855883 - DNA, 17 bp, Homo sapiens
ccggggaactggccaag

SEQ ID NO: 3855884 - DNA, 16 bp, Homo sapiens
ccggggctggcaagca

SEQ ID NO: 3855885 - DNA, 20 bp, Homo sapiens
ccggggctggcaagcaggga

SEQ ID NO: 3855886 - DNA, 17 bp, Homo sapiens
ccgggggccagacacag

SEQ ID NO: 3855887 - DNA, 13 bp, Homo sapiens
ccggggtctgtgc

SEQ ID NO: 3855888 - DNA, 15 bp, Homo sapiens
ccggggtctgtgctg

SEQ ID NO: 3855889 - DNA, 17 bp, Homo sapiens
ccggggtctgtgctgtg

SEQ ID NO: 3855890 - DNA, 23 bp, Homo sapiens
ccggggtctgtgctgtgcctgct

SEQ ID NO: 3855891 - DNA, 21 bp, Homo sapiens
ccgggtgaaaatgccagtctg

SEQ ID NO: 3855892 - DNA, 14 bp, Homo sapiens
ccgggtgccattcc

SEQ ID NO: 3855893 - DNA, 21 bp, Homo sapiens
ccgggtgcctcagagcaggct

SEQ ID NO: 3855894 - DNA, 16 bp, Homo sapiens
ccgggtgggcctggcc

SEQ ID NO: 3855895 - DNA, 18 bp, Homo sapiens
ccgggtgtgcctgccctg

SEQ ID NO: 3855896 - DNA, 20 bp, Homo sapiens
ccgggtgtgcctgccctgga

SEQ ID NO: 3855897 - DNA, 18 bp, Homo sapiens
ccggtcccttgagacctc

SEQ ID NO: 3855898 - DNA, 21 bp, Homo sapiens
ccgtaggcagcctctctgcta

SEQ ID NO: 3855899 - DNA, 15 bp, Homo sapiens
ccgtagttccctgaa

SEQ ID NO: 3855900 - DNA, 21 bp, Homo sapiens
ccgtcatggcttaatgtttat

SEQ ID NO: 3855901 - DNA, 12 bp, Homo sapiens
ccgtccacccag

SEQ ID NO: 3855902 - DNA, 17 bp, Homo sapiens
ccgtccacccaggctgc

SEQ ID NO: 3855903 - DNA, 23 bp, Homo sapiens
ccgtccacccaggctgcactgca

SEQ ID NO: 3855904 - DNA, 16 bp, Homo sapiens
ccgtccaggagcctgg

SEQ ID NO: 3855905 - DNA, 18 bp, Homo sapiens
ccgtccaggagcctgtgc

SEQ ID NO: 3855906 - DNA, 14 bp, Homo sapiens
ccgtctctgtcccg

SEQ ID NO: 3855907 - DNA, 19 bp, Homo sapiens
ccgtctgactccagagtct

SEQ ID NO: 3855908 - DNA, 16 bp, Homo sapiens
ccgtgaagcagtgcct

SEQ ID NO: 3855909 - DNA, 17 bp, Homo sapiens
ccgtgaagcagtgcctc

SEQ ID NO: 3855910 - DNA, 17 bp, Homo sapiens
ccgtgatgctcaggctt

SEQ ID NO: 3855911 - DNA, 16 bp, Homo sapiens
ccgtgatttggaagag

SEQ ID NO: 3855912 - DNA, 22 bp, Homo sapiens
ccgtgatttggaagagaggcac

SEQ ID NO: 3855913 - DNA, 18 bp, Homo sapiens
ccgtgcagcttctgtcct

SEQ ID NO: 3855914 - DNA, 19 bp, Homo sapiens
ccgtgcagcttctgtcctg

SEQ ID NO: 3855915 - DNA, 22 bp, Homo sapiens
ccgtgccacccgtaggcagcct

SEQ ID NO: 3855916 - DNA, 15 bp, Homo sapiens
ccgtgccccgcctcc

SEQ ID NO: 3855917 - DNA, 15 bp, Homo sapiens
ccgtgccttcagctc

SEQ ID NO: 3855918 - DNA, 11 bp, Homo sapiens
ccgtggaggct

SEQ ID NO: 3855919 - DNA, 22 bp, Homo sapiens
ccgtggaggctgctcggggtgc

SEQ ID NO: 3855920 - DNA, 19 bp, Homo sapiens
ccgtggcccttcctggaca

SEQ ID NO: 3855921 - DNA, 21 bp, Homo sapiens
ccgtggcccttcctggacagc

SEQ ID NO: 3855922 - DNA, 21 bp, Homo sapiens
ccgtggtggcaccgagaccaa

SEQ ID NO: 3855923 - DNA, 16 bp, Homo sapiens
ccgtgtctctgaggac

SEQ ID NO: 3855924 - DNA, 17 bp, Homo sapiens
ccgttactctccaacct

SEQ ID NO: 3855925 - DNA, 22 bp, Homo sapiens
ccgttactctccaacctggaca

SEQ ID NO: 3855926 - DNA, 13 bp, Homo sapiens
ccgttccctgtca

SEQ ID NO: 3855927 - DNA, 14 bp, Homo sapiens
ccgttttcatcctg

SEQ ID NO: 3855928 - DNA, 18 bp, Homo sapiens
ccgttttcatcctggcct

SEQ ID NO: 3855929 - DNA, 21 bp, Homo sapiens
ccgttttcatcctggcctcct

SEQ ID NO: 3855930 - DNA, 13 bp, Homo sapiens
cctaaaataaaaa

SEQ ID NO: 3855931 - DNA, 14 bp, Homo sapiens
cctaaaatgacagc

SEQ ID NO: 3855932 - DNA, 19 bp, Homo sapiens
cctaaacccccgctccaga

SEQ ID NO: 3855933 - DNA, 20 bp, Homo sapiens
cctaaagaggaaaagtgcaa

SEQ ID NO: 3855934 - DNA, 16 bp, Homo sapiens
cctaactgaagagaca

SEQ ID NO: 3855935 - DNA, 22 bp, Homo sapiens
cctaagaaaccccagggcaggg

SEQ ID NO: 3855936 - DNA, 23 bp, Homo sapiens
cctaagaaaccccagggcaggga

SEQ ID NO: 3855937 - DNA, 20 bp, Homo sapiens
cctaagaccggcggccatga

SEQ ID NO: 3855938 - DNA, 22 bp, Homo sapiens
cctaagcagtgcttgtaaacca

SEQ ID NO: 3855939 - DNA, 17 bp, Homo sapiens
cctaaggacacactaat

SEQ ID NO: 3855940 - DNA, 21 bp, Homo sapiens
ccctggtgcactggccccacc

SEQ ID NO: 3855941 - DNA, 19 bp, Homo sapiens
ccctggtgcagaggtgagc

SEQ ID NO: 3855942 - DNA, 15 bp, Homo sapiens
ccctggtgctgccac

SEQ ID NO: 3855943 - DNA, 14 bp, Homo sapiens
ccctggtgtgtttc

SEQ ID NO: 3855944 - DNA, 14 bp, Homo sapiens
ccctgtacccagct

SEQ ID NO: 3855945 - DNA, 16 bp, Homo sapiens
ccctgtacccagctcc

SEQ ID NO: 3855946 - DNA, 13 bp, Homo sapiens
ccctgtagctctg

SEQ ID NO: 3855947 - DNA, 19 bp, Homo sapiens
ccctgtatataatactaaa

SEQ ID NO: 3855948 - DNA, 17 bp, Homo sapiens
ccctgtcagaggctaag

SEQ ID NO: 3855949 - DNA, 17 bp, Homo sapiens
ccctgtcccaccaactc

SEQ ID NO: 3855950 - DNA, 14 bp, Homo sapiens
ccctgtcccctgaa

SEQ ID NO: 3855951 - DNA, 15 bp, Homo sapiens
ccctgtcctcctcgg

SEQ ID NO: 3855952 - DNA, 13 bp, Homo sapiens
ccctgtcttctct

SEQ ID NO: 3855953 - DNA, 13 bp, Homo sapiens
ccctgtcttgtcc

SEQ ID NO: 3855954 - DNA, 12 bp, Homo sapiens
ccctgtgccagc

SEQ ID NO: 3855955 - DNA, 15 bp, Homo sapiens
ccctgtggggcctga

SEQ ID NO: 3855956 - DNA, 13 bp, Homo sapiens
ccctgttcactct

SEQ ID NO: 3855957 - DNA, 14 bp, Homo sapiens
ccctgttcactcta

SEQ ID NO: 3855958 - DNA, 18 bp, Homo sapiens
ccctgtttaatatttaaa

SEQ ID NO: 3855959 - DNA, 19 bp, Homo sapiens
ccctgtttcctttcaggag

SEQ ID NO: 3855960 - DNA, 21 bp, Homo sapiens
cccttagagattgccccagag

SEQ ID NO: 3855961 - DNA, 15 bp, Homo sapiens
cccttatccaggact

SEQ ID NO: 3855962 - DNA, 19 bp, Homo sapiens
cccttcagggccagaagga

SEQ ID NO: 3855963 - DNA, 11 bp, Homo sapiens
cccttcatttg

SEQ ID NO: 3855964 - DNA, 19 bp, Homo sapiens
cccttcccaatcagcactg

SEQ ID NO: 3855965 - DNA, 16 bp, Homo sapiens
cccttcccactggagg

SEQ ID NO: 3855966 - DNA, 19 bp, Homo sapiens
cccttccccttctgtgtca

SEQ ID NO: 3855967 - DNA, 12 bp, Homo sapiens
cccttccctgct

SEQ ID NO: 3855968 - DNA, 15 bp, Homo sapiens
cccttccctgctttg

SEQ ID NO: 3855969 - DNA, 21 bp, Homo sapiens
cccttcctccctattaaccta

SEQ ID NO: 3855970 - DNA, 12 bp, Homo sapiens
cccttcctcctg

SEQ ID NO: 3855971 - DNA, 13 bp, Homo sapiens
cccttcctctcca

SEQ ID NO: 3855972 - DNA, 14 bp, Homo sapiens
cccttcctggacag

SEQ ID NO: 3855973 - DNA, 14 bp, Homo sapiens
cccttcctggcctc

SEQ ID NO: 3855974 - DNA, 16 bp, Homo sapiens
cccttcctttcctctg

SEQ ID NO: 3855975 - DNA, 22 bp, Homo sapiens
cccttcgaggttgccccttccc

SEQ ID NO: 3855976 - DNA, 20 bp, Homo sapiens
cccttcgctgccaggacacc

SEQ ID NO: 3855977 - DNA, 18 bp, Homo sapiens
cccttctttaaatcaaaa

SEQ ID NO: 3855978 - DNA, 14 bp, Homo sapiens
cccttctttcctct

SEQ ID NO: 3855979 - DNA, 23 bp, Homo sapiens
cccttgacgtcaagtctccttcc

SEQ ID NO: 3855980 - DNA, 15 bp, Homo sapiens
cccttgagacctcag

SEQ ID NO: 3855981 - DNA, 15 bp, Homo sapiens
cccttgcccccatcc

SEQ ID NO: 3855982 - DNA, 12 bp, Homo sapiens
cccttgccctga

SEQ ID NO: 3855983 - DNA, 13 bp, Homo sapiens
cccttgccctgac

SEQ ID NO: 3855984 - DNA, 19 bp, Homo sapiens
cccttgccctgacctccca

SEQ ID NO: 3855985 - DNA, 21 bp, Homo sapiens
cccttgccctgacctcccagc

SEQ ID NO: 3855986 - DNA, 19 bp, Homo sapiens
cccttgctcagtgcctcct

SEQ ID NO: 3855987 - DNA, 19 bp, Homo sapiens
cccttggaaagttcagcca

SEQ ID NO: 3855988 - DNA, 20 bp, Homo sapiens
cccttggaaagttcagccag

SEQ ID NO: 3855989 - DNA, 21 bp, Homo sapiens
cccttggaaagttcagccaga

SEQ ID NO: 3855990 - DNA, 22 bp, Homo sapiens
cccttggctgtgaggcccctgg

SEQ ID NO: 3855991 - DNA, 23 bp, Homo sapiens
cccttggcttttgcttggcagag

SEQ ID NO: 3855992 - DNA, 19 bp, Homo sapiens
cccttgggcatccacccag

SEQ ID NO: 3855993 - DNA, 23 bp, Homo sapiens
cccttgggcatccacccagtgct

SEQ ID NO: 3855994 - DNA, 18 bp, Homo sapiens
cccttggggcctggcttg

SEQ ID NO: 3855995 - DNA, 23 bp, Homo sapiens
cccttggggcctggcttgctcca

SEQ ID NO: 3855996 - DNA, 19 bp, Homo sapiens
cccttggggttcccccaga

SEQ ID NO: 3855997 - DNA, 16 bp, Homo sapiens
cccttgtaccccatcc

SEQ ID NO: 3855998 - DNA, 18 bp, Homo sapiens
cccttgtaccccatccct

SEQ ID NO: 3855999 - DNA, 18 bp, Homo sapiens
cccttgtcctgccagctg

SEQ ID NO: 3856000 - DNA, 22 bp, Homo sapiens
cccttgtcctgccagctgcctt

SEQ ID NO: 3856001 - DNA, 14 bp, Homo sapiens
cccttgtgtcagag

SEQ ID NO: 3856002 - DNA, 21 bp, Homo sapiens
ccctttccttccttccctggc

SEQ ID NO: 3856003 - DNA, 23 bp, Homo sapiens
cccttttacagctcttggcattt

SEQ ID NO: 3856004 - DNA, 14 bp, Homo sapiens
cccttttcctccag

SEQ ID NO: 3856005 - DNA, 19 bp, Homo sapiens
cccttttcctccagacaga

SEQ ID NO: 3856006 - DNA, 15 bp, Homo sapiens
cccttttgcctggct

SEQ ID NO: 3856007 - DNA, 16 bp, Homo sapiens
cccttttgcctggctg

SEQ ID NO: 3856008 - DNA, 24 bp, Homo sapiens
ccgaaacaggctactctcctcggc

SEQ ID NO: 3856009 - DNA, 20 bp, Homo sapiens
ccgaagcccaggctgaagag

SEQ ID NO: 3856010 - DNA, 23 bp, Homo sapiens
ccgaagctaacagggaaggcagg

SEQ ID NO: 3856011 - DNA, 21 bp, Homo sapiens
ccgaaggttatggtcaatccc

SEQ ID NO: 3856012 - DNA, 14 bp, Homo sapiens
ccgacactgctgca

SEQ ID NO: 3856013 - DNA, 18 bp, Homo sapiens
ccgacactgctgcaccag

SEQ ID NO: 3856014 - DNA, 12 bp, Homo sapiens
ccgacagcccag

SEQ ID NO: 3856015 - DNA, 14 bp, Homo sapiens
ccgacagcccagcc

SEQ ID NO: 3856016 - DNA, 12 bp, Homo sapiens
ccgacagcctgg

SEQ ID NO: 3856017 - DNA, 14 bp, Homo sapiens
ccgaccccatctca

SEQ ID NO: 3856018 - DNA, 13 bp, Homo sapiens
ccgacctcgtcct

SEQ ID NO: 3856019 - DNA, 23 bp, Homo sapiens
ccgacctcgtcctccccctgcca

SEQ ID NO: 3856020 - DNA, 22 bp, Homo sapiens
ccgagagaggcgcgtctgcccc

SEQ ID NO: 3856021 - DNA, 20 bp, Homo sapiens
ccgagagcctgctcccccac

SEQ ID NO: 3856022 - DNA, 20 bp, Homo sapiens
ccgagagtagccgagagcct

SEQ ID NO: 3856023 - DNA, 18 bp, Homo sapiens
ccgagcaaccgtggccct

SEQ ID NO: 3856024 - DNA, 18 bp, Homo sapiens
ccgagcagctgagcaggg

SEQ ID NO: 3856025 - DNA, 20 bp, Homo sapiens
ccgagcagctgagcagggcc

SEQ ID NO: 3856026 - DNA, 12 bp, Homo sapiens
cctacctgctgc

SEQ ID NO: 3856027 - DNA, 16 bp, Homo sapiens
cctacctgtgcctgac

SEQ ID NO: 3856028 - DNA, 20 bp, Homo sapiens
cctactagttttccttgaaa

SEQ ID NO: 3856029 - DNA, 15 bp, Homo sapiens
cctactcacacaggc

SEQ ID NO: 3856030 - DNA, 22 bp, Homo sapiens
cctacttcttttgctcttagct

SEQ ID NO: 3856031 - DNA, 14 bp, Homo sapiens
cctacttgtgactg

SEQ ID NO: 3856032 - DNA, 20 bp, Homo sapiens
cctactttatgtatggagct

SEQ ID NO: 3856033 - DNA, 20 bp, Homo sapiens
cctagaaccaagcttcagag

SEQ ID NO: 3856034 - DNA, 21 bp, Homo sapiens
cctagaagagtgtgaaaagga

SEQ ID NO: 3856035 - DNA, 12 bp, Homo sapiens
cctagacctggg

SEQ ID NO: 3856036 - DNA, 14 bp, Homo sapiens
cctagacctgggcc

SEQ ID NO: 3856037 - DNA, 23 bp, Homo sapiens
cctagagaagctaaaacctgagc

SEQ ID NO: 3856038 - DNA, 21 bp, Homo sapiens
cctagagctcctgtccctacc

SEQ ID NO: 3856039 - DNA, 16 bp, Homo sapiens
cctagaggtgggcagc

SEQ ID NO: 3856040 - DNA, 17 bp, Homo sapiens
cctagatccacacacag

SEQ ID NO: 3856041 - DNA, 19 bp, Homo sapiens
cctagatccacacacagag

SEQ ID NO: 3856042 - DNA, 13 bp, Homo sapiens
cctagcaattcca

SEQ ID NO: 3856043 - DNA, 12 bp, Homo sapiens
cctagccacctc

SEQ ID NO: 3856044 - DNA, 18 bp, Homo sapiens
cctagcgctctcttccag

SEQ ID NO: 3856045 - DNA, 22 bp, Homo sapiens
cctagctccaccctcaccagga

SEQ ID NO: 3856046 - DNA, 15 bp, Homo sapiens
cctaggaaagcagtg

SEQ ID NO: 3856047 - DNA, 17 bp, Homo sapiens
cctaggagaagcagcct

SEQ ID NO: 3856048 - DNA, 21 bp, Homo sapiens
cctaggagaagcagcctccta

SEQ ID NO: 3856049 - DNA, 15 bp, Homo sapiens
cctaggaggaccccg

SEQ ID NO: 3856050 - DNA, 17 bp, Homo sapiens
cctaggattcctccccc

SEQ ID NO: 3856051 - DNA, 16 bp, Homo sapiens
cctaggccactcctcc

SEQ ID NO: 3856052 - DNA, 17 bp, Homo sapiens
cctaggccactcctcca

SEQ ID NO: 3856053 - DNA, 17 bp, Homo sapiens
cctaggctccaccccat

SEQ ID NO: 3856054 - DNA, 12 bp, Homo sapiens
cctaggtgctgg

SEQ ID NO: 3856055 - DNA, 15 bp, Homo sapiens
cctaggtgctggatg

SEQ ID NO: 3856056 - DNA, 16 bp, Homo sapiens
cctagtactctctgct

SEQ ID NO: 3856057 - DNA, 19 bp, Homo sapiens
cctagtactctctgctcta

SEQ ID NO: 3856058 - DNA, 22 bp, Homo sapiens
cctagtactctctgctctagcc

SEQ ID NO: 3856059 - DNA, 16 bp, Homo sapiens
cctagtccagtgacct

SEQ ID NO: 3856060 - DNA, 19 bp, Homo sapiens
cctagtggggtctccctct

SEQ ID NO: 3856061 - DNA, 20 bp, Homo sapiens
cctagtggggtctccctctc

SEQ ID NO: 3856062 - DNA, 22 bp, Homo sapiens
cctataaggagagttcaagcct

SEQ ID NO: 3856063 - DNA, 14 bp, Homo sapiens
cctataatgtgtgt

SEQ ID NO: 3856064 - DNA, 21 bp, Homo sapiens
cctataatgtgtgtatgtgta

SEQ ID NO: 3856065 - DNA, 18 bp, Homo sapiens
cctataccatatgtctgc

SEQ ID NO: 3856066 - DNA, 21 bp, Homo sapiens
cctatccacccagcccattct

SEQ ID NO: 3856067 - DNA, 23 bp, Homo sapiens
cctatccttggagagcagctggc

SEQ ID NO: 3856068 - DNA, 14 bp, Homo sapiens
cctatcttctccat

SEQ ID NO: 3856069 - DNA, 14 bp, Homo sapiens
cctatggagagccc

SEQ ID NO: 3856070 - DNA, 22 bp, Homo sapiens
cctatggagagccctgggaccg

SEQ ID NO: 3856071 - DNA, 19 bp, Homo sapiens
cctatgtcaatttgtatat

SEQ ID NO: 3856072 - DNA, 22 bp, Homo sapiens
cctatgtcctaaggacacacta

SEQ ID NO: 3856073 - DNA, 15 bp, Homo sapiens
cctattctcaccagg

SEQ ID NO: 3856074 - DNA, 14 bp, Homo sapiens
cctatttatgaaaa

SEQ ID NO: 3856075 - DNA, 15 bp, Homo sapiens
cctatttattcattc

SEQ ID NO: 3856076 - DNA, 17 bp, Homo sapiens
cctatttattcattcag

SEQ ID NO: 3856077 - DNA, 17 bp, Homo sapiens
cctatttattggggatc

SEQ ID NO: 3856078 - DNA, 20 bp, Homo sapiens
cctattttaaaaccatgcag

SEQ ID NO: 3856079 - DNA, 16 bp, Homo sapiens
cctcaaacatggaaga

SEQ ID NO: 3856080 - DNA, 16 bp, Homo sapiens
cctcaaatgacccaaa

SEQ ID NO: 3856081 - DNA, 13 bp, Homo sapiens
cctcaaatgtcag

SEQ ID NO: 3856082 - DNA, 21 bp, Homo sapiens
cctccctctgctgtcaccttg

SEQ ID NO: 3856083 - DNA, 17 bp, Homo sapiens
cctccctcttccttccc

SEQ ID NO: 3856084 - DNA, 19 bp, Homo sapiens
cctccctgactccctgtgg

SEQ ID NO: 3856085 - DNA, 18 bp, Homo sapiens
cctccctgcccctccctt

SEQ ID NO: 3856086 - DNA, 21 bp, Homo sapiens
cctccctgcccctcccttcaa

SEQ ID NO: 3856087 - DNA, 22 bp, Homo sapiens
cctccctgcccctcccttcaac

SEQ ID NO: 3856088 - DNA, 12 bp, Homo sapiens
cctccctgctac

SEQ ID NO: 3856089 - DNA, 11 bp, Homo sapiens
cctccctgtcc

SEQ ID NO: 3856090 - DNA, 15 bp, Homo sapiens
cctccctgtcctcct

SEQ ID NO: 3856091 - DNA, 21 bp, Homo sapiens
cctcccttgctcagtgcctcc

SEQ ID NO: 3856092 - DNA, 14 bp, Homo sapiens
cctccggggagagc

SEQ ID NO: 3856093 - DNA, 16 bp, Homo sapiens
cctccgtccacccagg

SEQ ID NO: 3856094 - DNA, 15 bp, Homo sapiens
cctcctaagcagctg

SEQ ID NO: 3856095 - DNA, 20 bp, Homo sapiens
cctcctaagcagctgggact

SEQ ID NO: 3856096 - DNA, 19 bp, Homo sapiens
cctcctagaggtgggcagc

SEQ ID NO: 3856097 - DNA, 16 bp, Homo sapiens
cctcctatccttggag

SEQ ID NO: 3856098 - DNA, 13 bp, Homo sapiens
cctcctcaccccc

SEQ ID NO: 3856099 - DNA, 16 bp, Homo sapiens
cctcctcacccccagc

SEQ ID NO: 3856100 - DNA, 13 bp, Homo sapiens
cctcctcaccccg

SEQ ID NO: 3856101 - DNA, 17 bp, Homo sapiens
cctcctccacagtgctg

SEQ ID NO: 3856102 - DNA, 22 bp, Homo sapiens
cctcctccactcactccagccc

SEQ ID NO: 3856103 - DNA, 12 bp, Homo sapiens
cctcctctgcca

SEQ ID NO: 3856104 - DNA, 13 bp, Homo sapiens
cctcctctgccac

SEQ ID NO: 3856105 - DNA, 15 bp, Homo sapiens
cctcctctgccacct

SEQ ID NO: 3856106 - DNA, 20 bp, Homo sapiens
cctcctctgccacctcccct

SEQ ID NO: 3856107 - DNA, 15 bp, Homo sapiens
cctcctctgcttgca

SEQ ID NO: 3856108 - DNA, 19 bp, Homo sapiens
cctcctgaagcctctgccc

SEQ ID NO: 3856109 - DNA, 20 bp, Homo sapiens
cctcctgatggccaagagca

SEQ ID NO: 3856110 - DNA, 12 bp, Homo sapiens
cctcctgcccag

SEQ ID NO: 3856111 - DNA, 13 bp, Homo sapiens
cctcctgcccagg

SEQ ID NO: 3856112 - DNA, 19 bp, Homo sapiens
cctcctgcccaggagagcc

SEQ ID NO: 3856113 - DNA, 18 bp, Homo sapiens
cctcctgcctctactggg

SEQ ID NO: 3856114 - DNA, 20 bp, Homo sapiens
cctcctggagcatcccaggc

SEQ ID NO: 3856115 - DNA, 11 bp, Homo sapiens
cctcctggcca

SEQ ID NO: 3856116 - DNA, 21 bp, Homo sapiens
cctcctggccggggcccctca

SEQ ID NO: 3856117 - DNA, 12 bp, Homo sapiens
cctcctgggacc

SEQ ID NO: 3856118 - DNA, 16 bp, Homo sapiens
cctccttatttatcaa

SEQ ID NO: 3856119 - DNA, 13 bp, Homo sapiens
cctccttcccttc

SEQ ID NO: 3856120 - DNA, 22 bp, Homo sapiens
cctccttcccttctctccttcc

SEQ ID NO: 3856121 - DNA, 15 bp, Homo sapiens
cctccttgctctgca

SEQ ID NO: 3856122 - DNA, 12 bp, Homo sapiens
cctcgaggcacc

SEQ ID NO: 3856123 - DNA, 13 bp, Homo sapiens
cctcgaggcaccg

SEQ ID NO: 3856124 - DNA, 15 bp, Homo sapiens
cctcgaggcaccggc

SEQ ID NO: 3856125 - DNA, 23 bp, Homo sapiens
cctcgaggcaccggcgctgcagg

SEQ ID NO: 3856126 - DNA, 14 bp, Homo sapiens
cctcgcagcaggtg

SEQ ID NO: 3856127 - DNA, 22 bp, Homo sapiens
cctcgcagcaggtgcaagagac

SEQ ID NO: 3856128 - DNA, 20 bp, Homo sapiens
cctcgcaggtctcagcccgg

SEQ ID NO: 3856129 - DNA, 22 bp, Homo sapiens
cctcgcaggtctcagcccggga

SEQ ID NO: 3856130 - DNA, 18 bp, Homo sapiens
cctcgctccccactctgc

SEQ ID NO: 3856131 - DNA, 22 bp, Homo sapiens
cctcgctccccactctgctctg

SEQ ID NO: 3856132 - DNA, 17 bp, Homo sapiens
cctcggagctgccagcc

SEQ ID NO: 3856133 - DNA, 15 bp, Homo sapiens
cctcggatcaccgag

SEQ ID NO: 3856134 - DNA, 16 bp, Homo sapiens
cctcgtaccagccagg

SEQ ID NO: 3856135 - DNA, 17 bp, Homo sapiens
cctcgtaccagccagga

SEQ ID NO: 3856136 - DNA, 18 bp, Homo sapiens
cctcgtccacaggggcag

SEQ ID NO: 3856137 - DNA, 16 bp, Homo sapiens
cctcgtcctccccctg

SEQ ID NO: 3856138 - DNA, 21 bp, Homo sapiens
cctcgtcctccccctgccagt

SEQ ID NO: 3856139 - DNA, 15 bp, Homo sapiens
cctcgtcctgtccca

SEQ ID NO: 3856140 - DNA, 16 bp, Homo sapiens
cctcgtcctgtcccag

SEQ ID NO: 3856141 - DNA, 18 bp, Homo sapiens
cctcgtggacacctgccc

SEQ ID NO: 3856142 - DNA, 16 bp, Homo sapiens
cctctagaacacccac

SEQ ID NO: 3856143 - DNA, 18 bp, Homo sapiens
cctctagaacacccactg

SEQ ID NO: 3856144 - DNA, 21 bp, Homo sapiens
cctctagaacacccactggcc

SEQ ID NO: 3856145 - DNA, 22 bp, Homo sapiens
cctctagaacacccactggcca

SEQ ID NO: 3856146 - DNA, 22 bp, Homo sapiens
cctctcaacagatctgtgggcc

SEQ ID NO: 3856147 - DNA, 19 bp, Homo sapiens
cctctccactgccttcgat

SEQ ID NO: 3856148 - DNA, 12 bp, Homo sapiens
cctctccaggca

SEQ ID NO: 3856149 - DNA, 17 bp, Homo sapiens
cctctccatatctcctt

SEQ ID NO: 3856150 - DNA, 20 bp, Homo sapiens
cctctccatatctccttccc

SEQ ID NO: 3856151 - DNA, 13 bp, Homo sapiens
cctctccatgccc

SEQ ID NO: 3856152 - DNA, 15 bp, Homo sapiens
cctctccatgcccaa

SEQ ID NO: 3856153 - DNA, 17 bp, Homo sapiens
cctctccatgcccaacc

SEQ ID NO: 3856154 - DNA, 18 bp, Homo sapiens
cctctcccaggccccatg

SEQ ID NO: 3856155 - DNA, 13 bp, Homo sapiens
cctctcccatgca

SEQ ID NO: 3856156 - DNA, 12 bp, Homo sapiens
cctctccccaaa

SEQ ID NO: 3856157 - DNA, 14 bp, Homo sapiens
cctctcccggctgc

SEQ ID NO: 3856158 - DNA, 16 bp, Homo sapiens
cctctcccggctgcct

SEQ ID NO: 3856159 - DNA, 19 bp, Homo sapiens
cctctcccggctgcctgcc

SEQ ID NO: 3856160 - DNA, 15 bp, Homo sapiens
cctctcctgcctact

SEQ ID NO: 3856161 - DNA, 22 bp, Homo sapiens
cctctcctgggggtggcaggca

SEQ ID NO: 3856162 - DNA, 14 bp, Homo sapiens
cctctccttgggct

SEQ ID NO: 3856163 - DNA, 15 bp, Homo sapiens
cctctcgagcccaga

SEQ ID NO: 3856164 - DNA, 16 bp, Homo sapiens
cctctcgagcccagat

SEQ ID NO: 3856165 - DNA, 19 bp, Homo sapiens
cctctcgagttctcctatc

SEQ ID NO: 3856166 - DNA, 18 bp, Homo sapiens
cctctctaagccacagct

SEQ ID NO: 3856167 - DNA, 16 bp, Homo sapiens
cctctctcagttattc

SEQ ID NO: 3856168 - DNA, 14 bp, Homo sapiens
cctgagcactgcca

SEQ ID NO: 3856169 - DNA, 15 bp, Homo sapiens
cctgagcactgccag

SEQ ID NO: 3856170 - DNA, 18 bp, Homo sapiens
cctgagcactgccaggag

SEQ ID NO: 3856171 - DNA, 19 bp, Homo sapiens
cctgagcactgccaggagg

SEQ ID NO: 3856172 - DNA, 20 bp, Homo sapiens
cctgagcactgccaggaggg

SEQ ID NO: 3856173 - DNA, 12 bp, Homo sapiens
cctgagcccagg

SEQ ID NO: 3856174 - DNA, 14 bp, Homo sapiens
cctgagcccaggga

SEQ ID NO: 3856175 - DNA, 15 bp, Homo sapiens
cctgagctggggcca

SEQ ID NO: 3856176 - DNA, 17 bp, Homo sapiens
cctgagctggggccaca

SEQ ID NO: 3856177 - DNA, 17 bp, Homo sapiens
cctgagctggggcctgg

SEQ ID NO: 3856178 - DNA, 18 bp, Homo sapiens
cctgagctggggcctgga

SEQ ID NO: 3856179 - DNA, 21 bp, Homo sapiens
cctgagctggggcctggagag

SEQ ID NO: 3856180 - DNA, 13 bp, Homo sapiens
cctgaggagtctg

SEQ ID NO: 3856181 - DNA, 21 bp, Homo sapiens
cctgaggcctctggaaagcaa

SEQ ID NO: 3856182 - DNA, 17 bp, Homo sapiens
cctgaggctcaagaggc

SEQ ID NO: 3856183 - DNA, 12 bp, Homo sapiens
cctgaggctcct

SEQ ID NO: 3856184 - DNA, 13 bp, Homo sapiens
cctgagggtcccc

SEQ ID NO: 3856185 - DNA, 15 bp, Homo sapiens
cctgagtcggcccca

SEQ ID NO: 3856186 - DNA, 22 bp, Homo sapiens
cctgagtcggccccacatggga

SEQ ID NO: 3856187 - DNA, 22 bp, Homo sapiens
cctgagtcttggcctgcctccc

SEQ ID NO: 3856188 - DNA, 13 bp, Homo sapiens
cctgagtggatct

SEQ ID NO: 3856189 - DNA, 14 bp, Homo sapiens
cctgagtggatctc

SEQ ID NO: 3856190 - DNA, 20 bp, Homo sapiens
cctgagtggatctccaagga

SEQ ID NO: 3856191 - DNA, 20 bp, Homo sapiens
cctgagtgtgggcttctgaa

SEQ ID NO: 3856192 - DNA, 19 bp, Homo sapiens
cctgataaagaacatctgt

SEQ ID NO: 3856193 - DNA, 17 bp, Homo sapiens
cctgataacaacctgga

SEQ ID NO: 3856194 - DNA, 18 bp, Homo sapiens
cctgataacaacctggag

SEQ ID NO: 3856195 - DNA, 19 bp, Homo sapiens
cctgataacaacctggaga

SEQ ID NO: 3856196 - DNA, 17 bp, Homo sapiens
cctgataataattgatc

SEQ ID NO: 3856197 - DNA, 14 bp, Homo sapiens
cctgatcacctctg

SEQ ID NO: 3856198 - DNA, 24 bp, Homo sapiens
cctgatcacctctggctttgtctc

SEQ ID NO: 3856199 - DNA, 16 bp, Homo sapiens
cctgatcatggtcagc

SEQ ID NO: 3856200 - DNA, 19 bp, Homo sapiens
cctgatcatggtcagctca

SEQ ID NO: 3856201 - DNA, 21 bp, Homo sapiens
cctgatcatggtcagctcaca

SEQ ID NO: 3856202 - DNA, 12 bp, Homo sapiens
cctgcctggagg

SEQ ID NO: 3856203 - DNA, 20 bp, Homo sapiens
cctgcctggaggacctgagc

SEQ ID NO: 3856204 - DNA, 19 bp, Homo sapiens
cctgcctgggttttctaac

SEQ ID NO: 3856205 - DNA, 20 bp, Homo sapiens
cctgcctgggttttctaact

SEQ ID NO: 3856206 - DNA, 12 bp, Homo sapiens
cctgcctgtgtt

SEQ ID NO: 3856207 - DNA, 20 bp, Homo sapiens
cctgcggagaccctgagtcc

SEQ ID NO: 3856208 - DNA, 21 bp, Homo sapiens
cctgcggctgctgtgtgcctt

SEQ ID NO: 3856209 - DNA, 19 bp, Homo sapiens
cctgcgggcttttccccgg

SEQ ID NO: 3856210 - DNA, 21 bp, Homo sapiens
cctgcgggcttttccccggtc

SEQ ID NO: 3856211 - DNA, 21 bp, Homo sapiens
cctgcgtcctgacgccctgcg

SEQ ID NO: 3856212 - DNA, 13 bp, Homo sapiens
cctgcgttggagc

SEQ ID NO: 3856213 - DNA, 21 bp, Homo sapiens
cctgcgttggagccactcctg

SEQ ID NO: 3856214 - DNA, 15 bp, Homo sapiens
cctgctactcctgtg

SEQ ID NO: 3856215 - DNA, 16 bp, Homo sapiens
cctgctactcctgtgc

SEQ ID NO: 3856216 - DNA, 15 bp, Homo sapiens
cctgctagagcaacc

SEQ ID NO: 3856217 - DNA, 20 bp, Homo sapiens
cctgctagagcaacccctgt

SEQ ID NO: 3856218 - DNA, 12 bp, Homo sapiens
cctgctcccagc

SEQ ID NO: 3856219 - DNA, 14 bp, Homo sapiens
cctgctcccagcag

SEQ ID NO: 3856220 - DNA, 12 bp, Homo sapiens
cctgctcctccc

SEQ ID NO: 3856221 - DNA, 18 bp, Homo sapiens
cctgctcctcccaaccca

SEQ ID NO: 3856222 - DNA, 18 bp, Homo sapiens
cctgctccttcccaggag

SEQ ID NO: 3856223 - DNA, 21 bp, Homo sapiens
cctgctctcctcttgccactg

SEQ ID NO: 3856224 - DNA, 15 bp, Homo sapiens
cctgctctcttcagg

SEQ ID NO: 3856225 - DNA, 20 bp, Homo sapiens
cctgctctcttcaggaggcc

SEQ ID NO: 3856226 - DNA, 23 bp, Homo sapiens
cctgctctcttcaggaggccctg

SEQ ID NO: 3856227 - DNA, 23 bp, Homo sapiens
cctgctgaatgatttccaaagag

SEQ ID NO: 3856228 - DNA, 20 bp, Homo sapiens
cctgctgagagacccaagga

SEQ ID NO: 3856229 - DNA, 12 bp, Homo sapiens
cctgctgagctc

SEQ ID NO: 3856230 - DNA, 16 bp, Homo sapiens
cctgctgagctctgag

SEQ ID NO: 3856231 - DNA, 18 bp, Homo sapiens
cctgctgagctctgagag

SEQ ID NO: 3856232 - DNA, 22 bp, Homo sapiens
cctgctgagctctgagaggccc

SEQ ID NO: 3856233 - DNA, 15 bp, Homo sapiens
cctgctgccgcctcc

SEQ ID NO: 3856234 - DNA, 22 bp, Homo sapiens
cctgctgcgtcagaccagtact

SEQ ID NO: 3856235 - DNA, 23 bp, Homo sapiens
cctgctgcgtcagaccagtactg

SEQ ID NO: 3856236 - DNA, 14 bp, Homo sapiens
cctgctgctcatcc

SEQ ID NO: 3856237 - DNA, 15 bp, Homo sapiens
cctgctgctgagaac

SEQ ID NO: 3856238 - DNA, 22 bp, Homo sapiens
cctgctgctgagaacctggcct

SEQ ID NO: 3856239 - DNA, 20 bp, Homo sapiens
cctgctgctgtaactgctga

SEQ ID NO: 3856240 - DNA, 21 bp, Homo sapiens
cctgctgctgtaactgctgag

SEQ ID NO: 3856241 - DNA, 23 bp, Homo sapiens
cctgctgctgtaactgctgagcc

SEQ ID NO: 3856242 - DNA, 20 bp, Homo sapiens
cctgctgctgtgtttttgct

SEQ ID NO: 3856243 - DNA, 20 bp, Homo sapiens
cctgctggaaaccacacttc

SEQ ID NO: 3856244 - DNA, 12 bp, Homo sapiens
cctgctggcacc

SEQ ID NO: 3856245 - DNA, 16 bp, Homo sapiens
cctgctggcacctcag

SEQ ID NO: 3856246 - DNA, 19 bp, Homo sapiens
cctgctgggaaccccgcag

SEQ ID NO: 3856247 - DNA, 18 bp, Homo sapiens
cctgctgggctctccacc

SEQ ID NO: 3856248 - DNA, 20 bp, Homo sapiens
cctgctgggctctccacctc

SEQ ID NO: 3856249 - DNA, 21 bp, Homo sapiens
cctgctgggctctccacctca

SEQ ID NO: 3856250 - DNA, 16 bp, Homo sapiens
cctgctgtggcctcac

SEQ ID NO: 3856251 - DNA, 13 bp, Homo sapiens
cctgctgtgggag

SEQ ID NO: 3856252 - DNA, 15 bp, Homo sapiens
cctgcttacctgacg

SEQ ID NO: 3856253 - DNA, 17 bp, Homo sapiens
cctgcttcatgctcagc

SEQ ID NO: 3856254 - DNA, 21 bp, Homo sapiens
cctgcttcctaggccccagag

SEQ ID NO: 3856255 - DNA, 21 bp, Homo sapiens
cctgcttcttcaagcacctgc

SEQ ID NO: 3856256 - DNA, 13 bp, Homo sapiens
tcccggcctcttc

SEQ ID NO: 3856257 - DNA, 20 bp, Homo sapiens
tcccggcctcttccacccat

SEQ ID NO: 3856258 - DNA, 12 bp, Homo sapiens
tcccggctgcct

SEQ ID NO: 3856259 - DNA, 16 bp, Homo sapiens
tcccggctgcctgccg

SEQ ID NO: 3856260 - DNA, 22 bp, Homo sapiens
tcccggtcatgcttttgccact

SEQ ID NO: 3856261 - DNA, 13 bp, Homo sapiens
tcccgtgcagctt

SEQ ID NO: 3856262 - DNA, 19 bp, Homo sapiens
tccctaaaataaaaaccag

SEQ ID NO: 3856263 - DNA, 13 bp, Homo sapiens
tccctaaactgta

SEQ ID NO: 3856264 - DNA, 16 bp, Homo sapiens
tccctaactctcggga

SEQ ID NO: 3856265 - DNA, 18 bp, Homo sapiens
tccctaagaaaccccagg

SEQ ID NO: 3856266 - DNA, 16 bp, Homo sapiens
tccctaaggaatctga

SEQ ID NO: 3856267 - DNA, 13 bp, Homo sapiens
tccctacccactc

SEQ ID NO: 3856268 - DNA, 15 bp, Homo sapiens
tccctacccactctt

SEQ ID NO: 3856269 - DNA, 16 bp, Homo sapiens
tccctaccccatttgt

SEQ ID NO: 3856270 - DNA, 15 bp, Homo sapiens
tccctacttcctgtg

SEQ ID NO: 3856271 - DNA, 19 bp, Homo sapiens
tccctacttttcaagagtg

SEQ ID NO: 3856272 - DNA, 16 bp, Homo sapiens
tccctagatctttcta

SEQ ID NO: 3856273 - DNA, 13 bp, Homo sapiens
tccctagcagtga

SEQ ID NO: 3856274 - DNA, 20 bp, Homo sapiens
tccctagctgaggatgacag

SEQ ID NO: 3856275 - DNA, 13 bp, Homo sapiens
tccctatcaaaac

SEQ ID NO: 3856276 - DNA, 20 bp, Homo sapiens
tccctcaaatgacccaaaga

SEQ ID NO: 3856277 - DNA, 19 bp, Homo sapiens
tccctcatcttgccccctc

SEQ ID NO: 3856278 - DNA, 19 bp, Homo sapiens
tccctccatccggctcctg

SEQ ID NO: 3856279 - DNA, 13 bp, Homo sapiens
tccctccttccct

SEQ ID NO: 3856280 - DNA, 15 bp, Homo sapiens
tccctcggacccacc

SEQ ID NO: 3856281 - DNA, 15 bp, Homo sapiens
tccctcgtccacagg

SEQ ID NO: 3856282 - DNA, 20 bp, Homo sapiens
tccctcgtccacaggggcag

SEQ ID NO: 3856283 - DNA, 14 bp, Homo sapiens
tccctctcccaggc

SEQ ID NO: 3856284 - DNA, 17 bp, Homo sapiens
tccctctcccaggcccc

SEQ ID NO: 3856285 - DNA, 20 bp, Homo sapiens
tccctctcccaggccccatg

SEQ ID NO: 3856286 - DNA, 11 bp, Homo sapiens
tccctctgccc

SEQ ID NO: 3856287 - DNA, 16 bp, Homo sapiens
tccctctgccccaagc

SEQ ID NO: 3856288 - DNA, 20 bp, Homo sapiens
tccctctgccccaagcagcc

SEQ ID NO: 3856289 - DNA, 21 bp, Homo sapiens
tccctctgccccaagcagcca

SEQ ID NO: 3856290 - DNA, 16 bp, Homo sapiens
tccctctggccctgcc

SEQ ID NO: 3856291 - DNA, 19 bp, Homo sapiens
tccctctttccccacctct

SEQ ID NO: 3856292 - DNA, 19 bp, Homo sapiens
tccctgactccctgtgggg

SEQ ID NO: 3856293 - DNA, 15 bp, Homo sapiens
tccctgagtcaccag

SEQ ID NO: 3856294 - DNA, 15 bp, Homo sapiens
tccctgcaccctgga

SEQ ID NO: 3856295 - DNA, 23 bp, Homo sapiens
tccctgcccagaattcccagctg

SEQ ID NO: 3856296 - DNA, 18 bp, Homo sapiens
tccctgcccctcccttca

SEQ ID NO: 3856297 - DNA, 11 bp, Homo sapiens
tccctgctcct

SEQ ID NO: 3856298 - DNA, 11 bp, Homo sapiens
tccctggctga

SEQ ID NO: 3856299 - DNA, 13 bp, Homo sapiens
tccctggctgacc

SEQ ID NO: 3856300 - DNA, 11 bp, Homo sapiens
tccctggcttg

SEQ ID NO: 3856301 - DNA, 15 bp, Homo sapiens
tccctgggcccctcc

SEQ ID NO: 3856302 - DNA, 16 bp, Homo sapiens
tccctgggcccctcca

SEQ ID NO: 3856303 - DNA, 17 bp, Homo sapiens
tccctgggcccctccac

SEQ ID NO: 3856304 - DNA, 14 bp, Homo sapiens
tccctgggcctgct

SEQ ID NO: 3856305 - DNA, 16 bp, Homo sapiens
tccctgggcctgctgc

SEQ ID NO: 3856306 - DNA, 17 bp, Homo sapiens
tccctgggcctgctgct

SEQ ID NO: 3856307 - DNA, 20 bp, Homo sapiens
tccctgggcctgctgctgag

SEQ ID NO: 3856308 - DNA, 22 bp, Homo sapiens
tccctggggatatgcaaccctt

SEQ ID NO: 3856309 - DNA, 22 bp, Homo sapiens
tccctggtccctcgtccacagg

SEQ ID NO: 3856310 - DNA, 14 bp, Homo sapiens
tccctggtgcagag

SEQ ID NO: 3856311 - DNA, 14 bp, Homo sapiens
tccctgtagctctg

SEQ ID NO: 3856312 - DNA, 16 bp, Homo sapiens
tccctgtgggggtggc

SEQ ID NO: 3856313 - DNA, 20 bp, Homo sapiens
tccctgtgggggtggccatc

SEQ ID NO: 3856314 - DNA, 22 bp, Homo sapiens
tccctgtgggggtggccatccc

SEQ ID NO: 3856315 - DNA, 16 bp, Homo sapiens
tccctgtttaatattt

SEQ ID NO: 3856316 - DNA, 21 bp, Homo sapiens
tccctgtttaatatttaaaca

SEQ ID NO: 3856317 - DNA, 22 bp, Homo sapiens
tccctgtttaatatttaaacag

SEQ ID NO: 3856318 - DNA, 16 bp, Homo sapiens
tccctgttttaaatta

SEQ ID NO: 3856319 - DNA, 23 bp, Homo sapiens
tcccttaggcattatttaatgtt

SEQ ID NO: 3856320 - DNA, 16 bp, Homo sapiens
tcccttcccctgcctg

SEQ ID NO: 3856321 - DNA, 17 bp, Homo sapiens
tcccttcccctgcctgg

SEQ ID NO: 3856322 - DNA, 14 bp, Homo sapiens
tcccttcctcccca

SEQ ID NO: 3856323 - DNA, 14 bp, Homo sapiens
tcccttcctggcct

SEQ ID NO: 3856324 - DNA, 14 bp, Homo sapiens
tcccttctatgcag

SEQ ID NO: 3856325 - DNA, 14 bp, Homo sapiens
tcccttctctcctt

SEQ ID NO: 3856326 - DNA, 17 bp, Homo sapiens
tcccttgaaattttaaa

SEQ ID NO: 3856327 - DNA, 13 bp, Homo sapiens
tcccttgagacct

SEQ ID NO: 3856328 - DNA, 17 bp, Homo sapiens
tcccttgagacctcagc

SEQ ID NO: 3856329 - DNA, 19 bp, Homo sapiens
tcccttggaaagttcagcc

SEQ ID NO: 3856330 - DNA, 22 bp, Homo sapiens
tcccttggatgtagtctgaggc

SEQ ID NO: 3856331 - DNA, 18 bp, Homo sapiens
tccctttaaaattaaaaa

SEQ ID NO: 3856332 - DNA, 18 bp, Homo sapiens
tccgcaccagctgctctg

SEQ ID NO: 3856333 - DNA, 20 bp, Homo sapiens
tccgcaccagctgctctgcc

SEQ ID NO: 3856334 - DNA, 14 bp, Homo sapiens
tccgcacttggaaa

SEQ ID NO: 3856335 - DNA, 19 bp, Homo sapiens
tccgcaggctatttgttca

SEQ ID NO: 3856336 - DNA, 22 bp, Homo sapiens
tccgcctgcagaggacagagct

SEQ ID NO: 3856337 - DNA, 12 bp, Homo sapiens
tccgctgccacc

SEQ ID NO: 3856338 - DNA, 22 bp, Homo sapiens
tccgctgccaccacgtctgcca

SEQ ID NO: 3856339 - DNA, 23 bp, Homo sapiens
tccgctgccaccacgtctgccag

SEQ ID NO: 3856340 - DNA, 22 bp, Homo sapiens
tccggaggggttgcgggggagc

SEQ ID NO: 3856341 - DNA, 19 bp, Homo sapiens
tccggcggcgagctctggc

SEQ ID NO: 3856342 - DNA, 16 bp, Homo sapiens
tctatagagaaaaact

SEQ ID NO: 3856343 - DNA, 15 bp, Homo sapiens
tctatagtagtcaat

SEQ ID NO: 3856344 - DNA, 15 bp, Homo sapiens
tctatattaaagtgt

SEQ ID NO: 3856345 - DNA, 15 bp, Homo sapiens
tctatcccaagccaa

SEQ ID NO: 3856346 - DNA, 20 bp, Homo sapiens
tctatctgcctttacctaca

SEQ ID NO: 3856347 - DNA, 22 bp, Homo sapiens
tctatgagaacaagtcacagct

SEQ ID NO: 3856348 - DNA, 23 bp, Homo sapiens
tctatgagaacaagtcacagctg

SEQ ID NO: 3856349 - DNA, 15 bp, Homo sapiens
tctatgcaattttta

SEQ ID NO: 3856350 - DNA, 20 bp, Homo sapiens
tctatgcaatttttaaacta

SEQ ID NO: 3856351 - DNA, 18 bp, Homo sapiens
tctatgccccaaatatag

SEQ ID NO: 3856352 - DNA, 20 bp, Homo sapiens
tctattattataaaaataat

SEQ ID NO: 3856353 - DNA, 16 bp, Homo sapiens
tctattcagacaagca

SEQ ID NO: 3856354 - DNA, 13 bp, Homo sapiens
tctattctgagcc

SEQ ID NO: 3856355 - DNA, 15 bp, Homo sapiens
tctattctgagcctt

SEQ ID NO: 3856356 - DNA, 13 bp, Homo sapiens
tctattgtttgtt

SEQ ID NO: 3856357 - DNA, 12 bp, Homo sapiens
tctatttaatat

SEQ ID NO: 3856358 - DNA, 13 bp, Homo sapiens
tctatttaatatt

SEQ ID NO: 3856359 - DNA, 16 bp, Homo sapiens
tctcaaatgctaaatg

SEQ ID NO: 3856360 - DNA, 17 bp, Homo sapiens
tctcaaatgctaaatgc

SEQ ID NO: 3856361 - DNA, 19 bp, Homo sapiens
tctcaaatgctaaatgcaa

SEQ ID NO: 3856362 - DNA, 22 bp, Homo sapiens
tctcaacctaccaccccttcct

SEQ ID NO: 3856363 - DNA, 21 bp, Homo sapiens
tctcaagcactaaaaagtggc

SEQ ID NO: 3856364 - DNA, 17 bp, Homo sapiens
tctcaatattcaataaa

SEQ ID NO: 3856365 - DNA, 18 bp, Homo sapiens
tctcaatattcaataaag

SEQ ID NO: 3856366 - DNA, 13 bp, Homo sapiens
tctcaatgtgaaa

SEQ ID NO: 3856367 - DNA, 13 bp, Homo sapiens
tctcactaaactt

SEQ ID NO: 3856368 - DNA, 12 bp, Homo sapiens
tctcactccacc

SEQ ID NO: 3856369 - DNA, 17 bp, Homo sapiens
tctcactccaccaccca

SEQ ID NO: 3856370 - DNA, 13 bp, Homo sapiens
tctcacttatacc

SEQ ID NO: 3856371 - DNA, 15 bp, Homo sapiens
tctcagaacagctga

SEQ ID NO: 3856372 - DNA, 19 bp, Homo sapiens
tctcagaaggtattccttt

SEQ ID NO: 3856373 - DNA, 17 bp, Homo sapiens
tctcagatcttgacagt

SEQ ID NO: 3856374 - DNA, 14 bp, Homo sapiens
tctcaggagcacag

SEQ ID NO: 3856375 - DNA, 19 bp, Homo sapiens
tctcaggagcacaggcagc

SEQ ID NO: 3856376 - DNA, 21 bp, Homo sapiens
tctcaggccctgaaggttcct

SEQ ID NO: 3856377 - DNA, 15 bp, Homo sapiens
tctcaggtgccactc

SEQ ID NO: 3856378 - DNA, 17 bp, Homo sapiens
tctcaggtgccactccc

SEQ ID NO: 3856379 - DNA, 18 bp, Homo sapiens
tctcaggtgccactccct

SEQ ID NO: 3856380 - DNA, 23 bp, Homo sapiens
tctcagtgggacaaaccagagca

SEQ ID NO: 3856381 - DNA, 19 bp, Homo sapiens
tctcatatgtagccctcat

SEQ ID NO: 3856382 - DNA, 15 bp, Homo sapiens
tctcatcagtgtcct

SEQ ID NO: 3856383 - DNA, 15 bp, Homo sapiens
tctcatcatattgta

SEQ ID NO: 3856384 - DNA, 13 bp, Homo sapiens
tctcatctactca

SEQ ID NO: 3856385 - DNA, 21 bp, Homo sapiens
tctcatctactcattgtctca

SEQ ID NO: 3856386 - DNA, 21 bp, Homo sapiens
tctcatgcctgcctgataccc

SEQ ID NO: 3856387 - DNA, 14 bp, Homo sapiens
tctcatgtgatcct

SEQ ID NO: 3856388 - DNA, 15 bp, Homo sapiens
tctcatgtgatcctt

SEQ ID NO: 3856389 - DNA, 21 bp, Homo sapiens
tctcattcccagagtcagagg

SEQ ID NO: 3856390 - DNA, 23 bp, Homo sapiens
tctcattctgttgcccaggctgg

SEQ ID NO: 3856391 - DNA, 15 bp, Homo sapiens
tctccaacctggaca

SEQ ID NO: 3856392 - DNA, 15 bp, Homo sapiens
tcaggaggcgcagcc

SEQ ID NO: 3856393 - DNA, 20 bp, Homo sapiens
tcaggagggtccccagctgg

SEQ ID NO: 3856394 - DNA, 23 bp, Homo sapiens
tcaggagttagaaatctccagtg

SEQ ID NO: 3856395 - DNA, 20 bp, Homo sapiens
tcaggatcaaaccccgacca

SEQ ID NO: 3856396 - DNA, 24 bp, Homo sapiens
tcaggcaagcccctcagcccttgc

SEQ ID NO: 3856397 - DNA, 14 bp, Homo sapiens
tcaggcacaggcag

SEQ ID NO: 3856398 - DNA, 18 bp, Homo sapiens
tcaggcacaggcaggaag

SEQ ID NO: 3856399 - DNA, 20 bp, Homo sapiens
tcaggcagacaagagctgct

SEQ ID NO: 3856400 - DNA, 22 bp, Homo sapiens
tcaggcagacaagagctgctgt

SEQ ID NO: 3856401 - DNA, 20 bp, Homo sapiens
tcaggcagaggatgttctgg

SEQ ID NO: 3856402 - DNA, 22 bp, Homo sapiens
tcaggcagaggatgttctggac

SEQ ID NO: 3856403 - DNA, 24 bp, Homo sapiens
tcaggcagaggatgttctggacct

SEQ ID NO: 3856404 - DNA, 13 bp, Homo sapiens
tcaggcattttgt

SEQ ID NO: 3856405 - DNA, 13 bp, Homo sapiens
tcaggccacttga

SEQ ID NO: 3856406 - DNA, 13 bp, Homo sapiens
tcaggcctgtgtg

SEQ ID NO: 3856407 - DNA, 16 bp, Homo sapiens
tcaggctcttctcctt

SEQ ID NO: 3856408 - DNA, 21 bp, Homo sapiens
tcaggctcttctcctttcaca

SEQ ID NO: 3856409 - DNA, 13 bp, Homo sapiens
tcaggctgaggtg

SEQ ID NO: 3856410 - DNA, 13 bp, Homo sapiens
tcagggaagcagg

SEQ ID NO: 3856411 - DNA, 16 bp, Homo sapiens
tcagggaagcaggcag

SEQ ID NO: 3856412 - DNA, 18 bp, Homo sapiens
tcagggaagcaggcagag

SEQ ID NO: 3856413 - DNA, 18 bp, Homo sapiens
tcagggacagagacacct

SEQ ID NO: 3856414 - DNA, 21 bp, Homo sapiens
tcagggacagagacacctgca

SEQ ID NO: 3856415 - DNA, 23 bp, Homo sapiens
tcagggacagagacacctgcacc

SEQ ID NO: 3856416 - DNA, 14 bp, Homo sapiens
tcagggcaggcttg

SEQ ID NO: 3856417 - DNA, 21 bp, Homo sapiens
tcagggccagaaggagggcag

SEQ ID NO: 3856418 - DNA, 23 bp, Homo sapiens
tcagggccagaaggagggcagag

SEQ ID NO: 3856419 - DNA, 23 bp, Homo sapiens
tcaggggtcgtcaccacctctcc

SEQ ID NO: 3856420 - DNA, 17 bp, Homo sapiens
tcaggggtggagaagtg

SEQ ID NO: 3856421 - DNA, 19 bp, Homo sapiens
tcagggtgggaagaaagaa

SEQ ID NO: 3856422 - DNA, 20 bp, Homo sapiens
tcagggtgggccactctccc

SEQ ID NO: 3856423 - DNA, 17 bp, Homo sapiens
tcaggtaggcccttgtc

SEQ ID NO: 3856424 - DNA, 19 bp, Homo sapiens
tcaggtctcccacgtggga

SEQ ID NO: 3856425 - DNA, 23 bp, Homo sapiens
tcaggttgacagtcccttgctga

SEQ ID NO: 3856426 - DNA, 15 bp, Homo sapiens
tcaggttgttaatgt

SEQ ID NO: 3856427 - DNA, 16 bp, Homo sapiens
tcaggttgttaatgtt

SEQ ID NO: 3856428 - DNA, 14 bp, Homo sapiens
tcagtaaataatga

SEQ ID NO: 3856429 - DNA, 17 bp, Homo sapiens
tcagtaagtatctggag

SEQ ID NO: 3856430 - DNA, 15 bp, Homo sapiens
tcagtaatttgagga

SEQ ID NO: 3856431 - DNA, 19 bp, Homo sapiens
tcagtaggtccaagggcca

SEQ ID NO: 3856432 - DNA, 23 bp, Homo sapiens
tcagtattaatactaaaatatgt

SEQ ID NO: 3856433 - DNA, 15 bp, Homo sapiens
tcagtcatattctta

SEQ ID NO: 3856434 - DNA, 19 bp, Homo sapiens
tcagtccagatgccttcct

SEQ ID NO: 3856435 - DNA, 19 bp, Homo sapiens
tcagtctagtgaagatgtt

SEQ ID NO: 3856436 - DNA, 22 bp, Homo sapiens
tcagtctttcttagtgcctgtg

SEQ ID NO: 3856437 - DNA, 20 bp, Homo sapiens
tcagtgccacttgacattcc

SEQ ID NO: 3856438 - DNA, 22 bp, Homo sapiens
tcagtgcccaccaacatcccat

SEQ ID NO: 3856439 - DNA, 12 bp, Homo sapiens
tcagtgcctcct

SEQ ID NO: 3856440 - DNA, 19 bp, Homo sapiens
tcagtgggaacgtgactgc

SEQ ID NO: 3856441 - DNA, 23 bp, Homo sapiens
tcagtgggacaaaccagagcaga

SEQ ID NO: 3856442 - DNA, 22 bp, Homo sapiens
tcagtgtaccgcgtctaccctg

SEQ ID NO: 3856443 - DNA, 19 bp, Homo sapiens
tcagttactcagccctggg

SEQ ID NO: 3856444 - DNA, 15 bp, Homo sapiens
tcagttcccggagca

SEQ ID NO: 3856445 - DNA, 20 bp, Homo sapiens
tcagttcccggagcacagcc

SEQ ID NO: 3856446 - DNA, 18 bp, Homo sapiens
tcagttcctctttgcatg

SEQ ID NO: 3856447 - DNA, 19 bp, Homo sapiens
tcagttcctctttgcatgg

SEQ ID NO: 3856448 - DNA, 14 bp, Homo sapiens
tcagttggctgact

SEQ ID NO: 3856449 - DNA, 19 bp, Homo sapiens
tcagtttcaattcagtgct

SEQ ID NO: 3856450 - DNA, 15 bp, Homo sapiens
tcataacttgctgaa

SEQ ID NO: 3856451 - DNA, 14 bp, Homo sapiens
tcataattagaaca

SEQ ID NO: 3856452 - DNA, 17 bp, Homo sapiens
tcataattagaacaata

SEQ ID NO: 3856453 - DNA, 15 bp, Homo sapiens
tcataattttcaaga

SEQ ID NO: 3856454 - DNA, 16 bp, Homo sapiens
tcatacgcatggtcct

SEQ ID NO: 3856455 - DNA, 16 bp, Homo sapiens
tcatacttaagcaaaa

SEQ ID NO: 3856456 - DNA, 19 bp, Homo sapiens
tcatagaaagtgccagaaa

SEQ ID NO: 3856457 - DNA, 22 bp, Homo sapiens
tcatagaaatgtaacttttgta

SEQ ID NO: 3856458 - DNA, 16 bp, Homo sapiens
tcataggttgccaata

SEQ ID NO: 3856459 - DNA, 14 bp, Homo sapiens
tcatatattcatgt

SEQ ID NO: 3856460 - DNA, 21 bp, Homo sapiens
tcatatattcatgtaataaat

SEQ ID NO: 3856461 - DNA, 18 bp, Homo sapiens
tcatatgacatgccaccc

SEQ ID NO: 3856462 - DNA, 14 bp, Homo sapiens
tcatattgtatgta

SEQ ID NO: 3856463 - DNA, 18 bp, Homo sapiens
tcatattgtatgtaagta

SEQ ID NO: 3856464 - DNA, 14 bp, Homo sapiens
tcatcaatttaaaa

SEQ ID NO: 3856465 - DNA, 16 bp, Homo sapiens
tcatcaatttttatac

SEQ ID NO: 3856466 - DNA, 17 bp, Homo sapiens
tcatcaatttttataca

SEQ ID NO: 3856467 - DNA, 20 bp, Homo sapiens
tcatcaatttttatacatat

SEQ ID NO: 3856468 - DNA, 19 bp, Homo sapiens
tcatcactccctggatgtg

SEQ ID NO: 3856469 - DNA, 15 bp, Homo sapiens
tcatcaggcttggaa

SEQ ID NO: 3856470 - DNA, 18 bp, Homo sapiens
tcatcaggcttggaatga

SEQ ID NO: 3856471 - DNA, 13 bp, Homo sapiens
tcacctcagctga

SEQ ID NO: 3856472 - DNA, 11 bp, Homo sapiens
tcacctcctcc

SEQ ID NO: 3856473 - DNA, 17 bp, Homo sapiens
tcacctcctccactcac

SEQ ID NO: 3856474 - DNA, 13 bp, Homo sapiens
tcacctctctcta

SEQ ID NO: 3856475 - DNA, 13 bp, Homo sapiens
tcacctctggctt

SEQ ID NO: 3856476 - DNA, 13 bp, Homo sapiens
tcacctctgtaat

SEQ ID NO: 3856477 - DNA, 15 bp, Homo sapiens
tcacctgaggtcggg

SEQ ID NO: 3856478 - DNA, 19 bp, Homo sapiens
tcacctgagtcaccctacc

SEQ ID NO: 3856479 - DNA, 16 bp, Homo sapiens
tcacctgcaagcccca

SEQ ID NO: 3856480 - DNA, 21 bp, Homo sapiens
tcacctgcaagccccagggcc

SEQ ID NO: 3856481 - DNA, 14 bp, Homo sapiens
tcaccttatgtatt

SEQ ID NO: 3856482 - DNA, 15 bp, Homo sapiens
tcaccttatgtatta

SEQ ID NO: 3856483 - DNA, 21 bp, Homo sapiens
tcaccttgccgagagaggcgc

SEQ ID NO: 3856484 - DNA, 19 bp, Homo sapiens
tcacgcctgtaatcccagc

SEQ ID NO: 3856485 - DNA, 21 bp, Homo sapiens
tcacgcctgtaatcccagcac

SEQ ID NO: 3856486 - DNA, 22 bp, Homo sapiens
tcacgcctgtaatcccagcact

SEQ ID NO: 3856487 - DNA, 15 bp, Homo sapiens
tcacgctctggacat

SEQ ID NO: 3856488 - DNA, 16 bp, Homo sapiens
tcacgctctggacatg

SEQ ID NO: 3856489 - DNA, 14 bp, Homo sapiens
tcacgtgaaatatt

SEQ ID NO: 3856490 - DNA, 16 bp, Homo sapiens
tcactaaagggtgccc

SEQ ID NO: 3856491 - DNA, 21 bp, Homo sapiens
tcactacgggggggagaagga

SEQ ID NO: 3856492 - DNA, 14 bp, Homo sapiens
tcactagagctggg

SEQ ID NO: 3856493 - DNA, 17 bp, Homo sapiens
tcactagatggcgagca

SEQ ID NO: 3856494 - DNA, 17 bp, Homo sapiens
tcactatgctatttctg

SEQ ID NO: 3856495 - DNA, 16 bp, Homo sapiens
tcactattacttgaac

SEQ ID NO: 3856496 - DNA, 18 bp, Homo sapiens
tcactattacttgaactt

SEQ ID NO: 3856497 - DNA, 16 bp, Homo sapiens
tcactcactcattcct

SEQ ID NO: 3856498 - DNA, 13 bp, Homo sapiens
tcactctggcctc

SEQ ID NO: 3856499 - DNA, 15 bp, Homo sapiens
tcactctgtcagcca

SEQ ID NO: 3856500 - DNA, 22 bp, Homo sapiens
tcactgaatgcctcaatgtgac

SEQ ID NO: 3856501 - DNA, 19 bp, Homo sapiens
tcactgcaacctccacctc

SEQ ID NO: 3856502 - DNA, 20 bp, Homo sapiens
tcactgcaacctccacctcc

SEQ ID NO: 3856503 - DNA, 18 bp, Homo sapiens
tcactgcaacctcttcct

SEQ ID NO: 3856504 - DNA, 15 bp, Homo sapiens
tcactgcacagtgca

SEQ ID NO: 3856505 - DNA, 20 bp, Homo sapiens
tcactgcacagtgcatctca

SEQ ID NO: 3856506 - DNA, 22 bp, Homo sapiens
tcactgcacagtgcatctcagc

SEQ ID NO: 3856507 - DNA, 24 bp, Homo sapiens
tcactgcacagtgcatctcagccc

SEQ ID NO: 3856508 - DNA, 22 bp, Homo sapiens
tcactgcagcctccttctcctg

SEQ ID NO: 3856509 - DNA, 17 bp, Homo sapiens
tcactgccatgcctcaa

SEQ ID NO: 3856510 - DNA, 14 bp, Homo sapiens
tcactgctggctgc

SEQ ID NO: 3856511 - DNA, 17 bp, Homo sapiens
tcactgctggctgcctt

SEQ ID NO: 3856512 - DNA, 18 bp, Homo sapiens
tcactggagcaccaggca

SEQ ID NO: 3856513 - DNA, 20 bp, Homo sapiens
tcactggagtagttgctact

SEQ ID NO: 3856514 - DNA, 20 bp, Homo sapiens
tcactggtagaccaaaataa

SEQ ID NO: 3856515 - DNA, 13 bp, Homo sapiens
tcacttataccaa

SEQ ID NO: 3856516 - DNA, 13 bp, Homo sapiens
tcacttccagtgt

SEQ ID NO: 3856517 - DNA, 20 bp, Homo sapiens
tcacttccagtgttggctgt

SEQ ID NO: 3856518 - DNA, 14 bp, Homo sapiens
tcacttccctggga

SEQ ID NO: 3856519 - DNA, 23 bp, Homo sapiens
tcacttggggtcaccaccctccc

SEQ ID NO: 3856520 - DNA, 13 bp, Homo sapiens
tcacttgtaaata

SEQ ID NO: 3856521 - DNA, 14 bp, Homo sapiens
tcacttgtaaataa

SEQ ID NO: 3856522 - DNA, 18 bp, Homo sapiens
tcacttgtaaataaatag

SEQ ID NO: 3856523 - DNA, 19 bp, Homo sapiens
tcacttgtaaataaataga

SEQ ID NO: 3856524 - DNA, 22 bp, Homo sapiens
tcacttgtaaataaatagattt

SEQ ID NO: 3856525 - DNA, 13 bp, Homo sapiens
tcacttgtacaaa

SEQ ID NO: 3856526 - DNA, 16 bp, Homo sapiens
tcacttgtacaaaata

SEQ ID NO: 3856527 - DNA, 20 bp, Homo sapiens
tcactttaattctcatgtga

SEQ ID NO: 3856528 - DNA, 22 bp, Homo sapiens
tcactttaattctcatgtgatc

SEQ ID NO: 3856529 - DNA, 18 bp, Homo sapiens
tcactttagctatgtgga

SEQ ID NO: 3856530 - DNA, 16 bp, Homo sapiens
tcacttttcagtgatg

SEQ ID NO: 3856531 - DNA, 14 bp, Homo sapiens
tcagaaaagggaag

SEQ ID NO: 3856532 - DNA, 23 bp, Homo sapiens
tcagaaaagtagaattatatcta

SEQ ID NO: 3856533 - DNA, 20 bp, Homo sapiens
tcagaaagggagggctctga

SEQ ID NO: 3856534 - DNA, 21 bp, Homo sapiens
tcagaaagggagggctctgag

SEQ ID NO: 3856535 - DNA, 20 bp, Homo sapiens
tcagaaataaaatgaaatgt

SEQ ID NO: 3856536 - DNA, 22 bp, Homo sapiens
tcagaaataaaatgaaatgtct

SEQ ID NO: 3856537 - DNA, 12 bp, Homo sapiens
tcagaagaaatt

SEQ ID NO: 3856538 - DNA, 12 bp, Homo sapiens
tcagaagcaggt

SEQ ID NO: 3856539 - DNA, 20 bp, Homo sapiens
tcagaagccccatttgcaca

SEQ ID NO: 3856540 - DNA, 13 bp, Homo sapiens
tcagaagcctggg

SEQ ID NO: 3856541 - DNA, 20 bp, Homo sapiens
tcagaagcctgggggcctgg

SEQ ID NO: 3856542 - DNA, 22 bp, Homo sapiens
tcagaagcctgggggcctggct

SEQ ID NO: 3856543 - DNA, 23 bp, Homo sapiens
tcagaagcctgggggcctggctg

SEQ ID NO: 3856544 - DNA, 13 bp, Homo sapiens
tcagaaggagaag

SEQ ID NO: 3856545 - DNA, 19 bp, Homo sapiens
tcagaaggagaaggaagga

SEQ ID NO: 3856546 - DNA, 23 bp, Homo sapiens
tcagaaggagaaggaaggagact

SEQ ID NO: 3856547 - DNA, 17 bp, Homo sapiens
tcagaatcaggttgaca

SEQ ID NO: 3856548 - DNA, 17 bp, Homo sapiens
tcagaatgctctacttc

SEQ ID NO: 3856549 - DNA, 23 bp, Homo sapiens
tcagacaggtaaatgggcagtgc

SEQ ID NO: 3856550 - DNA, 13 bp, Homo sapiens
tcagaccccagcg

SEQ ID NO: 3856551 - DNA, 12 bp, Homo sapiens
tcagacccccac

SEQ ID NO: 3856552 - DNA, 16 bp, Homo sapiens
tcagaccctaccccac

SEQ ID NO: 3856553 - DNA, 18 bp, Homo sapiens
tcagaccctaccccacca

SEQ ID NO: 3856554 - DNA, 17 bp, Homo sapiens
tcatccagttgcaataa

SEQ ID NO: 3856555 - DNA, 20 bp, Homo sapiens
tcatccagttgcaataaaat

SEQ ID NO: 3856556 - DNA, 23 bp, Homo sapiens
tcatcccaaaggacagccgcctg

SEQ ID NO: 3856557 - DNA, 13 bp, Homo sapiens
tcatcccagcccc

SEQ ID NO: 3856558 - DNA, 14 bp, Homo sapiens
tcatcccctacact

SEQ ID NO: 3856559 - DNA, 15 bp, Homo sapiens
tcatcccctcgtcct

SEQ ID NO: 3856560 - DNA, 14 bp, Homo sapiens
tcatccccttgtgt

SEQ ID NO: 3856561 - DNA, 13 bp, Homo sapiens
tcatccctttcca

SEQ ID NO: 3856562 - DNA, 16 bp, Homo sapiens
tcatcctggcctcctt

SEQ ID NO: 3856563 - DNA, 18 bp, Homo sapiens
tcatcgaaaattcatttc

SEQ ID NO: 3856564 - DNA, 22 bp, Homo sapiens
tcatcgaaaattcatttcacat

SEQ ID NO: 3856565 - DNA, 14 bp, Homo sapiens
tcatcggaggctgg

SEQ ID NO: 3856566 - DNA, 16 bp, Homo sapiens
tcatcggaggctgggc

SEQ ID NO: 3856567 - DNA, 17 bp, Homo sapiens
tcatctacaagcatttg

SEQ ID NO: 3856568 - DNA, 19 bp, Homo sapiens
tcatctacaagcatttgcc

SEQ ID NO: 3856569 - DNA, 17 bp, Homo sapiens
tcatctcaaatccttga

SEQ ID NO: 3856570 - DNA, 14 bp, Homo sapiens
tcatctctctgggg

SEQ ID NO: 3856571 - DNA, 12 bp, Homo sapiens
tcatctgaggag

SEQ ID NO: 3856572 - DNA, 14 bp, Homo sapiens
tcatctgcagaatg

SEQ ID NO: 3856573 - DNA, 17 bp, Homo sapiens
tcatctggattccagag

SEQ ID NO: 3856574 - DNA, 18 bp, Homo sapiens
tcatctgttatcctgcta

SEQ ID NO: 3856575 - DNA, 18 bp, Homo sapiens
tcatgaaaagaggaacag

SEQ ID NO: 3856576 - DNA, 17 bp, Homo sapiens
tcatgacttttccatgt

SEQ ID NO: 3856577 - DNA, 13 bp, Homo sapiens
tcatgagctgagt

SEQ ID NO: 3856578 - DNA, 18 bp, Homo sapiens
tcatgatctccctgccgc

SEQ ID NO: 3856579 - DNA, 16 bp, Homo sapiens
tcatgatggagacttc

SEQ ID NO: 3856580 - DNA, 11 bp, Homo sapiens
tcatgccatct

SEQ ID NO: 3856581 - DNA, 15 bp, Homo sapiens
tcatgccatctgttt

SEQ ID NO: 3856582 - DNA, 12 bp, Homo sapiens
tcatgcctcagt

SEQ ID NO: 3856583 - DNA, 15 bp, Homo sapiens
tcatgcctctgaggc

SEQ ID NO: 3856584 - DNA, 13 bp, Homo sapiens
tcatgcctgcctg

SEQ ID NO: 3856585 - DNA, 14 bp, Homo sapiens
tcatgcctgcctga

SEQ ID NO: 3856586 - DNA, 15 bp, Homo sapiens
tcatgcctggccccc

SEQ ID NO: 3856587 - DNA, 19 bp, Homo sapiens
tcatgctttaaagtgtaat

SEQ ID NO: 3856588 - DNA, 22 bp, Homo sapiens
tcatgctttaaagtgtaataat

SEQ ID NO: 3856589 - DNA, 23 bp, Homo sapiens
tcatgctttaaagtgtaataata

SEQ ID NO: 3856590 - DNA, 15 bp, Homo sapiens
tcatgctttctcctt

SEQ ID NO: 3856591 - DNA, 17 bp, Homo sapiens
tcatggaaaagcccagt

SEQ ID NO: 3856592 - DNA, 22 bp, Homo sapiens
tcatggaaaagcccagtgacct

SEQ ID NO: 3856593 - DNA, 18 bp, Homo sapiens
tcatggcgtaatgggcct

SEQ ID NO: 3856594 - DNA, 19 bp, Homo sapiens
tcatggcgtaatgggcctg

SEQ ID NO: 3856595 - DNA, 14 bp, Homo sapiens
tcatggcttaatgt

SEQ ID NO: 3856596 - DNA, 17 bp, Homo sapiens
tcatgggaaaagaccag

SEQ ID NO: 3856597 - DNA, 18 bp, Homo sapiens
tcatggtcagctcacacc

SEQ ID NO: 3856598 - DNA, 16 bp, Homo sapiens
tcatgtaaattttgta

SEQ ID NO: 3856599 - DNA, 17 bp, Homo sapiens
tcatgtaaattttgtat

SEQ ID NO: 3856600 - DNA, 16 bp, Homo sapiens
tcatgtacttcctgtg

SEQ ID NO: 3856601 - DNA, 22 bp, Homo sapiens
tcatgtacttcctgtgtactct

SEQ ID NO: 3856602 - DNA, 11 bp, Homo sapiens
tcatgtagatt

SEQ ID NO: 3856603 - DNA, 21 bp, Homo sapiens
tcatgtatgttcagaagaaat

SEQ ID NO: 3856604 - DNA, 22 bp, Homo sapiens
tcatgtatgttcagaagaaatt

SEQ ID NO: 3856605 - DNA, 14 bp, Homo sapiens
tcatgtcaggcctg

SEQ ID NO: 3856606 - DNA, 19 bp, Homo sapiens
tcatgtggaatataaagat

SEQ ID NO: 3856607 - DNA, 16 bp, Homo sapiens
tcatgtgtgcatgtga

SEQ ID NO: 3856608 - DNA, 15 bp, Homo sapiens
tcatgtgtgctgtgc

SEQ ID NO: 3856609 - DNA, 17 bp, Homo sapiens
tcatgttgaagccactg

SEQ ID NO: 3856610 - DNA, 14 bp, Homo sapiens
tcattaatgtgttg

SEQ ID NO: 3856611 - DNA, 12 bp, Homo sapiens
tcattactaacc

SEQ ID NO: 3856612 - DNA, 18 bp, Homo sapiens
tcattactgcctttggaa

SEQ ID NO: 3856613 - DNA, 12 bp, Homo sapiens
tcattatgtaga

SEQ ID NO: 3856614 - DNA, 14 bp, Homo sapiens
tcattatgtagaaa

SEQ ID NO: 3856615 - DNA, 18 bp, Homo sapiens
tcattatgtagaaatatt

SEQ ID NO: 3856616 - DNA, 22 bp, Homo sapiens
tcattcaaaacaaccatcctgc

SEQ ID NO: 3856617 - DNA, 15 bp, Homo sapiens
tcattcaatatctga

SEQ ID NO: 3856618 - DNA, 17 bp, Homo sapiens
tcattcaatatctgaca

SEQ ID NO: 3856619 - DNA, 16 bp, Homo sapiens
tcattcaggtgttctc

SEQ ID NO: 3856620 - DNA, 21 bp, Homo sapiens
tcattcagtgagacacagagt

SEQ ID NO: 3856621 - DNA, 17 bp, Homo sapiens
tcattccaacagtgagt

SEQ ID NO: 3856622 - DNA, 23 bp, Homo sapiens
tcattccaccttcccatgccctg

SEQ ID NO: 3856623 - DNA, 20 bp, Homo sapiens
tcattccttcactcatccag

SEQ ID NO: 3856624 - DNA, 21 bp, Homo sapiens
tcattcgcctgtgggaagaga

SEQ ID NO: 3856625 - DNA, 13 bp, Homo sapiens
tcattctcctgcc

SEQ ID NO: 3856626 - DNA, 22 bp, Homo sapiens
tcattctttcccctcagagctc

SEQ ID NO: 3856627 - DNA, 12 bp, Homo sapiens
tcattgtagaaa

SEQ ID NO: 3856628 - DNA, 16 bp, Homo sapiens
tcattgtatatatgtg

SEQ ID NO: 3856629 - DNA, 17 bp, Homo sapiens
tcattgtatatatgtgt

SEQ ID NO: 3856630 - DNA, 15 bp, Homo sapiens
tcatttaaaatgatt

SEQ ID NO: 3856631 - DNA, 16 bp, Homo sapiens
tcatttaaaatgatta

SEQ ID NO: 3856632 - DNA, 22 bp, Homo sapiens
tcatttaccataaaaatccttc

SEQ ID NO: 3856633 - DNA, 16 bp, Homo sapiens
tccactccatatttat

SEQ ID NO: 3856634 - DNA, 16 bp, Homo sapiens
tccactcccccacctg

SEQ ID NO: 3856635 - DNA, 17 bp, Homo sapiens
tccactcccccacctga

SEQ ID NO: 3856636 - DNA, 23 bp, Homo sapiens
tccactctccttcgtgtctctcc

SEQ ID NO: 3856637 - DNA, 13 bp, Homo sapiens
tccactgaggatg

SEQ ID NO: 3856638 - DNA, 20 bp, Homo sapiens
tccactgaggatgtgagcct

SEQ ID NO: 3856639 - DNA, 12 bp, Homo sapiens
tccactgtcacc

SEQ ID NO: 3856640 - DNA, 17 bp, Homo sapiens
tccacttctctagagaa

SEQ ID NO: 3856641 - DNA, 20 bp, Homo sapiens
tccactttgttggaaagcag

SEQ ID NO: 3856642 - DNA, 19 bp, Homo sapiens
tccagaaaatataaatgca

SEQ ID NO: 3856643 - DNA, 11 bp, Homo sapiens
tccagaaagaa

SEQ ID NO: 3856644 - DNA, 16 bp, Homo sapiens
tccagaagaatattca

SEQ ID NO: 3856645 - DNA, 17 bp, Homo sapiens
tccagaagaatattcag

SEQ ID NO: 3856646 - DNA, 19 bp, Homo sapiens
tccagaagaatattcagga

SEQ ID NO: 3856647 - DNA, 18 bp, Homo sapiens
tccagaagtggggctctg

SEQ ID NO: 3856648 - DNA, 15 bp, Homo sapiens
tccagaataagtgct

SEQ ID NO: 3856649 - DNA, 16 bp, Homo sapiens
tccagaataagtgctg

SEQ ID NO: 3856650 - DNA, 24 bp, Homo sapiens
tccagaatccacaaagccgtgcct

SEQ ID NO: 3856651 - DNA, 20 bp, Homo sapiens
tccagacatacgaaacacaa

SEQ ID NO: 3856652 - DNA, 12 bp, Homo sapiens
tccagaccacct

SEQ ID NO: 3856653 - DNA, 14 bp, Homo sapiens
tccagaccacctgc

SEQ ID NO: 3856654 - DNA, 19 bp, Homo sapiens
tccagaccacctgccagcc

SEQ ID NO: 3856655 - DNA, 16 bp, Homo sapiens
tccagaccattgtctt

SEQ ID NO: 3856656 - DNA, 18 bp, Homo sapiens
tccagaccattgtcttcc

SEQ ID NO: 3856657 - DNA, 15 bp, Homo sapiens
tccagacccctggct

SEQ ID NO: 3856658 - DNA, 13 bp, Homo sapiens
tccagaccctgcc

SEQ ID NO: 3856659 - DNA, 14 bp, Homo sapiens
tccagaccctgcct

SEQ ID NO: 3856660 - DNA, 16 bp, Homo sapiens
tccagaccctgcctga

SEQ ID NO: 3856661 - DNA, 23 bp, Homo sapiens
tccagactgcttccaattttctg

SEQ ID NO: 3856662 - DNA, 17 bp, Homo sapiens
tccagagacaggaaaga

SEQ ID NO: 3856663 - DNA, 18 bp, Homo sapiens
tccagagacaggaaagaa

SEQ ID NO: 3856664 - DNA, 19 bp, Homo sapiens
tccagagagaggatgcaga

SEQ ID NO: 3856665 - DNA, 19 bp, Homo sapiens
tccagagagtcctctggat

SEQ ID NO: 3856666 - DNA, 19 bp, Homo sapiens
tccagagagtggctcctcc

SEQ ID NO: 3856667 - DNA, 17 bp, Homo sapiens
tccagagcactgctcca

SEQ ID NO: 3856668 - DNA, 15 bp, Homo sapiens
tccagagtctgagcc

SEQ ID NO: 3856669 - DNA, 16 bp, Homo sapiens
tccagagtctgagccc

SEQ ID NO: 3856670 - DNA, 15 bp, Homo sapiens
tccagatctgcactg

SEQ ID NO: 3856671 - DNA, 13 bp, Homo sapiens
tccagattcttcc

SEQ ID NO: 3856672 - DNA, 18 bp, Homo sapiens
tccagattcttccactgg

SEQ ID NO: 3856673 - DNA, 14 bp, Homo sapiens
tccagcatccagcc

SEQ ID NO: 3856674 - DNA, 13 bp, Homo sapiens
tccagcatttgcc

SEQ ID NO: 3856675 - DNA, 22 bp, Homo sapiens
tccagcatttgccattcctgga

SEQ ID NO: 3856676 - DNA, 22 bp, Homo sapiens
tccagcccacacccctccaaag

SEQ ID NO: 3856677 - DNA, 13 bp, Homo sapiens
tccagcctctccc

SEQ ID NO: 3856678 - DNA, 21 bp, Homo sapiens
tccagcctctcccggctgcct

SEQ ID NO: 3856679 - DNA, 20 bp, Homo sapiens
tccagcctggtttagcctgg

SEQ ID NO: 3856680 - DNA, 21 bp, Homo sapiens
tccagcgcctgccctccctgg

SEQ ID NO: 3856681 - DNA, 22 bp, Homo sapiens
tccagctagccaactcctcctt

SEQ ID NO: 3856682 - DNA, 10 bp, Homo sapiens
tccagctcca

SEQ ID NO: 3856683 - DNA, 17 bp, Homo sapiens
tccagcttgctcttcag

SEQ ID NO: 3856684 - DNA, 14 bp, Homo sapiens
tccaggaaggcagc

SEQ ID NO: 3856685 - DNA, 17 bp, Homo sapiens
tccaggaaggcagctgc

SEQ ID NO: 3856686 - DNA, 15 bp, Homo sapiens
tccaggagcctgtgc

SEQ ID NO: 3856687 - DNA, 18 bp, Homo sapiens
tccaggatcctgcaggaa

SEQ ID NO: 3856688 - DNA, 19 bp, Homo sapiens
tccaggatcctgcaggaac

SEQ ID NO: 3856689 - DNA, 15 bp, Homo sapiens
tccaggcacccttct

SEQ ID NO: 3856690 - DNA, 14 bp, Homo sapiens
tccaggcatgctgg

SEQ ID NO: 3856691 - DNA, 17 bp, Homo sapiens
tccaggcatgctggcct

SEQ ID NO: 3856692 - DNA, 16 bp, Homo sapiens
tccaggccactgtggc

SEQ ID NO: 3856693 - DNA, 17 bp, Homo sapiens
tccaggccactgtggcc

SEQ ID NO: 3856694 - DNA, 23 bp, Homo sapiens
tccaggccactgtggccagagct

SEQ ID NO: 3856695 - DNA, 16 bp, Homo sapiens
tccaggcccctgagga

SEQ ID NO: 3856696 - DNA, 18 bp, Homo sapiens
tccaggcccctgaggact

SEQ ID NO: 3856697 - DNA, 22 bp, Homo sapiens
tccaggcccctgaggactggag

SEQ ID NO: 3856698 - DNA, 14 bp, Homo sapiens
tccaggctcttcct

SEQ ID NO: 3856699 - DNA, 15 bp, Homo sapiens
tccaggctcttcctg

SEQ ID NO: 3856700 - DNA, 20 bp, Homo sapiens
tccaggctcttcctggacct

SEQ ID NO: 3856701 - DNA, 23 bp, Homo sapiens
tccagggaatccgcctgcagagg

SEQ ID NO: 3856702 - DNA, 22 bp, Homo sapiens
tccagggccacgtgccaggccc

SEQ ID NO: 3856703 - DNA, 17 bp, Homo sapiens
tccaggtatctccagga

SEQ ID NO: 3856704 - DNA, 18 bp, Homo sapiens
tccaggtatctccaggat

SEQ ID NO: 3856705 - DNA, 19 bp, Homo sapiens
tccaggtccggaggggttg

SEQ ID NO: 3856706 - DNA, 14 bp, Homo sapiens
tccaggtgggagag

SEQ ID NO: 3856707 - DNA, 16 bp, Homo sapiens
tccaggtgggagagac

SEQ ID NO: 3856708 - DNA, 13 bp, Homo sapiens
tccagtattcttg

SEQ ID NO: 3856709 - DNA, 17 bp, Homo sapiens
tccagtgatgtgctgga

SEQ ID NO: 3856710 - DNA, 22 bp, Homo sapiens
tccagtgatgtgctggagctgg

SEQ ID NO: 3856711 - DNA, 15 bp, Homo sapiens
tccagtgcaacaaaa

SEQ ID NO: 3856712 - DNA, 15 bp, Homo sapiens
tccagtggttgctgt

SEQ ID NO: 3856713 - DNA, 16 bp, Homo sapiens
tccagtgttggctgtg

SEQ ID NO: 3856714 - DNA, 17 bp, Homo sapiens
tccagtgttggctgtgt

SEQ ID NO: 3856715 - DNA, 23 bp, Homo sapiens
tccagttcacaggccagaaaaca

SEQ ID NO: 3856716 - DNA, 12 bp, Homo sapiens
tccagtttccca

SEQ ID NO: 3856717 - DNA, 15 bp, Homo sapiens
tccataggaatcatg

SEQ ID NO: 3856718 - DNA, 23 bp, Homo sapiens
tccatatcagacctctgatccct

SEQ ID NO: 3856719 - DNA, 13 bp, Homo sapiens
tccatcagctccc

SEQ ID NO: 3856720 - DNA, 18 bp, Homo sapiens
tcaatgtttttaaaaatc

SEQ ID NO: 3856721 - DNA, 16 bp, Homo sapiens
tcaattagtacagtag

SEQ ID NO: 3856722 - DNA, 21 bp, Homo sapiens
tcaattattacatttatacat

SEQ ID NO: 3856723 - DNA, 23 bp, Homo sapiens
tcaattcaacacattacttgcac

SEQ ID NO: 3856724 - DNA, 24 bp, Homo sapiens
tcaattcaacacattacttgcaca

SEQ ID NO: 3856725 - DNA, 13 bp, Homo sapiens
tcaattgtatttt

SEQ ID NO: 3856726 - DNA, 17 bp, Homo sapiens
tcaattgtattttatat

SEQ ID NO: 3856727 - DNA, 17 bp, Homo sapiens
tcaatttttatacatat

SEQ ID NO: 3856728 - DNA, 21 bp, Homo sapiens
tcaatttttatacatatcaga

SEQ ID NO: 3856729 - DNA, 17 bp, Homo sapiens
tcacaaaacctggcaca

SEQ ID NO: 3856730 - DNA, 21 bp, Homo sapiens
tcacaacagattattacctta

SEQ ID NO: 3856731 - DNA, 20 bp, Homo sapiens
tcacaacataaggagaatgt

SEQ ID NO: 3856732 - DNA, 14 bp, Homo sapiens
tcacaaccttctgt

SEQ ID NO: 3856733 - DNA, 16 bp, Homo sapiens
tcacaaggcagcaagg

SEQ ID NO: 3856734 - DNA, 20 bp, Homo sapiens
tcacaagggacgctttggga

SEQ ID NO: 3856735 - DNA, 16 bp, Homo sapiens
tcacaatagaaactca

SEQ ID NO: 3856736 - DNA, 22 bp, Homo sapiens
tcacaatgaaatgctctccttt

SEQ ID NO: 3856737 - DNA, 15 bp, Homo sapiens
tcacacaaggctggg

SEQ ID NO: 3856738 - DNA, 12 bp, Homo sapiens
tcacacagagat

SEQ ID NO: 3856739 - DNA, 23 bp, Homo sapiens
tcacacagtgggtggtggatctg

SEQ ID NO: 3856740 - DNA, 12 bp, Homo sapiens
tcacacctctgg

SEQ ID NO: 3856741 - DNA, 17 bp, Homo sapiens
tcacacctctgggcttc

SEQ ID NO: 3856742 - DNA, 22 bp, Homo sapiens
tcacacctctgggcttcagggt

SEQ ID NO: 3856743 - DNA, 11 bp, Homo sapiens
tcacactgatg

SEQ ID NO: 3856744 - DNA, 21 bp, Homo sapiens
tcacagaacccttggagccaa

SEQ ID NO: 3856745 - DNA, 20 bp, Homo sapiens
tcacagacgctcctgaagtt

SEQ ID NO: 3856746 - DNA, 21 bp, Homo sapiens
tcacagatgggtattaaactt

SEQ ID NO: 3856747 - DNA, 14 bp, Homo sapiens
tcacagcctctccc

SEQ ID NO: 3856748 - DNA, 12 bp, Homo sapiens
tcacagctgcag

SEQ ID NO: 3856749 - DNA, 16 bp, Homo sapiens
tcacagctgcagctgg

SEQ ID NO: 3856750 - DNA, 18 bp, Homo sapiens
tcacagctgcagctgggc

SEQ ID NO: 3856751 - DNA, 20 bp, Homo sapiens
tcacagctgcagctgggccc

SEQ ID NO: 3856752 - DNA, 22 bp, Homo sapiens
tcacagctgcagctgggcccca

SEQ ID NO: 3856753 - DNA, 16 bp, Homo sapiens
tcacaggactctgcct

SEQ ID NO: 3856754 - DNA, 17 bp, Homo sapiens
tcacaggactctgcctc

SEQ ID NO: 3856755 - DNA, 12 bp, Homo sapiens
tcacaggagcag

SEQ ID NO: 3856756 - DNA, 14 bp, Homo sapiens
tcacaggagcagac

SEQ ID NO: 3856757 - DNA, 15 bp, Homo sapiens
tcacaggagcagaca

SEQ ID NO: 3856758 - DNA, 19 bp, Homo sapiens
tcacaggagcagacagaga

SEQ ID NO: 3856759 - DNA, 16 bp, Homo sapiens
tcacagggccccagaa

SEQ ID NO: 3856760 - DNA, 17 bp, Homo sapiens
tcacagggccccagaag

SEQ ID NO: 3856761 - DNA, 15 bp, Homo sapiens
tcacaggggcggggc

SEQ ID NO: 3856762 - DNA, 13 bp, Homo sapiens
tcacagtctcaca

SEQ ID NO: 3856763 - DNA, 18 bp, Homo sapiens
tcacagtgacccttccca

SEQ ID NO: 3856764 - DNA, 13 bp, Homo sapiens
tcacagtgctgag

SEQ ID NO: 3856765 - DNA, 14 bp, Homo sapiens
tcacagtgtttcga

SEQ ID NO: 3856766 - DNA, 22 bp, Homo sapiens
tcacagttaccctaaactctct

SEQ ID NO: 3856767 - DNA, 13 bp, Homo sapiens
tcacagttcctcg

SEQ ID NO: 3856768 - DNA, 18 bp, Homo sapiens
tcacagttcctcgccctg

SEQ ID NO: 3856769 - DNA, 20 bp, Homo sapiens
tcacagttcctcgccctggg

SEQ ID NO: 3856770 - DNA, 21 bp, Homo sapiens
tcacagttcctcgccctgggt

SEQ ID NO: 3856771 - DNA, 22 bp, Homo sapiens
tcacagttcctcgccctgggtc

SEQ ID NO: 3856772 - DNA, 13 bp, Homo sapiens
tcacagttgacaa

SEQ ID NO: 3856773 - DNA, 13 bp, Homo sapiens
tcacatacactca

SEQ ID NO: 3856774 - DNA, 14 bp, Homo sapiens
tcacatcttatgct

SEQ ID NO: 3856775 - DNA, 15 bp, Homo sapiens
tcacatgggacaaag

SEQ ID NO: 3856776 - DNA, 14 bp, Homo sapiens
tcaccaaagtatta

SEQ ID NO: 3856777 - DNA, 12 bp, Homo sapiens
tcaccaagctca

SEQ ID NO: 3856778 - DNA, 15 bp, Homo sapiens
tcaccactccattcc

SEQ ID NO: 3856779 - DNA, 16 bp, Homo sapiens
tcaccactccattccc

SEQ ID NO: 3856780 - DNA, 21 bp, Homo sapiens
tcaccacttcaatagatcaaa

SEQ ID NO: 3856781 - DNA, 15 bp, Homo sapiens
tcaccagatttgcta

SEQ ID NO: 3856782 - DNA, 13 bp, Homo sapiens
tcaccagcaacat

SEQ ID NO: 3856783 - DNA, 15 bp, Homo sapiens
tcaccagcaacatct

SEQ ID NO: 3856784 - DNA, 21 bp, Homo sapiens
tcaccagcaactctgactctt

SEQ ID NO: 3856785 - DNA, 17 bp, Homo sapiens
tcaccagctatctgtca

SEQ ID NO: 3856786 - DNA, 18 bp, Homo sapiens
tcaccagctatctgtcat

SEQ ID NO: 3856787 - DNA, 19 bp, Homo sapiens
tcaccagctatctgtcatc

SEQ ID NO: 3856788 - DNA, 17 bp, Homo sapiens
tcaccagtgtcccctcc

SEQ ID NO: 3856789 - DNA, 14 bp, Homo sapiens
tcacccacagggct

SEQ ID NO: 3856790 - DNA, 22 bp, Homo sapiens
tcacccaggctctggagccaga

SEQ ID NO: 3856791 - DNA, 16 bp, Homo sapiens
tcacccagtcctggcc

SEQ ID NO: 3856792 - DNA, 18 bp, Homo sapiens
tcacccagtcctggccat

SEQ ID NO: 3856793 - DNA, 12 bp, Homo sapiens
tcacccatgtgc

SEQ ID NO: 3856794 - DNA, 18 bp, Homo sapiens
tcacccccagctttgcta

SEQ ID NO: 3856795 - DNA, 13 bp, Homo sapiens
tcaccccccactc

SEQ ID NO: 3856796 - DNA, 20 bp, Homo sapiens
tcaccctccacctcttcacc

SEQ ID NO: 3856797 - DNA, 23 bp, Homo sapiens
tcaccctctgggcagctgtcatg

SEQ ID NO: 3856798 - DNA, 15 bp, Homo sapiens
tcaccctgcagagct

SEQ ID NO: 3856799 - DNA, 12 bp, Homo sapiens
tcacccttctgg

SEQ ID NO: 3856800 - DNA, 18 bp, Homo sapiens
tcaccgagacggctggac

SEQ ID NO: 3856801 - DNA, 19 bp, Homo sapiens
tcaccgagacggctggacc

SEQ ID NO: 3856802 - DNA, 20 bp, Homo sapiens
tcaccgagacggctggacct

SEQ ID NO: 3856803 - DNA, 21 bp, Homo sapiens
tcaccgagacggctggacctg

SEQ ID NO: 3856804 - DNA, 20 bp, Homo sapiens
tcaccgagagtagccgagag

SEQ ID NO: 3856805 - DNA, 23 bp, Homo sapiens
tcaccgagagtagccgagagcct

SEQ ID NO: 3856806 - DNA, 16 bp, Homo sapiens
tcaccgggatgaacct

SEQ ID NO: 3856807 - DNA, 20 bp, Homo sapiens
taccatatgtctgcttctgt

SEQ ID NO: 3856808 - DNA, 11 bp, Homo sapiens
taccatgaaga

SEQ ID NO: 3856809 - DNA, 12 bp, Homo sapiens
taccatttcaga

SEQ ID NO: 3856810 - DNA, 14 bp, Homo sapiens
tacccactctttgc

SEQ ID NO: 3856811 - DNA, 22 bp, Homo sapiens
tacccactctttgctacaataa

SEQ ID NO: 3856812 - DNA, 12 bp, Homo sapiens
tatgaaatgata

SEQ ID NO: 3856813 - DNA, 16 bp, Homo sapiens
tatgaacttgaggaca

SEQ ID NO: 3856814 - DNA, 18 bp, Homo sapiens
tatgaacttgaggacaca

SEQ ID NO: 3856815 - DNA, 22 bp, Homo sapiens
tatgaacttgaggacacatgtc

SEQ ID NO: 3856816 - DNA, 19 bp, Homo sapiens
tatgacatcacttgtacaa

SEQ ID NO: 3856817 - DNA, 21 bp, Homo sapiens
tatgacatgccaccctctcca

SEQ ID NO: 3856818 - DNA, 22 bp, Homo sapiens
tatgacatgccaccctctccat

SEQ ID NO: 3856819 - DNA, 23 bp, Homo sapiens
tatgacatgccaccctctccatg

SEQ ID NO: 3856820 - DNA, 17 bp, Homo sapiens
tatgactgctccccagc

SEQ ID NO: 3856821 - DNA, 12 bp, Homo sapiens
tatgagctgagg

SEQ ID NO: 3856822 - DNA, 13 bp, Homo sapiens
tatgagctgaggg

SEQ ID NO: 3856823 - DNA, 17 bp, Homo sapiens
tatgaggacttgtgtct

SEQ ID NO: 3856824 - DNA, 14 bp, Homo sapiens
tatgaggtgaaatg

SEQ ID NO: 3856825 - DNA, 14 bp, Homo sapiens
tatgagtatacaat

SEQ ID NO: 3856826 - DNA, 16 bp, Homo sapiens
tatgagtatacaatat

SEQ ID NO: 3856827 - DNA, 23 bp, Homo sapiens
tatgagtatacaatatataaaaa

SEQ ID NO: 3856828 - DNA, 16 bp, Homo sapiens
tatgagtcagtctctc

SEQ ID NO: 3856829 - DNA, 14 bp, Homo sapiens
tatgatcacagtga

SEQ ID NO: 3856830 - DNA, 17 bp, Homo sapiens
tatgatcacagtgactt

SEQ ID NO: 3856831 - DNA, 13 bp, Homo sapiens
tatgatccaagta

SEQ ID NO: 3856832 - DNA, 18 bp, Homo sapiens
tatgatttatagtttgta

SEQ ID NO: 3856833 - DNA, 17 bp, Homo sapiens
tatgattttttaaaaga

SEQ ID NO: 3856834 - DNA, 12 bp, Homo sapiens
tatgcaaagcac

SEQ ID NO: 3856835 - DNA, 13 bp, Homo sapiens
tatgcaaagcact

SEQ ID NO: 3856836 - DNA, 18 bp, Homo sapiens
tatgcaatttttaaacta

SEQ ID NO: 3856837 - DNA, 19 bp, Homo sapiens
tatgcaatttttaaactag

SEQ ID NO: 3856838 - DNA, 22 bp, Homo sapiens
tatgccatagcaagattgctta

SEQ ID NO: 3856839 - DNA, 16 bp, Homo sapiens
tatgcctctgtattta

SEQ ID NO: 3856840 - DNA, 19 bp, Homo sapiens
tatgcgtcccaagcagccg

SEQ ID NO: 3856841 - DNA, 20 bp, Homo sapiens
tatgctagtttattggaagt

SEQ ID NO: 3856842 - DNA, 14 bp, Homo sapiens
tatgctatttctgg

SEQ ID NO: 3856843 - DNA, 20 bp, Homo sapiens
tatgctggccagcaccctct

SEQ ID NO: 3856844 - DNA, 22 bp, Homo sapiens
tatggaaaagggtcttcttggc

SEQ ID NO: 3856845 - DNA, 12 bp, Homo sapiens
tatggaaatata

SEQ ID NO: 3856846 - DNA, 17 bp, Homo sapiens
tatggaacttctaatat

SEQ ID NO: 3856847 - DNA, 16 bp, Homo sapiens
tatggaagggaggggt

SEQ ID NO: 3856848 - DNA, 14 bp, Homo sapiens
tatggaatacagtg

SEQ ID NO: 3856849 - DNA, 15 bp, Homo sapiens
tatggaggatggaga

SEQ ID NO: 3856850 - DNA, 11 bp, Homo sapiens
tatggatgtgg

SEQ ID NO: 3856851 - DNA, 14 bp, Homo sapiens
tatggcatatttat

SEQ ID NO: 3856852 - DNA, 20 bp, Homo sapiens
tatggcatatttatattgta

SEQ ID NO: 3856853 - DNA, 13 bp, Homo sapiens
tatgggaagccat

SEQ ID NO: 3856854 - DNA, 18 bp, Homo sapiens
tatgggactgagcctggc

SEQ ID NO: 3856855 - DNA, 14 bp, Homo sapiens
tatgggtgctggca

SEQ ID NO: 3856856 - DNA, 17 bp, Homo sapiens
tatggtatgctggccag

SEQ ID NO: 3856857 - DNA, 22 bp, Homo sapiens
tatggtatgctggccagcaccc

SEQ ID NO: 3856858 - DNA, 23 bp, Homo sapiens
tatggtatgctggccagcaccct

SEQ ID NO: 3856859 - DNA, 16 bp, Homo sapiens
tatggttcccaataaa

SEQ ID NO: 3856860 - DNA, 17 bp, Homo sapiens
tatggttcccaataaaa

SEQ ID NO: 3856861 - DNA, 22 bp, Homo sapiens
tatggttcccaataaaagtgac

SEQ ID NO: 3856862 - DNA, 14 bp, Homo sapiens
tatggttgattccc

SEQ ID NO: 3856863 - DNA, 19 bp, Homo sapiens
tatggtttctgcgtgcttt

SEQ ID NO: 3856864 - DNA, 15 bp, Homo sapiens
tatgtaaacaggaga

SEQ ID NO: 3856865 - DNA, 14 bp, Homo sapiens
tatgtaaacataat

SEQ ID NO: 3856866 - DNA, 18 bp, Homo sapiens
tatgtaaacataattctt

SEQ ID NO: 3856867 - DNA, 23 bp, Homo sapiens
tatgtaaactgcattagaaatta

SEQ ID NO: 3856868 - DNA, 14 bp, Homo sapiens
tatgtagaaatatt

SEQ ID NO: 3856869 - DNA, 18 bp, Homo sapiens
tatgtagaaatattataa

SEQ ID NO: 3856870 - DNA, 19 bp, Homo sapiens
tatgtagactatatacatg

SEQ ID NO: 3856871 - DNA, 22 bp, Homo sapiens
tatgtagactatatacatgtgt

SEQ ID NO: 3856872 - DNA, 14 bp, Homo sapiens
tatgtatacacaca

SEQ ID NO: 3856873 - DNA, 15 bp, Homo sapiens
tatgtatacacacat

SEQ ID NO: 3856874 - DNA, 21 bp, Homo sapiens
tatgtatacacacatatacat

SEQ ID NO: 3856875 - DNA, 23 bp, Homo sapiens
tatgtatatactatacaacaatg

SEQ ID NO: 3856876 - DNA, 14 bp, Homo sapiens
tatgtatatgtata

SEQ ID NO: 3856877 - DNA, 20 bp, Homo sapiens
tatgtatggaatacagtgtt

SEQ ID NO: 3856878 - DNA, 17 bp, Homo sapiens
tatgtatggtatccaag

SEQ ID NO: 3856879 - DNA, 16 bp, Homo sapiens
tatgtattattttcta

SEQ ID NO: 3856880 - DNA, 17 bp, Homo sapiens
tatgtattattttctat

SEQ ID NO: 3856881 - DNA, 17 bp, Homo sapiens
tatgtcaatttgtatat

SEQ ID NO: 3856882 - DNA, 20 bp, Homo sapiens
tatgtcaatttgtatatcat

SEQ ID NO: 3856883 - DNA, 12 bp, Homo sapiens
tatgtctaaaga

SEQ ID NO: 3856884 - DNA, 21 bp, Homo sapiens
tatgtgaaagtgtaaaataga

SEQ ID NO: 3856885 - DNA, 23 bp, Homo sapiens
tatgtggattagctagaatgcac

SEQ ID NO: 3856886 - DNA, 19 bp, Homo sapiens
tatgtgtgtggtgtgtgtg

SEQ ID NO: 3856887 - DNA, 17 bp, Homo sapiens
tatgtgtgtttaaataa

SEQ ID NO: 3856888 - DNA, 13 bp, Homo sapiens
tatgttagagagg

SEQ ID NO: 3856889 - DNA, 16 bp, Homo sapiens
tatgttcagaagaaat

SEQ ID NO: 3856890 - DNA, 17 bp, Homo sapiens
tatgttgagtgttcatt

SEQ ID NO: 3856891 - DNA, 12 bp, Homo sapiens
tattaaaaatat

SEQ ID NO: 3856892 - DNA, 20 bp, Homo sapiens
tattaaaatgattgtaaaat

SEQ ID NO: 3856893 - DNA, 22 bp, Homo sapiens
tattaaaatgattgtaaaatag

SEQ ID NO: 3856894 - DNA, 17 bp, Homo sapiens
tattaaatacagacact

SEQ ID NO: 3856895 - DNA, 16 bp, Homo sapiens
tattaacgggcatgta

SEQ ID NO: 3856896 - DNA, 15 bp, Homo sapiens
tattaagatttccaa

SEQ ID NO: 3856897 - DNA, 20 bp, Homo sapiens
gttggaatcacctggagggc

SEQ ID NO: 3856898 - DNA, 14 bp, Homo sapiens
gttggacacactgt

SEQ ID NO: 3856899 - DNA, 14 bp, Homo sapiens
gttggacagctgct

SEQ ID NO: 3856900 - DNA, 15 bp, Homo sapiens
gttggacagctgctt

SEQ ID NO: 3856901 - DNA, 16 bp, Homo sapiens
gttggacccgctctgg

SEQ ID NO: 3856902 - DNA, 18 bp, Homo sapiens
gttggacccgctctggac

SEQ ID NO: 3856903 - DNA, 22 bp, Homo sapiens
gttggagagctagaacctggag

SEQ ID NO: 3856904 - DNA, 13 bp, Homo sapiens
gttggagccactc

SEQ ID NO: 3856905 - DNA, 13 bp, Homo sapiens
gttggatgggaag

SEQ ID NO: 3856906 - DNA, 14 bp, Homo sapiens
gttggatgggaaga

SEQ ID NO: 3856907 - DNA, 13 bp, Homo sapiens
gttggcagagaag

SEQ ID NO: 3856908 - DNA, 20 bp, Homo sapiens
gttggcagagaaggcctctt

SEQ ID NO: 3856909 - DNA, 13 bp, Homo sapiens
gttggccaggctg

SEQ ID NO: 3856910 - DNA, 15 bp, Homo sapiens
gttggccaggctggt

SEQ ID NO: 3856911 - DNA, 16 bp, Homo sapiens
gttggcctcgcctggg

SEQ ID NO: 3856912 - DNA, 21 bp, Homo sapiens
gttggcctcgcctgggcccag

SEQ ID NO: 3856913 - DNA, 15 bp, Homo sapiens
gttggctcaggcaga

SEQ ID NO: 3856914 - DNA, 20 bp, Homo sapiens
gttggctgacttccacacct

SEQ ID NO: 3856915 - DNA, 18 bp, Homo sapiens
gttgggatttatatctat

SEQ ID NO: 3856916 - DNA, 14 bp, Homo sapiens
gttggggtggggca

SEQ ID NO: 3856917 - DNA, 15 bp, Homo sapiens
gttgggttcatctga

SEQ ID NO: 3856918 - DNA, 13 bp, Homo sapiens
gttggtgccactt

SEQ ID NO: 3856919 - DNA, 19 bp, Homo sapiens
gttggttggggtggggcag

SEQ ID NO: 3856920 - DNA, 14 bp, Homo sapiens
gttgtaaatattta

SEQ ID NO: 3856921 - DNA, 15 bp, Homo sapiens
gttgtaatagtccat

SEQ ID NO: 3856922 - DNA, 14 bp, Homo sapiens
gttgtacaagctca

SEQ ID NO: 3856923 - DNA, 16 bp, Homo sapiens
gttgtacgtaatgtat

SEQ ID NO: 3856924 - DNA, 15 bp, Homo sapiens
gttgtcaatattaaa

SEQ ID NO: 3856925 - DNA, 19 bp, Homo sapiens
gttgtcaatattaaataca

SEQ ID NO: 3856926 - DNA, 18 bp, Homo sapiens
gttgtccatattttcaca

SEQ ID NO: 3856927 - DNA, 20 bp, Homo sapiens
gttgtctattctgagccttg

SEQ ID NO: 3856928 - DNA, 22 bp, Homo sapiens
gttgtctattctgagccttgag

SEQ ID NO: 3856929 - DNA, 23 bp, Homo sapiens
gttgtgactttttagccagtgac

SEQ ID NO: 3856930 - DNA, 22 bp, Homo sapiens
gttgtgaggcctggccaggcac

SEQ ID NO: 3856931 - DNA, 20 bp, Homo sapiens
gttgtgattttgtacagaat

SEQ ID NO: 3856932 - DNA, 22 bp, Homo sapiens
gttgtgcttgctggtactaaga

SEQ ID NO: 3856933 - DNA, 21 bp, Homo sapiens
gttgttaaacacgtgtctata

SEQ ID NO: 3856934 - DNA, 20 bp, Homo sapiens
gttgttgccaactaagccct

SEQ ID NO: 3856935 - DNA, 14 bp, Homo sapiens
gtttaaataaagta

SEQ ID NO: 3856936 - DNA, 22 bp, Homo sapiens
gtttaaataaagtatcatgcat

SEQ ID NO: 3856937 - DNA, 13 bp, Homo sapiens
gtttaaattgtaa

SEQ ID NO: 3856938 - DNA, 12 bp, Homo sapiens
gtttaatattta

SEQ ID NO: 3856939 - DNA, 22 bp, Homo sapiens
gtttacaaaaggcagccctttg

SEQ ID NO: 3856940 - DNA, 19 bp, Homo sapiens
gtttacaagtgtatatcag

SEQ ID NO: 3856941 - DNA, 13 bp, Homo sapiens
gtttacagaactg

SEQ ID NO: 3856942 - DNA, 13 bp, Homo sapiens
gtttacagtaaat

SEQ ID NO: 3856943 - DNA, 19 bp, Homo sapiens
gtttacatgaacacagctg

SEQ ID NO: 3856944 - DNA, 13 bp, Homo sapiens
gtttacatgcaga

SEQ ID NO: 3856945 - DNA, 15 bp, Homo sapiens
gtttagaagcgctca

SEQ ID NO: 3856946 - DNA, 15 bp, Homo sapiens
gtttagattccagga

SEQ ID NO: 3856947 - DNA, 18 bp, Homo sapiens
gtttattaacaaattatg

SEQ ID NO: 3856948 - DNA, 13 bp, Homo sapiens
gtttattttttct

SEQ ID NO: 3856949 - DNA, 18 bp, Homo sapiens
gtttattttttctacaca

SEQ ID NO: 3856950 - DNA, 15 bp, Homo sapiens
gtttcaattcagtgc

SEQ ID NO: 3856951 - DNA, 16 bp, Homo sapiens
gtttcagaattttgta

SEQ ID NO: 3856952 - DNA, 16 bp, Homo sapiens
gtttcagatatatatc

SEQ ID NO: 3856953 - DNA, 21 bp, Homo sapiens
gtttcagctgacagctgctca

SEQ ID NO: 3856954 - DNA, 17 bp, Homo sapiens
gtttcaggacatggggc

SEQ ID NO: 3856955 - DNA, 14 bp, Homo sapiens
gtttcagtaaataa

SEQ ID NO: 3856956 - DNA, 22 bp, Homo sapiens
gtttccaaaaaggaacactgga

SEQ ID NO: 3856957 - DNA, 16 bp, Homo sapiens
gtttccaacctggagt

SEQ ID NO: 3856958 - DNA, 22 bp, Homo sapiens
gtttccacgatgaaaaacttcc

SEQ ID NO: 3856959 - DNA, 19 bp, Homo sapiens
gtttccagaaaatataaat

SEQ ID NO: 3856960 - DNA, 22 bp, Homo sapiens
gtttccatgggtcaaagccggt

SEQ ID NO: 3856961 - DNA, 22 bp, Homo sapiens
gtttccttttattctgtacctt

SEQ ID NO: 3856962 - DNA, 17 bp, Homo sapiens
gtttctaaaactatggt

SEQ ID NO: 3856963 - DNA, 15 bp, Homo sapiens
gtttctagaggcctc

SEQ ID NO: 3856964 - DNA, 18 bp, Homo sapiens
gtttctagaggcctcagt

SEQ ID NO: 3856965 - DNA, 20 bp, Homo sapiens
gtttctagaggcctcagttt

SEQ ID NO: 3856966 - DNA, 18 bp, Homo sapiens
gtttctagctagaaatat

SEQ ID NO: 3856967 - DNA, 23 bp, Homo sapiens
gtttctagctagaaatatgattt

SEQ ID NO: 3856968 - DNA, 23 bp, Homo sapiens
gtttctattctctcctcagactg

SEQ ID NO: 3856969 - DNA, 13 bp, Homo sapiens
gtttctgagaaaa

SEQ ID NO: 3856970 - DNA, 14 bp, Homo sapiens
gttcagcccctcct

SEQ ID NO: 3856971 - DNA, 17 bp, Homo sapiens
gttcagcccctcctctg

SEQ ID NO: 3856972 - DNA, 20 bp, Homo sapiens
gttcagcccctcctctgcca

SEQ ID NO: 3856973 - DNA, 22 bp, Homo sapiens
gttcagcccctcctctgccacc

SEQ ID NO: 3856974 - DNA, 19 bp, Homo sapiens
gttcagggaagcaggcaga

SEQ ID NO: 3856975 - DNA, 14 bp, Homo sapiens
gttcatgagtggat

SEQ ID NO: 3856976 - DNA, 16 bp, Homo sapiens
gttcatgagtggatgg

SEQ ID NO: 3856977 - DNA, 20 bp, Homo sapiens
gttcattcttaccgagaaaa

SEQ ID NO: 3856978 - DNA, 13 bp, Homo sapiens
gttcattttagtg

SEQ ID NO: 3856979 - DNA, 23 bp, Homo sapiens
gttccaaataaggatttgttcac

SEQ ID NO: 3856980 - DNA, 21 bp, Homo sapiens
gttccacgtccccctggggct

SEQ ID NO: 3856981 - DNA, 15 bp, Homo sapiens
gttccagctgcctgg

SEQ ID NO: 3856982 - DNA, 12 bp, Homo sapiens
gttccatgaaga

SEQ ID NO: 3856983 - DNA, 20 bp, Homo sapiens
gttccatgcctgagggtgga

SEQ ID NO: 3856984 - DNA, 13 bp, Homo sapiens
gttccatgttaaa

SEQ ID NO: 3856985 - DNA, 14 bp, Homo sapiens
gttcccaataaaag

SEQ ID NO: 3856986 - DNA, 16 bp, Homo sapiens
gttcccaataaaagtg

SEQ ID NO: 3856987 - DNA, 14 bp, Homo sapiens
gttcccccagacag

SEQ ID NO: 3856988 - DNA, 18 bp, Homo sapiens
gttcccggagcacagccc

SEQ ID NO: 3856989 - DNA, 19 bp, Homo sapiens
gttcccggagcacagccct

SEQ ID NO: 3856990 - DNA, 21 bp, Homo sapiens
gttcccggagcacagccctgg

SEQ ID NO: 3856991 - DNA, 19 bp, Homo sapiens
gttccctgaaaacccagag

SEQ ID NO: 3856992 - DNA, 20 bp, Homo sapiens
gttccctgaaaacccagaga

SEQ ID NO: 3856993 - DNA, 20 bp, Homo sapiens
gttccctgtcagaggctaag

SEQ ID NO: 3856994 - DNA, 16 bp, Homo sapiens
gttccctgtcttgtcc

SEQ ID NO: 3856995 - DNA, 14 bp, Homo sapiens
gttcctctttgcat

SEQ ID NO: 3856996 - DNA, 14 bp, Homo sapiens
gttccttactgcag

SEQ ID NO: 3856997 - DNA, 15 bp, Homo sapiens
gttccttctgcttct

SEQ ID NO: 3856998 - DNA, 16 bp, Homo sapiens
gttccttctgcttctc

SEQ ID NO: 3856999 - DNA, 13 bp, Homo sapiens
gttcgcagccacc

SEQ ID NO: 3857000 - DNA, 17 bp, Homo sapiens
gttcgcagccaccctga

SEQ ID NO: 3857001 - DNA, 18 bp, Homo sapiens
gttctaaaggactaacat

SEQ ID NO: 3857002 - DNA, 18 bp, Homo sapiens
gttctaatatttttagct

SEQ ID NO: 3857003 - DNA, 19 bp, Homo sapiens
gttctacaagcatatttga

SEQ ID NO: 3857004 - DNA, 15 bp, Homo sapiens
gttctagagaagagg

SEQ ID NO: 3857005 - DNA, 21 bp, Homo sapiens
gttctagtctcctttgcactg

SEQ ID NO: 3857006 - DNA, 21 bp, Homo sapiens
gttctatcccacccaacagct

SEQ ID NO: 3857007 - DNA, 13 bp, Homo sapiens
gttctccagccca

SEQ ID NO: 3857008 - DNA, 14 bp, Homo sapiens
gttctccagcccac

SEQ ID NO: 3857009 - DNA, 16 bp, Homo sapiens
gttctccagcccacac

SEQ ID NO: 3857010 - DNA, 17 bp, Homo sapiens
gttctccagcccacacc

SEQ ID NO: 3857011 - DNA, 18 bp, Homo sapiens
gttctcctccattgctgt

SEQ ID NO: 3857012 - DNA, 15 bp, Homo sapiens
gttctgacattcatt

SEQ ID NO: 3857013 - DNA, 19 bp, Homo sapiens
gttctgagccgggcaagtc

SEQ ID NO: 3857014 - DNA, 16 bp, Homo sapiens
gttctgcactgaaaag

SEQ ID NO: 3857015 - DNA, 14 bp, Homo sapiens
gttctgcgttacaa

SEQ ID NO: 3857016 - DNA, 11 bp, Homo sapiens
gttctgctcct

SEQ ID NO: 3857017 - DNA, 16 bp, Homo sapiens
gttctgctggcctgga

SEQ ID NO: 3857018 - DNA, 17 bp, Homo sapiens
gttctggcctcagacca

SEQ ID NO: 3857019 - DNA, 19 bp, Homo sapiens
gttctggctttacatttta

SEQ ID NO: 3857020 - DNA, 18 bp, Homo sapiens
gttctggggaggaagggc

SEQ ID NO: 3857021 - DNA, 23 bp, Homo sapiens
gttctggtatgaacttgaggaca

SEQ ID NO: 3857022 - DNA, 12 bp, Homo sapiens
gttctgtcacca

SEQ ID NO: 3857023 - DNA, 19 bp, Homo sapiens
gttctgtgggcttggcctt

SEQ ID NO: 3857024 - DNA, 21 bp, Homo sapiens
gttctgtgtgggtctggggag

SEQ ID NO: 3857025 - DNA, 14 bp, Homo sapiens
gttcttcgaggtgg

SEQ ID NO: 3857026 - DNA, 23 bp, Homo sapiens
gttcttgagtagatctgcttctt

SEQ ID NO: 3857027 - DNA, 13 bp, Homo sapiens
gttcttgatgaca

SEQ ID NO: 3857028 - DNA, 15 bp, Homo sapiens
gttcttgatgtcatg

SEQ ID NO: 3857029 - DNA, 14 bp, Homo sapiens
gttcttggtgactg

SEQ ID NO: 3857030 - DNA, 16 bp, Homo sapiens
gttcttgtgcatgttt

SEQ ID NO: 3857031 - DNA, 18 bp, Homo sapiens
gttcttgtgcatgtttac

SEQ ID NO: 3857032 - DNA, 13 bp, Homo sapiens
gttctttaatgtt

SEQ ID NO: 3857033 - DNA, 13 bp, Homo sapiens
gttgaaaaatcta

SEQ ID NO: 3857034 - DNA, 17 bp, Homo sapiens
gttgaaaagactccaaa

SEQ ID NO: 3857035 - DNA, 15 bp, Homo sapiens
gttgaaagagtccta

SEQ ID NO: 3857036 - DNA, 11 bp, Homo sapiens
gttgaaatctt

SEQ ID NO: 3857037 - DNA, 15 bp, Homo sapiens
gttgaatgacaacag

SEQ ID NO: 3857038 - DNA, 19 bp, Homo sapiens
gttgagggaacagacagga

SEQ ID NO: 3857039 - DNA, 23 bp, Homo sapiens
gttgcaataaaatagtattgaaa

SEQ ID NO: 3857040 - DNA, 17 bp, Homo sapiens
gttgcaccatctgcttg

SEQ ID NO: 3857041 - DNA, 16 bp, Homo sapiens
gttgcatgatgtattt

SEQ ID NO: 3857042 - DNA, 14 bp, Homo sapiens
gtgtgcgtgcgtgt

SEQ ID NO: 3857043 - DNA, 18 bp, Homo sapiens
gtgtgcgtgcgtgtgcgt

SEQ ID NO: 3857044 - DNA, 15 bp, Homo sapiens
gtgtgcgtgtgtgca

SEQ ID NO: 3857045 - DNA, 14 bp, Homo sapiens
gtgtggacaggact

SEQ ID NO: 3857046 - DNA, 14 bp, Homo sapiens
gtgtggagaggggt

SEQ ID NO: 3857047 - DNA, 13 bp, Homo sapiens
gtgtggcctcagc

SEQ ID NO: 3857048 - DNA, 16 bp, Homo sapiens
gtgtggctgtattcag

SEQ ID NO: 3857049 - DNA, 16 bp, Homo sapiens
gtgtgggaagggagag

SEQ ID NO: 3857050 - DNA, 22 bp, Homo sapiens
gtgtgggtgatcagaaggctgg

SEQ ID NO: 3857051 - DNA, 23 bp, Homo sapiens
gtgtgggtgatcagaaggctggg

SEQ ID NO: 3857052 - DNA, 15 bp, Homo sapiens
gtgtggtgtgtgtgc

SEQ ID NO: 3857053 - DNA, 14 bp, Homo sapiens
gtgtgtatgtgtat

SEQ ID NO: 3857054 - DNA, 13 bp, Homo sapiens
gtgtgtgcatgta

SEQ ID NO: 3857055 - DNA, 16 bp, Homo sapiens
gtgtgtgcatgtgtgt

SEQ ID NO: 3857056 - DNA, 15 bp, Homo sapiens
gtgtgtgtgcatgtg

SEQ ID NO: 3857057 - DNA, 10 bp, Homo sapiens
gtgtgtgtgt

SEQ ID NO: 3857058 - DNA, 13 bp, Homo sapiens
gtgtgtgtgtgtg

SEQ ID NO: 3857059 - DNA, 14 bp, Homo sapiens
gtgtgtgtgtgtgt

SEQ ID NO: 3857060 - DNA, 16 bp, Homo sapiens
gtgtgtttaaataaag

SEQ ID NO: 3857061 - DNA, 19 bp, Homo sapiens
gtgttaggaggctgcatgc

SEQ ID NO: 3857062 - DNA, 14 bp, Homo sapiens
gtgttagtgtgtgt

SEQ ID NO: 3857063 - DNA, 17 bp, Homo sapiens
gtgttagtgtgtgtgca

SEQ ID NO: 3857064 - DNA, 17 bp, Homo sapiens
gtgttccagctgcctgg

SEQ ID NO: 3857065 - DNA, 14 bp, Homo sapiens
gtgttctattaatc

SEQ ID NO: 3857066 - DNA, 12 bp, Homo sapiens
gtgttctgtttc

SEQ ID NO: 3857067 - DNA, 17 bp, Homo sapiens
gtgttgaaaatgttcag

SEQ ID NO: 3857068 - DNA, 14 bp, Homo sapiens
gtgttgccatttct

SEQ ID NO: 3857069 - DNA, 19 bp, Homo sapiens
gtgttgccatttctctgct

SEQ ID NO: 3857070 - DNA, 21 bp, Homo sapiens
gtgttggctaatgaagggaaa

SEQ ID NO: 3857071 - DNA, 14 bp, Homo sapiens
gtgtttaaagtcaa

SEQ ID NO: 3857072 - DNA, 16 bp, Homo sapiens
gtgtttacaaaaggca

SEQ ID NO: 3857073 - DNA, 23 bp, Homo sapiens
gtgttttttcactttagctatgt

SEQ ID NO: 3857074 - DNA, 14 bp, Homo sapiens
gttaaaagacagtg

SEQ ID NO: 3857075 - DNA, 21 bp, Homo sapiens
gttaaaagactgcagctgctg

SEQ ID NO: 3857076 - DNA, 15 bp, Homo sapiens
gttaaaatgtacact

SEQ ID NO: 3857077 - DNA, 15 bp, Homo sapiens
gttaaagctgccggc

SEQ ID NO: 3857078 - DNA, 20 bp, Homo sapiens
gttaaaggaagtttgttcac

SEQ ID NO: 3857079 - DNA, 17 bp, Homo sapiens
gttaaatggagtatttt

SEQ ID NO: 3857080 - DNA, 22 bp, Homo sapiens
gttaacattgttgctccctgtg

SEQ ID NO: 3857081 - DNA, 11 bp, Homo sapiens
gttaactatta

SEQ ID NO: 3857082 - DNA, 22 bp, Homo sapiens
gttaagttacttcactttaatt

SEQ ID NO: 3857083 - DNA, 15 bp, Homo sapiens
gttaatgctttctga

SEQ ID NO: 3857084 - DNA, 17 bp, Homo sapiens
gttaatgttgggattta

SEQ ID NO: 3857085 - DNA, 18 bp, Homo sapiens
gttaattcagcactgatt

SEQ ID NO: 3857086 - DNA, 21 bp, Homo sapiens
gttaattcagcactgatttca

SEQ ID NO: 3857087 - DNA, 16 bp, Homo sapiens
gttacacagcccaaga

SEQ ID NO: 3857088 - DNA, 19 bp, Homo sapiens
gttacagggcccaggtgag

SEQ ID NO: 3857089 - DNA, 13 bp, Homo sapiens
gttacctttccca

SEQ ID NO: 3857090 - DNA, 17 bp, Homo sapiens
gttacctttcccatgct

SEQ ID NO: 3857091 - DNA, 23 bp, Homo sapiens
gttactgaaatgaggagagaagg

SEQ ID NO: 3857092 - DNA, 17 bp, Homo sapiens
gttacttacctaaacag

SEQ ID NO: 3857093 - DNA, 16 bp, Homo sapiens
gttacttcactttaat

SEQ ID NO: 3857094 - DNA, 16 bp, Homo sapiens
gttacttgaaatacca

SEQ ID NO: 3857095 - DNA, 19 bp, Homo sapiens
gttacttgaaataccagtg

SEQ ID NO: 3857096 - DNA, 19 bp, Homo sapiens
gttacttgtctgaggcctc

SEQ ID NO: 3857097 - DNA, 23 bp, Homo sapiens
gttacttgtctgaggcctcatcc

SEQ ID NO: 3857098 - DNA, 20 bp, Homo sapiens
gttactttttagtcttttac

SEQ ID NO: 3857099 - DNA, 18 bp, Homo sapiens
gttagagaggtagcgagc

SEQ ID NO: 3857100 - DNA, 23 bp, Homo sapiens
gttagcagcagtgagcttctatt

SEQ ID NO: 3857101 - DNA, 11 bp, Homo sapiens
gttagctgagc

SEQ ID NO: 3857102 - DNA, 12 bp, Homo sapiens
gttagctggaca

SEQ ID NO: 3857103 - DNA, 16 bp, Homo sapiens
gttaggaaataaaacc

SEQ ID NO: 3857104 - DNA, 22 bp, Homo sapiens
gttaggaaataaaacctttcaa

SEQ ID NO: 3857105 - DNA, 14 bp, Homo sapiens
gttagtttttactt

SEQ ID NO: 3857106 - DNA, 17 bp, Homo sapiens
gttatattgaatatatc

SEQ ID NO: 3857107 - DNA, 17 bp, Homo sapiens
gttatcagttaacatta

SEQ ID NO: 3857108 - DNA, 16 bp, Homo sapiens
gttatctgcctggcct

SEQ ID NO: 3857109 - DNA, 18 bp, Homo sapiens
gttatctgcctggcctgg

SEQ ID NO: 3857110 - DNA, 20 bp, Homo sapiens
gttatgagggtcagggcagt

SEQ ID NO: 3857111 - DNA, 22 bp, Homo sapiens
gttatgtttgcactttgtatat

SEQ ID NO: 3857112 - DNA, 22 bp, Homo sapiens
cctggagggctagaacctggag

SEQ ID NO: 3857113 - DNA, 20 bp, Homo sapiens
cctggaggggctagaaccta

SEQ ID NO: 3857114 - DNA, 18 bp, Homo sapiens
cctggatcagcgtggcct

SEQ ID NO: 3857115 - DNA, 19 bp, Homo sapiens
cctggatctccccactcta

SEQ ID NO: 3857116 - DNA, 20 bp, Homo sapiens
cctggatgggcattgggctg

SEQ ID NO: 3857117 - DNA, 21 bp, Homo sapiens
cctggatgggcattgggctga

SEQ ID NO: 3857118 - DNA, 20 bp, Homo sapiens
cctggatgtgtggggcatgg

SEQ ID NO: 3857119 - DNA, 21 bp, Homo sapiens
cctggcaagctagaacctgga

SEQ ID NO: 3857120 - DNA, 14 bp, Homo sapiens
cctggcacaggact

SEQ ID NO: 3857121 - DNA, 19 bp, Homo sapiens
cctggcagccgtgccttca

SEQ ID NO: 3857122 - DNA, 21 bp, Homo sapiens
cctggcagccgtgccttcagc

SEQ ID NO: 3857123 - DNA, 13 bp, Homo sapiens
cctggccagacgc

SEQ ID NO: 3857124 - DNA, 21 bp, Homo sapiens
cctggccaggcaccccctgga

SEQ ID NO: 3857125 - DNA, 16 bp, Homo sapiens
cctggcccccctccag

SEQ ID NO: 3857126 - DNA, 20 bp, Homo sapiens
cctggcccccctccaggcat

SEQ ID NO: 3857127 - DNA, 22 bp, Homo sapiens
cctggccccgggctctggccac

SEQ ID NO: 3857128 - DNA, 21 bp, Homo sapiens
cctggcccctccagaccctgc

SEQ ID NO: 3857129 - DNA, 15 bp, Homo sapiens
cctggcccgcccctc

SEQ ID NO: 3857130 - DNA, 13 bp, Homo sapiens
cctggccctgcct

SEQ ID NO: 3857131 - DNA, 21 bp, Homo sapiens
cctggccggcaaccccagttc

SEQ ID NO: 3857132 - DNA, 17 bp, Homo sapiens
cctggcctcactggctg

SEQ ID NO: 3857133 - DNA, 23 bp, Homo sapiens
cctggcctcactggctggggcag

SEQ ID NO: 3857134 - DNA, 14 bp, Homo sapiens
cctggcctcctgcc

SEQ ID NO: 3857135 - DNA, 15 bp, Homo sapiens
cctggcctcctgcct

SEQ ID NO: 3857136 - DNA, 12 bp, Homo sapiens
cctggcctgagc

SEQ ID NO: 3857137 - DNA, 14 bp, Homo sapiens
cctggcctgagctg

SEQ ID NO: 3857138 - DNA, 19 bp, Homo sapiens
cctggcctgagctggggcc

SEQ ID NO: 3857139 - DNA, 18 bp, Homo sapiens
cctggcctgctgggaacc

SEQ ID NO: 3857140 - DNA, 12 bp, Homo sapiens
cctggcctggct

SEQ ID NO: 3857141 - DNA, 16 bp, Homo sapiens
cctggcctggctcccc

SEQ ID NO: 3857142 - DNA, 18 bp, Homo sapiens
cctggccttgtcaggacc

SEQ ID NO: 3857143 - DNA, 20 bp, Homo sapiens
cctggccttgtcaggaccca

SEQ ID NO: 3857144 - DNA, 23 bp, Homo sapiens
cctggccttgtcaggacccaggc

SEQ ID NO: 3857145 - DNA, 16 bp, Homo sapiens
cctggcggggcaggag

SEQ ID NO: 3857146 - DNA, 21 bp, Homo sapiens
cctggcggggcaggaggcctg

SEQ ID NO: 3857147 - DNA, 22 bp, Homo sapiens
cctggcggggcaggaggcctgg

SEQ ID NO: 3857148 - DNA, 22 bp, Homo sapiens
cctggctgaccccaaagagcct

SEQ ID NO: 3857149 - DNA, 12 bp, Homo sapiens
cctggctgccag

SEQ ID NO: 3857150 - DNA, 13 bp, Homo sapiens
cctggctgccagg

SEQ ID NO: 3857151 - DNA, 15 bp, Homo sapiens
cctggctgccaggcg

SEQ ID NO: 3857152 - DNA, 15 bp, Homo sapiens
cctggcttgctccag

SEQ ID NO: 3857153 - DNA, 18 bp, Homo sapiens
cctggcttgctccagggt

SEQ ID NO: 3857154 - DNA, 21 bp, Homo sapiens
cctggcttgcttgccgagcct

SEQ ID NO: 3857155 - DNA, 17 bp, Homo sapiens
cctggcttttcactgct

SEQ ID NO: 3857156 - DNA, 22 bp, Homo sapiens
cctggcttttcactgctggctg

SEQ ID NO: 3857157 - DNA, 23 bp, Homo sapiens
cctggcttttcactgctggctgc

SEQ ID NO: 3857158 - DNA, 24 bp, Homo sapiens
cctggcttttcactgctggctgcc

SEQ ID NO: 3857159 - DNA, 19 bp, Homo sapiens
cctgggaaaacagaggaat

SEQ ID NO: 3857160 - DNA, 23 bp, Homo sapiens
cctgggaaaggacccacccatct

SEQ ID NO: 3857161 - DNA, 16 bp, Homo sapiens
cctgggaactcatcct

SEQ ID NO: 3857162 - DNA, 13 bp, Homo sapiens
cctgggacccagc

SEQ ID NO: 3857163 - DNA, 14 bp, Homo sapiens
cctgggacccagct

SEQ ID NO: 3857164 - DNA, 15 bp, Homo sapiens
cctgggacccagcta

SEQ ID NO: 3857165 - DNA, 20 bp, Homo sapiens
cctgggcatcttctggcttg

SEQ ID NO: 3857166 - DNA, 19 bp, Homo sapiens
cctgggccaaaagggcagc

SEQ ID NO: 3857167 - DNA, 13 bp, Homo sapiens
gtggccctggcct

SEQ ID NO: 3857168 - DNA, 18 bp, Homo sapiens
gtggccctggcctgctgg

SEQ ID NO: 3857169 - DNA, 19 bp, Homo sapiens
gtggccctggcctgctggg

SEQ ID NO: 3857170 - DNA, 19 bp, Homo sapiens
gtggccgcaagcgcaggga

SEQ ID NO: 3857171 - DNA, 20 bp, Homo sapiens
gtggccgcaagcgcagggag

SEQ ID NO: 3857172 - DNA, 21 bp, Homo sapiens
gtggccgcaagcgcagggagg

SEQ ID NO: 3857173 - DNA, 13 bp, Homo sapiens
gtggcctcacttc

SEQ ID NO: 3857174 - DNA, 20 bp, Homo sapiens
gtggcctcacttccctggga

SEQ ID NO: 3857175 - DNA, 13 bp, Homo sapiens
gtggcctcagccc

SEQ ID NO: 3857176 - DNA, 17 bp, Homo sapiens
gtggcctcagccctcag

SEQ ID NO: 3857177 - DNA, 19 bp, Homo sapiens
gtggcctcagccctcagaa

SEQ ID NO: 3857178 - DNA, 22 bp, Homo sapiens
gtggcctcgggacacctgccct

SEQ ID NO: 3857179 - DNA, 14 bp, Homo sapiens
gtggcggtgcctgg

SEQ ID NO: 3857180 - DNA, 17 bp, Homo sapiens
gtggcggtgcctgggtg

SEQ ID NO: 3857181 - DNA, 14 bp, Homo sapiens
gtggctaattcaat

SEQ ID NO: 3857182 - DNA, 17 bp, Homo sapiens
gtggctactctgtgcca

SEQ ID NO: 3857183 - DNA, 21 bp, Homo sapiens
gtggctactctgtgccagagc

SEQ ID NO: 3857184 - DNA, 23 bp, Homo sapiens
gtggctactctgtgccagagcct

SEQ ID NO: 3857185 - DNA, 17 bp, Homo sapiens
gtggctagtcagagaga

SEQ ID NO: 3857186 - DNA, 23 bp, Homo sapiens
gtggctcacgcctgtaatcccag

SEQ ID NO: 3857187 - DNA, 19 bp, Homo sapiens
gtggctgacccagtccctg

SEQ ID NO: 3857188 - DNA, 19 bp, Homo sapiens
gtggcttcccgctcagccc

SEQ ID NO: 3857189 - DNA, 21 bp, Homo sapiens
gtgggaaagggacccgaagcc

SEQ ID NO: 3857190 - DNA, 23 bp, Homo sapiens
gtgggaacgactgggcactgcca

SEQ ID NO: 3857191 - DNA, 22 bp, Homo sapiens
gtgggaagcttgctggcttctg

SEQ ID NO: 3857192 - DNA, 16 bp, Homo sapiens
gtgggaagtgaagccc

SEQ ID NO: 3857193 - DNA, 21 bp, Homo sapiens
gtgggacaaaccagagcagag

SEQ ID NO: 3857194 - DNA, 12 bp, Homo sapiens
gtgggagagaca

SEQ ID NO: 3857195 - DNA, 12 bp, Homo sapiens
gtgggagcctcg

SEQ ID NO: 3857196 - DNA, 13 bp, Homo sapiens
gtgggagcctcgc

SEQ ID NO: 3857197 - DNA, 19 bp, Homo sapiens
gtgggagggagcagacagg

SEQ ID NO: 3857198 - DNA, 14 bp, Homo sapiens
gtgggatggaggag

SEQ ID NO: 3857199 - DNA, 14 bp, Homo sapiens
gtgggcagcaccct

SEQ ID NO: 3857200 - DNA, 14 bp, Homo sapiens
gtgggcagctgggc

SEQ ID NO: 3857201 - DNA, 19 bp, Homo sapiens
gtgggccactctcccctcc

SEQ ID NO: 3857202 - DNA, 18 bp, Homo sapiens
gtgggccaggacaggccc

SEQ ID NO: 3857203 - DNA, 12 bp, Homo sapiens
gtgggcctggcc

SEQ ID NO: 3857204 - DNA, 14 bp, Homo sapiens
gtgggcctggcctg

SEQ ID NO: 3857205 - DNA, 15 bp, Homo sapiens
gtgggcctggcctga

SEQ ID NO: 3857206 - DNA, 17 bp, Homo sapiens
gtgggcctggcctgagc

SEQ ID NO: 3857207 - DNA, 22 bp, Homo sapiens
gtggggagcacttgcgtcctgc

SEQ ID NO: 3857208 - DNA, 16 bp, Homo sapiens
gtggggaggaaataga

SEQ ID NO: 3857209 - DNA, 13 bp, Homo sapiens
gtggggagggaga

SEQ ID NO: 3857210 - DNA, 18 bp, Homo sapiens
gtggggctcgtggccttc

SEQ ID NO: 3857211 - DNA, 14 bp, Homo sapiens
gtgggggcagaggg

SEQ ID NO: 3857212 - DNA, 18 bp, Homo sapiens
gtgggggcagagggcaga

SEQ ID NO: 3857213 - DNA, 14 bp, Homo sapiens
gtgggggtggccat

SEQ ID NO: 3857214 - DNA, 23 bp, Homo sapiens
gtggggttttatgtgtgggaaag

SEQ ID NO: 3857215 - DNA, 16 bp, Homo sapiens
gtgggtatttcctgct

SEQ ID NO: 3857216 - DNA, 21 bp, Homo sapiens
gtgggtccaggaaggcagctg

SEQ ID NO: 3857217 - DNA, 23 bp, Homo sapiens
gtgggtccaggaaggcagctgct

SEQ ID NO: 3857218 - DNA, 20 bp, Homo sapiens
gtgggtggcacctcctgaga

SEQ ID NO: 3857219 - DNA, 20 bp, Homo sapiens
gtgggtgtagattacctgcc

SEQ ID NO: 3857220 - DNA, 19 bp, Homo sapiens
gtgggttcactagagctgg

SEQ ID NO: 3857221 - DNA, 14 bp, Homo sapiens
gtggtagaagccag

SEQ ID NO: 3857222 - DNA, 20 bp, Homo sapiens
gtggtatatttgtgtatgtg

SEQ ID NO: 3857223 - DNA, 13 bp, Homo sapiens
gtggtgccagagg

SEQ ID NO: 3857224 - DNA, 13 bp, Homo sapiens
gtggtggaggagg

SEQ ID NO: 3857225 - DNA, 20 bp, Homo sapiens
gtggtggatctgtccaagga

SEQ ID NO: 3857226 - DNA, 12 bp, Homo sapiens
gtggtgtaattt

SEQ ID NO: 3857227 - DNA, 22 bp, Homo sapiens
gtggttgttgccaactaagccc

SEQ ID NO: 3857228 - DNA, 22 bp, Homo sapiens
gtgtaaagaataaatgaatctt

SEQ ID NO: 3857229 - DNA, 21 bp, Homo sapiens
gtgtaatgcacaatttagaaa

SEQ ID NO: 3857230 - DNA, 17 bp, Homo sapiens
gtgtaatttataaaatt

SEQ ID NO: 3857231 - DNA, 12 bp, Homo sapiens
gtgtacagtgtg

SEQ ID NO: 3857232 - DNA, 20 bp, Homo sapiens
gtgtaccgcgtctaccctgg

SEQ ID NO: 3857233 - DNA, 22 bp, Homo sapiens
gtgtaccgcgtctaccctggga

SEQ ID NO: 3857234 - DNA, 12 bp, Homo sapiens
gtgtagctgtga

SEQ ID NO: 3857235 - DNA, 21 bp, Homo sapiens
gtgtagctgtgacctgctgag

SEQ ID NO: 3857236 - DNA, 22 bp, Homo sapiens
gtgtagctgtgacctgctgagc

SEQ ID NO: 3857237 - DNA, 17 bp, Homo sapiens
gtgtataagtgcacaca

SEQ ID NO: 3857238 - DNA, 13 bp, Homo sapiens
gtgtatatataca

SEQ ID NO: 3857239 - DNA, 22 bp, Homo sapiens
gtgtatcccccccctgtatagt

SEQ ID NO: 3857240 - DNA, 14 bp, Homo sapiens
gtgtatgatccaag

SEQ ID NO: 3857241 - DNA, 11 bp, Homo sapiens
gtgtatgtgta

SEQ ID NO: 3857242 - DNA, 14 bp, Homo sapiens
gtgtattctggctg

SEQ ID NO: 3857243 - DNA, 15 bp, Homo sapiens
gtgtcaccctgcaga

SEQ ID NO: 3857244 - DNA, 18 bp, Homo sapiens
gtgtcaccctgcagagct

SEQ ID NO: 3857245 - DNA, 20 bp, Homo sapiens
gtgtcagagtaacatgccag

SEQ ID NO: 3857246 - DNA, 14 bp, Homo sapiens
gtgtccagcagctg

SEQ ID NO: 3857247 - DNA, 19 bp, Homo sapiens
gtgtccagcagctgcgggt

SEQ ID NO: 3857248 - DNA, 22 bp, Homo sapiens
gtgtccagcagctgcgggtctg

SEQ ID NO: 3857249 - DNA, 13 bp, Homo sapiens
gtgtcctctcccc

SEQ ID NO: 3857250 - DNA, 23 bp, Homo sapiens
gtgtcctctcccctctgccctgt

SEQ ID NO: 3857251 - DNA, 15 bp, Homo sapiens
gtgtccttccctgca

SEQ ID NO: 3857252 - DNA, 17 bp, Homo sapiens
gtgtcgagtcaaaatgt

SEQ ID NO: 3857253 - DNA, 13 bp, Homo sapiens
cctgggcccaggc

SEQ ID NO: 3857254 - DNA, 18 bp, Homo sapiens
cctgggcccaggctctgg

SEQ ID NO: 3857255 - DNA, 13 bp, Homo sapiens
cctgggccccacc

SEQ ID NO: 3857256 - DNA, 15 bp, Homo sapiens
cctgggcccctccac

SEQ ID NO: 3857257 - DNA, 18 bp, Homo sapiens
cctgggcccctccacgcc

SEQ ID NO: 3857258 - DNA, 22 bp, Homo sapiens
cctgggcccctccacgcctcct

SEQ ID NO: 3857259 - DNA, 14 bp, Homo sapiens
cctgggccctgggg

SEQ ID NO: 3857260 - DNA, 13 bp, Homo sapiens
cctgggcctgctg

SEQ ID NO: 3857261 - DNA, 14 bp, Homo sapiens
cctgggcctgctgc

SEQ ID NO: 3857262 - DNA, 20 bp, Homo sapiens
cctgggcctgcttttccagg

SEQ ID NO: 3857263 - DNA, 23 bp, Homo sapiens
cctgggcctgcttttccaggatc

SEQ ID NO: 3857264 - DNA, 14 bp, Homo sapiens
cctgggcctgtccc

SEQ ID NO: 3857265 - DNA, 14 bp, Homo sapiens
cctgggcctgtgca

SEQ ID NO: 3857266 - DNA, 17 bp, Homo sapiens
cctgggcctgtgcagca

SEQ ID NO: 3857267 - DNA, 18 bp, Homo sapiens
cctgggcctgtgcagcag

SEQ ID NO: 3857268 - DNA, 22 bp, Homo sapiens
cctgggcctgtgcagcagccca

SEQ ID NO: 3857269 - DNA, 23 bp, Homo sapiens
cctgggcctgtgcagcagcccag

SEQ ID NO: 3857270 - DNA, 17 bp, Homo sapiens
cctgggcctttcctgtg

SEQ ID NO: 3857271 - DNA, 17 bp, Homo sapiens
cctgggctgtctgtcac

SEQ ID NO: 3857272 - DNA, 18 bp, Homo sapiens
cctgggctgtctgtcacc

SEQ ID NO: 3857273 - DNA, 17 bp, Homo sapiens
cctggggccccgctggg

SEQ ID NO: 3857274 - DNA, 13 bp, Homo sapiens
cctggggcctgta

SEQ ID NO: 3857275 - DNA, 21 bp, Homo sapiens
cctggggcctgtactgcctgc

SEQ ID NO: 3857276 - DNA, 15 bp, Homo sapiens
cctggggctcctttc

SEQ ID NO: 3857277 - DNA, 22 bp, Homo sapiens
cctggggctctaacgcctgagc

SEQ ID NO: 3857278 - DNA, 17 bp, Homo sapiens
cctggggcttctcctga

SEQ ID NO: 3857279 - DNA, 21 bp, Homo sapiens
cctggggcttctcctgaccca

SEQ ID NO: 3857280 - DNA, 17 bp, Homo sapiens
taaaggtagagatgtgt

SEQ ID NO: 3857281 - DNA, 15 bp, Homo sapiens
taaagtacctgtagt

SEQ ID NO: 3857282 - DNA, 21 bp, Homo sapiens
taaagtatgtaaagtatgtaa

SEQ ID NO: 3857283 - DNA, 22 bp, Homo sapiens
taaagtatgtaaagtatgtaaa

SEQ ID NO: 3857284 - DNA, 22 bp, Homo sapiens
taaagtgtaaatcctttttctt

SEQ ID NO: 3857285 - DNA, 15 bp, Homo sapiens
taaagtgtagcaccc

SEQ ID NO: 3857286 - DNA, 21 bp, Homo sapiens
taaagtgtctattagttttct

SEQ ID NO: 3857287 - DNA, 13 bp, Homo sapiens
taaagttggaaag

SEQ ID NO: 3857288 - DNA, 21 bp, Homo sapiens
taaagttgttcacatatatgt

SEQ ID NO: 3857289 - DNA, 13 bp, Homo sapiens
taacagtcattta

SEQ ID NO: 3857290 - DNA, 14 bp, Homo sapiens
taacagtcatttaa

SEQ ID NO: 3857291 - DNA, 23 bp, Homo sapiens
taacatcatcaggcttggaatga

SEQ ID NO: 3857292 - DNA, 20 bp, Homo sapiens
taacatgaaaaacacggcag

SEQ ID NO: 3857293 - DNA, 22 bp, Homo sapiens
taacatgaaaaacacggcagct

SEQ ID NO: 3857294 - DNA, 13 bp, Homo sapiens
taacatgccagct

SEQ ID NO: 3857295 - DNA, 17 bp, Homo sapiens
taacatgccagcttcct

SEQ ID NO: 3857296 - DNA, 17 bp, Homo sapiens
taacattaacatctatt

SEQ ID NO: 3857297 - DNA, 22 bp, Homo sapiens
taaccatagttatttacttgaa

SEQ ID NO: 3857298 - DNA, 16 bp, Homo sapiens
taaccattacatgttt

SEQ ID NO: 3857299 - DNA, 12 bp, Homo sapiens
taacccctttcc

SEQ ID NO: 3857300 - DNA, 23 bp, Homo sapiens
taacccgctcatcactggatgaa

SEQ ID NO: 3857301 - DNA, 22 bp, Homo sapiens
taacctatatgatttatagttt

SEQ ID NO: 3857302 - DNA, 20 bp, Homo sapiens
taacgccctatttttgcaat

SEQ ID NO: 3857303 - DNA, 12 bp, Homo sapiens
taacgcctgagc

SEQ ID NO: 3857304 - DNA, 13 bp, Homo sapiens
taacgcctgagcc

SEQ ID NO: 3857305 - DNA, 14 bp, Homo sapiens
taacgcctgagccc

SEQ ID NO: 3857306 - DNA, 21 bp, Homo sapiens
taactaaggtcccataataaa

SEQ ID NO: 3857307 - DNA, 12 bp, Homo sapiens
taactaatttaa

SEQ ID NO: 3857308 - DNA, 15 bp, Homo sapiens
taactaatttaaacc

SEQ ID NO: 3857309 - DNA, 17 bp, Homo sapiens
taactaatttaaaccag

SEQ ID NO: 3857310 - DNA, 19 bp, Homo sapiens
taactaatttaaaccagca

SEQ ID NO: 3857311 - DNA, 17 bp, Homo sapiens
taactagtcctttacta

SEQ ID NO: 3857312 - DNA, 17 bp, Homo sapiens
taactagtgttgcttgg

SEQ ID NO: 3857313 - DNA, 20 bp, Homo sapiens
taactccagtctcctgacat

SEQ ID NO: 3857314 - DNA, 21 bp, Homo sapiens
taactccagtctcctgacatt

SEQ ID NO: 3857315 - DNA, 10 bp, Homo sapiens
taactctggc

SEQ ID NO: 3857316 - DNA, 12 bp, Homo sapiens
taactctggcac

SEQ ID NO: 3857317 - DNA, 15 bp, Homo sapiens
taactgaaggagaag

SEQ ID NO: 3857318 - DNA, 19 bp, Homo sapiens
taactgcaaagtgaagttg

SEQ ID NO: 3857319 - DNA, 12 bp, Homo sapiens
taactgcaattt

SEQ ID NO: 3857320 - DNA, 13 bp, Homo sapiens
taactgctgagcc

SEQ ID NO: 3857321 - DNA, 14 bp, Homo sapiens
taactgtaaatcac

SEQ ID NO: 3857322 - DNA, 22 bp, Homo sapiens
taactgtaaatcacttgtaaat

SEQ ID NO: 3857323 - DNA, 16 bp, Homo sapiens
taactgtcatctagcc

SEQ ID NO: 3857324 - DNA, 20 bp, Homo sapiens
taactgtcatctagcccctt

SEQ ID NO: 3857325 - DNA, 15 bp, Homo sapiens
taacttagcatgtgt

SEQ ID NO: 3857326 - DNA, 18 bp, Homo sapiens
taacttcaaatatagaga

SEQ ID NO: 3857327 - DNA, 21 bp, Homo sapiens
taacttccttggactcatttt

SEQ ID NO: 3857328 - DNA, 21 bp, Homo sapiens
taacttgatatagaaagctgt

SEQ ID NO: 3857329 - DNA, 20 bp, Homo sapiens
taacttgctgaatttcaggc

SEQ ID NO: 3857330 - DNA, 13 bp, Homo sapiens
taacttgtatatt

SEQ ID NO: 3857331 - DNA, 21 bp, Homo sapiens
taacttgtatattccaccatt

SEQ ID NO: 3857332 - DNA, 19 bp, Homo sapiens
taacttgtcctatgtcaat

SEQ ID NO: 3857333 - DNA, 14 bp, Homo sapiens
taactttagaaata

SEQ ID NO: 3857334 - DNA, 13 bp, Homo sapiens
taacttttgtaag

SEQ ID NO: 3857335 - DNA, 16 bp, Homo sapiens
taagaaaacaatcaca

SEQ ID NO: 3857336 - DNA, 14 bp, Homo sapiens
taagaaccacagaa

SEQ ID NO: 3857337 - DNA, 22 bp, Homo sapiens
taagaagacatgacaatgcaat

SEQ ID NO: 3857338 - DNA, 14 bp, Homo sapiens
taagaaggaaaaat

SEQ ID NO: 3857339 - DNA, 13 bp, Homo sapiens
taagaatggaaga

SEQ ID NO: 3857340 - DNA, 19 bp, Homo sapiens
taagacgtgaatgtctcag

SEQ ID NO: 3857341 - DNA, 18 bp, Homo sapiens
taagagaaagaaaatgaa

SEQ ID NO: 3857342 - DNA, 12 bp, Homo sapiens
taagagagaaat

SEQ ID NO: 3857343 - DNA, 14 bp, Homo sapiens
taagagagaaatct

SEQ ID NO: 3857344 - DNA, 18 bp, Homo sapiens
taagagagaaatctgaaa

SEQ ID NO: 3857345 - DNA, 14 bp, Homo sapiens
taagagcaataaat

SEQ ID NO: 3857346 - DNA, 18 bp, Homo sapiens
taagagctagcgctgccg

SEQ ID NO: 3857347 - DNA, 16 bp, Homo sapiens
taagataaatagagtt

SEQ ID NO: 3857348 - DNA, 19 bp, Homo sapiens
taagatacactcctgctgt

SEQ ID NO: 3857349 - DNA, 17 bp, Homo sapiens
taagatatattttgagt

SEQ ID NO: 3857350 - DNA, 18 bp, Homo sapiens
taagattaaaggaaggaa

SEQ ID NO: 3857351 - DNA, 14 bp, Homo sapiens
taagattaaattat

SEQ ID NO: 3857352 - DNA, 22 bp, Homo sapiens
taagattaaattatatctgagg

SEQ ID NO: 3857353 - DNA, 13 bp, Homo sapiens
taagattagaatg

SEQ ID NO: 3857354 - DNA, 14 bp, Homo sapiens
taagattccagaga

SEQ ID NO: 3857355 - DNA, 18 bp, Homo sapiens
taagcaaaggaaaccaaa

SEQ ID NO: 3857356 - DNA, 23 bp, Homo sapiens
taagcaaagggagcactgggttg

SEQ ID NO: 3857357 - DNA, 13 bp, Homo sapiens
taagcaaatttca

SEQ ID NO: 3857358 - DNA, 21 bp, Homo sapiens
taagcaaatttcaaaagacat

SEQ ID NO: 3857359 - DNA, 14 bp, Homo sapiens
taagccagagcctg

SEQ ID NO: 3857360 - DNA, 15 bp, Homo sapiens
taagccagagcctgg

SEQ ID NO: 3857361 - DNA, 19 bp, Homo sapiens
taagccctcgaaccaaggc

SEQ ID NO: 3857362 - DNA, 21 bp, Homo sapiens
taagccctcgaaccaaggcag

SEQ ID NO: 3857363 - DNA, 20 bp, Homo sapiens
taagccctgtcgagacactt

SEQ ID NO: 3857364 - DNA, 13 bp, Homo sapiens
taagcctgttgct

SEQ ID NO: 3857365 - DNA, 15 bp, Homo sapiens
taagctgcagcttcc

SEQ ID NO: 3857366 - DNA, 13 bp, Homo sapiens
taagctgtaaaaa

SEQ ID NO: 3857367 - DNA, 16 bp, Homo sapiens
taagcttatgtcagac

SEQ ID NO: 3857368 - DNA, 15 bp, Homo sapiens
taaggaagttattaa

SEQ ID NO: 3857369 - DNA, 14 bp, Homo sapiens
taaggacacactaa

SEQ ID NO: 3857370 - DNA, 21 bp, Homo sapiens
taaggaccgtggccctgccct

SEQ ID NO: 3857371 - DNA, 22 bp, Homo sapiens
taaggagagttcaagcctgtgg

SEQ ID NO: 3857372 - DNA, 15 bp, Homo sapiens
taaggattgtgatat

SEQ ID NO: 3857373 - DNA, 16 bp, Homo sapiens
taaggatttgttcaca

SEQ ID NO: 3857374 - DNA, 21 bp, Homo sapiens
taaggcttaggtgccaggctg

SEQ ID NO: 3857375 - DNA, 13 bp, Homo sapiens
taagggcatttta

SEQ ID NO: 3857376 - DNA, 21 bp, Homo sapiens
taagggtctgttgtaaatgac

SEQ ID NO: 3857377 - DNA, 13 bp, Homo sapiens
taagtaaaaccac

SEQ ID NO: 3857378 - DNA, 15 bp, Homo sapiens
taagtaaaaccacag

SEQ ID NO: 3857379 - DNA, 18 bp, Homo sapiens
taagtaaaaccacagcag

SEQ ID NO: 3857380 - DNA, 14 bp, Homo sapiens
taagtcctctcttc

SEQ ID NO: 3857381 - DNA, 19 bp, Homo sapiens
taagtctgggatgtagaac

SEQ ID NO: 3857382 - DNA, 15 bp, Homo sapiens
taagtgctgtttgag

SEQ ID NO: 3857383 - DNA, 20 bp, Homo sapiens
taagtggaaaaaagagaaaa

SEQ ID NO: 3857384 - DNA, 14 bp, Homo sapiens
taagttatagtata

SEQ ID NO: 3857385 - DNA, 18 bp, Homo sapiens
taagttcatgtttgtaaa

SEQ ID NO: 3857386 - DNA, 13 bp, Homo sapiens
taagttctaagtt

SEQ ID NO: 3857387 - DNA, 16 bp, Homo sapiens
taagtttagaagcgct

SEQ ID NO: 3857388 - DNA, 14 bp, Homo sapiens
taataaaaaatgga

SEQ ID NO: 3857389 - DNA, 15 bp, Homo sapiens
taataaaaaatggaa

SEQ ID NO: 3857390 - DNA, 22 bp, Homo sapiens
taataaaacccagcatgtacaa

SEQ ID NO: 3857391 - DNA, 22 bp, Homo sapiens
taataaatctgagcctaaatct

SEQ ID NO: 3857392 - DNA, 13 bp, Homo sapiens
taataaattcaga

SEQ ID NO: 3857393 - DNA, 21 bp, Homo sapiens
taataagaaagtataaagtca

SEQ ID NO: 3857394 - DNA, 21 bp, Homo sapiens
taataagtttgatcaaatcta

SEQ ID NO: 3857395 - DNA, 19 bp, Homo sapiens
taatacagcagtgtcatca

SEQ ID NO: 3857396 - DNA, 23 bp, Homo sapiens
taatacagcagtgtcatcagaag

SEQ ID NO: 3857397 - DNA, 14 bp, Homo sapiens
taataccaaatatt

SEQ ID NO: 3857398 - DNA, 16 bp, Homo sapiens
taataccaaatatttt

SEQ ID NO: 3857399 - DNA, 18 bp, Homo sapiens
taatactaaaatatgtct

SEQ ID NO: 3857400 - DNA, 19 bp, Homo sapiens
taatacttcatttggtgct

SEQ ID NO: 3857401 - DNA, 19 bp, Homo sapiens
taatagtccaatatttggc

SEQ ID NO: 3857402 - DNA, 13 bp, Homo sapiens
taatataatggaa

SEQ ID NO: 3857403 - DNA, 19 bp, Homo sapiens
taatataatggaagagaaa

SEQ ID NO: 3857404 - DNA, 18 bp, Homo sapiens
taatatccactgcaatac

SEQ ID NO: 3857405 - DNA, 22 bp, Homo sapiens
taatatcttgctggattaatgt

SEQ ID NO: 3857406 - DNA, 18 bp, Homo sapiens
taatatggcaaaaatggc

SEQ ID NO: 3857407 - DNA, 17 bp, Homo sapiens
taatatgtttgaggtta

SEQ ID NO: 3857408 - DNA, 22 bp, Homo sapiens
taatattaaaaatatggaactt

SEQ ID NO: 3857409 - DNA, 13 bp, Homo sapiens
taatattttgtat

SEQ ID NO: 3857410 - DNA, 15 bp, Homo sapiens
taatattttgtattt

SEQ ID NO: 3857411 - DNA, 16 bp, Homo sapiens
taatcaagaatattca

SEQ ID NO: 3857412 - DNA, 15 bp, Homo sapiens
taatcaggctgaggt

SEQ ID NO: 3857413 - DNA, 17 bp, Homo sapiens
taatcaggttgttaatg

SEQ ID NO: 3857414 - DNA, 15 bp, Homo sapiens
taatcggcccacagc

SEQ ID NO: 3857415 - DNA, 14 bp, Homo sapiens
taatctatttacat

SEQ ID NO: 3857416 - DNA, 20 bp, Homo sapiens
taatctcatacctctgacca

SEQ ID NO: 3857417 - DNA, 21 bp, Homo sapiens
taatctgcaaagaatgagaag

SEQ ID NO: 3857418 - DNA, 17 bp, Homo sapiens
taatctggactcctctg

SEQ ID NO: 3857419 - DNA, 19 bp, Homo sapiens
taatctggactcctctgtc

SEQ ID NO: 3857420 - DNA, 17 bp, Homo sapiens
taatctgtagggctgga

SEQ ID NO: 3857421 - DNA, 18 bp, Homo sapiens
taatctttctttacctga

SEQ ID NO: 3857422 - DNA, 23 bp, Homo sapiens
taatctttctttacctgagacca

SEQ ID NO: 3857423 - DNA, 21 bp, Homo sapiens
taatgaaaaggaagttaatac

SEQ ID NO: 3857424 - DNA, 22 bp, Homo sapiens
taatgactttttataatgtgga

SEQ ID NO: 3857425 - DNA, 13 bp, Homo sapiens
taatgcacaattt

SEQ ID NO: 3857426 - DNA, 14 bp, Homo sapiens
taatgcacaattta

SEQ ID NO: 3857427 - DNA, 15 bp, Homo sapiens
taatgcacaatttag

SEQ ID NO: 3857428 - DNA, 18 bp, Homo sapiens
taatgcacaatttagaaa

SEQ ID NO: 3857429 - DNA, 19 bp, Homo sapiens
taatgcacaatttagaaaa

SEQ ID NO: 3857430 - DNA, 21 bp, Homo sapiens
taatgcatgttaggaaaattt

SEQ ID NO: 3857431 - DNA, 16 bp, Homo sapiens
taatgctgttgcctca

SEQ ID NO: 3857432 - DNA, 19 bp, Homo sapiens
taatgcttagagaatgttc

SEQ ID NO: 3857433 - DNA, 17 bp, Homo sapiens
taatgcttcaagtgttg

SEQ ID NO: 3857434 - DNA, 20 bp, Homo sapiens
taatggaaacatttacaata

SEQ ID NO: 3857435 - DNA, 13 bp, Homo sapiens
taatggaagagaa

SEQ ID NO: 3857436 - DNA, 20 bp, Homo sapiens
taatgggccaattaaaatat

SEQ ID NO: 3857437 - DNA, 14 bp, Homo sapiens
taatgggcctgccc

SEQ ID NO: 3857438 - DNA, 16 bp, Homo sapiens
taatgggcctgcccaa

SEQ ID NO: 3857439 - DNA, 17 bp, Homo sapiens
taatggtctaaaaataa

SEQ ID NO: 3857440 - DNA, 21 bp, Homo sapiens
taatggtctaaaaataaacca

SEQ ID NO: 3857441 - DNA, 19 bp, Homo sapiens
taatggtttttatttctcg

SEQ ID NO: 3857442 - DNA, 15 bp, Homo sapiens
taatgtacaagtttt

SEQ ID NO: 3857443 - DNA, 19 bp, Homo sapiens
taatgtaggtttagatata

SEQ ID NO: 3857444 - DNA, 17 bp, Homo sapiens
taatgtatttatatgtt

SEQ ID NO: 3857445 - DNA, 21 bp, Homo sapiens
taatgtcaccaccttcccagc

SEQ ID NO: 3857446 - DNA, 12 bp, Homo sapiens
taatgtgtgtat

SEQ ID NO: 3857447 - DNA, 13 bp, Homo sapiens
taatgtgtgtatg

SEQ ID NO: 3857448 - DNA, 13 bp, Homo sapiens
taatgttctctgg

SEQ ID NO: 3857449 - DNA, 16 bp, Homo sapiens
taatgttctttaatgt

SEQ ID NO: 3857450 - DNA, 15 bp, Homo sapiens
taatgtttgatttag

SEQ ID NO: 3857451 - DNA, 16 bp, Homo sapiens
taatgtttgatttagt

SEQ ID NO: 3857452 - DNA, 13 bp, Homo sapiens
taattaaaatctg

SEQ ID NO: 3857453 - DNA, 16 bp, Homo sapiens
taattcattaaatttc

SEQ ID NO: 3857454 - DNA, 22 bp, Homo sapiens
taattcctctcactaaacttta

SEQ ID NO: 3857455 - DNA, 21 bp, Homo sapiens
taattcggaagggaaaacagt

SEQ ID NO: 3857456 - DNA, 20 bp, Homo sapiens
taattctcatgtgatccttt

SEQ ID NO: 3857457 - DNA, 22 bp, Homo sapiens
taattctccctaaggaatctga

SEQ ID NO: 3857458 - DNA, 20 bp, Homo sapiens
taattcttgttgttctgtag

SEQ ID NO: 3857459 - DNA, 18 bp, Homo sapiens
taattgagaaacatgaat

SEQ ID NO: 3857460 - DNA, 18 bp, Homo sapiens
taattgatcaaattcatt

SEQ ID NO: 3857461 - DNA, 19 bp, Homo sapiens
taattgatttcaagacctt

SEQ ID NO: 3857462 - DNA, 23 bp, Homo sapiens
taattgatttgacccactcacac

SEQ ID NO: 3857463 - DNA, 18 bp, Homo sapiens
taattgcatttctgctct

SEQ ID NO: 3857464 - DNA, 16 bp, Homo sapiens
taattgcttacatttt

SEQ ID NO: 3857465 - DNA, 13 bp, Homo sapiens
taatttaaaccag

SEQ ID NO: 3857466 - DNA, 14 bp, Homo sapiens
taatttaaaccagc

SEQ ID NO: 3857467 - DNA, 15 bp, Homo sapiens
taatttaaaccagca

SEQ ID NO: 3857468 - DNA, 17 bp, Homo sapiens
taatttaaaccagcaga

SEQ ID NO: 3857469 - DNA, 22 bp, Homo sapiens
taatttagcagtccaaagaaca

SEQ ID NO: 3857470 - DNA, 16 bp, Homo sapiens
taatttatacaaaata

SEQ ID NO: 3857471 - DNA, 14 bp, Homo sapiens
taatttatatttga

SEQ ID NO: 3857472 - DNA, 17 bp, Homo sapiens
taatttgagaattattc

SEQ ID NO: 3857473 - DNA, 15 bp, Homo sapiens
taatttgttatgtat

SEQ ID NO: 3857474 - DNA, 13 bp, Homo sapiens
taatttttaaagt

SEQ ID NO: 3857475 - DNA, 16 bp, Homo sapiens
taattttttttaatgt

SEQ ID NO: 3857476 - DNA, 12 bp, Homo sapiens
tacaaaaacaaa

SEQ ID NO: 3857477 - DNA, 15 bp, Homo sapiens
tacaaaaacaaaaca

SEQ ID NO: 3857478 - DNA, 15 bp, Homo sapiens
tacaaaaacacagca

SEQ ID NO: 3857479 - DNA, 18 bp, Homo sapiens
tacaaaaacacagcaagg

SEQ ID NO: 3857480 - DNA, 15 bp, Homo sapiens
tacaaaagtaccata

SEQ ID NO: 3857481 - DNA, 23 bp, Homo sapiens
tacaaaataaaattatggtgaaa

SEQ ID NO: 3857482 - DNA, 20 bp, Homo sapiens
tacaaaataaacaaataaca

SEQ ID NO: 3857483 - DNA, 18 bp, Homo sapiens
tacaaaataatttaacta

SEQ ID NO: 3857484 - DNA, 10 bp, Homo sapiens
tacaaaatgg

SEQ ID NO: 3857485 - DNA, 11 bp, Homo sapiens
tacaaaatgga

SEQ ID NO: 3857486 - DNA, 19 bp, Homo sapiens
tacaaactcccacttgtca

SEQ ID NO: 3857487 - DNA, 15 bp, Homo sapiens
tacaaatttttcctg

SEQ ID NO: 3857488 - DNA, 17 bp, Homo sapiens
tacaaatttttcctgca

SEQ ID NO: 3857489 - DNA, 17 bp, Homo sapiens
tacaacattcaacttta

SEQ ID NO: 3857490 - DNA, 12 bp, Homo sapiens
tacaaccagagc

SEQ ID NO: 3857491 - DNA, 18 bp, Homo sapiens
tacaagcatatttgagaa

SEQ ID NO: 3857492 - DNA, 18 bp, Homo sapiens
tacaagggtctagggaga

SEQ ID NO: 3857493 - DNA, 10 bp, Homo sapiens
tacaataaat

SEQ ID NO: 3857494 - DNA, 15 bp, Homo sapiens
tacaataaataatct

SEQ ID NO: 3857495 - DNA, 15 bp, Homo sapiens
tacaataaatattct

SEQ ID NO: 3857496 - DNA, 18 bp, Homo sapiens
tacaataaatattctgca

SEQ ID NO: 3857497 - DNA, 11 bp, Homo sapiens
tacaataaatg

SEQ ID NO: 3857498 - DNA, 20 bp, Homo sapiens
tacaataataaatcctcagg

SEQ ID NO: 3857499 - DNA, 18 bp, Homo sapiens
tacaatatataaaaatat

SEQ ID NO: 3857500 - DNA, 14 bp, Homo sapiens
tacaatgtttcaga

SEQ ID NO: 3857501 - DNA, 18 bp, Homo sapiens
tacaattactaaattgta

SEQ ID NO: 3857502 - DNA, 19 bp, Homo sapiens
tacaattactaaattgtat

SEQ ID NO: 3857503 - DNA, 16 bp, Homo sapiens
tacacaagtaaacatt

SEQ ID NO: 3857504 - DNA, 15 bp, Homo sapiens
tacacaattaattgt

SEQ ID NO: 3857505 - DNA, 13 bp, Homo sapiens
tacacacaaaaat

SEQ ID NO: 3857506 - DNA, 12 bp, Homo sapiens
tacacacatata

SEQ ID NO: 3857507 - DNA, 13 bp, Homo sapiens
tacacacatatac

SEQ ID NO: 3857508 - DNA, 16 bp, Homo sapiens
tacacactcaaatcaa

SEQ ID NO: 3857509 - DNA, 18 bp, Homo sapiens
tacacagcagtatgaatg

SEQ ID NO: 3857510 - DNA, 19 bp, Homo sapiens
tacacagcagtatgaatga

SEQ ID NO: 3857511 - DNA, 16 bp, Homo sapiens
tacacagcccaagagg

SEQ ID NO: 3857512 - DNA, 15 bp, Homo sapiens
tacacagctctagac

SEQ ID NO: 3857513 - DNA, 16 bp, Homo sapiens
tacacagtaaaaactt

SEQ ID NO: 3857514 - DNA, 22 bp, Homo sapiens
tacacagtgggaactctgacaa

SEQ ID NO: 3857515 - DNA, 11 bp, Homo sapiens
tacacagttgc

SEQ ID NO: 3857516 - DNA, 21 bp, Homo sapiens
tacacataagaccgtgtccca

SEQ ID NO: 3857517 - DNA, 22 bp, Homo sapiens
tacacataagaccgtgtcccaa

SEQ ID NO: 3857518 - DNA, 19 bp, Homo sapiens
tacacatacatacatacat

SEQ ID NO: 3857519 - DNA, 18 bp, Homo sapiens
tacaccacctcactcctg

SEQ ID NO: 3857520 - DNA, 14 bp, Homo sapiens
tacaccactctggc

SEQ ID NO: 3857521 - DNA, 19 bp, Homo sapiens
tacaccatgtttgagctca

SEQ ID NO: 3857522 - DNA, 15 bp, Homo sapiens
tacaccgggcctgga

SEQ ID NO: 3857523 - DNA, 13 bp, Homo sapiens
tacacctccctcc

SEQ ID NO: 3857524 - DNA, 18 bp, Homo sapiens
tacactctctgtacaaaa

SEQ ID NO: 3857525 - DNA, 21 bp, Homo sapiens
tacactctctgtacaaaaaca

SEQ ID NO: 3857526 - DNA, 22 bp, Homo sapiens
tacacttgtataaatgtatata

SEQ ID NO: 3857527 - DNA, 13 bp, Homo sapiens
tacagaattttta

SEQ ID NO: 3857528 - DNA, 14 bp, Homo sapiens
tacagacactaagt

SEQ ID NO: 3857529 - DNA, 15 bp, Homo sapiens
tacagacgtctcaag

SEQ ID NO: 3857530 - DNA, 14 bp, Homo sapiens
tacagacttctcca

SEQ ID NO: 3857531 - DNA, 16 bp, Homo sapiens
tacagagaatctgaag

SEQ ID NO: 3857532 - DNA, 19 bp, Homo sapiens
tacagatagtcaaaccata

SEQ ID NO: 3857533 - DNA, 19 bp, Homo sapiens
tacagccccaaaccagggt

SEQ ID NO: 3857534 - DNA, 22 bp, Homo sapiens
tacagccccaaaccagggtgca

SEQ ID NO: 3857535 - DNA, 15 bp, Homo sapiens
tacagcctcagaaac

SEQ ID NO: 3857536 - DNA, 14 bp, Homo sapiens
tacagcgagaggca

SEQ ID NO: 3857537 - DNA, 18 bp, Homo sapiens
tacaggaggttgtggatg

SEQ ID NO: 3857538 - DNA, 20 bp, Homo sapiens
tacaggcaaaacacgcaagg

SEQ ID NO: 3857539 - DNA, 13 bp, Homo sapiens
tacagtaaagttt

SEQ ID NO: 3857540 - DNA, 18 bp, Homo sapiens
tacagtaaataaattgtt

SEQ ID NO: 3857541 - DNA, 18 bp, Homo sapiens
tacagtagcttaaataaa

SEQ ID NO: 3857542 - DNA, 21 bp, Homo sapiens
tacagtagcttaaataaattc

SEQ ID NO: 3857543 - DNA, 14 bp, Homo sapiens
tacagtcaatttta

SEQ ID NO: 3857544 - DNA, 20 bp, Homo sapiens
tacagtctttctttctgaat

SEQ ID NO: 3857545 - DNA, 12 bp, Homo sapiens
tacagtgagcca

SEQ ID NO: 3857546 - DNA, 14 bp, Homo sapiens
tacagtgagccaag

SEQ ID NO: 3857547 - DNA, 13 bp, Homo sapiens
tacagtgaggagg

SEQ ID NO: 3857548 - DNA, 22 bp, Homo sapiens
tacagttcagttcctctttgca

SEQ ID NO: 3857549 - DNA, 19 bp, Homo sapiens
tacataacaagaaaatcaa

SEQ ID NO: 3857550 - DNA, 14 bp, Homo sapiens
tacatacacataca

SEQ ID NO: 3857551 - DNA, 15 bp, Homo sapiens
tacatacacatacat

SEQ ID NO: 3857552 - DNA, 16 bp, Homo sapiens
tacatacacatacata

SEQ ID NO: 3857553 - DNA, 14 bp, Homo sapiens
tacatacacttgta

SEQ ID NO: 3857554 - DNA, 21 bp, Homo sapiens
tacatacacttgtataaatgt

SEQ ID NO: 3857555 - DNA, 13 bp, Homo sapiens
tacatacagaggt

SEQ ID NO: 3857556 - DNA, 18 bp, Homo sapiens
tacatacagaggtaacta

SEQ ID NO: 3857557 - DNA, 9 bp, Homo sapiens
tacatacat

SEQ ID NO: 3857558 - DNA, 14 bp, Homo sapiens
tacatacatacata

SEQ ID NO: 3857559 - DNA, 16 bp, Homo sapiens
tacatacatacataca

SEQ ID NO: 3857560 - DNA, 17 bp, Homo sapiens
tacatacatacatatat

SEQ ID NO: 3857561 - DNA, 13 bp, Homo sapiens
tacatacatatat

SEQ ID NO: 3857562 - DNA, 19 bp, Homo sapiens
tacatatatatatacacat

SEQ ID NO: 3857563 - DNA, 23 bp, Homo sapiens
tacatatatatatacacatacat

SEQ ID NO: 3857564 - DNA, 12 bp, Homo sapiens
tacatatcagaa

SEQ ID NO: 3857565 - DNA, 16 bp, Homo sapiens
tacatatcagaaaagt

SEQ ID NO: 3857566 - DNA, 17 bp, Homo sapiens
tacatatcagaaaagta

SEQ ID NO: 3857567 - DNA, 15 bp, Homo sapiens
tacatatgtaaaata

SEQ ID NO: 3857568 - DNA, 17 bp, Homo sapiens
tacatatgtagactata

SEQ ID NO: 3857569 - DNA, 19 bp, Homo sapiens
tacatatgtagactatata

SEQ ID NO: 3857570 - DNA, 20 bp, Homo sapiens
tacatatgtagactatatac

SEQ ID NO: 3857571 - DNA, 21 bp, Homo sapiens
tacatatgtagactatataca

SEQ ID NO: 3857572 - DNA, 23 bp, Homo sapiens
tacatatgtagactatatacatg

SEQ ID NO: 3857573 - DNA, 22 bp, Homo sapiens
tacatattataaataaatgcca

SEQ ID NO: 3857574 - DNA, 14 bp, Homo sapiens
tacatattctttaa

SEQ ID NO: 3857575 - DNA, 23 bp, Homo sapiens
tacatcacctttttgacttttcc

SEQ ID NO: 3857576 - DNA, 20 bp, Homo sapiens
tacatcctgctttccctccc

SEQ ID NO: 3857577 - DNA, 16 bp, Homo sapiens
tacatgaacacagctg

SEQ ID NO: 3857578 - DNA, 23 bp, Homo sapiens
tacatgaacacagctgctgaaga

SEQ ID NO: 3857579 - DNA, 18 bp, Homo sapiens
tacatgaattgcatttta

SEQ ID NO: 3857580 - DNA, 20 bp, Homo sapiens
tacatgcaatttattaaaat

SEQ ID NO: 3857581 - DNA, 14 bp, Homo sapiens
tacatgctgctaat

SEQ ID NO: 3857582 - DNA, 18 bp, Homo sapiens
tacatgtgtggatgtgta

SEQ ID NO: 3857583 - DNA, 19 bp, Homo sapiens
tacatgtgtggatgtgtaa

SEQ ID NO: 3857584 - DNA, 14 bp, Homo sapiens
tacatgtgtgtata

SEQ ID NO: 3857585 - DNA, 18 bp, Homo sapiens
tacatgttcatcgtattt

SEQ ID NO: 3857586 - DNA, 23 bp, Homo sapiens
tacattaatgttaattcagcact

SEQ ID NO: 3857587 - DNA, 22 bp, Homo sapiens
tacattaattattattgctgtt

SEQ ID NO: 3857588 - DNA, 20 bp, Homo sapiens
tacattccctatcaaaacat

SEQ ID NO: 3857589 - DNA, 21 bp, Homo sapiens
tacattcctagagagcagaaa

SEQ ID NO: 3857590 - DNA, 13 bp, Homo sapiens
tacattcctcagc

SEQ ID NO: 3857591 - DNA, 14 bp, Homo sapiens
tacattcctcagct

SEQ ID NO: 3857592 - DNA, 16 bp, Homo sapiens
tacattcctcagctgc

SEQ ID NO: 3857593 - DNA, 23 bp, Homo sapiens
tacattctcatctactcattgtc

SEQ ID NO: 3857594 - DNA, 23 bp, Homo sapiens
tacatttcataaggcctgccctc

SEQ ID NO: 3857595 - DNA, 14 bp, Homo sapiens
tacattttatttat

SEQ ID NO: 3857596 - DNA, 22 bp, Homo sapiens
tacattttatttattagctgta

SEQ ID NO: 3857597 - DNA, 12 bp, Homo sapiens
tacattttgtta

SEQ ID NO: 3857598 - DNA, 15 bp, Homo sapiens
tacatttttacaata

SEQ ID NO: 3857599 - DNA, 17 bp, Homo sapiens
tacatttttacaataaa

SEQ ID NO: 3857600 - DNA, 19 bp, Homo sapiens
tacatttttacaataaata

SEQ ID NO: 3857601 - DNA, 19 bp, Homo sapiens
taccaaagtgacctaccca

SEQ ID NO: 3857602 - DNA, 16 bp, Homo sapiens
taccaaatattttagc

SEQ ID NO: 3857603 - DNA, 18 bp, Homo sapiens
taccaaatccacaagcca

SEQ ID NO: 3857604 - DNA, 16 bp, Homo sapiens
taccaacacgagcagg

SEQ ID NO: 3857605 - DNA, 17 bp, Homo sapiens
taccaactttctgtaaa

SEQ ID NO: 3857606 - DNA, 19 bp, Homo sapiens
taccaactttctgtaaact

SEQ ID NO: 3857607 - DNA, 14 bp, Homo sapiens
taccaccccttcct

SEQ ID NO: 3857608 - DNA, 15 bp, Homo sapiens
taccaccccttcctg

SEQ ID NO: 3857609 - DNA, 19 bp, Homo sapiens
taccaccccttcctgtccc

SEQ ID NO: 3857610 - DNA, 14 bp, Homo sapiens
taccagatatttga

SEQ ID NO: 3857611 - DNA, 12 bp, Homo sapiens
taccagccagga

SEQ ID NO: 3857612 - DNA, 21 bp, Homo sapiens
taccagctaactccagtctcc

SEQ ID NO: 3857613 - DNA, 22 bp, Homo sapiens
taccagctaactccagtctcct

SEQ ID NO: 3857614 - DNA, 16 bp, Homo sapiens
taccagggatgtagat

SEQ ID NO: 3857615 - DNA, 15 bp, Homo sapiens
taccagtgaaccaaa

SEQ ID NO: 3857616 - DNA, 12 bp, Homo sapiens
taccatagaaca

SEQ ID NO: 3857617 - DNA, 12 bp, Homo sapiens
taaaagtaaaca

SEQ ID NO: 3857618 - DNA, 14 bp, Homo sapiens
taaaataaaaacca

SEQ ID NO: 3857619 - DNA, 17 bp, Homo sapiens
taaaataaaaaccagaa

SEQ ID NO: 3857620 - DNA, 13 bp, Homo sapiens
taaaataaagcct

SEQ ID NO: 3857621 - DNA, 19 bp, Homo sapiens
taaaataaggataataatc

SEQ ID NO: 3857622 - DNA, 18 bp, Homo sapiens
taaaatacggtacctggc

SEQ ID NO: 3857623 - DNA, 23 bp, Homo sapiens
taaaatactctagcctgggccag

SEQ ID NO: 3857624 - DNA, 23 bp, Homo sapiens
taaaatagatcctaggtgctgga

SEQ ID NO: 3857625 - DNA, 14 bp, Homo sapiens
taaaatagcttgta

SEQ ID NO: 3857626 - DNA, 15 bp, Homo sapiens
taaaatagtattgaa

SEQ ID NO: 3857627 - DNA, 17 bp, Homo sapiens
taaaatagttgtccata

SEQ ID NO: 3857628 - DNA, 21 bp, Homo sapiens
tctccctctcctgcctactca

SEQ ID NO: 3857629 - DNA, 17 bp, Homo sapiens
tctccctctggccctgc

SEQ ID NO: 3857630 - DNA, 20 bp, Homo sapiens
tctccctctggccctgcctt

SEQ ID NO: 3857631 - DNA, 14 bp, Homo sapiens
tctccctgacattt

SEQ ID NO: 3857632 - DNA, 13 bp, Homo sapiens
tctccctgccgcc

SEQ ID NO: 3857633 - DNA, 15 bp, Homo sapiens
tctccctgccgcctc

SEQ ID NO: 3857634 - DNA, 17 bp, Homo sapiens
tctccgactgctaggga

SEQ ID NO: 3857635 - DNA, 18 bp, Homo sapiens
tctccggggtctgtgctg

SEQ ID NO: 3857636 - DNA, 23 bp, Homo sapiens
tctccggggtctgtgctgtgcct

SEQ ID NO: 3857637 - DNA, 17 bp, Homo sapiens
tctcctaccccacctca

SEQ ID NO: 3857638 - DNA, 24 bp, Homo sapiens
tctcctaccccacctcatgcctgg

SEQ ID NO: 3857639 - DNA, 16 bp, Homo sapiens
tctcctatcttctcca

SEQ ID NO: 3857640 - DNA, 21 bp, Homo sapiens
tctcctatcttctccattcta

SEQ ID NO: 3857641 - DNA, 16 bp, Homo sapiens
tctcctcccatggcct

SEQ ID NO: 3857642 - DNA, 21 bp, Homo sapiens
tctcctcccatggccttccct

SEQ ID NO: 3857643 - DNA, 13 bp, Homo sapiens
tctcctccctgtt

SEQ ID NO: 3857644 - DNA, 13 bp, Homo sapiens
tctcctcttgcca

SEQ ID NO: 3857645 - DNA, 17 bp, Homo sapiens
tctcctcttgccactgc

SEQ ID NO: 3857646 - DNA, 17 bp, Homo sapiens
tctcctgacccagtccc

SEQ ID NO: 3857647 - DNA, 18 bp, Homo sapiens
tctcctgatttctctgaa

SEQ ID NO: 3857648 - DNA, 11 bp, Homo sapiens
tctcctgccta

SEQ ID NO: 3857649 - DNA, 12 bp, Homo sapiens
tctcctgcctac

SEQ ID NO: 3857650 - DNA, 12 bp, Homo sapiens
tctcctggcttc

SEQ ID NO: 3857651 - DNA, 13 bp, Homo sapiens
tctcctggcttcc

SEQ ID NO: 3857652 - DNA, 15 bp, Homo sapiens
tctcctggcttccca

SEQ ID NO: 3857653 - DNA, 18 bp, Homo sapiens
tctcctgggggtggcagg

SEQ ID NO: 3857654 - DNA, 20 bp, Homo sapiens
tctcctggtctgtgctgccc

SEQ ID NO: 3857655 - DNA, 12 bp, Homo sapiens
tctcctgtgacc

SEQ ID NO: 3857656 - DNA, 15 bp, Homo sapiens
tctcctgtgcccaca

SEQ ID NO: 3857657 - DNA, 16 bp, Homo sapiens
tctcctgtgcccacat

SEQ ID NO: 3857658 - DNA, 18 bp, Homo sapiens
tctcctgtgcccacatcc

SEQ ID NO: 3857659 - DNA, 19 bp, Homo sapiens
tctcctgtttttctgggtg

SEQ ID NO: 3857660 - DNA, 17 bp, Homo sapiens
tctccttactctgagcc

SEQ ID NO: 3857661 - DNA, 22 bp, Homo sapiens
tctccttactctgagcccaggc

SEQ ID NO: 3857662 - DNA, 23 bp, Homo sapiens
tctccttactctgagcccaggcc

SEQ ID NO: 3857663 - DNA, 11 bp, Homo sapiens
tctccttcctt

SEQ ID NO: 3857664 - DNA, 18 bp, Homo sapiens
tctccttccttacccaaa

SEQ ID NO: 3857665 - DNA, 17 bp, Homo sapiens
tctccttgggctcctgg

SEQ ID NO: 3857666 - DNA, 20 bp, Homo sapiens
tctccttgggctcctggctg

SEQ ID NO: 3857667 - DNA, 22 bp, Homo sapiens
tctccttgggctcctggctgcc

SEQ ID NO: 3857668 - DNA, 16 bp, Homo sapiens
tctcctttgcactgag

SEQ ID NO: 3857669 - DNA, 21 bp, Homo sapiens
tctcctttgcactgagggcca

SEQ ID NO: 3857670 - DNA, 14 bp, Homo sapiens
tctcggggcccttg

SEQ ID NO: 3857671 - DNA, 22 bp, Homo sapiens
tctcggggcccttggggcctgg

SEQ ID NO: 3857672 - DNA, 14 bp, Homo sapiens
tctcgggtgcattt

SEQ ID NO: 3857673 - DNA, 12 bp, Homo sapiens
tctcgtttttct

SEQ ID NO: 3857674 - DNA, 18 bp, Homo sapiens
tctctaaatcaagtattt

SEQ ID NO: 3857675 - DNA, 20 bp, Homo sapiens
tctactggtcttgtggaatt

SEQ ID NO: 3857676 - DNA, 23 bp, Homo sapiens
tctactggtcttgtggaattggg

SEQ ID NO: 3857677 - DNA, 22 bp, Homo sapiens
tctactttagaatgagagtgtg

SEQ ID NO: 3857678 - DNA, 16 bp, Homo sapiens
tctagaaagaaaagac

SEQ ID NO: 3857679 - DNA, 21 bp, Homo sapiens
tctagaaagaaaagaccctga

SEQ ID NO: 3857680 - DNA, 13 bp, Homo sapiens
tctagaacacagg

SEQ ID NO: 3857681 - DNA, 14 bp, Homo sapiens
tctagaacacccac

SEQ ID NO: 3857682 - DNA, 20 bp, Homo sapiens
tctagaacacccactggcca

SEQ ID NO: 3857683 - DNA, 21 bp, Homo sapiens
tctagaacacccactggccag

SEQ ID NO: 3857684 - DNA, 13 bp, Homo sapiens
tctagagaagagg

SEQ ID NO: 3857685 - DNA, 21 bp, Homo sapiens
tctagagattttcttggcagt

SEQ ID NO: 3857686 - DNA, 12 bp, Homo sapiens
tctagaggcctc

SEQ ID NO: 3857687 - DNA, 16 bp, Homo sapiens
tctagaggcctcagtt

SEQ ID NO: 3857688 - DNA, 11 bp, Homo sapiens
tctagatgctt

SEQ ID NO: 3857689 - DNA, 15 bp, Homo sapiens
tctagattgagagaa

SEQ ID NO: 3857690 - DNA, 20 bp, Homo sapiens
tctagccaggagtctgtgct

SEQ ID NO: 3857691 - DNA, 16 bp, Homo sapiens
tctagctagaaatatg

SEQ ID NO: 3857692 - DNA, 17 bp, Homo sapiens
tctagcttcatgcctca

SEQ ID NO: 3857693 - DNA, 21 bp, Homo sapiens
tctaggagctgggaggaaaag

SEQ ID NO: 3857694 - DNA, 17 bp, Homo sapiens
tctaggagctgtctcca

SEQ ID NO: 3857695 - DNA, 17 bp, Homo sapiens
tctaggtcctggcttct

SEQ ID NO: 3857696 - DNA, 19 bp, Homo sapiens
tctagtgatttcctgtata

SEQ ID NO: 3857697 - DNA, 20 bp, Homo sapiens
tctagttctcaatcactgct

SEQ ID NO: 3857698 - DNA, 23 bp, Homo sapiens
tctagtttcagtaaataatgaaa

SEQ ID NO: 3857699 - DNA, 15 bp, Homo sapiens
tctagtttctttctg

SEQ ID NO: 3857700 - DNA, 18 bp, Homo sapiens
tctagttttttttgtaaa

SEQ ID NO: 3857701 - DNA, 13 bp, Homo sapiens
tctataaataacc

SEQ ID NO: 3857702 - DNA, 15 bp, Homo sapiens
tctataacatgcatt

SEQ ID NO: 3857703 - DNA, 19 bp, Homo sapiens
tctataatggaaacattta

SEQ ID NO: 3857704 - DNA, 15 bp, Homo sapiens
tgatggcaattttgt

SEQ ID NO: 3857705 - DNA, 14 bp, Homo sapiens
tgatggggagaaag

SEQ ID NO: 3857706 - DNA, 17 bp, Homo sapiens
tgatgggtcccaaaagc

SEQ ID NO: 3857707 - DNA, 20 bp, Homo sapiens
tgatgtagggtaaggtgcct

SEQ ID NO: 3857708 - DNA, 16 bp, Homo sapiens
tgatgtcagccttgca

SEQ ID NO: 3857709 - DNA, 15 bp, Homo sapiens
tgatgtcatgtactt

SEQ ID NO: 3857710 - DNA, 22 bp, Homo sapiens
tgatgtcatgtacttcctgtgt

SEQ ID NO: 3857711 - DNA, 12 bp, Homo sapiens
tgatgtccagaa

SEQ ID NO: 3857712 - DNA, 15 bp, Homo sapiens
tgatgtccagaagaa

SEQ ID NO: 3857713 - DNA, 19 bp, Homo sapiens
tgatgtcccaacttgtaaa

SEQ ID NO: 3857714 - DNA, 15 bp, Homo sapiens
tgatgtgctggagct

SEQ ID NO: 3857715 - DNA, 14 bp, Homo sapiens
tgatgtttccagaa

SEQ ID NO: 3857716 - DNA, 23 bp, Homo sapiens
tgatgtttccagaaaatataaat

SEQ ID NO: 3857717 - DNA, 15 bp, Homo sapiens
tgattaaacagactt

SEQ ID NO: 3857718 - DNA, 13 bp, Homo sapiens
tgattaatttgag

SEQ ID NO: 3857719 - DNA, 20 bp, Homo sapiens
tgattacataatcaaagcta

SEQ ID NO: 3857720 - DNA, 20 bp, Homo sapiens
tgattacctcctgtgtggaa

SEQ ID NO: 3857721 - DNA, 16 bp, Homo sapiens
tgattactttaaaata

SEQ ID NO: 3857722 - DNA, 21 bp, Homo sapiens
tgattagaaggcaagtttcta

SEQ ID NO: 3857723 - DNA, 15 bp, Homo sapiens
tgattcaagaaacag

SEQ ID NO: 3857724 - DNA, 19 bp, Homo sapiens
tgattcactattagagaaa

SEQ ID NO: 3857725 - DNA, 16 bp, Homo sapiens
tgattcataacaatgt

SEQ ID NO: 3857726 - DNA, 23 bp, Homo sapiens
tgattcataacaatgtatgtgaa

SEQ ID NO: 3857727 - DNA, 15 bp, Homo sapiens
tgattccttttgatg

SEQ ID NO: 3857728 - DNA, 21 bp, Homo sapiens
tgattccttttgatggggaga

SEQ ID NO: 3857729 - DNA, 14 bp, Homo sapiens
tgattctgaatctg

SEQ ID NO: 3857730 - DNA, 19 bp, Homo sapiens
tgattggagtgtgtccgga

SEQ ID NO: 3857731 - DNA, 14 bp, Homo sapiens
tgattggattattc

SEQ ID NO: 3857732 - DNA, 22 bp, Homo sapiens
tgatttagtaatagtccaatat

SEQ ID NO: 3857733 - DNA, 22 bp, Homo sapiens
tgatttatagtttgtacatgca

SEQ ID NO: 3857734 - DNA, 18 bp, Homo sapiens
tgatttatatatggcata

SEQ ID NO: 3857735 - DNA, 16 bp, Homo sapiens
tgcaaggtctttggtt

SEQ ID NO: 3857736 - DNA, 16 bp, Homo sapiens
tgcaataaaatagtat

SEQ ID NO: 3857737 - DNA, 15 bp, Homo sapiens
tgcaataatgtgcaa

SEQ ID NO: 3857738 - DNA, 22 bp, Homo sapiens
tgcaatatttcccccttactac

SEQ ID NO: 3857739 - DNA, 15 bp, Homo sapiens
tgcaatgttttcctt

SEQ ID NO: 3857740 - DNA, 14 bp, Homo sapiens
tgcaatttattaaa

SEQ ID NO: 3857741 - DNA, 18 bp, Homo sapiens
tgcaatttattaaaatga

SEQ ID NO: 3857742 - DNA, 16 bp, Homo sapiens
tgcaatttcccctctg

SEQ ID NO: 3857743 - DNA, 15 bp, Homo sapiens
tgcaatttttaaact

SEQ ID NO: 3857744 - DNA, 16 bp, Homo sapiens
tgcaatttttaaacta

SEQ ID NO: 3857745 - DNA, 18 bp, Homo sapiens
tgcaatttttaaactagt

SEQ ID NO: 3857746 - DNA, 21 bp, Homo sapiens
tgcaatttttaaactagtaat

SEQ ID NO: 3857747 - DNA, 21 bp, Homo sapiens
tgcacaaccatctgtccctgc

SEQ ID NO: 3857748 - DNA, 17 bp, Homo sapiens
tgcacaagcttgtatat

SEQ ID NO: 3857749 - DNA, 13 bp, Homo sapiens
tgcacaatgggca

SEQ ID NO: 3857750 - DNA, 15 bp, Homo sapiens
tgcacaatttagaaa

SEQ ID NO: 3857751 - DNA, 17 bp, Homo sapiens
tgcacaatttagaaaac

SEQ ID NO: 3857752 - DNA, 20 bp, Homo sapiens
tgcacaatttagaaaacatt

SEQ ID NO: 3857753 - DNA, 18 bp, Homo sapiens
tgcacaatttgagcaatt

SEQ ID NO: 3857754 - DNA, 15 bp, Homo sapiens
tgcacacaaacacct

SEQ ID NO: 3857755 - DNA, 18 bp, Homo sapiens
tgcacacaaacacctcct

SEQ ID NO: 3857756 - DNA, 19 bp, Homo sapiens
tgcacacacacggatgcac

SEQ ID NO: 3857757 - DNA, 20 bp, Homo sapiens
tgcacacacacggatgcaca

SEQ ID NO: 3857758 - DNA, 21 bp, Homo sapiens
tgcacacacacggatgcacac

SEQ ID NO: 3857759 - DNA, 14 bp, Homo sapiens
tgcacacacagctc

SEQ ID NO: 3857760 - DNA, 16 bp, Homo sapiens
tgcacacacagctcct

SEQ ID NO: 3857761 - DNA, 17 bp, Homo sapiens
tgcacacacagctcctc

SEQ ID NO: 3857762 - DNA, 19 bp, Homo sapiens
tgcacacagaaatatatat

SEQ ID NO: 3857763 - DNA, 20 bp, Homo sapiens
tgcacacgcacatagagata

SEQ ID NO: 3857764 - DNA, 21 bp, Homo sapiens
tgcagtccagaataagtgctg

SEQ ID NO: 3857765 - DNA, 12 bp, Homo sapiens
tgcagtccccag

SEQ ID NO: 3857766 - DNA, 17 bp, Homo sapiens
tgcagtcccgtggaggg

SEQ ID NO: 3857767 - DNA, 21 bp, Homo sapiens
tgcagtccgcagtctggcctg

SEQ ID NO: 3857768 - DNA, 22 bp, Homo sapiens
tgcagtgatacatgtactccag

SEQ ID NO: 3857769 - DNA, 20 bp, Homo sapiens
tgcagttcaaatcctcacca

SEQ ID NO: 3857770 - DNA, 17 bp, Homo sapiens
tgcagttgacagcaggt

SEQ ID NO: 3857771 - DNA, 14 bp, Homo sapiens
tgcagttgagaggg

SEQ ID NO: 3857772 - DNA, 13 bp, Homo sapiens
tgcataaaccaat

SEQ ID NO: 3857773 - DNA, 21 bp, Homo sapiens
tgcataagattaaaggaagga

SEQ ID NO: 3857774 - DNA, 21 bp, Homo sapiens
tgcatactgatccctttccca

SEQ ID NO: 3857775 - DNA, 17 bp, Homo sapiens
tgcatatcggaggtggt

SEQ ID NO: 3857776 - DNA, 22 bp, Homo sapiens
tgcatcacttggggtcaccacc

SEQ ID NO: 3857777 - DNA, 20 bp, Homo sapiens
tgcatcagaaagggagggct

SEQ ID NO: 3857778 - DNA, 14 bp, Homo sapiens
tgcatccattcctc

SEQ ID NO: 3857779 - DNA, 17 bp, Homo sapiens
tgcatccattcctcagg

SEQ ID NO: 3857780 - DNA, 18 bp, Homo sapiens
tgcatccattcctcaggg

SEQ ID NO: 3857781 - DNA, 18 bp, Homo sapiens
tgcatcccccagcactga

SEQ ID NO: 3857782 - DNA, 16 bp, Homo sapiens
tgcatccccttggctg

SEQ ID NO: 3857783 - DNA, 15 bp, Homo sapiens
tgcatccggagaatt

SEQ ID NO: 3857784 - DNA, 21 bp, Homo sapiens
tgcatccggagaattgcctct

SEQ ID NO: 3857785 - DNA, 15 bp, Homo sapiens
tgcatcctcctccca

SEQ ID NO: 3857786 - DNA, 15 bp, Homo sapiens
tgcatctcagcccac

SEQ ID NO: 3857787 - DNA, 13 bp, Homo sapiens
tgcatgattttat

SEQ ID NO: 3857788 - DNA, 22 bp, Homo sapiens
tgcatgattttatacatagtca

SEQ ID NO: 3857789 - DNA, 16 bp, Homo sapiens
tgcatgctctctgcag

SEQ ID NO: 3857790 - DNA, 19 bp, Homo sapiens
tgcatgctctctgcagcca

SEQ ID NO: 3857791 - DNA, 16 bp, Homo sapiens
tgcatgctctggaagc

SEQ ID NO: 3857792 - DNA, 17 bp, Homo sapiens
tgcatgctctggaagcc

SEQ ID NO: 3857793 - DNA, 19 bp, Homo sapiens
tgcatggaaacctgaaaaa

SEQ ID NO: 3857794 - DNA, 19 bp, Homo sapiens
tgcatggcttggggagcag

SEQ ID NO: 3857795 - DNA, 17 bp, Homo sapiens
tgcatggggaaagagat

SEQ ID NO: 3857796 - DNA, 14 bp, Homo sapiens
tgcatgtaaaatgc

SEQ ID NO: 3857797 - DNA, 18 bp, Homo sapiens
tgcatgtaaaatgcagtc

SEQ ID NO: 3857798 - DNA, 20 bp, Homo sapiens
tgcatgtaaaatgcagtcca

SEQ ID NO: 3857799 - DNA, 20 bp, Homo sapiens
tgcatgtatgtgcacatgtg

SEQ ID NO: 3857800 - DNA, 21 bp, Homo sapiens
tgcatgtatgtgcacatgtgt

SEQ ID NO: 3857801 - DNA, 14 bp, Homo sapiens
tgcatgtgtgtata

SEQ ID NO: 3857802 - DNA, 22 bp, Homo sapiens
tgcatgttaggaaaatttcaca

SEQ ID NO: 3857803 - DNA, 12 bp, Homo sapiens
tgcatgtttact

SEQ ID NO: 3857804 - DNA, 19 bp, Homo sapiens
tgcattagaaatagacagt

SEQ ID NO: 3857805 - DNA, 16 bp, Homo sapiens
tgcattccatgatttt

SEQ ID NO: 3857806 - DNA, 14 bp, Homo sapiens
tgcattcccagtgg

SEQ ID NO: 3857807 - DNA, 18 bp, Homo sapiens
tgcattccccgctgccca

SEQ ID NO: 3857808 - DNA, 19 bp, Homo sapiens
tgcattccccgctgcccaa

SEQ ID NO: 3857809 - DNA, 13 bp, Homo sapiens
tgcattgaatata

SEQ ID NO: 3857810 - DNA, 16 bp, Homo sapiens
tgcattgtcttgtgga

SEQ ID NO: 3857811 - DNA, 18 bp, Homo sapiens
tgcattgttattgtggaa

SEQ ID NO: 3857812 - DNA, 20 bp, Homo sapiens
tgcatttagttttatggcat

SEQ ID NO: 3857813 - DNA, 17 bp, Homo sapiens
tgcatttataaatgtgt

SEQ ID NO: 3857814 - DNA, 17 bp, Homo sapiens
tgcatttgagagaagcc

SEQ ID NO: 3857815 - DNA, 19 bp, Homo sapiens
tgccaaattccatgtccct

SEQ ID NO: 3857816 - DNA, 23 bp, Homo sapiens
tgccaacatacccttctttaaat

SEQ ID NO: 3857817 - DNA, 18 bp, Homo sapiens
tgccaacctgatgcccct

SEQ ID NO: 3857818 - DNA, 22 bp, Homo sapiens
tgccaacctgatgccccttccc

SEQ ID NO: 3857819 - DNA, 13 bp, Homo sapiens
tgccaactaagcc

SEQ ID NO: 3857820 - DNA, 12 bp, Homo sapiens
tgccaagagagg

SEQ ID NO: 3857821 - DNA, 19 bp, Homo sapiens
tgccaagcttgtgagagct

SEQ ID NO: 3857822 - DNA, 17 bp, Homo sapiens
tgccaaggttgtcctgg

SEQ ID NO: 3857823 - DNA, 17 bp, Homo sapiens
tgccaagtccaggtcct

SEQ ID NO: 3857824 - DNA, 20 bp, Homo sapiens
tgccaagtccaggtcctggt

SEQ ID NO: 3857825 - DNA, 15 bp, Homo sapiens
tgccacaatgcctct

SEQ ID NO: 3857826 - DNA, 19 bp, Homo sapiens
tgccacaatgcctctccca

SEQ ID NO: 3857827 - DNA, 14 bp, Homo sapiens
tgccacacactgtt

SEQ ID NO: 3857828 - DNA, 12 bp, Homo sapiens
tgccacacttca

SEQ ID NO: 3857829 - DNA, 16 bp, Homo sapiens
tgccacacttcaggct

SEQ ID NO: 3857830 - DNA, 11 bp, Homo sapiens
tgccacagaga

SEQ ID NO: 3857831 - DNA, 13 bp, Homo sapiens
tgccacagagaag

SEQ ID NO: 3857832 - DNA, 14 bp, Homo sapiens
tgccacagagaaga

SEQ ID NO: 3857833 - DNA, 17 bp, Homo sapiens
tgccacagccccacagc

SEQ ID NO: 3857834 - DNA, 21 bp, Homo sapiens
tgccacagccccacagcaccc

SEQ ID NO: 3857835 - DNA, 11 bp, Homo sapiens
tgccaccaata

SEQ ID NO: 3857836 - DNA, 17 bp, Homo sapiens
tgccaccaataaaaatc

SEQ ID NO: 3857837 - DNA, 19 bp, Homo sapiens
tgccaccacgtctgccagg

SEQ ID NO: 3857838 - DNA, 17 bp, Homo sapiens
tgccaccactagagctg

SEQ ID NO: 3857839 - DNA, 20 bp, Homo sapiens
tgccacccagcaacacagag

SEQ ID NO: 3857840 - DNA, 17 bp, Homo sapiens
tgccacccgtaggcagc

SEQ ID NO: 3857841 - DNA, 14 bp, Homo sapiens
tgccaccctctcca

SEQ ID NO: 3857842 - DNA, 22 bp, Homo sapiens
tgccaccctctccatgcccaac

SEQ ID NO: 3857843 - DNA, 17 bp, Homo sapiens
tgccaccggggaaccca

SEQ ID NO: 3857844 - DNA, 20 bp, Homo sapiens
tgccaccggggaacccagcc

SEQ ID NO: 3857845 - DNA, 17 bp, Homo sapiens
tgccacctcccctatcc

SEQ ID NO: 3857846 - DNA, 12 bp, Homo sapiens
tgccacctgtct

SEQ ID NO: 3857847 - DNA, 13 bp, Homo sapiens
tgccacctgtctg

SEQ ID NO: 3857848 - DNA, 23 bp, Homo sapiens
tgccacctgttaaaatgtacact

SEQ ID NO: 3857849 - DNA, 18 bp, Homo sapiens
tgccactaacctgtagaa

SEQ ID NO: 3857850 - DNA, 17 bp, Homo sapiens
tgccactcattcctgta

SEQ ID NO: 3857851 - DNA, 14 bp, Homo sapiens
tgccactccctgag

SEQ ID NO: 3857852 - DNA, 17 bp, Homo sapiens
tgccactccctgagctt

SEQ ID NO: 3857853 - DNA, 13 bp, Homo sapiens
tgccactgccagg

SEQ ID NO: 3857854 - DNA, 17 bp, Homo sapiens
tgccactgccaggcacc

SEQ ID NO: 3857855 - DNA, 17 bp, Homo sapiens
tgccactgcctcttcct

SEQ ID NO: 3857856 - DNA, 20 bp, Homo sapiens
tgccacttcttaaaggcctg

SEQ ID NO: 3857857 - DNA, 21 bp, Homo sapiens
tgccacttcttaaaggcctgg

SEQ ID NO: 3857858 - DNA, 23 bp, Homo sapiens
tgccacttcttaaaggcctggaa

SEQ ID NO: 3857859 - DNA, 20 bp, Homo sapiens
tgccactttggcttctcctg

SEQ ID NO: 3857860 - DNA, 21 bp, Homo sapiens
tgccactttggcttctcctgt

SEQ ID NO: 3857861 - DNA, 22 bp, Homo sapiens
tgccactttggcttctcctgtg

SEQ ID NO: 3857862 - DNA, 23 bp, Homo sapiens
tgccactttggcttctcctgtga

SEQ ID NO: 3857863 - DNA, 21 bp, Homo sapiens
tgccagagacggaagcctttt

SEQ ID NO: 3857864 - DNA, 20 bp, Homo sapiens
tgccagagcccaagtgccat

SEQ ID NO: 3857865 - DNA, 12 bp, Homo sapiens
tgccagagcctg

SEQ ID NO: 3857866 - DNA, 13 bp, Homo sapiens
tgccagagcctgg

SEQ ID NO: 3857867 - DNA, 14 bp, Homo sapiens
tgccagagcctggg

SEQ ID NO: 3857868 - DNA, 17 bp, Homo sapiens
tgccagagcctggggct

SEQ ID NO: 3857869 - DNA, 19 bp, Homo sapiens
tgccagagcctggggctct

SEQ ID NO: 3857870 - DNA, 21 bp, Homo sapiens
tgccagatgcctttatggctg

SEQ ID NO: 3857871 - DNA, 15 bp, Homo sapiens
tgccagcacaggggc

SEQ ID NO: 3857872 - DNA, 16 bp, Homo sapiens
tgccagcacaggggcc

SEQ ID NO: 3857873 - DNA, 15 bp, Homo sapiens
tgccagccatcacaa

SEQ ID NO: 3857874 - DNA, 17 bp, Homo sapiens
tgccagccatcacaagg

SEQ ID NO: 3857875 - DNA, 19 bp, Homo sapiens
tgccagccgtgatgctcag

SEQ ID NO: 3857876 - DNA, 21 bp, Homo sapiens
tgccagctcaggtgactggag

SEQ ID NO: 3857877 - DNA, 13 bp, Homo sapiens
tgccagctgcctt

SEQ ID NO: 3857878 - DNA, 15 bp, Homo sapiens
tgccagctgccttcc

SEQ ID NO: 3857879 - DNA, 11 bp, Homo sapiens
tgccaggacac

SEQ ID NO: 3857880 - DNA, 16 bp, Homo sapiens
tgccaggacacctgcc

SEQ ID NO: 3857881 - DNA, 17 bp, Homo sapiens
tgccaggacacctgccc

SEQ ID NO: 3857882 - DNA, 21 bp, Homo sapiens
tgccaggacacctgccccagc

SEQ ID NO: 3857883 - DNA, 21 bp, Homo sapiens
tgccaggactccccaggccag

SEQ ID NO: 3857884 - DNA, 23 bp, Homo sapiens
tgccaggactccccaggccaggc

SEQ ID NO: 3857885 - DNA, 21 bp, Homo sapiens
tgccaggaggctgcggcctag

SEQ ID NO: 3857886 - DNA, 24 bp, Homo sapiens
tgccaggagggacaaaggagcctg

SEQ ID NO: 3857887 - DNA, 14 bp, Homo sapiens
tgccaggcacctgg

SEQ ID NO: 3857888 - DNA, 18 bp, Homo sapiens
tgccaggcacctggcctg

SEQ ID NO: 3857889 - DNA, 12 bp, Homo sapiens
tgccaggcccat

SEQ ID NO: 3857890 - DNA, 21 bp, Homo sapiens
tgccaggcccatctcaggtgc

SEQ ID NO: 3857891 - DNA, 22 bp, Homo sapiens
tgccaggcccatctcaggtgcc

SEQ ID NO: 3857892 - DNA, 19 bp, Homo sapiens
tgccaggcgttggtgccac

SEQ ID NO: 3857893 - DNA, 21 bp, Homo sapiens
tgccaggcgttggtgccactt

SEQ ID NO: 3857894 - DNA, 22 bp, Homo sapiens
tgccaggcgttggtgccacttc

SEQ ID NO: 3857895 - DNA, 20 bp, Homo sapiens
tgccaggctagagtgcagtg

SEQ ID NO: 3857896 - DNA, 22 bp, Homo sapiens
tgccagggcaggctaccccttc

SEQ ID NO: 3857897 - DNA, 22 bp, Homo sapiens
tgccagtgaagacttcttgggt

SEQ ID NO: 3857898 - DNA, 22 bp, Homo sapiens
tgccagtgccttacctcctgcc

SEQ ID NO: 3857899 - DNA, 14 bp, Homo sapiens
tgccagtggaatac

SEQ ID NO: 3857900 - DNA, 18 bp, Homo sapiens
tgccatagagtttaacac

SEQ ID NO: 3857901 - DNA, 20 bp, Homo sapiens
tgccatagagtttaacacaa

SEQ ID NO: 3857902 - DNA, 17 bp, Homo sapiens
tgccatgatctgtattt

SEQ ID NO: 3857903 - DNA, 13 bp, Homo sapiens
tgccatgccactg

SEQ ID NO: 3857904 - DNA, 18 bp, Homo sapiens
tgccatgccactgccagg

SEQ ID NO: 3857905 - DNA, 19 bp, Homo sapiens
tgccatgccactgccaggc

SEQ ID NO: 3857906 - DNA, 22 bp, Homo sapiens
tgccatgccactgccaggcacc

SEQ ID NO: 3857907 - DNA, 22 bp, Homo sapiens
tgccatgtcttgttcagaagac

SEQ ID NO: 3857908 - DNA, 16 bp, Homo sapiens
tgccatgtggagtgga

SEQ ID NO: 3857909 - DNA, 18 bp, Homo sapiens
tgccatgtggagtggaca

SEQ ID NO: 3857910 - DNA, 23 bp, Homo sapiens
tgccatgtttagattccaggatc

SEQ ID NO: 3857911 - DNA, 18 bp, Homo sapiens
tgccattcatagagagcc

SEQ ID NO: 3857912 - DNA, 24 bp, Homo sapiens
tgcccaacctgctctcctcttgcc

SEQ ID NO: 3857913 - DNA, 22 bp, Homo sapiens
tgcccaagaatagatgctgact

SEQ ID NO: 3857914 - DNA, 16 bp, Homo sapiens
tgcccaatgctttggg

SEQ ID NO: 3857915 - DNA, 22 bp, Homo sapiens
tgcccaatgctttgggaggcca

SEQ ID NO: 3857916 - DNA, 16 bp, Homo sapiens
tgcccacatcccaggc

SEQ ID NO: 3857917 - DNA, 23 bp, Homo sapiens
tgcccacatcccaggcttcaccc

SEQ ID NO: 3857918 - DNA, 23 bp, Homo sapiens
tgcccaccaacatcccattgccc

SEQ ID NO: 3857919 - DNA, 23 bp, Homo sapiens
tgcccacttagccgtccatggca

SEQ ID NO: 3857920 - DNA, 16 bp, Homo sapiens
tgcccagaattcccag

SEQ ID NO: 3857921 - DNA, 20 bp, Homo sapiens
tgcccagagatgcctccacc

SEQ ID NO: 3857922 - DNA, 21 bp, Homo sapiens
tgcccagagatgcctccaccg

SEQ ID NO: 3857923 - DNA, 13 bp, Homo sapiens
tgcccagctctcg

SEQ ID NO: 3857924 - DNA, 12 bp, Homo sapiens
tgcccaggagaa

SEQ ID NO: 3857925 - DNA, 23 bp, Homo sapiens
tgcccaggagagccagccctccc

SEQ ID NO: 3857926 - DNA, 17 bp, Homo sapiens
tgcccaggcctgcctgt

SEQ ID NO: 3857927 - DNA, 20 bp, Homo sapiens
tgcccaggctggagtgcagt

SEQ ID NO: 3857928 - DNA, 16 bp, Homo sapiens
tgcccatgggagctgg

SEQ ID NO: 3857929 - DNA, 13 bp, Homo sapiens
tgccccaactcct

SEQ ID NO: 3857930 - DNA, 20 bp, Homo sapiens
tgccccaactccttccagct

SEQ ID NO: 3857931 - DNA, 14 bp, Homo sapiens
tgccccaagcagcc

SEQ ID NO: 3857932 - DNA, 16 bp, Homo sapiens
tgccccaagcagccag

SEQ ID NO: 3857933 - DNA, 19 bp, Homo sapiens
tgccccaagcagccagcca

SEQ ID NO: 3857934 - DNA, 21 bp, Homo sapiens
tgccccaagcagccagccagt

SEQ ID NO: 3857935 - DNA, 13 bp, Homo sapiens
tgccccagaggcc

SEQ ID NO: 3857936 - DNA, 16 bp, Homo sapiens
tgccccagaggcctct

SEQ ID NO: 3857937 - DNA, 11 bp, Homo sapiens
tgccccagcgc

SEQ ID NO: 3857938 - DNA, 13 bp, Homo sapiens
tgccccagcgcgg

SEQ ID NO: 3857939 - DNA, 15 bp, Homo sapiens
tgccccagcgcggct

SEQ ID NO: 3857940 - DNA, 20 bp, Homo sapiens
tgccccagcgcggcttggcc

SEQ ID NO: 3857941 - DNA, 13 bp, Homo sapiens
tgcccccatccca

SEQ ID NO: 3857942 - DNA, 16 bp, Homo sapiens
tgcccccatcccacat

SEQ ID NO: 3857943 - DNA, 18 bp, Homo sapiens
tgcccccgacagcccagc

SEQ ID NO: 3857944 - DNA, 16 bp, Homo sapiens
tgccccctcatctcac

SEQ ID NO: 3857945 - DNA, 19 bp, Homo sapiens
tgccccgaatttagtcaca

SEQ ID NO: 3857946 - DNA, 16 bp, Homo sapiens
tgcccctcccttcaac

SEQ ID NO: 3857947 - DNA, 23 bp, Homo sapiens
tgccccttaagggttgaaggcag

SEQ ID NO: 3857948 - DNA, 22 bp, Homo sapiens
tgccccttccccatctccattt

SEQ ID NO: 3857949 - DNA, 13 bp, Homo sapiens
tgcccgcagagcc

SEQ ID NO: 3857950 - DNA, 18 bp, Homo sapiens
tgcccgccagcctcagtg

SEQ ID NO: 3857951 - DNA, 22 bp, Homo sapiens
tgcccgccagcctcagtgccac

SEQ ID NO: 3857952 - DNA, 23 bp, Homo sapiens
tgcccgccagcctcagtgccact

SEQ ID NO: 3857953 - DNA, 12 bp, Homo sapiens
tgccctcaggga

SEQ ID NO: 3857954 - DNA, 22 bp, Homo sapiens
tgccctcccatgttgcatgcct

SEQ ID NO: 3857955 - DNA, 14 bp, Homo sapiens
tgccctctctcagt

SEQ ID NO: 3857956 - DNA, 13 bp, Homo sapiens
tgccctgacctcc

SEQ ID NO: 3857957 - DNA, 16 bp, Homo sapiens
tgccctgacctcccag

SEQ ID NO: 3857958 - DNA, 18 bp, Homo sapiens
tgccctgacctcccagcc

SEQ ID NO: 3857959 - DNA, 14 bp, Homo sapiens
tgccctgccacctg

SEQ ID NO: 3857960 - DNA, 16 bp, Homo sapiens
tgccctgccacctgtc

SEQ ID NO: 3857961 - DNA, 19 bp, Homo sapiens
tgccctgccacctgtctgt

SEQ ID NO: 3857962 - DNA, 20 bp, Homo sapiens
tgccctgccacctgtctgtc

SEQ ID NO: 3857963 - DNA, 12 bp, Homo sapiens
tgccctgccatt

SEQ ID NO: 3857964 - DNA, 13 bp, Homo sapiens
tgccctgccccca

SEQ ID NO: 3857965 - DNA, 14 bp, Homo sapiens
tgccctgccctgcc

SEQ ID NO: 3857966 - DNA, 12 bp, Homo sapiens
tgccctgcctgc

SEQ ID NO: 3857967 - DNA, 13 bp, Homo sapiens
tgccctgcctgcc

SEQ ID NO: 3857968 - DNA, 14 bp, Homo sapiens
tgccctgcctgccc

SEQ ID NO: 3857969 - DNA, 15 bp, Homo sapiens
tgccctgcctgccca

SEQ ID NO: 3857970 - DNA, 20 bp, Homo sapiens
tgccctgctctggggatgca

SEQ ID NO: 3857971 - DNA, 13 bp, Homo sapiens
tgccctggaggga

SEQ ID NO: 3857972 - DNA, 18 bp, Homo sapiens
tgccctggatccatcagg

SEQ ID NO: 3857973 - DNA, 14 bp, Homo sapiens
tgccctggtgctgc

SEQ ID NO: 3857974 - DNA, 23 bp, Homo sapiens
tgccctgtatataatactaaagt

SEQ ID NO: 3857975 - DNA, 17 bp, Homo sapiens
tgcccttcacagtgttt

SEQ ID NO: 3857976 - DNA, 18 bp, Homo sapiens
tgcccttcgctgccagga

SEQ ID NO: 3857977 - DNA, 20 bp, Homo sapiens
tgcccttcgctgccaggaca

SEQ ID NO: 3857978 - DNA, 15 bp, Homo sapiens
tgcccttgccctgac

SEQ ID NO: 3857979 - DNA, 19 bp, Homo sapiens
tgcccttgccctgacctcc

SEQ ID NO: 3857980 - DNA, 21 bp, Homo sapiens
tgcccttttcatctccagtgt

SEQ ID NO: 3857981 - DNA, 15 bp, Homo sapiens
tgccgaccagagccc

SEQ ID NO: 3857982 - DNA, 15 bp, Homo sapiens
tgccgacctcgtcct

SEQ ID NO: 3857983 - DNA, 16 bp, Homo sapiens
tgccgagagaggcgcg

SEQ ID NO: 3857984 - DNA, 23 bp, Homo sapiens
tgccgagagaggcgcgtctgccc

SEQ ID NO: 3857985 - DNA, 15 bp, Homo sapiens
tgccgagcaaccgtg

SEQ ID NO: 3857986 - DNA, 17 bp, Homo sapiens
tgccgagcaaccgtggc

SEQ ID NO: 3857987 - DNA, 19 bp, Homo sapiens
tgccgagcaaccgtggccc

SEQ ID NO: 3857988 - DNA, 20 bp, Homo sapiens
tgccgcaagtctgcagcccg

SEQ ID NO: 3857989 - DNA, 22 bp, Homo sapiens
tgccgcaatggccatgtgggga

SEQ ID NO: 3857990 - DNA, 18 bp, Homo sapiens
tgccgccgtctctgtccc

SEQ ID NO: 3857991 - DNA, 18 bp, Homo sapiens
tgccgcctcccagcctgg

SEQ ID NO: 3857992 - DNA, 16 bp, Homo sapiens
tgccgttactctccaa

SEQ ID NO: 3857993 - DNA, 15 bp, Homo sapiens
tgcctaagtggctgc

SEQ ID NO: 3857994 - DNA, 22 bp, Homo sapiens
tgcctaggccaaatgcacaagc

SEQ ID NO: 3857995 - DNA, 23 bp, Homo sapiens
tgcctaggccaaatgcacaagct

SEQ ID NO: 3857996 - DNA, 14 bp, Homo sapiens
tgcctatccatcct

SEQ ID NO: 3857997 - DNA, 15 bp, Homo sapiens
tgcctatccatcctg

SEQ ID NO: 3857998 - DNA, 17 bp, Homo sapiens
tgcctatccatcctgcg

SEQ ID NO: 3857999 - DNA, 16 bp, Homo sapiens
tgcctatgataaattc

SEQ ID NO: 3858000 - DNA, 17 bp, Homo sapiens
tgcctatttattcattc

SEQ ID NO: 3858001 - DNA, 19 bp, Homo sapiens
tgcctatttattcattcag

SEQ ID NO: 3858002 - DNA, 13 bp, Homo sapiens
tgcctcaagaaca

SEQ ID NO: 3858003 - DNA, 15 bp, Homo sapiens
tgcctcagagcaggc

SEQ ID NO: 3858004 - DNA, 16 bp, Homo sapiens
tgcctcagtttcccca

SEQ ID NO: 3858005 - DNA, 20 bp, Homo sapiens
tgcctcatctataacatgca

SEQ ID NO: 3858006 - DNA, 15 bp, Homo sapiens
tgcctccaagatttc

SEQ ID NO: 3858007 - DNA, 17 bp, Homo sapiens
tgcctccaagccattca

SEQ ID NO: 3858008 - DNA, 11 bp, Homo sapiens
tgcctccaccg

SEQ ID NO: 3858009 - DNA, 13 bp, Homo sapiens
tgcctccaccgct

SEQ ID NO: 3858010 - DNA, 23 bp, Homo sapiens
tgcgtgttagtgtgtgtgcatgt

SEQ ID NO: 3858011 - DNA, 23 bp, Homo sapiens
tgcgttggagccactcctgtccc

SEQ ID NO: 3858012 - DNA, 23 bp, Homo sapiens
tgctaaacgactccgagaacaac

SEQ ID NO: 3858013 - DNA, 16 bp, Homo sapiens
tgctaaagttggaaag

SEQ ID NO: 3858014 - DNA, 17 bp, Homo sapiens
tgctacaaaaacacagc

SEQ ID NO: 3858015 - DNA, 18 bp, Homo sapiens
tgctacaataaatgctga

SEQ ID NO: 3858016 - DNA, 19 bp, Homo sapiens
tgctaccaaggcccagcta

SEQ ID NO: 3858017 - DNA, 19 bp, Homo sapiens
tgctacgtacatgtgaggc

SEQ ID NO: 3858018 - DNA, 16 bp, Homo sapiens
tgctactcctgtgctc

SEQ ID NO: 3858019 - DNA, 14 bp, Homo sapiens
tgctagagcaaccc

SEQ ID NO: 3858020 - DNA, 20 bp, Homo sapiens
tgctagccggccactttgga

SEQ ID NO: 3858021 - DNA, 15 bp, Homo sapiens
tgctagctgtagaaa

SEQ ID NO: 3858022 - DNA, 21 bp, Homo sapiens
tgctaggcgagtgccaggact

SEQ ID NO: 3858023 - DNA, 22 bp, Homo sapiens
tgctaggcgagtgccaggactc

SEQ ID NO: 3858024 - DNA, 23 bp, Homo sapiens
tgctatagatttgtattttaaaa

SEQ ID NO: 3858025 - DNA, 23 bp, Homo sapiens
tgctataggctggagaagctcac

SEQ ID NO: 3858026 - DNA, 15 bp, Homo sapiens
tgctatatatataaa

SEQ ID NO: 3858027 - DNA, 16 bp, Homo sapiens
tgctatattttcatga

SEQ ID NO: 3858028 - DNA, 21 bp, Homo sapiens
tgctatctctgtgtgcacaaa

SEQ ID NO: 3858029 - DNA, 17 bp, Homo sapiens
tgctattaaattaatat

SEQ ID NO: 3858030 - DNA, 15 bp, Homo sapiens
tgctattctgtgttg

SEQ ID NO: 3858031 - DNA, 13 bp, Homo sapiens
tgctattgaaatt

SEQ ID NO: 3858032 - DNA, 13 bp, Homo sapiens
tgctattgaactg

SEQ ID NO: 3858033 - DNA, 18 bp, Homo sapiens
tgctattgttgtgggctt

SEQ ID NO: 3858034 - DNA, 17 bp, Homo sapiens
tgctatttctggcctca

SEQ ID NO: 3858035 - DNA, 15 bp, Homo sapiens
tgctcaaaaatctgt

SEQ ID NO: 3858036 - DNA, 15 bp, Homo sapiens
tgctcaaatcattta

SEQ ID NO: 3858037 - DNA, 19 bp, Homo sapiens
tgctcaaatctattcagac

SEQ ID NO: 3858038 - DNA, 15 bp, Homo sapiens
tgctcacgactcttc

SEQ ID NO: 3858039 - DNA, 18 bp, Homo sapiens
tgctcacgactcttcctg

SEQ ID NO: 3858040 - DNA, 20 bp, Homo sapiens
tgctcacgactcttcctgca

SEQ ID NO: 3858041 - DNA, 13 bp, Homo sapiens
tgctcactcagga

SEQ ID NO: 3858042 - DNA, 16 bp, Homo sapiens
tgctcactcaggactt

SEQ ID NO: 3858043 - DNA, 13 bp, Homo sapiens
tgctcagacagaa

SEQ ID NO: 3858044 - DNA, 15 bp, Homo sapiens
tgctcagcaggccct

SEQ ID NO: 3858045 - DNA, 13 bp, Homo sapiens
tgctcagccctga

SEQ ID NO: 3858046 - DNA, 17 bp, Homo sapiens
tgctcagtaatttgagg

SEQ ID NO: 3858047 - DNA, 17 bp, Homo sapiens
tgctcagtgcctcctgg

SEQ ID NO: 3858048 - DNA, 21 bp, Homo sapiens
tgctcatcacccagtcctggc

SEQ ID NO: 3858049 - DNA, 23 bp, Homo sapiens
tgctccagagagaggatgcagag

SEQ ID NO: 3858050 - DNA, 17 bp, Homo sapiens
tgctcccagcagcccta

SEQ ID NO: 3858051 - DNA, 13 bp, Homo sapiens
tgctccccacacg

SEQ ID NO: 3858052 - DNA, 16 bp, Homo sapiens
tgctccccagccctgg

SEQ ID NO: 3858053 - DNA, 18 bp, Homo sapiens
tgctccccagccctggct

SEQ ID NO: 3858054 - DNA, 22 bp, Homo sapiens
tgctccccagccctggctctgc

SEQ ID NO: 3858055 - DNA, 23 bp, Homo sapiens
tgctccccagccctggctctgca

SEQ ID NO: 3858056 - DNA, 14 bp, Homo sapiens
tgctcccccacccc

SEQ ID NO: 3858057 - DNA, 23 bp, Homo sapiens
tgctcccccaccccctccccagg

SEQ ID NO: 3858058 - DNA, 22 bp, Homo sapiens
tgctcctaaacccccgctccag

SEQ ID NO: 3858059 - DNA, 23 bp, Homo sapiens
tgctcctaaacccccgctccaga

SEQ ID NO: 3858060 - DNA, 20 bp, Homo sapiens
tgctcctagtttgacctcac

SEQ ID NO: 3858061 - DNA, 12 bp, Homo sapiens
tgctcctctcca

SEQ ID NO: 3858062 - DNA, 13 bp, Homo sapiens
tgctcctctccag

SEQ ID NO: 3858063 - DNA, 14 bp, Homo sapiens
tgctcgcagcctgg

SEQ ID NO: 3858064 - DNA, 23 bp, Homo sapiens
tgctcgcagcctggcggggcagg

SEQ ID NO: 3858065 - DNA, 17 bp, Homo sapiens
tgctcgcttctcctcca

SEQ ID NO: 3858066 - DNA, 18 bp, Homo sapiens
tgctcgcttctcctccag

SEQ ID NO: 3858067 - DNA, 15 bp, Homo sapiens
tgctcggggtgcaca

SEQ ID NO: 3858068 - DNA, 16 bp, Homo sapiens
tgctcggggtgcacag

SEQ ID NO: 3858069 - DNA, 13 bp, Homo sapiens
tgctctagctggc

SEQ ID NO: 3858070 - DNA, 16 bp, Homo sapiens
tgctctagctggcagg

SEQ ID NO: 3858071 - DNA, 18 bp, Homo sapiens
tgctctagctggcaggac

SEQ ID NO: 3858072 - DNA, 22 bp, Homo sapiens
tgctctagtcttgctttgctgt

SEQ ID NO: 3858073 - DNA, 22 bp, Homo sapiens
tgctctcaccagctgctgctct

SEQ ID NO: 3858074 - DNA, 19 bp, Homo sapiens
tgctctcatgcctgcctga

SEQ ID NO: 3858075 - DNA, 16 bp, Homo sapiens
tgctctcccctgccct

SEQ ID NO: 3858076 - DNA, 20 bp, Homo sapiens
tgctctcccctgccctgctg

SEQ ID NO: 3858077 - DNA, 19 bp, Homo sapiens
tgctctcctaccccacctc

SEQ ID NO: 3858078 - DNA, 14 bp, Homo sapiens
tgctctcctcttgc

SEQ ID NO: 3858079 - DNA, 16 bp, Homo sapiens
tgctctcctcttgcca

SEQ ID NO: 3858080 - DNA, 18 bp, Homo sapiens
tgctctcctcttgccact

SEQ ID NO: 3858081 - DNA, 13 bp, Homo sapiens
tgctctctgcagc

SEQ ID NO: 3858082 - DNA, 17 bp, Homo sapiens
tgctctctgcagccagc

SEQ ID NO: 3858083 - DNA, 21 bp, Homo sapiens
tgctctctgcagccagcccag

SEQ ID NO: 3858084 - DNA, 14 bp, Homo sapiens
tgctctcttcagga

SEQ ID NO: 3858085 - DNA, 17 bp, Homo sapiens
tgctgttgccatagccc

SEQ ID NO: 3858086 - DNA, 14 bp, Homo sapiens
tgctgttgcctcat

SEQ ID NO: 3858087 - DNA, 11 bp, Homo sapiens
tgctgtttcct

SEQ ID NO: 3858088 - DNA, 17 bp, Homo sapiens
tgctgtttgagatgtga

SEQ ID NO: 3858089 - DNA, 21 bp, Homo sapiens
tgctgtttgagatgtgatgct

SEQ ID NO: 3858090 - DNA, 13 bp, Homo sapiens
tgcttaactggct

SEQ ID NO: 3858091 - DNA, 12 bp, Homo sapiens
tgcttacatttt

SEQ ID NO: 3858092 - DNA, 14 bp, Homo sapiens
tgcttacattttta

SEQ ID NO: 3858093 - DNA, 15 bp, Homo sapiens
tgcttacatttttac

SEQ ID NO: 3858094 - DNA, 13 bp, Homo sapiens
tgcttacccttca

SEQ ID NO: 3858095 - DNA, 17 bp, Homo sapiens
tgcttacccttcacctt

SEQ ID NO: 3858096 - DNA, 18 bp, Homo sapiens
tgcttactaatgtgcccc

SEQ ID NO: 3858097 - DNA, 21 bp, Homo sapiens
tgcttagatgagggtgactgt

SEQ ID NO: 3858098 - DNA, 17 bp, Homo sapiens
tgcttcaaatccatcca

SEQ ID NO: 3858099 - DNA, 19 bp, Homo sapiens
tgcttcaagtgttgctctt

SEQ ID NO: 3858100 - DNA, 22 bp, Homo sapiens
tgcttcaagtgttgctcttgga

SEQ ID NO: 3858101 - DNA, 15 bp, Homo sapiens
tgcttcaattaataa

SEQ ID NO: 3858102 - DNA, 16 bp, Homo sapiens
tgcttcaattaataaa

SEQ ID NO: 3858103 - DNA, 12 bp, Homo sapiens
tgcttcacataa

SEQ ID NO: 3858104 - DNA, 18 bp, Homo sapiens
tgcttcagacctgacacc

SEQ ID NO: 3858105 - DNA, 19 bp, Homo sapiens
tgcttcctaggccccagag

SEQ ID NO: 3858106 - DNA, 13 bp, Homo sapiens
tgcttccttctgc

SEQ ID NO: 3858107 - DNA, 19 bp, Homo sapiens
tgcttccttctgcacccag

SEQ ID NO: 3858108 - DNA, 14 bp, Homo sapiens
tgcttctctacaga

SEQ ID NO: 3858109 - DNA, 16 bp, Homo sapiens
tgcttctgcagcaact

SEQ ID NO: 3858110 - DNA, 18 bp, Homo sapiens
tgcttctgcagcaactcc

SEQ ID NO: 3858111 - DNA, 21 bp, Homo sapiens
tgcttcttcaagcacctgcag

SEQ ID NO: 3858112 - DNA, 15 bp, Homo sapiens
tgcttgactatcaca

SEQ ID NO: 3858113 - DNA, 17 bp, Homo sapiens
tgcttgactatcacata

SEQ ID NO: 3858114 - DNA, 20 bp, Homo sapiens
tgcttgcatcacttggggtc

SEQ ID NO: 3858115 - DNA, 16 bp, Homo sapiens
tgcttgcccccatgtg

SEQ ID NO: 3858116 - DNA, 12 bp, Homo sapiens
tgcttggcagag

SEQ ID NO: 3858117 - DNA, 21 bp, Homo sapiens
tgcttggggggtgatgagggc

SEQ ID NO: 3858118 - DNA, 22 bp, Homo sapiens
tgcttggtggggctcgtggcct

SEQ ID NO: 3858119 - DNA, 18 bp, Homo sapiens
tgcttgtcctgctctctt

SEQ ID NO: 3858120 - DNA, 23 bp, Homo sapiens
tgcttgtcctgctctcttcagga

SEQ ID NO: 3858121 - DNA, 12 bp, Homo sapiens
tgcttgtgggcc

SEQ ID NO: 3858122 - DNA, 20 bp, Homo sapiens
tgcttgttaatgctttctga

SEQ ID NO: 3858123 - DNA, 20 bp, Homo sapiens
tgctttacatgctgtgctct

SEQ ID NO: 3858124 - DNA, 14 bp, Homo sapiens
tgctttatttatgg

SEQ ID NO: 3858125 - DNA, 14 bp, Homo sapiens
tgctttccttttct

SEQ ID NO: 3858126 - DNA, 15 bp, Homo sapiens
tgctttctgaagctt

SEQ ID NO: 3858127 - DNA, 20 bp, Homo sapiens
tgctttctgaagctttacca

SEQ ID NO: 3858128 - DNA, 21 bp, Homo sapiens
tgctttctgaagctttaccag

SEQ ID NO: 3858129 - DNA, 22 bp, Homo sapiens
tgctttgactcacctgttactt

SEQ ID NO: 3858130 - DNA, 21 bp, Homo sapiens
tgctttgggctttgcaggctc

SEQ ID NO: 3858131 - DNA, 14 bp, Homo sapiens
tgcttttcatcctt

SEQ ID NO: 3858132 - DNA, 13 bp, Homo sapiens
tgcttttccagga

SEQ ID NO: 3858133 - DNA, 21 bp, Homo sapiens
tgcttttccaggatcctgcag

SEQ ID NO: 3858134 - DNA, 21 bp, Homo sapiens
tgcttttgccactttggcttc

SEQ ID NO: 3858135 - DNA, 15 bp, Homo sapiens
tgcttttgctggggt

SEQ ID NO: 3858136 - DNA, 16 bp, Homo sapiens
tgcttttgttgtgact

SEQ ID NO: 3858137 - DNA, 17 bp, Homo sapiens
tgcttttgttgtgactt

SEQ ID NO: 3858138 - DNA, 15 bp, Homo sapiens
tgctttttggcacag

SEQ ID NO: 3858139 - DNA, 15 bp, Homo sapiens
tggaaaaagaaagaa

SEQ ID NO: 3858140 - DNA, 18 bp, Homo sapiens
tggaaaaagaaagaaaca

SEQ ID NO: 3858141 - DNA, 13 bp, Homo sapiens
tggaaaaatccag

SEQ ID NO: 3858142 - DNA, 19 bp, Homo sapiens
tggaaaaatcttgggcaag

SEQ ID NO: 3858143 - DNA, 14 bp, Homo sapiens
tggaaaagaataca

SEQ ID NO: 3858144 - DNA, 22 bp, Homo sapiens
tggaaaagaatccctgcagcct

SEQ ID NO: 3858145 - DNA, 23 bp, Homo sapiens
tggaaaagcccagtgacctgacc

SEQ ID NO: 3858146 - DNA, 16 bp, Homo sapiens
tggaaaatgtcctgtg

SEQ ID NO: 3858147 - DNA, 20 bp, Homo sapiens
tggaaaccacacttcttgaa

SEQ ID NO: 3858148 - DNA, 15 bp, Homo sapiens
tggaaagcaaagggc

SEQ ID NO: 3858149 - DNA, 20 bp, Homo sapiens
tggaaaggtcattgtggcta

SEQ ID NO: 3858150 - DNA, 16 bp, Homo sapiens
tggaaagttcagccag

SEQ ID NO: 3858151 - DNA, 21 bp, Homo sapiens
tggaaataaacctggagatga

SEQ ID NO: 3858152 - DNA, 13 bp, Homo sapiens
tggaaataaatgt

SEQ ID NO: 3858153 - DNA, 21 bp, Homo sapiens
tggaaatactttatctgtgac

SEQ ID NO: 3858154 - DNA, 16 bp, Homo sapiens
tggaaattttgtccat

SEQ ID NO: 3858155 - DNA, 14 bp, Homo sapiens
tggaacaccaggct

SEQ ID NO: 3858156 - DNA, 15 bp, Homo sapiens
tggaacaccaggctg

SEQ ID NO: 3858157 - DNA, 22 bp, Homo sapiens
tggaacacctaccaaaaaataa

SEQ ID NO: 3858158 - DNA, 20 bp, Homo sapiens
tggaacataaaatacaatgt

SEQ ID NO: 3858159 - DNA, 13 bp, Homo sapiens
tggaactgaaggg

SEQ ID NO: 3858160 - DNA, 22 bp, Homo sapiens
tggaactgaagggggcggccta

SEQ ID NO: 3858161 - DNA, 22 bp, Homo sapiens
tggaactgaccccctcccctga

SEQ ID NO: 3858162 - DNA, 13 bp, Homo sapiens
tggaagaaacagg

SEQ ID NO: 3858163 - DNA, 13 bp, Homo sapiens
tggaagagaaatc

SEQ ID NO: 3858164 - DNA, 16 bp, Homo sapiens
tggaagagaggcacct

SEQ ID NO: 3858165 - DNA, 20 bp, Homo sapiens
tggaagagaggcacctgctg

SEQ ID NO: 3858166 - DNA, 13 bp, Homo sapiens
tggaagagctctt

SEQ ID NO: 3858167 - DNA, 14 bp, Homo sapiens
tggaagagctcttc

SEQ ID NO: 3858168 - DNA, 16 bp, Homo sapiens
tggaagattttaaatt

SEQ ID NO: 3858169 - DNA, 13 bp, Homo sapiens
tggaagcccccca

SEQ ID NO: 3858170 - DNA, 16 bp, Homo sapiens
tggaagccctccttcc

SEQ ID NO: 3858171 - DNA, 21 bp, Homo sapiens
tggaatcaaggaatcctgagt

SEQ ID NO: 3858172 - DNA, 20 bp, Homo sapiens
tggaatcaatttcccagaag

SEQ ID NO: 3858173 - DNA, 19 bp, Homo sapiens
tggaatcgatctgtactgt

SEQ ID NO: 3858174 - DNA, 15 bp, Homo sapiens
tggaatgtgagtgtg

SEQ ID NO: 3858175 - DNA, 19 bp, Homo sapiens
tggaattcagcaccctggg

SEQ ID NO: 3858176 - DNA, 21 bp, Homo sapiens
tggaattcagcaccctgggtg

SEQ ID NO: 3858177 - DNA, 22 bp, Homo sapiens
tggaatttctcccagtcattta

SEQ ID NO: 3858178 - DNA, 14 bp, Homo sapiens
tggaatttgtaagt

SEQ ID NO: 3858179 - DNA, 16 bp, Homo sapiens
tggaatttgtaagttt

SEQ ID NO: 3858180 - DNA, 13 bp, Homo sapiens
tggaattttctta

SEQ ID NO: 3858181 - DNA, 14 bp, Homo sapiens
tggacaacccagaa

SEQ ID NO: 3858182 - DNA, 22 bp, Homo sapiens
tggacaagcagaggtggccaga

SEQ ID NO: 3858183 - DNA, 17 bp, Homo sapiens
tggacaagccaacttgt

SEQ ID NO: 3858184 - DNA, 14 bp, Homo sapiens
tggacaaggaggtc

SEQ ID NO: 3858185 - DNA, 12 bp, Homo sapiens
tggacacactgt

SEQ ID NO: 3858186 - DNA, 21 bp, Homo sapiens
tggacacactgtaaacccctg

SEQ ID NO: 3858187 - DNA, 22 bp, Homo sapiens
tggacacactgtaaacccctgg

SEQ ID NO: 3858188 - DNA, 20 bp, Homo sapiens
tggacacagacccacacatg

SEQ ID NO: 3858189 - DNA, 13 bp, Homo sapiens
tggacacagtgtt

SEQ ID NO: 3858190 - DNA, 22 bp, Homo sapiens
tggacacattttctcctaggag

SEQ ID NO: 3858191 - DNA, 20 bp, Homo sapiens
tggacaccccttatccagga

SEQ ID NO: 3858192 - DNA, 22 bp, Homo sapiens
tggacaccccttatccaggact

SEQ ID NO: 3858193 - DNA, 23 bp, Homo sapiens
tggacaccccttatccaggactc

SEQ ID NO: 3858194 - DNA, 10 bp, Homo sapiens
tggacacctg

SEQ ID NO: 3858195 - DNA, 14 bp, Homo sapiens
tggacacctgccct

SEQ ID NO: 3858196 - DNA, 23 bp, Homo sapiens
tggacacctgccctgccctgcca

SEQ ID NO: 3858197 - DNA, 18 bp, Homo sapiens
tggacagatagacagtgc

SEQ ID NO: 3858198 - DNA, 14 bp, Homo sapiens
tggacagctgcttg

SEQ ID NO: 3858199 - DNA, 15 bp, Homo sapiens
tggacagctgcttgt

SEQ ID NO: 3858200 - DNA, 13 bp, Homo sapiens
tggacagctgtgc

SEQ ID NO: 3858201 - DNA, 15 bp, Homo sapiens
tggacagctgtgcct

SEQ ID NO: 3858202 - DNA, 16 bp, Homo sapiens
tggacagctgtgcctc

SEQ ID NO: 3858203 - DNA, 21 bp, Homo sapiens
tggacatgatttagggaagca

SEQ ID NO: 3858204 - DNA, 17 bp, Homo sapiens
tggacatggtctcctct

SEQ ID NO: 3858205 - DNA, 22 bp, Homo sapiens
tggacatttgccttgctggacg

SEQ ID NO: 3858206 - DNA, 14 bp, Homo sapiens
tggaccaggacagg

SEQ ID NO: 3858207 - DNA, 22 bp, Homo sapiens
tggacccacgaacgctcttagc

SEQ ID NO: 3858208 - DNA, 16 bp, Homo sapiens
tggaccccgcctccca

SEQ ID NO: 3858209 - DNA, 19 bp, Homo sapiens
tggacccctgaattcaatg

SEQ ID NO: 3858210 - DNA, 14 bp, Homo sapiens
tggacccgctctgg

SEQ ID NO: 3858211 - DNA, 16 bp, Homo sapiens
tggacccgctctggac

SEQ ID NO: 3858212 - DNA, 21 bp, Homo sapiens
tggaccgggtgggcctggcct

SEQ ID NO: 3858213 - DNA, 22 bp, Homo sapiens
tggacctatgtcctaaggacac

SEQ ID NO: 3858214 - DNA, 13 bp, Homo sapiens
tggaccttcctgc

SEQ ID NO: 3858215 - DNA, 14 bp, Homo sapiens
tggaccttcctgcc

SEQ ID NO: 3858216 - DNA, 19 bp, Homo sapiens
tggaccttcctgccaccag

SEQ ID NO: 3858217 - DNA, 21 bp, Homo sapiens
tggacctttggggaaggggga

SEQ ID NO: 3858218 - DNA, 15 bp, Homo sapiens
tggacgcccagctga

SEQ ID NO: 3858219 - DNA, 22 bp, Homo sapiens
tggacgcccagctgaggctggg

SEQ ID NO: 3858220 - DNA, 22 bp, Homo sapiens
tggactaaccccaacgcacagg

SEQ ID NO: 3858221 - DNA, 13 bp, Homo sapiens
tggactcctctgt

SEQ ID NO: 3858222 - DNA, 14 bp, Homo sapiens
tggactcctctgtc

SEQ ID NO: 3858223 - DNA, 15 bp, Homo sapiens
tggactcctctgtcc

SEQ ID NO: 3858224 - DNA, 23 bp, Homo sapiens
tggactctaagctggagctcttg

SEQ ID NO: 3858225 - DNA, 16 bp, Homo sapiens
tggactgcgctggacg

SEQ ID NO: 3858226 - DNA, 14 bp, Homo sapiens
tggacttcctgggg

SEQ ID NO: 3858227 - DNA, 14 bp, Homo sapiens
tggagaaaccctgt

SEQ ID NO: 3858228 - DNA, 17 bp, Homo sapiens
tggagaaattatttaat

SEQ ID NO: 3858229 - DNA, 21 bp, Homo sapiens
tggagaaattatttaataaaa

SEQ ID NO: 3858230 - DNA, 18 bp, Homo sapiens
tggagaactagaacctgg

SEQ ID NO: 3858231 - DNA, 19 bp, Homo sapiens
tggagaactagaacctgga

SEQ ID NO: 3858232 - DNA, 17 bp, Homo sapiens
tggagaagaccctcccc

SEQ ID NO: 3858233 - DNA, 16 bp, Homo sapiens
tggagaagctcaccca

SEQ ID NO: 3858234 - DNA, 20 bp, Homo sapiens
tggagaccgcttcacccctg

SEQ ID NO: 3858235 - DNA, 23 bp, Homo sapiens
tggagaccgcttcacccctgcac

SEQ ID NO: 3858236 - DNA, 18 bp, Homo sapiens
tggagactaagccctgtc

SEQ ID NO: 3858237 - DNA, 14 bp, Homo sapiens
tggagactgtctca

SEQ ID NO: 3858238 - DNA, 22 bp, Homo sapiens
tggagacttcaggttgttctgt

SEQ ID NO: 3858239 - DNA, 17 bp, Homo sapiens
tggagacttggaagagt

SEQ ID NO: 3858240 - DNA, 11 bp, Homo sapiens
tggagagaagt

SEQ ID NO: 3858241 - DNA, 13 bp, Homo sapiens
tggagagaagttt

SEQ ID NO: 3858242 - DNA, 23 bp, Homo sapiens
tggagagaagtttctggccctgg

SEQ ID NO: 3858243 - DNA, 13 bp, Homo sapiens
tggagagcagctg

SEQ ID NO: 3858244 - DNA, 18 bp, Homo sapiens
tggagagccagaacctgg

SEQ ID NO: 3858245 - DNA, 18 bp, Homo sapiens
tggagagccctgggaccg

SEQ ID NO: 3858246 - DNA, 19 bp, Homo sapiens
tggagagctagaacctgga

SEQ ID NO: 3858247 - DNA, 23 bp, Homo sapiens
tggagagctagaacctggagagc

SEQ ID NO: 3858248 - DNA, 13 bp, Homo sapiens
tggagaggcggcc

SEQ ID NO: 3858249 - DNA, 16 bp, Homo sapiens
tggagaggggcctggg

SEQ ID NO: 3858250 - DNA, 19 bp, Homo sapiens
tggagatatttatgggggg

SEQ ID NO: 3858251 - DNA, 13 bp, Homo sapiens
tgctctggcggct

SEQ ID NO: 3858252 - DNA, 24 bp, Homo sapiens
tgctctggcggcttcctgtccact

SEQ ID NO: 3858253 - DNA, 12 bp, Homo sapiens
tgctcttagctg

SEQ ID NO: 3858254 - DNA, 18 bp, Homo sapiens
tgctcttagtgcccgcct

SEQ ID NO: 3858255 - DNA, 17 bp, Homo sapiens
tgctcttctttctgaga

SEQ ID NO: 3858256 - DNA, 22 bp, Homo sapiens
tgctgaattattttgttgtgat

SEQ ID NO: 3858257 - DNA, 21 bp, Homo sapiens
tgctgactccatatggaggcc

SEQ ID NO: 3858258 - DNA, 14 bp, Homo sapiens
tgctgactgtactc

SEQ ID NO: 3858259 - DNA, 19 bp, Homo sapiens
tgctgactgtactcctccc

SEQ ID NO: 3858260 - DNA, 19 bp, Homo sapiens
tgctgagaacctggccttc

SEQ ID NO: 3858261 - DNA, 18 bp, Homo sapiens
tgctgagagacccaagga

SEQ ID NO: 3858262 - DNA, 15 bp, Homo sapiens
tgctgagcaccctct

SEQ ID NO: 3858263 - DNA, 17 bp, Homo sapiens
tgctgagcaccctctcc

SEQ ID NO: 3858264 - DNA, 13 bp, Homo sapiens
tgctgagccactc

SEQ ID NO: 3858265 - DNA, 17 bp, Homo sapiens
tgctgagctctgagagg

SEQ ID NO: 3858266 - DNA, 17 bp, Homo sapiens
tgctgagcttagccttg

SEQ ID NO: 3858267 - DNA, 21 bp, Homo sapiens
tgctgagcttagccttgtgcc

SEQ ID NO: 3858268 - DNA, 15 bp, Homo sapiens
tgctgaggactccct

SEQ ID NO: 3858269 - DNA, 17 bp, Homo sapiens
tgctgaggactccctcc

SEQ ID NO: 3858270 - DNA, 22 bp, Homo sapiens
tgctgaggactccctccatgtg

SEQ ID NO: 3858271 - DNA, 18 bp, Homo sapiens
tgctgcaaagtgcaaata

SEQ ID NO: 3858272 - DNA, 21 bp, Homo sapiens
tgctgcaaagtgcaaatactc

SEQ ID NO: 3858273 - DNA, 15 bp, Homo sapiens
tgctgcaccagagtg

SEQ ID NO: 3858274 - DNA, 16 bp, Homo sapiens
tgctgcaccagagtga

SEQ ID NO: 3858275 - DNA, 15 bp, Homo sapiens
tgctgcatgcctggt

SEQ ID NO: 3858276 - DNA, 19 bp, Homo sapiens
tgctgcatttgtgtcatct

SEQ ID NO: 3858277 - DNA, 16 bp, Homo sapiens
tgctgccacacttcag

SEQ ID NO: 3858278 - DNA, 15 bp, Homo sapiens
tgctgccatgccact

SEQ ID NO: 3858279 - DNA, 20 bp, Homo sapiens
tgctgccatgccactgccag

SEQ ID NO: 3858280 - DNA, 22 bp, Homo sapiens
tgctgccatgccactgccaggc

SEQ ID NO: 3858281 - DNA, 23 bp, Homo sapiens
tgctgccatgccactgccaggca

SEQ ID NO: 3858282 - DNA, 19 bp, Homo sapiens
tgctgccccgttccctgtc

SEQ ID NO: 3858283 - DNA, 11 bp, Homo sapiens
tgctgccctgc

SEQ ID NO: 3858284 - DNA, 15 bp, Homo sapiens
tgctgcgtcagacca

SEQ ID NO: 3858285 - DNA, 17 bp, Homo sapiens
tgctgctcccatctgca

SEQ ID NO: 3858286 - DNA, 11 bp, Homo sapiens
tgctgctgaga

SEQ ID NO: 3858287 - DNA, 16 bp, Homo sapiens
tgctgctgagaacctg

SEQ ID NO: 3858288 - DNA, 22 bp, Homo sapiens
tgctgctgagaacctggccttc

SEQ ID NO: 3858289 - DNA, 18 bp, Homo sapiens
tgctgctgtaactgctga

SEQ ID NO: 3858290 - DNA, 21 bp, Homo sapiens
tgctgctgtaactgctgagcc

SEQ ID NO: 3858291 - DNA, 14 bp, Homo sapiens
tgctgcttctcttg

SEQ ID NO: 3858292 - DNA, 17 bp, Homo sapiens
tgctggactgaggacca

SEQ ID NO: 3858293 - DNA, 14 bp, Homo sapiens
tgctggactgtcat

SEQ ID NO: 3858294 - DNA, 13 bp, Homo sapiens
tgctggagctggc

SEQ ID NO: 3858295 - DNA, 14 bp, Homo sapiens
tgctggagctggct

SEQ ID NO: 3858296 - DNA, 13 bp, Homo sapiens
tgctggcacctca

SEQ ID NO: 3858297 - DNA, 15 bp, Homo sapiens
tgctggccagcaccc

SEQ ID NO: 3858298 - DNA, 20 bp, Homo sapiens
tgctggccagcaccctctcc

SEQ ID NO: 3858299 - DNA, 16 bp, Homo sapiens
tgctggcctcaggctg

SEQ ID NO: 3858300 - DNA, 15 bp, Homo sapiens
tgctggcctggatct

SEQ ID NO: 3858301 - DNA, 17 bp, Homo sapiens
tgctggcggcgcagagg

SEQ ID NO: 3858302 - DNA, 14 bp, Homo sapiens
tgctgggctctcca

SEQ ID NO: 3858303 - DNA, 15 bp, Homo sapiens
tgctgggctctccac

SEQ ID NO: 3858304 - DNA, 17 bp, Homo sapiens
tgctgggctctccacct

SEQ ID NO: 3858305 - DNA, 18 bp, Homo sapiens
tgctggtaccactggaat

SEQ ID NO: 3858306 - DNA, 18 bp, Homo sapiens
tgctggtgtcattgctgt

SEQ ID NO: 3858307 - DNA, 15 bp, Homo sapiens
tgctggttttaacaa

SEQ ID NO: 3858308 - DNA, 20 bp, Homo sapiens
tgctgtaaataaatgcttta

SEQ ID NO: 3858309 - DNA, 22 bp, Homo sapiens
tgctgtaactcagacattccaa

SEQ ID NO: 3858310 - DNA, 16 bp, Homo sapiens
tgctgtaactgctgag

SEQ ID NO: 3858311 - DNA, 17 bp, Homo sapiens
tgctgtaactgctgagc

SEQ ID NO: 3858312 - DNA, 23 bp, Homo sapiens
tgctgtaactgctgagccactcg

SEQ ID NO: 3858313 - DNA, 15 bp, Homo sapiens
tgctgtacccttcca

SEQ ID NO: 3858314 - DNA, 19 bp, Homo sapiens
tgctgtacccttccacctc

SEQ ID NO: 3858315 - DNA, 17 bp, Homo sapiens
tgctgtcaccttgctca

SEQ ID NO: 3858316 - DNA, 15 bp, Homo sapiens
tgctgtccttttagg

SEQ ID NO: 3858317 - DNA, 18 bp, Homo sapiens
tgctgtctccataatgcc

SEQ ID NO: 3858318 - DNA, 21 bp, Homo sapiens
tgctgtgaatttgtgtaagga

SEQ ID NO: 3858319 - DNA, 12 bp, Homo sapiens
tgctgtgcctgc

SEQ ID NO: 3858320 - DNA, 19 bp, Homo sapiens
tgctgtgcctgctagagca

SEQ ID NO: 3858321 - DNA, 17 bp, Homo sapiens
tgctgtggccagggtga

SEQ ID NO: 3858322 - DNA, 22 bp, Homo sapiens
tgctgtggcctcacttccctgg

SEQ ID NO: 3858323 - DNA, 14 bp, Homo sapiens
tgctgtgggcagca

SEQ ID NO: 3858324 - DNA, 17 bp, Homo sapiens
tgctgtgggcagcaccc

SEQ ID NO: 3858325 - DNA, 18 bp, Homo sapiens
tgctgtgggcagcaccct

SEQ ID NO: 3858326 - DNA, 19 bp, Homo sapiens
tgctgtgggcagcaccctc

SEQ ID NO: 3858327 - DNA, 15 bp, Homo sapiens
tgctgtgtttgagct

SEQ ID NO: 3858328 - DNA, 14 bp, Homo sapiens
tggagatgcagagg

SEQ ID NO: 3858329 - DNA, 18 bp, Homo sapiens
tggagcaagaaggaagga

SEQ ID NO: 3858330 - DNA, 23 bp, Homo sapiens
tggagcaagaaggaaggaggcag

SEQ ID NO: 3858331 - DNA, 14 bp, Homo sapiens
tggagcaagagaga

SEQ ID NO: 3858332 - DNA, 15 bp, Homo sapiens
tggagcaagagagag

SEQ ID NO: 3858333 - DNA, 15 bp, Homo sapiens
tggagcagaatcagt

SEQ ID NO: 3858334 - DNA, 15 bp, Homo sapiens
tggagcatcccaggc

SEQ ID NO: 3858335 - DNA, 11 bp, Homo sapiens
tggagcatctg

SEQ ID NO: 3858336 - DNA, 18 bp, Homo sapiens
tggagcccgagggcctga

SEQ ID NO: 3858337 - DNA, 13 bp, Homo sapiens
tggagcccgtgca

SEQ ID NO: 3858338 - DNA, 22 bp, Homo sapiens
tggagcccgtgcagtacaggca

SEQ ID NO: 3858339 - DNA, 22 bp, Homo sapiens
tggagctaattaaggtttgccc

SEQ ID NO: 3858340 - DNA, 23 bp, Homo sapiens
tggagctaattaaggtttgccct

SEQ ID NO: 3858341 - DNA, 15 bp, Homo sapiens
tggaggaaggtgctg

SEQ ID NO: 3858342 - DNA, 17 bp, Homo sapiens
tggaggaaggtgctgag

SEQ ID NO: 3858343 - DNA, 13 bp, Homo sapiens
tggaggacctgag

SEQ ID NO: 3858344 - DNA, 15 bp, Homo sapiens
tggaggacctgagcc

SEQ ID NO: 3858345 - DNA, 18 bp, Homo sapiens
tggaggacctgagcctgc

SEQ ID NO: 3858346 - DNA, 20 bp, Homo sapiens
tggaggacctgagcctgccg

SEQ ID NO: 3858347 - DNA, 14 bp, Homo sapiens
tggaggagaaataa

SEQ ID NO: 3858348 - DNA, 15 bp, Homo sapiens
tggaggagaaataaa

SEQ ID NO: 3858349 - DNA, 21 bp, Homo sapiens
tggaggagaagaattttcaga

SEQ ID NO: 3858350 - DNA, 23 bp, Homo sapiens
tggaggaggcctgggggcaggga

SEQ ID NO: 3858351 - DNA, 20 bp, Homo sapiens
tggaggaggtgtcccaagct

SEQ ID NO: 3858352 - DNA, 22 bp, Homo sapiens
tggaggcagggccttgcccaga

SEQ ID NO: 3858353 - DNA, 14 bp, Homo sapiens
tggaggcctcacac

SEQ ID NO: 3858354 - DNA, 15 bp, Homo sapiens
tggaggcctgatgct

SEQ ID NO: 3858355 - DNA, 21 bp, Homo sapiens
tggagggaatgaacctggagg

SEQ ID NO: 3858356 - DNA, 20 bp, Homo sapiens
tggagggatgccacccagca

SEQ ID NO: 3858357 - DNA, 21 bp, Homo sapiens
tggagggctagaatctggaga

SEQ ID NO: 3858358 - DNA, 22 bp, Homo sapiens
tggagggctagaatctggagag

SEQ ID NO: 3858359 - DNA, 21 bp, Homo sapiens
tggagggctggaatctggaga

SEQ ID NO: 3858360 - DNA, 22 bp, Homo sapiens
tggagggctggaatctggagag

SEQ ID NO: 3858361 - DNA, 20 bp, Homo sapiens
tggagggcttggtaaaacac

SEQ ID NO: 3858362 - DNA, 14 bp, Homo sapiens
tggagggtagggga

SEQ ID NO: 3858363 - DNA, 23 bp, Homo sapiens
tggagggtaggggagtgtgggtg

SEQ ID NO: 3858364 - DNA, 20 bp, Homo sapiens
tggaggttgcagtgagctga

SEQ ID NO: 3858365 - DNA, 22 bp, Homo sapiens
tggagtcagtaggtccaagggc

SEQ ID NO: 3858366 - DNA, 22 bp, Homo sapiens
tggagtcatggtccggtgtcct

SEQ ID NO: 3858367 - DNA, 13 bp, Homo sapiens
tggagtctgagtc

SEQ ID NO: 3858368 - DNA, 20 bp, Homo sapiens
tggagtgaggcttccaggct

SEQ ID NO: 3858369 - DNA, 23 bp, Homo sapiens
tggagtgaggcttccaggctctt

SEQ ID NO: 3858370 - DNA, 23 bp, Homo sapiens
tggagtgcgctcttggtccctgg

SEQ ID NO: 3858371 - DNA, 13 bp, Homo sapiens
tggagtgggagat

SEQ ID NO: 3858372 - DNA, 12 bp, Homo sapiens
tggagtgtcacc

SEQ ID NO: 3858373 - DNA, 20 bp, Homo sapiens
tggagttacattaatgttaa

SEQ ID NO: 3858374 - DNA, 13 bp, Homo sapiens
tggagttcagaga

SEQ ID NO: 3858375 - DNA, 19 bp, Homo sapiens
tggataatatccactgcaa

SEQ ID NO: 3858376 - DNA, 23 bp, Homo sapiens
tggatcacagaggcttcttcaga

SEQ ID NO: 3858377 - DNA, 18 bp, Homo sapiens
tggatcagcgtggccttg

SEQ ID NO: 3858378 - DNA, 17 bp, Homo sapiens
tggatcccaattcattt

SEQ ID NO: 3858379 - DNA, 20 bp, Homo sapiens
tggatcccaattcatttcat

SEQ ID NO: 3858380 - DNA, 21 bp, Homo sapiens
tggatcctgctgtggcctcac

SEQ ID NO: 3858381 - DNA, 15 bp, Homo sapiens
tggatctccaaggac

SEQ ID NO: 3858382 - DNA, 15 bp, Homo sapiens
tggatctccccactc

SEQ ID NO: 3858383 - DNA, 19 bp, Homo sapiens
tggatctccccactctagg

SEQ ID NO: 3858384 - DNA, 20 bp, Homo sapiens
tggatctgggaccctttcct

SEQ ID NO: 3858385 - DNA, 16 bp, Homo sapiens
tggatctgtccaagga

SEQ ID NO: 3858386 - DNA, 18 bp, Homo sapiens
tggatctgtccaaggaaa

SEQ ID NO: 3858387 - DNA, 17 bp, Homo sapiens
tggatcttcagaaggct

SEQ ID NO: 3858388 - DNA, 22 bp, Homo sapiens
tggatgaagattctcctgtgct

SEQ ID NO: 3858389 - DNA, 17 bp, Homo sapiens
tggatgctccagggcag

SEQ ID NO: 3858390 - DNA, 16 bp, Homo sapiens
tggatggacagaatga

SEQ ID NO: 3858391 - DNA, 17 bp, Homo sapiens
tggatggatggacagaa

SEQ ID NO: 3858392 - DNA, 19 bp, Homo sapiens
tggatgggcattgggctga

SEQ ID NO: 3858393 - DNA, 18 bp, Homo sapiens
tggatgtcccctgtccca

SEQ ID NO: 3858394 - DNA, 13 bp, Homo sapiens
tggattgagggta

SEQ ID NO: 3858395 - DNA, 22 bp, Homo sapiens
tggatttcctattttaaaacca

SEQ ID NO: 3858396 - DNA, 15 bp, Homo sapiens
tggatttttaaatta

SEQ ID NO: 3858397 - DNA, 17 bp, Homo sapiens
tggcaaaaatggctaga

SEQ ID NO: 3858398 - DNA, 15 bp, Homo sapiens
tggcaagcagggaaa

SEQ ID NO: 3858399 - DNA, 22 bp, Homo sapiens
tggcaagcagggaaagctccac

SEQ ID NO: 3858400 - DNA, 17 bp, Homo sapiens
tggcaagggggtgtcat

SEQ ID NO: 3858401 - DNA, 23 bp, Homo sapiens
tggcaagttttgatatgagtata

SEQ ID NO: 3858402 - DNA, 13 bp, Homo sapiens
tggcaattttgta

SEQ ID NO: 3858403 - DNA, 22 bp, Homo sapiens
tggcacaactgtctaatgacac

SEQ ID NO: 3858404 - DNA, 14 bp, Homo sapiens
tggcacagaaacac

SEQ ID NO: 3858405 - DNA, 22 bp, Homo sapiens
tggcacagacttctggaaggct

SEQ ID NO: 3858406 - DNA, 18 bp, Homo sapiens
tggcacagggcagtggga

SEQ ID NO: 3858407 - DNA, 19 bp, Homo sapiens
tggcacagttttctgagaa

SEQ ID NO: 3858408 - DNA, 20 bp, Homo sapiens
tggcacagttttctgagaaa

SEQ ID NO: 3858409 - DNA, 19 bp, Homo sapiens
tggcaccagatgcaacctc

SEQ ID NO: 3858410 - DNA, 18 bp, Homo sapiens
tggcaccagccccctgga

SEQ ID NO: 3858411 - DNA, 14 bp, Homo sapiens
tggcacctcagaca

SEQ ID NO: 3858412 - DNA, 16 bp, Homo sapiens
tggcacctcctgagaa

SEQ ID NO: 3858413 - DNA, 18 bp, Homo sapiens
tgggcctgcttttccagg

SEQ ID NO: 3858414 - DNA, 20 bp, Homo sapiens
tgggcctgcttttccaggat

SEQ ID NO: 3858415 - DNA, 11 bp, Homo sapiens
tgggcctggcc

SEQ ID NO: 3858416 - DNA, 15 bp, Homo sapiens
tgggcctggcctgag

SEQ ID NO: 3858417 - DNA, 15 bp, Homo sapiens
tgggcctgggcctgc

SEQ ID NO: 3858418 - DNA, 13 bp, Homo sapiens
tgggcctgtgcag

SEQ ID NO: 3858419 - DNA, 20 bp, Homo sapiens
tgggcctgtgcagcagccca

SEQ ID NO: 3858420 - DNA, 23 bp, Homo sapiens
tgggcctgtgcagcagcccagct

SEQ ID NO: 3858421 - DNA, 15 bp, Homo sapiens
tgggcctttcctgtg

SEQ ID NO: 3858422 - DNA, 13 bp, Homo sapiens
tgggctactggca

SEQ ID NO: 3858423 - DNA, 15 bp, Homo sapiens
tgggctactggcagc

SEQ ID NO: 3858424 - DNA, 18 bp, Homo sapiens
tgggctactggcagctcc

SEQ ID NO: 3858425 - DNA, 22 bp, Homo sapiens
tgggctagggagaatgcagaga

SEQ ID NO: 3858426 - DNA, 21 bp, Homo sapiens
tgggctagtgtgagtggcagc

SEQ ID NO: 3858427 - DNA, 13 bp, Homo sapiens
tgggctcagggct

SEQ ID NO: 3858428 - DNA, 20 bp, Homo sapiens
tgggctcagggctggagtgc

SEQ ID NO: 3858429 - DNA, 17 bp, Homo sapiens
tgggctcctggaaccaa

SEQ ID NO: 3858430 - DNA, 13 bp, Homo sapiens
tgggctcctggct

SEQ ID NO: 3858431 - DNA, 16 bp, Homo sapiens
tgggctcctggctgcc

SEQ ID NO: 3858432 - DNA, 19 bp, Homo sapiens
tgggctcctggctgccagg

SEQ ID NO: 3858433 - DNA, 14 bp, Homo sapiens
tgggctctccacct

SEQ ID NO: 3858434 - DNA, 19 bp, Homo sapiens
tgggctgacacctaccatg

SEQ ID NO: 3858435 - DNA, 22 bp, Homo sapiens
tgggctgacacctaccatgctg

SEQ ID NO: 3858436 - DNA, 13 bp, Homo sapiens
tgggctgccctgg

SEQ ID NO: 3858437 - DNA, 16 bp, Homo sapiens
tgggctgccctggtgc

SEQ ID NO: 3858438 - DNA, 21 bp, Homo sapiens
tgggctgccctggtgctgcca

SEQ ID NO: 3858439 - DNA, 12 bp, Homo sapiens
tgggctggccca

SEQ ID NO: 3858440 - DNA, 14 bp, Homo sapiens
tgggctgtctgtca

SEQ ID NO: 3858441 - DNA, 15 bp, Homo sapiens
tgggctgtctgtcac

SEQ ID NO: 3858442 - DNA, 16 bp, Homo sapiens
tgggctgtctgtcacc

SEQ ID NO: 3858443 - DNA, 20 bp, Homo sapiens
tgggcttctgaaacttcata

SEQ ID NO: 3858444 - DNA, 15 bp, Homo sapiens
tgggctttaacaaaa

SEQ ID NO: 3858445 - DNA, 19 bp, Homo sapiens
tgggctttaacaaaacaag

SEQ ID NO: 3858446 - DNA, 16 bp, Homo sapiens
tgggctttgcaggctc

SEQ ID NO: 3858447 - DNA, 19 bp, Homo sapiens
tggggaagtgctccccaca

SEQ ID NO: 3858448 - DNA, 22 bp, Homo sapiens
tggggaagtgctccccacacgt

SEQ ID NO: 3858449 - DNA, 20 bp, Homo sapiens
tggggacactaatgaagata

SEQ ID NO: 3858450 - DNA, 17 bp, Homo sapiens
tggggacagttggcaga

SEQ ID NO: 3858451 - DNA, 23 bp, Homo sapiens
tggggacagttggcagagaaggc

SEQ ID NO: 3858452 - DNA, 19 bp, Homo sapiens
tggggagaaataaattttg

SEQ ID NO: 3858453 - DNA, 20 bp, Homo sapiens
tggggagaagtgagggctgg

SEQ ID NO: 3858454 - DNA, 23 bp, Homo sapiens
tggggagcacttgcgtcctgcag

SEQ ID NO: 3858455 - DNA, 22 bp, Homo sapiens
tggggagcagagtataggatgg

SEQ ID NO: 3858456 - DNA, 16 bp, Homo sapiens
tggggaggaagggcca

SEQ ID NO: 3858457 - DNA, 17 bp, Homo sapiens
tggggaggaagggccag

SEQ ID NO: 3858458 - DNA, 23 bp, Homo sapiens
tggggaggaagggccaggagaga

SEQ ID NO: 3858459 - DNA, 15 bp, Homo sapiens
tggggatgtgggagg

SEQ ID NO: 3858460 - DNA, 19 bp, Homo sapiens
tggggcaacgacggtttca

SEQ ID NO: 3858461 - DNA, 16 bp, Homo sapiens
tggggcagctcctctg

SEQ ID NO: 3858462 - DNA, 20 bp, Homo sapiens
tggggcagctcctctgtctc

SEQ ID NO: 3858463 - DNA, 22 bp, Homo sapiens
tggggcaggagtagctgagctc

SEQ ID NO: 3858464 - DNA, 15 bp, Homo sapiens
tggggcatgtgtgcc

SEQ ID NO: 3858465 - DNA, 22 bp, Homo sapiens
tggggcatgtgtgcctgtggca

SEQ ID NO: 3858466 - DNA, 21 bp, Homo sapiens
tggggccagtgtaaggcatag

SEQ ID NO: 3858467 - DNA, 17 bp, Homo sapiens
tggggccctgggcctca

SEQ ID NO: 3858468 - DNA, 18 bp, Homo sapiens
tggggcctagatccacac

SEQ ID NO: 3858469 - DNA, 14 bp, Homo sapiens
tggggcctggagag

SEQ ID NO: 3858470 - DNA, 17 bp, Homo sapiens
tggggcctggagagggg

SEQ ID NO: 3858471 - DNA, 18 bp, Homo sapiens
tggggcctggagaggggc

SEQ ID NO: 3858472 - DNA, 21 bp, Homo sapiens
tggggcctggcttgctccagg

SEQ ID NO: 3858473 - DNA, 22 bp, Homo sapiens
tggggcctggcttgctccaggg

SEQ ID NO: 3858474 - DNA, 18 bp, Homo sapiens
tggggcctgtactgcctg

SEQ ID NO: 3858475 - DNA, 21 bp, Homo sapiens
tggggctcctttctccagcca

SEQ ID NO: 3858476 - DNA, 18 bp, Homo sapiens
tggggctcgccccaccca

SEQ ID NO: 3858477 - DNA, 20 bp, Homo sapiens
tggggctcgccccacccagg

SEQ ID NO: 3858478 - DNA, 21 bp, Homo sapiens
tggggctcgccccacccaggg

SEQ ID NO: 3858479 - DNA, 22 bp, Homo sapiens
tggggctcgccccacccagggc

SEQ ID NO: 3858480 - DNA, 21 bp, Homo sapiens
tggggctcgtggccttcccct

SEQ ID NO: 3858481 - DNA, 17 bp, Homo sapiens
tggggctctaacgcctg

SEQ ID NO: 3858482 - DNA, 24 bp, Homo sapiens
tggggctctaacgcctgagcccag

SEQ ID NO: 3858483 - DNA, 16 bp, Homo sapiens
tggggctgctcctcca

SEQ ID NO: 3858484 - DNA, 19 bp, Homo sapiens
tggggctgctcctccaggg

SEQ ID NO: 3858485 - DNA, 17 bp, Homo sapiens
tggggctggagaggaca

SEQ ID NO: 3858486 - DNA, 15 bp, Homo sapiens
tggggcttctcctga

SEQ ID NO: 3858487 - DNA, 20 bp, Homo sapiens
tgggggatgactagaggcag

SEQ ID NO: 3858488 - DNA, 21 bp, Homo sapiens
tgggggatgggccagggttta

SEQ ID NO: 3858489 - DNA, 16 bp, Homo sapiens
tgggggcagagggcag

SEQ ID NO: 3858490 - DNA, 18 bp, Homo sapiens
tgggggcagtgactggca

SEQ ID NO: 3858491 - DNA, 11 bp, Homo sapiens
tgggggcctgg

SEQ ID NO: 3858492 - DNA, 17 bp, Homo sapiens
tgggggcctggctggct

SEQ ID NO: 3858493 - DNA, 13 bp, Homo sapiens
tggcttgctccag

SEQ ID NO: 3858494 - DNA, 19 bp, Homo sapiens
tggcttgtgattctgggat

SEQ ID NO: 3858495 - DNA, 21 bp, Homo sapiens
tggctttcccggactgcaagc

SEQ ID NO: 3858496 - DNA, 14 bp, Homo sapiens
tggcttttcactgc

SEQ ID NO: 3858497 - DNA, 19 bp, Homo sapiens
tggcttttcactgctggct

SEQ ID NO: 3858498 - DNA, 15 bp, Homo sapiens
tggctttttaacatg

SEQ ID NO: 3858499 - DNA, 19 bp, Homo sapiens
tggcttttttcctcctgtg

SEQ ID NO: 3858500 - DNA, 20 bp, Homo sapiens
tgggaaaaaagttttgatga

SEQ ID NO: 3858501 - DNA, 16 bp, Homo sapiens
tgggaaaacagaggaa

SEQ ID NO: 3858502 - DNA, 18 bp, Homo sapiens
tgggaaaagaccagggct

SEQ ID NO: 3858503 - DNA, 15 bp, Homo sapiens
tgggaaacagggagc

SEQ ID NO: 3858504 - DNA, 21 bp, Homo sapiens
tgggaaagcattgtaaatgtg

SEQ ID NO: 3858505 - DNA, 21 bp, Homo sapiens
tgggaaaggaggcatgcctct

SEQ ID NO: 3858506 - DNA, 13 bp, Homo sapiens
tgggaaagggacc

SEQ ID NO: 3858507 - DNA, 12 bp, Homo sapiens
tgggaaagtgca

SEQ ID NO: 3858508 - DNA, 17 bp, Homo sapiens
tgggaaataagagagaa

SEQ ID NO: 3858509 - DNA, 23 bp, Homo sapiens
tgggaaatggtatgagctgaggg

SEQ ID NO: 3858510 - DNA, 13 bp, Homo sapiens
tgggaaccctccc

SEQ ID NO: 3858511 - DNA, 16 bp, Homo sapiens
tgggaaccctccccaa

SEQ ID NO: 3858512 - DNA, 18 bp, Homo sapiens
tgggaacgtgactgcccc

SEQ ID NO: 3858513 - DNA, 13 bp, Homo sapiens
tgggaagacatga

SEQ ID NO: 3858514 - DNA, 17 bp, Homo sapiens
tgggaagagaagggaag

SEQ ID NO: 3858515 - DNA, 20 bp, Homo sapiens
tgggaaggggtgccctctgg

SEQ ID NO: 3858516 - DNA, 20 bp, Homo sapiens
tgggaattctttacaataaa

SEQ ID NO: 3858517 - DNA, 16 bp, Homo sapiens
tgggacagggcatggc

SEQ ID NO: 3858518 - DNA, 13 bp, Homo sapiens
tgggaccaggcac

SEQ ID NO: 3858519 - DNA, 13 bp, Homo sapiens
tgggaccctttcc

SEQ ID NO: 3858520 - DNA, 20 bp, Homo sapiens
tgggaccgctacaccactct

SEQ ID NO: 3858521 - DNA, 22 bp, Homo sapiens
tgggaccgctacaccactctgg

SEQ ID NO: 3858522 - DNA, 17 bp, Homo sapiens
tgggagagccagctctc

SEQ ID NO: 3858523 - DNA, 12 bp, Homo sapiens
tgggagcactgg

SEQ ID NO: 3858524 - DNA, 23 bp, Homo sapiens
tgggagcactggagtgcagggag

SEQ ID NO: 3858525 - DNA, 16 bp, Homo sapiens
tgggagcctaaggaag

SEQ ID NO: 3858526 - DNA, 22 bp, Homo sapiens
tgggagcctgcaaactcactgc

SEQ ID NO: 3858527 - DNA, 19 bp, Homo sapiens
tgggagctggttagaaatg

SEQ ID NO: 3858528 - DNA, 15 bp, Homo sapiens
tgggaggccaaggca

SEQ ID NO: 3858529 - DNA, 16 bp, Homo sapiens
tgggagggggctccat

SEQ ID NO: 3858530 - DNA, 20 bp, Homo sapiens
tgggagggggctccatggag

SEQ ID NO: 3858531 - DNA, 19 bp, Homo sapiens
tgggagtcaggacctccgg

SEQ ID NO: 3858532 - DNA, 15 bp, Homo sapiens
tgggagtgttctgtg

SEQ ID NO: 3858533 - DNA, 21 bp, Homo sapiens
tgggataacagaggcaggagt

SEQ ID NO: 3858534 - DNA, 13 bp, Homo sapiens
tgggatcagcctc

SEQ ID NO: 3858535 - DNA, 14 bp, Homo sapiens
tgggatcagcctcc

SEQ ID NO: 3858536 - DNA, 12 bp, Homo sapiens
tgggatgctcct

SEQ ID NO: 3858537 - DNA, 14 bp, Homo sapiens
tgggatggaggaga

SEQ ID NO: 3858538 - DNA, 15 bp, Homo sapiens
tgggatgggaccagg

SEQ ID NO: 3858539 - DNA, 13 bp, Homo sapiens
tgggatgtagaac

SEQ ID NO: 3858540 - DNA, 13 bp, Homo sapiens
tgggatgtcctct

SEQ ID NO: 3858541 - DNA, 22 bp, Homo sapiens
tgggattcaggaaaaggcctgg

SEQ ID NO: 3858542 - DNA, 19 bp, Homo sapiens
tgggattgtggtacaatct

SEQ ID NO: 3858543 - DNA, 19 bp, Homo sapiens
tgggatttatatctatagt

SEQ ID NO: 3858544 - DNA, 17 bp, Homo sapiens
tgggcaatgaaaccaaa

SEQ ID NO: 3858545 - DNA, 18 bp, Homo sapiens
tgggcaatgaaaccaaag

SEQ ID NO: 3858546 - DNA, 23 bp, Homo sapiens
tgggcacccccagcctgggccta

SEQ ID NO: 3858547 - DNA, 16 bp, Homo sapiens
tgggcactgggatgag

SEQ ID NO: 3858548 - DNA, 22 bp, Homo sapiens
tgggcactgggatgagccgctg

SEQ ID NO: 3858549 - DNA, 17 bp, Homo sapiens
tgggcagaagggagaag

SEQ ID NO: 3858550 - DNA, 19 bp, Homo sapiens
tgggcagaagggagaagga

SEQ ID NO: 3858551 - DNA, 15 bp, Homo sapiens
tgggcagctgggccc

SEQ ID NO: 3858552 - DNA, 21 bp, Homo sapiens
tgggcagctgtcatggaaaag

SEQ ID NO: 3858553 - DNA, 20 bp, Homo sapiens
tgggcagtcgtaagggttgc

SEQ ID NO: 3858554 - DNA, 11 bp, Homo sapiens
tgggcagtgcc

SEQ ID NO: 3858555 - DNA, 20 bp, Homo sapiens
tgggcagtgcctcctgggac

SEQ ID NO: 3858556 - DNA, 22 bp, Homo sapiens
tgggcagtgcctcctgggacca

SEQ ID NO: 3858557 - DNA, 16 bp, Homo sapiens
tgggcatccacccagt

SEQ ID NO: 3858558 - DNA, 23 bp, Homo sapiens
tgggcatctcgtgccagggcagg

SEQ ID NO: 3858559 - DNA, 15 bp, Homo sapiens
tgggcattgggctga

SEQ ID NO: 3858560 - DNA, 16 bp, Homo sapiens
tgggccaactcacctg

SEQ ID NO: 3858561 - DNA, 18 bp, Homo sapiens
tgggccactctcccctcc

SEQ ID NO: 3858562 - DNA, 20 bp, Homo sapiens
tgggccactgccagcagctg

SEQ ID NO: 3858563 - DNA, 21 bp, Homo sapiens
tgggccactgccagcagctgt

SEQ ID NO: 3858564 - DNA, 18 bp, Homo sapiens
tgggccaggacaggcccg

SEQ ID NO: 3858565 - DNA, 19 bp, Homo sapiens
tgggcccacagagatgcat

SEQ ID NO: 3858566 - DNA, 15 bp, Homo sapiens
tgggcccaggctctg

SEQ ID NO: 3858567 - DNA, 17 bp, Homo sapiens
tgggcccaggctctggg

SEQ ID NO: 3858568 - DNA, 22 bp, Homo sapiens
tgggcccaggctctgggaaggg

SEQ ID NO: 3858569 - DNA, 18 bp, Homo sapiens
tgggccccaccacctagg

SEQ ID NO: 3858570 - DNA, 14 bp, Homo sapiens
tgggccccatgctc

SEQ ID NO: 3858571 - DNA, 18 bp, Homo sapiens
tgggccccatgctctgcc

SEQ ID NO: 3858572 - DNA, 19 bp, Homo sapiens
tgggccccatgctctgccc

SEQ ID NO: 3858573 - DNA, 22 bp, Homo sapiens
tgggcccggagtaatcaggcag

SEQ ID NO: 3858574 - DNA, 17 bp, Homo sapiens
tgggccggccagccttg

SEQ ID NO: 3858575 - DNA, 19 bp, Homo sapiens
tgggcctatggagagccct

SEQ ID NO: 3858576 - DNA, 20 bp, Homo sapiens
tgggcctgcccaatgctttg

SEQ ID NO: 3858577 - DNA, 14 bp, Homo sapiens
tgggcctgctgctg

SEQ ID NO: 3858578 - DNA, 17 bp, Homo sapiens
tgggcctgctgctgaga

SEQ ID NO: 3858579 - DNA, 17 bp, Homo sapiens
tgtacaagttttgtata

SEQ ID NO: 3858580 - DNA, 19 bp, Homo sapiens
tgtacaatacataactagt

SEQ ID NO: 3858581 - DNA, 22 bp, Homo sapiens
tgtacaataccagatcactcaa

SEQ ID NO: 3858582 - DNA, 18 bp, Homo sapiens
tgtacacacggaccatgt

SEQ ID NO: 3858583 - DNA, 22 bp, Homo sapiens
tgtacagaatttttaatgactt

SEQ ID NO: 3858584 - DNA, 18 bp, Homo sapiens
tgtacatagatgtatcat

SEQ ID NO: 3858585 - DNA, 21 bp, Homo sapiens
tgtacatagatgtatcattaa

SEQ ID NO: 3858586 - DNA, 15 bp, Homo sapiens
tgtacatatgtaaaa

SEQ ID NO: 3858587 - DNA, 16 bp, Homo sapiens
tgtacatatgtaaaat

SEQ ID NO: 3858588 - DNA, 19 bp, Homo sapiens
tgtacattccctgcatcca

SEQ ID NO: 3858589 - DNA, 20 bp, Homo sapiens
tgtacccaccgggccactcc

SEQ ID NO: 3858590 - DNA, 12 bp, Homo sapiens
tgtacccagctc

SEQ ID NO: 3858591 - DNA, 19 bp, Homo sapiens
tgtaccccatcccttcctc

SEQ ID NO: 3858592 - DNA, 22 bp, Homo sapiens
tgtacccttccacctcctagag

SEQ ID NO: 3858593 - DNA, 22 bp, Homo sapiens
tgtaccgcgtctaccctgggat

SEQ ID NO: 3858594 - DNA, 17 bp, Homo sapiens
tgtacctatgtgacaga

SEQ ID NO: 3858595 - DNA, 21 bp, Homo sapiens
tgtaccttccttaagccagga

SEQ ID NO: 3858596 - DNA, 15 bp, Homo sapiens
tgtactattgtttaa

SEQ ID NO: 3858597 - DNA, 12 bp, Homo sapiens
tgtactgcctgc

SEQ ID NO: 3858598 - DNA, 23 bp, Homo sapiens
tgtactgtaattttgtttgtaat

SEQ ID NO: 3858599 - DNA, 15 bp, Homo sapiens
tgtacttcctgtgta

SEQ ID NO: 3858600 - DNA, 16 bp, Homo sapiens
tgtacttgatgacaga

SEQ ID NO: 3858601 - DNA, 18 bp, Homo sapiens
tgtagaaatattataaat

SEQ ID NO: 3858602 - DNA, 22 bp, Homo sapiens
tgtagaataataataaaaagac

SEQ ID NO: 3858603 - DNA, 18 bp, Homo sapiens
tgtagaatgatttcatgc

SEQ ID NO: 3858604 - DNA, 21 bp, Homo sapiens
tgtagaccactgtcctggctg

SEQ ID NO: 3858605 - DNA, 15 bp, Homo sapiens
tgtagactatataca

SEQ ID NO: 3858606 - DNA, 16 bp, Homo sapiens
tgtagactatatacat

SEQ ID NO: 3858607 - DNA, 17 bp, Homo sapiens
tgtagactatatacatg

SEQ ID NO: 3858608 - DNA, 20 bp, Homo sapiens
tgtagactatatacatgtgt

SEQ ID NO: 3858609 - DNA, 21 bp, Homo sapiens
tgtagatagttaaaagactgc

SEQ ID NO: 3858610 - DNA, 11 bp, Homo sapiens
tgtagcagtga

SEQ ID NO: 3858611 - DNA, 12 bp, Homo sapiens
tgtagccagccg

SEQ ID NO: 3858612 - DNA, 17 bp, Homo sapiens
tgtagccatggctcagg

SEQ ID NO: 3858613 - DNA, 19 bp, Homo sapiens
tgtagccatggctcaggca

SEQ ID NO: 3858614 - DNA, 17 bp, Homo sapiens
tgtagcccggccagggc

SEQ ID NO: 3858615 - DNA, 22 bp, Homo sapiens
tgtagcctcgccgtctgtgaat

SEQ ID NO: 3858616 - DNA, 23 bp, Homo sapiens
tgtagccttgccttttaaaagaa

SEQ ID NO: 3858617 - DNA, 13 bp, Homo sapiens
tgtagctgatgaa

SEQ ID NO: 3858618 - DNA, 21 bp, Homo sapiens
tgtagctgatgaaactcctga

SEQ ID NO: 3858619 - DNA, 11 bp, Homo sapiens
tgtagctgtga

SEQ ID NO: 3858620 - DNA, 23 bp, Homo sapiens
tgtagctgtgacctgctgagctc

SEQ ID NO: 3858621 - DNA, 14 bp, Homo sapiens
tgtaggagggactg

SEQ ID NO: 3858622 - DNA, 19 bp, Homo sapiens
tgtaggtgtctgcacccag

SEQ ID NO: 3858623 - DNA, 15 bp, Homo sapiens
tgtagtctaagacct

SEQ ID NO: 3858624 - DNA, 16 bp, Homo sapiens
tgtagtgagaaactga

SEQ ID NO: 3858625 - DNA, 19 bp, Homo sapiens
tgtagtggaagagcagcct

SEQ ID NO: 3858626 - DNA, 14 bp, Homo sapiens
tgtagttaggaaat

SEQ ID NO: 3858627 - DNA, 20 bp, Homo sapiens
tgtataaaatgcaaaataaa

SEQ ID NO: 3858628 - DNA, 14 bp, Homo sapiens
tgtataaatgtata

SEQ ID NO: 3858629 - DNA, 18 bp, Homo sapiens
tgtataacttcttaaaag

SEQ ID NO: 3858630 - DNA, 23 bp, Homo sapiens
tgtataatttaacagtgcccttt

SEQ ID NO: 3858631 - DNA, 17 bp, Homo sapiens
tgtatacacacatatac

SEQ ID NO: 3858632 - DNA, 16 bp, Homo sapiens
tgtatacattttgtta

SEQ ID NO: 3858633 - DNA, 18 bp, Homo sapiens
tgtatacattttgttata

SEQ ID NO: 3858634 - DNA, 19 bp, Homo sapiens
tgtatacattttgttatag

SEQ ID NO: 3858635 - DNA, 21 bp, Homo sapiens
tgtatagcaccaaaaaatgga

SEQ ID NO: 3858636 - DNA, 23 bp, Homo sapiens
tgtatagtaaagtgataatttct

SEQ ID NO: 3858637 - DNA, 21 bp, Homo sapiens
tgtatagtactggcatggtac

SEQ ID NO: 3858638 - DNA, 15 bp, Homo sapiens
tgtatagtgtaaaat

SEQ ID NO: 3858639 - DNA, 16 bp, Homo sapiens
tgtatatacaataaca

SEQ ID NO: 3858640 - DNA, 12 bp, Homo sapiens
tgtatatacata

SEQ ID NO: 3858641 - DNA, 20 bp, Homo sapiens
tgtatatacatattataaat

SEQ ID NO: 3858642 - DNA, 12 bp, Homo sapiens
tgtatatacatt

SEQ ID NO: 3858643 - DNA, 14 bp, Homo sapiens
tgtatatacatttc

SEQ ID NO: 3858644 - DNA, 17 bp, Homo sapiens
tgtatatatacatacac

SEQ ID NO: 3858645 - DNA, 18 bp, Homo sapiens
tgtatatatatatgtgtg

SEQ ID NO: 3858646 - DNA, 15 bp, Homo sapiens
tgtatatatgtgtat

SEQ ID NO: 3858647 - DNA, 19 bp, Homo sapiens
tgtatatatgtgtgtttaa

SEQ ID NO: 3858648 - DNA, 23 bp, Homo sapiens
tgtatattatggaagattttaaa

SEQ ID NO: 3858649 - DNA, 16 bp, Homo sapiens
tgtatattctggaaaa

SEQ ID NO: 3858650 - DNA, 21 bp, Homo sapiens
tgtatcaaatctgtatatgtt

SEQ ID NO: 3858651 - DNA, 16 bp, Homo sapiens
tgtatcatagaaatgt

SEQ ID NO: 3858652 - DNA, 20 bp, Homo sapiens
tgtatcccccccctgtatag

SEQ ID NO: 3858653 - DNA, 22 bp, Homo sapiens
tgtatcccccccctgtatagtt

SEQ ID NO: 3858654 - DNA, 15 bp, Homo sapiens
tgtatctacctcact

SEQ ID NO: 3858655 - DNA, 18 bp, Homo sapiens
tgtatctgaaggagattt

SEQ ID NO: 3858656 - DNA, 22 bp, Homo sapiens
tgtatgaaagatggctgtgcct

SEQ ID NO: 3858657 - DNA, 23 bp, Homo sapiens
tgtatggaaataaatgtatcata

SEQ ID NO: 3858658 - DNA, 19 bp, Homo sapiens
tgtatggaatacagtgtta

SEQ ID NO: 3858659 - DNA, 11 bp, Homo sapiens
tgtatgtatac

SEQ ID NO: 3858660 - DNA, 17 bp, Homo sapiens
tgtatgtatacacacat

SEQ ID NO: 3858661 - DNA, 23 bp, Homo sapiens
tgtatgtatacacacatatacat

SEQ ID NO: 3858662 - DNA, 13 bp, Homo sapiens
tgtatgtgaaagt

SEQ ID NO: 3858663 - DNA, 23 bp, Homo sapiens
tgtatgtgaaagtgtaaaataga

SEQ ID NO: 3858664 - DNA, 16 bp, Homo sapiens
tggggtacatttctct

SEQ ID NO: 3858665 - DNA, 20 bp, Homo sapiens
tggggtcaccaccctcccct

SEQ ID NO: 3858666 - DNA, 15 bp, Homo sapiens
tggggtcccagggaa

SEQ ID NO: 3858667 - DNA, 13 bp, Homo sapiens
tggggtctccctc

SEQ ID NO: 3858668 - DNA, 17 bp, Homo sapiens
tggggttcagcccctcc

SEQ ID NO: 3858669 - DNA, 21 bp, Homo sapiens
tggggttcagcccctcctctg

SEQ ID NO: 3858670 - DNA, 14 bp, Homo sapiens
tggggttcccccag

SEQ ID NO: 3858671 - DNA, 14 bp, Homo sapiens
tgggtaacgtgaga

SEQ ID NO: 3858672 - DNA, 22 bp, Homo sapiens
tgggtactactgctgcaaagtg

SEQ ID NO: 3858673 - DNA, 22 bp, Homo sapiens
tgggtattaaacttgtcagaat

SEQ ID NO: 3858674 - DNA, 22 bp, Homo sapiens
tgggtccaggaaggcagctgct

SEQ ID NO: 3858675 - DNA, 22 bp, Homo sapiens
tgggtccgccttaatctggaag

SEQ ID NO: 3858676 - DNA, 23 bp, Homo sapiens
tgggtcctgcaatctccagggct

SEQ ID NO: 3858677 - DNA, 21 bp, Homo sapiens
tgggtcgccctaccctcactc

SEQ ID NO: 3858678 - DNA, 22 bp, Homo sapiens
tgggtctcaatccttaacatat

SEQ ID NO: 3858679 - DNA, 13 bp, Homo sapiens
tgggtctcactcc

SEQ ID NO: 3858680 - DNA, 18 bp, Homo sapiens
tgggtctcactcctgagt

SEQ ID NO: 3858681 - DNA, 23 bp, Homo sapiens
tgggtgacggtcctttaggcagc

SEQ ID NO: 3858682 - DNA, 13 bp, Homo sapiens
tgggtgatcagaa

SEQ ID NO: 3858683 - DNA, 16 bp, Homo sapiens
tgggtgatcagaaggc

SEQ ID NO: 3858684 - DNA, 17 bp, Homo sapiens
tgggtgccattcccagc

SEQ ID NO: 3858685 - DNA, 19 bp, Homo sapiens
tgggtggctactctgtgcc

SEQ ID NO: 3858686 - DNA, 21 bp, Homo sapiens
tgggttatttttgtccctgct

SEQ ID NO: 3858687 - DNA, 18 bp, Homo sapiens
tgggttcactagagctgg

SEQ ID NO: 3858688 - DNA, 16 bp, Homo sapiens
tgggttcattccccgg

SEQ ID NO: 3858689 - DNA, 14 bp, Homo sapiens
tgggttgactttca

SEQ ID NO: 3858690 - DNA, 14 bp, Homo sapiens
tgggttgttctgga

SEQ ID NO: 3858691 - DNA, 17 bp, Homo sapiens
tgggtttgtattttaaa

SEQ ID NO: 3858692 - DNA, 14 bp, Homo sapiens
tgggttttatcagt

SEQ ID NO: 3858693 - DNA, 22 bp, Homo sapiens
tgggttttctaactgtaaatca

SEQ ID NO: 3858694 - DNA, 17 bp, Homo sapiens
tgggttttgtctctgca

SEQ ID NO: 3858695 - DNA, 14 bp, Homo sapiens
tggtaaattgtaaa

SEQ ID NO: 3858696 - DNA, 13 bp, Homo sapiens
tggtaagctctgg

SEQ ID NO: 3858697 - DNA, 14 bp, Homo sapiens
tggtaagctctggc

SEQ ID NO: 3858698 - DNA, 22 bp, Homo sapiens
tggtaatttaagattccagaga

SEQ ID NO: 3858699 - DNA, 23 bp, Homo sapiens
tggtactaagaggctatttaaaa

SEQ ID NO: 3858700 - DNA, 20 bp, Homo sapiens
tggtaggcttatcaaaatct

SEQ ID NO: 3858701 - DNA, 20 bp, Homo sapiens
tggtatatttgtgtatgtgt

SEQ ID NO: 3858702 - DNA, 15 bp, Homo sapiens
tggtatcaagaaagt

SEQ ID NO: 3858703 - DNA, 14 bp, Homo sapiens
tggtatgctggcca

SEQ ID NO: 3858704 - DNA, 17 bp, Homo sapiens
tggtatgctggccagca

SEQ ID NO: 3858705 - DNA, 22 bp, Homo sapiens
tggtatgctggccagcaccctc

SEQ ID NO: 3858706 - DNA, 21 bp, Homo sapiens
tggtcaaaccgcactcaccca

SEQ ID NO: 3858707 - DNA, 23 bp, Homo sapiens
tggtcaatacacataagaccgtg

SEQ ID NO: 3858708 - DNA, 20 bp, Homo sapiens
tggtcacaggactctgcctc

SEQ ID NO: 3858709 - DNA, 14 bp, Homo sapiens
tggtcaccatgaaa

SEQ ID NO: 3858710 - DNA, 17 bp, Homo sapiens
tggtcagtgtggagagg

SEQ ID NO: 3858711 - DNA, 15 bp, Homo sapiens
tggtccactcagggc

SEQ ID NO: 3858712 - DNA, 14 bp, Homo sapiens
tggtccagggttga

SEQ ID NO: 3858713 - DNA, 21 bp, Homo sapiens
tggtcccacatccctgggcct

SEQ ID NO: 3858714 - DNA, 13 bp, Homo sapiens
tggtccctcgtcc

SEQ ID NO: 3858715 - DNA, 12 bp, Homo sapiens
tggtccctgggg

SEQ ID NO: 3858716 - DNA, 11 bp, Homo sapiens
tggtccctggt

SEQ ID NO: 3858717 - DNA, 14 bp, Homo sapiens
tggtcctgagacct

SEQ ID NO: 3858718 - DNA, 20 bp, Homo sapiens
tggtcctgtgtgcagtgaag

SEQ ID NO: 3858719 - DNA, 23 bp, Homo sapiens
tggtctaggagctgtctccagga

SEQ ID NO: 3858720 - DNA, 13 bp, Homo sapiens
tggtctcctccca

SEQ ID NO: 3858721 - DNA, 21 bp, Homo sapiens
tggtctcctctgattatcagg

SEQ ID NO: 3858722 - DNA, 21 bp, Homo sapiens
tggtctccttgcactttctca

SEQ ID NO: 3858723 - DNA, 19 bp, Homo sapiens
tggtctctcgggcccccca

SEQ ID NO: 3858724 - DNA, 16 bp, Homo sapiens
tggtctgagcaccccc

SEQ ID NO: 3858725 - DNA, 22 bp, Homo sapiens
tggtctgaggggcaactgagtc

SEQ ID NO: 3858726 - DNA, 14 bp, Homo sapiens
tggtcttcactgcc

SEQ ID NO: 3858727 - DNA, 11 bp, Homo sapiens
tggtcttggaa

SEQ ID NO: 3858728 - DNA, 19 bp, Homo sapiens
tggtgactgaacgagggat

SEQ ID NO: 3858729 - DNA, 15 bp, Homo sapiens
tggtgactgtcccac

SEQ ID NO: 3858730 - DNA, 19 bp, Homo sapiens
tggtgactgtcccaccggg

SEQ ID NO: 3858731 - DNA, 23 bp, Homo sapiens
tggtgacttcctcgcctctccca

SEQ ID NO: 3858732 - DNA, 15 bp, Homo sapiens
tggtgagctgggaag

SEQ ID NO: 3858733 - DNA, 17 bp, Homo sapiens
tggtgaggcccagcctg

SEQ ID NO: 3858734 - DNA, 18 bp, Homo sapiens
tggtgaggcccagcctgt

SEQ ID NO: 3858735 - DNA, 21 bp, Homo sapiens
tggtgaggcccagcctgtcct

SEQ ID NO: 3858736 - DNA, 23 bp, Homo sapiens
tggtgaggcccagcctgtcctgg

SEQ ID NO: 3858737 - DNA, 17 bp, Homo sapiens
tggtgagggaagacgcc

SEQ ID NO: 3858738 - DNA, 17 bp, Homo sapiens
tggtgcccatcctcccg

SEQ ID NO: 3858739 - DNA, 18 bp, Homo sapiens
tggtgtagctcctctgct

SEQ ID NO: 3858740 - DNA, 21 bp, Homo sapiens
tggtgtccagacagagccctg

SEQ ID NO: 3858741 - DNA, 19 bp, Homo sapiens
tggtgtgaggctgggccag

SEQ ID NO: 3858742 - DNA, 13 bp, Homo sapiens
tggttagaaatgc

SEQ ID NO: 3858743 - DNA, 22 bp, Homo sapiens
tggttagtggggtaattctgct

SEQ ID NO: 3858744 - DNA, 13 bp, Homo sapiens
tggttccatgcct

SEQ ID NO: 3858745 - DNA, 17 bp, Homo sapiens
tggttccatgcctgagg

SEQ ID NO: 3858746 - DNA, 15 bp, Homo sapiens
tggttcccaataaaa

SEQ ID NO: 3858747 - DNA, 20 bp, Homo sapiens
tggttcccctgttcactcta

SEQ ID NO: 3858748 - DNA, 17 bp, Homo sapiens
tggttcctaagcctgtt

SEQ ID NO: 3858749 - DNA, 14 bp, Homo sapiens
tggttccttccctg

SEQ ID NO: 3858750 - DNA, 20 bp, Homo sapiens
tggttctcagatcttgacag

SEQ ID NO: 3858751 - DNA, 15 bp, Homo sapiens
tggttgactgggttt

SEQ ID NO: 3858752 - DNA, 17 bp, Homo sapiens
tggttgattcccagcat

SEQ ID NO: 3858753 - DNA, 17 bp, Homo sapiens
tggttgccttaaagaaa

SEQ ID NO: 3858754 - DNA, 12 bp, Homo sapiens
tggttgttgcca

SEQ ID NO: 3858755 - DNA, 11 bp, Homo sapiens
tggtttataga

SEQ ID NO: 3858756 - DNA, 11 bp, Homo sapiens
tggtttatgtc

SEQ ID NO: 3858757 - DNA, 21 bp, Homo sapiens
tggtttccacgatgaaaaact

SEQ ID NO: 3858758 - DNA, 20 bp, Homo sapiens
tggtttgatggtgacttcct

SEQ ID NO: 3858759 - DNA, 16 bp, Homo sapiens
tggtttggggagaaat

SEQ ID NO: 3858760 - DNA, 20 bp, Homo sapiens
tggtttgtcatatattcatg

SEQ ID NO: 3858761 - DNA, 23 bp, Homo sapiens
tgtaaaacaaaaatgtaatgatc

SEQ ID NO: 3858762 - DNA, 22 bp, Homo sapiens
tgtaaaacgagaatccacccat

SEQ ID NO: 3858763 - DNA, 14 bp, Homo sapiens
tgtaaaatagcttg

SEQ ID NO: 3858764 - DNA, 17 bp, Homo sapiens
tgtaaaatagcttgtat

SEQ ID NO: 3858765 - DNA, 21 bp, Homo sapiens
tgtaaaatagcttgtatagtg

SEQ ID NO: 3858766 - DNA, 21 bp, Homo sapiens
tgtaaaatcttggcacagaaa

SEQ ID NO: 3858767 - DNA, 22 bp, Homo sapiens
tgtaaaatcttggcacagaaac

SEQ ID NO: 3858768 - DNA, 15 bp, Homo sapiens
tgtaaaatgcagtcc

SEQ ID NO: 3858769 - DNA, 19 bp, Homo sapiens
tgtaaaatgcagtccagaa

SEQ ID NO: 3858770 - DNA, 22 bp, Homo sapiens
tgtaaaatgcagtccagaataa

SEQ ID NO: 3858771 - DNA, 20 bp, Homo sapiens
tgtaaactcaaaatatttgt

SEQ ID NO: 3858772 - DNA, 15 bp, Homo sapiens
tgtaaagaataaatg

SEQ ID NO: 3858773 - DNA, 13 bp, Homo sapiens
tgtaaaggtcaga

SEQ ID NO: 3858774 - DNA, 14 bp, Homo sapiens
tgtaaaggtcagag

SEQ ID NO: 3858775 - DNA, 18 bp, Homo sapiens
tgtaaagtatgtaaacag

SEQ ID NO: 3858776 - DNA, 10 bp, Homo sapiens
tgtaaataaa

SEQ ID NO: 3858777 - DNA, 18 bp, Homo sapiens
tgtaaataaatagatttg

SEQ ID NO: 3858778 - DNA, 21 bp, Homo sapiens
tgtaaatacaaaataaaatta

SEQ ID NO: 3858779 - DNA, 19 bp, Homo sapiens
tgtaaatacatgtgtggat

SEQ ID NO: 3858780 - DNA, 20 bp, Homo sapiens
tgtaaatacatgtgtggatg

SEQ ID NO: 3858781 - DNA, 15 bp, Homo sapiens
tgtaaatatccacag

SEQ ID NO: 3858782 - DNA, 13 bp, Homo sapiens
tgtaaatatttat

SEQ ID NO: 3858783 - DNA, 15 bp, Homo sapiens
tgtaaatcacttgta

SEQ ID NO: 3858784 - DNA, 17 bp, Homo sapiens
tgtaaatcacttgtaaa

SEQ ID NO: 3858785 - DNA, 22 bp, Homo sapiens
tgtaaatcctttttctttataa

SEQ ID NO: 3858786 - DNA, 20 bp, Homo sapiens
tgtaaatggagcttgtacat

SEQ ID NO: 3858787 - DNA, 20 bp, Homo sapiens
tgtaaattttgtatgaaaaa

SEQ ID NO: 3858788 - DNA, 15 bp, Homo sapiens
tgtaacacaagccac

SEQ ID NO: 3858789 - DNA, 24 bp, Homo sapiens
tgtaacacaagccacagaagccag

SEQ ID NO: 3858790 - DNA, 23 bp, Homo sapiens
tgtaacacagctgagagactttt

SEQ ID NO: 3858791 - DNA, 14 bp, Homo sapiens
tgtaacgcctgctt

SEQ ID NO: 3858792 - DNA, 16 bp, Homo sapiens
tgtaacttttgtaaga

SEQ ID NO: 3858793 - DNA, 15 bp, Homo sapiens
tgtaagaaaatttga

SEQ ID NO: 3858794 - DNA, 20 bp, Homo sapiens
tgtaagcattctgagctggg

SEQ ID NO: 3858795 - DNA, 22 bp, Homo sapiens
tgtaagcattctgagctgggct

SEQ ID NO: 3858796 - DNA, 13 bp, Homo sapiens
tgtaagggaaact

SEQ ID NO: 3858797 - DNA, 20 bp, Homo sapiens
tgtaagggtctgttgtaaat

SEQ ID NO: 3858798 - DNA, 18 bp, Homo sapiens
tgtaagtacccctgataa

SEQ ID NO: 3858799 - DNA, 15 bp, Homo sapiens
tgtaagttgtgtgca

SEQ ID NO: 3858800 - DNA, 20 bp, Homo sapiens
tgtaagttgtgtgcaacaaa

SEQ ID NO: 3858801 - DNA, 15 bp, Homo sapiens
tgtaagtttattttt

SEQ ID NO: 3858802 - DNA, 12 bp, Homo sapiens
tgtaataaaagg

SEQ ID NO: 3858803 - DNA, 16 bp, Homo sapiens
tgtaataaaggtcttt

SEQ ID NO: 3858804 - DNA, 13 bp, Homo sapiens
tgtaataagaaag

SEQ ID NO: 3858805 - DNA, 14 bp, Homo sapiens
tgtaataagaaagt

SEQ ID NO: 3858806 - DNA, 19 bp, Homo sapiens
tgtaatcctgtatattatg

SEQ ID NO: 3858807 - DNA, 17 bp, Homo sapiens
tgtaatgagaacttcaa

SEQ ID NO: 3858808 - DNA, 13 bp, Homo sapiens
tgtaatgatcata

SEQ ID NO: 3858809 - DNA, 13 bp, Homo sapiens
tgtaatgcacaat

SEQ ID NO: 3858810 - DNA, 16 bp, Homo sapiens
tgtaatgcacaattta

SEQ ID NO: 3858811 - DNA, 17 bp, Homo sapiens
tgtaatgcacaatttag

SEQ ID NO: 3858812 - DNA, 17 bp, Homo sapiens
tgtaatggaactgaccc

SEQ ID NO: 3858813 - DNA, 19 bp, Homo sapiens
tgtaatgtcaccaccttcc

SEQ ID NO: 3858814 - DNA, 23 bp, Homo sapiens
tgtaatgtcaccaccttcccagc

SEQ ID NO: 3858815 - DNA, 14 bp, Homo sapiens
tgtaattaagtgca

SEQ ID NO: 3858816 - DNA, 16 bp, Homo sapiens
tgtaattaatatcttg

SEQ ID NO: 3858817 - DNA, 22 bp, Homo sapiens
tgtaattatgaggtgaaacaat

SEQ ID NO: 3858818 - DNA, 16 bp, Homo sapiens
tgtaattgcttacatt

SEQ ID NO: 3858819 - DNA, 17 bp, Homo sapiens
tgtaattgcttacattt

SEQ ID NO: 3858820 - DNA, 15 bp, Homo sapiens
tgtaatttataaaat

SEQ ID NO: 3858821 - DNA, 17 bp, Homo sapiens
tgtaattttgtttgtaa

SEQ ID NO: 3858822 - DNA, 19 bp, Homo sapiens
tgtaattttgtttgtaatc

SEQ ID NO: 3858823 - DNA, 18 bp, Homo sapiens
tgtacaaaaacaaaacaa

SEQ ID NO: 3858824 - DNA, 21 bp, Homo sapiens
tgtacaaaatcgattggcttt

SEQ ID NO: 3858825 - DNA, 16 bp, Homo sapiens
tggcctcctgcctcta

SEQ ID NO: 3858826 - DNA, 14 bp, Homo sapiens
gccccagcgcggct

SEQ ID NO: 3858827 - DNA, 13 bp, Homo sapiens
gccccaggccctc

SEQ ID NO: 3858828 - DNA, 16 bp, Homo sapiens
gccccaggccctccct

SEQ ID NO: 3858829 - DNA, 14 bp, Homo sapiens
gccccaggcctctg

SEQ ID NO: 3858830 - DNA, 14 bp, Homo sapiens
gccccatgacctcc

SEQ ID NO: 3858831 - DNA, 15 bp, Homo sapiens
gccccatgctctgcc

SEQ ID NO: 3858832 - DNA, 18 bp, Homo sapiens
gccccatgctctgcccca

SEQ ID NO: 3858833 - DNA, 20 bp, Homo sapiens
gccccatgctctgccccaag

SEQ ID NO: 3858834 - DNA, 18 bp, Homo sapiens
gccccatgtctctcagaa

SEQ ID NO: 3858835 - DNA, 12 bp, Homo sapiens
gcccccaagcct

SEQ ID NO: 3858836 - DNA, 13 bp, Homo sapiens
gcccccacccagt

SEQ ID NO: 3858837 - DNA, 16 bp, Homo sapiens
gcccccaggtgccagt

SEQ ID NO: 3858838 - DNA, 18 bp, Homo sapiens
gcccccatcccacatgat

SEQ ID NO: 3858839 - DNA, 14 bp, Homo sapiens
gcccccatccctcg

SEQ ID NO: 3858840 - DNA, 17 bp, Homo sapiens
gcccccatctccccagg

SEQ ID NO: 3858841 - DNA, 21 bp, Homo sapiens
gccccccctcttttggccttg

SEQ ID NO: 3858842 - DNA, 15 bp, Homo sapiens
gcccccctccaggca

SEQ ID NO: 3858843 - DNA, 23 bp, Homo sapiens
gccccctcatctcactgcccagt

SEQ ID NO: 3858844 - DNA, 13 bp, Homo sapiens
gccccctgtgcca

SEQ ID NO: 3858845 - DNA, 15 bp, Homo sapiens
gccccctgtgccagc

SEQ ID NO: 3858846 - DNA, 16 bp, Homo sapiens
gccccctgtgccagct

SEQ ID NO: 3858847 - DNA, 19 bp, Homo sapiens
gccccctgtgccagctcag

SEQ ID NO: 3858848 - DNA, 20 bp, Homo sapiens
gccccctgtgccagctcagg

SEQ ID NO: 3858849 - DNA, 22 bp, Homo sapiens
gccccctgtgccagctcaggtg

SEQ ID NO: 3858850 - DNA, 19 bp, Homo sapiens
gccccgcttgtccagcgcc

SEQ ID NO: 3858851 - DNA, 23 bp, Homo sapiens
gccccggacggacgttggttctg

SEQ ID NO: 3858852 - DNA, 21 bp, Homo sapiens
gccccgggctctggccaccct

SEQ ID NO: 3858853 - DNA, 15 bp, Homo sapiens
gccccggggctggca

SEQ ID NO: 3858854 - DNA, 17 bp, Homo sapiens
gccccggggctggcaag

SEQ ID NO: 3858855 - DNA, 17 bp, Homo sapiens
gccccgggtgcctcaga

SEQ ID NO: 3858856 - DNA, 18 bp, Homo sapiens
gccccgggtgcctcagag

SEQ ID NO: 3858857 - DNA, 14 bp, Homo sapiens
gcccctcagccctt

SEQ ID NO: 3858858 - DNA, 15 bp, Homo sapiens
gcccctcagcccttg

SEQ ID NO: 3858859 - DNA, 16 bp, Homo sapiens
gcccctcagcccttgc

SEQ ID NO: 3858860 - DNA, 15 bp, Homo sapiens
gcccctccacgcctc

SEQ ID NO: 3858861 - DNA, 17 bp, Homo sapiens
gcccctccagaccctgc

SEQ ID NO: 3858862 - DNA, 22 bp, Homo sapiens
gcccctccagagacaggaaaga

SEQ ID NO: 3858863 - DNA, 19 bp, Homo sapiens
gcccctccctctgccccaa

SEQ ID NO: 3858864 - DNA, 21 bp, Homo sapiens
gcccctccctctgccccaagc

SEQ ID NO: 3858865 - DNA, 13 bp, Homo sapiens
gcccctccctgct

SEQ ID NO: 3858866 - DNA, 15 bp, Homo sapiens
gcccctcccttcaac

SEQ ID NO: 3858867 - DNA, 14 bp, Homo sapiens
gcccctcctctgcc

SEQ ID NO: 3858868 - DNA, 17 bp, Homo sapiens
gcccctcctctgccacc

SEQ ID NO: 3858869 - DNA, 22 bp, Homo sapiens
gcccctcctctgccacctcccc

SEQ ID NO: 3858870 - DNA, 23 bp, Homo sapiens
gcccctcctctgccacctcccct

SEQ ID NO: 3858871 - DNA, 22 bp, Homo sapiens
gcccctctccaaacaccggcag

SEQ ID NO: 3858872 - DNA, 16 bp, Homo sapiens
gcccctgaggactgga

SEQ ID NO: 3858873 - DNA, 15 bp, Homo sapiens
gcccctgggatggga

SEQ ID NO: 3858874 - DNA, 22 bp, Homo sapiens
gcccctgggatgggaccaggga

SEQ ID NO: 3858875 - DNA, 20 bp, Homo sapiens
ttcaagagaagaaaaaatta

SEQ ID NO: 3858876 - DNA, 21 bp, Homo sapiens
ttcaagattggacatggtctc

SEQ ID NO: 3858877 - DNA, 12 bp, Homo sapiens
ttcaagccatgg

SEQ ID NO: 3858878 - DNA, 20 bp, Homo sapiens
ttcaagcctgtgggagtaga

SEQ ID NO: 3858879 - DNA, 14 bp, Homo sapiens
ttcaaggtgtaaaa

SEQ ID NO: 3858880 - DNA, 19 bp, Homo sapiens
ttcaagtgatatatgtatt

SEQ ID NO: 3858881 - DNA, 13 bp, Homo sapiens
ttcaataaagctg

SEQ ID NO: 3858882 - DNA, 20 bp, Homo sapiens
ttcaatgtttttaaaaatct

SEQ ID NO: 3858883 - DNA, 15 bp, Homo sapiens
ttcaattgtatttta

SEQ ID NO: 3858884 - DNA, 15 bp, Homo sapiens
ttcaatttaaaggtt

SEQ ID NO: 3858885 - DNA, 17 bp, Homo sapiens
ttcacacctcacgctct

SEQ ID NO: 3858886 - DNA, 20 bp, Homo sapiens
ttcacacctcacgctctgga

SEQ ID NO: 3858887 - DNA, 18 bp, Homo sapiens
ttcacaggtgtggtgtaa

SEQ ID NO: 3858888 - DNA, 23 bp, Homo sapiens
ttcacaggttctgcgttacaaca

SEQ ID NO: 3858889 - DNA, 12 bp, Homo sapiens
ttcacagtgttt

SEQ ID NO: 3858890 - DNA, 22 bp, Homo sapiens
ttcacagtgtttcgacagctga

SEQ ID NO: 3858891 - DNA, 17 bp, Homo sapiens
ttcacataccctccccc

SEQ ID NO: 3858892 - DNA, 15 bp, Homo sapiens
ttcacatccaatgca

SEQ ID NO: 3858893 - DNA, 22 bp, Homo sapiens
ttcacattaatatttgctgaca

SEQ ID NO: 3858894 - DNA, 18 bp, Homo sapiens
ttcacatttgatgtacat

SEQ ID NO: 3858895 - DNA, 20 bp, Homo sapiens
ttcacatttgatgtacatgt

SEQ ID NO: 3858896 - DNA, 23 bp, Homo sapiens
ttcaccaaatgatgccacttccc

SEQ ID NO: 3858897 - DNA, 19 bp, Homo sapiens
ttcaccagcaactctgact

SEQ ID NO: 3858898 - DNA, 17 bp, Homo sapiens
ttcacccctgcacttca

SEQ ID NO: 3858899 - DNA, 15 bp, Homo sapiens
ttcaccttatgtatt

SEQ ID NO: 3858900 - DNA, 20 bp, Homo sapiens
ttcaccttatgtattatttt

SEQ ID NO: 3858901 - DNA, 16 bp, Homo sapiens
ttcacctttggtgcag

SEQ ID NO: 3858902 - DNA, 21 bp, Homo sapiens
ttcacgggaactctccaaata

SEQ ID NO: 3858903 - DNA, 12 bp, Homo sapiens
ttcactcagcca

SEQ ID NO: 3858904 - DNA, 13 bp, Homo sapiens
ttcactgctggct

SEQ ID NO: 3858905 - DNA, 18 bp, Homo sapiens
ttcactgctggctgcctt

SEQ ID NO: 3858906 - DNA, 20 bp, Homo sapiens
ttcactgtaagactcattcc

SEQ ID NO: 3858907 - DNA, 22 bp, Homo sapiens
ttcactgtagaatgatttcatg

SEQ ID NO: 3858908 - DNA, 15 bp, Homo sapiens
cctgagcctgccgag

SEQ ID NO: 3858909 - DNA, 20 bp, Homo sapiens
cctgagcctgccgagcaacc

SEQ ID NO: 3858910 - DNA, 23 bp, Homo sapiens
cctgagcctgccgagcaaccgtg

SEQ ID NO: 3858911 - DNA, 14 bp, Homo sapiens
cctgagctggggcc

SEQ ID NO: 3858912 - DNA, 16 bp, Homo sapiens
cctgagctggggccac

SEQ ID NO: 3858913 - DNA, 16 bp, Homo sapiens
cctgaggactggagac

SEQ ID NO: 3858914 - DNA, 17 bp, Homo sapiens
cctgaggactggagacc

SEQ ID NO: 3858915 - DNA, 16 bp, Homo sapiens
cctgaggagtctgagg

SEQ ID NO: 3858916 - DNA, 17 bp, Homo sapiens
cctgaggagtctgaggt

SEQ ID NO: 3858917 - DNA, 20 bp, Homo sapiens
cctgaggagtctgaggtcct

SEQ ID NO: 3858918 - DNA, 19 bp, Homo sapiens
cctgaggctcaagaggccc

SEQ ID NO: 3858919 - DNA, 21 bp, Homo sapiens
cctgaggctcaagaggcccag

SEQ ID NO: 3858920 - DNA, 23 bp, Homo sapiens
cctgaggctcaagaggcccaggg

SEQ ID NO: 3858921 - DNA, 13 bp, Homo sapiens
cctgagggtggag

SEQ ID NO: 3858922 - DNA, 15 bp, Homo sapiens
cctgagggtggagac

SEQ ID NO: 3858923 - DNA, 22 bp, Homo sapiens
cctgagtaccttctacaggccc

SEQ ID NO: 3858924 - DNA, 23 bp, Homo sapiens
cctgagtaccttctacaggcccg

SEQ ID NO: 3858925 - DNA, 21 bp, Homo sapiens
cctgagtagctgggattacag

SEQ ID NO: 3858926 - DNA, 17 bp, Homo sapiens
cctgagtcaactggagc

SEQ ID NO: 3858927 - DNA, 14 bp, Homo sapiens
cctgagtcactggt

SEQ ID NO: 3858928 - DNA, 14 bp, Homo sapiens
cctgagtcggcccc

SEQ ID NO: 3858929 - DNA, 18 bp, Homo sapiens
cctgagtcggccccacat

SEQ ID NO: 3858930 - DNA, 21 bp, Homo sapiens
cctgagtcggccccacatggg

SEQ ID NO: 3858931 - DNA, 14 bp, Homo sapiens
cctgagtctcctgt

SEQ ID NO: 3858932 - DNA, 15 bp, Homo sapiens
cctgagtctcctgtg

SEQ ID NO: 3858933 - DNA, 18 bp, Homo sapiens
cctgagtctcctgtgccc

SEQ ID NO: 3858934 - DNA, 14 bp, Homo sapiens
cctgagtcttggcc

SEQ ID NO: 3858935 - DNA, 17 bp, Homo sapiens
cctgagtcttggcctgc

SEQ ID NO: 3858936 - DNA, 18 bp, Homo sapiens
cctgagtcttggcctgcc

SEQ ID NO: 3858937 - DNA, 19 bp, Homo sapiens
cctgagtgctttaccttta

SEQ ID NO: 3858938 - DNA, 23 bp, Homo sapiens
cctgagtggatctccaaggacca

SEQ ID NO: 3858939 - DNA, 22 bp, Homo sapiens
cctgataaacattaaacactgt

SEQ ID NO: 3858940 - DNA, 20 bp, Homo sapiens
cctgatcaagtcaccggagc

SEQ ID NO: 3858941 - DNA, 23 bp, Homo sapiens
cctgatcacctctggctttgtct

SEQ ID NO: 3858942 - DNA, 15 bp, Homo sapiens
cctgatcatggtcag

SEQ ID NO: 3858943 - DNA, 22 bp, Homo sapiens
cctgatcatggtcagctcacac

SEQ ID NO: 3858944 - DNA, 13 bp, Homo sapiens
cctgatgacagag

SEQ ID NO: 3858945 - DNA, 16 bp, Homo sapiens
cctgatgacagagcga

SEQ ID NO: 3858946 - DNA, 16 bp, Homo sapiens
cctgatgctcatatca

SEQ ID NO: 3858947 - DNA, 13 bp, Homo sapiens
cctgatgctgccc

SEQ ID NO: 3858948 - DNA, 21 bp, Homo sapiens
cctgatggccaagggggtgga

SEQ ID NO: 3858949 - DNA, 14 bp, Homo sapiens
cctgatttcaggga

SEQ ID NO: 3858950 - DNA, 16 bp, Homo sapiens
cctgatttcagggaaa

SEQ ID NO: 3858951 - DNA, 15 bp, Homo sapiens
cctgcaaaaatataa

SEQ ID NO: 3858952 - DNA, 15 bp, Homo sapiens
cctgcaaactcactg

SEQ ID NO: 3858953 - DNA, 16 bp, Homo sapiens
cctgcaaactcactgc

SEQ ID NO: 3858954 - DNA, 23 bp, Homo sapiens
cctgcacaaagcccttccatgtc

SEQ ID NO: 3858955 - DNA, 13 bp, Homo sapiens
cctgcaccctgga

SEQ ID NO: 3858956 - DNA, 17 bp, Homo sapiens
cctgcacctccccccac

SEQ ID NO: 3858957 - DNA, 19 bp, Homo sapiens
cctgcacctccccccactg

SEQ ID NO: 3858958 - DNA, 21 bp, Homo sapiens
cctgcacctccccccactgca

SEQ ID NO: 3858959 - DNA, 13 bp, Homo sapiens
cctgcactccaga

SEQ ID NO: 3858960 - DNA, 14 bp, Homo sapiens
cctgcagaccctgc

SEQ ID NO: 3858961 - DNA, 13 bp, Homo sapiens
cctgcagagagaa

SEQ ID NO: 3858962 - DNA, 15 bp, Homo sapiens
cctgcagagctatgg

SEQ ID NO: 3858963 - DNA, 16 bp, Homo sapiens
cctgcagaggaccaca

SEQ ID NO: 3858964 - DNA, 15 bp, Homo sapiens
cctgcagcctcctcc

SEQ ID NO: 3858965 - DNA, 12 bp, Homo sapiens
cctgcagcttgt

SEQ ID NO: 3858966 - DNA, 19 bp, Homo sapiens
cctgcaggaacgagcactg

SEQ ID NO: 3858967 - DNA, 21 bp, Homo sapiens
cctgcaggaacgagcactggc

SEQ ID NO: 3858968 - DNA, 22 bp, Homo sapiens
cctgcaggaacgagcactggcc

SEQ ID NO: 3858969 - DNA, 14 bp, Homo sapiens
cctgcagttcctga

SEQ ID NO: 3858970 - DNA, 15 bp, Homo sapiens
cctgcagttcctgag

SEQ ID NO: 3858971 - DNA, 19 bp, Homo sapiens
cctgcatcatgacaaagtt

SEQ ID NO: 3858972 - DNA, 18 bp, Homo sapiens
cctgcatccccttggctg

SEQ ID NO: 3858973 - DNA, 22 bp, Homo sapiens
cctgcatccgtagttccctgaa

SEQ ID NO: 3858974 - DNA, 23 bp, Homo sapiens
cctgcatttgtgaaatgatggtg

SEQ ID NO: 3858975 - DNA, 16 bp, Homo sapiens
cctgccacctgtctgt

SEQ ID NO: 3858976 - DNA, 14 bp, Homo sapiens
cctgccagccatca

SEQ ID NO: 3858977 - DNA, 12 bp, Homo sapiens
cctgccaggagg

SEQ ID NO: 3858978 - DNA, 13 bp, Homo sapiens
cctgccagtgcct

SEQ ID NO: 3858979 - DNA, 20 bp, Homo sapiens
cctgccagtgccttacctcc

SEQ ID NO: 3858980 - DNA, 21 bp, Homo sapiens
cctgcccaatgctttgggagg

SEQ ID NO: 3858981 - DNA, 22 bp, Homo sapiens
cctgcccaatgctttgggaggc

SEQ ID NO: 3858982 - DNA, 19 bp, Homo sapiens
cctgcccacttagccgtcc

SEQ ID NO: 3858983 - DNA, 16 bp, Homo sapiens
cctgcccatgggagct

SEQ ID NO: 3858984 - DNA, 14 bp, Homo sapiens
cctgccccaactcc

SEQ ID NO: 3858985 - DNA, 17 bp, Homo sapiens
cctgccccaactccttc

SEQ ID NO: 3858986 - DNA, 12 bp, Homo sapiens
cctgccccagcg

SEQ ID NO: 3858987 - DNA, 14 bp, Homo sapiens
cctgccccagcgcg

SEQ ID NO: 3858988 - DNA, 22 bp, Homo sapiens
cctgcccccagaccttttatcc

SEQ ID NO: 3858989 - DNA, 20 bp, Homo sapiens
cctgcccccgacagcccagc

SEQ ID NO: 3858990 - DNA, 22 bp, Homo sapiens
cctgcccccgacagcccagcct

SEQ ID NO: 3858991 - DNA, 14 bp, Homo sapiens
cctgcccctccctt

SEQ ID NO: 3858992 - DNA, 14 bp, Homo sapiens
cctgccctcaggga

SEQ ID NO: 3858993 - DNA, 24 bp, Homo sapiens
cctgccctcccatgttgcatgcct

SEQ ID NO: 3858994 - DNA, 13 bp, Homo sapiens
cctgccctctctc

SEQ ID NO: 3858995 - DNA, 12 bp, Homo sapiens
cctgccctgcca

SEQ ID NO: 3858996 - DNA, 15 bp, Homo sapiens
cctgccctgccacct

SEQ ID NO: 3858997 - DNA, 17 bp, Homo sapiens
cctgccctgccacctgt

SEQ ID NO: 3858998 - DNA, 16 bp, Homo sapiens
cctgccctgccctgcc

SEQ ID NO: 3858999 - DNA, 22 bp, Homo sapiens
cctgcctcccagccctgccagg

SEQ ID NO: 3859000 - DNA, 23 bp, Homo sapiens
cctgcctcccagccctgccagga

SEQ ID NO: 3859001 - DNA, 12 bp, Homo sapiens
cctgcctccctt

SEQ ID NO: 3859002 - DNA, 12 bp, Homo sapiens
cctgcctctact

SEQ ID NO: 3859003 - DNA, 21 bp, Homo sapiens
cctgcctctactgggaaggct

SEQ ID NO: 3859004 - DNA, 18 bp, Homo sapiens
cctgcctctctgctccag

SEQ ID NO: 3859005 - DNA, 20 bp, Homo sapiens
cctgcctctctgctccagag

SEQ ID NO: 3859006 - DNA, 14 bp, Homo sapiens
cctgcctgagccca

SEQ ID NO: 3859007 - DNA, 23 bp, Homo sapiens
cctgcctgataccctgcttggtc

SEQ ID NO: 3859008 - DNA, 14 bp, Homo sapiens
cctgcctgcccact

SEQ ID NO: 3859009 - DNA, 14 bp, Homo sapiens
cctgcctggaggac

SEQ ID NO: 3859010 - DNA, 17 bp, Homo sapiens
cctgcctggaggacctg

SEQ ID NO: 3859011 - DNA, 19 bp, Homo sapiens
cctgcctggaggacctgag

SEQ ID NO: 3859012 - DNA, 22 bp, Homo sapiens
cctgcctggaggacctgagcct

SEQ ID NO: 3859013 - DNA, 13 bp, Homo sapiens
cctgcctgtgcat

SEQ ID NO: 3859014 - DNA, 19 bp, Homo sapiens
cctgcggccgggctgccct

SEQ ID NO: 3859015 - DNA, 23 bp, Homo sapiens
cctgcgtcgaagctttgaaggcc

SEQ ID NO: 3859016 - DNA, 22 bp, Homo sapiens
cctgcgtgccgggagaggactc

SEQ ID NO: 3859017 - DNA, 15 bp, Homo sapiens
cctgcgttggagcca

SEQ ID NO: 3859018 - DNA, 17 bp, Homo sapiens
cctgcgttggagccact

SEQ ID NO: 3859019 - DNA, 16 bp, Homo sapiens
  misc_feature (6)..(6): n is a, c, g or t
cctgcnttgtccctgg

SEQ ID NO: 3859020 - DNA, 13 bp, Homo sapiens
cctgctaatagct

SEQ ID NO: 3859021 - DNA, 18 bp, Homo sapiens
cctgctaccaaggcccag

SEQ ID NO: 3859022 - DNA, 14 bp, Homo sapiens
cctgctagagcaac

SEQ ID NO: 3859023 - DNA, 19 bp, Homo sapiens
cctgctagagcaacccctg

SEQ ID NO: 3859024 - DNA, 19 bp, Homo sapiens
cctctgtgtccttccctgc

SEQ ID NO: 3859025 - DNA, 20 bp, Homo sapiens
cctctgtgtccttccctgca

SEQ ID NO: 3859026 - DNA, 19 bp, Homo sapiens
cctcttaaagctgcctgta

SEQ ID NO: 3859027 - DNA, 22 bp, Homo sapiens
cctcttaaagctgcctgtagtt

SEQ ID NO: 3859028 - DNA, 18 bp, Homo sapiens
cctcttaccgtagcctcc

SEQ ID NO: 3859029 - DNA, 13 bp, Homo sapiens
cctcttcctcctg

SEQ ID NO: 3859030 - DNA, 12 bp, Homo sapiens
cctcttctcttc

SEQ ID NO: 3859031 - DNA, 16 bp, Homo sapiens
cctcttctcttcctgt

SEQ ID NO: 3859032 - DNA, 17 bp, Homo sapiens
cctcttctcttcctgta

SEQ ID NO: 3859033 - DNA, 15 bp, Homo sapiens
cctcttcttcttcag

SEQ ID NO: 3859034 - DNA, 17 bp, Homo sapiens
cctcttggacctctgct

SEQ ID NO: 3859035 - DNA, 18 bp, Homo sapiens
cctcttggacctctgctc

SEQ ID NO: 3859036 - DNA, 19 bp, Homo sapiens
cctcttggacctctgctct

SEQ ID NO: 3859037 - DNA, 15 bp, Homo sapiens
cctcttgttgcagag

SEQ ID NO: 3859038 - DNA, 15 bp, Homo sapiens
cctctttgcatggaa

SEQ ID NO: 3859039 - DNA, 14 bp, Homo sapiens
cctcttttggcctt

SEQ ID NO: 3859040 - DNA, 15 bp, Homo sapiens
cctcttttggccttg

SEQ ID NO: 3859041 - DNA, 13 bp, Homo sapiens
cctgaacaagaat

SEQ ID NO: 3859042 - DNA, 17 bp, Homo sapiens
cctgaacaagaattgga

SEQ ID NO: 3859043 - DNA, 21 bp, Homo sapiens
cctgaacaagaattggaagct

SEQ ID NO: 3859044 - DNA, 13 bp, Homo sapiens
cctgaaccacagc

SEQ ID NO: 3859045 - DNA, 14 bp, Homo sapiens
cctgaaccacagcg

SEQ ID NO: 3859046 - DNA, 17 bp, Homo sapiens
cctgaaccccatgggct

SEQ ID NO: 3859047 - DNA, 15 bp, Homo sapiens
cctgaacctcagttt

SEQ ID NO: 3859048 - DNA, 16 bp, Homo sapiens
cctgaacctcagtttc

SEQ ID NO: 3859049 - DNA, 17 bp, Homo sapiens
cctgaacctcagtttcc

SEQ ID NO: 3859050 - DNA, 18 bp, Homo sapiens
cctgaagacttacttatt

SEQ ID NO: 3859051 - DNA, 22 bp, Homo sapiens
cctgaagcctctgccctgcctc

SEQ ID NO: 3859052 - DNA, 22 bp, Homo sapiens
cctgaagggtgacatcccagga

SEQ ID NO: 3859053 - DNA, 23 bp, Homo sapiens
cctgaatggttccatgcctgagg

SEQ ID NO: 3859054 - DNA, 23 bp, Homo sapiens
cctgaatgtattgaacttggaaa

SEQ ID NO: 3859055 - DNA, 15 bp, Homo sapiens
cctgaattattccaa

SEQ ID NO: 3859056 - DNA, 14 bp, Homo sapiens
cctgacaatggcag

SEQ ID NO: 3859057 - DNA, 18 bp, Homo sapiens
cctgacaatggcagctag

SEQ ID NO: 3859058 - DNA, 21 bp, Homo sapiens
cctgacaccgtccctcagtga

SEQ ID NO: 3859059 - DNA, 20 bp, Homo sapiens
cctgacagatgtcagccgag

SEQ ID NO: 3859060 - DNA, 20 bp, Homo sapiens
cctgaccaacagttccttca

SEQ ID NO: 3859061 - DNA, 15 bp, Homo sapiens
cctgaccctccctac

SEQ ID NO: 3859062 - DNA, 17 bp, Homo sapiens
cctgaccctccctacct

SEQ ID NO: 3859063 - DNA, 18 bp, Homo sapiens
cctgaccctccctacctg

SEQ ID NO: 3859064 - DNA, 21 bp, Homo sapiens
cctgaccctcctccactccac

SEQ ID NO: 3859065 - DNA, 15 bp, Homo sapiens
cctgaccggcacctg

SEQ ID NO: 3859066 - DNA, 18 bp, Homo sapiens
cctgaccggcacctgcga

SEQ ID NO: 3859067 - DNA, 16 bp, Homo sapiens
cctgactccagtgagc

SEQ ID NO: 3859068 - DNA, 19 bp, Homo sapiens
cctgactccagtgagctgg

SEQ ID NO: 3859069 - DNA, 15 bp, Homo sapiens
cctgactccctgtgg

SEQ ID NO: 3859070 - DNA, 21 bp, Homo sapiens
cctgactccctgtgggggtgg

SEQ ID NO: 3859071 - DNA, 15 bp, Homo sapiens
cctgactcctctaag

SEQ ID NO: 3859072 - DNA, 14 bp, Homo sapiens
cctgagaaggcgag

SEQ ID NO: 3859073 - DNA, 21 bp, Homo sapiens
cctgagaccagttgggagcac

SEQ ID NO: 3859074 - DNA, 18 bp, Homo sapiens
cctgagaccatttaacat

SEQ ID NO: 3859075 - DNA, 20 bp, Homo sapiens
cctgagacctcgccggcctt

SEQ ID NO: 3859076 - DNA, 20 bp, Homo sapiens
cctgagagaaactgaggtca

SEQ ID NO: 3859077 - DNA, 16 bp, Homo sapiens
cctgagagctcacagt

SEQ ID NO: 3859078 - DNA, 19 bp, Homo sapiens
cctgagcccagggaggccg

SEQ ID NO: 3859079 - DNA, 18 bp, Homo sapiens
agcctgttcatggcagat

SEQ ID NO: 3859080 - DNA, 14 bp, Homo sapiens
agcctgttggaccc

SEQ ID NO: 3859081 - DNA, 18 bp, Homo sapiens
agcctgttttgttggaag

SEQ ID NO: 3859082 - DNA, 18 bp, Homo sapiens
agccttaatcaggtcctc

SEQ ID NO: 3859083 - DNA, 17 bp, Homo sapiens
agccttcttttcaaaac

SEQ ID NO: 3859084 - DNA, 18 bp, Homo sapiens
agccttgcactgtggggg

SEQ ID NO: 3859085 - DNA, 20 bp, Homo sapiens
agccttgccttttaaaagaa

SEQ ID NO: 3859086 - DNA, 19 bp, Homo sapiens
agccttggataatgctgtt

SEQ ID NO: 3859087 - DNA, 16 bp, Homo sapiens
agccttggtgtccacc

SEQ ID NO: 3859088 - DNA, 19 bp, Homo sapiens
agccttggtgtccacctgg

SEQ ID NO: 3859089 - DNA, 21 bp, Homo sapiens
agccttggtgtccacctggcc

SEQ ID NO: 3859090 - DNA, 13 bp, Homo sapiens
agccttgtgccct

SEQ ID NO: 3859091 - DNA, 15 bp, Homo sapiens
agccttgtgccctgc

SEQ ID NO: 3859092 - DNA, 16 bp, Homo sapiens
agcctttgccctgtca

SEQ ID NO: 3859093 - DNA, 21 bp, Homo sapiens
agcctttttttagtaaatcct

SEQ ID NO: 3859094 - DNA, 12 bp, Homo sapiens
agcgaaactccg

SEQ ID NO: 3859095 - DNA, 20 bp, Homo sapiens
agcgaagggggtcaaaggaa

SEQ ID NO: 3859096 - DNA, 23 bp, Homo sapiens
agcgagacccttgcattagaaac

SEQ ID NO: 3859097 - DNA, 22 bp, Homo sapiens
agcgaggtcaacagagaaggca

SEQ ID NO: 3859098 - DNA, 23 bp, Homo sapiens
agcgaggtcaacagagaaggcag

SEQ ID NO: 3859099 - DNA, 18 bp, Homo sapiens
agcgatggtctcagaaac

SEQ ID NO: 3859100 - DNA, 21 bp, Homo sapiens
agcgcagccgccgggcaggcc

SEQ ID NO: 3859101 - DNA, 23 bp, Homo sapiens
agcgcagccgccgggcaggcctg

SEQ ID NO: 3859102 - DNA, 14 bp, Homo sapiens
agcgcagggaggat

SEQ ID NO: 3859103 - DNA, 18 bp, Homo sapiens
agcgcagggaggatgcca

SEQ ID NO: 3859104 - DNA, 19 bp, Homo sapiens
agcgcagggaggatgccac

SEQ ID NO: 3859105 - DNA, 17 bp, Homo sapiens
agcgccctgcagaccct

SEQ ID NO: 3859106 - DNA, 18 bp, Homo sapiens
agcgccctgcagaccctg

SEQ ID NO: 3859107 - DNA, 23 bp, Homo sapiens
agcgccctgcagaccctgccctt

SEQ ID NO: 3859108 - DNA, 21 bp, Homo sapiens
agcgccctggagtcccctggg

SEQ ID NO: 3859109 - DNA, 20 bp, Homo sapiens
agcgcctgccctccctgggg

SEQ ID NO: 3859110 - DNA, 21 bp, Homo sapiens
agcgcctgccctccctggggt

SEQ ID NO: 3859111 - DNA, 20 bp, Homo sapiens
agcgcctgtgctgaggactc

SEQ ID NO: 3859112 - DNA, 17 bp, Homo sapiens
agcgcggcttggccgcc

SEQ ID NO: 3859113 - DNA, 18 bp, Homo sapiens
agcgcggcttggccgcca

SEQ ID NO: 3859114 - DNA, 14 bp, Homo sapiens
agcgcgggcggagg

SEQ ID NO: 3859115 - DNA, 16 bp, Homo sapiens
agcgcgggcggaggcg

SEQ ID NO: 3859116 - DNA, 17 bp, Homo sapiens
agcgctatcttcacata

SEQ ID NO: 3859117 - DNA, 20 bp, Homo sapiens
agcgctctcttccagaagat

SEQ ID NO: 3859118 - DNA, 19 bp, Homo sapiens
agcgctgccgcaccccaga

SEQ ID NO: 3859119 - DNA, 21 bp, Homo sapiens
agcgctgccgcaccccagagt

SEQ ID NO: 3859120 - DNA, 15 bp, Homo sapiens
agcgctggctcagga

SEQ ID NO: 3859121 - DNA, 16 bp, Homo sapiens
agcgctggctcaggaa

SEQ ID NO: 3859122 - DNA, 19 bp, Homo sapiens
agcggctgagtcatgatct

SEQ ID NO: 3859123 - DNA, 17 bp, Homo sapiens
ttcaagaaaaaataaat

SEQ ID NO: 3859124 - DNA, 12 bp, Homo sapiens
ttcaagaaactg

SEQ ID NO: 3859125 - DNA, 22 bp, Homo sapiens
ttcaagaaagcttcaaactgca

SEQ ID NO: 3859126 - DNA, 14 bp, Homo sapiens
ttcaagagaagaaa

SEQ ID NO: 3859127 - DNA, 16 bp, Homo sapiens
ttcaagagaagaaaaa

SEQ ID NO: 3859128 - DNA, 21 bp, Homo sapiens
ttcaagagtgcagttgattct

SEQ ID NO: 3859129 - DNA, 15 bp, Homo sapiens
ttcaagcctgtggga

SEQ ID NO: 3859130 - DNA, 12 bp, Homo sapiens
ttcaaggaaagt

SEQ ID NO: 3859131 - DNA, 14 bp, Homo sapiens
ttcaaggaaagtga

SEQ ID NO: 3859132 - DNA, 16 bp, Homo sapiens
ttcaagggaagaaaca

SEQ ID NO: 3859133 - DNA, 17 bp, Homo sapiens
ttcaaggtggccaaatt

SEQ ID NO: 3859134 - DNA, 18 bp, Homo sapiens
ttcaaggtggccaaatta

SEQ ID NO: 3859135 - DNA, 20 bp, Homo sapiens
ttcaaggtggccaaattatt

SEQ ID NO: 3859136 - DNA, 20 bp, Homo sapiens
ttcaagtgcctcttgttgca

SEQ ID NO: 3859137 - DNA, 21 bp, Homo sapiens
ttcaagtgttgctcttggaaa

SEQ ID NO: 3859138 - DNA, 12 bp, Homo sapiens
ttcaatgcaaag

SEQ ID NO: 3859139 - DNA, 19 bp, Homo sapiens
ttcaattcagtgctgtact

SEQ ID NO: 3859140 - DNA, 13 bp, Homo sapiens
ttcaattgtattt

SEQ ID NO: 3859141 - DNA, 20 bp, Homo sapiens
ttcaattgtattttatatga

SEQ ID NO: 3859142 - DNA, 14 bp, Homo sapiens
ttcacaaaatgcaa

SEQ ID NO: 3859143 - DNA, 15 bp, Homo sapiens
ttcacacaggtcctg

SEQ ID NO: 3859144 - DNA, 23 bp, Homo sapiens
ttcacacctcacgctctggacat

SEQ ID NO: 3859145 - DNA, 21 bp, Homo sapiens
ttcacactgcaagagccttgg

SEQ ID NO: 3859146 - DNA, 20 bp, Homo sapiens
ttcacaggtgtggtgtaatt

SEQ ID NO: 3859147 - DNA, 20 bp, Homo sapiens
ttcacattaatggtctaaaa

SEQ ID NO: 3859148 - DNA, 18 bp, Homo sapiens
ttcaccagatttgctaat

SEQ ID NO: 3859149 - DNA, 13 bp, Homo sapiens
ttcaccatttccg

SEQ ID NO: 3859150 - DNA, 13 bp, Homo sapiens
ttcacccctgcac

SEQ ID NO: 3859151 - DNA, 15 bp, Homo sapiens
ttcacccgctgcagc

SEQ ID NO: 3859152 - DNA, 13 bp, Homo sapiens
ttcaccttatgta

SEQ ID NO: 3859153 - DNA, 19 bp, Homo sapiens
ttcacctttggtgcagagg

SEQ ID NO: 3859154 - DNA, 14 bp, Homo sapiens
ttcactcactgtca

SEQ ID NO: 3859155 - DNA, 14 bp, Homo sapiens
ttcactcagccaca

SEQ ID NO: 3859156 - DNA, 17 bp, Homo sapiens
ttcactgctggctgcct

SEQ ID NO: 3859157 - DNA, 17 bp, Homo sapiens
ttcactggagttacatt

SEQ ID NO: 3859158 - DNA, 19 bp, Homo sapiens
ttcactggagttacattaa

SEQ ID NO: 3859159 - DNA, 15 bp, Homo sapiens
ttcactgtagaatga

SEQ ID NO: 3859160 - DNA, 21 bp, Homo sapiens
ttcactgtgaggggaaggcct

SEQ ID NO: 3859161 - DNA, 22 bp, Homo sapiens
ttcactttaaagtctttccgtc

SEQ ID NO: 3859162 - DNA, 22 bp, Homo sapiens
ttcagaagacacaggggagcag

SEQ ID NO: 3859163 - DNA, 16 bp, Homo sapiens
ttcagaagacactgca

SEQ ID NO: 3859164 - DNA, 15 bp, Homo sapiens
ttcagacaagcaaca

SEQ ID NO: 3859165 - DNA, 21 bp, Homo sapiens
ttcagacaagcaacaggtttt

SEQ ID NO: 3859166 - DNA, 13 bp, Homo sapiens
ttcagacctgaca

SEQ ID NO: 3859167 - DNA, 14 bp, Homo sapiens
ttcagactcagact

SEQ ID NO: 3859168 - DNA, 22 bp, Homo sapiens
ttcagagccagtgaaggagcca

SEQ ID NO: 3859169 - DNA, 12 bp, Homo sapiens
ttcagagcctag

SEQ ID NO: 3859170 - DNA, 22 bp, Homo sapiens
ttcagagcctagccacctccca

SEQ ID NO: 3859171 - DNA, 16 bp, Homo sapiens
ttcagatatatttttc

SEQ ID NO: 3859172 - DNA, 16 bp, Homo sapiens
ttcagatcgtattaat

SEQ ID NO: 3859173 - DNA, 17 bp, Homo sapiens
ttcagatcgtattaatt

SEQ ID NO: 3859174 - DNA, 21 bp, Homo sapiens
ttcagattcccagagcaaaat

SEQ ID NO: 3859175 - DNA, 18 bp, Homo sapiens
ttcagcacaccccaaggg

SEQ ID NO: 3859176 - DNA, 23 bp, Homo sapiens
ttcagcaccctgggtgccattcc

SEQ ID NO: 3859177 - DNA, 21 bp, Homo sapiens
ttcagccagaatcttcgtcct

SEQ ID NO: 3859178 - DNA, 21 bp, Homo sapiens
ttcagccatcaacaagagttg

SEQ ID NO: 3859179 - DNA, 10 bp, Homo sapiens
ttcagcccag

SEQ ID NO: 3859180 - DNA, 20 bp, Homo sapiens
ttcagcccatatttcatcgt

SEQ ID NO: 3859181 - DNA, 16 bp, Homo sapiens
ttcagcccctcctctg

SEQ ID NO: 3859182 - DNA, 17 bp, Homo sapiens
ttcagcccctcctctgc

SEQ ID NO: 3859183 - DNA, 23 bp, Homo sapiens
ttcagcccctcctctgccacctc

SEQ ID NO: 3859184 - DNA, 19 bp, Homo sapiens
ttcagcctggccatcccca

SEQ ID NO: 3859185 - DNA, 13 bp, Homo sapiens
ttcagccttggga

SEQ ID NO: 3859186 - DNA, 13 bp, Homo sapiens
ttcagctcccata

SEQ ID NO: 3859187 - DNA, 15 bp, Homo sapiens
ttcagctctctgtat

SEQ ID NO: 3859188 - DNA, 21 bp, Homo sapiens
ttcagctctctgtataaacat

SEQ ID NO: 3859189 - DNA, 23 bp, Homo sapiens
ttcagctttggtgaaagggaggg

SEQ ID NO: 3859190 - DNA, 14 bp, Homo sapiens
ttcaggactggctc

SEQ ID NO: 3859191 - DNA, 16 bp, Homo sapiens
ttcaggctcttctcct

SEQ ID NO: 3859192 - DNA, 16 bp, Homo sapiens
ttcagggaagcaggca

SEQ ID NO: 3859193 - DNA, 13 bp, Homo sapiens
ttcagggccagaa

SEQ ID NO: 3859194 - DNA, 22 bp, Homo sapiens
ttcagggggcctttaaagactt

SEQ ID NO: 3859195 - DNA, 17 bp, Homo sapiens
ttcagggtgagtgaatg

SEQ ID NO: 3859196 - DNA, 22 bp, Homo sapiens
ttcaggtaggcccttgtcctgc

SEQ ID NO: 3859197 - DNA, 20 bp, Homo sapiens
ttcaggtgcttttgatgtga

SEQ ID NO: 3859198 - DNA, 14 bp, Homo sapiens
ttcagtaggaactg

SEQ ID NO: 3859199 - DNA, 17 bp, Homo sapiens
ttcagtaggctttatgc

SEQ ID NO: 3859200 - DNA, 20 bp, Homo sapiens
ttcagtattttggagaaatt

SEQ ID NO: 3859201 - DNA, 23 bp, Homo sapiens
ttcagtgagacacagagtggagc

SEQ ID NO: 3859202 - DNA, 12 bp, Homo sapiens
ttcagtggagaa

SEQ ID NO: 3859203 - DNA, 23 bp, Homo sapiens
ttcagttcctctttgcatggaat

SEQ ID NO: 3859204 - DNA, 18 bp, Homo sapiens
ttcagttgatcactggca

SEQ ID NO: 3859205 - DNA, 17 bp, Homo sapiens
ttcataaggcctgccct

SEQ ID NO: 3859206 - DNA, 18 bp, Homo sapiens
ttcataaggcctgccctc

SEQ ID NO: 3859207 - DNA, 20 bp, Homo sapiens
ttcataggcggtcatgtgtg

SEQ ID NO: 3859208 - DNA, 23 bp, Homo sapiens
ttcataggcggtcatgtgtgcat

SEQ ID NO: 3859209 - DNA, 21 bp, Homo sapiens
ttcatatatgaggacttgtgt

SEQ ID NO: 3859210 - DNA, 13 bp, Homo sapiens
ttcatcaattttt

SEQ ID NO: 3859211 - DNA, 14 bp, Homo sapiens
ttcatcaattttta

SEQ ID NO: 3859212 - DNA, 16 bp, Homo sapiens
ttcatcaatttttata

SEQ ID NO: 3859213 - DNA, 15 bp, Homo sapiens
ttcatccagttgcaa

SEQ ID NO: 3859214 - DNA, 16 bp, Homo sapiens
ttcatccagttgcaat

SEQ ID NO: 3859215 - DNA, 13 bp, Homo sapiens
ttcatcccagccc

SEQ ID NO: 3859216 - DNA, 14 bp, Homo sapiens
ttcatcctggcctc

SEQ ID NO: 3859217 - DNA, 19 bp, Homo sapiens
ttcatcctggcctcctttt

SEQ ID NO: 3859218 - DNA, 17 bp, Homo sapiens
ttcatctgggaggcaga

SEQ ID NO: 3859219 - DNA, 18 bp, Homo sapiens
ttcatctgttgttttgtt

SEQ ID NO: 3859220 - DNA, 22 bp, Homo sapiens
ttcatgaaaatagctctttcag

SEQ ID NO: 3859221 - DNA, 18 bp, Homo sapiens
ttcatgagtggatggatg

SEQ ID NO: 3859222 - DNA, 18 bp, Homo sapiens
ttcatgcctcagtttccc

SEQ ID NO: 3859223 - DNA, 17 bp, Homo sapiens
ttcatgctatctctgtg

SEQ ID NO: 3859224 - DNA, 14 bp, Homo sapiens
ttcatgctttctcc

SEQ ID NO: 3859225 - DNA, 18 bp, Homo sapiens
ttcatgtttgtaaattaa

SEQ ID NO: 3859226 - DNA, 16 bp, Homo sapiens
ttcatttaaaatgatt

SEQ ID NO: 3859227 - DNA, 12 bp, Homo sapiens
ttcatttcactt

SEQ ID NO: 3859228 - DNA, 13 bp, Homo sapiens
ttcatttcatcta

SEQ ID NO: 3859229 - DNA, 15 bp, Homo sapiens
ttcatttggtgctgg

SEQ ID NO: 3859230 - DNA, 22 bp, Homo sapiens
ttcattttaatttatatttgaa

SEQ ID NO: 3859231 - DNA, 11 bp, Homo sapiens
ttcatttttgg

SEQ ID NO: 3859232 - DNA, 21 bp, Homo sapiens
ttcatttttgttatccttttt

SEQ ID NO: 3859233 - DNA, 15 bp, Homo sapiens
ttccaaataaaatga

SEQ ID NO: 3859234 - DNA, 21 bp, Homo sapiens
ttccaaataaggatttgttca

SEQ ID NO: 3859235 - DNA, 21 bp, Homo sapiens
ttccaacaatggggtgggccc

SEQ ID NO: 3859236 - DNA, 13 bp, Homo sapiens
ttccaaccccagc

SEQ ID NO: 3859237 - DNA, 14 bp, Homo sapiens
ttccaaccccagct

SEQ ID NO: 3859238 - DNA, 20 bp, Homo sapiens
ttccaaccccagctggcctc

SEQ ID NO: 3859239 - DNA, 21 bp, Homo sapiens
ttccaaccccagctggcctct

SEQ ID NO: 3859240 - DNA, 19 bp, Homo sapiens
ttccaagtaatataatgga

SEQ ID NO: 3859241 - DNA, 19 bp, Homo sapiens
ttccaagtcaacactcttc

SEQ ID NO: 3859242 - DNA, 21 bp, Homo sapiens
ttccaattttctggaatacat

SEQ ID NO: 3859243 - DNA, 19 bp, Homo sapiens
ttccacaagattcccagag

SEQ ID NO: 3859244 - DNA, 16 bp, Homo sapiens
ttccacatataaagct

SEQ ID NO: 3859245 - DNA, 15 bp, Homo sapiens
ttccaccttcccatg

SEQ ID NO: 3859246 - DNA, 23 bp, Homo sapiens
ttccacgggtctcacttatacca

SEQ ID NO: 3859247 - DNA, 16 bp, Homo sapiens
ttccactcctatggaa

SEQ ID NO: 3859248 - DNA, 14 bp, Homo sapiens
ttccacttctctag

SEQ ID NO: 3859249 - DNA, 18 bp, Homo sapiens
ttccagaagatgccctcc

SEQ ID NO: 3859250 - DNA, 14 bp, Homo sapiens
ttccagaccacctg

SEQ ID NO: 3859251 - DNA, 16 bp, Homo sapiens
ttccagaccacctgcc

SEQ ID NO: 3859252 - DNA, 17 bp, Homo sapiens
ttccagaccacctgcca

SEQ ID NO: 3859253 - DNA, 18 bp, Homo sapiens
ttccagaccacctgccag

SEQ ID NO: 3859254 - DNA, 20 bp, Homo sapiens
ttccagaccacctgccagcc

SEQ ID NO: 3859255 - DNA, 21 bp, Homo sapiens
ttccagaccacctgccagcca

SEQ ID NO: 3859256 - DNA, 20 bp, Homo sapiens
ttccagagagtggctcctcc

SEQ ID NO: 3859257 - DNA, 17 bp, Homo sapiens
ttccagagcctaagaaa

SEQ ID NO: 3859258 - DNA, 16 bp, Homo sapiens
ttccaggatcctgcag

SEQ ID NO: 3859259 - DNA, 11 bp, Homo sapiens
ttccaggcccc

SEQ ID NO: 3859260 - DNA, 17 bp, Homo sapiens
ttccaggcccctgagga

SEQ ID NO: 3859261 - DNA, 21 bp, Homo sapiens
ttccaggctcttcctggacct

SEQ ID NO: 3859262 - DNA, 17 bp, Homo sapiens
ttccaggtatctccagg

SEQ ID NO: 3859263 - DNA, 19 bp, Homo sapiens
ttccagtacacctttcagc

SEQ ID NO: 3859264 - DNA, 20 bp, Homo sapiens
ttccagtgttggctgtgtga

SEQ ID NO: 3859265 - DNA, 19 bp, Homo sapiens
ttccagttctgacacacgt

SEQ ID NO: 3859266 - DNA, 22 bp, Homo sapiens
ttccataatctggactcctctg

SEQ ID NO: 3859267 - DNA, 15 bp, Homo sapiens
ttccatccccaaact

SEQ ID NO: 3859268 - DNA, 14 bp, Homo sapiens
ttccatctaggact

SEQ ID NO: 3859269 - DNA, 18 bp, Homo sapiens
ttccatgaagaccacatc

SEQ ID NO: 3859270 - DNA, 14 bp, Homo sapiens
ttccatgattttac

SEQ ID NO: 3859271 - DNA, 15 bp, Homo sapiens
ttccatgattttaca

SEQ ID NO: 3859272 - DNA, 21 bp, Homo sapiens
ttccatgattttacagagaat

SEQ ID NO: 3859273 - DNA, 18 bp, Homo sapiens
ttccatgcctgagggtgg

SEQ ID NO: 3859274 - DNA, 22 bp, Homo sapiens
ttccatgcctgagggtggagac

SEQ ID NO: 3859275 - DNA, 17 bp, Homo sapiens
ttccatgggatgttaag

SEQ ID NO: 3859276 - DNA, 16 bp, Homo sapiens
ttccatgtcgcctctg

SEQ ID NO: 3859277 - DNA, 19 bp, Homo sapiens
ttccatgtcgcctctgcat

SEQ ID NO: 3859278 - DNA, 21 bp, Homo sapiens
ttccatgtcgcctctgcattc

SEQ ID NO: 3859279 - DNA, 12 bp, Homo sapiens
ttccatgttaaa

SEQ ID NO: 3859280 - DNA, 14 bp, Homo sapiens
ttccatttctcaat

SEQ ID NO: 3859281 - DNA, 18 bp, Homo sapiens
ttcccaaactacagaata

SEQ ID NO: 3859282 - DNA, 21 bp, Homo sapiens
ttcccaagagcatcatgcctc

SEQ ID NO: 3859283 - DNA, 16 bp, Homo sapiens
ttcccaagtattgcga

SEQ ID NO: 3859284 - DNA, 15 bp, Homo sapiens
ttcccaataaaagtg

SEQ ID NO: 3859285 - DNA, 19 bp, Homo sapiens
ttcccaatcagcactgaaa

SEQ ID NO: 3859286 - DNA, 20 bp, Homo sapiens
ttcccactaagctttctcct

SEQ ID NO: 3859287 - DNA, 10 bp, Homo sapiens
ttcccagagg

SEQ ID NO: 3859288 - DNA, 15 bp, Homo sapiens
ttcccatgatccaga

SEQ ID NO: 3859289 - DNA, 14 bp, Homo sapiens
ttcccatgctgaat

SEQ ID NO: 3859290 - DNA, 18 bp, Homo sapiens
ttcccatgctgaattatt

SEQ ID NO: 3859291 - DNA, 14 bp, Homo sapiens
ttcccattcttgca

SEQ ID NO: 3859292 - DNA, 15 bp, Homo sapiens
ttccccacctcttcc

SEQ ID NO: 3859293 - DNA, 21 bp, Homo sapiens
ttccccacctcttccttccgc

SEQ ID NO: 3859294 - DNA, 12 bp, Homo sapiens
ttccccagacac

SEQ ID NO: 3859295 - DNA, 13 bp, Homo sapiens
ttccccagactca

SEQ ID NO: 3859296 - DNA, 22 bp, Homo sapiens
ttccccagactcagctccagaa

SEQ ID NO: 3859297 - DNA, 21 bp, Homo sapiens
ttcccccacccctaacctggc

SEQ ID NO: 3859298 - DNA, 21 bp, Homo sapiens
ttcccccatcccctttcctcc

SEQ ID NO: 3859299 - DNA, 17 bp, Homo sapiens
ttcccccatgtggctga

SEQ ID NO: 3859300 - DNA, 19 bp, Homo sapiens
ttccccctccaatcccacc

SEQ ID NO: 3859301 - DNA, 16 bp, Homo sapiens
ttccccgctgcccaat

SEQ ID NO: 3859302 - DNA, 15 bp, Homo sapiens
ttcccctcagagctc

SEQ ID NO: 3859303 - DNA, 12 bp, Homo sapiens
ttcccctgaaga

SEQ ID NO: 3859304 - DNA, 17 bp, Homo sapiens
ttcccctgttcactcta

SEQ ID NO: 3859305 - DNA, 19 bp, Homo sapiens
ttccccttctgtgtcacag

SEQ ID NO: 3859306 - DNA, 13 bp, Homo sapiens
ttccccttgccct

SEQ ID NO: 3859307 - DNA, 14 bp, Homo sapiens
ttcccctttcccca

SEQ ID NO: 3859308 - DNA, 22 bp, Homo sapiens
ttccccttttgcctggctgtgg

SEQ ID NO: 3859309 - DNA, 14 bp, Homo sapiens
ttcccgctcagccc

SEQ ID NO: 3859310 - DNA, 18 bp, Homo sapiens
ttcccgctcagccctccc

SEQ ID NO: 3859311 - DNA, 22 bp, Homo sapiens
ttcccgctcagccctccctgcc

SEQ ID NO: 3859312 - DNA, 20 bp, Homo sapiens
ttcccggagcacagccctgg

SEQ ID NO: 3859313 - DNA, 14 bp, Homo sapiens
ttccctacttcctg

SEQ ID NO: 3859314 - DNA, 13 bp, Homo sapiens
ttccctcatcttg

SEQ ID NO: 3859315 - DNA, 11 bp, Homo sapiens
ttccctctcta

SEQ ID NO: 3859316 - DNA, 19 bp, Homo sapiens
ttccctctttccccacctc

SEQ ID NO: 3859317 - DNA, 20 bp, Homo sapiens
ttccctgaaaacccagagag

SEQ ID NO: 3859318 - DNA, 18 bp, Homo sapiens
ttccctgactcctctaag

SEQ ID NO: 3859319 - DNA, 16 bp, Homo sapiens
ttccctgagtcaccag

SEQ ID NO: 3859320 - DNA, 14 bp, Homo sapiens
ttccctgggaaggc

SEQ ID NO: 3859321 - DNA, 16 bp, Homo sapiens
ttccctgtcagaggct

SEQ ID NO: 3859322 - DNA, 23 bp, Homo sapiens
ttccgaagagggaatggatgggg

SEQ ID NO: 3859323 - DNA, 19 bp, Homo sapiens
ttccgtctccctaaaataa

SEQ ID NO: 3859324 - DNA, 20 bp, Homo sapiens
ttccgtctccctaaaataaa

SEQ ID NO: 3859325 - DNA, 23 bp, Homo sapiens
ttccgtctccctaaaataaaaac

SEQ ID NO: 3859326 - DNA, 18 bp, Homo sapiens
ttccgtgacgtcactgga

SEQ ID NO: 3859327 - DNA, 19 bp, Homo sapiens
ttcctaaagtctctgctgc

SEQ ID NO: 3859328 - DNA, 16 bp, Homo sapiens
ttcctacaaagatgtt

SEQ ID NO: 3859329 - DNA, 18 bp, Homo sapiens
ttcctacacccttggact

SEQ ID NO: 3859330 - DNA, 23 bp, Homo sapiens
ttcctacagaaatactgctctga

SEQ ID NO: 3859331 - DNA, 17 bp, Homo sapiens
ttcctacagatagtcaa

SEQ ID NO: 3859332 - DNA, 23 bp, Homo sapiens
ttcctagactaattaaaatctgg

SEQ ID NO: 3859333 - DNA, 19 bp, Homo sapiens
ttcctagagagcagaaata

SEQ ID NO: 3859334 - DNA, 20 bp, Homo sapiens
ttcctagagagcagaaataa

SEQ ID NO: 3859335 - DNA, 21 bp, Homo sapiens
ttcctagagagcagaaataaa

SEQ ID NO: 3859336 - DNA, 14 bp, Homo sapiens
ttcctagccctctc

SEQ ID NO: 3859337 - DNA, 18 bp, Homo sapiens
ttcctagccctctcacat

SEQ ID NO: 3859338 - DNA, 15 bp, Homo sapiens
ttcctattttaaaac

SEQ ID NO: 3859339 - DNA, 21 bp, Homo sapiens
ttcctccaaactcctgcctgt

SEQ ID NO: 3859340 - DNA, 15 bp, Homo sapiens
ttcctccagacagat

SEQ ID NO: 3859341 - DNA, 13 bp, Homo sapiens
ttcctccccagtc

SEQ ID NO: 3859342 - DNA, 14 bp, Homo sapiens
ttcctccgtccacc

SEQ ID NO: 3859343 - DNA, 21 bp, Homo sapiens
ttcctccgtccacccaggctg

SEQ ID NO: 3859344 - DNA, 16 bp, Homo sapiens
ttcctcctccacagtg

SEQ ID NO: 3859345 - DNA, 20 bp, Homo sapiens
ttcctcctccacagtgctgc

SEQ ID NO: 3859346 - DNA, 17 bp, Homo sapiens
ttcctcgcctctcccac

SEQ ID NO: 3859347 - DNA, 18 bp, Homo sapiens
ttcctctcactaaacttt

SEQ ID NO: 3859348 - DNA, 18 bp, Homo sapiens
ttcctctccaattgtaaa

SEQ ID NO: 3859349 - DNA, 12 bp, Homo sapiens
ttcctctccact

SEQ ID NO: 3859350 - DNA, 14 bp, Homo sapiens
ttcctctccactgc

SEQ ID NO: 3859351 - DNA, 19 bp, Homo sapiens
ttcctctccactgccttcg

SEQ ID NO: 3859352 - DNA, 16 bp, Homo sapiens
ttcctcttccccttgc

SEQ ID NO: 3859353 - DNA, 18 bp, Homo sapiens
ttcctcttccccttgccc

SEQ ID NO: 3859354 - DNA, 17 bp, Homo sapiens
ttcctcttgcctctctc

SEQ ID NO: 3859355 - DNA, 14 bp, Homo sapiens
ttcctgaagccaga

SEQ ID NO: 3859356 - DNA, 14 bp, Homo sapiens
ttcctgaatattaa

SEQ ID NO: 3859357 - DNA, 16 bp, Homo sapiens
ttcctgaatattaatc

SEQ ID NO: 3859358 - DNA, 14 bp, Homo sapiens
ttcctgaccctccc

SEQ ID NO: 3859359 - DNA, 16 bp, Homo sapiens
ttcctgaccctcccta

SEQ ID NO: 3859360 - DNA, 17 bp, Homo sapiens
ttcctgataataattga

SEQ ID NO: 3859361 - DNA, 15 bp, Homo sapiens
ttcctgattccccac

SEQ ID NO: 3859362 - DNA, 13 bp, Homo sapiens
ttcctgcactcca

SEQ ID NO: 3859363 - DNA, 15 bp, Homo sapiens
ttcctgccaccagtc

SEQ ID NO: 3859364 - DNA, 17 bp, Homo sapiens
ttcctgccaccagtcac

SEQ ID NO: 3859365 - DNA, 21 bp, Homo sapiens
ttcctgcgggcttttccccgg

SEQ ID NO: 3859366 - DNA, 11 bp, Homo sapiens
ttcctgctgct

SEQ ID NO: 3859367 - DNA, 19 bp, Homo sapiens
ttcctggacagctgtgcct

SEQ ID NO: 3859368 - DNA, 21 bp, Homo sapiens
ttcctggacagctgtgcctcg

SEQ ID NO: 3859369 - DNA, 24 bp, Homo sapiens
ttcctggacagctgtgcctcgctc

SEQ ID NO: 3859370 - DNA, 12 bp, Homo sapiens
ttcctgggcctg

SEQ ID NO: 3859371 - DNA, 14 bp, Homo sapiens
ttcctgggcctgtc

SEQ ID NO: 3859372 - DNA, 16 bp, Homo sapiens
ttcctggggccccgct

SEQ ID NO: 3859373 - DNA, 11 bp, Homo sapiens
ttcctgtaaca

SEQ ID NO: 3859374 - DNA, 23 bp, Homo sapiens
ttcctgtaacacaagccacagaa

SEQ ID NO: 3859375 - DNA, 22 bp, Homo sapiens
ttcctgtatttgttcccaagag

SEQ ID NO: 3859376 - DNA, 15 bp, Homo sapiens
ttcctgtgccaacct

SEQ ID NO: 3859377 - DNA, 17 bp, Homo sapiens
ttcctgtgccaacctga

SEQ ID NO: 3859378 - DNA, 18 bp, Homo sapiens
ttcctgtggccaggaggt

SEQ ID NO: 3859379 - DNA, 22 bp, Homo sapiens
ttcctgtgggccaggagctcag

SEQ ID NO: 3859380 - DNA, 18 bp, Homo sapiens
ttcctgtgtactctttat

SEQ ID NO: 3859381 - DNA, 14 bp, Homo sapiens
ttcctgttcacctt

SEQ ID NO: 3859382 - DNA, 15 bp, Homo sapiens
ttcctgttcacctta

SEQ ID NO: 3859383 - DNA, 19 bp, Homo sapiens
ttcctgttcaccttatgta

SEQ ID NO: 3859384 - DNA, 21 bp, Homo sapiens
ttcctgttcaccttatgtatt

SEQ ID NO: 3859385 - DNA, 14 bp, Homo sapiens
ttccttacctttac

SEQ ID NO: 3859386 - DNA, 23 bp, Homo sapiens
ttccttcccccatcccctttcct

SEQ ID NO: 3859387 - DNA, 12 bp, Homo sapiens
ttccttccctgg

SEQ ID NO: 3859388 - DNA, 13 bp, Homo sapiens
ttccttccctggg

SEQ ID NO: 3859389 - DNA, 20 bp, Homo sapiens
ttccttccgctcctttacct

SEQ ID NO: 3859390 - DNA, 16 bp, Homo sapiens
ttccttccttccctgg

SEQ ID NO: 3859391 - DNA, 19 bp, Homo sapiens
ttccttctgcacccagaaa

SEQ ID NO: 3859392 - DNA, 15 bp, Homo sapiens
ttccttgtcaccagc

SEQ ID NO: 3859393 - DNA, 22 bp, Homo sapiens
ttccttttaaaacacttccata

SEQ ID NO: 3859394 - DNA, 21 bp, Homo sapiens
ttccttttgatggggagaaag

SEQ ID NO: 3859395 - DNA, 17 bp, Homo sapiens
ttccttttgtgtacagt

SEQ ID NO: 3859396 - DNA, 16 bp, Homo sapiens
ttcctttttgcagtat

SEQ ID NO: 3859397 - DNA, 17 bp, Homo sapiens
ttcgaccctttctctga

SEQ ID NO: 3859398 - DNA, 20 bp, Homo sapiens
ttcgaccctttctctgagag

SEQ ID NO: 3859399 - DNA, 18 bp, Homo sapiens
ttcgagaccaacctgacc

SEQ ID NO: 3859400 - DNA, 19 bp, Homo sapiens
ttcgaggttgccccttccc

SEQ ID NO: 3859401 - DNA, 20 bp, Homo sapiens
ttcgaggttgccccttcccc

SEQ ID NO: 3859402 - DNA, 11 bp, Homo sapiens
ttcgcagccac

SEQ ID NO: 3859403 - DNA, 13 bp, Homo sapiens
ttcgcagccaccc

SEQ ID NO: 3859404 - DNA, 14 bp, Homo sapiens
ttcgcagccaccct

SEQ ID NO: 3859405 - DNA, 15 bp, Homo sapiens
ttcgcagccaccctg

SEQ ID NO: 3859406 - DNA, 16 bp, Homo sapiens
ttcgcagccaccctga

SEQ ID NO: 3859407 - DNA, 19 bp, Homo sapiens
ttcgcagccaccctgagga

SEQ ID NO: 3859408 - DNA, 17 bp, Homo sapiens
ttcgcccccatgtgact

SEQ ID NO: 3859409 - DNA, 16 bp, Homo sapiens
ttcgctgccaggacac

SEQ ID NO: 3859410 - DNA, 20 bp, Homo sapiens
ttcgctgccaggacacctgc

SEQ ID NO: 3859411 - DNA, 15 bp, Homo sapiens
ttcgctgctctagct

SEQ ID NO: 3859412 - DNA, 15 bp, Homo sapiens
ttcgcttgcttctgc

SEQ ID NO: 3859413 - DNA, 16 bp, Homo sapiens
ttcgcttgcttctgca

SEQ ID NO: 3859414 - DNA, 17 bp, Homo sapiens
ttcggaagggaaaacag

SEQ ID NO: 3859415 - DNA, 18 bp, Homo sapiens
ttcggaagggggaagtct

SEQ ID NO: 3859416 - DNA, 15 bp, Homo sapiens
ttcggggtgtgatga

SEQ ID NO: 3859417 - DNA, 14 bp, Homo sapiens
ttcggtttctgagc

SEQ ID NO: 3859418 - DNA, 23 bp, Homo sapiens
ttcgtgtagtggaagagcagcct

SEQ ID NO: 3859419 - DNA, 13 bp, Homo sapiens
ttctaaaattgaa

SEQ ID NO: 3859420 - DNA, 16 bp, Homo sapiens
ttctaaaattgaagag

SEQ ID NO: 3859421 - DNA, 17 bp, Homo sapiens
ttctaacatatgtatta

SEQ ID NO: 3859422 - DNA, 18 bp, Homo sapiens
ttctaactgtaaatcact

SEQ ID NO: 3859423 - DNA, 23 bp, Homo sapiens
ttctaactgtaaatcacttgtaa

SEQ ID NO: 3859424 - DNA, 16 bp, Homo sapiens
ttctaagtaaaaccac

SEQ ID NO: 3859425 - DNA, 17 bp, Homo sapiens
ttctaagtaaaaccaca

SEQ ID NO: 3859426 - DNA, 21 bp, Homo sapiens
ttctaagtaaaaccacagcag

SEQ ID NO: 3859427 - DNA, 17 bp, Homo sapiens
ttctacaaccagagccc

SEQ ID NO: 3859428 - DNA, 21 bp, Homo sapiens
ttctacaagcatatttgagaa

SEQ ID NO: 3859429 - DNA, 22 bp, Homo sapiens
ttctacacctgttgcacctcag

SEQ ID NO: 3859430 - DNA, 15 bp, Homo sapiens
ttctacatactatgg

SEQ ID NO: 3859431 - DNA, 14 bp, Homo sapiens
ttctaccatttcag

SEQ ID NO: 3859432 - DNA, 21 bp, Homo sapiens
ttctacctttttttctctcct

SEQ ID NO: 3859433 - DNA, 15 bp, Homo sapiens
ttctacgtataaata

SEQ ID NO: 3859434 - DNA, 15 bp, Homo sapiens
ttctacttttaaaga

SEQ ID NO: 3859435 - DNA, 22 bp, Homo sapiens
ttctagacttcagaacatgctg

SEQ ID NO: 3859436 - DNA, 18 bp, Homo sapiens
ttctagctagaaatatga

SEQ ID NO: 3859437 - DNA, 23 bp, Homo sapiens
ttctatagcagattgtgtaacaa

SEQ ID NO: 3859438 - DNA, 19 bp, Homo sapiens
ttctatagctcttctattt

SEQ ID NO: 3859439 - DNA, 20 bp, Homo sapiens
ttctatagctcttctattta

SEQ ID NO: 3859440 - DNA, 19 bp, Homo sapiens
ttctatataaggaggaaaa

SEQ ID NO: 3859441 - DNA, 22 bp, Homo sapiens
ttctatataaggaggaaaacgg

SEQ ID NO: 3859442 - DNA, 23 bp, Homo sapiens
ttctatcctacaacaagagttta

SEQ ID NO: 3859443 - DNA, 22 bp, Homo sapiens
ttctatgaagtctttgttgcac

SEQ ID NO: 3859444 - DNA, 17 bp, Homo sapiens
ttctattctctcctcag

SEQ ID NO: 3859445 - DNA, 14 bp, Homo sapiens
ttctattgaaaaat

SEQ ID NO: 3859446 - DNA, 12 bp, Homo sapiens
ttcttggaaaaa

SEQ ID NO: 3859447 - DNA, 15 bp, Homo sapiens
ttcttggacccctga

SEQ ID NO: 3859448 - DNA, 12 bp, Homo sapiens
ttcttgggtagt

SEQ ID NO: 3859449 - DNA, 15 bp, Homo sapiens
ttcttggtttgggga

SEQ ID NO: 3859450 - DNA, 17 bp, Homo sapiens
ttcttggtttggggaga

SEQ ID NO: 3859451 - DNA, 12 bp, Homo sapiens
ttctttaaatca

SEQ ID NO: 3859452 - DNA, 21 bp, Homo sapiens
ttctttcctctccaattgtaa

SEQ ID NO: 3859453 - DNA, 22 bp, Homo sapiens
ttctttcctctccaattgtaaa

SEQ ID NO: 3859454 - DNA, 12 bp, Homo sapiens
ttctttctgtta

SEQ ID NO: 3859455 - DNA, 17 bp, Homo sapiens
ttctttctttttctgga

SEQ ID NO: 3859456 - DNA, 14 bp, Homo sapiens
ttctttgtaaaggt

SEQ ID NO: 3859457 - DNA, 12 bp, Homo sapiens
ttcttttatcac

SEQ ID NO: 3859458 - DNA, 17 bp, Homo sapiens
ttcttttttgtctcaag

SEQ ID NO: 3859459 - DNA, 22 bp, Homo sapiens
ttgaaaagactccaaagaaatg

SEQ ID NO: 3859460 - DNA, 23 bp, Homo sapiens
ttgaaaagactccaaagaaatgt

SEQ ID NO: 3859461 - DNA, 14 bp, Homo sapiens
ttgaaaatgaaatg

SEQ ID NO: 3859462 - DNA, 14 bp, Homo sapiens
ttgaaacagcctgg

SEQ ID NO: 3859463 - DNA, 18 bp, Homo sapiens
ttgaaactagaagtcaaa

SEQ ID NO: 3859464 - DNA, 23 bp, Homo sapiens
ttgaaactgagatgtgaacacat

SEQ ID NO: 3859465 - DNA, 20 bp, Homo sapiens
ttgaaactgtaaatatgttt

SEQ ID NO: 3859466 - DNA, 21 bp, Homo sapiens
ttgaaattatgtatgtttaca

SEQ ID NO: 3859467 - DNA, 12 bp, Homo sapiens
ttgaacccagga

SEQ ID NO: 3859468 - DNA, 14 bp, Homo sapiens
ttgaacccctgtgt

SEQ ID NO: 3859469 - DNA, 14 bp, Homo sapiens
ttgaaccttggtaa

SEQ ID NO: 3859470 - DNA, 15 bp, Homo sapiens
ttgaactttccaaaa

SEQ ID NO: 3859471 - DNA, 20 bp, Homo sapiens
ttgaagagatttcaacatat

SEQ ID NO: 3859472 - DNA, 13 bp, Homo sapiens
ttgaaggcagtct

SEQ ID NO: 3859473 - DNA, 14 bp, Homo sapiens
ttgaaggcagtctg

SEQ ID NO: 3859474 - DNA, 16 bp, Homo sapiens
ttgaaggcagtctgaa

SEQ ID NO: 3859475 - DNA, 18 bp, Homo sapiens
ttgaagggtaaagaagtt

SEQ ID NO: 3859476 - DNA, 21 bp, Homo sapiens
ttgaataaagcctgcttttta

SEQ ID NO: 3859477 - DNA, 18 bp, Homo sapiens
ttgaatacccccagagac

SEQ ID NO: 3859478 - DNA, 20 bp, Homo sapiens
ttgaatatatcagaatctgt

SEQ ID NO: 3859479 - DNA, 20 bp, Homo sapiens
ttgaatgacaacagaagctt

SEQ ID NO: 3859480 - DNA, 21 bp, Homo sapiens
ttgaatgacaacagaagcttc

SEQ ID NO: 3859481 - DNA, 23 bp, Homo sapiens
ttgaatgctttttgaatgttatt

SEQ ID NO: 3859482 - DNA, 16 bp, Homo sapiens
ttgaatgtttatgttc

SEQ ID NO: 3859483 - DNA, 23 bp, Homo sapiens
ttgaattggatacaaggatcaga

SEQ ID NO: 3859484 - DNA, 22 bp, Homo sapiens
ttgaatttcctatctgtatgtc

SEQ ID NO: 3859485 - DNA, 15 bp, Homo sapiens
ttgacaacagactga

SEQ ID NO: 3859486 - DNA, 18 bp, Homo sapiens
ttgacaataaatgtgctt

SEQ ID NO: 3859487 - DNA, 18 bp, Homo sapiens
ttgacaataatttcaggt

SEQ ID NO: 3859488 - DNA, 18 bp, Homo sapiens
ttgacacggtgaaatcca

SEQ ID NO: 3859489 - DNA, 22 bp, Homo sapiens
ttgacattgtatgtatctattt

SEQ ID NO: 3859490 - DNA, 23 bp, Homo sapiens
ttgacctcacagtgacccttccc

SEQ ID NO: 3859491 - DNA, 22 bp, Homo sapiens
ttgacctcagctgcacattcct

SEQ ID NO: 3859492 - DNA, 23 bp, Homo sapiens
ttgacctcagctgcacattcctg

SEQ ID NO: 3859493 - DNA, 23 bp, Homo sapiens
ttgaccttctccctcactcctgc

SEQ ID NO: 3859494 - DNA, 18 bp, Homo sapiens
ttgacgggaggcctcagt

SEQ ID NO: 3859495 - DNA, 20 bp, Homo sapiens
ttgacgggaggcctcagttc

SEQ ID NO: 3859496 - DNA, 14 bp, Homo sapiens
ttgactcacctgtt

SEQ ID NO: 3859497 - DNA, 23 bp, Homo sapiens
ttgactccttgtggtttatgtca

SEQ ID NO: 3859498 - DNA, 20 bp, Homo sapiens
ttgactcttttatctgagtt

SEQ ID NO: 3859499 - DNA, 17 bp, Homo sapiens
ttgactgggtttctctg

SEQ ID NO: 3859500 - DNA, 22 bp, Homo sapiens
ttgacttcttggtttggggaga

SEQ ID NO: 3859501 - DNA, 14 bp, Homo sapiens
ttgagaaagaaata

SEQ ID NO: 3859502 - DNA, 18 bp, Homo sapiens
ttgagaagttttgtacag

SEQ ID NO: 3859503 - DNA, 15 bp, Homo sapiens
ttgagacaagccctg

SEQ ID NO: 3859504 - DNA, 19 bp, Homo sapiens
ttgagacaagccctggcaa

SEQ ID NO: 3859505 - DNA, 18 bp, Homo sapiens
ttgagagaagccacgctg

SEQ ID NO: 3859506 - DNA, 16 bp, Homo sapiens
ttgagcaattcatttc

SEQ ID NO: 3859507 - DNA, 19 bp, Homo sapiens
ttgagcatgcacagctgct

SEQ ID NO: 3859508 - DNA, 20 bp, Homo sapiens
ttgagcatgcacagctgctt

SEQ ID NO: 3859509 - DNA, 14 bp, Homo sapiens
ttgagctgtatata

SEQ ID NO: 3859510 - DNA, 13 bp, Homo sapiens
ttgaggacacatg

SEQ ID NO: 3859511 - DNA, 20 bp, Homo sapiens
ttgagtgactcgagggttgg

SEQ ID NO: 3859512 - DNA, 12 bp, Homo sapiens
ttgagtgattat

SEQ ID NO: 3859513 - DNA, 20 bp, Homo sapiens
ttgatacttcaggtgctttt

SEQ ID NO: 3859514 - DNA, 13 bp, Homo sapiens
ttgatatgagtat

SEQ ID NO: 3859515 - DNA, 18 bp, Homo sapiens
ttgatatgagtatacaat

SEQ ID NO: 3859516 - DNA, 17 bp, Homo sapiens
ttgatcaaattcatttt

SEQ ID NO: 3859517 - DNA, 20 bp, Homo sapiens
ttgatcacagtggcgagagg

SEQ ID NO: 3859518 - DNA, 22 bp, Homo sapiens
ttgatcacagtggcgagaggag

SEQ ID NO: 3859519 - DNA, 18 bp, Homo sapiens
ttgatgaaattcttgaag

SEQ ID NO: 3859520 - DNA, 13 bp, Homo sapiens
ttgatggggagaa

SEQ ID NO: 3859521 - DNA, 16 bp, Homo sapiens
ttgatggggagaaagg

SEQ ID NO: 3859522 - DNA, 16 bp, Homo sapiens
ttgatgtacatgtgta

SEQ ID NO: 3859523 - DNA, 18 bp, Homo sapiens
ttgatgtttccagaaaat

SEQ ID NO: 3859524 - DNA, 13 bp, Homo sapiens
ttgattatgcata

SEQ ID NO: 3859525 - DNA, 12 bp, Homo sapiens
ttgattattctg

SEQ ID NO: 3859526 - DNA, 17 bp, Homo sapiens
ttgcaaaagactaattt

SEQ ID NO: 3859527 - DNA, 13 bp, Homo sapiens
ttgcaagaggagg

SEQ ID NO: 3859528 - DNA, 14 bp, Homo sapiens
ttgcaataaaatag

SEQ ID NO: 3859529 - DNA, 20 bp, Homo sapiens
ttgcaatggtgttgccctga

SEQ ID NO: 3859530 - DNA, 19 bp, Homo sapiens
ttgcacaagcttgtatata

SEQ ID NO: 3859531 - DNA, 21 bp, Homo sapiens
ttgcacaagcttgtatataca

SEQ ID NO: 3859532 - DNA, 21 bp, Homo sapiens
ttggaaagcaggtggcatctc

SEQ ID NO: 3859533 - DNA, 17 bp, Homo sapiens
ttggaaagttcagccag

SEQ ID NO: 3859534 - DNA, 18 bp, Homo sapiens
ttggaaagttcagccaga

SEQ ID NO: 3859535 - DNA, 17 bp, Homo sapiens
ttggaactgaagggggc

SEQ ID NO: 3859536 - DNA, 16 bp, Homo sapiens
ttggaagaaaaaatct

SEQ ID NO: 3859537 - DNA, 20 bp, Homo sapiens
ttggaagtgtgtggaaggca

SEQ ID NO: 3859538 - DNA, 21 bp, Homo sapiens
ttggaatgactataaacatta

SEQ ID NO: 3859539 - DNA, 13 bp, Homo sapiens
ttggacacactgt

SEQ ID NO: 3859540 - DNA, 14 bp, Homo sapiens
ttggacacactgta

SEQ ID NO: 3859541 - DNA, 13 bp, Homo sapiens
ttggacagctgct

SEQ ID NO: 3859542 - DNA, 15 bp, Homo sapiens
ttggacccgctctgg

SEQ ID NO: 3859543 - DNA, 14 bp, Homo sapiens
ttggacctctgctc

SEQ ID NO: 3859544 - DNA, 13 bp, Homo sapiens
ttggacttgagga

SEQ ID NO: 3859545 - DNA, 15 bp, Homo sapiens
ttggagagacacagc

SEQ ID NO: 3859546 - DNA, 22 bp, Homo sapiens
ttggagagctagaacctggaga

SEQ ID NO: 3859547 - DNA, 19 bp, Homo sapiens
ttggagagggacgaagaaa

SEQ ID NO: 3859548 - DNA, 20 bp, Homo sapiens
ttggagagggacgaagaaag

SEQ ID NO: 3859549 - DNA, 17 bp, Homo sapiens
ttggagagtaaaaactg

SEQ ID NO: 3859550 - DNA, 11 bp, Homo sapiens
ttggagccact

SEQ ID NO: 3859551 - DNA, 21 bp, Homo sapiens
ttggatgggagtgagacagaa

SEQ ID NO: 3859552 - DNA, 13 bp, Homo sapiens
ttggattattcat

SEQ ID NO: 3859553 - DNA, 17 bp, Homo sapiens
ccctgttttccacacca

SEQ ID NO: 3859554 - DNA, 19 bp, Homo sapiens
ccctgttttccacaccatc

SEQ ID NO: 3859555 - DNA, 15 bp, Homo sapiens
cccttacacgtacct

SEQ ID NO: 3859556 - DNA, 20 bp, Homo sapiens
cccttagagattgccccaga

SEQ ID NO: 3859557 - DNA, 23 bp, Homo sapiens
cccttagagattgccccagagcc

SEQ ID NO: 3859558 - DNA, 19 bp, Homo sapiens
cccttaggcattatttaat

SEQ ID NO: 3859559 - DNA, 14 bp, Homo sapiens
cccttcagggccag

SEQ ID NO: 3859560 - DNA, 12 bp, Homo sapiens
cccttccagaca

SEQ ID NO: 3859561 - DNA, 21 bp, Homo sapiens
cccttcccaatcagcactgaa

SEQ ID NO: 3859562 - DNA, 14 bp, Homo sapiens
cccttccccaagaa

SEQ ID NO: 3859563 - DNA, 13 bp, Homo sapiens
cccttccccttct

SEQ ID NO: 3859564 - DNA, 13 bp, Homo sapiens
cccttcctcctga

SEQ ID NO: 3859565 - DNA, 22 bp, Homo sapiens
cccttcctcctgaagcctctgc

SEQ ID NO: 3859566 - DNA, 16 bp, Homo sapiens
cccttcctctccactg

SEQ ID NO: 3859567 - DNA, 17 bp, Homo sapiens
cccttcctctccactgc

SEQ ID NO: 3859568 - DNA, 20 bp, Homo sapiens
cccttcctctccactgcctt

SEQ ID NO: 3859569 - DNA, 22 bp, Homo sapiens
cccttcctggacagctgtgcct

SEQ ID NO: 3859570 - DNA, 22 bp, Homo sapiens
cccttcctggcctcactggctg

SEQ ID NO: 3859571 - DNA, 24 bp, Homo sapiens
cccttcctggcctcactggctggg

SEQ ID NO: 3859572 - DNA, 13 bp, Homo sapiens
cccttcctttcct

SEQ ID NO: 3859573 - DNA, 15 bp, Homo sapiens
cccttcctttcctct

SEQ ID NO: 3859574 - DNA, 14 bp, Homo sapiens
cccttcgctgccag

SEQ ID NO: 3859575 - DNA, 16 bp, Homo sapiens
cccttcgctgccagga

SEQ ID NO: 3859576 - DNA, 23 bp, Homo sapiens
cccttctatgcagtattgccaca

SEQ ID NO: 3859577 - DNA, 18 bp, Homo sapiens
cccttctctccttccctc

SEQ ID NO: 3859578 - DNA, 13 bp, Homo sapiens
cccttctttaaat

SEQ ID NO: 3859579 - DNA, 17 bp, Homo sapiens
cccttgaaattttaaac

SEQ ID NO: 3859580 - DNA, 21 bp, Homo sapiens
cccttgaactgttctggcctc

SEQ ID NO: 3859581 - DNA, 16 bp, Homo sapiens
cccttgaatctgcagg

SEQ ID NO: 3859582 - DNA, 19 bp, Homo sapiens
cccttgaatctgcagggag

SEQ ID NO: 3859583 - DNA, 14 bp, Homo sapiens
cccttgagacctca

SEQ ID NO: 3859584 - DNA, 17 bp, Homo sapiens
cccttgagacctcagcc

SEQ ID NO: 3859585 - DNA, 19 bp, Homo sapiens
cccttgagacctcagccat

SEQ ID NO: 3859586 - DNA, 20 bp, Homo sapiens
cccttgagacctcagccatg

SEQ ID NO: 3859587 - DNA, 20 bp, Homo sapiens
cccttgccctgacctcccag

SEQ ID NO: 3859588 - DNA, 16 bp, Homo sapiens
cccttgctcagtgcct

SEQ ID NO: 3859589 - DNA, 20 bp, Homo sapiens
cccttgctcagtgcctcctg

SEQ ID NO: 3859590 - DNA, 20 bp, Homo sapiens
cccttgctgacatggctttg

SEQ ID NO: 3859591 - DNA, 22 bp, Homo sapiens
cccttggaaagttcagccagaa

SEQ ID NO: 3859592 - DNA, 14 bp, Homo sapiens
cccttggctgtgag

SEQ ID NO: 3859593 - DNA, 18 bp, Homo sapiens
cccttggcttcctccgtc

SEQ ID NO: 3859594 - DNA, 15 bp, Homo sapiens
cccttggggcctggc

SEQ ID NO: 3859595 - DNA, 19 bp, Homo sapiens
cccttgtaccccatccctt

SEQ ID NO: 3859596 - DNA, 16 bp, Homo sapiens
cccttgtcctctcccg

SEQ ID NO: 3859597 - DNA, 16 bp, Homo sapiens
cccttgtcctgccagc

SEQ ID NO: 3859598 - DNA, 17 bp, Homo sapiens
cccttgtcctgccagct

SEQ ID NO: 3859599 - DNA, 21 bp, Homo sapiens
cccttgtcctgccagctgcct

SEQ ID NO: 3859600 - DNA, 20 bp, Homo sapiens
cccttgtttggggcaggagt

SEQ ID NO: 3859601 - DNA, 13 bp, Homo sapiens
ccctttcctgcgg

SEQ ID NO: 3859602 - DNA, 18 bp, Homo sapiens
ccctttccttccttccct

SEQ ID NO: 3859603 - DNA, 23 bp, Homo sapiens
cccttttcaagttgagaacaaaa

SEQ ID NO: 3859604 - DNA, 14 bp, Homo sapiens
cccttttgcctggc

SEQ ID NO: 3859605 - DNA, 11 bp, Homo sapiens
ccgaaagctga

SEQ ID NO: 3859606 - DNA, 18 bp, Homo sapiens
ccgaagaggaagcaagaa

SEQ ID NO: 3859607 - DNA, 22 bp, Homo sapiens
ccgaagaggaagcaagaaagcc

SEQ ID NO: 3859608 - DNA, 13 bp, Homo sapiens
ccgaatgcctgtc

SEQ ID NO: 3859609 - DNA, 19 bp, Homo sapiens
ccgaatttagtcacaccat

SEQ ID NO: 3859610 - DNA, 17 bp, Homo sapiens
ccgacactgctgcacca

SEQ ID NO: 3859611 - DNA, 16 bp, Homo sapiens
ccgacagcccagccta

SEQ ID NO: 3859612 - DNA, 19 bp, Homo sapiens
ccgacagcccagcctagcc

SEQ ID NO: 3859613 - DNA, 14 bp, Homo sapiens
ccgacagcctggca

SEQ ID NO: 3859614 - DNA, 22 bp, Homo sapiens
ccgacagcctggcacagggcag

SEQ ID NO: 3859615 - DNA, 13 bp, Homo sapiens
ccgaccagagccc

SEQ ID NO: 3859616 - DNA, 22 bp, Homo sapiens
ccgacctcgtcctccccctgcc

SEQ ID NO: 3859617 - DNA, 16 bp, Homo sapiens
ccgacgcgtctcctgt

SEQ ID NO: 3859618 - DNA, 17 bp, Homo sapiens
ccgacgcgtctcctgtt

SEQ ID NO: 3859619 - DNA, 14 bp, Homo sapiens
ccgactagcaggca

SEQ ID NO: 3859620 - DNA, 13 bp, Homo sapiens
ccgactcaggtcc

SEQ ID NO: 3859621 - DNA, 23 bp, Homo sapiens
ccgactgcacagcggcccctgca

SEQ ID NO: 3859622 - DNA, 11 bp, Homo sapiens
ccgagaaaagg

SEQ ID NO: 3859623 - DNA, 12 bp, Homo sapiens
ccgagaaaagga

SEQ ID NO: 3859624 - DNA, 12 bp, Homo sapiens
ccgagaacaaca

SEQ ID NO: 3859625 - DNA, 17 bp, Homo sapiens
ccgagacggctggacct

SEQ ID NO: 3859626 - DNA, 18 bp, Homo sapiens
ccgagacggctggacctg

SEQ ID NO: 3859627 - DNA, 14 bp, Homo sapiens
ccgagagcctgctc

SEQ ID NO: 3859628 - DNA, 15 bp, Homo sapiens
ccgagagcctgctcc

SEQ ID NO: 3859629 - DNA, 21 bp, Homo sapiens
ccgagagtagccgagagcctg

SEQ ID NO: 3859630 - DNA, 11 bp, Homo sapiens
ccgagattgca

SEQ ID NO: 3859631 - DNA, 18 bp, Homo sapiens
ccgagcaaagtctaaagt

SEQ ID NO: 3859632 - DNA, 16 bp, Homo sapiens
ccgagcaaccgtggcc

SEQ ID NO: 3859633 - DNA, 14 bp, Homo sapiens
ccgagcctaatgaa

SEQ ID NO: 3859634 - DNA, 18 bp, Homo sapiens
ccgagcgctttctggaaa

SEQ ID NO: 3859635 - DNA, 18 bp, Homo sapiens
ccgagcggtgtggggacc

SEQ ID NO: 3859636 - DNA, 21 bp, Homo sapiens
ccgaggaccgggctggggttt

SEQ ID NO: 3859637 - DNA, 16 bp, Homo sapiens
ccgagggcctgacagg

SEQ ID NO: 3859638 - DNA, 21 bp, Homo sapiens
ccgagtctcttctccactgga

SEQ ID NO: 3859639 - DNA, 14 bp, Homo sapiens
ccgcaagcgcaggg

SEQ ID NO: 3859640 - DNA, 20 bp, Homo sapiens
ccggggaactggccaagctg

SEQ ID NO: 3859641 - DNA, 13 bp, Homo sapiens
ccggggcccctca

SEQ ID NO: 3859642 - DNA, 15 bp, Homo sapiens
ccgggggaggaaggg

SEQ ID NO: 3859643 - DNA, 14 bp, Homo sapiens
ccgggggccagaca

SEQ ID NO: 3859644 - DNA, 18 bp, Homo sapiens
ccgggggccagacacaga

SEQ ID NO: 3859645 - DNA, 18 bp, Homo sapiens
ccggggtctgtgctgtgc

SEQ ID NO: 3859646 - DNA, 20 bp, Homo sapiens
ccggggtctgtgctgtgcct

SEQ ID NO: 3859647 - DNA, 18 bp, Homo sapiens
ccggggttcaagccatgg

SEQ ID NO: 3859648 - DNA, 20 bp, Homo sapiens
ccgggtggaaaagaatccct

SEQ ID NO: 3859649 - DNA, 13 bp, Homo sapiens
ccgggtgggcctg

SEQ ID NO: 3859650 - DNA, 18 bp, Homo sapiens
ccgggtgggcctggcctg

SEQ ID NO: 3859651 - DNA, 19 bp, Homo sapiens
ccgggtgggcctggcctga

SEQ ID NO: 3859652 - DNA, 21 bp, Homo sapiens
ccgggtgggcctggcctgagc

SEQ ID NO: 3859653 - DNA, 13 bp, Homo sapiens
ccgggtgtggcct

SEQ ID NO: 3859654 - DNA, 15 bp, Homo sapiens
ccgggtgtggcctca

SEQ ID NO: 3859655 - DNA, 16 bp, Homo sapiens
ccgggtgtggcctcag

SEQ ID NO: 3859656 - DNA, 17 bp, Homo sapiens
ccgggtgtggcctcagc

SEQ ID NO: 3859657 - DNA, 18 bp, Homo sapiens
ccgggtgtggcctcagcc

SEQ ID NO: 3859658 - DNA, 17 bp, Homo sapiens
ccgggttctagtctcct

SEQ ID NO: 3859659 - DNA, 20 bp, Homo sapiens
ccgggttctagtctcctttg

SEQ ID NO: 3859660 - DNA, 22 bp, Homo sapiens
ccggtcccttgagacctcagcc

SEQ ID NO: 3859661 - DNA, 18 bp, Homo sapiens
ccgtagagggtggccgac

SEQ ID NO: 3859662 - DNA, 18 bp, Homo sapiens
ccgtataggatgtcagac

SEQ ID NO: 3859663 - DNA, 15 bp, Homo sapiens
ccgtcatgttcctca

SEQ ID NO: 3859664 - DNA, 17 bp, Homo sapiens
ccgtcatgttcctcaaa

SEQ ID NO: 3859665 - DNA, 16 bp, Homo sapiens
ccgtccatggcaccag

SEQ ID NO: 3859666 - DNA, 20 bp, Homo sapiens
ccgtccatggcaccagcccc

SEQ ID NO: 3859667 - DNA, 14 bp, Homo sapiens
ccgtctgactccag

SEQ ID NO: 3859668 - DNA, 17 bp, Homo sapiens
ccgtctggggttcagcc

SEQ ID NO: 3859669 - DNA, 20 bp, Homo sapiens
ccgtctggggttcagcccct

SEQ ID NO: 3859670 - DNA, 23 bp, Homo sapiens
ccgtctggggttcagcccctcct

SEQ ID NO: 3859671 - DNA, 13 bp, Homo sapiens
ccgtctgtgaatt

SEQ ID NO: 3859672 - DNA, 14 bp, Homo sapiens
ccgtgccaagtcca

SEQ ID NO: 3859673 - DNA, 20 bp, Homo sapiens
ccgtgccaagtccaggtcct

SEQ ID NO: 3859674 - DNA, 21 bp, Homo sapiens
ccgtgccaagtccaggtcctg

SEQ ID NO: 3859675 - DNA, 20 bp, Homo sapiens
ccgtgcccaggggcccacag

SEQ ID NO: 3859676 - DNA, 17 bp, Homo sapiens
ccgtgccttcagctcta

SEQ ID NO: 3859677 - DNA, 11 bp, Homo sapiens
ccgtgctgggc

SEQ ID NO: 3859678 - DNA, 14 bp, Homo sapiens
ccgtggaccttcct

SEQ ID NO: 3859679 - DNA, 17 bp, Homo sapiens
ccgtggaccttcctgcc

SEQ ID NO: 3859680 - DNA, 12 bp, Homo sapiens
ccgtggaggctg

SEQ ID NO: 3859681 - DNA, 14 bp, Homo sapiens
ccgtggcccttcct

SEQ ID NO: 3859682 - DNA, 14 bp, Homo sapiens
ccgtggcttcccgc

SEQ ID NO: 3859683 - DNA, 14 bp, Homo sapiens
ccgtgtcccaagga

SEQ ID NO: 3859684 - DNA, 21 bp, Homo sapiens
ccgtgtgttctccgtccctgc

SEQ ID NO: 3859685 - DNA, 18 bp, Homo sapiens
ccgttctgctggcctgga

SEQ ID NO: 3859686 - DNA, 23 bp, Homo sapiens
ccgttctgctggcctggatctcc

SEQ ID NO: 3859687 - DNA, 15 bp, Homo sapiens
ccgtttatgggcctt

SEQ ID NO: 3859688 - DNA, 16 bp, Homo sapiens
ccgtttatgggccttg

SEQ ID NO: 3859689 - DNA, 19 bp, Homo sapiens
ccgttttcatcctggcctc

SEQ ID NO: 3859690 - DNA, 20 bp, Homo sapiens
ccgttttcatcctggcctcc

SEQ ID NO: 3859691 - DNA, 15 bp, Homo sapiens
cctaaaagtaaacat

SEQ ID NO: 3859692 - DNA, 15 bp, Homo sapiens
cctaaaataaaaacc

SEQ ID NO: 3859693 - DNA, 17 bp, Homo sapiens
cctaaaataaaaaccag

SEQ ID NO: 3859694 - DNA, 15 bp, Homo sapiens
cctaaagaggaaaag

SEQ ID NO: 3859695 - DNA, 14 bp, Homo sapiens
cctaaatttcagta

SEQ ID NO: 3859696 - DNA, 15 bp, Homo sapiens
cctaacccctttcct

SEQ ID NO: 3859697 - DNA, 13 bp, Homo sapiens
cctaaggacacac

SEQ ID NO: 3859698 - DNA, 15 bp, Homo sapiens
cctaaggacacacta

SEQ ID NO: 3859699 - DNA, 14 bp, Homo sapiens
cctaagtggctgct

SEQ ID NO: 3859700 - DNA, 16 bp, Homo sapiens
cctaagtggctgctga

SEQ ID NO: 3859701 - DNA, 15 bp, Homo sapiens
cctaataagtccaca

SEQ ID NO: 3859702 - DNA, 21 bp, Homo sapiens
cctaataagtttgatcaaatc

SEQ ID NO: 3859703 - DNA, 19 bp, Homo sapiens
cctaatctcatacctctga

SEQ ID NO: 3859704 - DNA, 20 bp, Homo sapiens
cctacatcttcagctcccat

SEQ ID NO: 3859705 - DNA, 14 bp, Homo sapiens
cctaccaaatataa

SEQ ID NO: 3859706 - DNA, 15 bp, Homo sapiens
cctaccaatgcatgc

SEQ ID NO: 3859707 - DNA, 13 bp, Homo sapiens
cctaccacccctt

SEQ ID NO: 3859708 - DNA, 18 bp, Homo sapiens
cctaccaccccttcctgt

SEQ ID NO: 3859709 - DNA, 14 bp, Homo sapiens
cctaccaccttccc

SEQ ID NO: 3859710 - DNA, 12 bp, Homo sapiens
cctacccactct

SEQ ID NO: 3859711 - DNA, 13 bp, Homo sapiens
cctacccactctt

SEQ ID NO: 3859712 - DNA, 11 bp, Homo sapiens
cctaccccacc

SEQ ID NO: 3859713 - DNA, 12 bp, Homo sapiens
cctacctggtaa

SEQ ID NO: 3859714 - DNA, 20 bp, Homo sapiens
cctacgtcaaacatgaagtg

SEQ ID NO: 3859715 - DNA, 17 bp, Homo sapiens
cctactcccctgatccc

SEQ ID NO: 3859716 - DNA, 13 bp, Homo sapiens
cctactgaatgct

SEQ ID NO: 3859717 - DNA, 23 bp, Homo sapiens
cctactgccacccgcttcctgtt

SEQ ID NO: 3859718 - DNA, 13 bp, Homo sapiens
cctacttcctgtg

SEQ ID NO: 3859719 - DNA, 16 bp, Homo sapiens
cctacttcttttgctc

SEQ ID NO: 3859720 - DNA, 19 bp, Homo sapiens
cctagaaccaagcttcaga

SEQ ID NO: 3859721 - DNA, 23 bp, Homo sapiens
cctagaaccaagcttcagagcct

SEQ ID NO: 3859722 - DNA, 14 bp, Homo sapiens
cctagaacttcaaa

SEQ ID NO: 3859723 - DNA, 22 bp, Homo sapiens
cctagaagggctagaacctgga

SEQ ID NO: 3859724 - DNA, 15 bp, Homo sapiens
cctagacctgggcca

SEQ ID NO: 3859725 - DNA, 13 bp, Homo sapiens
cctagagaggctg

SEQ ID NO: 3859726 - DNA, 17 bp, Homo sapiens
cctagagaggctggcaa

SEQ ID NO: 3859727 - DNA, 19 bp, Homo sapiens
cctcagcacccctgtctct

SEQ ID NO: 3859728 - DNA, 15 bp, Homo sapiens
cctcagcaggaacct

SEQ ID NO: 3859729 - DNA, 19 bp, Homo sapiens
cctcagccaaacacagagc

SEQ ID NO: 3859730 - DNA, 21 bp, Homo sapiens
cctcagccaaacacagagcgg

SEQ ID NO: 3859731 - DNA, 11 bp, Homo sapiens
cctcagccctc

SEQ ID NO: 3859732 - DNA, 14 bp, Homo sapiens
cctcagccctcaga

SEQ ID NO: 3859733 - DNA, 11 bp, Homo sapiens
cctcagccctt

SEQ ID NO: 3859734 - DNA, 13 bp, Homo sapiens
cctcagcccttgc

SEQ ID NO: 3859735 - DNA, 16 bp, Homo sapiens
cctcagcccttgcccc

SEQ ID NO: 3859736 - DNA, 13 bp, Homo sapiens
cctcagcctccta

SEQ ID NO: 3859737 - DNA, 22 bp, Homo sapiens
cctcagcctcctaagcagctgg

SEQ ID NO: 3859738 - DNA, 23 bp, Homo sapiens
cctcagccttggataatgctgtt

SEQ ID NO: 3859739 - DNA, 15 bp, Homo sapiens
cctcagctcagcctc

SEQ ID NO: 3859740 - DNA, 18 bp, Homo sapiens
cctcagctgcacattcct

SEQ ID NO: 3859741 - DNA, 13 bp, Homo sapiens
cctcagctgccaa

SEQ ID NO: 3859742 - DNA, 22 bp, Homo sapiens
cctcagggacagagacacctgc

SEQ ID NO: 3859743 - DNA, 23 bp, Homo sapiens
cctcagggacagagacacctgca

SEQ ID NO: 3859744 - DNA, 16 bp, Homo sapiens
cctcaggggtggagaa

SEQ ID NO: 3859745 - DNA, 21 bp, Homo sapiens
cctcagtaagtatctggagga

SEQ ID NO: 3859746 - DNA, 22 bp, Homo sapiens
cctcagtcagttcccggagcac

SEQ ID NO: 3859747 - DNA, 14 bp, Homo sapiens
cctcagtgccactt

SEQ ID NO: 3859748 - DNA, 16 bp, Homo sapiens
cctcagtgccacttga

SEQ ID NO: 3859749 - DNA, 23 bp, Homo sapiens
cctcagtgccacttgacattcct

SEQ ID NO: 3859750 - DNA, 22 bp, Homo sapiens
cctcagttcaacctggtggcac

SEQ ID NO: 3859751 - DNA, 22 bp, Homo sapiens
cctcagtttcctcatctgcaga

SEQ ID NO: 3859752 - DNA, 21 bp, Homo sapiens
cctcatcccctcgtcctgtcc

SEQ ID NO: 3859753 - DNA, 11 bp, Homo sapiens
cctcatccctc

SEQ ID NO: 3859754 - DNA, 13 bp, Homo sapiens
cctcatctccttt

SEQ ID NO: 3859755 - DNA, 22 bp, Homo sapiens
cctcatcttgccccctcatctc

SEQ ID NO: 3859756 - DNA, 18 bp, Homo sapiens
cctcatgataatctgggc

SEQ ID NO: 3859757 - DNA, 14 bp, Homo sapiens
cctcatgcctggcc

SEQ ID NO: 3859758 - DNA, 13 bp, Homo sapiens
cctcattcaggaa

SEQ ID NO: 3859759 - DNA, 16 bp, Homo sapiens
cctcattcaggaaaac

SEQ ID NO: 3859760 - DNA, 20 bp, Homo sapiens
cctccaaactcctgcctgtg

SEQ ID NO: 3859761 - DNA, 19 bp, Homo sapiens
cctccaatcctttccaccc

SEQ ID NO: 3859762 - DNA, 17 bp, Homo sapiens
cctccacagtgctgctt

SEQ ID NO: 3859763 - DNA, 16 bp, Homo sapiens
cctccacccccgccac

SEQ ID NO: 3859764 - DNA, 13 bp, Homo sapiens
cctccaccgctgc

SEQ ID NO: 3859765 - DNA, 13 bp, Homo sapiens
cctccacctcctg

SEQ ID NO: 3859766 - DNA, 17 bp, Homo sapiens
cctccaccttgctcttc

SEQ ID NO: 3859767 - DNA, 13 bp, Homo sapiens
cctccacgcctcc

SEQ ID NO: 3859768 - DNA, 19 bp, Homo sapiens
cctccacgcctcctggcca

SEQ ID NO: 3859769 - DNA, 21 bp, Homo sapiens
cctccacgcctcctggccaga

SEQ ID NO: 3859770 - DNA, 14 bp, Homo sapiens
cctccactcactcc

SEQ ID NO: 3859771 - DNA, 14 bp, Homo sapiens
cctccagaccctgc

SEQ ID NO: 3859772 - DNA, 17 bp, Homo sapiens
cctccagaccctgcctg

SEQ ID NO: 3859773 - DNA, 19 bp, Homo sapiens
cctccagaccctgcctgag

SEQ ID NO: 3859774 - DNA, 21 bp, Homo sapiens
cctccagaccctgcctgagcc

SEQ ID NO: 3859775 - DNA, 13 bp, Homo sapiens
cctccagagccag

SEQ ID NO: 3859776 - DNA, 15 bp, Homo sapiens
cctccagagccagcc

SEQ ID NO: 3859777 - DNA, 18 bp, Homo sapiens
cctccagagccagcctgg

SEQ ID NO: 3859778 - DNA, 20 bp, Homo sapiens
cctccagagccagcctggga

SEQ ID NO: 3859779 - DNA, 21 bp, Homo sapiens
cctccagagccagcctgggac

SEQ ID NO: 3859780 - DNA, 23 bp, Homo sapiens
cctccagagccagcctgggactc

SEQ ID NO: 3859781 - DNA, 14 bp, Homo sapiens
cctccagctccagt

SEQ ID NO: 3859782 - DNA, 13 bp, Homo sapiens
cctccagctttcc

SEQ ID NO: 3859783 - DNA, 18 bp, Homo sapiens
cctccaggcatgctggcc

SEQ ID NO: 3859784 - DNA, 19 bp, Homo sapiens
cctccaggcatgctggcct

SEQ ID NO: 3859785 - DNA, 20 bp, Homo sapiens
cctccaggcatgctggcctc

SEQ ID NO: 3859786 - DNA, 19 bp, Homo sapiens
cctccagggaatccgcctg

SEQ ID NO: 3859787 - DNA, 20 bp, Homo sapiens
cctccagggccacgtgccag

SEQ ID NO: 3859788 - DNA, 21 bp, Homo sapiens
cctccagggccacgtgccagg

SEQ ID NO: 3859789 - DNA, 16 bp, Homo sapiens
cctccatccggctcct

SEQ ID NO: 3859790 - DNA, 19 bp, Homo sapiens
cctccatgctgcctccaga

SEQ ID NO: 3859791 - DNA, 18 bp, Homo sapiens
cctccatggtggaagggg

SEQ ID NO: 3859792 - DNA, 14 bp, Homo sapiens
cctccatgtggccc

SEQ ID NO: 3859793 - DNA, 15 bp, Homo sapiens
cctccatgtggcccc

SEQ ID NO: 3859794 - DNA, 20 bp, Homo sapiens
cctccatttcaactccagaa

SEQ ID NO: 3859795 - DNA, 20 bp, Homo sapiens
cctccatttctctccaggaa

SEQ ID NO: 3859796 - DNA, 16 bp, Homo sapiens
cctcccaccccactcc

SEQ ID NO: 3859797 - DNA, 19 bp, Homo sapiens
cctcccaccccactccagc

SEQ ID NO: 3859798 - DNA, 18 bp, Homo sapiens
cctcccagccctatggat

SEQ ID NO: 3859799 - DNA, 12 bp, Homo sapiens
cctcccagcctg

SEQ ID NO: 3859800 - DNA, 14 bp, Homo sapiens
cctcccaggcgccc

SEQ ID NO: 3859801 - DNA, 22 bp, Homo sapiens
cctcccagttctacaagcatat

SEQ ID NO: 3859802 - DNA, 20 bp, Homo sapiens
cctccccaaacccatcagac

SEQ ID NO: 3859803 - DNA, 19 bp, Homo sapiens
cctccccaccttccccaga

SEQ ID NO: 3859804 - DNA, 23 bp, Homo sapiens
cctccccaccttccccagactca

SEQ ID NO: 3859805 - DNA, 14 bp, Homo sapiens
cctccccaggggag

SEQ ID NO: 3859806 - DNA, 17 bp, Homo sapiens
cctcccccagagccact

SEQ ID NO: 3859807 - DNA, 15 bp, Homo sapiens
cctccccctgccagt

SEQ ID NO: 3859808 - DNA, 17 bp, Homo sapiens
cctccccctgccagtgc

SEQ ID NO: 3859809 - DNA, 15 bp, Homo sapiens
cctccccctgctgct

SEQ ID NO: 3859810 - DNA, 21 bp, Homo sapiens
ccactctttgctacaataaat

SEQ ID NO: 3859811 - DNA, 16 bp, Homo sapiens
ccactgagacggcaga

SEQ ID NO: 3859812 - DNA, 18 bp, Homo sapiens
ccactgcactccagcctg

SEQ ID NO: 3859813 - DNA, 16 bp, Homo sapiens
ccactgccaggcacct

SEQ ID NO: 3859814 - DNA, 17 bp, Homo sapiens
ccactgccaggcacctg

SEQ ID NO: 3859815 - DNA, 16 bp, Homo sapiens
ccactgccctgcctgc

SEQ ID NO: 3859816 - DNA, 13 bp, Homo sapiens
ccactgcctcttc

SEQ ID NO: 3859817 - DNA, 16 bp, Homo sapiens
ccactgcctcttcctc

SEQ ID NO: 3859818 - DNA, 18 bp, Homo sapiens
ccactgctttccagcctg

SEQ ID NO: 3859819 - DNA, 20 bp, Homo sapiens
ccactggccagtcctagagc

SEQ ID NO: 3859820 - DNA, 24 bp, Homo sapiens
ccactggccagtcctagagctcct

SEQ ID NO: 3859821 - DNA, 15 bp, Homo sapiens
ccactgggtctcact

SEQ ID NO: 3859822 - DNA, 21 bp, Homo sapiens
ccactgggtctcactcctgag

SEQ ID NO: 3859823 - DNA, 14 bp, Homo sapiens
ccactgtacatata

SEQ ID NO: 3859824 - DNA, 14 bp, Homo sapiens
ccactgtcaccctc

SEQ ID NO: 3859825 - DNA, 14 bp, Homo sapiens
ccactgtccgcctc

SEQ ID NO: 3859826 - DNA, 15 bp, Homo sapiens
ccactgtccgcctct

SEQ ID NO: 3859827 - DNA, 19 bp, Homo sapiens
ccactgtcctggctgctct

SEQ ID NO: 3859828 - DNA, 12 bp, Homo sapiens
ccactgtgctta

SEQ ID NO: 3859829 - DNA, 16 bp, Homo sapiens
ccactgtggccagagc

SEQ ID NO: 3859830 - DNA, 17 bp, Homo sapiens
ccactgtggccagagct

SEQ ID NO: 3859831 - DNA, 19 bp, Homo sapiens
ccactgtggccagagctgg

SEQ ID NO: 3859832 - DNA, 15 bp, Homo sapiens
ccacttagccgtcca

SEQ ID NO: 3859833 - DNA, 20 bp, Homo sapiens
ccacttagccgtccatggca

SEQ ID NO: 3859834 - DNA, 22 bp, Homo sapiens
ccacttagccgtccatggcacc

SEQ ID NO: 3859835 - DNA, 22 bp, Homo sapiens
ccacttattccccattcttcct

SEQ ID NO: 3859836 - DNA, 13 bp, Homo sapiens
ccacttcaataga

SEQ ID NO: 3859837 - DNA, 14 bp, Homo sapiens
ccacttcactgtga

SEQ ID NO: 3859838 - DNA, 18 bp, Homo sapiens
ccacttcttaaaggcctg

SEQ ID NO: 3859839 - DNA, 19 bp, Homo sapiens
ccacttcttaaaggcctgg

SEQ ID NO: 3859840 - DNA, 22 bp, Homo sapiens
ccacttcttaaaggcctggaac

SEQ ID NO: 3859841 - DNA, 14 bp, Homo sapiens
ccacttgacattcc

SEQ ID NO: 3859842 - DNA, 20 bp, Homo sapiens
ccactttggcttctcctgtg

SEQ ID NO: 3859843 - DNA, 18 bp, Homo sapiens
ccactttggtcccgtgca

SEQ ID NO: 3859844 - DNA, 14 bp, Homo sapiens
ccactttgttggaa

SEQ ID NO: 3859845 - DNA, 14 bp, Homo sapiens
ccagaaaatataaa

SEQ ID NO: 3859846 - DNA, 15 bp, Homo sapiens
ccagaaaatataaat

SEQ ID NO: 3859847 - DNA, 22 bp, Homo sapiens
ccagaaaatataaatgcatgat

SEQ ID NO: 3859848 - DNA, 16 bp, Homo sapiens
ccagaaactccttttg

SEQ ID NO: 3859849 - DNA, 15 bp, Homo sapiens
ccagaaccacactgt

SEQ ID NO: 3859850 - DNA, 19 bp, Homo sapiens
ccagaagaatattcaggac

SEQ ID NO: 3859851 - DNA, 17 bp, Homo sapiens
ccagaagatgccctcca

SEQ ID NO: 3859852 - DNA, 19 bp, Homo sapiens
ccagaaggagggcagagcc

SEQ ID NO: 3859853 - DNA, 20 bp, Homo sapiens
ccagaaggagggcagagcca

SEQ ID NO: 3859854 - DNA, 21 bp, Homo sapiens
ccagaaggagggcagagccat

SEQ ID NO: 3859855 - DNA, 18 bp, Homo sapiens
ccagaagggagttgctca

SEQ ID NO: 3859856 - DNA, 17 bp, Homo sapiens
ccagaagtggggctctg

SEQ ID NO: 3859857 - DNA, 19 bp, Homo sapiens
ccagaagtggggctctggg

SEQ ID NO: 3859858 - DNA, 20 bp, Homo sapiens
ccagaatcataattttcaag

SEQ ID NO: 3859859 - DNA, 15 bp, Homo sapiens
ccagaatctgctgtt

SEQ ID NO: 3859860 - DNA, 17 bp, Homo sapiens
ccagaatctgctgttgc

SEQ ID NO: 3859861 - DNA, 19 bp, Homo sapiens
ccagaatcttcgtcctgcc

SEQ ID NO: 3859862 - DNA, 16 bp, Homo sapiens
ccagacacagatacat

SEQ ID NO: 3859863 - DNA, 14 bp, Homo sapiens
ccagacagatacag

SEQ ID NO: 3859864 - DNA, 18 bp, Homo sapiens
ccagacatacgaaacaca

SEQ ID NO: 3859865 - DNA, 20 bp, Homo sapiens
ccagacatacgaaacacaaa

SEQ ID NO: 3859866 - DNA, 13 bp, Homo sapiens
ccagaccacctgc

SEQ ID NO: 3859867 - DNA, 20 bp, Homo sapiens
ccagaccacctgccagccat

SEQ ID NO: 3859868 - DNA, 18 bp, Homo sapiens
ccagaccattgtcttcca

SEQ ID NO: 3859869 - DNA, 22 bp, Homo sapiens
ccagaccattgtcttccaaccc

SEQ ID NO: 3859870 - DNA, 17 bp, Homo sapiens
ccagacccctgtggcag

SEQ ID NO: 3859871 - DNA, 13 bp, Homo sapiens
ccagaccctgcct

SEQ ID NO: 3859872 - DNA, 14 bp, Homo sapiens
ccagaccctgcctg

SEQ ID NO: 3859873 - DNA, 18 bp, Homo sapiens
ccagaccctgcctgagcc

SEQ ID NO: 3859874 - DNA, 16 bp, Homo sapiens
ccagacctagacctgg

SEQ ID NO: 3859875 - DNA, 18 bp, Homo sapiens
ccagacctagacctgggc

SEQ ID NO: 3859876 - DNA, 17 bp, Homo sapiens
ccagactcctttcctct

SEQ ID NO: 3859877 - DNA, 18 bp, Homo sapiens
ccagactcctttcctctg

SEQ ID NO: 3859878 - DNA, 21 bp, Homo sapiens
ccagactcgttcttctgggaa

SEQ ID NO: 3859879 - DNA, 20 bp, Homo sapiens
ccagactttctacacctgtt

SEQ ID NO: 3859880 - DNA, 18 bp, Homo sapiens
ccagagaatcagggcagg

SEQ ID NO: 3859881 - DNA, 12 bp, Homo sapiens
ccagagacagga

SEQ ID NO: 3859882 - DNA, 15 bp, Homo sapiens
ccagagacaggaaaa

SEQ ID NO: 3859883 - DNA, 23 bp, Homo sapiens
ccagagacaggaaaatcctctgg

SEQ ID NO: 3859884 - DNA, 18 bp, Homo sapiens
ccagagacctgaggcaga

SEQ ID NO: 3859885 - DNA, 21 bp, Homo sapiens
ccagagacctgaggcagatga

SEQ ID NO: 3859886 - DNA, 20 bp, Homo sapiens
ccagagagaggatgcagagg

SEQ ID NO: 3859887 - DNA, 15 bp, Homo sapiens
ccagagaggagcacc

SEQ ID NO: 3859888 - DNA, 16 bp, Homo sapiens
ccagagaggagcacct

SEQ ID NO: 3859889 - DNA, 15 bp, Homo sapiens
ccagagagtcctctg

SEQ ID NO: 3859890 - DNA, 16 bp, Homo sapiens
ccagagagtggctcct

SEQ ID NO: 3859891 - DNA, 18 bp, Homo sapiens
ccagagatgcctccaccg

SEQ ID NO: 3859892 - DNA, 21 bp, Homo sapiens
ccagagcattacgtgagccag

SEQ ID NO: 3859893 - DNA, 20 bp, Homo sapiens
ccagagccactacctttgtc

SEQ ID NO: 3859894 - DNA, 15 bp, Homo sapiens
ccagagccagcctgg

SEQ ID NO: 3859895 - DNA, 19 bp, Homo sapiens
ccagagcccaagtgccatc

SEQ ID NO: 3859896 - DNA, 21 bp, Homo sapiens
ccagagcccaagtgccatccc

SEQ ID NO: 3859897 - DNA, 23 bp, Homo sapiens
ccagagccccccacaatgatgat

SEQ ID NO: 3859898 - DNA, 20 bp, Homo sapiens
ccagagccggggcactttca

SEQ ID NO: 3859899 - DNA, 13 bp, Homo sapiens
ccagagcctgggg

SEQ ID NO: 3859900 - DNA, 15 bp, Homo sapiens
ccagagcctggggct

SEQ ID NO: 3859901 - DNA, 23 bp, Homo sapiens
ccagagctggaaggcagggcaga

SEQ ID NO: 3859902 - DNA, 21 bp, Homo sapiens
ccagagcttattggccactgg

SEQ ID NO: 3859903 - DNA, 19 bp, Homo sapiens
ccagaggccaaggaggcct

SEQ ID NO: 3859904 - DNA, 14 bp, Homo sapiens
ccagaggctgcaga

SEQ ID NO: 3859905 - DNA, 21 bp, Homo sapiens
ccagagggccaagagagacat

SEQ ID NO: 3859906 - DNA, 18 bp, Homo sapiens
ccagaggttatctgcctg

SEQ ID NO: 3859907 - DNA, 13 bp, Homo sapiens
ccagagtctgagc

SEQ ID NO: 3859908 - DNA, 18 bp, Homo sapiens
ccagagtctgagcccccg

SEQ ID NO: 3859909 - DNA, 19 bp, Homo sapiens
ccagagtgaaagggctatg

SEQ ID NO: 3859910 - DNA, 20 bp, Homo sapiens
ccagagtgtgcagactgatg

SEQ ID NO: 3859911 - DNA, 19 bp, Homo sapiens
ccagagttccacaaatcta

SEQ ID NO: 3859912 - DNA, 21 bp, Homo sapiens
ccagatacttcccattttgga

SEQ ID NO: 3859913 - DNA, 18 bp, Homo sapiens
ccagatcaccagcccggc

SEQ ID NO: 3859914 - DNA, 13 bp, Homo sapiens
ccagatccaccct

SEQ ID NO: 3859915 - DNA, 18 bp, Homo sapiens
ccagatcctctgctgact

SEQ ID NO: 3859916 - DNA, 21 bp, Homo sapiens
ccagatcctctgctgactcca

SEQ ID NO: 3859917 - DNA, 21 bp, Homo sapiens
ccagatctgcctgggcctgtg

SEQ ID NO: 3859918 - DNA, 20 bp, Homo sapiens
ccagatgccttcctgtcttt

SEQ ID NO: 3859919 - DNA, 12 bp, Homo sapiens
ccagatgctggg

SEQ ID NO: 3859920 - DNA, 14 bp, Homo sapiens
ccagatgctgggga

SEQ ID NO: 3859921 - DNA, 21 bp, Homo sapiens
ccagatttgctaatttatcct

SEQ ID NO: 3859922 - DNA, 18 bp, Homo sapiens
ccagcaaaccaggactct

SEQ ID NO: 3859923 - DNA, 13 bp, Homo sapiens
ccagcaacatctc

SEQ ID NO: 3859924 - DNA, 17 bp, Homo sapiens
ccagcaatgatgtccag

SEQ ID NO: 3859925 - DNA, 18 bp, Homo sapiens
ccagcaatgatgtccaga

SEQ ID NO: 3859926 - DNA, 13 bp, Homo sapiens
ccagcacaggggc

SEQ ID NO: 3859927 - DNA, 20 bp, Homo sapiens
ccagcaccctctcctggggg

SEQ ID NO: 3859928 - DNA, 20 bp, Homo sapiens
ccagcactttgggaggctga

SEQ ID NO: 3859929 - DNA, 14 bp, Homo sapiens
ccagcagaaaagtg

SEQ ID NO: 3859930 - DNA, 16 bp, Homo sapiens
ccagcagaaaagtgct

SEQ ID NO: 3859931 - DNA, 17 bp, Homo sapiens
ccagcagaaaagtgctt

SEQ ID NO: 3859932 - DNA, 21 bp, Homo sapiens
ccagcagccctaaggatctct

SEQ ID NO: 3859933 - DNA, 21 bp, Homo sapiens
ccagcagccctggcctgtgga

SEQ ID NO: 3859934 - DNA, 24 bp, Homo sapiens
ccagcagctgcgggtctgaaggaa

SEQ ID NO: 3859935 - DNA, 22 bp, Homo sapiens
ccagcagctgggccggccagcc

SEQ ID NO: 3859936 - DNA, 13 bp, Homo sapiens
ccagcaggtgtgg

SEQ ID NO: 3859937 - DNA, 23 bp, Homo sapiens
ccagcaggtgtggtggctcatgg

SEQ ID NO: 3859938 - DNA, 16 bp, Homo sapiens
ccagcatccagcctgt

SEQ ID NO: 3859939 - DNA, 15 bp, Homo sapiens
ccagcatcctgcttc

SEQ ID NO: 3859940 - DNA, 15 bp, Homo sapiens
ccagcattcatgccg

SEQ ID NO: 3859941 - DNA, 22 bp, Homo sapiens
ccagcatttgccattcctggaa

SEQ ID NO: 3859942 - DNA, 21 bp, Homo sapiens
ccagccaacatttaatgagca

SEQ ID NO: 3859943 - DNA, 22 bp, Homo sapiens
ccagccagtcttgcctaggcca

SEQ ID NO: 3859944 - DNA, 19 bp, Homo sapiens
ccagccatggtgaggaagc

SEQ ID NO: 3859945 - DNA, 14 bp, Homo sapiens
ccagcccagcccag

SEQ ID NO: 3859946 - DNA, 14 bp, Homo sapiens
ccagccccaggggt

SEQ ID NO: 3859947 - DNA, 23 bp, Homo sapiens
ccagccccaggggtgcctgtggg

SEQ ID NO: 3859948 - DNA, 15 bp, Homo sapiens
ccagccccctggatg

SEQ ID NO: 3859949 - DNA, 21 bp, Homo sapiens
ccagccctacatcttcagctc

SEQ ID NO: 3859950 - DNA, 16 bp, Homo sapiens
ccagccctatggatgt

SEQ ID NO: 3859951 - DNA, 21 bp, Homo sapiens
ccagccctccccgcagtggga

SEQ ID NO: 3859952 - DNA, 14 bp, Homo sapiens
ccagccctccctgt

SEQ ID NO: 3859953 - DNA, 19 bp, Homo sapiens
ccagccctccctgtcctcc

SEQ ID NO: 3859954 - DNA, 20 bp, Homo sapiens
ccagccctccctgtcctcct

SEQ ID NO: 3859955 - DNA, 13 bp, Homo sapiens
ccagccctgccag

SEQ ID NO: 3859956 - DNA, 17 bp, Homo sapiens
ccagccctgccaggagg

SEQ ID NO: 3859957 - DNA, 21 bp, Homo sapiens
ccagccctgccaggaggctgc

SEQ ID NO: 3859958 - DNA, 21 bp, Homo sapiens
ccagccctgcctggaggacct

SEQ ID NO: 3859959 - DNA, 23 bp, Homo sapiens
ccagccctttgcaggcccagcag

SEQ ID NO: 3859960 - DNA, 19 bp, Homo sapiens
ccagccgccatcagcccaa

SEQ ID NO: 3859961 - DNA, 14 bp, Homo sapiens
ccagccgccctggg

SEQ ID NO: 3859962 - DNA, 15 bp, Homo sapiens
ccagccgccctgggc

SEQ ID NO: 3859963 - DNA, 16 bp, Homo sapiens
ccagccgccctgggct

SEQ ID NO: 3859964 - DNA, 19 bp, Homo sapiens
ccagccgtgatgctcaggc

SEQ ID NO: 3859965 - DNA, 20 bp, Homo sapiens
ccagccgtgatgctcaggct

SEQ ID NO: 3859966 - DNA, 17 bp, Homo sapiens
ccagcctcagctcagcc

SEQ ID NO: 3859967 - DNA, 16 bp, Homo sapiens
ccagcctctcccggct

SEQ ID NO: 3859968 - DNA, 20 bp, Homo sapiens
ccagcctctcccggctgcct

SEQ ID NO: 3859969 - DNA, 13 bp, Homo sapiens
ccagcctggcctc

SEQ ID NO: 3859970 - DNA, 19 bp, Homo sapiens
ccagcctgggactcccagt

SEQ ID NO: 3859971 - DNA, 11 bp, Homo sapiens
ccagcctgggc

SEQ ID NO: 3859972 - DNA, 13 bp, Homo sapiens
ccagcctgggcct

SEQ ID NO: 3859973 - DNA, 22 bp, Homo sapiens
ccagcctgggcctatggagagc

SEQ ID NO: 3859974 - DNA, 22 bp, Homo sapiens
ccagcctggtgcccatcctccc

SEQ ID NO: 3859975 - DNA, 18 bp, Homo sapiens
ccagcctgtgtgttctgt

SEQ ID NO: 3859976 - DNA, 22 bp, Homo sapiens
ccagcgattccctctcccaggc

SEQ ID NO: 3859977 - DNA, 15 bp, Homo sapiens
ccagcgcctgccctc

SEQ ID NO: 3859978 - DNA, 14 bp, Homo sapiens
ccagctacattcct

SEQ ID NO: 3859979 - DNA, 18 bp, Homo sapiens
ccagctactctgtccagg

SEQ ID NO: 3859980 - DNA, 19 bp, Homo sapiens
ccagctactctgtccaggc

SEQ ID NO: 3859981 - DNA, 16 bp, Homo sapiens
ccagctagggctggac

SEQ ID NO: 3859982 - DNA, 18 bp, Homo sapiens
ccagctagtgacccacat

SEQ ID NO: 3859983 - DNA, 15 bp, Homo sapiens
ccagctatctgtcat

SEQ ID NO: 3859984 - DNA, 17 bp, Homo sapiens
ccagctcacaagcccag

SEQ ID NO: 3859985 - DNA, 20 bp, Homo sapiens
ccagctccttttgtccccag

SEQ ID NO: 3859986 - DNA, 21 bp, Homo sapiens
ccagctccttttgtccccagg

SEQ ID NO: 3859987 - DNA, 22 bp, Homo sapiens
ccagctccttttgtccccaggg

SEQ ID NO: 3859988 - DNA, 20 bp, Homo sapiens
ccagctctccctctggccct

SEQ ID NO: 3859989 - DNA, 16 bp, Homo sapiens
ccagctctgtggcctg

SEQ ID NO: 3859990 - DNA, 22 bp, Homo sapiens
ccagctctgtggcctgtgtcca

SEQ ID NO: 3859991 - DNA, 15 bp, Homo sapiens
ccagctgaggctggg

SEQ ID NO: 3859992 - DNA, 18 bp, Homo sapiens
ccagctgccgaccagagc

SEQ ID NO: 3859993 - DNA, 20 bp, Homo sapiens
ccagctgccgaccagagccc

SEQ ID NO: 3859994 - DNA, 11 bp, Homo sapiens
ccagctgcctt

SEQ ID NO: 3859995 - DNA, 19 bp, Homo sapiens
ccagctgccttcctcatcc

SEQ ID NO: 3859996 - DNA, 12 bp, Homo sapiens
ccagctggcctc

SEQ ID NO: 3859997 - DNA, 13 bp, Homo sapiens
ccagctggcctct

SEQ ID NO: 3859998 - DNA, 17 bp, Homo sapiens
ccagctggcctctagaa

SEQ ID NO: 3859999 - DNA, 21 bp, Homo sapiens
ccagctgtagccatggctcag

SEQ ID NO: 3860000 - DNA, 22 bp, Homo sapiens
ccagctgtagccatggctcagg

SEQ ID NO: 3860001 - DNA, 23 bp, Homo sapiens
ccagctgtagccatggctcaggc

SEQ ID NO: 3860002 - DNA, 22 bp, Homo sapiens
ccagctgtctgtgtcagcctgt

SEQ ID NO: 3860003 - DNA, 14 bp, Homo sapiens
ccagcttcctggtg

SEQ ID NO: 3860004 - DNA, 14 bp, Homo sapiens
ccagcttcctgtgg

SEQ ID NO: 3860005 - DNA, 14 bp, Homo sapiens
ccagcttctccagg

SEQ ID NO: 3860006 - DNA, 17 bp, Homo sapiens
ccagcttctccaggctc

SEQ ID NO: 3860007 - DNA, 16 bp, Homo sapiens
ccagcttgctcttcag

SEQ ID NO: 3860008 - DNA, 14 bp, Homo sapiens
ccaggaactgggcc

SEQ ID NO: 3860009 - DNA, 14 bp, Homo sapiens
ccaggaaggcagct

SEQ ID NO: 3860010 - DNA, 15 bp, Homo sapiens
ccaggaaggcagctg

SEQ ID NO: 3860011 - DNA, 18 bp, Homo sapiens
ccaggaaggcagctgctc

SEQ ID NO: 3860012 - DNA, 19 bp, Homo sapiens
ccaggaaggcagctgctct

SEQ ID NO: 3860013 - DNA, 22 bp, Homo sapiens
ccaggaagggggtccacccagc

SEQ ID NO: 3860014 - DNA, 17 bp, Homo sapiens
ccaggacaagcatggtc

SEQ ID NO: 3860015 - DNA, 23 bp, Homo sapiens
ccaggacaagcatggtcccacat

SEQ ID NO: 3860016 - DNA, 20 bp, Homo sapiens
ccaggacacctgccccagcg

SEQ ID NO: 3860017 - DNA, 17 bp, Homo sapiens
ccaggacaggcccggcg

SEQ ID NO: 3860018 - DNA, 20 bp, Homo sapiens
ccaggactaatgcatgtggt

SEQ ID NO: 3860019 - DNA, 15 bp, Homo sapiens
ccaggagaagaaaga

SEQ ID NO: 3860020 - DNA, 20 bp, Homo sapiens
ccaggagaagaaagaggtga

SEQ ID NO: 3860021 - DNA, 11 bp, Homo sapiens
ccaggagagag

SEQ ID NO: 3860022 - DNA, 12 bp, Homo sapiens
ccaggagagaga

SEQ ID NO: 3860023 - DNA, 23 bp, Homo sapiens
ccaggagagccagccctccctgt

SEQ ID NO: 3860024 - DNA, 19 bp, Homo sapiens
ccaggagctgagtcacctc

SEQ ID NO: 3860025 - DNA, 23 bp, Homo sapiens
ccaggagctgagtcacctcctcc

SEQ ID NO: 3860026 - DNA, 14 bp, Homo sapiens
ccaggaggctgcgg

SEQ ID NO: 3860027 - DNA, 16 bp, Homo sapiens
ccaggagggacaaagg

SEQ ID NO: 3860028 - DNA, 19 bp, Homo sapiens
ccaggaggtcctcctctct

SEQ ID NO: 3860029 - DNA, 19 bp, Homo sapiens
ccaggaggttggtgactga

SEQ ID NO: 3860030 - DNA, 14 bp, Homo sapiens
ccaggagtctgtgc

SEQ ID NO: 3860031 - DNA, 17 bp, Homo sapiens
ccaggagtctgtgctct

SEQ ID NO: 3860032 - DNA, 18 bp, Homo sapiens
ccaggagtctgtgctctt

SEQ ID NO: 3860033 - DNA, 14 bp, Homo sapiens
ccaggagttctgaa

SEQ ID NO: 3860034 - DNA, 15 bp, Homo sapiens
ccaggagttctgaag

SEQ ID NO: 3860035 - DNA, 24 bp, Homo sapiens
ccaggatcccaagcgtcccgtccc

SEQ ID NO: 3860036 - DNA, 22 bp, Homo sapiens
ccaggatcccagagcttcccag

SEQ ID NO: 3860037 - DNA, 14 bp, Homo sapiens
ccaggatgaaggcg

SEQ ID NO: 3860038 - DNA, 22 bp, Homo sapiens
ccaggatgacacctccatttct

SEQ ID NO: 3860039 - DNA, 17 bp, Homo sapiens
ccaggattgaagagcat

SEQ ID NO: 3860040 - DNA, 18 bp, Homo sapiens
ccaggattgaagagcatt

SEQ ID NO: 3860041 - DNA, 21 bp, Homo sapiens
ccaggcaccccctggagagaa

SEQ ID NO: 3860042 - DNA, 22 bp, Homo sapiens
ccaggcacccttctttcctctt

SEQ ID NO: 3860043 - DNA, 18 bp, Homo sapiens
ccaggcacgaacccacct

SEQ ID NO: 3860044 - DNA, 19 bp, Homo sapiens
ccaggcacgaacccacctg

SEQ ID NO: 3860045 - DNA, 16 bp, Homo sapiens
ccaggcactgctgccc

SEQ ID NO: 3860046 - DNA, 15 bp, Homo sapiens
ccaggcactgtctta

SEQ ID NO: 3860047 - DNA, 17 bp, Homo sapiens
ccaggcaggtgcctgga

SEQ ID NO: 3860048 - DNA, 14 bp, Homo sapiens
ccaggcatcccatc

SEQ ID NO: 3860049 - DNA, 18 bp, Homo sapiens
ccaggcatcccatccctt

SEQ ID NO: 3860050 - DNA, 16 bp, Homo sapiens
ccaggcatgctggcct

SEQ ID NO: 3860051 - DNA, 18 bp, Homo sapiens
ccaggcatgctggcctcc

SEQ ID NO: 3860052 - DNA, 12 bp, Homo sapiens
ccaggccaccag

SEQ ID NO: 3860053 - DNA, 12 bp, Homo sapiens
ccaggccactgt

SEQ ID NO: 3860054 - DNA, 20 bp, Homo sapiens
ccaggccactgtggccagag

SEQ ID NO: 3860055 - DNA, 21 bp, Homo sapiens
ccaggccactgtggccagagc

SEQ ID NO: 3860056 - DNA, 12 bp, Homo sapiens
ccaggccaggcc

SEQ ID NO: 3860057 - DNA, 14 bp, Homo sapiens
ccaggcccatctca

SEQ ID NO: 3860058 - DNA, 16 bp, Homo sapiens
ccaggcccatctcagg

SEQ ID NO: 3860059 - DNA, 13 bp, Homo sapiens
ccaggccccatga

SEQ ID NO: 3860060 - DNA, 16 bp, Homo sapiens
ccaggccccatgacct

SEQ ID NO: 3860061 - DNA, 17 bp, Homo sapiens
ccaggccccatgacctc

SEQ ID NO: 3860062 - DNA, 22 bp, Homo sapiens
ccaggccccatgacctccagct

SEQ ID NO: 3860063 - DNA, 15 bp, Homo sapiens
ccaggcccctgagga

SEQ ID NO: 3860064 - DNA, 15 bp, Homo sapiens
ccaggcccggggctg

SEQ ID NO: 3860065 - DNA, 20 bp, Homo sapiens
ccaggcccggggctggcggc

SEQ ID NO: 3860066 - DNA, 21 bp, Homo sapiens
ccaggccctaggattcctccc

SEQ ID NO: 3860067 - DNA, 15 bp, Homo sapiens
ccaggccctccatgg

SEQ ID NO: 3860068 - DNA, 20 bp, Homo sapiens
ccaggccctccatgggctag

SEQ ID NO: 3860069 - DNA, 21 bp, Homo sapiens
ccaggccctccatgggctagt

SEQ ID NO: 3860070 - DNA, 14 bp, Homo sapiens
ccaggccctccctg

SEQ ID NO: 3860071 - DNA, 19 bp, Homo sapiens
ccaggccgcctgccatacc

SEQ ID NO: 3860072 - DNA, 13 bp, Homo sapiens
ccaggcctccagc

SEQ ID NO: 3860073 - DNA, 16 bp, Homo sapiens
ccaggcctccagcctc

SEQ ID NO: 3860074 - DNA, 19 bp, Homo sapiens
ccaggcctccagcctctcc

SEQ ID NO: 3860075 - DNA, 18 bp, Homo sapiens
ccaggcctctgtgtcctt

SEQ ID NO: 3860076 - DNA, 12 bp, Homo sapiens
ccaggcctgcct

SEQ ID NO: 3860077 - DNA, 23 bp, Homo sapiens
ccaggcgggcggcacgccaacag

SEQ ID NO: 3860078 - DNA, 19 bp, Homo sapiens
ccaggcgttggtgccactt

SEQ ID NO: 3860079 - DNA, 17 bp, Homo sapiens
ccaggctctgcctggag

SEQ ID NO: 3860080 - DNA, 16 bp, Homo sapiens
ccaggctctgggaagg

SEQ ID NO: 3860081 - DNA, 21 bp, Homo sapiens
ccaggctctgggaaggggtgc

SEQ ID NO: 3860082 - DNA, 12 bp, Homo sapiens
ccaggctcttcc

SEQ ID NO: 3860083 - DNA, 17 bp, Homo sapiens
ccaggctcttcctggac

SEQ ID NO: 3860084 - DNA, 19 bp, Homo sapiens
ccaggctcttcctggacct

SEQ ID NO: 3860085 - DNA, 22 bp, Homo sapiens
ccaggctcttcctggacctgag

SEQ ID NO: 3860086 - DNA, 15 bp, Homo sapiens
ccaggctgaggtcct

SEQ ID NO: 3860087 - DNA, 23 bp, Homo sapiens
ccaggctggtctcgaactcctga

SEQ ID NO: 3860088 - DNA, 18 bp, Homo sapiens
ccaggcttcaccctgaat

SEQ ID NO: 3860089 - DNA, 21 bp, Homo sapiens
ccagggaatccgcctgcagag

SEQ ID NO: 3860090 - DNA, 22 bp, Homo sapiens
ccagggaatccgcctgcagagg

SEQ ID NO: 3860091 - DNA, 13 bp, Homo sapiens
ccagggaggagag

SEQ ID NO: 3860092 - DNA, 14 bp, Homo sapiens
ccagggaggagagg

SEQ ID NO: 3860093 - DNA, 15 bp, Homo sapiens
ccagggaggagagga

SEQ ID NO: 3860094 - DNA, 10 bp, Homo sapiens
ccagggcaca

SEQ ID NO: 3860095 - DNA, 15 bp, Homo sapiens
ccagggcacaggagc

SEQ ID NO: 3860096 - DNA, 13 bp, Homo sapiens
ccagggccacgtg

SEQ ID NO: 3860097 - DNA, 17 bp, Homo sapiens
ccagggccacgtgccag

SEQ ID NO: 3860098 - DNA, 12 bp, Homo sapiens
ccagggccaggg

SEQ ID NO: 3860099 - DNA, 19 bp, Homo sapiens
ccagggcccctccctctgc

SEQ ID NO: 3860100 - DNA, 21 bp, Homo sapiens
ccagggcctggtgtgaggctg

SEQ ID NO: 3860101 - DNA, 17 bp, Homo sapiens
ccagggctccctcctgg

SEQ ID NO: 3860102 - DNA, 20 bp, Homo sapiens
ccaggggagagggtctggag

SEQ ID NO: 3860103 - DNA, 18 bp, Homo sapiens
ccaggggcccacagggaa

SEQ ID NO: 3860104 - DNA, 19 bp, Homo sapiens
ccaggggcccacagggaac

SEQ ID NO: 3860105 - DNA, 21 bp, Homo sapiens
ccaggggctgctcatcaccca

SEQ ID NO: 3860106 - DNA, 22 bp, Homo sapiens
ccaggggctgctcatcacccag

SEQ ID NO: 3860107 - DNA, 16 bp, Homo sapiens
ccaggggtctccctgg

SEQ ID NO: 3860108 - DNA, 18 bp, Homo sapiens
ccaggggtctccctggag

SEQ ID NO: 3860109 - DNA, 21 bp, Homo sapiens
ccaggggtgatttcagagagg

SEQ ID NO: 3860110 - DNA, 20 bp, Homo sapiens
ccaggggtgctatgacatgc

SEQ ID NO: 3860111 - DNA, 19 bp, Homo sapiens
ccagggtccgcaccagctg

SEQ ID NO: 3860112 - DNA, 17 bp, Homo sapiens
ccagggtcttgggctac

SEQ ID NO: 3860113 - DNA, 20 bp, Homo sapiens
ccagggtcttgggctactgg

SEQ ID NO: 3860114 - DNA, 22 bp, Homo sapiens
ccagggtcttgggctactggca

SEQ ID NO: 3860115 - DNA, 17 bp, Homo sapiens
ccagggtgagagctgct

SEQ ID NO: 3860116 - DNA, 18 bp, Homo sapiens
ccagggtgcatggcttgg

SEQ ID NO: 3860117 - DNA, 22 bp, Homo sapiens
ccagggtgcatggcttggggag

SEQ ID NO: 3860118 - DNA, 22 bp, Homo sapiens
ccagggtgttacaaggcacttg

SEQ ID NO: 3860119 - DNA, 17 bp, Homo sapiens
ccagggtttacccagtg

SEQ ID NO: 3860120 - DNA, 17 bp, Homo sapiens
ccaggtatctccaggat

SEQ ID NO: 3860121 - DNA, 13 bp, Homo sapiens
ccaggtcctctga

SEQ ID NO: 3860122 - DNA, 14 bp, Homo sapiens
ccaggtcctctgat

SEQ ID NO: 3860123 - DNA, 14 bp, Homo sapiens
ccaggtcctggtgg

SEQ ID NO: 3860124 - DNA, 21 bp, Homo sapiens
ccaggtgccaccaataaaaat

SEQ ID NO: 3860125 - DNA, 13 bp, Homo sapiens
ccaggtgccagtt

SEQ ID NO: 3860126 - DNA, 17 bp, Homo sapiens
ccaggtgccagttatgg

SEQ ID NO: 3860127 - DNA, 16 bp, Homo sapiens
ccaggtggccactcca

SEQ ID NO: 3860128 - DNA, 21 bp, Homo sapiens
ccaggtggccactccagaccc

SEQ ID NO: 3860129 - DNA, 17 bp, Homo sapiens
ccaggtggctgacccag

SEQ ID NO: 3860130 - DNA, 21 bp, Homo sapiens
ccaggtggctgacccagtccc

SEQ ID NO: 3860131 - DNA, 22 bp, Homo sapiens
ccaggtggctgacccagtccct

SEQ ID NO: 3860132 - DNA, 14 bp, Homo sapiens
ccaggtgggagaga

SEQ ID NO: 3860133 - DNA, 22 bp, Homo sapiens
ccaggtgggagagacactccca

SEQ ID NO: 3860134 - DNA, 18 bp, Homo sapiens
ccaggtgttgccatttct

SEQ ID NO: 3860135 - DNA, 17 bp, Homo sapiens
ccagtactgggaaggag

SEQ ID NO: 3860136 - DNA, 15 bp, Homo sapiens
ccagtcccagagcag

SEQ ID NO: 3860137 - DNA, 13 bp, Homo sapiens
ccagtccctgggg

SEQ ID NO: 3860138 - DNA, 16 bp, Homo sapiens
ccagtcctagagctcc

SEQ ID NO: 3860139 - DNA, 12 bp, Homo sapiens
ccagtcctggcc

SEQ ID NO: 3860140 - DNA, 17 bp, Homo sapiens
ccagtcttgcctaggcc

SEQ ID NO: 3860141 - DNA, 16 bp, Homo sapiens
ccagtgaaccaaagag

SEQ ID NO: 3860142 - DNA, 20 bp, Homo sapiens
ccagtgaacttacacttgga

SEQ ID NO: 3860143 - DNA, 12 bp, Homo sapiens
ccagtgaagact

SEQ ID NO: 3860144 - DNA, 15 bp, Homo sapiens
ccagtgagctggaat

SEQ ID NO: 3860145 - DNA, 16 bp, Homo sapiens
ccagtgagggctgggc

SEQ ID NO: 3860146 - DNA, 20 bp, Homo sapiens
ccagtgagggctgggcccac

SEQ ID NO: 3860147 - DNA, 14 bp, Homo sapiens
ccagtgccacagag

SEQ ID NO: 3860148 - DNA, 17 bp, Homo sapiens
ccagtgccttacctcct

SEQ ID NO: 3860149 - DNA, 18 bp, Homo sapiens
ccagtgccttacctcctg

SEQ ID NO: 3860150 - DNA, 19 bp, Homo sapiens
ccagtgccttacctcctgc

SEQ ID NO: 3860151 - DNA, 16 bp, Homo sapiens
ccagtgctgccatgcc

SEQ ID NO: 3860152 - DNA, 20 bp, Homo sapiens
ccagtggaacagtcaccctt

SEQ ID NO: 3860153 - DNA, 14 bp, Homo sapiens
ccagtggttgctgt

SEQ ID NO: 3860154 - DNA, 18 bp, Homo sapiens
ccagtgtccccacgtatg

SEQ ID NO: 3860155 - DNA, 17 bp, Homo sapiens
ccagtgtggctgtctgc

SEQ ID NO: 3860156 - DNA, 21 bp, Homo sapiens
ccagtgttacttttaattcct

SEQ ID NO: 3860157 - DNA, 16 bp, Homo sapiens
ccagttaagaatggaa

SEQ ID NO: 3860158 - DNA, 13 bp, Homo sapiens
ccagttaaggacc

SEQ ID NO: 3860159 - DNA, 19 bp, Homo sapiens
ccagttctacaagcatatt

SEQ ID NO: 3860160 - DNA, 15 bp, Homo sapiens
ccagttctgctcctc

SEQ ID NO: 3860161 - DNA, 19 bp, Homo sapiens
ccagttctgctcctctcca

SEQ ID NO: 3860162 - DNA, 22 bp, Homo sapiens
ccagttctgctcctctccaggc

SEQ ID NO: 3860163 - DNA, 15 bp, Homo sapiens
ccagttctggccagg

SEQ ID NO: 3860164 - DNA, 20 bp, Homo sapiens
ccagttgggagcactggagt

SEQ ID NO: 3860165 - DNA, 15 bp, Homo sapiens
ccagttggggccccg

SEQ ID NO: 3860166 - DNA, 23 bp, Homo sapiens
ccagtttagatttcaagaaaaaa

SEQ ID NO: 3860167 - DNA, 23 bp, Homo sapiens
ccagtttgcagaaaagcacctgc

SEQ ID NO: 3860168 - DNA, 22 bp, Homo sapiens
ccataaacacccatgaatcaaa

SEQ ID NO: 3860169 - DNA, 14 bp, Homo sapiens
ccataaacttcatg

SEQ ID NO: 3860170 - DNA, 13 bp, Homo sapiens
ccataacagccaa

SEQ ID NO: 3860171 - DNA, 15 bp, Homo sapiens
ccataacagccaaca

SEQ ID NO: 3860172 - DNA, 22 bp, Homo sapiens
ccataaggtgcagtaggagcaa

SEQ ID NO: 3860173 - DNA, 20 bp, Homo sapiens
ccataatagttagccctcag

SEQ ID NO: 3860174 - DNA, 21 bp, Homo sapiens
ccataatctggactcctctgt

SEQ ID NO: 3860175 - DNA, 20 bp, Homo sapiens
ccataattttttttttcctt

SEQ ID NO: 3860176 - DNA, 17 bp, Homo sapiens
ccataccatcactgagt

SEQ ID NO: 3860177 - DNA, 16 bp, Homo sapiens
ccatacccctgcctgg

SEQ ID NO: 3860178 - DNA, 16 bp, Homo sapiens
ccataccgctggggaa

SEQ ID NO: 3860179 - DNA, 19 bp, Homo sapiens
ccataccgctggggaacag

SEQ ID NO: 3860180 - DNA, 20 bp, Homo sapiens
ccataccgctggggaacaga

SEQ ID NO: 3860181 - DNA, 15 bp, Homo sapiens
ccatactcatttcta

SEQ ID NO: 3860182 - DNA, 18 bp, Homo sapiens
ccatacttttgagagggg

SEQ ID NO: 3860183 - DNA, 22 bp, Homo sapiens
ccatagaaacatgacactgacc

SEQ ID NO: 3860184 - DNA, 14 bp, Homo sapiens
ccatagcgctggct

SEQ ID NO: 3860185 - DNA, 15 bp, Homo sapiens
ccatagcgctggctc

SEQ ID NO: 3860186 - DNA, 17 bp, Homo sapiens
ccatagcgctggctcag

SEQ ID NO: 3860187 - DNA, 19 bp, Homo sapiens
ccatagcgctggctcagga

SEQ ID NO: 3860188 - DNA, 12 bp, Homo sapiens
ccatatgatatt

SEQ ID NO: 3860189 - DNA, 12 bp, Homo sapiens
ccatcaaatgct

SEQ ID NO: 3860190 - DNA, 19 bp, Homo sapiens
ccatcaatggaaacagggc

SEQ ID NO: 3860191 - DNA, 21 bp, Homo sapiens
ccatcaatggaaacagggcag

SEQ ID NO: 3860192 - DNA, 21 bp, Homo sapiens
ccatcaccctctgggcagctg

SEQ ID NO: 3860193 - DNA, 21 bp, Homo sapiens
ccatcacctactcacacaggc

SEQ ID NO: 3860194 - DNA, 16 bp, Homo sapiens
ccatcactgagtggct

SEQ ID NO: 3860195 - DNA, 14 bp, Homo sapiens
ccatcactggagca

SEQ ID NO: 3860196 - DNA, 18 bp, Homo sapiens
ccatcactggagcaccag

SEQ ID NO: 3860197 - DNA, 13 bp, Homo sapiens
ccatcagctccct

SEQ ID NO: 3860198 - DNA, 22 bp, Homo sapiens
ccatcagggtgggccactctcc

SEQ ID NO: 3860199 - DNA, 17 bp, Homo sapiens
ccatcatatgacatgcc

SEQ ID NO: 3860200 - DNA, 23 bp, Homo sapiens
ccatcatatgacatgccaccctc

SEQ ID NO: 3860201 - DNA, 15 bp, Homo sapiens
ccatcatcccagctg

SEQ ID NO: 3860202 - DNA, 14 bp, Homo sapiens
ccatccattctgcc

SEQ ID NO: 3860203 - DNA, 23 bp, Homo sapiens
ccatcccacattcggaccctgcc

SEQ ID NO: 3860204 - DNA, 14 bp, Homo sapiens
ccatcccctttcct

SEQ ID NO: 3860205 - DNA, 21 bp, Homo sapiens
ccatcccctttcctccccacc

SEQ ID NO: 3860206 - DNA, 16 bp, Homo sapiens
ccatccctgggcccct

SEQ ID NO: 3860207 - DNA, 17 bp, Homo sapiens
ccatccctgggcccctc

SEQ ID NO: 3860208 - DNA, 22 bp, Homo sapiens
ccatcccttcctccccagtcta

SEQ ID NO: 3860209 - DNA, 15 bp, Homo sapiens
ccatccggctcctgt

SEQ ID NO: 3860210 - DNA, 16 bp, Homo sapiens
ccatccgggacgcttc

SEQ ID NO: 3860211 - DNA, 17 bp, Homo sapiens
ccatccgggacgcttcc

SEQ ID NO: 3860212 - DNA, 23 bp, Homo sapiens
ccatccgggacgcttccagacca

SEQ ID NO: 3860213 - DNA, 20 bp, Homo sapiens
ccatcctaccaatgcatgca

SEQ ID NO: 3860214 - DNA, 18 bp, Homo sapiens
ccatcctgcagcctcctc

SEQ ID NO: 3860215 - DNA, 21 bp, Homo sapiens
ccatcctgcagcctcctcctg

SEQ ID NO: 3860216 - DNA, 12 bp, Homo sapiens
ccatcctggccc

SEQ ID NO: 3860217 - DNA, 16 bp, Homo sapiens
ccatcctggcccctcc

SEQ ID NO: 3860218 - DNA, 20 bp, Homo sapiens
ccatctaagctgcagcttcc

SEQ ID NO: 3860219 - DNA, 17 bp, Homo sapiens
ccatctagtggaaatga

SEQ ID NO: 3860220 - DNA, 22 bp, Homo sapiens
ccatctatgtcccttgctgtga

SEQ ID NO: 3860221 - DNA, 15 bp, Homo sapiens
ccatctcaggtgcca

SEQ ID NO: 3860222 - DNA, 15 bp, Homo sapiens
ccatctccatttcac

SEQ ID NO: 3860223 - DNA, 19 bp, Homo sapiens
ccatctccatttcacacag

SEQ ID NO: 3860224 - DNA, 12 bp, Homo sapiens
ccatctccccag

SEQ ID NO: 3860225 - DNA, 15 bp, Homo sapiens
ccatctccccaggcc

SEQ ID NO: 3860226 - DNA, 21 bp, Homo sapiens
ccatctcttcctacccaacca

SEQ ID NO: 3860227 - DNA, 19 bp, Homo sapiens
ccatctgcttggttggctg

SEQ ID NO: 3860228 - DNA, 14 bp, Homo sapiens
ccatctggcagggt

SEQ ID NO: 3860229 - DNA, 17 bp, Homo sapiens
ccatctgggtccttgca

SEQ ID NO: 3860230 - DNA, 22 bp, Homo sapiens
ccatctgggtccttgcacccct

SEQ ID NO: 3860231 - DNA, 20 bp, Homo sapiens
ccatcttaaatgacagtgaa

SEQ ID NO: 3860232 - DNA, 18 bp, Homo sapiens
ccatcttcctgctgctgt

SEQ ID NO: 3860233 - DNA, 20 bp, Homo sapiens
ccatcttttaatatgctgtg

SEQ ID NO: 3860234 - DNA, 13 bp, Homo sapiens
ccatgaagagact

SEQ ID NO: 3860235 - DNA, 14 bp, Homo sapiens
ccatgaagagactc

SEQ ID NO: 3860236 - DNA, 22 bp, Homo sapiens
ccatgaccagttctggccagga

SEQ ID NO: 3860237 - DNA, 14 bp, Homo sapiens
ccatgacctccagc

SEQ ID NO: 3860238 - DNA, 21 bp, Homo sapiens
ccatgacctccagctttcctg

SEQ ID NO: 3860239 - DNA, 17 bp, Homo sapiens
ccatgagaagagggcct

SEQ ID NO: 3860240 - DNA, 18 bp, Homo sapiens
ccatgagaagagggcctg

SEQ ID NO: 3860241 - DNA, 20 bp, Homo sapiens
ccatgagatagcattagctg

SEQ ID NO: 3860242 - DNA, 18 bp, Homo sapiens
ccatgaggagttgctgtt

SEQ ID NO: 3860243 - DNA, 21 bp, Homo sapiens
ccatgatcgagccactgcact

SEQ ID NO: 3860244 - DNA, 15 bp, Homo sapiens
ccatgatctgtattt

SEQ ID NO: 3860245 - DNA, 22 bp, Homo sapiens
ccatgatggtgctgacctctgg

SEQ ID NO: 3860246 - DNA, 12 bp, Homo sapiens
ccatgattttac

SEQ ID NO: 3860247 - DNA, 23 bp, Homo sapiens
ccatgcagcttcatcaattttta

SEQ ID NO: 3860248 - DNA, 14 bp, Homo sapiens
ccatgccactgcca

SEQ ID NO: 3860249 - DNA, 20 bp, Homo sapiens
ccatgccactgccaggcacc

SEQ ID NO: 3860250 - DNA, 18 bp, Homo sapiens
ccatgcctcatgccacac

SEQ ID NO: 3860251 - DNA, 13 bp, Homo sapiens
ccatgcctgaggg

SEQ ID NO: 3860252 - DNA, 14 bp, Homo sapiens
ccatgcctgagggt

SEQ ID NO: 3860253 - DNA, 17 bp, Homo sapiens
ccatgcctgagggtgga

SEQ ID NO: 3860254 - DNA, 18 bp, Homo sapiens
ccatgcctgagggtggag

SEQ ID NO: 3860255 - DNA, 14 bp, Homo sapiens
ccatgctctgcccc

SEQ ID NO: 3860256 - DNA, 15 bp, Homo sapiens
ccatgctctgcccca

SEQ ID NO: 3860257 - DNA, 17 bp, Homo sapiens
ccatgctctgccccaag

SEQ ID NO: 3860258 - DNA, 23 bp, Homo sapiens
ccatgctctgccccaagccccca

SEQ ID NO: 3860259 - DNA, 13 bp, Homo sapiens
ccatgctgaaggg

SEQ ID NO: 3860260 - DNA, 18 bp, Homo sapiens
ccatgctgaattattttg

SEQ ID NO: 3860261 - DNA, 14 bp, Homo sapiens
ccatgctgcctcca

SEQ ID NO: 3860262 - DNA, 22 bp, Homo sapiens
ccatgctgctttttggcacagt

SEQ ID NO: 3860263 - DNA, 21 bp, Homo sapiens
ccatggaggaggtgtcccaag

SEQ ID NO: 3860264 - DNA, 13 bp, Homo sapiens
ccatggaggcagg

SEQ ID NO: 3860265 - DNA, 14 bp, Homo sapiens
ccatggaggcaggc

SEQ ID NO: 3860266 - DNA, 16 bp, Homo sapiens
ccatggcaccagcccc

SEQ ID NO: 3860267 - DNA, 18 bp, Homo sapiens
ccatggcaccagccccct

SEQ ID NO: 3860268 - DNA, 18 bp, Homo sapiens
ccatggcagcatggagag

SEQ ID NO: 3860269 - DNA, 11 bp, Homo sapiens
ccatggccacc

SEQ ID NO: 3860270 - DNA, 14 bp, Homo sapiens
ccatggccaccccg

SEQ ID NO: 3860271 - DNA, 12 bp, Homo sapiens
ccatggccttcc

SEQ ID NO: 3860272 - DNA, 13 bp, Homo sapiens
ccatggctcaggc

SEQ ID NO: 3860273 - DNA, 15 bp, Homo sapiens
ccatgggatgttaag

SEQ ID NO: 3860274 - DNA, 16 bp, Homo sapiens
ccatgggcctgctgcg

SEQ ID NO: 3860275 - DNA, 14 bp, Homo sapiens
ccatgggcctgggc

SEQ ID NO: 3860276 - DNA, 15 bp, Homo sapiens
ccatgggcctgggcc

SEQ ID NO: 3860277 - DNA, 21 bp, Homo sapiens
ccatgggcttggacttcctgg

SEQ ID NO: 3860278 - DNA, 23 bp, Homo sapiens
ccatggggaagtgctccccacac

SEQ ID NO: 3860279 - DNA, 22 bp, Homo sapiens
ccatggtctctcgggcccccca

SEQ ID NO: 3860280 - DNA, 17 bp, Homo sapiens
ccatggtgacacacagc

SEQ ID NO: 3860281 - DNA, 14 bp, Homo sapiens
ccatggtgcttgtt

SEQ ID NO: 3860282 - DNA, 15 bp, Homo sapiens
ccatgtaacaaccag

SEQ ID NO: 3860283 - DNA, 19 bp, Homo sapiens
ccatgtaacaaccagagat

SEQ ID NO: 3860284 - DNA, 23 bp, Homo sapiens
ccatgtaacaaccagagatgact

SEQ ID NO: 3860285 - DNA, 16 bp, Homo sapiens
ccatgtagcaggactg

SEQ ID NO: 3860286 - DNA, 20 bp, Homo sapiens
ccatgtagttttaacagaac

SEQ ID NO: 3860287 - DNA, 16 bp, Homo sapiens
ccatgtatttatctct

SEQ ID NO: 3860288 - DNA, 22 bp, Homo sapiens
ccatgtatttatctctatttaa

SEQ ID NO: 3860289 - DNA, 17 bp, Homo sapiens
ccatgtcacctcagctg

SEQ ID NO: 3860290 - DNA, 19 bp, Homo sapiens
ccatgtccaagtccaacct

SEQ ID NO: 3860291 - DNA, 16 bp, Homo sapiens
ccatgtcgcctctgca

SEQ ID NO: 3860292 - DNA, 21 bp, Homo sapiens
ccatgtgaaaaggcaaaaagc

SEQ ID NO: 3860293 - DNA, 13 bp, Homo sapiens
ccatgtggagtgg

SEQ ID NO: 3860294 - DNA, 15 bp, Homo sapiens
ccatgtggccccagg

SEQ ID NO: 3860295 - DNA, 17 bp, Homo sapiens
ccatgtggccccaggtg

SEQ ID NO: 3860296 - DNA, 19 bp, Homo sapiens
ccatgtggccccaggtgcc

SEQ ID NO: 3860297 - DNA, 22 bp, Homo sapiens
ccatgtggccccaggtgccacc

SEQ ID NO: 3860298 - DNA, 14 bp, Homo sapiens
ccatgtggctgaag

SEQ ID NO: 3860299 - DNA, 15 bp, Homo sapiens
ccatgtggctgaaga

SEQ ID NO: 3860300 - DNA, 22 bp, Homo sapiens
ccatgtgtcccctcactctgtc

SEQ ID NO: 3860301 - DNA, 15 bp, Homo sapiens
ccatgttgcatgcct

SEQ ID NO: 3860302 - DNA, 23 bp, Homo sapiens
ccatgtttaaactttgtgccttt

SEQ ID NO: 3860303 - DNA, 18 bp, Homo sapiens
ccatgtttagattccagg

SEQ ID NO: 3860304 - DNA, 16 bp, Homo sapiens
ccatgtttgagctcag

SEQ ID NO: 3860305 - DNA, 21 bp, Homo sapiens
ccatgtttggttgtaaatgct

SEQ ID NO: 3860306 - DNA, 22 bp, Homo sapiens
ccatgtttggttgtaaatgctc

SEQ ID NO: 3860307 - DNA, 12 bp, Homo sapiens
ccattacatgtt

SEQ ID NO: 3860308 - DNA, 15 bp, Homo sapiens
ccattaggcatgcct

SEQ ID NO: 3860309 - DNA, 18 bp, Homo sapiens
ccattcacatttgatgta

SEQ ID NO: 3860310 - DNA, 21 bp, Homo sapiens
ccattccaagtcaacactctt

SEQ ID NO: 3860311 - DNA, 17 bp, Homo sapiens
ccattcccccatgtggc

SEQ ID NO: 3860312 - DNA, 17 bp, Homo sapiens
ccattcccgtggtctcc

SEQ ID NO: 3860313 - DNA, 17 bp, Homo sapiens
ccattcgtctgtcccag

SEQ ID NO: 3860314 - DNA, 15 bp, Homo sapiens
ccattctagatgctt

SEQ ID NO: 3860315 - DNA, 17 bp, Homo sapiens
ccattctgaccatttca

SEQ ID NO: 3860316 - DNA, 20 bp, Homo sapiens
ccattctgcctccattctga

SEQ ID NO: 3860317 - DNA, 17 bp, Homo sapiens
ccattcttcagtgccta

SEQ ID NO: 3860318 - DNA, 15 bp, Homo sapiens
ccattgacctcagct

SEQ ID NO: 3860319 - DNA, 16 bp, Homo sapiens
ccattgacctcagctg

SEQ ID NO: 3860320 - DNA, 20 bp, Homo sapiens
ccattgtcttccaaccccag

SEQ ID NO: 3860321 - DNA, 21 bp, Homo sapiens
ccattgtcttccaaccccagc

SEQ ID NO: 3860322 - DNA, 13 bp, Homo sapiens
ccatttaaagctt

SEQ ID NO: 3860323 - DNA, 23 bp, Homo sapiens
ccatttaattcataattagaaca

SEQ ID NO: 3860324 - DNA, 15 bp, Homo sapiens
ccatttcaactccag

SEQ ID NO: 3860325 - DNA, 17 bp, Homo sapiens
ccatttcaattctcaaa

SEQ ID NO: 3860326 - DNA, 13 bp, Homo sapiens
ccatttctctgct

SEQ ID NO: 3860327 - DNA, 18 bp, Homo sapiens
ccatttggacaaaatgga

SEQ ID NO: 3860328 - DNA, 19 bp, Homo sapiens
cccaaagagcctggagaag

SEQ ID NO: 3860329 - DNA, 14 bp, Homo sapiens
aaaaaaaaattgca

SEQ ID NO: 3860330 - DNA, 12 bp, Homo sapiens
aaaaaaaatata

SEQ ID NO: 3860331 - DNA, 10 bp, Homo sapiens
aaaaaaagag

SEQ ID NO: 3860332 - DNA, 13 bp, Homo sapiens
aaaaaaatacagt

SEQ ID NO: 3860333 - DNA, 20 bp, Homo sapiens
aaaaaagtttacaagtgtat

SEQ ID NO: 3860334 - DNA, 12 bp, Homo sapiens
aaaaaatacagt

SEQ ID NO: 3860335 - DNA, 13 bp, Homo sapiens
aaaaaatatatat

SEQ ID NO: 3860336 - DNA, 16 bp, Homo sapiens
aaaaacacggcagctg

SEQ ID NO: 3860337 - DNA, 20 bp, Homo sapiens
aaaaaccagaatcataattt

SEQ ID NO: 3860338 - DNA, 12 bp, Homo sapiens
aaaaacttgtaa

SEQ ID NO: 3860339 - DNA, 15 bp, Homo sapiens
aaaaacttgtactat

SEQ ID NO: 3860340 - DNA, 18 bp, Homo sapiens
aaaaacttgtactatgtt

SEQ ID NO: 3860341 - DNA, 22 bp, Homo sapiens
aaaaacttgtactatgttaata

SEQ ID NO: 3860342 - DNA, 16 bp, Homo sapiens
aaaaactttgttatat

SEQ ID NO: 3860343 - DNA, 12 bp, Homo sapiens
aaaaagaaatga

SEQ ID NO: 3860344 - DNA, 13 bp, Homo sapiens
aaaaagatttgtt

SEQ ID NO: 3860345 - DNA, 19 bp, Homo sapiens
aaaaagctcaatgcattgt

SEQ ID NO: 3860346 - DNA, 19 bp, Homo sapiens
aaaaagctcatattttgta

SEQ ID NO: 3860347 - DNA, 22 bp, Homo sapiens
aaaaaggaccaactggcttctg

SEQ ID NO: 3860348 - DNA, 22 bp, Homo sapiens
aaaaagtctacgctctcctttc

SEQ ID NO: 3860349 - DNA, 17 bp, Homo sapiens
aaaaagtttgccagaag

SEQ ID NO: 3860350 - DNA, 15 bp, Homo sapiens
aaaaataaaatgatg

SEQ ID NO: 3860351 - DNA, 13 bp, Homo sapiens
aaaaataaactag

SEQ ID NO: 3860352 - DNA, 21 bp, Homo sapiens
aaaaataaactagtttccagt

SEQ ID NO: 3860353 - DNA, 12 bp, Homo sapiens
aaaaataaatgg

SEQ ID NO: 3860354 - DNA, 15 bp, Homo sapiens
aaaaatacttgagct

SEQ ID NO: 3860355 - DNA, 19 bp, Homo sapiens
aaaaatagtaagcctccct

SEQ ID NO: 3860356 - DNA, 21 bp, Homo sapiens
aaaaatatatatatatattta

SEQ ID NO: 3860357 - DNA, 20 bp, Homo sapiens
aaaaatatggaacttctaat

SEQ ID NO: 3860358 - DNA, 17 bp, Homo sapiens
aaaaatgacagatgttg

SEQ ID NO: 3860359 - DNA, 22 bp, Homo sapiens
aaaaatggaacataaaatacaa

SEQ ID NO: 3860360 - DNA, 18 bp, Homo sapiens
aaaaattaagagatacat

SEQ ID NO: 3860361 - DNA, 13 bp, Homo sapiens
aaaaattgcacaa

SEQ ID NO: 3860362 - DNA, 15 bp, Homo sapiens
aaaaattgcacaatt

SEQ ID NO: 3860363 - DNA, 13 bp, Homo sapiens
aaaacaagaaaga

SEQ ID NO: 3860364 - DNA, 13 bp, Homo sapiens
aaaacacagcaag

SEQ ID NO: 3860365 - DNA, 12 bp, Homo sapiens
aaaacaggaaaa

SEQ ID NO: 3860366 - DNA, 23 bp, Homo sapiens
aaaacatatcaattcaacacatt

SEQ ID NO: 3860367 - DNA, 22 bp, Homo sapiens
aaaacattcatccagttgcaat

SEQ ID NO: 3860368 - DNA, 15 bp, Homo sapiens
aaaacatttcaaagc

SEQ ID NO: 3860369 - DNA, 14 bp, Homo sapiens
aaaaccacagcagt

SEQ ID NO: 3860370 - DNA, 20 bp, Homo sapiens
aaaaccactgaacatttgct

SEQ ID NO: 3860371 - DNA, 16 bp, Homo sapiens
aaaaccatgcagcttc

SEQ ID NO: 3860372 - DNA, 23 bp, Homo sapiens
aaaaccatgcagcttcatcaatt

SEQ ID NO: 3860373 - DNA, 15 bp, Homo sapiens
aaaaccattttagtt

SEQ ID NO: 3860374 - DNA, 13 bp, Homo sapiens
aaaacccagagag

SEQ ID NO: 3860375 - DNA, 21 bp, Homo sapiens
aaaacccagcaacagaaaaat

SEQ ID NO: 3860376 - DNA, 19 bp, Homo sapiens
aaaacctagaacttcaaaa

SEQ ID NO: 3860377 - DNA, 18 bp, Homo sapiens
aaaaccttgatttaaaat

SEQ ID NO: 3860378 - DNA, 20 bp, Homo sapiens
aaaacctttcaaatttcaca

SEQ ID NO: 3860379 - DNA, 17 bp, Homo sapiens
aaaactatggttcccaa

SEQ ID NO: 3860380 - DNA, 18 bp, Homo sapiens
aaaactgatcaaaaataa

SEQ ID NO: 3860381 - DNA, 19 bp, Homo sapiens
aaaactgatcaaaaataaa

SEQ ID NO: 3860382 - DNA, 23 bp, Homo sapiens
aaaactgatcaaaaataaactag

SEQ ID NO: 3860383 - DNA, 12 bp, Homo sapiens
aaaactgtaaat

SEQ ID NO: 3860384 - DNA, 18 bp, Homo sapiens
aaaactgtaaatacaaaa

SEQ ID NO: 3860385 - DNA, 20 bp, Homo sapiens
aaaacttatgctagtttatt

SEQ ID NO: 3860386 - DNA, 20 bp, Homo sapiens
aaaacttgaatctgttactg

SEQ ID NO: 3860387 - DNA, 22 bp, Homo sapiens
aaaacttgaatctgttactgaa

SEQ ID NO: 3860388 - DNA, 20 bp, Homo sapiens
aaaagaaaaccattttagtt

SEQ ID NO: 3860389 - DNA, 15 bp, Homo sapiens
aaaagaagactggaa

SEQ ID NO: 3860390 - DNA, 21 bp, Homo sapiens
aaaagaatattcagagaatat

SEQ ID NO: 3860391 - DNA, 12 bp, Homo sapiens
aaaagaatattt

SEQ ID NO: 3860392 - DNA, 13 bp, Homo sapiens
aaaagaatatttt

SEQ ID NO: 3860393 - DNA, 23 bp, Homo sapiens
aaaagaatttgtgacattttaaa

SEQ ID NO: 3860394 - DNA, 13 bp, Homo sapiens
aaaagacattttt

SEQ ID NO: 3860395 - DNA, 17 bp, Homo sapiens
aaaagactgcagctgct

SEQ ID NO: 3860396 - DNA, 14 bp, Homo sapiens
aaaagataaagatg

SEQ ID NO: 3860397 - DNA, 20 bp, Homo sapiens
aaaagataggtttgagttca

SEQ ID NO: 3860398 - DNA, 12 bp, Homo sapiens
aaaagattctgt

SEQ ID NO: 3860399 - DNA, 13 bp, Homo sapiens
aaaagatttgttt

SEQ ID NO: 3860400 - DNA, 17 bp, Homo sapiens
aaaagatttgttttgtc

SEQ ID NO: 3860401 - DNA, 14 bp, Homo sapiens
aaaagcaagactgt

SEQ ID NO: 3860402 - DNA, 10 bp, Homo sapiens
aaaagcactt

SEQ ID NO: 3860403 - DNA, 14 bp, Homo sapiens
aaaagcacttttta

SEQ ID NO: 3860404 - DNA, 22 bp, Homo sapiens
aaaagcatgactatttccacca

SEQ ID NO: 3860405 - DNA, 20 bp, Homo sapiens
aaaagcccagtgacctgacc

SEQ ID NO: 3860406 - DNA, 11 bp, Homo sapiens
aaaagctaatt

SEQ ID NO: 3860407 - DNA, 20 bp, Homo sapiens
aaaagctacagttttgtgaa

SEQ ID NO: 3860408 - DNA, 18 bp, Homo sapiens
aaaagctcatattttgta

SEQ ID NO: 3860409 - DNA, 23 bp, Homo sapiens
aaaagctgcttgactatcacata

SEQ ID NO: 3860410 - DNA, 11 bp, Homo sapiens
aaaaggcctgg

SEQ ID NO: 3860411 - DNA, 14 bp, Homo sapiens
aaaaggctagttta

SEQ ID NO: 3860412 - DNA, 19 bp, Homo sapiens
aaaagggaagttgtgcctt

SEQ ID NO: 3860413 - DNA, 15 bp, Homo sapiens
aaaagtaaatgtaca

SEQ ID NO: 3860414 - DNA, 20 bp, Homo sapiens
aaaagtaacaaggtgtcttt

SEQ ID NO: 3860415 - DNA, 17 bp, Homo sapiens
aaaagtacatttaatac

SEQ ID NO: 3860416 - DNA, 15 bp, Homo sapiens
aaaagtagaattata

SEQ ID NO: 3860417 - DNA, 19 bp, Homo sapiens
aaaagtagaattatatcta

SEQ ID NO: 3860418 - DNA, 23 bp, Homo sapiens
aaaagtagaattatatctaattt

SEQ ID NO: 3860419 - DNA, 19 bp, Homo sapiens
aaaagtatgtgaatatgaa

SEQ ID NO: 3860420 - DNA, 19 bp, Homo sapiens
aaaagtatttttttaagtt

SEQ ID NO: 3860421 - DNA, 15 bp, Homo sapiens
aaaagtcaaaaggtg

SEQ ID NO: 3860422 - DNA, 13 bp, Homo sapiens
aaaagtgcaatgc

SEQ ID NO: 3860423 - DNA, 14 bp, Homo sapiens
aaaagtgcaatgcg

SEQ ID NO: 3860424 - DNA, 20 bp, Homo sapiens
aaaagtgcttagaaagttat

SEQ ID NO: 3860425 - DNA, 19 bp, Homo sapiens
aaaagtggaatcactgtat

SEQ ID NO: 3860426 - DNA, 14 bp, Homo sapiens
aaaagttgcagtct

SEQ ID NO: 3860427 - DNA, 16 bp, Homo sapiens
aaaagtttacaagtgt

SEQ ID NO: 3860428 - DNA, 14 bp, Homo sapiens
aaaataaaaaccag

SEQ ID NO: 3860429 - DNA, 16 bp, Homo sapiens
aaaataaaaaccagaa

SEQ ID NO: 3860430 - DNA, 13 bp, Homo sapiens
aaaataaaaatgg

SEQ ID NO: 3860431 - DNA, 12 bp, Homo sapiens
aaaataaacaaa

SEQ ID NO: 3860432 - DNA, 11 bp, Homo sapiens
aaaataaatgg

SEQ ID NO: 3860433 - DNA, 15 bp, Homo sapiens
aaaataaatggaaat

SEQ ID NO: 3860434 - DNA, 15 bp, Homo sapiens
aaaataatgtaaggg

SEQ ID NO: 3860435 - DNA, 16 bp, Homo sapiens
aaaataatttaactaa

SEQ ID NO: 3860436 - DNA, 17 bp, Homo sapiens
aaaataatttaactaat

SEQ ID NO: 3860437 - DNA, 19 bp, Homo sapiens
aaaatacaccacgaatttg

SEQ ID NO: 3860438 - DNA, 17 bp, Homo sapiens
aaaatacataagaccat

SEQ ID NO: 3860439 - DNA, 15 bp, Homo sapiens
aaaatactctagcct

SEQ ID NO: 3860440 - DNA, 15 bp, Homo sapiens
aaaatagaagctgta

SEQ ID NO: 3860441 - DNA, 12 bp, Homo sapiens
aaaatagcttgt

SEQ ID NO: 3860442 - DNA, 13 bp, Homo sapiens
aaaatataaaata

SEQ ID NO: 3860443 - DNA, 11 bp, Homo sapiens
aaaatataaat

SEQ ID NO: 3860444 - DNA, 12 bp, Homo sapiens
aaaatataaatg

SEQ ID NO: 3860445 - DNA, 14 bp, Homo sapiens
aaaatataaatgca

SEQ ID NO: 3860446 - DNA, 15 bp, Homo sapiens
aaaatataaatgcat

SEQ ID NO: 3860447 - DNA, 22 bp, Homo sapiens
aaaatataaattaagactttaa

SEQ ID NO: 3860448 - DNA, 19 bp, Homo sapiens
aaaatataaccattacatg

SEQ ID NO: 3860449 - DNA, 10 bp, Homo sapiens
aaaatatata

SEQ ID NO: 3860450 - DNA, 13 bp, Homo sapiens
aaaatatatataa

SEQ ID NO: 3860451 - DNA, 16 bp, Homo sapiens
aaaatatatataaata

SEQ ID NO: 3860452 - DNA, 21 bp, Homo sapiens
aaaatatatataaatatatat

SEQ ID NO: 3860453 - DNA, 23 bp, Homo sapiens
aaaatatatataaatatatattt

SEQ ID NO: 3860454 - DNA, 18 bp, Homo sapiens
aaaatatatatgtgcagt

SEQ ID NO: 3860455 - DNA, 21 bp, Homo sapiens
aaaatatatttaatacctttg

SEQ ID NO: 3860456 - DNA, 21 bp, Homo sapiens
aaaatatggaacttctaatat

SEQ ID NO: 3860457 - DNA, 11 bp, Homo sapiens
aaaatatgtat

SEQ ID NO: 3860458 - DNA, 12 bp, Homo sapiens
aaaatattttct

SEQ ID NO: 3860459 - DNA, 16 bp, Homo sapiens
aaaatcaaagctgagg

SEQ ID NO: 3860460 - DNA, 23 bp, Homo sapiens
aaaatcacaagcaataattagga

SEQ ID NO: 3860461 - DNA, 12 bp, Homo sapiens
aaaatcatgaga

SEQ ID NO: 3860462 - DNA, 19 bp, Homo sapiens
aaaatcattcaatatctga

SEQ ID NO: 3860463 - DNA, 21 bp, Homo sapiens
aaaatcatttctgcatcagct

SEQ ID NO: 3860464 - DNA, 14 bp, Homo sapiens
aaaatccatggata

SEQ ID NO: 3860465 - DNA, 14 bp, Homo sapiens
aaaatccctattta

SEQ ID NO: 3860466 - DNA, 22 bp, Homo sapiens
aaaatccctatttaattttcct

SEQ ID NO: 3860467 - DNA, 23 bp, Homo sapiens
aaaatctaatattaaaaatatgg

SEQ ID NO: 3860468 - DNA, 14 bp, Homo sapiens
aaaatctagttttt

SEQ ID NO: 3860469 - DNA, 14 bp, Homo sapiens
aaaatctgatttaa

SEQ ID NO: 3860470 - DNA, 17 bp, Homo sapiens
aaaatctgatttaatgt

SEQ ID NO: 3860471 - DNA, 23 bp, Homo sapiens
aaaatctgatttaatgttttctg

SEQ ID NO: 3860472 - DNA, 14 bp, Homo sapiens
aaaatctggaaatc

SEQ ID NO: 3860473 - DNA, 18 bp, Homo sapiens
aaaatcttggcacagaaa

SEQ ID NO: 3860474 - DNA, 12 bp, Homo sapiens
aaaatcttgggc

SEQ ID NO: 3860475 - DNA, 15 bp, Homo sapiens
aaaatgaaatgtttt

SEQ ID NO: 3860476 - DNA, 22 bp, Homo sapiens
aaaatgaaatgtttttgctata

SEQ ID NO: 3860477 - DNA, 13 bp, Homo sapiens
aaaatgacagatg

SEQ ID NO: 3860478 - DNA, 17 bp, Homo sapiens
aaaatgacagatgttga

SEQ ID NO: 3860479 - DNA, 19 bp, Homo sapiens
aaaatgagcctgtaatcct

SEQ ID NO: 3860480 - DNA, 19 bp, Homo sapiens
aaaatgatgtatgatttgt

SEQ ID NO: 3860481 - DNA, 19 bp, Homo sapiens
aaaatgattgtaaaatagc

SEQ ID NO: 3860482 - DNA, 16 bp, Homo sapiens
aaaatgcagtccagaa

SEQ ID NO: 3860483 - DNA, 16 bp, Homo sapiens
aaaatgcttctgttgt

SEQ ID NO: 3860484 - DNA, 19 bp, Homo sapiens
aaaatgcttctgttgtaat

SEQ ID NO: 3860485 - DNA, 13 bp, Homo sapiens
aaaatggaaagaa

SEQ ID NO: 3860486 - DNA, 23 bp, Homo sapiens
aaaatggccatttgctttttcac

SEQ ID NO: 3860487 - DNA, 12 bp, Homo sapiens
aaaatgtacact

SEQ ID NO: 3860488 - DNA, 19 bp, Homo sapiens
aaaatgtgacccagatcct

SEQ ID NO: 3860489 - DNA, 12 bp, Homo sapiens
aaaatgttcatc

SEQ ID NO: 3860490 - DNA, 19 bp, Homo sapiens
aaaattaagagatacattc

SEQ ID NO: 3860491 - DNA, 18 bp, Homo sapiens
aaaattatggtgaaatta

SEQ ID NO: 3860492 - DNA, 13 bp, Homo sapiens
aaaattcttggaa

SEQ ID NO: 3860493 - DNA, 15 bp, Homo sapiens
aaaattgtgatgttt

SEQ ID NO: 3860494 - DNA, 15 bp, Homo sapiens
aaaattttataagca

SEQ ID NO: 3860495 - DNA, 23 bp, Homo sapiens
aaaattttataagcaaatttcaa

SEQ ID NO: 3860496 - DNA, 12 bp, Homo sapiens
aaacaaaaagac

SEQ ID NO: 3860497 - DNA, 13 bp, Homo sapiens
aaacaaaaataaa

SEQ ID NO: 3860498 - DNA, 16 bp, Homo sapiens
aaacaaaacaaaacaa

SEQ ID NO: 3860499 - DNA, 16 bp, Homo sapiens
aaacaaaagagagaat

SEQ ID NO: 3860500 - DNA, 13 bp, Homo sapiens
aaacaacaacaat

SEQ ID NO: 3860501 - DNA, 14 bp, Homo sapiens
aaacaacaacaata

SEQ ID NO: 3860502 - DNA, 21 bp, Homo sapiens
aaacaacaacaatacaacaag

SEQ ID NO: 3860503 - DNA, 12 bp, Homo sapiens
aaacaagaaaga

SEQ ID NO: 3860504 - DNA, 18 bp, Homo sapiens
aaacaattattgtacact

SEQ ID NO: 3860505 - DNA, 22 bp, Homo sapiens
aaacacaaaccacaactgacac

SEQ ID NO: 3860506 - DNA, 20 bp, Homo sapiens
aaacacaaatgtaaaataag

SEQ ID NO: 3860507 - DNA, 14 bp, Homo sapiens
aaacacaatatttt

SEQ ID NO: 3860508 - DNA, 14 bp, Homo sapiens
aaacacactgtaaa

SEQ ID NO: 3860509 - DNA, 15 bp, Homo sapiens
aaacacactgtaaat

SEQ ID NO: 3860510 - DNA, 12 bp, Homo sapiens
aaacacagcaag

SEQ ID NO: 3860511 - DNA, 17 bp, Homo sapiens
aaacacctgacacatct

SEQ ID NO: 3860512 - DNA, 11 bp, Homo sapiens
aaacactccac

SEQ ID NO: 3860513 - DNA, 12 bp, Homo sapiens
aaacactgtaat

SEQ ID NO: 3860514 - DNA, 23 bp, Homo sapiens
aaacactgtaatcttaaaagtgt

SEQ ID NO: 3860515 - DNA, 21 bp, Homo sapiens
aagccaatatttactcatcag

SEQ ID NO: 3860516 - DNA, 20 bp, Homo sapiens
aagccactatgtccagctag

SEQ ID NO: 3860517 - DNA, 18 bp, Homo sapiens
aagccaggagcaaatgtt

SEQ ID NO: 3860518 - DNA, 20 bp, Homo sapiens
aagccagtatttctttccct

SEQ ID NO: 3860519 - DNA, 15 bp, Homo sapiens
aagccatctttcttt

SEQ ID NO: 3860520 - DNA, 12 bp, Homo sapiens
aagccatggtga

SEQ ID NO: 3860521 - DNA, 17 bp, Homo sapiens
aagccatggtgacacac

SEQ ID NO: 3860522 - DNA, 21 bp, Homo sapiens
aagccatggtgacacacagca

SEQ ID NO: 3860523 - DNA, 11 bp, Homo sapiens
aagcccaggct

SEQ ID NO: 3860524 - DNA, 13 bp, Homo sapiens
aagccccagggcc

SEQ ID NO: 3860525 - DNA, 17 bp, Homo sapiens
aagccccagggcctggg

SEQ ID NO: 3860526 - DNA, 12 bp, Homo sapiens
aagcccctggaa

SEQ ID NO: 3860527 - DNA, 21 bp, Homo sapiens
aagccccttgctctcccctgc

SEQ ID NO: 3860528 - DNA, 20 bp, Homo sapiens
aagccccttgtcctctcccg

SEQ ID NO: 3860529 - DNA, 11 bp, Homo sapiens
aagccctcctt

SEQ ID NO: 3860530 - DNA, 12 bp, Homo sapiens
aagccctccttc

SEQ ID NO: 3860531 - DNA, 14 bp, Homo sapiens
aagccctccttcca

SEQ ID NO: 3860532 - DNA, 12 bp, Homo sapiens
aagccctgaggg

SEQ ID NO: 3860533 - DNA, 13 bp, Homo sapiens
aagccctgctggg

SEQ ID NO: 3860534 - DNA, 11 bp, Homo sapiens
aagccctggca

SEQ ID NO: 3860535 - DNA, 18 bp, Homo sapiens
aagccctgtcgagacact

SEQ ID NO: 3860536 - DNA, 23 bp, Homo sapiens
aagcccttccatgtcgcctctgc

SEQ ID NO: 3860537 - DNA, 23 bp, Homo sapiens
aagccggccccccctcttttggc

SEQ ID NO: 3860538 - DNA, 22 bp, Homo sapiens
aagcctatttatttgaaagtcc

SEQ ID NO: 3860539 - DNA, 13 bp, Homo sapiens
aagcctctgccct

SEQ ID NO: 3860540 - DNA, 17 bp, Homo sapiens
aagcctctgccctgcct

SEQ ID NO: 3860541 - DNA, 18 bp, Homo sapiens
aagcctctgccctgcctc

SEQ ID NO: 3860542 - DNA, 21 bp, Homo sapiens
aagcctctgccctgcctccct

SEQ ID NO: 3860543 - DNA, 13 bp, Homo sapiens
aagcctctggaaa

SEQ ID NO: 3860544 - DNA, 21 bp, Homo sapiens
aagcctgcctaggaattccca

SEQ ID NO: 3860545 - DNA, 18 bp, Homo sapiens
aagcctggtctcctccca

SEQ ID NO: 3860546 - DNA, 22 bp, Homo sapiens
aagcctggtctcctcccaaaat

SEQ ID NO: 3860547 - DNA, 16 bp, Homo sapiens
aagccttactcacctc

SEQ ID NO: 3860548 - DNA, 15 bp, Homo sapiens
aagcgcagggaggat

SEQ ID NO: 3860549 - DNA, 23 bp, Homo sapiens
aagcgcagggaggatgccacagc

SEQ ID NO: 3860550 - DNA, 22 bp, Homo sapiens
aagcgctcatctggcttttcgc

SEQ ID NO: 3860551 - DNA, 16 bp, Homo sapiens
aagctaaaacctgagc

SEQ ID NO: 3860552 - DNA, 23 bp, Homo sapiens
aagctaaaacctgagctagaagc

SEQ ID NO: 3860553 - DNA, 20 bp, Homo sapiens
aagctaacagggaaggcagg

SEQ ID NO: 3860554 - DNA, 21 bp, Homo sapiens
aagctaacagggaaggcaggc

SEQ ID NO: 3860555 - DNA, 23 bp, Homo sapiens
aagctaacagggaaggcaggcag

SEQ ID NO: 3860556 - DNA, 17 bp, Homo sapiens
aagctacaatctgttca

SEQ ID NO: 3860557 - DNA, 18 bp, Homo sapiens
aagctagccagagggtgg

SEQ ID NO: 3860558 - DNA, 22 bp, Homo sapiens
aagctattgatgtttccagaaa

SEQ ID NO: 3860559 - DNA, 19 bp, Homo sapiens
aagctcacagttcctcgcc

SEQ ID NO: 3860560 - DNA, 23 bp, Homo sapiens
aagctcatattttgtatatatct

SEQ ID NO: 3860561 - DNA, 14 bp, Homo sapiens
aagctccatctcca

SEQ ID NO: 3860562 - DNA, 13 bp, Homo sapiens
aagctcctgtcct

SEQ ID NO: 3860563 - DNA, 15 bp, Homo sapiens
aagctcctgtcctcc

SEQ ID NO: 3860564 - DNA, 15 bp, Homo sapiens
aagctctattaagat

SEQ ID NO: 3860565 - DNA, 11 bp, Homo sapiens
aagctctggct

SEQ ID NO: 3860566 - DNA, 22 bp, Homo sapiens
aagctcttacactacattagaa

SEQ ID NO: 3860567 - DNA, 12 bp, Homo sapiens
aagctgaagtga

SEQ ID NO: 3860568 - DNA, 14 bp, Homo sapiens
aagctgaagtgaag

SEQ ID NO: 3860569 - DNA, 19 bp, Homo sapiens
aagctgaagtgaaggagaa

SEQ ID NO: 3860570 - DNA, 19 bp, Homo sapiens
aagctgacagcactacaaa

SEQ ID NO: 3860571 - DNA, 21 bp, Homo sapiens
aagctgagaagaagctgagga

SEQ ID NO: 3860572 - DNA, 14 bp, Homo sapiens
aagctgagcaggcc

SEQ ID NO: 3860573 - DNA, 20 bp, Homo sapiens
aagctgaggtgcccaggaga

SEQ ID NO: 3860574 - DNA, 21 bp, Homo sapiens
aagctgatgatgtctcttgta

SEQ ID NO: 3860575 - DNA, 15 bp, Homo sapiens
aagctgcagcttcct

SEQ ID NO: 3860576 - DNA, 21 bp, Homo sapiens
aagctgcctgtagttaggaaa

SEQ ID NO: 3860577 - DNA, 17 bp, Homo sapiens
aagctggacaagaagct

SEQ ID NO: 3860578 - DNA, 19 bp, Homo sapiens
aagctggacaagaagctgc

SEQ ID NO: 3860579 - DNA, 18 bp, Homo sapiens
aagctggagctcttggaa

SEQ ID NO: 3860580 - DNA, 20 bp, Homo sapiens
aagctggagctcttggaaga

SEQ ID NO: 3860581 - DNA, 23 bp, Homo sapiens
aagctggaggactagaacctgga

SEQ ID NO: 3860582 - DNA, 15 bp, Homo sapiens
aagctgggggaaggg

SEQ ID NO: 3860583 - DNA, 18 bp, Homo sapiens
aagctgtaaaaagagaga

SEQ ID NO: 3860584 - DNA, 11 bp, Homo sapiens
aagctgtaccc

SEQ ID NO: 3860585 - DNA, 19 bp, Homo sapiens
aagctgtactcagagcaga

SEQ ID NO: 3860586 - DNA, 20 bp, Homo sapiens
aagctgtactcagagcagag

SEQ ID NO: 3860587 - DNA, 20 bp, Homo sapiens
aagctgtgtccttgcacctg

SEQ ID NO: 3860588 - DNA, 15 bp, Homo sapiens
aagcttcaagtgata

SEQ ID NO: 3860589 - DNA, 14 bp, Homo sapiens
aagcttcagagcct

SEQ ID NO: 3860590 - DNA, 17 bp, Homo sapiens
aagcttcagagcctagc

SEQ ID NO: 3860591 - DNA, 22 bp, Homo sapiens
aagcttcagagcctagccacct

SEQ ID NO: 3860592 - DNA, 13 bp, Homo sapiens
aagcttgtatata

SEQ ID NO: 3860593 - DNA, 17 bp, Homo sapiens
aagcttgtatatacata

SEQ ID NO: 3860594 - DNA, 15 bp, Homo sapiens
aagctttaccagctg

SEQ ID NO: 3860595 - DNA, 21 bp, Homo sapiens
aagctttatttatttctttgt

SEQ ID NO: 3860596 - DNA, 23 bp, Homo sapiens
aagctttcttctacaaccagagc

SEQ ID NO: 3860597 - DNA, 20 bp, Homo sapiens
aagctttgaatacccccaga

SEQ ID NO: 3860598 - DNA, 22 bp, Homo sapiens
aaggaaagaaaactaacaacca

SEQ ID NO: 3860599 - DNA, 15 bp, Homo sapiens
aaggaacactggaaa

SEQ ID NO: 3860600 - DNA, 18 bp, Homo sapiens
aaggaactctggcttcca

SEQ ID NO: 3860601 - DNA, 21 bp, Homo sapiens
aactgttatcacttatatata

SEQ ID NO: 3860602 - DNA, 13 bp, Homo sapiens
aacttaaaatatt

SEQ ID NO: 3860603 - DNA, 16 bp, Homo sapiens
aacttaaaatatttta

SEQ ID NO: 3860604 - DNA, 15 bp, Homo sapiens
aacttaaacaatttc

SEQ ID NO: 3860605 - DNA, 13 bp, Homo sapiens
aacttaacatgaa

SEQ ID NO: 3860606 - DNA, 17 bp, Homo sapiens
aacttagaataaaattg

SEQ ID NO: 3860607 - DNA, 18 bp, Homo sapiens
aacttagaataaaattgt

SEQ ID NO: 3860608 - DNA, 22 bp, Homo sapiens
aacttcaagtgcatgctctctg

SEQ ID NO: 3860609 - DNA, 13 bp, Homo sapiens
aacttcagcacca

SEQ ID NO: 3860610 - DNA, 21 bp, Homo sapiens
aacttcaggataataaagtgt

SEQ ID NO: 3860611 - DNA, 12 bp, Homo sapiens
aacttgaggaca

SEQ ID NO: 3860612 - DNA, 22 bp, Homo sapiens
aacttgagggtaataaacttag

SEQ ID NO: 3860613 - DNA, 15 bp, Homo sapiens
aacttgtaaatacac

SEQ ID NO: 3860614 - DNA, 14 bp, Homo sapiens
aacttgtatattcc

SEQ ID NO: 3860615 - DNA, 15 bp, Homo sapiens
aacttgtatattcca

SEQ ID NO: 3860616 - DNA, 20 bp, Homo sapiens
aacttgtgtactgataaaat

SEQ ID NO: 3860617 - DNA, 21 bp, Homo sapiens
aacttgtgtactgataaaata

SEQ ID NO: 3860618 - DNA, 16 bp, Homo sapiens
aacttgttcacaggtt

SEQ ID NO: 3860619 - DNA, 15 bp, Homo sapiens
aactttataaagata

SEQ ID NO: 3860620 - DNA, 17 bp, Homo sapiens
aactttgatctctgctt

SEQ ID NO: 3860621 - DNA, 15 bp, Homo sapiens
aagaaaaagttgcag

SEQ ID NO: 3860622 - DNA, 12 bp, Homo sapiens
aagaaaaccatt

SEQ ID NO: 3860623 - DNA, 20 bp, Homo sapiens
aagaaaactaacaaccaacc

SEQ ID NO: 3860624 - DNA, 19 bp, Homo sapiens
aagaaaagcactttttaaa

SEQ ID NO: 3860625 - DNA, 19 bp, Homo sapiens
aagaaaatacataagacca

SEQ ID NO: 3860626 - DNA, 22 bp, Homo sapiens
aagaaacactcaacaataaaga

SEQ ID NO: 3860627 - DNA, 16 bp, Homo sapiens
aagaaacagataccat

SEQ ID NO: 3860628 - DNA, 19 bp, Homo sapiens
aagaaacaggggatcaaag

SEQ ID NO: 3860629 - DNA, 17 bp, Homo sapiens
aagaaactatacatcat

SEQ ID NO: 3860630 - DNA, 16 bp, Homo sapiens
aagaaagcatagacat

SEQ ID NO: 3860631 - DNA, 20 bp, Homo sapiens
aagaaagccgtactgtctat

SEQ ID NO: 3860632 - DNA, 22 bp, Homo sapiens
aagaaagcttcaaactgcatga

SEQ ID NO: 3860633 - DNA, 17 bp, Homo sapiens
aagaaagtgcagaatca

SEQ ID NO: 3860634 - DNA, 14 bp, Homo sapiens
aagaaattcctgta

SEQ ID NO: 3860635 - DNA, 16 bp, Homo sapiens
aagaaattgtttcttt

SEQ ID NO: 3860636 - DNA, 21 bp, Homo sapiens
aagaacaaagagaaaaaatac

SEQ ID NO: 3860637 - DNA, 14 bp, Homo sapiens
aagaacaacaacaa

SEQ ID NO: 3860638 - DNA, 22 bp, Homo sapiens
aagaaccaaaagttttcctgag

SEQ ID NO: 3860639 - DNA, 13 bp, Homo sapiens
aagaactccttat

SEQ ID NO: 3860640 - DNA, 13 bp, Homo sapiens
aagaactgcccca

SEQ ID NO: 3860641 - DNA, 14 bp, Homo sapiens
aagaagacatgaca

SEQ ID NO: 3860642 - DNA, 10 bp, Homo sapiens
aagaagagac

SEQ ID NO: 3860643 - DNA, 19 bp, Homo sapiens
aagaagctcccagatgctg

SEQ ID NO: 3860644 - DNA, 19 bp, Homo sapiens
aagaaggaaaaattccagg

SEQ ID NO: 3860645 - DNA, 13 bp, Homo sapiens
aagaagtaaattt

SEQ ID NO: 3860646 - DNA, 22 bp, Homo sapiens
aagaagtttctggagcaagaga

SEQ ID NO: 3860647 - DNA, 12 bp, Homo sapiens
aagaataaatga

SEQ ID NO: 3860648 - DNA, 16 bp, Homo sapiens
aagaataaatgaatct

SEQ ID NO: 3860649 - DNA, 18 bp, Homo sapiens
aagaatacagaaaatgct

SEQ ID NO: 3860650 - DNA, 15 bp, Homo sapiens
aagaatattcaaatg

SEQ ID NO: 3860651 - DNA, 16 bp, Homo sapiens
aagaatattcaaatgt

SEQ ID NO: 3860652 - DNA, 22 bp, Homo sapiens
aagaatattcagagaatatcaa

SEQ ID NO: 3860653 - DNA, 13 bp, Homo sapiens
aagaatattcagg

SEQ ID NO: 3860654 - DNA, 21 bp, Homo sapiens
aagaatgagaaggagtcagaa

SEQ ID NO: 3860655 - DNA, 16 bp, Homo sapiens
aagaatggagcagtac

SEQ ID NO: 3860656 - DNA, 15 bp, Homo sapiens
aagaattcacacctt

SEQ ID NO: 3860657 - DNA, 20 bp, Homo sapiens
aagaattcctgaagccagat

SEQ ID NO: 3860658 - DNA, 22 bp, Homo sapiens
aagacaagaaaagaggaaaaaa

SEQ ID NO: 3860659 - DNA, 22 bp, Homo sapiens
aagacaatatgaacaaactatg

SEQ ID NO: 3860660 - DNA, 22 bp, Homo sapiens
aagacacacctctggatccctg

SEQ ID NO: 3860661 - DNA, 17 bp, Homo sapiens
aagacagaatgtcacca

SEQ ID NO: 3860662 - DNA, 18 bp, Homo sapiens
aagacagaatgtcaccag

SEQ ID NO: 3860663 - DNA, 19 bp, Homo sapiens
aagacatgttgtaaattag

SEQ ID NO: 3860664 - DNA, 20 bp, Homo sapiens
aagacccagtgtaaagaata

SEQ ID NO: 3860665 - DNA, 14 bp, Homo sapiens
aagaccccagcttc

SEQ ID NO: 3860666 - DNA, 14 bp, Homo sapiens
aagaccccatctct

SEQ ID NO: 3860667 - DNA, 13 bp, Homo sapiens
aagaccctccccg

SEQ ID NO: 3860668 - DNA, 13 bp, Homo sapiens
aagaccctgagac

SEQ ID NO: 3860669 - DNA, 15 bp, Homo sapiens
aagaccctgagactc

SEQ ID NO: 3860670 - DNA, 21 bp, Homo sapiens
aagacgacggcttcaggcccg

SEQ ID NO: 3860671 - DNA, 21 bp, Homo sapiens
aagacgctcaagaatcctctg

SEQ ID NO: 3860672 - DNA, 16 bp, Homo sapiens
aagactattaagagca

SEQ ID NO: 3860673 - DNA, 17 bp, Homo sapiens
aagactattaagagcaa

SEQ ID NO: 3860674 - DNA, 14 bp, Homo sapiens
aagactcagtgttc

SEQ ID NO: 3860675 - DNA, 19 bp, Homo sapiens
aagactgagcacctgcttc

SEQ ID NO: 3860676 - DNA, 21 bp, Homo sapiens
aagacttgatactgcaataaa

SEQ ID NO: 3860677 - DNA, 18 bp, Homo sapiens
aagacttggcaacagaag

SEQ ID NO: 3860678 - DNA, 18 bp, Homo sapiens
aagactttaaaagatgaa

SEQ ID NO: 3860679 - DNA, 22 bp, Homo sapiens
aagagaaaaaaagtttgccaga

SEQ ID NO: 3860680 - DNA, 17 bp, Homo sapiens
aagagaaaaaccaatga

SEQ ID NO: 3860681 - DNA, 20 bp, Homo sapiens
aagagaaaaaccaatgattc

SEQ ID NO: 3860682 - DNA, 15 bp, Homo sapiens
aagagaagaaaaaat

SEQ ID NO: 3860683 - DNA, 22 bp, Homo sapiens
aagagaagaaaaaattaagaga

SEQ ID NO: 3860684 - DNA, 14 bp, Homo sapiens
aagagaagggaagc

SEQ ID NO: 3860685 - DNA, 19 bp, Homo sapiens
aagagagacattgcctcca

SEQ ID NO: 3860686 - DNA, 17 bp, Homo sapiens
aagagagagagagaggt

SEQ ID NO: 3860687 - DNA, 12 bp, Homo sapiens
aagagaggcacc

SEQ ID NO: 3860688 - DNA, 16 bp, Homo sapiens
aagagaggcacctgct

SEQ ID NO: 3860689 - DNA, 17 bp, Homo sapiens
aagagagtaccatgctg

SEQ ID NO: 3860690 - DNA, 15 bp, Homo sapiens
aagagatcaggaaga

SEQ ID NO: 3860691 - DNA, 22 bp, Homo sapiens
aagagatcaggaagagaaggag

SEQ ID NO: 3860692 - DNA, 18 bp, Homo sapiens
aagagatttcaacatatc

SEQ ID NO: 3860693 - DNA, 15 bp, Homo sapiens
aagagcaagtctgga

SEQ ID NO: 3860694 - DNA, 21 bp, Homo sapiens
aagagcacattcttaaaggaa

SEQ ID NO: 3860695 - DNA, 11 bp, Homo sapiens
aagagcagcct

SEQ ID NO: 3860696 - DNA, 14 bp, Homo sapiens
aagagcagcctgat

SEQ ID NO: 3860697 - DNA, 23 bp, Homo sapiens
aagagcaggcacatggaggagct

SEQ ID NO: 3860698 - DNA, 15 bp, Homo sapiens
aagagcatcatgcct

SEQ ID NO: 3860699 - DNA, 18 bp, Homo sapiens
aagagcatcatgcctctg

SEQ ID NO: 3860700 - DNA, 20 bp, Homo sapiens
aagagcatcatgcctctgag

SEQ ID NO: 3860701 - DNA, 22 bp, Homo sapiens
aagagcatcatgcctctgaggc

SEQ ID NO: 3860702 - DNA, 24 bp, Homo sapiens
aagagcatcatgcctctgaggcca

SEQ ID NO: 3860703 - DNA, 11 bp, Homo sapiens
aagagcctgga

SEQ ID NO: 3860704 - DNA, 20 bp, Homo sapiens
aagagccttggtgtccacct

SEQ ID NO: 3860705 - DNA, 19 bp, Homo sapiens
aagagctagcgctgccgca

SEQ ID NO: 3860706 - DNA, 12 bp, Homo sapiens
aagagctgctgt

SEQ ID NO: 3860707 - DNA, 17 bp, Homo sapiens
aagagctgctgtccttt

SEQ ID NO: 3860708 - DNA, 19 bp, Homo sapiens
aagagctgttcacagccag

SEQ ID NO: 3860709 - DNA, 15 bp, Homo sapiens
aagaggagaccctgg

SEQ ID NO: 3860710 - DNA, 16 bp, Homo sapiens
aagaggagaccctgga

SEQ ID NO: 3860711 - DNA, 21 bp, Homo sapiens
aagaggagtttcgaggtagag

SEQ ID NO: 3860712 - DNA, 23 bp, Homo sapiens
aagaggccctgtctgtacctaac

SEQ ID NO: 3860713 - DNA, 12 bp, Homo sapiens
aagagggcctgt

SEQ ID NO: 3860714 - DNA, 22 bp, Homo sapiens
aagaggtctgagccctggtgtg

SEQ ID NO: 3860715 - DNA, 20 bp, Homo sapiens
aagaggtgaccccagggcac

SEQ ID NO: 3860716 - DNA, 23 bp, Homo sapiens
aagagtttaactttgggcccaga

SEQ ID NO: 3860717 - DNA, 17 bp, Homo sapiens
aagataaagccagaagc

SEQ ID NO: 3860718 - DNA, 19 bp, Homo sapiens
aagataacaagatctttca

SEQ ID NO: 3860719 - DNA, 15 bp, Homo sapiens
aagataacttgagca

SEQ ID NO: 3860720 - DNA, 12 bp, Homo sapiens
aagataatgttc

SEQ ID NO: 3860721 - DNA, 16 bp, Homo sapiens
aagataatgttcttta

SEQ ID NO: 3860722 - DNA, 14 bp, Homo sapiens
aagatacactcctg

SEQ ID NO: 3860723 - DNA, 14 bp, Homo sapiens
aagatagcagggca

SEQ ID NO: 3860724 - DNA, 21 bp, Homo sapiens
aagataggtttgagttcaaat

SEQ ID NO: 3860725 - DNA, 23 bp, Homo sapiens
aagataggtttgagttcaaattt

SEQ ID NO: 3860726 - DNA, 22 bp, Homo sapiens
aagatatatatttactaaaaga

SEQ ID NO: 3860727 - DNA, 23 bp, Homo sapiens
aagatatatatttactaaaagaa

SEQ ID NO: 3860728 - DNA, 15 bp, Homo sapiens
aagatatattttgag

SEQ ID NO: 3860729 - DNA, 13 bp, Homo sapiens
aagatatttatat

SEQ ID NO: 3860730 - DNA, 20 bp, Homo sapiens
aagatcgcgccactgcactc

SEQ ID NO: 3860731 - DNA, 14 bp, Homo sapiens
aagatgaagagaag

SEQ ID NO: 3860732 - DNA, 16 bp, Homo sapiens
aagatggctgtgcctc

SEQ ID NO: 3860733 - DNA, 18 bp, Homo sapiens
aagatgggcagctagttc

SEQ ID NO: 3860734 - DNA, 21 bp, Homo sapiens
aagatgtcaaatatctcagag

SEQ ID NO: 3860735 - DNA, 16 bp, Homo sapiens
aagattaaaggaagga

SEQ ID NO: 3860736 - DNA, 18 bp, Homo sapiens
aagattaaaggaaggaaa

SEQ ID NO: 3860737 - DNA, 19 bp, Homo sapiens
aagattaaaggaaggaaaa

SEQ ID NO: 3860738 - DNA, 20 bp, Homo sapiens
aagattaaattatatctgag

SEQ ID NO: 3860739 - DNA, 18 bp, Homo sapiens
aagattagaatgaaaatt

SEQ ID NO: 3860740 - DNA, 18 bp, Homo sapiens
aagattatattataataa

SEQ ID NO: 3860741 - DNA, 24 bp, Homo sapiens
aagattatattataataatgttct

SEQ ID NO: 3860742 - DNA, 15 bp, Homo sapiens
aagattcccagagac

SEQ ID NO: 3860743 - DNA, 20 bp, Homo sapiens
aagattcccagagacaggaa

SEQ ID NO: 3860744 - DNA, 20 bp, Homo sapiens
aagattggacatggtctcct

SEQ ID NO: 3860745 - DNA, 22 bp, Homo sapiens
aagatttaccttttctgttgta

SEQ ID NO: 3860746 - DNA, 14 bp, Homo sapiens
aagattttttttgt

SEQ ID NO: 3860747 - DNA, 16 bp, Homo sapiens
aagattttttttgtaa

SEQ ID NO: 3860748 - DNA, 16 bp, Homo sapiens
aagcaaaggaaaccaa

SEQ ID NO: 3860749 - DNA, 17 bp, Homo sapiens
aagcaaaggtgaagaga

SEQ ID NO: 3860750 - DNA, 21 bp, Homo sapiens
aagcaacattttatttaagaa

SEQ ID NO: 3860751 - DNA, 19 bp, Homo sapiens
aagcaagaaagccgtactg

SEQ ID NO: 3860752 - DNA, 23 bp, Homo sapiens
aagcaataattaggatctatgca

SEQ ID NO: 3860753 - DNA, 16 bp, Homo sapiens
aagcaattatattgtc

SEQ ID NO: 3860754 - DNA, 15 bp, Homo sapiens
aagcaattgccctgt

SEQ ID NO: 3860755 - DNA, 19 bp, Homo sapiens
aagcaccagcttctccagg

SEQ ID NO: 3860756 - DNA, 13 bp, Homo sapiens
aagcagcattcag

SEQ ID NO: 3860757 - DNA, 10 bp, Homo sapiens
aagcagccag

SEQ ID NO: 3860758 - DNA, 11 bp, Homo sapiens
aagcagccagc

SEQ ID NO: 3860759 - DNA, 22 bp, Homo sapiens
aagcagccagccagtcttgcct

SEQ ID NO: 3860760 - DNA, 12 bp, Homo sapiens
aagcagcctcct

SEQ ID NO: 3860761 - DNA, 17 bp, Homo sapiens
aagcaggaaggatggca

SEQ ID NO: 3860762 - DNA, 19 bp, Homo sapiens
aagcaggaaggatggcaag

SEQ ID NO: 3860763 - DNA, 16 bp, Homo sapiens
aagcaggcagagcggg

SEQ ID NO: 3860764 - DNA, 20 bp, Homo sapiens
aagcaggcagagcggggagg

SEQ ID NO: 3860765 - DNA, 20 bp, Homo sapiens
aagcaggttcttgatgtcat

SEQ ID NO: 3860766 - DNA, 14 bp, Homo sapiens
aagcagtgcctcga

SEQ ID NO: 3860767 - DNA, 15 bp, Homo sapiens
aagcagtgtgtcctt

SEQ ID NO: 3860768 - DNA, 22 bp, Homo sapiens
aagcataaatgcaaacacacaa

SEQ ID NO: 3860769 - DNA, 15 bp, Homo sapiens
aagcatatttgagaa

SEQ ID NO: 3860770 - DNA, 18 bp, Homo sapiens
aagcattacatttccaaa

SEQ ID NO: 3860771 - DNA, 16 bp, Homo sapiens
aagccaacaccctgtc

SEQ ID NO: 3860772 - DNA, 17 bp, Homo sapiens
aagccaacagtcaaaac

SEQ ID NO: 3860773 - DNA, 16 bp, Homo sapiens
aagtgatatatgtatt

SEQ ID NO: 3860774 - DNA, 19 bp, Homo sapiens
aagtgatctgtcccctctc

SEQ ID NO: 3860775 - DNA, 22 bp, Homo sapiens
aagtgatctgtcccctctcccc

SEQ ID NO: 3860776 - DNA, 17 bp, Homo sapiens
aagtgatttttttgtcc

SEQ ID NO: 3860777 - DNA, 18 bp, Homo sapiens
aagtgcacacagaaatat

SEQ ID NO: 3860778 - DNA, 21 bp, Homo sapiens
aagtgcacacagaaatatata

SEQ ID NO: 3860779 - DNA, 23 bp, Homo sapiens
aagtgcacacagaaatatatata

SEQ ID NO: 3860780 - DNA, 16 bp, Homo sapiens
aagtgcatgctctctg

SEQ ID NO: 3860781 - DNA, 20 bp, Homo sapiens
aagtgccactcattcctgta

SEQ ID NO: 3860782 - DNA, 17 bp, Homo sapiens
aagtgccatcccacatt

SEQ ID NO: 3860783 - DNA, 13 bp, Homo sapiens
aagtgctccccac

SEQ ID NO: 3860784 - DNA, 14 bp, Homo sapiens
aagtgctccccaca

SEQ ID NO: 3860785 - DNA, 15 bp, Homo sapiens
aagtgctccccacac

SEQ ID NO: 3860786 - DNA, 17 bp, Homo sapiens
aagtgctccccacacgt

SEQ ID NO: 3860787 - DNA, 22 bp, Homo sapiens
aagtgctgtacccttccacctc

SEQ ID NO: 3860788 - DNA, 23 bp, Homo sapiens
aagtgctgtttgagatgtgatgc

SEQ ID NO: 3860789 - DNA, 16 bp, Homo sapiens
aagtggaccaggacag

SEQ ID NO: 3860790 - DNA, 18 bp, Homo sapiens
aagtggctaattcaattt

SEQ ID NO: 3860791 - DNA, 20 bp, Homo sapiens
aagtggggttgcaaccactg

SEQ ID NO: 3860792 - DNA, 22 bp, Homo sapiens
aagtgggttcactagagctggg

SEQ ID NO: 3860793 - DNA, 23 bp, Homo sapiens
aagtgtatatcagaaaagggaag

SEQ ID NO: 3860794 - DNA, 24 bp, Homo sapiens
aagtgtgtggaaggcagggacaga

SEQ ID NO: 3860795 - DNA, 15 bp, Homo sapiens
aagtgttagatagaa

SEQ ID NO: 3860796 - DNA, 17 bp, Homo sapiens
aagtgttcaagaaataa

SEQ ID NO: 3860797 - DNA, 21 bp, Homo sapiens
aagtgttcaagaaataaaaat

SEQ ID NO: 3860798 - DNA, 16 bp, Homo sapiens
aagtgttgctcttgga

SEQ ID NO: 3860799 - DNA, 23 bp, Homo sapiens
aagtgttttgttctttctggagt

SEQ ID NO: 3860800 - DNA, 14 bp, Homo sapiens
aagttaaaaaaaag

SEQ ID NO: 3860801 - DNA, 15 bp, Homo sapiens
aagttacttattcta

SEQ ID NO: 3860802 - DNA, 18 bp, Homo sapiens
aagttagagaatatattt

SEQ ID NO: 3860803 - DNA, 16 bp, Homo sapiens
aagttatagtatatct

SEQ ID NO: 3860804 - DNA, 18 bp, Homo sapiens
aagttatgagggtcaggg

SEQ ID NO: 3860805 - DNA, 20 bp, Homo sapiens
aagttattaacgggcatgta

SEQ ID NO: 3860806 - DNA, 16 bp, Homo sapiens
aagttcagccaccctg

SEQ ID NO: 3860807 - DNA, 13 bp, Homo sapiens
aagttcagccaga

SEQ ID NO: 3860808 - DNA, 17 bp, Homo sapiens
aagttcatgtttgtaaa

SEQ ID NO: 3860809 - DNA, 20 bp, Homo sapiens
aagttccctacttcctgtga

SEQ ID NO: 3860810 - DNA, 17 bp, Homo sapiens
aagttcctgttcacctt

SEQ ID NO: 3860811 - DNA, 15 bp, Homo sapiens
aagttctaagttcat

SEQ ID NO: 3860812 - DNA, 16 bp, Homo sapiens
aagttctaagttcatg

SEQ ID NO: 3860813 - DNA, 21 bp, Homo sapiens
aagttctagagaagaggctgg

SEQ ID NO: 3860814 - DNA, 20 bp, Homo sapiens
aagttgaaagagtcctattt

SEQ ID NO: 3860815 - DNA, 16 bp, Homo sapiens
aagttgcagtctcaga

SEQ ID NO: 3860816 - DNA, 16 bp, Homo sapiens
aagttgggactctgga

SEQ ID NO: 3860817 - DNA, 21 bp, Homo sapiens
aagtttacaagtgtatatcag

SEQ ID NO: 3860818 - DNA, 23 bp, Homo sapiens
aagtttacaagtgtatatcagaa

SEQ ID NO: 3860819 - DNA, 18 bp, Homo sapiens
aagtttacagtaaataaa

SEQ ID NO: 3860820 - DNA, 19 bp, Homo sapiens
aagtttattttttctacac

SEQ ID NO: 3860821 - DNA, 21 bp, Homo sapiens
aagtttattttttctacacag

SEQ ID NO: 3860822 - DNA, 22 bp, Homo sapiens
aagtttcccgccaggaggtcct

SEQ ID NO: 3860823 - DNA, 19 bp, Homo sapiens
aagtttctagctagaaata

SEQ ID NO: 3860824 - DNA, 23 bp, Homo sapiens
aagtttctagctagaaatatgat

SEQ ID NO: 3860825 - DNA, 19 bp, Homo sapiens
aagtttggcaatagtttgc

SEQ ID NO: 3860826 - DNA, 11 bp, Homo sapiens
aagttttcagg

SEQ ID NO: 3860827 - DNA, 13 bp, Homo sapiens
aagttttcctgag

SEQ ID NO: 3860828 - DNA, 18 bp, Homo sapiens
aataaaaaaaagaaatga

SEQ ID NO: 3860829 - DNA, 14 bp, Homo sapiens
aataaaaaaataca

SEQ ID NO: 3860830 - DNA, 16 bp, Homo sapiens
aataaaaaaatacagt

SEQ ID NO: 3860831 - DNA, 18 bp, Homo sapiens
aataaaaaaatacagtaa

SEQ ID NO: 3860832 - DNA, 19 bp, Homo sapiens
aataaaaaaatacagtaaa

SEQ ID NO: 3860833 - DNA, 13 bp, Homo sapiens
aataaaaaatgga

SEQ ID NO: 3860834 - DNA, 15 bp, Homo sapiens
aataaaaaccagaat

SEQ ID NO: 3860835 - DNA, 20 bp, Homo sapiens
aataaaaacttcagaaaaac

SEQ ID NO: 3860836 - DNA, 22 bp, Homo sapiens
aataaaaagactattaagagca

SEQ ID NO: 3860837 - DNA, 13 bp, Homo sapiens
aataaaaagtata

SEQ ID NO: 3860838 - DNA, 13 bp, Homo sapiens
aataaaaccagct

SEQ ID NO: 3860839 - DNA, 15 bp, Homo sapiens
aataaaacctttcaa

SEQ ID NO: 3860840 - DNA, 16 bp, Homo sapiens
aataaaactttatgga

SEQ ID NO: 3860841 - DNA, 13 bp, Homo sapiens
aataaaagtgact

SEQ ID NO: 3860842 - DNA, 21 bp, Homo sapiens
aataaaatagtattgaaagtg

SEQ ID NO: 3860843 - DNA, 13 bp, Homo sapiens
aataaaatgatgt

SEQ ID NO: 3860844 - DNA, 13 bp, Homo sapiens
aataaacctggag

SEQ ID NO: 3860845 - DNA, 22 bp, Homo sapiens
aataaagaactccttattttgt

SEQ ID NO: 3860846 - DNA, 17 bp, Homo sapiens
aataaagacttcatgtt

SEQ ID NO: 3860847 - DNA, 12 bp, Homo sapiens
aataaagagctc

SEQ ID NO: 3860848 - DNA, 12 bp, Homo sapiens
aataaagctgga

SEQ ID NO: 3860849 - DNA, 23 bp, Homo sapiens
aataaagctggacaagaagctgc

SEQ ID NO: 3860850 - DNA, 19 bp, Homo sapiens
aataaagggaaacgaatgt

SEQ ID NO: 3860851 - DNA, 19 bp, Homo sapiens
aataaagttggtcttttga

SEQ ID NO: 3860852 - DNA, 14 bp, Homo sapiens
aataaatattctgc

SEQ ID NO: 3860853 - DNA, 16 bp, Homo sapiens
aataaatattctgcat

SEQ ID NO: 3860854 - DNA, 21 bp, Homo sapiens
aataaatctgagcctaaatct

SEQ ID NO: 3860855 - DNA, 12 bp, Homo sapiens
aataaatgctga

SEQ ID NO: 3860856 - DNA, 13 bp, Homo sapiens
aataaattcaaac

SEQ ID NO: 3860857 - DNA, 16 bp, Homo sapiens
aataaattgctccttg

SEQ ID NO: 3860858 - DNA, 21 bp, Homo sapiens
aataaattggtgataagtgga

SEQ ID NO: 3860859 - DNA, 13 bp, Homo sapiens
aataaattgtttg

SEQ ID NO: 3860860 - DNA, 16 bp, Homo sapiens
aataaattttgtttca

SEQ ID NO: 3860861 - DNA, 21 bp, Homo sapiens
aataacttgtcctatgtcaat

SEQ ID NO: 3860862 - DNA, 14 bp, Homo sapiens
aataagagaaagaa

SEQ ID NO: 3860863 - DNA, 15 bp, Homo sapiens
aataagagaaagaaa

SEQ ID NO: 3860864 - DNA, 18 bp, Homo sapiens
aataaggggcacctggga

SEQ ID NO: 3860865 - DNA, 13 bp, Homo sapiens
aataagtgctgtt

SEQ ID NO: 3860866 - DNA, 14 bp, Homo sapiens
aataagtgctgttt

SEQ ID NO: 3860867 - DNA, 18 bp, Homo sapiens
aataagtgctgtttgaga

SEQ ID NO: 3860868 - DNA, 22 bp, Homo sapiens
aataagtgctgtttgagatgtg

SEQ ID NO: 3860869 - DNA, 14 bp, Homo sapiens
aataatacactaat

SEQ ID NO: 3860870 - DNA, 20 bp, Homo sapiens
aataatcattctttcccctc

SEQ ID NO: 3860871 - DNA, 16 bp, Homo sapiens
aataatgaacagcaga

SEQ ID NO: 3860872 - DNA, 18 bp, Homo sapiens
aataatgaagttattctt

SEQ ID NO: 3860873 - DNA, 20 bp, Homo sapiens
aataattaggttaacattgt

SEQ ID NO: 3860874 - DNA, 16 bp, Homo sapiens
aataatttaactaatt

SEQ ID NO: 3860875 - DNA, 22 bp, Homo sapiens
aataatttaactaatttaaacc

SEQ ID NO: 3860876 - DNA, 12 bp, Homo sapiens
aatacaaaataa

SEQ ID NO: 3860877 - DNA, 16 bp, Homo sapiens
aatacaacaagaacaa

SEQ ID NO: 3860878 - DNA, 22 bp, Homo sapiens
aatacaacatgtagctgagttt

SEQ ID NO: 3860879 - DNA, 22 bp, Homo sapiens
aatacaccacctcactcctgtt

SEQ ID NO: 3860880 - DNA, 20 bp, Homo sapiens
aatacactaattcctttcta

SEQ ID NO: 3860881 - DNA, 15 bp, Homo sapiens
aatacagacactaag

SEQ ID NO: 3860882 - DNA, 18 bp, Homo sapiens
aatacagtaaagtttaaa

SEQ ID NO: 3860883 - DNA, 20 bp, Homo sapiens
aatacatgtgtggatgtgta

SEQ ID NO: 3860884 - DNA, 16 bp, Homo sapiens
aataccaagtatttat

SEQ ID NO: 3860885 - DNA, 23 bp, Homo sapiens
aataccactggttaaaataaagc

SEQ ID NO: 3860886 - DNA, 20 bp, Homo sapiens
aataccagtgaaccaaagag

SEQ ID NO: 3860887 - DNA, 13 bp, Homo sapiens
aatacccccagag

SEQ ID NO: 3860888 - DNA, 22 bp, Homo sapiens
aatactccaagcttcaagtgat

SEQ ID NO: 3860889 - DNA, 20 bp, Homo sapiens
aatactctagcctgggccag

SEQ ID NO: 3860890 - DNA, 22 bp, Homo sapiens
aatactgcctagaaaatgcaaa

SEQ ID NO: 3860891 - DNA, 14 bp, Homo sapiens
aatactgtacatag

SEQ ID NO: 3860892 - DNA, 15 bp, Homo sapiens
aatactgtacataga

SEQ ID NO: 3860893 - DNA, 19 bp, Homo sapiens
aatactgtacatagatgta

SEQ ID NO: 3860894 - DNA, 11 bp, Homo sapiens
aatacttgagc

SEQ ID NO: 3860895 - DNA, 19 bp, Homo sapiens
aatacttgagctgtatata

SEQ ID NO: 3860896 - DNA, 13 bp, Homo sapiens
aatagaaaactga

SEQ ID NO: 3860897 - DNA, 17 bp, Homo sapiens
aatagaaaactgaaaat

SEQ ID NO: 3860898 - DNA, 18 bp, Homo sapiens
aatagaaaactgaaaatc

SEQ ID NO: 3860899 - DNA, 13 bp, Homo sapiens
aatagaaactcac

SEQ ID NO: 3860900 - DNA, 20 bp, Homo sapiens
aatagacagtatatttatag

SEQ ID NO: 3860901 - DNA, 15 bp, Homo sapiens
aatagactaaatgaa

SEQ ID NO: 3860902 - DNA, 16 bp, Homo sapiens
aatagagacacagaga

SEQ ID NO: 3860903 - DNA, 21 bp, Homo sapiens
aatagagagtatgtaatcttt

SEQ ID NO: 3860904 - DNA, 16 bp, Homo sapiens
aatagatgctgactgt

SEQ ID NO: 3860905 - DNA, 20 bp, Homo sapiens
aatagatttgattatttcct

SEQ ID NO: 3860906 - DNA, 12 bp, Homo sapiens
aatagccagaga

SEQ ID NO: 3860907 - DNA, 13 bp, Homo sapiens
aatagctattgca

SEQ ID NO: 3860908 - DNA, 21 bp, Homo sapiens
aataggatgataggaaataaa

SEQ ID NO: 3860909 - DNA, 22 bp, Homo sapiens
aatagtaaaagataacaagatc

SEQ ID NO: 3860910 - DNA, 15 bp, Homo sapiens
aatagttagccctca

SEQ ID NO: 3860911 - DNA, 18 bp, Homo sapiens
aatagttgtccatatttt

SEQ ID NO: 3860912 - DNA, 21 bp, Homo sapiens
aatagtttctgattcactatt

SEQ ID NO: 3860913 - DNA, 13 bp, Homo sapiens
aatataaaatagt

SEQ ID NO: 3860914 - DNA, 22 bp, Homo sapiens
aatataaaatagttgtccatat

SEQ ID NO: 3860915 - DNA, 21 bp, Homo sapiens
aatataaagatggctgacttt

SEQ ID NO: 3860916 - DNA, 15 bp, Homo sapiens
aatataaatgcatga

SEQ ID NO: 3860917 - DNA, 16 bp, Homo sapiens
aatataaatgcatgat

SEQ ID NO: 3860918 - DNA, 18 bp, Homo sapiens
aatataaatgcatgattt

SEQ ID NO: 3860919 - DNA, 15 bp, Homo sapiens
aatataaattaagac

SEQ ID NO: 3860920 - DNA, 20 bp, Homo sapiens
aatatacaaacatgtggcaa

SEQ ID NO: 3860921 - DNA, 20 bp, Homo sapiens
aatatagagatatttttgta

SEQ ID NO: 3860922 - DNA, 16 bp, Homo sapiens
aatatataaaaatata

SEQ ID NO: 3860923 - DNA, 14 bp, Homo sapiens
aatatatataaata

SEQ ID NO: 3860924 - DNA, 14 bp, Homo sapiens
aatatatatacata

SEQ ID NO: 3860925 - DNA, 16 bp, Homo sapiens
aatatatatacatatg

SEQ ID NO: 3860926 - DNA, 13 bp, Homo sapiens
aatatatatatat

SEQ ID NO: 3860927 - DNA, 12 bp, Homo sapiens
aatatatatttt

SEQ ID NO: 3860928 - DNA, 16 bp, Homo sapiens
aatatatatttttcaa

SEQ ID NO: 3860929 - DNA, 16 bp, Homo sapiens
aatatatcagaatctg

SEQ ID NO: 3860930 - DNA, 21 bp, Homo sapiens
aatatatcagaatctgtgtga

SEQ ID NO: 3860931 - DNA, 21 bp, Homo sapiens
aatatattgctgctggtaatt

SEQ ID NO: 3860932 - DNA, 19 bp, Homo sapiens
aatatatttttatatttag

SEQ ID NO: 3860933 - DNA, 22 bp, Homo sapiens
aatatcagttactcagccctgg

SEQ ID NO: 3860934 - DNA, 13 bp, Homo sapiens
aatatcctcaggg

SEQ ID NO: 3860935 - DNA, 15 bp, Homo sapiens
aatatgaaatgataa

SEQ ID NO: 3860936 - DNA, 22 bp, Homo sapiens
aatatgacagctgtccctgtca

SEQ ID NO: 3860937 - DNA, 15 bp, Homo sapiens
aatatgactcctttc

SEQ ID NO: 3860938 - DNA, 20 bp, Homo sapiens
aatatgattttttaaaagaa

SEQ ID NO: 3860939 - DNA, 12 bp, Homo sapiens
aatatgctgtgg

SEQ ID NO: 3860940 - DNA, 17 bp, Homo sapiens
aatatgctgtggggcat

SEQ ID NO: 3860941 - DNA, 11 bp, Homo sapiens
aatatgcttac

SEQ ID NO: 3860942 - DNA, 22 bp, Homo sapiens
aatatgtctcgctagtgatgtt

SEQ ID NO: 3860943 - DNA, 14 bp, Homo sapiens
aatatgtttgtgcc

SEQ ID NO: 3860944 - DNA, 14 bp, Homo sapiens
aatattaaatacag

SEQ ID NO: 3860945 - DNA, 22 bp, Homo sapiens
aaggaactctggcttccaggta

SEQ ID NO: 3860946 - DNA, 12 bp, Homo sapiens
aaggaaggaaaa

SEQ ID NO: 3860947 - DNA, 22 bp, Homo sapiens
aaggaaggagactcacctctgc

SEQ ID NO: 3860948 - DNA, 13 bp, Homo sapiens
aaggaaggaggca

SEQ ID NO: 3860949 - DNA, 17 bp, Homo sapiens
aaggaaggctccatctc

SEQ ID NO: 3860950 - DNA, 13 bp, Homo sapiens
aaggaagggacac

SEQ ID NO: 3860951 - DNA, 16 bp, Homo sapiens
aaggaagggacacaca

SEQ ID NO: 3860952 - DNA, 17 bp, Homo sapiens
aaggaagggacacacac

SEQ ID NO: 3860953 - DNA, 17 bp, Homo sapiens
aaggaatagccagagag

SEQ ID NO: 3860954 - DNA, 18 bp, Homo sapiens
aaggaatcgtttcaaatg

SEQ ID NO: 3860955 - DNA, 23 bp, Homo sapiens
aaggaatctgaaagtatattttc

SEQ ID NO: 3860956 - DNA, 17 bp, Homo sapiens
aaggacaacctgcccct

SEQ ID NO: 3860957 - DNA, 22 bp, Homo sapiens
aaggaccaactggcttctgtgc

SEQ ID NO: 3860958 - DNA, 24 bp, Homo sapiens
aaggacccacccatcttcctgctg

SEQ ID NO: 3860959 - DNA, 22 bp, Homo sapiens
aaggacccggaggggcctggca

SEQ ID NO: 3860960 - DNA, 20 bp, Homo sapiens
aaggaccctgttttccacac

SEQ ID NO: 3860961 - DNA, 16 bp, Homo sapiens
aaggaccgtttttact

SEQ ID NO: 3860962 - DNA, 18 bp, Homo sapiens
aaggactaacataaaatc

SEQ ID NO: 3860963 - DNA, 21 bp, Homo sapiens
aaggactaacataaaatctgt

SEQ ID NO: 3860964 - DNA, 21 bp, Homo sapiens
aaggactacgttaagggaagg

SEQ ID NO: 3860965 - DNA, 13 bp, Homo sapiens
aaggacttctgca

SEQ ID NO: 3860966 - DNA, 16 bp, Homo sapiens
aaggacttctgcagct

SEQ ID NO: 3860967 - DNA, 19 bp, Homo sapiens
aaggagaaacagagacagg

SEQ ID NO: 3860968 - DNA, 18 bp, Homo sapiens
aaggagaaaggagccgga

SEQ ID NO: 3860969 - DNA, 16 bp, Homo sapiens
aaggagactcacctct

SEQ ID NO: 3860970 - DNA, 20 bp, Homo sapiens
aaggagactcacctctgcct

SEQ ID NO: 3860971 - DNA, 22 bp, Homo sapiens
aaggagactcacctctgcctca

SEQ ID NO: 3860972 - DNA, 17 bp, Homo sapiens
aaggagagttcaagcct

SEQ ID NO: 3860973 - DNA, 16 bp, Homo sapiens
aaggagatataaaatc

SEQ ID NO: 3860974 - DNA, 23 bp, Homo sapiens
aaggagcagagctgatggagaag

SEQ ID NO: 3860975 - DNA, 22 bp, Homo sapiens
aaggagcctgtgaacccaggac

SEQ ID NO: 3860976 - DNA, 20 bp, Homo sapiens
aaggagctgatttccaggcc

SEQ ID NO: 3860977 - DNA, 20 bp, Homo sapiens
aaggaggcatgcctctgata

SEQ ID NO: 3860978 - DNA, 15 bp, Homo sapiens
aaggaggtgagggat

SEQ ID NO: 3860979 - DNA, 16 bp, Homo sapiens
aaggataagaaccaca

SEQ ID NO: 3860980 - DNA, 16 bp, Homo sapiens
aaggatctctcaggag

SEQ ID NO: 3860981 - DNA, 20 bp, Homo sapiens
aaggatctctcaggagcaca

SEQ ID NO: 3860982 - DNA, 21 bp, Homo sapiens
aaggatctctcaggagcacag

SEQ ID NO: 3860983 - DNA, 22 bp, Homo sapiens
aaggatggcaagcacgggacag

SEQ ID NO: 3860984 - DNA, 21 bp, Homo sapiens
aaggattgatcactttgttaa

SEQ ID NO: 3860985 - DNA, 22 bp, Homo sapiens
aaggattgttgggcttggggga

SEQ ID NO: 3860986 - DNA, 18 bp, Homo sapiens
aaggcacttgtcactatg

SEQ ID NO: 3860987 - DNA, 11 bp, Homo sapiens
aaggcagcctc

SEQ ID NO: 3860988 - DNA, 13 bp, Homo sapiens
aaggcagcctcca

SEQ ID NO: 3860989 - DNA, 17 bp, Homo sapiens
aaggcagcctccagagc

SEQ ID NO: 3860990 - DNA, 22 bp, Homo sapiens
aaggcagcctccagagccagcc

SEQ ID NO: 3860991 - DNA, 19 bp, Homo sapiens
aaggcaggaatgtgtggca

SEQ ID NO: 3860992 - DNA, 17 bp, Homo sapiens
aaggcaggcagggctct

SEQ ID NO: 3860993 - DNA, 21 bp, Homo sapiens
aaggcaggcagggctctcctg

SEQ ID NO: 3860994 - DNA, 18 bp, Homo sapiens
aaggcagggaaaggctct

SEQ ID NO: 3860995 - DNA, 12 bp, Homo sapiens
aaggcagggcag

SEQ ID NO: 3860996 - DNA, 23 bp, Homo sapiens
aaggcaggtagatcgcttgagcc

SEQ ID NO: 3860997 - DNA, 23 bp, Homo sapiens
aaggcagtgaacacactcagcag

SEQ ID NO: 3860998 - DNA, 23 bp, Homo sapiens
aaggcccagctatggccccaggg

SEQ ID NO: 3860999 - DNA, 12 bp, Homo sapiens
aaggcccctccc

SEQ ID NO: 3861000 - DNA, 14 bp, Homo sapiens
aaggcccgagcagc

SEQ ID NO: 3861001 - DNA, 16 bp, Homo sapiens
aaggcccgagcagctg

SEQ ID NO: 3861002 - DNA, 19 bp, Homo sapiens
aaggcccgagcagctgagc

SEQ ID NO: 3861003 - DNA, 22 bp, Homo sapiens
aaggccgctgttcacccacagg

SEQ ID NO: 3861004 - DNA, 13 bp, Homo sapiens
aaggcctgccctc

SEQ ID NO: 3861005 - DNA, 22 bp, Homo sapiens
aaggcctggaaccagggaggag

SEQ ID NO: 3861006 - DNA, 18 bp, Homo sapiens
aaggccttcaacccgaga

SEQ ID NO: 3861007 - DNA, 16 bp, Homo sapiens
aaggcgaggagagtgg

SEQ ID NO: 3861008 - DNA, 17 bp, Homo sapiens
aaggcgtgcaaggggct

SEQ ID NO: 3861009 - DNA, 20 bp, Homo sapiens
aaggctacttcggggctggg

SEQ ID NO: 3861010 - DNA, 17 bp, Homo sapiens
aaggctctgaaagccag

SEQ ID NO: 3861011 - DNA, 18 bp, Homo sapiens
aaggctctgaaagccagc

SEQ ID NO: 3861012 - DNA, 16 bp, Homo sapiens
aaggctgaccaagaga

SEQ ID NO: 3861013 - DNA, 19 bp, Homo sapiens
aaggctgaccaagagagaa

SEQ ID NO: 3861014 - DNA, 16 bp, Homo sapiens
aagggaaactgccagc

SEQ ID NO: 3861015 - DNA, 17 bp, Homo sapiens
aagggaaactgccagca

SEQ ID NO: 3861016 - DNA, 17 bp, Homo sapiens
aagggaactgaagacct

SEQ ID NO: 3861017 - DNA, 13 bp, Homo sapiens
aagggacacacac

SEQ ID NO: 3861018 - DNA, 14 bp, Homo sapiens
aagggagaagaaat

SEQ ID NO: 3861019 - DNA, 17 bp, Homo sapiens
aagggagagggagggag

SEQ ID NO: 3861020 - DNA, 16 bp, Homo sapiens
aagggagggctctgag

SEQ ID NO: 3861021 - DNA, 20 bp, Homo sapiens
aagggagttgctcactcagg

SEQ ID NO: 3861022 - DNA, 22 bp, Homo sapiens
aagggagttgctcactcaggac

SEQ ID NO: 3861023 - DNA, 17 bp, Homo sapiens
aagggatggcaagatgt

SEQ ID NO: 3861024 - DNA, 12 bp, Homo sapiens
aagggcagccag

SEQ ID NO: 3861025 - DNA, 16 bp, Homo sapiens
aagggcagccaggggc

SEQ ID NO: 3861026 - DNA, 17 bp, Homo sapiens
aagggcagccaggggct

SEQ ID NO: 3861027 - DNA, 17 bp, Homo sapiens
aagggcatccttctgcc

SEQ ID NO: 3861028 - DNA, 14 bp, Homo sapiens
aagggcattttaaa

SEQ ID NO: 3861029 - DNA, 19 bp, Homo sapiens
aagggccagccctacatct

SEQ ID NO: 3861030 - DNA, 16 bp, Homo sapiens
aaacagagatgtgata

SEQ ID NO: 3861031 - DNA, 12 bp, Homo sapiens
aaacagagggcc

SEQ ID NO: 3861032 - DNA, 20 bp, Homo sapiens
aaacagatgataaatattta

SEQ ID NO: 3861033 - DNA, 14 bp, Homo sapiens
aaacagcagtgttc

SEQ ID NO: 3861034 - DNA, 15 bp, Homo sapiens
aaacagcctcacaga

SEQ ID NO: 3861035 - DNA, 11 bp, Homo sapiens
aaacaggacca

SEQ ID NO: 3861036 - DNA, 18 bp, Homo sapiens
aaacaggagacaggaagg

SEQ ID NO: 3861037 - DNA, 23 bp, Homo sapiens
aaacagggagcccctaggaaagc

SEQ ID NO: 3861038 - DNA, 17 bp, Homo sapiens
aaacaggggatcaaagt

SEQ ID NO: 3861039 - DNA, 20 bp, Homo sapiens
aaacaggggatcaaagttcc

SEQ ID NO: 3861040 - DNA, 15 bp, Homo sapiens
aaacagtctcaggaa

SEQ ID NO: 3861041 - DNA, 14 bp, Homo sapiens
aaacagtgagcctg

SEQ ID NO: 3861042 - DNA, 12 bp, Homo sapiens
aaacagtgcctg

SEQ ID NO: 3861043 - DNA, 21 bp, Homo sapiens
aaacataattcttgtatatta

SEQ ID NO: 3861044 - DNA, 21 bp, Homo sapiens
aaacataccctttatctctgt

SEQ ID NO: 3861045 - DNA, 15 bp, Homo sapiens
aaacatatcaattca

SEQ ID NO: 3861046 - DNA, 18 bp, Homo sapiens
aaacatatcaattcaaca

SEQ ID NO: 3861047 - DNA, 12 bp, Homo sapiens
aaacatgaagtg

SEQ ID NO: 3861048 - DNA, 19 bp, Homo sapiens
aaacatgagtgaatagctt

SEQ ID NO: 3861049 - DNA, 24 bp, Homo sapiens
aaacatgctaaatagttctatcag

SEQ ID NO: 3861050 - DNA, 15 bp, Homo sapiens
aaacattaaaagaag

SEQ ID NO: 3861051 - DNA, 21 bp, Homo sapiens
aaacattaaaagaagactgga

SEQ ID NO: 3861052 - DNA, 20 bp, Homo sapiens
aaacattaagattgaggcct

SEQ ID NO: 3861053 - DNA, 23 bp, Homo sapiens
aaacattcacacagggctctttg

SEQ ID NO: 3861054 - DNA, 21 bp, Homo sapiens
aaacattcatccagttgcaat

SEQ ID NO: 3861055 - DNA, 19 bp, Homo sapiens
aaacatttacaataaatat

SEQ ID NO: 3861056 - DNA, 22 bp, Homo sapiens
aaacatttacaataaatattct

SEQ ID NO: 3861057 - DNA, 16 bp, Homo sapiens
aaacatttactgacca

SEQ ID NO: 3861058 - DNA, 15 bp, Homo sapiens
aaaccacagcagttg

SEQ ID NO: 3861059 - DNA, 21 bp, Homo sapiens
aaaccaccctaaaatgacagc

SEQ ID NO: 3861060 - DNA, 16 bp, Homo sapiens
aaaccactgaacattt

SEQ ID NO: 3861061 - DNA, 13 bp, Homo sapiens
aaaccactgtaca

SEQ ID NO: 3861062 - DNA, 15 bp, Homo sapiens
aaaccactgtacata

SEQ ID NO: 3861063 - DNA, 14 bp, Homo sapiens
aaaccagcagaaaa

SEQ ID NO: 3861064 - DNA, 18 bp, Homo sapiens
aaaccagcagaaaagtgc

SEQ ID NO: 3861065 - DNA, 21 bp, Homo sapiens
aaaccagcagaaaagtgctta

SEQ ID NO: 3861066 - DNA, 15 bp, Homo sapiens
aaaccagggtgcatg

SEQ ID NO: 3861067 - DNA, 16 bp, Homo sapiens
aaaccagggtgcatgg

SEQ ID NO: 3861068 - DNA, 23 bp, Homo sapiens
aaaccagtttagatttcaagaaa

SEQ ID NO: 3861069 - DNA, 13 bp, Homo sapiens
aaaccataaactt

SEQ ID NO: 3861070 - DNA, 15 bp, Homo sapiens
aaaccataaacttca

SEQ ID NO: 3861071 - DNA, 14 bp, Homo sapiens
aaaccatgtagttt

SEQ ID NO: 3861072 - DNA, 16 bp, Homo sapiens
aaaccatttaattcat

SEQ ID NO: 3861073 - DNA, 20 bp, Homo sapiens
aaaccatttaattcataatt

SEQ ID NO: 3861074 - DNA, 21 bp, Homo sapiens
aaaccatttaattcataatta

SEQ ID NO: 3861075 - DNA, 11 bp, Homo sapiens
aaacccagaga

SEQ ID NO: 3861076 - DNA, 12 bp, Homo sapiens
aaacccagagag

SEQ ID NO: 3861077 - DNA, 17 bp, Homo sapiens
aaacccccgctccagat

SEQ ID NO: 3861078 - DNA, 15 bp, Homo sapiens
aaaccgtaattttat

SEQ ID NO: 3861079 - DNA, 19 bp, Homo sapiens
aaaccgtaattttattatt

SEQ ID NO: 3861080 - DNA, 16 bp, Homo sapiens
aaacctaaagaggaaa

SEQ ID NO: 3861081 - DNA, 22 bp, Homo sapiens
aaacctgaaaaaaagtttacaa

SEQ ID NO: 3861082 - DNA, 20 bp, Homo sapiens
aaacctggcatggtgctttc

SEQ ID NO: 3861083 - DNA, 11 bp, Homo sapiens
aaaccttgcag

SEQ ID NO: 3861084 - DNA, 12 bp, Homo sapiens
aaaccttgcagc

SEQ ID NO: 3861085 - DNA, 15 bp, Homo sapiens
aaaccttgcagcatt

SEQ ID NO: 3861086 - DNA, 19 bp, Homo sapiens
aaaccttgcagcattttta

SEQ ID NO: 3861087 - DNA, 19 bp, Homo sapiens
aaacgagtcaatcccctca

SEQ ID NO: 3861088 - DNA, 15 bp, Homo sapiens
aaactaaatatatgt

SEQ ID NO: 3861089 - DNA, 22 bp, Homo sapiens
aaactacacatccctaatgtgt

SEQ ID NO: 3861090 - DNA, 12 bp, Homo sapiens
aaactactgtaa

SEQ ID NO: 3861091 - DNA, 14 bp, Homo sapiens
aaactactgtaatt

SEQ ID NO: 3861092 - DNA, 19 bp, Homo sapiens
aaactactgtaattaagtg

SEQ ID NO: 3861093 - DNA, 16 bp, Homo sapiens
aaactagtttccagtg

SEQ ID NO: 3861094 - DNA, 17 bp, Homo sapiens
aaactagtttccagtgg

SEQ ID NO: 3861095 - DNA, 19 bp, Homo sapiens
aaactatccaattaaaatt

SEQ ID NO: 3861096 - DNA, 20 bp, Homo sapiens
aaactatggctttaaactac

SEQ ID NO: 3861097 - DNA, 16 bp, Homo sapiens
aaactatggttcccaa

SEQ ID NO: 3861098 - DNA, 23 bp, Homo sapiens
aaactatggttcccaataaaagt

SEQ ID NO: 3861099 - DNA, 15 bp, Homo sapiens
aaactcactgctcaa

SEQ ID NO: 3861100 - DNA, 14 bp, Homo sapiens
aaactcagttaaaa

SEQ ID NO: 3861101 - DNA, 21 bp, Homo sapiens
aaactctaaacattaatcaat

SEQ ID NO: 3861102 - DNA, 19 bp, Homo sapiens
aaactgacaacctgtgcag

SEQ ID NO: 3861103 - DNA, 23 bp, Homo sapiens
aaactgagatgtgaacacatcag

SEQ ID NO: 3861104 - DNA, 14 bp, Homo sapiens
aaactgaggaattt

SEQ ID NO: 3861105 - DNA, 19 bp, Homo sapiens
aaactgaggaattttcttt

SEQ ID NO: 3861106 - DNA, 20 bp, Homo sapiens
aaactgaggccattatttca

SEQ ID NO: 3861107 - DNA, 20 bp, Homo sapiens
aaactgagtaaattggaaac

SEQ ID NO: 3861108 - DNA, 22 bp, Homo sapiens
aaactgatgcgaaaacttgaat

SEQ ID NO: 3861109 - DNA, 13 bp, Homo sapiens
aaactgatttctc

SEQ ID NO: 3861110 - DNA, 15 bp, Homo sapiens
aaactgcactgtcaa

SEQ ID NO: 3861111 - DNA, 16 bp, Homo sapiens
aaactggggcctccct

SEQ ID NO: 3861112 - DNA, 23 bp, Homo sapiens
aaactggggcttgcaagaggagg

SEQ ID NO: 3861113 - DNA, 20 bp, Homo sapiens
aaactgtaaatatgtttgtg

SEQ ID NO: 3861114 - DNA, 19 bp, Homo sapiens
aaactgtgccctgccttca

SEQ ID NO: 3861115 - DNA, 18 bp, Homo sapiens
aaacttagaataaaattg

SEQ ID NO: 3861116 - DNA, 13 bp, Homo sapiens
aaacttatgctag

SEQ ID NO: 3861117 - DNA, 10 bp, Homo sapiens
aaacttattt

SEQ ID NO: 3861118 - DNA, 12 bp, Homo sapiens
aaacttcagaaa

SEQ ID NO: 3861119 - DNA, 23 bp, Homo sapiens
aaacttccatgaggccaaacgtt

SEQ ID NO: 3861120 - DNA, 17 bp, Homo sapiens
aaacttcggaaacaagt

SEQ ID NO: 3861121 - DNA, 18 bp, Homo sapiens
aaacttgaatctgttact

SEQ ID NO: 3861122 - DNA, 11 bp, Homo sapiens
aaacttgtaaa

SEQ ID NO: 3861123 - DNA, 12 bp, Homo sapiens
aaacttgtaaat

SEQ ID NO: 3861124 - DNA, 19 bp, Homo sapiens
aaacttgtgtatgatccaa

SEQ ID NO: 3861125 - DNA, 18 bp, Homo sapiens
aaactttcatttttggta

SEQ ID NO: 3861126 - DNA, 19 bp, Homo sapiens
aaactttgatctctgctta

SEQ ID NO: 3861127 - DNA, 20 bp, Homo sapiens
aaactttgttatatatatca

SEQ ID NO: 3861128 - DNA, 18 bp, Homo sapiens
aaagaaaaaaaagaaagc

SEQ ID NO: 3861129 - DNA, 18 bp, Homo sapiens
aaagaaaaaataattgat

SEQ ID NO: 3861130 - DNA, 13 bp, Homo sapiens
aaagaaaaccatt

SEQ ID NO: 3861131 - DNA, 19 bp, Homo sapiens
aaagaaaaccattttagtt

SEQ ID NO: 3861132 - DNA, 14 bp, Homo sapiens
aaagaaaagataaa

SEQ ID NO: 3861133 - DNA, 23 bp, Homo sapiens
aaagaaaagataaagatgatcta

SEQ ID NO: 3861134 - DNA, 18 bp, Homo sapiens
aaagaaaattcttggaat

SEQ ID NO: 3861135 - DNA, 19 bp, Homo sapiens
aaagaaaccgtaattttat

SEQ ID NO: 3861136 - DNA, 14 bp, Homo sapiens
aaagaaatgcaaaa

SEQ ID NO: 3861137 - DNA, 15 bp, Homo sapiens
aaagaacggaagaag

SEQ ID NO: 3861138 - DNA, 19 bp, Homo sapiens
aaagaacggaagaagagat

SEQ ID NO: 3861139 - DNA, 16 bp, Homo sapiens
aaagaactccttattt

SEQ ID NO: 3861140 - DNA, 15 bp, Homo sapiens
aaagaactgccccat

SEQ ID NO: 3861141 - DNA, 12 bp, Homo sapiens
aaagaagagcct

SEQ ID NO: 3861142 - DNA, 17 bp, Homo sapiens
aaagaatacagaaagat

SEQ ID NO: 3861143 - DNA, 22 bp, Homo sapiens
aaagaatgagaaggagtcagaa

SEQ ID NO: 3861144 - DNA, 23 bp, Homo sapiens
aaagaattatttttgtgtttcta

SEQ ID NO: 3861145 - DNA, 21 bp, Homo sapiens
aaagaattcctgaagccagat

SEQ ID NO: 3861146 - DNA, 21 bp, Homo sapiens
aaagacagcactacagatatc

SEQ ID NO: 3861147 - DNA, 16 bp, Homo sapiens
aaagacagctgacaga

SEQ ID NO: 3861148 - DNA, 14 bp, Homo sapiens
aaagacatgttgta

SEQ ID NO: 3861149 - DNA, 23 bp, Homo sapiens
aaagactaatttaaaaaataact

SEQ ID NO: 3861150 - DNA, 17 bp, Homo sapiens
aaagactattcaaacag

SEQ ID NO: 3861151 - DNA, 21 bp, Homo sapiens
aaagactattcaaacagtctc

SEQ ID NO: 3861152 - DNA, 15 bp, Homo sapiens
aaagactccaaagaa

SEQ ID NO: 3861153 - DNA, 16 bp, Homo sapiens
aaagactgcagctgct

SEQ ID NO: 3861154 - DNA, 19 bp, Homo sapiens
aaagacttaagattaaatt

SEQ ID NO: 3861155 - DNA, 15 bp, Homo sapiens
aaagagactggagca

SEQ ID NO: 3861156 - DNA, 23 bp, Homo sapiens
aaagagcaagtctggatctggga

SEQ ID NO: 3861157 - DNA, 21 bp, Homo sapiens
aaagaggtgaccccagggcac

SEQ ID NO: 3861158 - DNA, 18 bp, Homo sapiens
aaagatagtatcttttaa

SEQ ID NO: 3861159 - DNA, 17 bp, Homo sapiens
aaagatatatacacagg

SEQ ID NO: 3861160 - DNA, 21 bp, Homo sapiens
aaagatccaccctcaaatgtc

SEQ ID NO: 3861161 - DNA, 23 bp, Homo sapiens
aaagatccaccctcaaatgtcag

SEQ ID NO: 3861162 - DNA, 23 bp, Homo sapiens
aaagatggctgtgcctctgcctg

SEQ ID NO: 3861163 - DNA, 21 bp, Homo sapiens
aaagatgtcaaatatctcaga

SEQ ID NO: 3861164 - DNA, 20 bp, Homo sapiens
aaagatgtgttgttggtttc

SEQ ID NO: 3861165 - DNA, 13 bp, Homo sapiens
aaagattcactaa

SEQ ID NO: 3861166 - DNA, 14 bp, Homo sapiens
aaagattcactaaa

SEQ ID NO: 3861167 - DNA, 14 bp, Homo sapiens
aaagcaacatttta

SEQ ID NO: 3861168 - DNA, 17 bp, Homo sapiens
aaagcaagggctccagc

SEQ ID NO: 3861169 - DNA, 22 bp, Homo sapiens
aaagcaagggctccagcatcca

SEQ ID NO: 3861170 - DNA, 16 bp, Homo sapiens
aaagcaattatattgt

SEQ ID NO: 3861171 - DNA, 22 bp, Homo sapiens
aaagcactcccttaggcattat

SEQ ID NO: 3861172 - DNA, 21 bp, Homo sapiens
aaagcactgacttctaagtaa

SEQ ID NO: 3861173 - DNA, 20 bp, Homo sapiens
aaagcagcagctaggactga

SEQ ID NO: 3861174 - DNA, 17 bp, Homo sapiens
aaagcaggtggcatctc

SEQ ID NO: 3861175 - DNA, 15 bp, Homo sapiens
aaagcataaatgcaa

SEQ ID NO: 3861176 - DNA, 12 bp, Homo sapiens
aaagcatggact

SEQ ID NO: 3861177 - DNA, 12 bp, Homo sapiens
aaagcccctgga

SEQ ID NO: 3861178 - DNA, 15 bp, Homo sapiens
aaagccgtgcctttc

SEQ ID NO: 3861179 - DNA, 21 bp, Homo sapiens
aaagctgcctgtagttaggaa

SEQ ID NO: 3861180 - DNA, 23 bp, Homo sapiens
aaagctgcctgtagttaggaaat

SEQ ID NO: 3861181 - DNA, 24 bp, Homo sapiens
aaagctgcttgactatcacataca

SEQ ID NO: 3861182 - DNA, 18 bp, Homo sapiens
aaagctggacaagaagct

SEQ ID NO: 3861183 - DNA, 19 bp, Homo sapiens
aaagctggacaagaagctg

SEQ ID NO: 3861184 - DNA, 15 bp, Homo sapiens
aaaggacccacccat

SEQ ID NO: 3861185 - DNA, 23 bp, Homo sapiens
aaaggagcctgtgaacccaggac

SEQ ID NO: 3861186 - DNA, 18 bp, Homo sapiens
aaaggaggcatgcctctg

SEQ ID NO: 3861187 - DNA, 12 bp, Homo sapiens
aaaggatatttt

SEQ ID NO: 3861188 - DNA, 19 bp, Homo sapiens
aaaggatgtaaacagtgcc

SEQ ID NO: 3861189 - DNA, 17 bp, Homo sapiens
aaaggcaccatctaata

SEQ ID NO: 3861190 - DNA, 10 bp, Homo sapiens
aaaggcctgg

SEQ ID NO: 3861191 - DNA, 20 bp, Homo sapiens
aaaggctctgaaagccagct

SEQ ID NO: 3861192 - DNA, 17 bp, Homo sapiens
aaagggagggctctgag

SEQ ID NO: 3861193 - DNA, 17 bp, Homo sapiens
aaagggctatggcaagg

SEQ ID NO: 3861194 - DNA, 18 bp, Homo sapiens
aaaggggcagaaaaactc

SEQ ID NO: 3861195 - DNA, 19 bp, Homo sapiens
aaaggggctgctggggcat

SEQ ID NO: 3861196 - DNA, 21 bp, Homo sapiens
aaagggtagcctacaaatgtt

SEQ ID NO: 3861197 - DNA, 15 bp, Homo sapiens
aaaggtagagatgtg

SEQ ID NO: 3861198 - DNA, 14 bp, Homo sapiens
aaaggtataatttt

SEQ ID NO: 3861199 - DNA, 17 bp, Homo sapiens
aaaggtcattgtggcta

SEQ ID NO: 3861200 - DNA, 21 bp, Homo sapiens
aaaggtttcaagacttgatac

SEQ ID NO: 3861201 - DNA, 18 bp, Homo sapiens
aaagtaaaagaaccacga

SEQ ID NO: 3861202 - DNA, 14 bp, Homo sapiens
aaagtacatttaat

SEQ ID NO: 3861203 - DNA, 20 bp, Homo sapiens
aaagtagaattatatctaat

SEQ ID NO: 3861204 - DNA, 21 bp, Homo sapiens
aaagtagaattatatctaatt

SEQ ID NO: 3861205 - DNA, 23 bp, Homo sapiens
aaagtagaattatatctaattta

SEQ ID NO: 3861206 - DNA, 13 bp, Homo sapiens
aaagtagcaggac

SEQ ID NO: 3861207 - DNA, 22 bp, Homo sapiens
aaagtatacttttgtttcaggg

SEQ ID NO: 3861208 - DNA, 15 bp, Homo sapiens
aaagtatcatgcatt

SEQ ID NO: 3861209 - DNA, 20 bp, Homo sapiens
aaagtatgtaaagtatgtaa

SEQ ID NO: 3861210 - DNA, 20 bp, Homo sapiens
aaagtcaaaaggtgcctgtg

SEQ ID NO: 3861211 - DNA, 16 bp, Homo sapiens
aaagtctaaagtttac

SEQ ID NO: 3861212 - DNA, 23 bp, Homo sapiens
aaagtcttgttaattactatatt

SEQ ID NO: 3861213 - DNA, 14 bp, Homo sapiens
aaagtgaataaact

SEQ ID NO: 3861214 - DNA, 16 bp, Homo sapiens
aaagtgaataaacttc

SEQ ID NO: 3861215 - DNA, 21 bp, Homo sapiens
aaagtgataatttctggaatt

SEQ ID NO: 3861216 - DNA, 23 bp, Homo sapiens
aaagtgatctgtcccctctcccc

SEQ ID NO: 3861217 - DNA, 15 bp, Homo sapiens
aaagtgcaatgcgtg

SEQ ID NO: 3861218 - DNA, 14 bp, Homo sapiens
aaagtgcagccctt

SEQ ID NO: 3861219 - DNA, 21 bp, Homo sapiens
aaagtgcagcccttcctcctg

SEQ ID NO: 3861220 - DNA, 21 bp, Homo sapiens
aaagtgccccttaagggttga

SEQ ID NO: 3861221 - DNA, 20 bp, Homo sapiens
aaagtgcttagaaagttatt

SEQ ID NO: 3861222 - DNA, 18 bp, Homo sapiens
aaagtggaatcactgtat

SEQ ID NO: 3861223 - DNA, 15 bp, Homo sapiens
aaagtggattttcct

SEQ ID NO: 3861224 - DNA, 21 bp, Homo sapiens
aaagtggctcttctaacctca

SEQ ID NO: 3861225 - DNA, 15 bp, Homo sapiens
aaagtgtaaaataga

SEQ ID NO: 3861226 - DNA, 16 bp, Homo sapiens
aaagtgtaaaatagaa

SEQ ID NO: 3861227 - DNA, 20 bp, Homo sapiens
aaagtgtaaatcctttttct

SEQ ID NO: 3861228 - DNA, 16 bp, Homo sapiens
aaagtgtagcaccctg

SEQ ID NO: 3861229 - DNA, 13 bp, Homo sapiens
aaagttaaaaaaa

SEQ ID NO: 3861230 - DNA, 16 bp, Homo sapiens
aaagttacaaattcaa

SEQ ID NO: 3861231 - DNA, 14 bp, Homo sapiens
aaagttcctgttca

SEQ ID NO: 3861232 - DNA, 19 bp, Homo sapiens
aaagttcctgttcacctta

SEQ ID NO: 3861233 - DNA, 23 bp, Homo sapiens
aaagttgtagttcttgtgcatgt

SEQ ID NO: 3861234 - DNA, 19 bp, Homo sapiens
aaagtttacaagtgtatat

SEQ ID NO: 3861235 - DNA, 15 bp, Homo sapiens
aaagtttgccagaag

SEQ ID NO: 3861236 - DNA, 23 bp, Homo sapiens
aaataaaaaaatacagtaaagtt

SEQ ID NO: 3861237 - DNA, 14 bp, Homo sapiens
aaataaaacctcag

SEQ ID NO: 3861238 - DNA, 15 bp, Homo sapiens
aaataaaacctttca

SEQ ID NO: 3861239 - DNA, 15 bp, Homo sapiens
aaataaagtatcatg

SEQ ID NO: 3861240 - DNA, 14 bp, Homo sapiens
aaataaatagattt

SEQ ID NO: 3861241 - DNA, 23 bp, Homo sapiens
aaataaattttgaatgtttatgt

SEQ ID NO: 3861242 - DNA, 15 bp, Homo sapiens
aaataatcggcccac

SEQ ID NO: 3861243 - DNA, 23 bp, Homo sapiens
aaataatgttctgtcacgtgaaa

SEQ ID NO: 3861244 - DNA, 17 bp, Homo sapiens
aaataattgatttcaag

SEQ ID NO: 3861245 - DNA, 11 bp, Homo sapiens
aaataatttaa

SEQ ID NO: 3861246 - DNA, 14 bp, Homo sapiens
aaataatttaacta

SEQ ID NO: 3861247 - DNA, 16 bp, Homo sapiens
aaataatttaactaat

SEQ ID NO: 3861248 - DNA, 14 bp, Homo sapiens
aaataattttaaac

SEQ ID NO: 3861249 - DNA, 20 bp, Homo sapiens
aaataattttaaacaaaggt

SEQ ID NO: 3861250 - DNA, 19 bp, Homo sapiens
aaatacaaacaagcacaga

SEQ ID NO: 3861251 - DNA, 17 bp, Homo sapiens
aaatacacaagtaaaca

SEQ ID NO: 3861252 - DNA, 15 bp, Homo sapiens
aaatacacactcaaa

SEQ ID NO: 3861253 - DNA, 17 bp, Homo sapiens
aaatacaccacgaattt

SEQ ID NO: 3861254 - DNA, 21 bp, Homo sapiens
aaatacaccacgaatttggtg

SEQ ID NO: 3861255 - DNA, 14 bp, Homo sapiens
aaatacagtaaagt

SEQ ID NO: 3861256 - DNA, 15 bp, Homo sapiens
aaatacagtaaagtt

SEQ ID NO: 3861257 - DNA, 16 bp, Homo sapiens
aaatacagtaaagttt

SEQ ID NO: 3861258 - DNA, 16 bp, Homo sapiens
aaatacagtggatctc

SEQ ID NO: 3861259 - DNA, 21 bp, Homo sapiens
aaataccagtgaaccaaagag

SEQ ID NO: 3861260 - DNA, 17 bp, Homo sapiens
aaataccatgtctctaa

SEQ ID NO: 3861261 - DNA, 23 bp, Homo sapiens
aaatactatgaaatgaaagaact

SEQ ID NO: 3861262 - DNA, 18 bp, Homo sapiens
aaatactgcctagaaaat

SEQ ID NO: 3861263 - DNA, 14 bp, Homo sapiens
aaatactgctctga

SEQ ID NO: 3861264 - DNA, 12 bp, Homo sapiens
aaatactgtaca

SEQ ID NO: 3861265 - DNA, 14 bp, Homo sapiens
aaatactgtacata

SEQ ID NO: 3861266 - DNA, 15 bp, Homo sapiens
aaatacttgagctgt

SEQ ID NO: 3861267 - DNA, 21 bp, Homo sapiens
aaatagaatgttactttggaa

SEQ ID NO: 3861268 - DNA, 19 bp, Homo sapiens
aaatagacagtatatttat

SEQ ID NO: 3861269 - DNA, 20 bp, Homo sapiens
aaatagagattaattttaac

SEQ ID NO: 3861270 - DNA, 20 bp, Homo sapiens
aaatagatggatttgtatca

SEQ ID NO: 3861271 - DNA, 21 bp, Homo sapiens
aaatagatttgattatttcct

SEQ ID NO: 3861272 - DNA, 20 bp, Homo sapiens
aaatagtaggaccaatgttg

SEQ ID NO: 3861273 - DNA, 23 bp, Homo sapiens
aaatagttgtccatattttcaca

SEQ ID NO: 3861274 - DNA, 11 bp, Homo sapiens
aaatataaact

SEQ ID NO: 3861275 - DNA, 13 bp, Homo sapiens
aaatataaacttg

SEQ ID NO: 3861276 - DNA, 16 bp, Homo sapiens
aaatataaatgtttaa

SEQ ID NO: 3861277 - DNA, 18 bp, Homo sapiens
aaatataaattaagactt

SEQ ID NO: 3861278 - DNA, 20 bp, Homo sapiens
aaatataaattaagacttta

SEQ ID NO: 3861279 - DNA, 16 bp, Homo sapiens
aaatatacaaacatgt

SEQ ID NO: 3861280 - DNA, 18 bp, Homo sapiens
aaatatagatcagttata

SEQ ID NO: 3861281 - DNA, 18 bp, Homo sapiens
aaatatatataaatatat

SEQ ID NO: 3861282 - DNA, 14 bp, Homo sapiens
aaatatatatacat

SEQ ID NO: 3861283 - DNA, 15 bp, Homo sapiens
aaatatatatacata

SEQ ID NO: 3861284 - DNA, 18 bp, Homo sapiens
aaatatatatacatatgt

SEQ ID NO: 3861285 - DNA, 17 bp, Homo sapiens
aaatatatatttttcaa

SEQ ID NO: 3861286 - DNA, 20 bp, Homo sapiens
aaatatatatttttcaacca

SEQ ID NO: 3861287 - DNA, 23 bp, Homo sapiens
aaatatatatttttcaaccagca

SEQ ID NO: 3861288 - DNA, 21 bp, Homo sapiens
aaatatcaccccttgaagcct

SEQ ID NO: 3861289 - DNA, 18 bp, Homo sapiens
aaatatccaccactttaa

SEQ ID NO: 3861290 - DNA, 19 bp, Homo sapiens
aaatatctacctgccctct

SEQ ID NO: 3861291 - DNA, 23 bp, Homo sapiens
aaatatgagtggttattgaaaat

SEQ ID NO: 3861292 - DNA, 15 bp, Homo sapiens
aaatatgcaaagcac

SEQ ID NO: 3861293 - DNA, 17 bp, Homo sapiens
aaatatgcaaagcactg

SEQ ID NO: 3861294 - DNA, 16 bp, Homo sapiens
aaatatggaacttcta

SEQ ID NO: 3861295 - DNA, 17 bp, Homo sapiens
aaatatggaacttctaa

SEQ ID NO: 3861296 - DNA, 18 bp, Homo sapiens
aaatatgtctcgctagtg

SEQ ID NO: 3861297 - DNA, 16 bp, Homo sapiens
aaatattcatgcttct

SEQ ID NO: 3861298 - DNA, 15 bp, Homo sapiens
aaatattcctgcatt

SEQ ID NO: 3861299 - DNA, 13 bp, Homo sapiens
aaatatttatttt

SEQ ID NO: 3861300 - DNA, 14 bp, Homo sapiens
aaatatttgtacat

SEQ ID NO: 3861301 - DNA, 22 bp, Homo sapiens
aaatatttgtacatagttattt

SEQ ID NO: 3861302 - DNA, 12 bp, Homo sapiens
aaatattttagc

SEQ ID NO: 3861303 - DNA, 15 bp, Homo sapiens
aaatcaaaagctgct

SEQ ID NO: 3861304 - DNA, 18 bp, Homo sapiens
aaatcaaaagctgcttga

SEQ ID NO: 3861305 - DNA, 21 bp, Homo sapiens
aaatcaaaagctgcttgacta

SEQ ID NO: 3861306 - DNA, 18 bp, Homo sapiens
aaatcacaagcaataatt

SEQ ID NO: 3861307 - DNA, 23 bp, Homo sapiens
aaatcacagatgggtattaaact

SEQ ID NO: 3861308 - DNA, 20 bp, Homo sapiens
aaatcaccatgtaacaacca

SEQ ID NO: 3861309 - DNA, 15 bp, Homo sapiens
aaatcactgtattta

SEQ ID NO: 3861310 - DNA, 12 bp, Homo sapiens
aaatcacttgta

SEQ ID NO: 3861311 - DNA, 15 bp, Homo sapiens
aaatcacttgtaaat

SEQ ID NO: 3861312 - DNA, 19 bp, Homo sapiens
aaatcacttgtaaataaat

SEQ ID NO: 3861313 - DNA, 17 bp, Homo sapiens
aaatcatcgaaaattca

SEQ ID NO: 3861314 - DNA, 17 bp, Homo sapiens
aaatcattccctttccc

SEQ ID NO: 3861315 - DNA, 14 bp, Homo sapiens
aaatcattgtagaa

SEQ ID NO: 3861316 - DNA, 21 bp, Homo sapiens
aaatcatttctgcatcagctg

SEQ ID NO: 3861317 - DNA, 14 bp, Homo sapiens
aaatccagaaagaa

SEQ ID NO: 3861318 - DNA, 15 bp, Homo sapiens
aaatccagaaagaaa

SEQ ID NO: 3861319 - DNA, 12 bp, Homo sapiens
aaatcctcacca

SEQ ID NO: 3861320 - DNA, 16 bp, Homo sapiens
aaatccttatttatat

SEQ ID NO: 3861321 - DNA, 20 bp, Homo sapiens
aaatctagttttttttgtaa

SEQ ID NO: 3861322 - DNA, 20 bp, Homo sapiens
aaatctatattaaagtgtta

SEQ ID NO: 3861323 - DNA, 18 bp, Homo sapiens
aaatctgagcctaaatct

SEQ ID NO: 3861324 - DNA, 20 bp, Homo sapiens
aaatctgagcctaaatctaa

SEQ ID NO: 3861325 - DNA, 19 bp, Homo sapiens
aaatctgtatatgttgtaa

SEQ ID NO: 3861326 - DNA, 20 bp, Homo sapiens
aaatctgtgaattaaaaaag

SEQ ID NO: 3861327 - DNA, 19 bp, Homo sapiens
aaatctgttttgtatatga

SEQ ID NO: 3861328 - DNA, 11 bp, Homo sapiens
aaatgaaaata

SEQ ID NO: 3861329 - DNA, 11 bp, Homo sapiens
aaatgaaaatt

SEQ ID NO: 3861330 - DNA, 22 bp, Homo sapiens
aaatgaacgatatgtagcagaa

SEQ ID NO: 3861331 - DNA, 23 bp, Homo sapiens
aaatgaacgatatgtagcagaaa

SEQ ID NO: 3861332 - DNA, 14 bp, Homo sapiens
aaatgacagatgtt

SEQ ID NO: 3861333 - DNA, 14 bp, Homo sapiens
aaatgacatgcact

SEQ ID NO: 3861334 - DNA, 17 bp, Homo sapiens
aaatgacatgcactgac

SEQ ID NO: 3861335 - DNA, 15 bp, Homo sapiens
aaatgaccaagaaaa

SEQ ID NO: 3861336 - DNA, 12 bp, Homo sapiens
aaatgaggagag

SEQ ID NO: 3861337 - DNA, 15 bp, Homo sapiens
aaatgattgtaaaat

SEQ ID NO: 3861338 - DNA, 21 bp, Homo sapiens
aaatgattttcatcaatttaa

SEQ ID NO: 3861339 - DNA, 15 bp, Homo sapiens
aaatgcaaacactgt

SEQ ID NO: 3861340 - DNA, 16 bp, Homo sapiens
aaatgcaaacactgtg

SEQ ID NO: 3861341 - DNA, 23 bp, Homo sapiens
aaatgcatccattcctcagggac

SEQ ID NO: 3861342 - DNA, 15 bp, Homo sapiens
aaatgcatgatttta

SEQ ID NO: 3861343 - DNA, 21 bp, Homo sapiens
aaatgcatgattttatacata

SEQ ID NO: 3861344 - DNA, 15 bp, Homo sapiens
aaatgccaacatacc

SEQ ID NO: 3861345 - DNA, 15 bp, Homo sapiens
aaatgcgtccctgta

SEQ ID NO: 3861346 - DNA, 13 bp, Homo sapiens
aaatgctgaatga

SEQ ID NO: 3861347 - DNA, 18 bp, Homo sapiens
aaatgcttctgttgtaat

SEQ ID NO: 3861348 - DNA, 19 bp, Homo sapiens
aaatggagcttgtacatat

SEQ ID NO: 3861349 - DNA, 14 bp, Homo sapiens
aaatggagggtggg

SEQ ID NO: 3861350 - DNA, 22 bp, Homo sapiens
aaatggccatttgctttttcac

SEQ ID NO: 3861351 - DNA, 23 bp, Homo sapiens
aaatggccatttgctttttcacc

SEQ ID NO: 3861352 - DNA, 17 bp, Homo sapiens
aaatggctggtttttag

SEQ ID NO: 3861353 - DNA, 22 bp, Homo sapiens
aaatgggttggtgcttctaacc

SEQ ID NO: 3861354 - DNA, 21 bp, Homo sapiens
aaatggtggtttgtcatatat

SEQ ID NO: 3861355 - DNA, 14 bp, Homo sapiens
aaatgtatatacac

SEQ ID NO: 3861356 - DNA, 18 bp, Homo sapiens
aaatgtatatacacatat

SEQ ID NO: 3861357 - DNA, 19 bp, Homo sapiens
aaatgtatatacacatata

SEQ ID NO: 3861358 - DNA, 21 bp, Homo sapiens
aaatgtatcctgataaacatt

SEQ ID NO: 3861359 - DNA, 14 bp, Homo sapiens
aaatgtcagagcta

SEQ ID NO: 3861360 - DNA, 12 bp, Homo sapiens
aaatgtcattat

SEQ ID NO: 3861361 - DNA, 21 bp, Homo sapiens
aaatgtctatagagaaaaact

SEQ ID NO: 3861362 - DNA, 16 bp, Homo sapiens
aaatgtcttatatagc

SEQ ID NO: 3861363 - DNA, 15 bp, Homo sapiens
aaatgtgcttttaaa

SEQ ID NO: 3861364 - DNA, 15 bp, Homo sapiens
aaatgttcagaaggt

SEQ ID NO: 3861365 - DNA, 18 bp, Homo sapiens
aaatgttgaaatcttaaa

SEQ ID NO: 3861366 - DNA, 19 bp, Homo sapiens
aaatgttgaaatcttaaaa

SEQ ID NO: 3861367 - DNA, 18 bp, Homo sapiens
aaattaacagtcctaact

SEQ ID NO: 3861368 - DNA, 13 bp, Homo sapiens
aaattaagacttt

SEQ ID NO: 3861369 - DNA, 22 bp, Homo sapiens
aaattaagactttaaaagatga

SEQ ID NO: 3861370 - DNA, 20 bp, Homo sapiens
aaattaagagatacattccc

SEQ ID NO: 3861371 - DNA, 22 bp, Homo sapiens
aaattaggaggctcaacaataa

SEQ ID NO: 3861372 - DNA, 23 bp, Homo sapiens
aaattaggaggctcaacaataaa

SEQ ID NO: 3861373 - DNA, 13 bp, Homo sapiens
aaattagtaattg

SEQ ID NO: 3861374 - DNA, 14 bp, Homo sapiens
aaattagtaattgt

SEQ ID NO: 3861375 - DNA, 16 bp, Homo sapiens
aaattatactgtagct

SEQ ID NO: 3861376 - DNA, 17 bp, Homo sapiens
aaattatgtatgtttac

SEQ ID NO: 3861377 - DNA, 20 bp, Homo sapiens
aaattatgttacatctgttt

SEQ ID NO: 3861378 - DNA, 15 bp, Homo sapiens
aaattatttaataaa

SEQ ID NO: 3861379 - DNA, 22 bp, Homo sapiens
aaattatttgtgtaatagaaaa

SEQ ID NO: 3861380 - DNA, 23 bp, Homo sapiens
aaattatttgtgtaatagaaaac

SEQ ID NO: 3861381 - DNA, 19 bp, Homo sapiens
aaattatttttaagaaatc

SEQ ID NO: 3861382 - DNA, 20 bp, Homo sapiens
aaattcagatatatttttca

SEQ ID NO: 3861383 - DNA, 22 bp, Homo sapiens
aaattcaggtgaaaatgttcat

SEQ ID NO: 3861384 - DNA, 19 bp, Homo sapiens
aaattcatttcacattaat

SEQ ID NO: 3861385 - DNA, 19 bp, Homo sapiens
aaattccatgtccctgtat

SEQ ID NO: 3861386 - DNA, 17 bp, Homo sapiens
aaattcttgaagttcat

SEQ ID NO: 3861387 - DNA, 17 bp, Homo sapiens
aaattctttatttctgt

SEQ ID NO: 3861388 - DNA, 23 bp, Homo sapiens
aaattgaagagatttcaacatat

SEQ ID NO: 3861389 - DNA, 11 bp, Homo sapiens
aaattgcacaa

SEQ ID NO: 3861390 - DNA, 16 bp, Homo sapiens
aaattgcacaatttga

SEQ ID NO: 3861391 - DNA, 22 bp, Homo sapiens
aaattgcacaatttgagcaatt

SEQ ID NO: 3861392 - DNA, 23 bp, Homo sapiens
aaattgcacaatttgagcaattc

SEQ ID NO: 3861393 - DNA, 18 bp, Homo sapiens
aaattgcatttcctgaca

SEQ ID NO: 3861394 - DNA, 13 bp, Homo sapiens
aaattgctccttg

SEQ ID NO: 3861395 - DNA, 19 bp, Homo sapiens
aaattggaaacattttctt

SEQ ID NO: 3861396 - DNA, 18 bp, Homo sapiens
aaattggtgataagtgga

SEQ ID NO: 3861397 - DNA, 17 bp, Homo sapiens
aaattgtaaattttaga

SEQ ID NO: 3861398 - DNA, 22 bp, Homo sapiens
aaattgtttaagtgttgtaaat

SEQ ID NO: 3861399 - DNA, 19 bp, Homo sapiens
aaattgtttggcttcctcc

SEQ ID NO: 3861400 - DNA, 21 bp, Homo sapiens
aaattgtttggcttcctcctg

SEQ ID NO: 3861401 - DNA, 14 bp, Homo sapiens
aaatttatataaaa

SEQ ID NO: 3861402 - DNA, 12 bp, Homo sapiens
aaatttcagatt

SEQ ID NO: 3861403 - DNA, 23 bp, Homo sapiens
aaatttgccaccactagagctga

SEQ ID NO: 3861404 - DNA, 24 bp, Homo sapiens
aaatttgtccaatggctgtaaact

SEQ ID NO: 3861405 - DNA, 14 bp, Homo sapiens
aaattttaacattt

SEQ ID NO: 3861406 - DNA, 12 bp, Homo sapiens
aaattttattcc

SEQ ID NO: 3861407 - DNA, 20 bp, Homo sapiens
aaattttatttagttcttga

SEQ ID NO: 3861408 - DNA, 19 bp, Homo sapiens
aaattttctagactttctg

SEQ ID NO: 3861409 - DNA, 13 bp, Homo sapiens
aaattttgcattt

SEQ ID NO: 3861410 - DNA, 17 bp, Homo sapiens
aaattttgcatttagtt

SEQ ID NO: 3861411 - DNA, 11 bp, Homo sapiens
aaattttgtcc

SEQ ID NO: 3861412 - DNA, 22 bp, Homo sapiens
aaattttgtttcagaattttgt

SEQ ID NO: 3861413 - DNA, 23 bp, Homo sapiens
aaatttttgtcattttaaaatct

SEQ ID NO: 3861414 - DNA, 19 bp, Homo sapiens
aacaaaaacactaaaaata

SEQ ID NO: 3861415 - DNA, 16 bp, Homo sapiens
aacaaaaaccagcagg

SEQ ID NO: 3861416 - DNA, 11 bp, Homo sapiens
aacaaaaataa

SEQ ID NO: 3861417 - DNA, 13 bp, Homo sapiens
aacaaaacaagaa

SEQ ID NO: 3861418 - DNA, 16 bp, Homo sapiens
aacaaaacaagaaaga

SEQ ID NO: 3861419 - DNA, 15 bp, Homo sapiens
aacaaaagcaagact

SEQ ID NO: 3861420 - DNA, 13 bp, Homo sapiens
aacaaaatcacaa

SEQ ID NO: 3861421 - DNA, 15 bp, Homo sapiens
aacaaaatcacaagc

SEQ ID NO: 3861422 - DNA, 21 bp, Homo sapiens
aacaaacactgaatcatgtta

SEQ ID NO: 3861423 - DNA, 20 bp, Homo sapiens
aacaaagaaataaaatcctg

SEQ ID NO: 3861424 - DNA, 22 bp, Homo sapiens
aacaaatcttcaaggtgtaaaa

SEQ ID NO: 3861425 - DNA, 15 bp, Homo sapiens
aacaacaaaccaaaa

SEQ ID NO: 3861426 - DNA, 15 bp, Homo sapiens
aacaacaacaacaat

SEQ ID NO: 3861427 - DNA, 17 bp, Homo sapiens
aacaacaacaatacaac

SEQ ID NO: 3861428 - DNA, 13 bp, Homo sapiens
aacaacctggaga

SEQ ID NO: 3861429 - DNA, 22 bp, Homo sapiens
aacaactccctgaacctcagtt

SEQ ID NO: 3861430 - DNA, 19 bp, Homo sapiens
aacaagaaattgtttcttt

SEQ ID NO: 3861431 - DNA, 18 bp, Homo sapiens
aacaagaatattgtatgt

SEQ ID NO: 3861432 - DNA, 15 bp, Homo sapiens
aacaaggaccctgtt

SEQ ID NO: 3861433 - DNA, 16 bp, Homo sapiens
aacaagtcacagctgc

SEQ ID NO: 3861434 - DNA, 17 bp, Homo sapiens
aacaataaaacattatg

SEQ ID NO: 3861435 - DNA, 15 bp, Homo sapiens
aacaataaagactga

SEQ ID NO: 3861436 - DNA, 15 bp, Homo sapiens
aacaataaagagctc

SEQ ID NO: 3861437 - DNA, 14 bp, Homo sapiens
aacaataacaacaa

SEQ ID NO: 3861438 - DNA, 13 bp, Homo sapiens
aacaatacaacaa

SEQ ID NO: 3861439 - DNA, 19 bp, Homo sapiens
aacaatagctattgcatgt

SEQ ID NO: 3861440 - DNA, 22 bp, Homo sapiens
aacaatagctattgcatgtaaa

SEQ ID NO: 3861441 - DNA, 14 bp, Homo sapiens
aacaattattgtac

SEQ ID NO: 3861442 - DNA, 14 bp, Homo sapiens
aacacaaatgtaaa

SEQ ID NO: 3861443 - DNA, 18 bp, Homo sapiens
aacacaagctggaagcac

SEQ ID NO: 3861444 - DNA, 17 bp, Homo sapiens
aacacacatggatgcac

SEQ ID NO: 3861445 - DNA, 18 bp, Homo sapiens
aacacagcaagggtgatg

SEQ ID NO: 3861446 - DNA, 19 bp, Homo sapiens
aacacagcagttctgcaga

SEQ ID NO: 3861447 - DNA, 19 bp, Homo sapiens
aacacagctgagagacttt

SEQ ID NO: 3861448 - DNA, 15 bp, Homo sapiens
aacacaggcaaaatc

SEQ ID NO: 3861449 - DNA, 15 bp, Homo sapiens
aacacagggttttgt

SEQ ID NO: 3861450 - DNA, 22 bp, Homo sapiens
aacacagtgcctggcaaggcct

SEQ ID NO: 3861451 - DNA, 17 bp, Homo sapiens
aacacataactagaaac

SEQ ID NO: 3861452 - DNA, 12 bp, Homo sapiens
aacacatcagct

SEQ ID NO: 3861453 - DNA, 17 bp, Homo sapiens
aacacatctttcctgtc

SEQ ID NO: 3861454 - DNA, 14 bp, Homo sapiens
aacacccactggcc

SEQ ID NO: 3861455 - DNA, 15 bp, Homo sapiens
aacacccactggcca

SEQ ID NO: 3861456 - DNA, 19 bp, Homo sapiens
aacacccgccccccccatg

SEQ ID NO: 3861457 - DNA, 13 bp, Homo sapiens
aacaccggcagaa

SEQ ID NO: 3861458 - DNA, 14 bp, Homo sapiens
aacacctcctagca

SEQ ID NO: 3861459 - DNA, 13 bp, Homo sapiens
aacacctgacaca

SEQ ID NO: 3861460 - DNA, 14 bp, Homo sapiens
aacacctgacacat

SEQ ID NO: 3861461 - DNA, 24 bp, Homo sapiens
aacaccttcttggcttctgggacc

SEQ ID NO: 3861462 - DNA, 18 bp, Homo sapiens
aacacggcagctgtagct

SEQ ID NO: 3861463 - DNA, 21 bp, Homo sapiens
aacacgtccagaatttttcat

SEQ ID NO: 3861464 - DNA, 16 bp, Homo sapiens
aacacgtgtctataat

SEQ ID NO: 3861465 - DNA, 19 bp, Homo sapiens
aacactaaacagactattt

SEQ ID NO: 3861466 - DNA, 12 bp, Homo sapiens
aacactcaccat

SEQ ID NO: 3861467 - DNA, 13 bp, Homo sapiens
aacactctatatt

SEQ ID NO: 3861468 - DNA, 20 bp, Homo sapiens
aacactcttcttgagcagac

SEQ ID NO: 3861469 - DNA, 11 bp, Homo sapiens
aacacttccat

SEQ ID NO: 3861470 - DNA, 20 bp, Homo sapiens
aacacttctcatcatattgt

SEQ ID NO: 3861471 - DNA, 13 bp, Homo sapiens
aacagaaccagag

SEQ ID NO: 3861472 - DNA, 22 bp, Homo sapiens
aacagaactgctaaatactgta

SEQ ID NO: 3861473 - DNA, 23 bp, Homo sapiens
aacagaactgctaaatactgtac

SEQ ID NO: 3861474 - DNA, 16 bp, Homo sapiens
aacagagaaggcagga

SEQ ID NO: 3861475 - DNA, 19 bp, Homo sapiens
aacagagacaggcccaaga

SEQ ID NO: 3861476 - DNA, 15 bp, Homo sapiens
aacagagcgggcctc

SEQ ID NO: 3861477 - DNA, 20 bp, Homo sapiens
aacagagcgggcctcttccc

SEQ ID NO: 3861478 - DNA, 22 bp, Homo sapiens
aacagaggaatctacctgtggt

SEQ ID NO: 3861479 - DNA, 13 bp, Homo sapiens
aacagcagaaaga

SEQ ID NO: 3861480 - DNA, 15 bp, Homo sapiens
aacagcagaaagact

SEQ ID NO: 3861481 - DNA, 16 bp, Homo sapiens
aacagcagaggttctt

SEQ ID NO: 3861482 - DNA, 17 bp, Homo sapiens
aacagcagaggttcttt

SEQ ID NO: 3861483 - DNA, 11 bp, Homo sapiens
aacagcagtgt

SEQ ID NO: 3861484 - DNA, 13 bp, Homo sapiens
aacagcagtgttc

SEQ ID NO: 3861485 - DNA, 21 bp, Homo sapiens
aacagcccattttatctttga

SEQ ID NO: 3861486 - DNA, 19 bp, Homo sapiens
aacagccccccccttgaat

SEQ ID NO: 3861487 - DNA, 20 bp, Homo sapiens
aacagctcttcactcagcca

SEQ ID NO: 3861488 - DNA, 18 bp, Homo sapiens
aacagcttgaccagacct

SEQ ID NO: 3861489 - DNA, 19 bp, Homo sapiens
aacagcttgaccagaccta

SEQ ID NO: 3861490 - DNA, 22 bp, Homo sapiens
aacaggaaaaaaaataatgtaa

SEQ ID NO: 3861491 - DNA, 20 bp, Homo sapiens
aacaggaccacaaaaatgaa

SEQ ID NO: 3861492 - DNA, 18 bp, Homo sapiens
aacaggctactctcctcg

SEQ ID NO: 3861493 - DNA, 21 bp, Homo sapiens
aacaggctgttctgcactgaa

SEQ ID NO: 3861494 - DNA, 22 bp, Homo sapiens
aacaggctgttctgcactgaaa

SEQ ID NO: 3861495 - DNA, 23 bp, Homo sapiens
aacaggctgttctgcactgaaaa

SEQ ID NO: 3861496 - DNA, 13 bp, Homo sapiens
aacagggaaggca

SEQ ID NO: 3861497 - DNA, 20 bp, Homo sapiens
aacagggaaggcaggcaggg

SEQ ID NO: 3861498 - DNA, 23 bp, Homo sapiens
aacagggaaggcaggcagggctc

SEQ ID NO: 3861499 - DNA, 21 bp, Homo sapiens
aacagggagcccctaggaaag

SEQ ID NO: 3861500 - DNA, 16 bp, Homo sapiens
aacaggggatcaaagt

SEQ ID NO: 3861501 - DNA, 22 bp, Homo sapiens
aacaggtggcaggaccaggact

SEQ ID NO: 3861502 - DNA, 15 bp, Homo sapiens
aacagtcacccttct

SEQ ID NO: 3861503 - DNA, 14 bp, Homo sapiens
aacagtcatttaaa

SEQ ID NO: 3861504 - DNA, 21 bp, Homo sapiens
aacagtgagcctgaattttgt

SEQ ID NO: 3861505 - DNA, 21 bp, Homo sapiens
aacagttaattagttaacagt

SEQ ID NO: 3861506 - DNA, 14 bp, Homo sapiens
aacagttccttcag

SEQ ID NO: 3861507 - DNA, 19 bp, Homo sapiens
aacagttgggctgtcaaca

SEQ ID NO: 3861508 - DNA, 16 bp, Homo sapiens
aacataaggagaatgt

SEQ ID NO: 3861509 - DNA, 18 bp, Homo sapiens
aacataattcttgtatat

SEQ ID NO: 3861510 - DNA, 21 bp, Homo sapiens
aacatacccttctttaaatca

SEQ ID NO: 3861511 - DNA, 13 bp, Homo sapiens
aacatatcaattc

SEQ ID NO: 3861512 - DNA, 16 bp, Homo sapiens
aacatatcaattcaac

SEQ ID NO: 3861513 - DNA, 13 bp, Homo sapiens
aacatatcatttt

SEQ ID NO: 3861514 - DNA, 17 bp, Homo sapiens
aacatccatgtcctatg

SEQ ID NO: 3861515 - DNA, 18 bp, Homo sapiens
aacatcccattgccctgg

SEQ ID NO: 3861516 - DNA, 21 bp, Homo sapiens
aacatctattataaaaccatg

SEQ ID NO: 3861517 - DNA, 16 bp, Homo sapiens
aacatctgaaagccac

SEQ ID NO: 3861518 - DNA, 16 bp, Homo sapiens
aacatctttgaaaaga

SEQ ID NO: 3861519 - DNA, 21 bp, Homo sapiens
aacatgaagtcgttgtgaggg

SEQ ID NO: 3861520 - DNA, 14 bp, Homo sapiens
aacatgacactgac

SEQ ID NO: 3861521 - DNA, 21 bp, Homo sapiens
aacatgagtgaatagctttca

SEQ ID NO: 3861522 - DNA, 22 bp, Homo sapiens
aacatgcaattttgcatttgaa

SEQ ID NO: 3861523 - DNA, 14 bp, Homo sapiens
aacatgcacattta

SEQ ID NO: 3861524 - DNA, 15 bp, Homo sapiens
aacatgggcattggg

SEQ ID NO: 3861525 - DNA, 21 bp, Homo sapiens
aacatgggcattgggttctaa

SEQ ID NO: 3861526 - DNA, 22 bp, Homo sapiens
aacatgggcattgggttctaaa

SEQ ID NO: 3861527 - DNA, 11 bp, Homo sapiens
aacattaaaca

SEQ ID NO: 3861528 - DNA, 23 bp, Homo sapiens
aacattaaatgtcttatatagca

SEQ ID NO: 3861529 - DNA, 20 bp, Homo sapiens
aacattcacacagggctctt

SEQ ID NO: 3861530 - DNA, 18 bp, Homo sapiens
aacattcatcaagctgta

SEQ ID NO: 3861531 - DNA, 11 bp, Homo sapiens
aacattcatcc

SEQ ID NO: 3861532 - DNA, 20 bp, Homo sapiens
aacattcatccagttgcaat

SEQ ID NO: 3861533 - DNA, 19 bp, Homo sapiens
aacatttacaataaatatt

SEQ ID NO: 3861534 - DNA, 21 bp, Homo sapiens
aacatttacaataaatattct

SEQ ID NO: 3861535 - DNA, 18 bp, Homo sapiens
aacatttcttatgatttt

SEQ ID NO: 3861536 - DNA, 21 bp, Homo sapiens
aacatttgctttgttttctaa

SEQ ID NO: 3861537 - DNA, 22 bp, Homo sapiens
aacattttctttctttttctgg

SEQ ID NO: 3861538 - DNA, 16 bp, Homo sapiens
aaccaaagagactgga

SEQ ID NO: 3861539 - DNA, 23 bp, Homo sapiens
aaccaaagagactggagcatctg

SEQ ID NO: 3861540 - DNA, 18 bp, Homo sapiens
aaccaaaggacattatgt

SEQ ID NO: 3861541 - DNA, 16 bp, Homo sapiens
aaccaagccgtggctt

SEQ ID NO: 3861542 - DNA, 15 bp, Homo sapiens
aaccaagcttcagag

SEQ ID NO: 3861543 - DNA, 17 bp, Homo sapiens
aaccaagcttcagagcc

SEQ ID NO: 3861544 - DNA, 22 bp, Homo sapiens
aaccaagcttcagagcctagcc

SEQ ID NO: 3861545 - DNA, 22 bp, Homo sapiens
aaccaaggcagcctccagagcc

SEQ ID NO: 3861546 - DNA, 18 bp, Homo sapiens
aaccaatcattttaagaa

SEQ ID NO: 3861547 - DNA, 20 bp, Homo sapiens
aaccacaactgacacaggaa

SEQ ID NO: 3861548 - DNA, 15 bp, Homo sapiens
aaccacacttcttga

SEQ ID NO: 3861549 - DNA, 18 bp, Homo sapiens
aaccacaggcccttgggg

SEQ ID NO: 3861550 - DNA, 19 bp, Homo sapiens
aaccactcaaattaatctt

SEQ ID NO: 3861551 - DNA, 15 bp, Homo sapiens
aaccactgtacatat

SEQ ID NO: 3861552 - DNA, 18 bp, Homo sapiens
aaccagaataaagttctg

SEQ ID NO: 3861553 - DNA, 10 bp, Homo sapiens
aaccagagcc

SEQ ID NO: 3861554 - DNA, 14 bp, Homo sapiens
aaccagcattttac

SEQ ID NO: 3861555 - DNA, 15 bp, Homo sapiens
aaccagcattttact

SEQ ID NO: 3861556 - DNA, 12 bp, Homo sapiens
aaccagggatag

SEQ ID NO: 3861557 - DNA, 22 bp, Homo sapiens
aaccagtttagatttcaagaaa

SEQ ID NO: 3861558 - DNA, 22 bp, Homo sapiens
aaccatagttatttacttgaaa

SEQ ID NO: 3861559 - DNA, 18 bp, Homo sapiens
aaccatgcagcttcatca

SEQ ID NO: 3861560 - DNA, 16 bp, Homo sapiens
aaccatggtgcttgtt

SEQ ID NO: 3861561 - DNA, 14 bp, Homo sapiens
aaccatttcaaatg

SEQ ID NO: 3861562 - DNA, 21 bp, Homo sapiens
aaccattttagttcctttatt

SEQ ID NO: 3861563 - DNA, 16 bp, Homo sapiens
aacccaaataaatgtg

SEQ ID NO: 3861564 - DNA, 16 bp, Homo sapiens
aacccaagtgggggca

SEQ ID NO: 3861565 - DNA, 13 bp, Homo sapiens
aacccactgtgct

SEQ ID NO: 3861566 - DNA, 21 bp, Homo sapiens
aacccactgtgcttacagtga

SEQ ID NO: 3861567 - DNA, 18 bp, Homo sapiens
aacccagaactggacgcc

SEQ ID NO: 3861568 - DNA, 14 bp, Homo sapiens
aacccagcatgtac

SEQ ID NO: 3861569 - DNA, 15 bp, Homo sapiens
aacccagcatgtaca

SEQ ID NO: 3861570 - DNA, 20 bp, Homo sapiens
aacccagcatgtacaaaagt

SEQ ID NO: 3861571 - DNA, 15 bp, Homo sapiens
aacccatcagaagga

SEQ ID NO: 3861572 - DNA, 15 bp, Homo sapiens
aaccccaacgcacag

SEQ ID NO: 3861573 - DNA, 17 bp, Homo sapiens
aaccccaacgcacagga

SEQ ID NO: 3861574 - DNA, 19 bp, Homo sapiens
aaccccaccttgccaagct

SEQ ID NO: 3861575 - DNA, 13 bp, Homo sapiens
aaccccagactca

SEQ ID NO: 3861576 - DNA, 14 bp, Homo sapiens
aaccccagactcaa

SEQ ID NO: 3861577 - DNA, 11 bp, Homo sapiens
aaccccagctg

SEQ ID NO: 3861578 - DNA, 13 bp, Homo sapiens
aaccccagctggc

SEQ ID NO: 3861579 - DNA, 15 bp, Homo sapiens
aaccccagctggcct

SEQ ID NO: 3861580 - DNA, 16 bp, Homo sapiens
aaccccagctggcctc

SEQ ID NO: 3861581 - DNA, 13 bp, Homo sapiens
aaccccagttctg

SEQ ID NO: 3861582 - DNA, 16 bp, Homo sapiens
aaccccagttctgctc

SEQ ID NO: 3861583 - DNA, 19 bp, Homo sapiens
aaccccagttctgctcctc

SEQ ID NO: 3861584 - DNA, 23 bp, Homo sapiens
aaccccatcatatgacatgccac

SEQ ID NO: 3861585 - DNA, 18 bp, Homo sapiens
aacccccagtgccacaga

SEQ ID NO: 3861586 - DNA, 20 bp, Homo sapiens
aacccccagtgccacagaga

SEQ ID NO: 3861587 - DNA, 15 bp, Homo sapiens
aacccccgctccaga

SEQ ID NO: 3861588 - DNA, 19 bp, Homo sapiens
aaccccgcggtgctctggc

SEQ ID NO: 3861589 - DNA, 20 bp, Homo sapiens
aaccccgcggtgctctggcg

SEQ ID NO: 3861590 - DNA, 21 bp, Homo sapiens
aaccccgcggtgctctggcgg

SEQ ID NO: 3861591 - DNA, 12 bp, Homo sapiens
aacccctgggta

SEQ ID NO: 3861592 - DNA, 13 bp, Homo sapiens
aacccctgtaccc

SEQ ID NO: 3861593 - DNA, 17 bp, Homo sapiens
aacccctgtacccagct

SEQ ID NO: 3861594 - DNA, 11 bp, Homo sapiens
aacccctttcc

SEQ ID NO: 3861595 - DNA, 15 bp, Homo sapiens
aacccgactgtgaaa

SEQ ID NO: 3861596 - DNA, 18 bp, Homo sapiens
aacccgtggaggctgctc

SEQ ID NO: 3861597 - DNA, 20 bp, Homo sapiens
aaccctcacatcagagtgac

SEQ ID NO: 3861598 - DNA, 19 bp, Homo sapiens
aaccctcagagccacccct

SEQ ID NO: 3861599 - DNA, 13 bp, Homo sapiens
aaccctctcttcc

SEQ ID NO: 3861600 - DNA, 23 bp, Homo sapiens
aaccctctcttccctattatttc

SEQ ID NO: 3861601 - DNA, 15 bp, Homo sapiens
aaccctgttttatac

SEQ ID NO: 3861602 - DNA, 16 bp, Homo sapiens
aaccctgttttatact

SEQ ID NO: 3861603 - DNA, 20 bp, Homo sapiens
aacccttctcttctcccccc

SEQ ID NO: 3861604 - DNA, 16 bp, Homo sapiens
aacccttgctgctgcc

SEQ ID NO: 3861605 - DNA, 14 bp, Homo sapiens
aaccgcttgccata

SEQ ID NO: 3861606 - DNA, 21 bp, Homo sapiens
aaccgtggcccttcctggaca

SEQ ID NO: 3861607 - DNA, 15 bp, Homo sapiens
aacctaacccctttc

SEQ ID NO: 3861608 - DNA, 19 bp, Homo sapiens
aacctaccaccccttcctg

SEQ ID NO: 3861609 - DNA, 22 bp, Homo sapiens
aacctactagacaatgatgtga

SEQ ID NO: 3861610 - DNA, 14 bp, Homo sapiens
aacctagaagggct

SEQ ID NO: 3861611 - DNA, 11 bp, Homo sapiens
aacctagagat

SEQ ID NO: 3861612 - DNA, 20 bp, Homo sapiens
aacctagcatcttacaaaaa

SEQ ID NO: 3861613 - DNA, 15 bp, Homo sapiens
aacctatcaatcctg

SEQ ID NO: 3861614 - DNA, 14 bp, Homo sapiens
aacctatccttcca

SEQ ID NO: 3861615 - DNA, 16 bp, Homo sapiens
aacctcaatgccctgc

SEQ ID NO: 3861616 - DNA, 23 bp, Homo sapiens
aacctcactatggtatgctggcc

SEQ ID NO: 3861617 - DNA, 14 bp, Homo sapiens
aacctcagtttcct

SEQ ID NO: 3861618 - DNA, 18 bp, Homo sapiens
aacctccgtgctgggctt

SEQ ID NO: 3861619 - DNA, 16 bp, Homo sapiens
aacctcttcctcctgg

SEQ ID NO: 3861620 - DNA, 11 bp, Homo sapiens
aacctgaaaaa

SEQ ID NO: 3861621 - DNA, 14 bp, Homo sapiens
aacctgaattattc

SEQ ID NO: 3861622 - DNA, 23 bp, Homo sapiens
aacctgacagatgtcagccgagc

SEQ ID NO: 3861623 - DNA, 22 bp, Homo sapiens
aacctgaggatgcaacaaatat

SEQ ID NO: 3861624 - DNA, 18 bp, Homo sapiens
aacctgatgccccttccc

SEQ ID NO: 3861625 - DNA, 10 bp, Homo sapiens
aacctggaga

SEQ ID NO: 3861626 - DNA, 14 bp, Homo sapiens
aacctggagatgat

SEQ ID NO: 3861627 - DNA, 19 bp, Homo sapiens
aacctggagggctagaacc

SEQ ID NO: 3861628 - DNA, 22 bp, Homo sapiens
aacctggagggctggaatctgg

SEQ ID NO: 3861629 - DNA, 22 bp, Homo sapiens
aacctgggaggcggagagtaca

SEQ ID NO: 3861630 - DNA, 23 bp, Homo sapiens
aacctggtcacaggactctgcct

SEQ ID NO: 3861631 - DNA, 14 bp, Homo sapiens
aacctgtactgggt

SEQ ID NO: 3861632 - DNA, 17 bp, Homo sapiens
aacctgtactgggttat

SEQ ID NO: 3861633 - DNA, 12 bp, Homo sapiens
aaccttgcagca

SEQ ID NO: 3861634 - DNA, 15 bp, Homo sapiens
aacctttccccagac

SEQ ID NO: 3861635 - DNA, 19 bp, Homo sapiens
aacctttccccagacacat

SEQ ID NO: 3861636 - DNA, 20 bp, Homo sapiens
aacctttccccagacacatt

SEQ ID NO: 3861637 - DNA, 18 bp, Homo sapiens
aacctttccgctgtcgcc

SEQ ID NO: 3861638 - DNA, 22 bp, Homo sapiens
aacctttccgctgtcgccccag

SEQ ID NO: 3861639 - DNA, 23 bp, Homo sapiens
aacgaaggggccccggggctggc

SEQ ID NO: 3861640 - DNA, 17 bp, Homo sapiens
aacgaatgtttcaaatc

SEQ ID NO: 3861641 - DNA, 19 bp, Homo sapiens
aacgactccgagaacaaca

SEQ ID NO: 3861642 - DNA, 15 bp, Homo sapiens
aacgagcactggcca

SEQ ID NO: 3861643 - DNA, 11 bp, Homo sapiens
aacgcagccct

SEQ ID NO: 3861644 - DNA, 12 bp, Homo sapiens
aacgcctgagcc

SEQ ID NO: 3861645 - DNA, 20 bp, Homo sapiens
aacgctcttagctttctcag

SEQ ID NO: 3861646 - DNA, 21 bp, Homo sapiens
aacgggaccccctggccctgc

SEQ ID NO: 3861647 - DNA, 13 bp, Homo sapiens
aacgtattttaaa

SEQ ID NO: 3861648 - DNA, 15 bp, Homo sapiens
aacgttaaaagacag

SEQ ID NO: 3861649 - DNA, 14 bp, Homo sapiens
aacgttgctcccca

SEQ ID NO: 3861650 - DNA, 15 bp, Homo sapiens
aacgttttgaactaa

SEQ ID NO: 3861651 - DNA, 13 bp, Homo sapiens
aactaaatatatg

SEQ ID NO: 3861652 - DNA, 16 bp, Homo sapiens
aactaatttaaaccag

SEQ ID NO: 3861653 - DNA, 22 bp, Homo sapiens
aactactcagctctcctgctgc

SEQ ID NO: 3861654 - DNA, 22 bp, Homo sapiens
aactagtaatgggccaattaaa

SEQ ID NO: 3861655 - DNA, 13 bp, Homo sapiens
aactagtttaatt

SEQ ID NO: 3861656 - DNA, 14 bp, Homo sapiens
aactagtttccagt

SEQ ID NO: 3861657 - DNA, 18 bp, Homo sapiens
aactagtttccagtggat

SEQ ID NO: 3861658 - DNA, 18 bp, Homo sapiens
aactatcaatatttaagt

SEQ ID NO: 3861659 - DNA, 19 bp, Homo sapiens
aactatcaatatttaagtt

SEQ ID NO: 3861660 - DNA, 15 bp, Homo sapiens
aactatccaattaaa

SEQ ID NO: 3861661 - DNA, 11 bp, Homo sapiens
aactatcttgg

SEQ ID NO: 3861662 - DNA, 17 bp, Homo sapiens
aactatgaactacaaag

SEQ ID NO: 3861663 - DNA, 18 bp, Homo sapiens
aactatgatcacagtgac

SEQ ID NO: 3861664 - DNA, 16 bp, Homo sapiens
aactatggttcccaat

SEQ ID NO: 3861665 - DNA, 17 bp, Homo sapiens
aactatggttcccaata

SEQ ID NO: 3861666 - DNA, 13 bp, Homo sapiens
aactattgaattg

SEQ ID NO: 3861667 - DNA, 16 bp, Homo sapiens
aactatttctacacag

SEQ ID NO: 3861668 - DNA, 16 bp, Homo sapiens
aactatttttgaggaa

SEQ ID NO: 3861669 - DNA, 19 bp, Homo sapiens
aactcaaaacttaacatat

SEQ ID NO: 3861670 - DNA, 17 bp, Homo sapiens
aactcactcttatgaaa

SEQ ID NO: 3861671 - DNA, 22 bp, Homo sapiens
aactcatcctgtgtggggaggc

SEQ ID NO: 3861672 - DNA, 23 bp, Homo sapiens
aactcatcctgtgtggggaggca

SEQ ID NO: 3861673 - DNA, 17 bp, Homo sapiens
aactcatctgttatcct

SEQ ID NO: 3861674 - DNA, 23 bp, Homo sapiens
aactccaccaacccatcagaagg

SEQ ID NO: 3861675 - DNA, 19 bp, Homo sapiens
aactccttttgctgtcttt

SEQ ID NO: 3861676 - DNA, 22 bp, Homo sapiens
aactctatagttattgttttat

SEQ ID NO: 3861677 - DNA, 15 bp, Homo sapiens
aactctccactccat

SEQ ID NO: 3861678 - DNA, 22 bp, Homo sapiens
aactctcgggacctcgtttggg

SEQ ID NO: 3861679 - DNA, 17 bp, Homo sapiens
aactctgacaagggctg

SEQ ID NO: 3861680 - DNA, 19 bp, Homo sapiens
aactctgacaagggctgac

SEQ ID NO: 3861681 - DNA, 20 bp, Homo sapiens
aactctgcactccatggcca

SEQ ID NO: 3861682 - DNA, 23 bp, Homo sapiens
aactctgcactccatggccaccc

SEQ ID NO: 3861683 - DNA, 17 bp, Homo sapiens
aactctggcttccaggt

SEQ ID NO: 3861684 - DNA, 14 bp, Homo sapiens
aactcttcattttg

SEQ ID NO: 3861685 - DNA, 16 bp, Homo sapiens
aactgaaaactgtaaa

SEQ ID NO: 3861686 - DNA, 17 bp, Homo sapiens
aactgaaaactgtaaat

SEQ ID NO: 3861687 - DNA, 19 bp, Homo sapiens
aactgaaaatctaatatta

SEQ ID NO: 3861688 - DNA, 20 bp, Homo sapiens
aactgaagacctccacatta

SEQ ID NO: 3861689 - DNA, 14 bp, Homo sapiens
aactgacacaggaa

SEQ ID NO: 3861690 - DNA, 23 bp, Homo sapiens
aactgagagcagatggtcctcca

SEQ ID NO: 3861691 - DNA, 24 bp, Homo sapiens
aactgagccaaacacactgtaaat

SEQ ID NO: 3861692 - DNA, 12 bp, Homo sapiens
aactgaggaatt

SEQ ID NO: 3861693 - DNA, 18 bp, Homo sapiens
aactgaggaattttcttt

SEQ ID NO: 3861694 - DNA, 20 bp, Homo sapiens
aactgaggaattttctttgt

SEQ ID NO: 3861695 - DNA, 19 bp, Homo sapiens
aactgaggagtagctgaga

SEQ ID NO: 3861696 - DNA, 22 bp, Homo sapiens
aactgaggagtagctgagagga

SEQ ID NO: 3861697 - DNA, 20 bp, Homo sapiens
aactgaggtcactgggttct

SEQ ID NO: 3861698 - DNA, 22 bp, Homo sapiens
aactgagtaaattggaaacatt

SEQ ID NO: 3861699 - DNA, 15 bp, Homo sapiens
aactgatcaaaaata

SEQ ID NO: 3861700 - DNA, 19 bp, Homo sapiens
aactgatcaaaaataaact

SEQ ID NO: 3861701 - DNA, 18 bp, Homo sapiens
aactgcaaagtgaagttg

SEQ ID NO: 3861702 - DNA, 14 bp, Homo sapiens
aactgcattagaaa

SEQ ID NO: 3861703 - DNA, 14 bp, Homo sapiens
aactgccccgggtg

SEQ ID NO: 3861704 - DNA, 14 bp, Homo sapiens
aactgctctgccca

SEQ ID NO: 3861705 - DNA, 15 bp, Homo sapiens
aactgctgagccact

SEQ ID NO: 3861706 - DNA, 20 bp, Homo sapiens
aactggaagcatgtaggaga

SEQ ID NO: 3861707 - DNA, 19 bp, Homo sapiens
aactggccaagctgaggtg

SEQ ID NO: 3861708 - DNA, 22 bp, Homo sapiens
aactggctgtttgatagcagaa

SEQ ID NO: 3861709 - DNA, 22 bp, Homo sapiens
aactggtccactcagggctgcc

SEQ ID NO: 3861710 - DNA, 12 bp, Homo sapiens
aactgtaaatca

SEQ ID NO: 3861711 - DNA, 13 bp, Homo sapiens
aactgtaaatcac

SEQ ID NO: 3861712 - DNA, 16 bp, Homo sapiens
aactgtaaatcacttg

SEQ ID NO: 3861713 - DNA, 19 bp, Homo sapiens
aactgtaaatcacttgtaa

SEQ ID NO: 3861714 - DNA, 20 bp, Homo sapiens
aactgtaaatcacttgtaaa

SEQ ID NO: 3861715 - DNA, 17 bp, Homo sapiens
aactgtatcaaatctgt

SEQ ID NO: 3861716 - DNA, 18 bp, Homo sapiens
aactgtcatctagcccct

SEQ ID NO: 3861717 - DNA, 22 bp, Homo sapiens
accccacccccttcagtgccca

SEQ ID NO: 3861718 - DNA, 22 bp, Homo sapiens
accccaccttgccaagctttct

SEQ ID NO: 3861719 - DNA, 19 bp, Homo sapiens
accccactccagccctgtc

SEQ ID NO: 3861720 - DNA, 20 bp, Homo sapiens
accccactccagccctgtcc

SEQ ID NO: 3861721 - DNA, 21 bp, Homo sapiens
accccagactcaaactcaagg

SEQ ID NO: 3861722 - DNA, 15 bp, Homo sapiens
accccagctagggct

SEQ ID NO: 3861723 - DNA, 16 bp, Homo sapiens
accccaggatcccaga

SEQ ID NO: 3861724 - DNA, 19 bp, Homo sapiens
accccagttctgctcctct

SEQ ID NO: 3861725 - DNA, 21 bp, Homo sapiens
acccccaagacagcagtcttc

SEQ ID NO: 3861726 - DNA, 17 bp, Homo sapiens
acccccactctcattcc

SEQ ID NO: 3861727 - DNA, 12 bp, Homo sapiens
acccccagagac

SEQ ID NO: 3861728 - DNA, 14 bp, Homo sapiens
acccccagagacct

SEQ ID NO: 3861729 - DNA, 19 bp, Homo sapiens
acccccagtgccacagaga

SEQ ID NO: 3861730 - DNA, 20 bp, Homo sapiens
acccccagtgtggctgtctg

SEQ ID NO: 3861731 - DNA, 21 bp, Homo sapiens
acccccgccacggccaccctc

SEQ ID NO: 3861732 - DNA, 22 bp, Homo sapiens
acccccgctccagatctgcact

SEQ ID NO: 3861733 - DNA, 15 bp, Homo sapiens
accccctcattcccc

SEQ ID NO: 3861734 - DNA, 16 bp, Homo sapiens
accccctcattcccct

SEQ ID NO: 3861735 - DNA, 16 bp, Homo sapiens
accccctcattgttta

SEQ ID NO: 3861736 - DNA, 12 bp, Homo sapiens
accccctgcagc

SEQ ID NO: 3861737 - DNA, 16 bp, Homo sapiens
accccctggccctgcc

SEQ ID NO: 3861738 - DNA, 16 bp, Homo sapiens
acccccttcagtgccc

SEQ ID NO: 3861739 - DNA, 20 bp, Homo sapiens
acccccttcagtgcccacca

SEQ ID NO: 3861740 - DNA, 12 bp, Homo sapiens
accccgcagccc

SEQ ID NO: 3861741 - DNA, 13 bp, Homo sapiens
accccgcagcccg

SEQ ID NO: 3861742 - DNA, 14 bp, Homo sapiens
accccgcagcccgt

SEQ ID NO: 3861743 - DNA, 15 bp, Homo sapiens
accccgcagcccgtg

SEQ ID NO: 3861744 - DNA, 15 bp, Homo sapiens
accccgcggtgctct

SEQ ID NO: 3861745 - DNA, 14 bp, Homo sapiens
accccggatcgagg

SEQ ID NO: 3861746 - DNA, 19 bp, Homo sapiens
accccggatcgaggacaag

SEQ ID NO: 3861747 - DNA, 15 bp, Homo sapiens
accccggcctccact

SEQ ID NO: 3861748 - DNA, 21 bp, Homo sapiens
accccggcctccactccccca

SEQ ID NO: 3861749 - DNA, 22 bp, Homo sapiens
accccgtctggggttcagcccc

SEQ ID NO: 3861750 - DNA, 23 bp, Homo sapiens
accccgtctggggttcagcccct

SEQ ID NO: 3861751 - DNA, 17 bp, Homo sapiens
acccctaacctggctta

SEQ ID NO: 3861752 - DNA, 15 bp, Homo sapiens
acccctcactctggc

SEQ ID NO: 3861753 - DNA, 18 bp, Homo sapiens
acccctcactctggcctc

SEQ ID NO: 3861754 - DNA, 18 bp, Homo sapiens
acccctccaaagccccac

SEQ ID NO: 3861755 - DNA, 21 bp, Homo sapiens
acccctcccttgctcagtgcc

SEQ ID NO: 3861756 - DNA, 15 bp, Homo sapiens
acccctctcagcccc

SEQ ID NO: 3861757 - DNA, 19 bp, Homo sapiens
acccctgcctgggttttct

SEQ ID NO: 3861758 - DNA, 19 bp, Homo sapiens
acccctgtacccagctcct

SEQ ID NO: 3861759 - DNA, 14 bp, Homo sapiens
acccctgtggcaga

SEQ ID NO: 3861760 - DNA, 18 bp, Homo sapiens
acccctgtggcagaccgg

SEQ ID NO: 3861761 - DNA, 15 bp, Homo sapiens
accccttatccagga

SEQ ID NO: 3861762 - DNA, 14 bp, Homo sapiens
accccttcctgtcc

SEQ ID NO: 3861763 - DNA, 12 bp, Homo sapiens
accccttccttt

SEQ ID NO: 3861764 - DNA, 16 bp, Homo sapiens
accccttcctttcctc

SEQ ID NO: 3861765 - DNA, 17 bp, Homo sapiens
accccttcctttcctct

SEQ ID NO: 3861766 - DNA, 19 bp, Homo sapiens
acccgagcccagctacatt

SEQ ID NO: 3861767 - DNA, 22 bp, Homo sapiens
acccgagcccagctacattcct

SEQ ID NO: 3861768 - DNA, 12 bp, Homo sapiens
acccgctctgga

SEQ ID NO: 3861769 - DNA, 15 bp, Homo sapiens
acccgctctggacca

SEQ ID NO: 3861770 - DNA, 15 bp, Homo sapiens
acccggaggggcctg

SEQ ID NO: 3861771 - DNA, 22 bp, Homo sapiens
acccggcaggctagaacctggc

SEQ ID NO: 3861772 - DNA, 16 bp, Homo sapiens
acccggccggagccgc

SEQ ID NO: 3861773 - DNA, 21 bp, Homo sapiens
acccgtaggcagcctctctgc

SEQ ID NO: 3861774 - DNA, 18 bp, Homo sapiens
acccgtgccaagtccagg

SEQ ID NO: 3861775 - DNA, 22 bp, Homo sapiens
acccgtgccaagtccaggtcct

SEQ ID NO: 3861776 - DNA, 23 bp, Homo sapiens
acccgtgccaagtccaggtcctg

SEQ ID NO: 3861777 - DNA, 15 bp, Homo sapiens
acccgtggaggctgc

SEQ ID NO: 3861778 - DNA, 18 bp, Homo sapiens
acccgttctgctggcctg

SEQ ID NO: 3861779 - DNA, 20 bp, Homo sapiens
acccgttctgctggcctgga

SEQ ID NO: 3861780 - DNA, 22 bp, Homo sapiens
acccgttctgctggcctggatc

SEQ ID NO: 3861781 - DNA, 23 bp, Homo sapiens
acccgttctgctggcctggatct

SEQ ID NO: 3861782 - DNA, 14 bp, Homo sapiens
accctacttctttt

SEQ ID NO: 3861783 - DNA, 13 bp, Homo sapiens
accctatccctgt

SEQ ID NO: 3861784 - DNA, 13 bp, Homo sapiens
accctattcccta

SEQ ID NO: 3861785 - DNA, 16 bp, Homo sapiens
accctcaaatgtcaga

SEQ ID NO: 3861786 - DNA, 11 bp, Homo sapiens
accctcagagc

SEQ ID NO: 3861787 - DNA, 20 bp, Homo sapiens
accctccaccgcagaaggaa

SEQ ID NO: 3861788 - DNA, 10 bp, Homo sapiens
accctccccc

SEQ ID NO: 3861789 - DNA, 13 bp, Homo sapiens
accctcccccgca

SEQ ID NO: 3861790 - DNA, 14 bp, Homo sapiens
accctcccccgcag

SEQ ID NO: 3861791 - DNA, 15 bp, Homo sapiens
accctcccccgcagc

SEQ ID NO: 3861792 - DNA, 17 bp, Homo sapiens
accctcgtggacacctg

SEQ ID NO: 3861793 - DNA, 18 bp, Homo sapiens
accctcgtggacacctgc

SEQ ID NO: 3861794 - DNA, 19 bp, Homo sapiens
accctcgtggacacctgcc

SEQ ID NO: 3861795 - DNA, 20 bp, Homo sapiens
accctcgtggacacctgccc

SEQ ID NO: 3861796 - DNA, 22 bp, Homo sapiens
accctcgtggacacctgccctg

SEQ ID NO: 3861797 - DNA, 23 bp, Homo sapiens
accctctccggtttgggttggga

SEQ ID NO: 3861798 - DNA, 15 bp, Homo sapiens
accctgagactccag

SEQ ID NO: 3861799 - DNA, 22 bp, Homo sapiens
accctgaggagtctgaggtcct

SEQ ID NO: 3861800 - DNA, 23 bp, Homo sapiens
accctgaggagtctgaggtcctg

SEQ ID NO: 3861801 - DNA, 13 bp, Homo sapiens
accctgcagagct

SEQ ID NO: 3861802 - DNA, 19 bp, Homo sapiens
accctgcccatacccctgc

SEQ ID NO: 3861803 - DNA, 19 bp, Homo sapiens
accatgtctctaagccaac

SEQ ID NO: 3861804 - DNA, 19 bp, Homo sapiens
accatgtttgagctcagac

SEQ ID NO: 3861805 - DNA, 13 bp, Homo sapiens
accattacatgtt

SEQ ID NO: 3861806 - DNA, 15 bp, Homo sapiens
accattccccatggg

SEQ ID NO: 3861807 - DNA, 20 bp, Homo sapiens
accattgacctcagctgcac

SEQ ID NO: 3861808 - DNA, 12 bp, Homo sapiens
accattgtcttc

SEQ ID NO: 3861809 - DNA, 21 bp, Homo sapiens
accattgtcttccaaccccag

SEQ ID NO: 3861810 - DNA, 22 bp, Homo sapiens
accattgtcttccaaccccagc

SEQ ID NO: 3861811 - DNA, 17 bp, Homo sapiens
accattgttccttacct

SEQ ID NO: 3861812 - DNA, 14 bp, Homo sapiens
accatttaattcat

SEQ ID NO: 3861813 - DNA, 16 bp, Homo sapiens
accatttaattcataa

SEQ ID NO: 3861814 - DNA, 22 bp, Homo sapiens
accattttagttcctttattta

SEQ ID NO: 3861815 - DNA, 15 bp, Homo sapiens
acccaaaagagaaaa

SEQ ID NO: 3861816 - DNA, 16 bp, Homo sapiens
acccaaaagagaaaaa

SEQ ID NO: 3861817 - DNA, 18 bp, Homo sapiens
acccaaagaggtatttat

SEQ ID NO: 3861818 - DNA, 14 bp, Homo sapiens
acccaagaggtggg

SEQ ID NO: 3861819 - DNA, 16 bp, Homo sapiens
acccaagtccaagcat

SEQ ID NO: 3861820 - DNA, 16 bp, Homo sapiens
acccaagtgggggcag

SEQ ID NO: 3861821 - DNA, 21 bp, Homo sapiens
acccaattcaggactggctca

SEQ ID NO: 3861822 - DNA, 14 bp, Homo sapiens
acccaatttaattc

SEQ ID NO: 3861823 - DNA, 13 bp, Homo sapiens
acccacacatgtt

SEQ ID NO: 3861824 - DNA, 23 bp, Homo sapiens
acccacatgccatttgtactgac

SEQ ID NO: 3861825 - DNA, 20 bp, Homo sapiens
acccacccatcttcctgctg

SEQ ID NO: 3861826 - DNA, 14 bp, Homo sapiens
acccaccgggccac

SEQ ID NO: 3861827 - DNA, 22 bp, Homo sapiens
acccaccgggccactccttcct

SEQ ID NO: 3861828 - DNA, 12 bp, Homo sapiens
acccacctccac

SEQ ID NO: 3861829 - DNA, 14 bp, Homo sapiens
acccacctccaccc

SEQ ID NO: 3861830 - DNA, 13 bp, Homo sapiens
acccactcacact

SEQ ID NO: 3861831 - DNA, 20 bp, Homo sapiens
acccactctcctctgcctca

SEQ ID NO: 3861832 - DNA, 17 bp, Homo sapiens
acccactctttgctaca

SEQ ID NO: 3861833 - DNA, 23 bp, Homo sapiens
acccactctttgctacaataaat

SEQ ID NO: 3861834 - DNA, 13 bp, Homo sapiens
acccactggccag

SEQ ID NO: 3861835 - DNA, 23 bp, Homo sapiens
acccactggccagtcctagagct

SEQ ID NO: 3861836 - DNA, 17 bp, Homo sapiens
acccactgtccgcctct

SEQ ID NO: 3861837 - DNA, 18 bp, Homo sapiens
acccactgtgcttacagt

SEQ ID NO: 3861838 - DNA, 19 bp, Homo sapiens
acccagaactggacgccca

SEQ ID NO: 3861839 - DNA, 14 bp, Homo sapiens
acccagagaatata

SEQ ID NO: 3861840 - DNA, 18 bp, Homo sapiens
acccagagaatatataca

SEQ ID NO: 3861841 - DNA, 17 bp, Homo sapiens
acccagagaggaatcag

SEQ ID NO: 3861842 - DNA, 24 bp, Homo sapiens
acccagagcattacgtgagccagg

SEQ ID NO: 3861843 - DNA, 22 bp, Homo sapiens
acccagagggtagggcagcaga

SEQ ID NO: 3861844 - DNA, 14 bp, Homo sapiens
acccagatcctcac

SEQ ID NO: 3861845 - DNA, 17 bp, Homo sapiens
acccagcaacagaaaaa

SEQ ID NO: 3861846 - DNA, 13 bp, Homo sapiens
acccagcatgtac

SEQ ID NO: 3861847 - DNA, 23 bp, Homo sapiens
acccagcccattctctctcctgt

SEQ ID NO: 3861848 - DNA, 21 bp, Homo sapiens
acccagccgccatcagcccaa

SEQ ID NO: 3861849 - DNA, 17 bp, Homo sapiens
acccagctactctgtcc

SEQ ID NO: 3861850 - DNA, 22 bp, Homo sapiens
acccagctactctgtccaggcc

SEQ ID NO: 3861851 - DNA, 11 bp, Homo sapiens
acccagctcct

SEQ ID NO: 3861852 - DNA, 21 bp, Homo sapiens
acccagctccttttgtcccca

SEQ ID NO: 3861853 - DNA, 22 bp, Homo sapiens
acccagctccttttgtccccag

SEQ ID NO: 3861854 - DNA, 14 bp, Homo sapiens
acccaggacaagca

SEQ ID NO: 3861855 - DNA, 16 bp, Homo sapiens
acccaggacaagcatg

SEQ ID NO: 3861856 - DNA, 17 bp, Homo sapiens
acccaggacaagcatgg

SEQ ID NO: 3861857 - DNA, 23 bp, Homo sapiens
acccaggaggcggaggttgcagt

SEQ ID NO: 3861858 - DNA, 14 bp, Homo sapiens
acccaggaggtgga

SEQ ID NO: 3861859 - DNA, 21 bp, Homo sapiens
acccaggaggtggaggttgca

SEQ ID NO: 3861860 - DNA, 19 bp, Homo sapiens
acccaggcaggccctgcct

SEQ ID NO: 3861861 - DNA, 16 bp, Homo sapiens
acccaggccctccatg

SEQ ID NO: 3861862 - DNA, 22 bp, Homo sapiens
acccaggccctccatgggctag

SEQ ID NO: 3861863 - DNA, 17 bp, Homo sapiens
acccaggccgcctgcca

SEQ ID NO: 3861864 - DNA, 15 bp, Homo sapiens
acccaggctccatgg

SEQ ID NO: 3861865 - DNA, 18 bp, Homo sapiens
acccaggctccatgggga

SEQ ID NO: 3861866 - DNA, 19 bp, Homo sapiens
acccaggctccatggggaa

SEQ ID NO: 3861867 - DNA, 19 bp, Homo sapiens
acccaggctctggagccag

SEQ ID NO: 3861868 - DNA, 11 bp, Homo sapiens
acccaggctgc

SEQ ID NO: 3861869 - DNA, 15 bp, Homo sapiens
acccaggctgcactg

SEQ ID NO: 3861870 - DNA, 16 bp, Homo sapiens
acccaggctgcactgc

SEQ ID NO: 3861871 - DNA, 18 bp, Homo sapiens
acccaggctgcactgcag

SEQ ID NO: 3861872 - DNA, 20 bp, Homo sapiens
acccaggctgcactgcagtg

SEQ ID NO: 3861873 - DNA, 15 bp, Homo sapiens
acccagtccctgggg

SEQ ID NO: 3861874 - DNA, 14 bp, Homo sapiens
acccagtcctggcc

SEQ ID NO: 3861875 - DNA, 14 bp, Homo sapiens
acccagtgctgcca

SEQ ID NO: 3861876 - DNA, 18 bp, Homo sapiens
acccagtgctgccatgcc

SEQ ID NO: 3861877 - DNA, 23 bp, Homo sapiens
acccagtgctgccatgccactgc

SEQ ID NO: 3861878 - DNA, 22 bp, Homo sapiens
acccagtgtaaagaataaatga

SEQ ID NO: 3861879 - DNA, 20 bp, Homo sapiens
acccatcttcctgctgctgt

SEQ ID NO: 3861880 - DNA, 17 bp, Homo sapiens
acccatgaatcaaagac

SEQ ID NO: 3861881 - DNA, 16 bp, Homo sapiens
acccattaggcatgcc

SEQ ID NO: 3861882 - DNA, 22 bp, Homo sapiens
acccattcccccatgtggctga

SEQ ID NO: 3861883 - DNA, 20 bp, Homo sapiens
acccattcttcagtgcctag

SEQ ID NO: 3861884 - DNA, 14 bp, Homo sapiens
acccattttcacat

SEQ ID NO: 3861885 - DNA, 21 bp, Homo sapiens
accccaaagagcctggagaag

SEQ ID NO: 3861886 - DNA, 12 bp, Homo sapiens
accccaagcagc

SEQ ID NO: 3861887 - DNA, 15 bp, Homo sapiens
accccaagtccacct

SEQ ID NO: 3861888 - DNA, 22 bp, Homo sapiens
accccaagtccacctgcctatc

SEQ ID NO: 3861889 - DNA, 20 bp, Homo sapiens
acattaaacactgtaatctt

SEQ ID NO: 3861890 - DNA, 21 bp, Homo sapiens
acattaaacactgtaatctta

SEQ ID NO: 3861891 - DNA, 14 bp, Homo sapiens
acattaaatgtctt

SEQ ID NO: 3861892 - DNA, 20 bp, Homo sapiens
acattaagattgaggcctgc

SEQ ID NO: 3861893 - DNA, 21 bp, Homo sapiens
acattaatcaatcatctgtgt

SEQ ID NO: 3861894 - DNA, 15 bp, Homo sapiens
acattaatgttaatt

SEQ ID NO: 3861895 - DNA, 20 bp, Homo sapiens
acattacatcatcctcctta

SEQ ID NO: 3861896 - DNA, 18 bp, Homo sapiens
acattagcagtttgcttt

SEQ ID NO: 3861897 - DNA, 13 bp, Homo sapiens
acattatcattca

SEQ ID NO: 3861898 - DNA, 23 bp, Homo sapiens
acattatcattcaaaacaaccat

SEQ ID NO: 3861899 - DNA, 13 bp, Homo sapiens
acattatcttagt

SEQ ID NO: 3861900 - DNA, 17 bp, Homo sapiens
acattatgtgtgcatgt

SEQ ID NO: 3861901 - DNA, 19 bp, Homo sapiens
acattatgtgtgcatgtgt

SEQ ID NO: 3861902 - DNA, 23 bp, Homo sapiens
acattatgtgtgcatgtgtgtat

SEQ ID NO: 3861903 - DNA, 21 bp, Homo sapiens
acattcatccagttgcaataa

SEQ ID NO: 3861904 - DNA, 15 bp, Homo sapiens
acattccctatcaaa

SEQ ID NO: 3861905 - DNA, 19 bp, Homo sapiens
acattccctatcaaaacat

SEQ ID NO: 3861906 - DNA, 20 bp, Homo sapiens
acattccctatcaaaacata

SEQ ID NO: 3861907 - DNA, 22 bp, Homo sapiens
acattccctatcaaaacatatc

SEQ ID NO: 3861908 - DNA, 22 bp, Homo sapiens
acattcctagagagcagaaata

SEQ ID NO: 3861909 - DNA, 23 bp, Homo sapiens
acattcctagagagcagaaataa

SEQ ID NO: 3861910 - DNA, 15 bp, Homo sapiens
acattcctcagctgc

SEQ ID NO: 3861911 - DNA, 13 bp, Homo sapiens
acattcctggccc

SEQ ID NO: 3861912 - DNA, 16 bp, Homo sapiens
acattcttaaaggaaa

SEQ ID NO: 3861913 - DNA, 15 bp, Homo sapiens
acattggacttcctt

SEQ ID NO: 3861914 - DNA, 16 bp, Homo sapiens
acatttaatacagcag

SEQ ID NO: 3861915 - DNA, 16 bp, Homo sapiens
acatttacaataaata

SEQ ID NO: 3861916 - DNA, 14 bp, Homo sapiens
acatttatacatca

SEQ ID NO: 3861917 - DNA, 16 bp, Homo sapiens
acatttatatatatat

SEQ ID NO: 3861918 - DNA, 16 bp, Homo sapiens
acatttcaaagctgag

SEQ ID NO: 3861919 - DNA, 20 bp, Homo sapiens
acatttcataaggcctgccc

SEQ ID NO: 3861920 - DNA, 21 bp, Homo sapiens
acatttcataaggcctgccct

SEQ ID NO: 3861921 - DNA, 13 bp, Homo sapiens
acatttgatgtac

SEQ ID NO: 3861922 - DNA, 14 bp, Homo sapiens
acatttgccttgct

SEQ ID NO: 3861923 - DNA, 16 bp, Homo sapiens
acattttatttattag

SEQ ID NO: 3861924 - DNA, 13 bp, Homo sapiens
acattttgccttt

SEQ ID NO: 3861925 - DNA, 17 bp, Homo sapiens
accaaaggacattatgt

SEQ ID NO: 3861926 - DNA, 19 bp, Homo sapiens
accaaaggacattatgtgt

SEQ ID NO: 3861927 - DNA, 20 bp, Homo sapiens
accaaaggacattatgtgtg

SEQ ID NO: 3861928 - DNA, 12 bp, Homo sapiens
accaaatataaa

SEQ ID NO: 3861929 - DNA, 21 bp, Homo sapiens
accaaatataaacttgtgtat

SEQ ID NO: 3861930 - DNA, 22 bp, Homo sapiens
accaacaggctgttctgcactg

SEQ ID NO: 3861931 - DNA, 16 bp, Homo sapiens
accaacagttccttca

SEQ ID NO: 3861932 - DNA, 15 bp, Homo sapiens
accaaccctcagagc

SEQ ID NO: 3861933 - DNA, 19 bp, Homo sapiens
accaaccctgtttcctgag

SEQ ID NO: 3861934 - DNA, 13 bp, Homo sapiens
accaacctgacca

SEQ ID NO: 3861935 - DNA, 19 bp, Homo sapiens
accaactatttttgaggaa

SEQ ID NO: 3861936 - DNA, 23 bp, Homo sapiens
accaactctgcactccatggcca

SEQ ID NO: 3861937 - DNA, 19 bp, Homo sapiens
accaactttctgtaaactc

SEQ ID NO: 3861938 - DNA, 16 bp, Homo sapiens
accaagaaaaagaaaa

SEQ ID NO: 3861939 - DNA, 19 bp, Homo sapiens
accaagagcacattcttaa

SEQ ID NO: 3861940 - DNA, 15 bp, Homo sapiens
accaagatgggcaca

SEQ ID NO: 3861941 - DNA, 18 bp, Homo sapiens
accaagctcacagttcct

SEQ ID NO: 3861942 - DNA, 13 bp, Homo sapiens
accaagcttcaga

SEQ ID NO: 3861943 - DNA, 17 bp, Homo sapiens
accaagcttcagagcct

SEQ ID NO: 3861944 - DNA, 24 bp, Homo sapiens
accaagcttcagagcctagccacc

SEQ ID NO: 3861945 - DNA, 18 bp, Homo sapiens
accaaggcagcctccaga

SEQ ID NO: 3861946 - DNA, 21 bp, Homo sapiens
accaaggcagcctccagagcc

SEQ ID NO: 3861947 - DNA, 20 bp, Homo sapiens
accaatagtccccatcagca

SEQ ID NO: 3861948 - DNA, 23 bp, Homo sapiens
accaatcccgtgaaagaattatt

SEQ ID NO: 3861949 - DNA, 15 bp, Homo sapiens
accaatctctaagcc

SEQ ID NO: 3861950 - DNA, 18 bp, Homo sapiens
accaatgcatgcagccac

SEQ ID NO: 3861951 - DNA, 22 bp, Homo sapiens
accaatgcatgcagccactgtg

SEQ ID NO: 3861952 - DNA, 16 bp, Homo sapiens
accaatgttgtgatta

SEQ ID NO: 3861953 - DNA, 15 bp, Homo sapiens
accaattgctttgtc

SEQ ID NO: 3861954 - DNA, 16 bp, Homo sapiens
accaattggttaatct

SEQ ID NO: 3861955 - DNA, 14 bp, Homo sapiens
accacaaaaattga

SEQ ID NO: 3861956 - DNA, 18 bp, Homo sapiens
accacacacctcaccaga

SEQ ID NO: 3861957 - DNA, 17 bp, Homo sapiens
accacaccaaacctctc

SEQ ID NO: 3861958 - DNA, 15 bp, Homo sapiens
accacacctccctga

SEQ ID NO: 3861959 - DNA, 20 bp, Homo sapiens
accacactccccgcctgtcc

SEQ ID NO: 3861960 - DNA, 14 bp, Homo sapiens
accacactgttgag

SEQ ID NO: 3861961 - DNA, 18 bp, Homo sapiens
accacacttcttgaaaca

SEQ ID NO: 3861962 - DNA, 11 bp, Homo sapiens
accacagcagt

SEQ ID NO: 3861963 - DNA, 15 bp, Homo sapiens
accacagtgggtggc

SEQ ID NO: 3861964 - DNA, 14 bp, Homo sapiens
accacatctacaat

SEQ ID NO: 3861965 - DNA, 14 bp, Homo sapiens
accaccccttcctg

SEQ ID NO: 3861966 - DNA, 18 bp, Homo sapiens
accacctaatcaggctga

SEQ ID NO: 3861967 - DNA, 16 bp, Homo sapiens
accacctaggccactc

SEQ ID NO: 3861968 - DNA, 18 bp, Homo sapiens
accacctaggccactcct

SEQ ID NO: 3861969 - DNA, 17 bp, Homo sapiens
accacctctccagaggc

SEQ ID NO: 3861970 - DNA, 15 bp, Homo sapiens
accacctgccagcca

SEQ ID NO: 3861971 - DNA, 17 bp, Homo sapiens
accacctgccagccatc

SEQ ID NO: 3861972 - DNA, 18 bp, Homo sapiens
accacctgccagccatca

SEQ ID NO: 3861973 - DNA, 19 bp, Homo sapiens
accacctgccagccatcac

SEQ ID NO: 3861974 - DNA, 22 bp, Homo sapiens
accaccttcccagctctccctc

SEQ ID NO: 3861975 - DNA, 16 bp, Homo sapiens
accacgatgtggccct

SEQ ID NO: 3861976 - DNA, 22 bp, Homo sapiens
accacgatgtggccctggcctg

SEQ ID NO: 3861977 - DNA, 19 bp, Homo sapiens
accacggcgtttttttaca

SEQ ID NO: 3861978 - DNA, 14 bp, Homo sapiens
accacgggcctcag

SEQ ID NO: 3861979 - DNA, 16 bp, Homo sapiens
accacgggcctcagtt

SEQ ID NO: 3861980 - DNA, 13 bp, Homo sapiens
accacgtctgcca

SEQ ID NO: 3861981 - DNA, 15 bp, Homo sapiens
accacgtctgccagg

SEQ ID NO: 3861982 - DNA, 17 bp, Homo sapiens
accacgtctgccaggcc

SEQ ID NO: 3861983 - DNA, 16 bp, Homo sapiens
accactagagctgaga

SEQ ID NO: 3861984 - DNA, 20 bp, Homo sapiens
accactcaaattaatctttc

SEQ ID NO: 3861985 - DNA, 12 bp, Homo sapiens
accactctggca

SEQ ID NO: 3861986 - DNA, 13 bp, Homo sapiens
accactctggcag

SEQ ID NO: 3861987 - DNA, 17 bp, Homo sapiens
accactctggcagccac

SEQ ID NO: 3861988 - DNA, 18 bp, Homo sapiens
accactctggcagccaca

SEQ ID NO: 3861989 - DNA, 18 bp, Homo sapiens
accactgaacatttgctt

SEQ ID NO: 3861990 - DNA, 17 bp, Homo sapiens
accactgccctgcctgc

SEQ ID NO: 3861991 - DNA, 22 bp, Homo sapiens
accactgccctgcctgcccact

SEQ ID NO: 3861992 - DNA, 16 bp, Homo sapiens
accactggttaaaata

SEQ ID NO: 3861993 - DNA, 22 bp, Homo sapiens
accactggttaaaataaagcct

SEQ ID NO: 3861994 - DNA, 13 bp, Homo sapiens
accactgtacata

SEQ ID NO: 3861995 - DNA, 14 bp, Homo sapiens
accacttacttcgt

SEQ ID NO: 3861996 - DNA, 17 bp, Homo sapiens
accacttcttttataac

SEQ ID NO: 3861997 - DNA, 16 bp, Homo sapiens
accagaatcataattt

SEQ ID NO: 3861998 - DNA, 19 bp, Homo sapiens
accagaatcataattttca

SEQ ID NO: 3861999 - DNA, 21 bp, Homo sapiens
accagaattgtgcaaatggaa

SEQ ID NO: 3862000 - DNA, 20 bp, Homo sapiens
accagacctagacctgggcc

SEQ ID NO: 3862001 - DNA, 21 bp, Homo sapiens
accagacctagacctgggcca

SEQ ID NO: 3862002 - DNA, 13 bp, Homo sapiens
accagactgtgga

SEQ ID NO: 3862003 - DNA, 18 bp, Homo sapiens
accagactgtggagaaat

SEQ ID NO: 3862004 - DNA, 11 bp, Homo sapiens
accagagcccc

SEQ ID NO: 3862005 - DNA, 21 bp, Homo sapiens
accagagccccccacaatgat

SEQ ID NO: 3862006 - DNA, 15 bp, Homo sapiens
accagaggctgcaga

SEQ ID NO: 3862007 - DNA, 19 bp, Homo sapiens
accagaggctgcagaaggc

SEQ ID NO: 3862008 - DNA, 21 bp, Homo sapiens
accagaggctgcagaaggcca

SEQ ID NO: 3862009 - DNA, 14 bp, Homo sapiens
accagcaacatctc

SEQ ID NO: 3862010 - DNA, 13 bp, Homo sapiens
accagcagaaaag

SEQ ID NO: 3862011 - DNA, 15 bp, Homo sapiens
accagcagaaaagtg

SEQ ID NO: 3862012 - DNA, 23 bp, Homo sapiens
accagcagaaaagtgcttagaaa

SEQ ID NO: 3862013 - DNA, 22 bp, Homo sapiens
accagcaggtgtggtggctcat

SEQ ID NO: 3862014 - DNA, 14 bp, Homo sapiens
accagcattttact

SEQ ID NO: 3862015 - DNA, 17 bp, Homo sapiens
accagcattttactact

SEQ ID NO: 3862016 - DNA, 13 bp, Homo sapiens
accagccccctgg

SEQ ID NO: 3862017 - DNA, 14 bp, Homo sapiens
accagccccctgga

SEQ ID NO: 3862018 - DNA, 20 bp, Homo sapiens
accagcctccatgctgcctc

SEQ ID NO: 3862019 - DNA, 20 bp, Homo sapiens
accagcctggtgcccatcct

SEQ ID NO: 3862020 - DNA, 14 bp, Homo sapiens
accagcctgttgga

SEQ ID NO: 3862021 - DNA, 19 bp, Homo sapiens
accagctatctgtcatctc

SEQ ID NO: 3862022 - DNA, 23 bp, Homo sapiens
accagctatctgtcatctctctg

SEQ ID NO: 3862023 - DNA, 14 bp, Homo sapiens
accagctctgtggc

SEQ ID NO: 3862024 - DNA, 12 bp, Homo sapiens
accagctgaaag

SEQ ID NO: 3862025 - DNA, 14 bp, Homo sapiens
accagctgccaaaa

SEQ ID NO: 3862026 - DNA, 13 bp, Homo sapiens
accagctgctctg

SEQ ID NO: 3862027 - DNA, 16 bp, Homo sapiens
accagctgctctgccc

SEQ ID NO: 3862028 - DNA, 17 bp, Homo sapiens
accagctgtaacacagc

SEQ ID NO: 3862029 - DNA, 15 bp, Homo sapiens
accagcttctccagg

SEQ ID NO: 3862030 - DNA, 16 bp, Homo sapiens
accagcttctccaggc

SEQ ID NO: 3862031 - DNA, 20 bp, Homo sapiens
accagcttctccaggctctt

SEQ ID NO: 3862032 - DNA, 20 bp, Homo sapiens
accaggaatgttaaagtcag

SEQ ID NO: 3862033 - DNA, 19 bp, Homo sapiens
accaggactatagcccagg

SEQ ID NO: 3862034 - DNA, 15 bp, Homo sapiens
accaggcaccaggca

SEQ ID NO: 3862035 - DNA, 21 bp, Homo sapiens
accagggagaccgagcgcttt

SEQ ID NO: 3862036 - DNA, 14 bp, Homo sapiens
accagggaggagag

SEQ ID NO: 3862037 - DNA, 16 bp, Homo sapiens
accagggaggagagga

SEQ ID NO: 3862038 - DNA, 20 bp, Homo sapiens
accagggtgcatggcttggg

SEQ ID NO: 3862039 - DNA, 14 bp, Homo sapiens
accagtatggaagg

SEQ ID NO: 3862040 - DNA, 16 bp, Homo sapiens
accagtatggaaggga

SEQ ID NO: 3862041 - DNA, 17 bp, Homo sapiens
accagtatggaagggag

SEQ ID NO: 3862042 - DNA, 16 bp, Homo sapiens
accagtgaaccaaaga

SEQ ID NO: 3862043 - DNA, 22 bp, Homo sapiens
accagtgcccaaagtctgtgtg

SEQ ID NO: 3862044 - DNA, 13 bp, Homo sapiens
accagtgtcccct

SEQ ID NO: 3862045 - DNA, 21 bp, Homo sapiens
accagtgtggtttgtgtttga

SEQ ID NO: 3862046 - DNA, 21 bp, Homo sapiens
accagtttagatttcaagaaa

SEQ ID NO: 3862047 - DNA, 21 bp, Homo sapiens
accatagttatttacttgaaa

SEQ ID NO: 3862048 - DNA, 20 bp, Homo sapiens
accatatgtctgcttctgtc

SEQ ID NO: 3862049 - DNA, 14 bp, Homo sapiens
accatcaccctctg

SEQ ID NO: 3862050 - DNA, 18 bp, Homo sapiens
accatcaccctctgggca

SEQ ID NO: 3862051 - DNA, 15 bp, Homo sapiens
accatccaccaggcc

SEQ ID NO: 3862052 - DNA, 17 bp, Homo sapiens
accatcctgcagcctcc

SEQ ID NO: 3862053 - DNA, 13 bp, Homo sapiens
accatcctggccc

SEQ ID NO: 3862054 - DNA, 17 bp, Homo sapiens
accatcgcgtgcaatga

SEQ ID NO: 3862055 - DNA, 18 bp, Homo sapiens
accatcttaaatgacagt

SEQ ID NO: 3862056 - DNA, 22 bp, Homo sapiens
accatgctgctttttggcacag

SEQ ID NO: 3862057 - DNA, 14 bp, Homo sapiens
accatgctggcggc

SEQ ID NO: 3862058 - DNA, 20 bp, Homo sapiens
accatgctggcggcgcagag

SEQ ID NO: 3862059 - DNA, 14 bp, Homo sapiens
accatggaggcagg

SEQ ID NO: 3862060 - DNA, 15 bp, Homo sapiens
accatgtagttttaa

SEQ ID NO: 3862061 - DNA, 17 bp, Homo sapiens
acacttgtataaatgta

SEQ ID NO: 3862062 - DNA, 20 bp, Homo sapiens
acacttgtataaatgtatat

SEQ ID NO: 3862063 - DNA, 22 bp, Homo sapiens
acactttggccaagcaagaggt

SEQ ID NO: 3862064 - DNA, 20 bp, Homo sapiens
acagaaaacaaaagagagaa

SEQ ID NO: 3862065 - DNA, 17 bp, Homo sapiens
acagaaacagagagaga

SEQ ID NO: 3862066 - DNA, 15 bp, Homo sapiens
acagaaatactgctc

SEQ ID NO: 3862067 - DNA, 18 bp, Homo sapiens
acagaaatatatatacat

SEQ ID NO: 3862068 - DNA, 22 bp, Homo sapiens
acagaaatatatatacatatgt

SEQ ID NO: 3862069 - DNA, 23 bp, Homo sapiens
acagaactgctaaatactgtaca

SEQ ID NO: 3862070 - DNA, 18 bp, Homo sapiens
acagaagccaggagcaaa

SEQ ID NO: 3862071 - DNA, 13 bp, Homo sapiens
acagaagcttcag

SEQ ID NO: 3862072 - DNA, 14 bp, Homo sapiens
acagaatcttgtat

SEQ ID NO: 3862073 - DNA, 16 bp, Homo sapiens
acagaatttttaatga

SEQ ID NO: 3862074 - DNA, 18 bp, Homo sapiens
acagacaaaaacagcctc

SEQ ID NO: 3862075 - DNA, 19 bp, Homo sapiens
acagacaaaaacagcctca

SEQ ID NO: 3862076 - DNA, 19 bp, Homo sapiens
acagacattttcaataatg

SEQ ID NO: 3862077 - DNA, 17 bp, Homo sapiens
acagactatttaacttg

SEQ ID NO: 3862078 - DNA, 23 bp, Homo sapiens
acagactccctcccctgccccca

SEQ ID NO: 3862079 - DNA, 11 bp, Homo sapiens
acagactgcaa

SEQ ID NO: 3862080 - DNA, 23 bp, Homo sapiens
acagactgcgatttgtcccaggt

SEQ ID NO: 3862081 - DNA, 15 bp, Homo sapiens
acagacttctccaga

SEQ ID NO: 3862082 - DNA, 16 bp, Homo sapiens
acagacttctccagac

SEQ ID NO: 3862083 - DNA, 17 bp, Homo sapiens
acagacttctccagacc

SEQ ID NO: 3862084 - DNA, 19 bp, Homo sapiens
acagacttctggaaggctg

SEQ ID NO: 3862085 - DNA, 20 bp, Homo sapiens
acagacttctggaaggctgg

SEQ ID NO: 3862086 - DNA, 21 bp, Homo sapiens
acagacttctggaaggctggc

SEQ ID NO: 3862087 - DNA, 22 bp, Homo sapiens
acagacttctggaaggctggct

SEQ ID NO: 3862088 - DNA, 21 bp, Homo sapiens
acagagaaattctgtggtggg

SEQ ID NO: 3862089 - DNA, 16 bp, Homo sapiens
acagagaaggcaggaa

SEQ ID NO: 3862090 - DNA, 18 bp, Homo sapiens
acagagaatctgaagcta

SEQ ID NO: 3862091 - DNA, 15 bp, Homo sapiens
acagagacacctgca

SEQ ID NO: 3862092 - DNA, 16 bp, Homo sapiens
acagagacacctgcac

SEQ ID NO: 3862093 - DNA, 17 bp, Homo sapiens
acagagacacctgcacc

SEQ ID NO: 3862094 - DNA, 23 bp, Homo sapiens
acagagacaggcccaagagatga

SEQ ID NO: 3862095 - DNA, 19 bp, Homo sapiens
acagagactctggaagccc

SEQ ID NO: 3862096 - DNA, 21 bp, Homo sapiens
acagagagagactgagggaga

SEQ ID NO: 3862097 - DNA, 14 bp, Homo sapiens
acagagcccccaag

SEQ ID NO: 3862098 - DNA, 13 bp, Homo sapiens
acagagcgggcct

SEQ ID NO: 3862099 - DNA, 14 bp, Homo sapiens
acagagcgggcctc

SEQ ID NO: 3862100 - DNA, 15 bp, Homo sapiens
acagagcgggcctct

SEQ ID NO: 3862101 - DNA, 22 bp, Homo sapiens
acagagcgtggctgtgctctca

SEQ ID NO: 3862102 - DNA, 19 bp, Homo sapiens
acagagctggctgtcttcc

SEQ ID NO: 3862103 - DNA, 18 bp, Homo sapiens
acagaggaagagcaggca

SEQ ID NO: 3862104 - DNA, 20 bp, Homo sapiens
acagaggaatctacctgtgg

SEQ ID NO: 3862105 - DNA, 21 bp, Homo sapiens
acagaggaatctacctgtggt

SEQ ID NO: 3862106 - DNA, 21 bp, Homo sapiens
acagagtaaatagcattctct

SEQ ID NO: 3862107 - DNA, 23 bp, Homo sapiens
acagagtacttggctgttagccc

SEQ ID NO: 3862108 - DNA, 19 bp, Homo sapiens
acagagtggcccctcacct

SEQ ID NO: 3862109 - DNA, 19 bp, Homo sapiens
acagatatgcacacacatg

SEQ ID NO: 3862110 - DNA, 22 bp, Homo sapiens
acagatcccatccatcagctcc

SEQ ID NO: 3862111 - DNA, 16 bp, Homo sapiens
acagatgcacacacag

SEQ ID NO: 3862112 - DNA, 20 bp, Homo sapiens
acagcaagatgaattttatc

SEQ ID NO: 3862113 - DNA, 15 bp, Homo sapiens
acagcaattggctcc

SEQ ID NO: 3862114 - DNA, 14 bp, Homo sapiens
acagcacccaggct

SEQ ID NO: 3862115 - DNA, 16 bp, Homo sapiens
acagcacccaggctcc

SEQ ID NO: 3862116 - DNA, 19 bp, Homo sapiens
acagcacccaggctccatg

SEQ ID NO: 3862117 - DNA, 19 bp, Homo sapiens
acagcagccccccagcact

SEQ ID NO: 3862118 - DNA, 18 bp, Homo sapiens
acagcagcccctgcacaa

SEQ ID NO: 3862119 - DNA, 18 bp, Homo sapiens
acagcagggtcttgctgt

SEQ ID NO: 3862120 - DNA, 13 bp, Homo sapiens
acagcagtgttcc

SEQ ID NO: 3862121 - DNA, 18 bp, Homo sapiens
acagcagttgaaaagact

SEQ ID NO: 3862122 - DNA, 23 bp, Homo sapiens
acagcagttgaaaagactccaaa

SEQ ID NO: 3862123 - DNA, 21 bp, Homo sapiens
acagcataccttggactgact

SEQ ID NO: 3862124 - DNA, 15 bp, Homo sapiens
acagccaacaaacat

SEQ ID NO: 3862125 - DNA, 12 bp, Homo sapiens
acagccccacag

SEQ ID NO: 3862126 - DNA, 15 bp, Homo sapiens
acagccccacagcac

SEQ ID NO: 3862127 - DNA, 17 bp, Homo sapiens
acagccccacagcaccc

SEQ ID NO: 3862128 - DNA, 12 bp, Homo sapiens
acagcctcagaa

SEQ ID NO: 3862129 - DNA, 20 bp, Homo sapiens
acagcctgtggcggtgcctg

SEQ ID NO: 3862130 - DNA, 21 bp, Homo sapiens
acagcgcgggcggaggcggct

SEQ ID NO: 3862131 - DNA, 13 bp, Homo sapiens
acagcggcccctg

SEQ ID NO: 3862132 - DNA, 15 bp, Homo sapiens
acagcggcccctgca

SEQ ID NO: 3862133 - DNA, 19 bp, Homo sapiens
acagcgtccctagcagtga

SEQ ID NO: 3862134 - DNA, 20 bp, Homo sapiens
acagctaatcagcattctca

SEQ ID NO: 3862135 - DNA, 15 bp, Homo sapiens
acagctatatttctg

SEQ ID NO: 3862136 - DNA, 20 bp, Homo sapiens
acagctcaagtcttccctga

SEQ ID NO: 3862137 - DNA, 13 bp, Homo sapiens
acagctcccaccc

SEQ ID NO: 3862138 - DNA, 17 bp, Homo sapiens
acagctcttcactcagc

SEQ ID NO: 3862139 - DNA, 21 bp, Homo sapiens
acagctcttcactcagccaca

SEQ ID NO: 3862140 - DNA, 23 bp, Homo sapiens
acagctcttcactcagccacacc

SEQ ID NO: 3862141 - DNA, 16 bp, Homo sapiens
acagctgcagctgggc

SEQ ID NO: 3862142 - DNA, 18 bp, Homo sapiens
acagctgctgaagaggca

SEQ ID NO: 3862143 - DNA, 13 bp, Homo sapiens
acagctgcttgtg

SEQ ID NO: 3862144 - DNA, 14 bp, Homo sapiens
acagctgtccctgt

SEQ ID NO: 3862145 - DNA, 18 bp, Homo sapiens
acagctgtccctgtcacc

SEQ ID NO: 3862146 - DNA, 17 bp, Homo sapiens
acagctgtttaagatgg

SEQ ID NO: 3862147 - DNA, 19 bp, Homo sapiens
acagctgtttaagatgggc

SEQ ID NO: 3862148 - DNA, 18 bp, Homo sapiens
acagcttgaccagaccta

SEQ ID NO: 3862149 - DNA, 18 bp, Homo sapiens
acaggaaaatcctctggc

SEQ ID NO: 3862150 - DNA, 16 bp, Homo sapiens
acaggaaagccctccc

SEQ ID NO: 3862151 - DNA, 18 bp, Homo sapiens
acaggaaagccctccccc

SEQ ID NO: 3862152 - DNA, 20 bp, Homo sapiens
acaggaaggtggtgcttaca

SEQ ID NO: 3862153 - DNA, 21 bp, Homo sapiens
acaggactaacactcagaagc

SEQ ID NO: 3862154 - DNA, 22 bp, Homo sapiens
acaggactaacactcagaagcc

SEQ ID NO: 3862155 - DNA, 14 bp, Homo sapiens
acaggactctgcct

SEQ ID NO: 3862156 - DNA, 15 bp, Homo sapiens
acaggactctgcctc

SEQ ID NO: 3862157 - DNA, 16 bp, Homo sapiens
acaggactgattctgg

SEQ ID NO: 3862158 - DNA, 23 bp, Homo sapiens
acaggactgattctgggatgctc

SEQ ID NO: 3862159 - DNA, 18 bp, Homo sapiens
acaggacttaaaatgaca

SEQ ID NO: 3862160 - DNA, 14 bp, Homo sapiens
acaggagacactgt

SEQ ID NO: 3862161 - DNA, 13 bp, Homo sapiens
acaggagcagaca

SEQ ID NO: 3862162 - DNA, 17 bp, Homo sapiens
acaggaggggcccacaa

SEQ ID NO: 3862163 - DNA, 23 bp, Homo sapiens
acaggagggggtcgtggagagct

SEQ ID NO: 3862164 - DNA, 19 bp, Homo sapiens
acaggataaagatatcaat

SEQ ID NO: 3862165 - DNA, 21 bp, Homo sapiens
acaggatcctattctcaccag

SEQ ID NO: 3862166 - DNA, 22 bp, Homo sapiens
acaggcagcgatggtctcagaa

SEQ ID NO: 3862167 - DNA, 17 bp, Homo sapiens
acaggcatttcctgggt

SEQ ID NO: 3862168 - DNA, 18 bp, Homo sapiens
acaggcatttcctgggtg

SEQ ID NO: 3862169 - DNA, 18 bp, Homo sapiens
acaggcccaagagatgaa

SEQ ID NO: 3862170 - DNA, 13 bp, Homo sapiens
acaggcccagtgg

SEQ ID NO: 3862171 - DNA, 22 bp, Homo sapiens
acaggcccttggggttccccca

SEQ ID NO: 3862172 - DNA, 18 bp, Homo sapiens
acaggctactctcctcgg

SEQ ID NO: 3862173 - DNA, 23 bp, Homo sapiens
acagggaaccctgcttgcacttt

SEQ ID NO: 3862174 - DNA, 14 bp, Homo sapiens
acagggaaggcagg

SEQ ID NO: 3862175 - DNA, 19 bp, Homo sapiens
acagggaaggcaggcaggg

SEQ ID NO: 3862176 - DNA, 20 bp, Homo sapiens
acagggcagtgacaagtgga

SEQ ID NO: 3862177 - DNA, 22 bp, Homo sapiens
acagggctaagagctagcgctg

SEQ ID NO: 3862178 - DNA, 22 bp, Homo sapiens
acagggctctttgatggaccca

SEQ ID NO: 3862179 - DNA, 22 bp, Homo sapiens
acaggggccccagatctgcctg

SEQ ID NO: 3862180 - DNA, 14 bp, Homo sapiens
acaggtgcaagcca

SEQ ID NO: 3862181 - DNA, 15 bp, Homo sapiens
acaggtggcaggacc

SEQ ID NO: 3862182 - DNA, 19 bp, Homo sapiens
acaggtggcaggaccagga

SEQ ID NO: 3862183 - DNA, 20 bp, Homo sapiens
acaggtggcaggaccaggac

SEQ ID NO: 3862184 - DNA, 21 bp, Homo sapiens
acaggtggcaggaccaggact

SEQ ID NO: 3862185 - DNA, 12 bp, Homo sapiens
acaggtgtaaat

SEQ ID NO: 3862186 - DNA, 13 bp, Homo sapiens
acaggtgtaaata

SEQ ID NO: 3862187 - DNA, 13 bp, Homo sapiens
acaggttttcagc

SEQ ID NO: 3862188 - DNA, 17 bp, Homo sapiens
acagtaaaaacttgtac

SEQ ID NO: 3862189 - DNA, 17 bp, Homo sapiens
acagtaaagtttaaaaa

SEQ ID NO: 3862190 - DNA, 17 bp, Homo sapiens
acagtaaataaattgtt

SEQ ID NO: 3862191 - DNA, 19 bp, Homo sapiens
acagtagccaagttatatt

SEQ ID NO: 3862192 - DNA, 17 bp, Homo sapiens
acagtagcttaaataaa

SEQ ID NO: 3862193 - DNA, 20 bp, Homo sapiens
acagtagcttaaataaattc

SEQ ID NO: 3862194 - DNA, 21 bp, Homo sapiens
acagtagcttaaataaattca

SEQ ID NO: 3862195 - DNA, 18 bp, Homo sapiens
acagtatttgtacaaata

SEQ ID NO: 3862196 - DNA, 17 bp, Homo sapiens
acagtcaaaacagagat

SEQ ID NO: 3862197 - DNA, 18 bp, Homo sapiens
acagtcaaaacagagatg

SEQ ID NO: 3862198 - DNA, 18 bp, Homo sapiens
acagtcctaactggtata

SEQ ID NO: 3862199 - DNA, 20 bp, Homo sapiens
acagtcctcacagcctctcc

SEQ ID NO: 3862200 - DNA, 18 bp, Homo sapiens
acagtctcaagcactaaa

SEQ ID NO: 3862201 - DNA, 13 bp, Homo sapiens
acagtctcaggaa

SEQ ID NO: 3862202 - DNA, 14 bp, Homo sapiens
acagtctcaggaaa

SEQ ID NO: 3862203 - DNA, 17 bp, Homo sapiens
acagtctcaggaaatca

SEQ ID NO: 3862204 - DNA, 16 bp, Homo sapiens
acagtctcagtccaga

SEQ ID NO: 3862205 - DNA, 19 bp, Homo sapiens
acagtctttctttctgaat

SEQ ID NO: 3862206 - DNA, 14 bp, Homo sapiens
acagtgacccttcc

SEQ ID NO: 3862207 - DNA, 20 bp, Homo sapiens
acagtgactgtcgtgtttac

SEQ ID NO: 3862208 - DNA, 22 bp, Homo sapiens
acagtgactgtcgtgtttacaa

SEQ ID NO: 3862209 - DNA, 14 bp, Homo sapiens
acagtgagcctgaa

SEQ ID NO: 3862210 - DNA, 17 bp, Homo sapiens
acagtgcatctcagccc

SEQ ID NO: 3862211 - DNA, 13 bp, Homo sapiens
acagtgcctgctg

SEQ ID NO: 3862212 - DNA, 15 bp, Homo sapiens
acagtgctgcttctc

SEQ ID NO: 3862213 - DNA, 16 bp, Homo sapiens
acagtggagtgagatc

SEQ ID NO: 3862214 - DNA, 20 bp, Homo sapiens
acagtggcgagaggagagga

SEQ ID NO: 3862215 - DNA, 18 bp, Homo sapiens
acagtgggaactctgaca

SEQ ID NO: 3862216 - DNA, 16 bp, Homo sapiens
acagttacatgaaagt

SEQ ID NO: 3862217 - DNA, 18 bp, Homo sapiens
acagttatttatagtcat

SEQ ID NO: 3862218 - DNA, 20 bp, Homo sapiens
acagttcaagaaagcttcaa

SEQ ID NO: 3862219 - DNA, 17 bp, Homo sapiens
acagttcttggtgactg

SEQ ID NO: 3862220 - DNA, 21 bp, Homo sapiens
acagttgctgtcataagaatg

SEQ ID NO: 3862221 - DNA, 22 bp, Homo sapiens
acagttgctgtcataagaatga

SEQ ID NO: 3862222 - DNA, 19 bp, Homo sapiens
acagttgtctattctgagc

SEQ ID NO: 3862223 - DNA, 22 bp, Homo sapiens
acagttgtctattctgagcctt

SEQ ID NO: 3862224 - DNA, 17 bp, Homo sapiens
acagttttctgagaaag

SEQ ID NO: 3862225 - DNA, 20 bp, Homo sapiens
acagttttctgagaaagact

SEQ ID NO: 3862226 - DNA, 13 bp, Homo sapiens
acataaagcaaat

SEQ ID NO: 3862227 - DNA, 14 bp, Homo sapiens
acataagaccataa

SEQ ID NO: 3862228 - DNA, 12 bp, Homo sapiens
acataatttttt

SEQ ID NO: 3862229 - DNA, 17 bp, Homo sapiens
acatacaatttgcactg

SEQ ID NO: 3862230 - DNA, 16 bp, Homo sapiens
acatacacttgtataa

SEQ ID NO: 3862231 - DNA, 19 bp, Homo sapiens
acatacacttgtataaatg

SEQ ID NO: 3862232 - DNA, 18 bp, Homo sapiens
aatctgggcatctcgtgc

SEQ ID NO: 3862233 - DNA, 13 bp, Homo sapiens
aatctgtaattct

SEQ ID NO: 3862234 - DNA, 15 bp, Homo sapiens
aatctgtagggctgg

SEQ ID NO: 3862235 - DNA, 18 bp, Homo sapiens
aatctgtatatgttgtaa

SEQ ID NO: 3862236 - DNA, 23 bp, Homo sapiens
aatctgtatatgttgtaataaaa

SEQ ID NO: 3862237 - DNA, 14 bp, Homo sapiens
aatctgtgtgaagt

SEQ ID NO: 3862238 - DNA, 19 bp, Homo sapiens
aatcttcggggtgtgatga

SEQ ID NO: 3862239 - DNA, 13 bp, Homo sapiens
aatcttgaaaatg

SEQ ID NO: 3862240 - DNA, 13 bp, Homo sapiens
aatcttgtatttg

SEQ ID NO: 3862241 - DNA, 13 bp, Homo sapiens
aatcttgtccaca

SEQ ID NO: 3862242 - DNA, 14 bp, Homo sapiens
aatcttgtccacag

SEQ ID NO: 3862243 - DNA, 17 bp, Homo sapiens
aatctttctttacctga

SEQ ID NO: 3862244 - DNA, 19 bp, Homo sapiens
aatctttctttacctgaga

SEQ ID NO: 3862245 - DNA, 22 bp, Homo sapiens
aatctttctttacctgagacca

SEQ ID NO: 3862246 - DNA, 22 bp, Homo sapiens
aatctttcttttgattcttcct

SEQ ID NO: 3862247 - DNA, 22 bp, Homo sapiens
aatctttgtgacaggaaagccc

SEQ ID NO: 3862248 - DNA, 17 bp, Homo sapiens
aatgaaaaattctcagt

SEQ ID NO: 3862249 - DNA, 19 bp, Homo sapiens
aatgaaacagatgataaat

SEQ ID NO: 3862250 - DNA, 21 bp, Homo sapiens
aatgaaagggaaagtcagctt

SEQ ID NO: 3862251 - DNA, 21 bp, Homo sapiens
aatgaagacccagtgtaaaga

SEQ ID NO: 3862252 - DNA, 21 bp, Homo sapiens
aatgaataataattatccaga

SEQ ID NO: 3862253 - DNA, 13 bp, Homo sapiens
aatgacaacagaa

SEQ ID NO: 3862254 - DNA, 14 bp, Homo sapiens
aatgacaacagaag

SEQ ID NO: 3862255 - DNA, 16 bp, Homo sapiens
aatgacaacagaagct

SEQ ID NO: 3862256 - DNA, 23 bp, Homo sapiens
aatgacaaggggagggccaggat

SEQ ID NO: 3862257 - DNA, 12 bp, Homo sapiens
aatgacatgcac

SEQ ID NO: 3862258 - DNA, 22 bp, Homo sapiens
aatgacatgcactgacccttcc

SEQ ID NO: 3862259 - DNA, 17 bp, Homo sapiens
aatgaccaagaaaaaga

SEQ ID NO: 3862260 - DNA, 21 bp, Homo sapiens
aatgaccacgggcctcagttt

SEQ ID NO: 3862261 - DNA, 24 bp, Homo sapiens
aatgactaaaaatattataactta

SEQ ID NO: 3862262 - DNA, 16 bp, Homo sapiens
aatgactataaacatt

SEQ ID NO: 3862263 - DNA, 15 bp, Homo sapiens
aatgagaacttcaat

SEQ ID NO: 3862264 - DNA, 14 bp, Homo sapiens
aatgaggacatgtt

SEQ ID NO: 3862265 - DNA, 20 bp, Homo sapiens
aatgagggactggaaccagg

SEQ ID NO: 3862266 - DNA, 21 bp, Homo sapiens
aatgagggactggaaccaggg

SEQ ID NO: 3862267 - DNA, 21 bp, Homo sapiens
aatgagtttttatggggctga

SEQ ID NO: 3862268 - DNA, 15 bp, Homo sapiens
aatgataagcaggaa

SEQ ID NO: 3862269 - DNA, 15 bp, Homo sapiens
aatgatgattaaaca

SEQ ID NO: 3862270 - DNA, 17 bp, Homo sapiens
aatgatggcaattttgt

SEQ ID NO: 3862271 - DNA, 19 bp, Homo sapiens
aatgatggcaattttgtaa

SEQ ID NO: 3862272 - DNA, 19 bp, Homo sapiens
aatgatgtatgatttgttg

SEQ ID NO: 3862273 - DNA, 15 bp, Homo sapiens
aatgatgtccagaag

SEQ ID NO: 3862274 - DNA, 18 bp, Homo sapiens
aatgatgtccagaagaat

SEQ ID NO: 3862275 - DNA, 16 bp, Homo sapiens
aatgattatatgacaa

SEQ ID NO: 3862276 - DNA, 15 bp, Homo sapiens
aatgattattttcat

SEQ ID NO: 3862277 - DNA, 18 bp, Homo sapiens
aatgattattttcattac

SEQ ID NO: 3862278 - DNA, 13 bp, Homo sapiens
aatgattcataac

SEQ ID NO: 3862279 - DNA, 18 bp, Homo sapiens
aatgatttccaaagagaa

SEQ ID NO: 3862280 - DNA, 16 bp, Homo sapiens
aatgattttcatcaat

SEQ ID NO: 3862281 - DNA, 17 bp, Homo sapiens
aatgcaaaatgaaataa

SEQ ID NO: 3862282 - DNA, 18 bp, Homo sapiens
aatgcaaacactgtgtat

SEQ ID NO: 3862283 - DNA, 17 bp, Homo sapiens
aatgcaagctagtggct

SEQ ID NO: 3862284 - DNA, 13 bp, Homo sapiens
aatgcacactagc

SEQ ID NO: 3862285 - DNA, 18 bp, Homo sapiens
aatgcacatccattccca

SEQ ID NO: 3862286 - DNA, 19 bp, Homo sapiens
aatgcagattcctgggcct

SEQ ID NO: 3862287 - DNA, 18 bp, Homo sapiens
aatgcagtccagaataag

SEQ ID NO: 3862288 - DNA, 22 bp, Homo sapiens
aatgcagtccagaataagtgct

SEQ ID NO: 3862289 - DNA, 14 bp, Homo sapiens
aatgcataaatgca

SEQ ID NO: 3862290 - DNA, 23 bp, Homo sapiens
aatgcatccattcctcagggaca

SEQ ID NO: 3862291 - DNA, 14 bp, Homo sapiens
aatgcatgatttta

SEQ ID NO: 3862292 - DNA, 15 bp, Homo sapiens
aatgcatgattttat

SEQ ID NO: 3862293 - DNA, 17 bp, Homo sapiens
aatgcatgattttatac

SEQ ID NO: 3862294 - DNA, 18 bp, Homo sapiens
aatgcatgattttataca

SEQ ID NO: 3862295 - DNA, 22 bp, Homo sapiens
aatgcatgattttatacatagt

SEQ ID NO: 3862296 - DNA, 21 bp, Homo sapiens
aatgcatgtaaggtcttcttg

SEQ ID NO: 3862297 - DNA, 23 bp, Homo sapiens
aatgcattataggatcatttgtt

SEQ ID NO: 3862298 - DNA, 22 bp, Homo sapiens
aatgccaacatacccttcttta

SEQ ID NO: 3862299 - DNA, 19 bp, Homo sapiens
aatgccaactggtcactgt

SEQ ID NO: 3862300 - DNA, 20 bp, Homo sapiens
aatgcctcaatgtgaccagg

SEQ ID NO: 3862301 - DNA, 12 bp, Homo sapiens
aatgcctcctcc

SEQ ID NO: 3862302 - DNA, 14 bp, Homo sapiens
aatgcctcctccct

SEQ ID NO: 3862303 - DNA, 13 bp, Homo sapiens
aatgcctctccca

SEQ ID NO: 3862304 - DNA, 21 bp, Homo sapiens
aatgccttgacaacagactga

SEQ ID NO: 3862305 - DNA, 14 bp, Homo sapiens
aatgcgtaattaaa

SEQ ID NO: 3862306 - DNA, 23 bp, Homo sapiens
aatgcgtgttgtacatacagagg

SEQ ID NO: 3862307 - DNA, 14 bp, Homo sapiens
aatgctaaatgcaa

SEQ ID NO: 3862308 - DNA, 19 bp, Homo sapiens
aatgctattgttgtgggct

SEQ ID NO: 3862309 - DNA, 21 bp, Homo sapiens
aatgctattgttgtgggcttt

SEQ ID NO: 3862310 - DNA, 23 bp, Homo sapiens
aatgctcccatctcctgatttct

SEQ ID NO: 3862311 - DNA, 17 bp, Homo sapiens
aatgctcgtgtgatttc

SEQ ID NO: 3862312 - DNA, 20 bp, Homo sapiens
aatgctgtagaatgcttggc

SEQ ID NO: 3862313 - DNA, 17 bp, Homo sapiens
aatgctgtcaactatga

SEQ ID NO: 3862314 - DNA, 20 bp, Homo sapiens
aatgcttgtggattgagggt

SEQ ID NO: 3862315 - DNA, 17 bp, Homo sapiens
aatgctttgggaggcca

SEQ ID NO: 3862316 - DNA, 17 bp, Homo sapiens
aatgctttttgaatgtt

SEQ ID NO: 3862317 - DNA, 12 bp, Homo sapiens
aatggaagaaaa

SEQ ID NO: 3862318 - DNA, 14 bp, Homo sapiens
aatggaagagaaat

SEQ ID NO: 3862319 - DNA, 13 bp, Homo sapiens
aatggactcatgg

SEQ ID NO: 3862320 - DNA, 15 bp, Homo sapiens
aatggagggtggggc

SEQ ID NO: 3862321 - DNA, 14 bp, Homo sapiens
aatggagtgggaga

SEQ ID NO: 3862322 - DNA, 16 bp, Homo sapiens
aatggcaagttttgat

SEQ ID NO: 3862323 - DNA, 13 bp, Homo sapiens
aatggcagctaga

SEQ ID NO: 3862324 - DNA, 19 bp, Homo sapiens
aatggcagctagactggag

SEQ ID NO: 3862325 - DNA, 21 bp, Homo sapiens
aatggctgcagtgacccagat

SEQ ID NO: 3862326 - DNA, 13 bp, Homo sapiens
aatggctgtaaac

SEQ ID NO: 3862327 - DNA, 18 bp, Homo sapiens
aatgggagatggtcagtg

SEQ ID NO: 3862328 - DNA, 21 bp, Homo sapiens
aatgggagggggctccatgga

SEQ ID NO: 3862329 - DNA, 17 bp, Homo sapiens
aatgggcagtgcctcct

SEQ ID NO: 3862330 - DNA, 12 bp, Homo sapiens
aatggggcggca

SEQ ID NO: 3862331 - DNA, 21 bp, Homo sapiens
aatggggtagaggagggcatg

SEQ ID NO: 3862332 - DNA, 15 bp, Homo sapiens
aatggggtgggccca

SEQ ID NO: 3862333 - DNA, 18 bp, Homo sapiens
aatggtctaaaaataaac

SEQ ID NO: 3862334 - DNA, 13 bp, Homo sapiens
aatggtgcagaaa

SEQ ID NO: 3862335 - DNA, 19 bp, Homo sapiens
aatggtgggaaccctcccc

SEQ ID NO: 3862336 - DNA, 14 bp, Homo sapiens
aatggttccatgcc

SEQ ID NO: 3862337 - DNA, 19 bp, Homo sapiens
aatggttccatgcctgagg

SEQ ID NO: 3862338 - DNA, 18 bp, Homo sapiens
aatggttgccttaaagaa

SEQ ID NO: 3862339 - DNA, 16 bp, Homo sapiens
aatggtttacatgaac

SEQ ID NO: 3862340 - DNA, 21 bp, Homo sapiens
aatgtaatgatcataagtcta

SEQ ID NO: 3862341 - DNA, 20 bp, Homo sapiens
aatgtacaagttttgtataa

SEQ ID NO: 3862342 - DNA, 16 bp, Homo sapiens
aatgtacactggatat

SEQ ID NO: 3862343 - DNA, 22 bp, Homo sapiens
aatgtagtgaagggatgtatca

SEQ ID NO: 3862344 - DNA, 14 bp, Homo sapiens
aatgtagtggagag

SEQ ID NO: 3862345 - DNA, 13 bp, Homo sapiens
aatgtatatacac

SEQ ID NO: 3862346 - DNA, 21 bp, Homo sapiens
aatgtatatacacatatacct

SEQ ID NO: 3862347 - DNA, 17 bp, Homo sapiens
aatgtatatgtcattta

SEQ ID NO: 3862348 - DNA, 18 bp, Homo sapiens
aatgtatcatagaaatgt

SEQ ID NO: 3862349 - DNA, 18 bp, Homo sapiens
aatgtatgtgaaagtgta

SEQ ID NO: 3862350 - DNA, 21 bp, Homo sapiens
aatgtatgtgaaagtgtaaaa

SEQ ID NO: 3862351 - DNA, 19 bp, Homo sapiens
aatgtattgaacttggaaa

SEQ ID NO: 3862352 - DNA, 21 bp, Homo sapiens
aatgtatttatatgttaattt

SEQ ID NO: 3862353 - DNA, 15 bp, Homo sapiens
aatgtcaccaccttc

SEQ ID NO: 3862354 - DNA, 18 bp, Homo sapiens
aatgtcaccaccttccca

SEQ ID NO: 3862355 - DNA, 22 bp, Homo sapiens
aatgtcagagctatgttccctc

SEQ ID NO: 3862356 - DNA, 22 bp, Homo sapiens
aatgtcctgtggtgacaggccc

SEQ ID NO: 3862357 - DNA, 16 bp, Homo sapiens
aatgtctcttcctctg

SEQ ID NO: 3862358 - DNA, 20 bp, Homo sapiens
aatgtctcttcctctgttct

SEQ ID NO: 3862359 - DNA, 15 bp, Homo sapiens
aatgtgaagggtggg

SEQ ID NO: 3862360 - DNA, 14 bp, Homo sapiens
aatgtgatcaactg

SEQ ID NO: 3862361 - DNA, 18 bp, Homo sapiens
aatgtgatcaactgttca

SEQ ID NO: 3862362 - DNA, 20 bp, Homo sapiens
aatgtgcctaatggagaaga

SEQ ID NO: 3862363 - DNA, 19 bp, Homo sapiens
aatgtggatagctgccttt

SEQ ID NO: 3862364 - DNA, 16 bp, Homo sapiens
aatgtgtattctggct

SEQ ID NO: 3862365 - DNA, 19 bp, Homo sapiens
aatgtgtgccatagagttt

SEQ ID NO: 3862366 - DNA, 21 bp, Homo sapiens
aatgtgtggtgctaactgtat

SEQ ID NO: 3862367 - DNA, 18 bp, Homo sapiens
aatgtgtgtatgtgtatt

SEQ ID NO: 3862368 - DNA, 21 bp, Homo sapiens
aatgtgtgtctgaagactatc

SEQ ID NO: 3862369 - DNA, 21 bp, Homo sapiens
aatgttaaggacttctgcagc

SEQ ID NO: 3862370 - DNA, 22 bp, Homo sapiens
aatgttatttgttattttcagt

SEQ ID NO: 3862371 - DNA, 23 bp, Homo sapiens
aatgttatttgttattttcagta

SEQ ID NO: 3862372 - DNA, 16 bp, Homo sapiens
aatgttcgtattctat

SEQ ID NO: 3862373 - DNA, 12 bp, Homo sapiens
aatgttctctgg

SEQ ID NO: 3862374 - DNA, 15 bp, Homo sapiens
aatgttctttaatgt

SEQ ID NO: 3862375 - DNA, 17 bp, Homo sapiens
aatgttgaaatcttaaa

SEQ ID NO: 3862376 - DNA, 16 bp, Homo sapiens
aatgttgggatttata

SEQ ID NO: 3862377 - DNA, 19 bp, Homo sapiens
aatgttgggatttatatct

SEQ ID NO: 3862378 - DNA, 16 bp, Homo sapiens
aatgtttaaatataaa

SEQ ID NO: 3862379 - DNA, 21 bp, Homo sapiens
aatgtttatgttctcagaatc

SEQ ID NO: 3862380 - DNA, 14 bp, Homo sapiens
aatgtttgatttag

SEQ ID NO: 3862381 - DNA, 16 bp, Homo sapiens
aatgtttttattaaca

SEQ ID NO: 3862382 - DNA, 14 bp, Homo sapiens
aattaaaaaccact

SEQ ID NO: 3862383 - DNA, 12 bp, Homo sapiens
aattaaaatata

SEQ ID NO: 3862384 - DNA, 15 bp, Homo sapiens
aattaaaatatatat

SEQ ID NO: 3862385 - DNA, 19 bp, Homo sapiens
aattaaaatatatataaat

SEQ ID NO: 3862386 - DNA, 22 bp, Homo sapiens
aattaaaatatatataaatata

SEQ ID NO: 3862387 - DNA, 17 bp, Homo sapiens
aattaaaatctggaaat

SEQ ID NO: 3862388 - DNA, 20 bp, Homo sapiens
aattaactatgtgatgttaa

SEQ ID NO: 3862389 - DNA, 12 bp, Homo sapiens
aattaagacttt

SEQ ID NO: 3862390 - DNA, 13 bp, Homo sapiens
aattaagtgcaat

SEQ ID NO: 3862391 - DNA, 15 bp, Homo sapiens
aattaagtgcaattt

SEQ ID NO: 3862392 - DNA, 18 bp, Homo sapiens
aattaagtgcaatttccc

SEQ ID NO: 3862393 - DNA, 13 bp, Homo sapiens
aattaatagcttt

SEQ ID NO: 3862394 - DNA, 14 bp, Homo sapiens
aattaatgtgtgtc

SEQ ID NO: 3862395 - DNA, 19 bp, Homo sapiens
aattacaaaatgaagtttt

SEQ ID NO: 3862396 - DNA, 16 bp, Homo sapiens
aattagctgtgtgaaa

SEQ ID NO: 3862397 - DNA, 14 bp, Homo sapiens
aattaggttaacat

SEQ ID NO: 3862398 - DNA, 14 bp, Homo sapiens
aattagtacagtag

SEQ ID NO: 3862399 - DNA, 20 bp, Homo sapiens
aattagtacagtagcttaaa

SEQ ID NO: 3862400 - DNA, 14 bp, Homo sapiens
aattataagatgtc

SEQ ID NO: 3862401 - DNA, 20 bp, Homo sapiens
aattatataggttgtgcaaa

SEQ ID NO: 3862402 - DNA, 16 bp, Homo sapiens
aattatcatgggaaaa

SEQ ID NO: 3862403 - DNA, 22 bp, Homo sapiens
aattatctgatcgggataacaa

SEQ ID NO: 3862404 - DNA, 22 bp, Homo sapiens
aattatgagatgatgaaaataa

SEQ ID NO: 3862405 - DNA, 14 bp, Homo sapiens
aattatgcactggc

SEQ ID NO: 3862406 - DNA, 18 bp, Homo sapiens
aattatggaaatatagtt

SEQ ID NO: 3862407 - DNA, 15 bp, Homo sapiens
aattatgtatgttta

SEQ ID NO: 3862408 - DNA, 16 bp, Homo sapiens
aattatgtatgtttac

SEQ ID NO: 3862409 - DNA, 14 bp, Homo sapiens
aattattttaaaca

SEQ ID NO: 3862410 - DNA, 14 bp, Homo sapiens
aattcaaagctcta

SEQ ID NO: 3862411 - DNA, 13 bp, Homo sapiens
aattcaacacatt

SEQ ID NO: 3862412 - DNA, 15 bp, Homo sapiens
aattcaacacattac

SEQ ID NO: 3862413 - DNA, 21 bp, Homo sapiens
aattcaaggagatataaaatc

SEQ ID NO: 3862414 - DNA, 15 bp, Homo sapiens
aattcaggactggct

SEQ ID NO: 3862415 - DNA, 16 bp, Homo sapiens
aattcaggactggctc

SEQ ID NO: 3862416 - DNA, 12 bp, Homo sapiens
aattcagtaaca

SEQ ID NO: 3862417 - DNA, 14 bp, Homo sapiens
aattcataattaga

SEQ ID NO: 3862418 - DNA, 17 bp, Homo sapiens
aattcataattagaaca

SEQ ID NO: 3862419 - DNA, 19 bp, Homo sapiens
aattcataattagaacaat

SEQ ID NO: 3862420 - DNA, 23 bp, Homo sapiens
aattcataattagaacaatagct

SEQ ID NO: 3862421 - DNA, 21 bp, Homo sapiens
aattcatttcactttaaagtc

SEQ ID NO: 3862422 - DNA, 12 bp, Homo sapiens
aattccaaggag

SEQ ID NO: 3862423 - DNA, 21 bp, Homo sapiens
aattcccagctgtctgtgtca

SEQ ID NO: 3862424 - DNA, 16 bp, Homo sapiens
aattcctgaagccaga

SEQ ID NO: 3862425 - DNA, 16 bp, Homo sapiens
aattcctggcatgaca

SEQ ID NO: 3862426 - DNA, 21 bp, Homo sapiens
aattcctgtagcatcttctgg

SEQ ID NO: 3862427 - DNA, 19 bp, Homo sapiens
aattccttttctaactctc

SEQ ID NO: 3862428 - DNA, 18 bp, Homo sapiens
aattctacagcatacaga

SEQ ID NO: 3862429 - DNA, 14 bp, Homo sapiens
aattctacaggatg

SEQ ID NO: 3862430 - DNA, 19 bp, Homo sapiens
aattctcatgtgatccttt

SEQ ID NO: 3862431 - DNA, 13 bp, Homo sapiens
aattctgtgaaga

SEQ ID NO: 3862432 - DNA, 18 bp, Homo sapiens
aattctgtgaagaatgaa

SEQ ID NO: 3862433 - DNA, 13 bp, Homo sapiens
aattcttggaata

SEQ ID NO: 3862434 - DNA, 14 bp, Homo sapiens
aattcttgtatatt

SEQ ID NO: 3862435 - DNA, 20 bp, Homo sapiens
aattctttatttctgtcatt

SEQ ID NO: 3862436 - DNA, 22 bp, Homo sapiens
aattgaaaggaaatgtttgagt

SEQ ID NO: 3862437 - DNA, 15 bp, Homo sapiens
aattgactcaaatct

SEQ ID NO: 3862438 - DNA, 22 bp, Homo sapiens
aattgagtctcttttttattct

SEQ ID NO: 3862439 - DNA, 23 bp, Homo sapiens
aattgagtctcttttttattctg

SEQ ID NO: 3862440 - DNA, 19 bp, Homo sapiens
aattgatacttcaggtgct

SEQ ID NO: 3862441 - DNA, 13 bp, Homo sapiens
aattgcacaattt

SEQ ID NO: 3862442 - DNA, 14 bp, Homo sapiens
aattgcacttttaa

SEQ ID NO: 3862443 - DNA, 18 bp, Homo sapiens
aattgcacttttaaacct

SEQ ID NO: 3862444 - DNA, 21 bp, Homo sapiens
aattgcctccttatttatcaa

SEQ ID NO: 3862445 - DNA, 20 bp, Homo sapiens
aattgctattttatttgtat

SEQ ID NO: 3862446 - DNA, 22 bp, Homo sapiens
aattgctattttatttgtattc

SEQ ID NO: 3862447 - DNA, 19 bp, Homo sapiens
aattgcttaaaagacattt

SEQ ID NO: 3862448 - DNA, 22 bp, Homo sapiens
aattgcttttgttgtgactttt

SEQ ID NO: 3862449 - DNA, 20 bp, Homo sapiens
aattggagtatctaaagcca

SEQ ID NO: 3862450 - DNA, 16 bp, Homo sapiens
aattgggaagctgggg

SEQ ID NO: 3862451 - DNA, 18 bp, Homo sapiens
aattggtatcaagaaagt

SEQ ID NO: 3862452 - DNA, 13 bp, Homo sapiens
aattgtaaatttt

SEQ ID NO: 3862453 - DNA, 20 bp, Homo sapiens
aattgtatacattttgttat

SEQ ID NO: 3862454 - DNA, 21 bp, Homo sapiens
aattgtatacattttgttata

SEQ ID NO: 3862455 - DNA, 22 bp, Homo sapiens
aattgtatacattttgttatag

SEQ ID NO: 3862456 - DNA, 13 bp, Homo sapiens
aattgtatagaga

SEQ ID NO: 3862457 - DNA, 24 bp, Homo sapiens
aattgtatcatttgaacaactagg

SEQ ID NO: 3862458 - DNA, 22 bp, Homo sapiens
aattgtatgttaagttacttca

SEQ ID NO: 3862459 - DNA, 17 bp, Homo sapiens
aattgtccctgtttcaa

SEQ ID NO: 3862460 - DNA, 15 bp, Homo sapiens
aattgtgatgttttg

SEQ ID NO: 3862461 - DNA, 17 bp, Homo sapiens
aattgttcctgatgtgc

SEQ ID NO: 3862462 - DNA, 19 bp, Homo sapiens
aattgttcctgatgtgcca

SEQ ID NO: 3862463 - DNA, 19 bp, Homo sapiens
aattgtttggcttcctcct

SEQ ID NO: 3862464 - DNA, 21 bp, Homo sapiens
aattgtttggcttcctcctga

SEQ ID NO: 3862465 - DNA, 22 bp, Homo sapiens
aatttaaaatcattcaatatct

SEQ ID NO: 3862466 - DNA, 13 bp, Homo sapiens
aatttaaaccagc

SEQ ID NO: 3862467 - DNA, 14 bp, Homo sapiens
aatttaaaccagca

SEQ ID NO: 3862468 - DNA, 16 bp, Homo sapiens
aatttaaaccagcaga

SEQ ID NO: 3862469 - DNA, 17 bp, Homo sapiens
aatttaaaccagcagaa

SEQ ID NO: 3862470 - DNA, 18 bp, Homo sapiens
aatttaaaccagcagaaa

SEQ ID NO: 3862471 - DNA, 19 bp, Homo sapiens
aatttaaaccagcagaaaa

SEQ ID NO: 3862472 - DNA, 15 bp, Homo sapiens
aatttaaagccacaa

SEQ ID NO: 3862473 - DNA, 21 bp, Homo sapiens
aatttaactaatttaaaccag

SEQ ID NO: 3862474 - DNA, 14 bp, Homo sapiens
aatttagaaaacat

SEQ ID NO: 3862475 - DNA, 18 bp, Homo sapiens
aatttagaaaacattcat

SEQ ID NO: 3862476 - DNA, 16 bp, Homo sapiens
aatttataaaattaga

SEQ ID NO: 3862477 - DNA, 18 bp, Homo sapiens
aatttataaaattagaaa

SEQ ID NO: 3862478 - DNA, 14 bp, Homo sapiens
aatttatacaaaat

SEQ ID NO: 3862479 - DNA, 15 bp, Homo sapiens
aatttatacaaaata

SEQ ID NO: 3862480 - DNA, 18 bp, Homo sapiens
aatttatatttgaaattt

SEQ ID NO: 3862481 - DNA, 12 bp, Homo sapiens
aatttatggttt

SEQ ID NO: 3862482 - DNA, 14 bp, Homo sapiens
aatttatggtttct

SEQ ID NO: 3862483 - DNA, 16 bp, Homo sapiens
aatttatttcatccag

SEQ ID NO: 3862484 - DNA, 17 bp, Homo sapiens
aatttatttcatccagt

SEQ ID NO: 3862485 - DNA, 20 bp, Homo sapiens
aatttcaaaagacatgttgt

SEQ ID NO: 3862486 - DNA, 15 bp, Homo sapiens
aatttcctatctgta

SEQ ID NO: 3862487 - DNA, 18 bp, Homo sapiens
aatttctaccatttcaga

SEQ ID NO: 3862488 - DNA, 20 bp, Homo sapiens
aatttctcccagtcatttaa

SEQ ID NO: 3862489 - DNA, 20 bp, Homo sapiens
aatttcttcactgttgaaaa

SEQ ID NO: 3862490 - DNA, 20 bp, Homo sapiens
aatattaaatacagacacta

SEQ ID NO: 3862491 - DNA, 22 bp, Homo sapiens
aatattaaatacagacactaag

SEQ ID NO: 3862492 - DNA, 12 bp, Homo sapiens
aatattaatccc

SEQ ID NO: 3862493 - DNA, 20 bp, Homo sapiens
aatattaatcccagccctac

SEQ ID NO: 3862494 - DNA, 13 bp, Homo sapiens
aatattattgggg

SEQ ID NO: 3862495 - DNA, 12 bp, Homo sapiens
aatattgtgctt

SEQ ID NO: 3862496 - DNA, 19 bp, Homo sapiens
aatattgttaccatgaaga

SEQ ID NO: 3862497 - DNA, 14 bp, Homo sapiens
aatatttaaacagc

SEQ ID NO: 3862498 - DNA, 16 bp, Homo sapiens
aatatttaaacagcag

SEQ ID NO: 3862499 - DNA, 19 bp, Homo sapiens
aatatttaagtatatagta

SEQ ID NO: 3862500 - DNA, 20 bp, Homo sapiens
aatatttaagtatatagtat

SEQ ID NO: 3862501 - DNA, 18 bp, Homo sapiens
aatatttaagtttgttgc

SEQ ID NO: 3862502 - DNA, 15 bp, Homo sapiens
aatatttaggcaaga

SEQ ID NO: 3862503 - DNA, 21 bp, Homo sapiens
aatatttatgcttaaaatatg

SEQ ID NO: 3862504 - DNA, 21 bp, Homo sapiens
aatatttatgtctatttaagc

SEQ ID NO: 3862505 - DNA, 14 bp, Homo sapiens
aatatttgtacata

SEQ ID NO: 3862506 - DNA, 17 bp, Homo sapiens
aatattttagccttaaa

SEQ ID NO: 3862507 - DNA, 22 bp, Homo sapiens
aatattttagccttaaattttt

SEQ ID NO: 3862508 - DNA, 19 bp, Homo sapiens
aatattttgtattttcaac

SEQ ID NO: 3862509 - DNA, 20 bp, Homo sapiens
aatatttttagctctgttct

SEQ ID NO: 3862510 - DNA, 23 bp, Homo sapiens
aatatttttgaaaggcatgttcc

SEQ ID NO: 3862511 - DNA, 12 bp, Homo sapiens
aatcaaaagctg

SEQ ID NO: 3862512 - DNA, 13 bp, Homo sapiens
aatcaaaagctgc

SEQ ID NO: 3862513 - DNA, 15 bp, Homo sapiens
aatcaaatatgcaaa

SEQ ID NO: 3862514 - DNA, 16 bp, Homo sapiens
aatcaaatatgcaaag

SEQ ID NO: 3862515 - DNA, 17 bp, Homo sapiens
aatcaagaatattcaaa

SEQ ID NO: 3862516 - DNA, 13 bp, Homo sapiens
aatcaagtattta

SEQ ID NO: 3862517 - DNA, 18 bp, Homo sapiens
aatcacaagcaataatta

SEQ ID NO: 3862518 - DNA, 16 bp, Homo sapiens
aatcacctggagggct

SEQ ID NO: 3862519 - DNA, 17 bp, Homo sapiens
aatcactgtattttcat

SEQ ID NO: 3862520 - DNA, 16 bp, Homo sapiens
aatcacttgtaaataa

SEQ ID NO: 3862521 - DNA, 19 bp, Homo sapiens
aatcacttgtaaataaata

SEQ ID NO: 3862522 - DNA, 17 bp, Homo sapiens
aatcagactcatctaca

SEQ ID NO: 3862523 - DNA, 16 bp, Homo sapiens
aatcagcactgaaaat

SEQ ID NO: 3862524 - DNA, 11 bp, Homo sapiens
aatcagctccc

SEQ ID NO: 3862525 - DNA, 14 bp, Homo sapiens
aatcaggcagcctt

SEQ ID NO: 3862526 - DNA, 18 bp, Homo sapiens
aatcagttatattcttta

SEQ ID NO: 3862527 - DNA, 23 bp, Homo sapiens
aatcatcaccacaccgtgagcag

SEQ ID NO: 3862528 - DNA, 17 bp, Homo sapiens
aatcatcgaaaattcat

SEQ ID NO: 3862529 - DNA, 21 bp, Homo sapiens
aatcatcgaaaattcatttca

SEQ ID NO: 3862530 - DNA, 18 bp, Homo sapiens
aatcatctgtgtgaaaat

SEQ ID NO: 3862531 - DNA, 19 bp, Homo sapiens
aatcatgagtacctcaaag

SEQ ID NO: 3862532 - DNA, 14 bp, Homo sapiens
aatcattcaatatc

SEQ ID NO: 3862533 - DNA, 23 bp, Homo sapiens
aatcattctttcccctcagagct

SEQ ID NO: 3862534 - DNA, 22 bp, Homo sapiens
aatcatttctgcatcagctgct

SEQ ID NO: 3862535 - DNA, 19 bp, Homo sapiens
aatcattttgcctcttttc

SEQ ID NO: 3862536 - DNA, 13 bp, Homo sapiens
aatccacagccaa

SEQ ID NO: 3862537 - DNA, 13 bp, Homo sapiens
aatccactctcag

SEQ ID NO: 3862538 - DNA, 22 bp, Homo sapiens
aatccaggtctcgggtccgatt

SEQ ID NO: 3862539 - DNA, 17 bp, Homo sapiens
aatccaggtgggagaga

SEQ ID NO: 3862540 - DNA, 21 bp, Homo sapiens
aatccaggtgggagagacact

SEQ ID NO: 3862541 - DNA, 22 bp, Homo sapiens
aatccatgttagtttttacttt

SEQ ID NO: 3862542 - DNA, 17 bp, Homo sapiens
aatccccaagctggcag

SEQ ID NO: 3862543 - DNA, 22 bp, Homo sapiens
aatccccggctgcttccttctg

SEQ ID NO: 3862544 - DNA, 14 bp, Homo sapiens
aatcccctcattca

SEQ ID NO: 3862545 - DNA, 21 bp, Homo sapiens
aatccgcctgcagaggacaga

SEQ ID NO: 3862546 - DNA, 12 bp, Homo sapiens
aatcctgaagaa

SEQ ID NO: 3862547 - DNA, 11 bp, Homo sapiens
aatcctgcctc

SEQ ID NO: 3862548 - DNA, 13 bp, Homo sapiens
aatccttgcttat

SEQ ID NO: 3862549 - DNA, 14 bp, Homo sapiens
aatcgatctgtact

SEQ ID NO: 3862550 - DNA, 18 bp, Homo sapiens
aatcgatctgtactgtaa

SEQ ID NO: 3862551 - DNA, 20 bp, Homo sapiens
aatcgatctgtactgtaatt

SEQ ID NO: 3862552 - DNA, 14 bp, Homo sapiens
aatcgattggcttt

SEQ ID NO: 3862553 - DNA, 13 bp, Homo sapiens
aatctaactacaa

SEQ ID NO: 3862554 - DNA, 19 bp, Homo sapiens
aatctaatattaaaaatat

SEQ ID NO: 3862555 - DNA, 17 bp, Homo sapiens
aatctaatgtaagaaaa

SEQ ID NO: 3862556 - DNA, 18 bp, Homo sapiens
aatctatattaaagtgtt

SEQ ID NO: 3862557 - DNA, 12 bp, Homo sapiens
aatctattcaga

SEQ ID NO: 3862558 - DNA, 13 bp, Homo sapiens
aatctattcagac

SEQ ID NO: 3862559 - DNA, 16 bp, Homo sapiens
aatctcatacctctga

SEQ ID NO: 3862560 - DNA, 22 bp, Homo sapiens
aatctcatacctctgaccaaca

SEQ ID NO: 3862561 - DNA, 11 bp, Homo sapiens
aatctcattcc

SEQ ID NO: 3862562 - DNA, 11 bp, Homo sapiens
aatctccaggg

SEQ ID NO: 3862563 - DNA, 23 bp, Homo sapiens
aatctccagggctgcccctgtag

SEQ ID NO: 3862564 - DNA, 20 bp, Homo sapiens
aatctctcggttccacgtcc

SEQ ID NO: 3862565 - DNA, 20 bp, Homo sapiens
aatctcttttttcaactggc

SEQ ID NO: 3862566 - DNA, 14 bp, Homo sapiens
aatctgaaagcccg

SEQ ID NO: 3862567 - DNA, 20 bp, Homo sapiens
aatctgagatctccctccag

SEQ ID NO: 3862568 - DNA, 18 bp, Homo sapiens
aatctgagcctaaatcta

SEQ ID NO: 3862569 - DNA, 15 bp, Homo sapiens
aatctgatctgagtg

SEQ ID NO: 3862570 - DNA, 15 bp, Homo sapiens
aatctgatttaatgt

SEQ ID NO: 3862571 - DNA, 20 bp, Homo sapiens
aatctgctcagcaggcccta

SEQ ID NO: 3862572 - DNA, 15 bp, Homo sapiens
aatctggactcctct

SEQ ID NO: 3862573 - DNA, 18 bp, Homo sapiens
aatctggactcctctgtc

SEQ ID NO: 3862574 - DNA, 20 bp, Homo sapiens
aatctggactcctctgtcca

SEQ ID NO: 3862575 - DNA, 16 bp, Homo sapiens
aatctgggaagggaag

SEQ ID NO: 3862576 - DNA, 15 bp, Homo sapiens
aatttgagaattatt

SEQ ID NO: 3862577 - DNA, 21 bp, Homo sapiens
aatttgagcaattcatttcac

SEQ ID NO: 3862578 - DNA, 21 bp, Homo sapiens
aatttgcactgttacttttta

SEQ ID NO: 3862579 - DNA, 22 bp, Homo sapiens
aatttgccaccactagagctga

SEQ ID NO: 3862580 - DNA, 23 bp, Homo sapiens
aatttggtgtggctgtattcaga

SEQ ID NO: 3862581 - DNA, 14 bp, Homo sapiens
aatttgtaagttta

SEQ ID NO: 3862582 - DNA, 13 bp, Homo sapiens
aatttgtatatca

SEQ ID NO: 3862583 - DNA, 18 bp, Homo sapiens
aatttgttgaaattatgt

SEQ ID NO: 3862584 - DNA, 22 bp, Homo sapiens
aattttaaggtagaacctcacc

SEQ ID NO: 3862585 - DNA, 15 bp, Homo sapiens
aattttagagcatac

SEQ ID NO: 3862586 - DNA, 21 bp, Homo sapiens
aattttataagcaaatttcaa

SEQ ID NO: 3862587 - DNA, 19 bp, Homo sapiens
aattttcaggtttcttaaa

SEQ ID NO: 3862588 - DNA, 17 bp, Homo sapiens
aattttctagactttct

SEQ ID NO: 3862589 - DNA, 21 bp, Homo sapiens
aattttctgtgttctgaagtc

SEQ ID NO: 3862590 - DNA, 15 bp, Homo sapiens
aattttgtaacgaag

SEQ ID NO: 3862591 - DNA, 13 bp, Homo sapiens
aattttgtatatt

SEQ ID NO: 3862592 - DNA, 21 bp, Homo sapiens
aattttgtatattgtaggaat

SEQ ID NO: 3862593 - DNA, 13 bp, Homo sapiens
aatttttaaagta

SEQ ID NO: 3862594 - DNA, 11 bp, Homo sapiens
aatttttaatg

SEQ ID NO: 3862595 - DNA, 14 bp, Homo sapiens
aatttttaatgact

SEQ ID NO: 3862596 - DNA, 19 bp, Homo sapiens
aatttttaatgacttttta

SEQ ID NO: 3862597 - DNA, 13 bp, Homo sapiens
aatttttatacat

SEQ ID NO: 3862598 - DNA, 15 bp, Homo sapiens
aatttttatacatat

SEQ ID NO: 3862599 - DNA, 16 bp, Homo sapiens
aatttttatacatatc

SEQ ID NO: 3862600 - DNA, 20 bp, Homo sapiens
aatttttcagctctctgtat

SEQ ID NO: 3862601 - DNA, 20 bp, Homo sapiens
aatttttctcagtttgtata

SEQ ID NO: 3862602 - DNA, 12 bp, Homo sapiens
acaaaaataaca

SEQ ID NO: 3862603 - DNA, 15 bp, Homo sapiens
acaaaaattgactca

SEQ ID NO: 3862604 - DNA, 16 bp, Homo sapiens
acaaaacaacaacaat

SEQ ID NO: 3862605 - DNA, 16 bp, Homo sapiens
acaaaagaagattaaa

SEQ ID NO: 3862606 - DNA, 17 bp, Homo sapiens
acaaaaggcagcccttt

SEQ ID NO: 3862607 - DNA, 16 bp, Homo sapiens
acaaaagtaccataga

SEQ ID NO: 3862608 - DNA, 14 bp, Homo sapiens
acaaaataaacaaa

SEQ ID NO: 3862609 - DNA, 13 bp, Homo sapiens
acaaaatgaagtt

SEQ ID NO: 3862610 - DNA, 15 bp, Homo sapiens
acaaacacctcccag

SEQ ID NO: 3862611 - DNA, 23 bp, Homo sapiens
acaaacactgaatcatgttaata

SEQ ID NO: 3862612 - DNA, 19 bp, Homo sapiens
acaaaccacaactgacaca

SEQ ID NO: 3862613 - DNA, 20 bp, Homo sapiens
acaaaccacaactgacacag

SEQ ID NO: 3862614 - DNA, 23 bp, Homo sapiens
acaaaccacaactgacacaggaa

SEQ ID NO: 3862615 - DNA, 22 bp, Homo sapiens
acaaaccaccctaaaatgacag

SEQ ID NO: 3862616 - DNA, 23 bp, Homo sapiens
acaaaccaccctaaaatgacagc

SEQ ID NO: 3862617 - DNA, 13 bp, Homo sapiens
acaaaccactgta

SEQ ID NO: 3862618 - DNA, 16 bp, Homo sapiens
acaaaccactgtacat

SEQ ID NO: 3862619 - DNA, 14 bp, Homo sapiens
acaaaccatgcaaa

SEQ ID NO: 3862620 - DNA, 22 bp, Homo sapiens
acaaactgatgcgaaaacttga

SEQ ID NO: 3862621 - DNA, 21 bp, Homo sapiens
acaaagaacggcatgtgaatt

SEQ ID NO: 3862622 - DNA, 18 bp, Homo sapiens
acaaagcccttccatgtc

SEQ ID NO: 3862623 - DNA, 14 bp, Homo sapiens
acaaaggagcctgt

SEQ ID NO: 3862624 - DNA, 15 bp, Homo sapiens
acaaaggagcctgtg

SEQ ID NO: 3862625 - DNA, 16 bp, Homo sapiens
acaaaggagcctgtga

SEQ ID NO: 3862626 - DNA, 24 bp, Homo sapiens
acaaaggggagaagggccagccct

SEQ ID NO: 3862627 - DNA, 22 bp, Homo sapiens
acaaaggtgaaaattgtttgta

SEQ ID NO: 3862628 - DNA, 19 bp, Homo sapiens
acaaagttccaaaatgcca

SEQ ID NO: 3862629 - DNA, 20 bp, Homo sapiens
acaaatatttatatatttga

SEQ ID NO: 3862630 - DNA, 22 bp, Homo sapiens
acaaatatttattttctttctg

SEQ ID NO: 3862631 - DNA, 22 bp, Homo sapiens
acaaatcaccatgtaacaacca

SEQ ID NO: 3862632 - DNA, 15 bp, Homo sapiens
acaaatctatattaa

SEQ ID NO: 3862633 - DNA, 18 bp, Homo sapiens
acaaattgtaactacact

SEQ ID NO: 3862634 - DNA, 19 bp, Homo sapiens
acaacaataacaacaatgg

SEQ ID NO: 3862635 - DNA, 14 bp, Homo sapiens
acaacacaaagaga

SEQ ID NO: 3862636 - DNA, 14 bp, Homo sapiens
acaacagtaacaca

SEQ ID NO: 3862637 - DNA, 19 bp, Homo sapiens
acaacatccatgtcctatg

SEQ ID NO: 3862638 - DNA, 23 bp, Homo sapiens
acaacatccatgtcctatgtgtg

SEQ ID NO: 3862639 - DNA, 17 bp, Homo sapiens
acaacatcccacagtgg

SEQ ID NO: 3862640 - DNA, 21 bp, Homo sapiens
acaaccacctaatcaggctga

SEQ ID NO: 3862641 - DNA, 14 bp, Homo sapiens
acaaccagagcccc

SEQ ID NO: 3862642 - DNA, 15 bp, Homo sapiens
acaacctgcccctcc

SEQ ID NO: 3862643 - DNA, 13 bp, Homo sapiens
acaacctgtgcag

SEQ ID NO: 3862644 - DNA, 14 bp, Homo sapiens
acaactaatcaaga

SEQ ID NO: 3862645 - DNA, 21 bp, Homo sapiens
acaactccctgaacctcagtt

SEQ ID NO: 3862646 - DNA, 18 bp, Homo sapiens
acaactcttccatttatt

SEQ ID NO: 3862647 - DNA, 15 bp, Homo sapiens
acaactgacacagga

SEQ ID NO: 3862648 - DNA, 13 bp, Homo sapiens
acaagaaagaaac

SEQ ID NO: 3862649 - DNA, 16 bp, Homo sapiens
acaagaaatccctgtt

SEQ ID NO: 3862650 - DNA, 21 bp, Homo sapiens
acaagaaatccctgtttaata

SEQ ID NO: 3862651 - DNA, 18 bp, Homo sapiens
acaagaaatttgatttct

SEQ ID NO: 3862652 - DNA, 14 bp, Homo sapiens
acaagaagctgcta

SEQ ID NO: 3862653 - DNA, 17 bp, Homo sapiens
acaagaatcacctcaaa

SEQ ID NO: 3862654 - DNA, 17 bp, Homo sapiens
acaagagcgaaactccg

SEQ ID NO: 3862655 - DNA, 13 bp, Homo sapiens
acaagagctgctg

SEQ ID NO: 3862656 - DNA, 22 bp, Homo sapiens
acaagagtttatttccaaataa

SEQ ID NO: 3862657 - DNA, 18 bp, Homo sapiens
acaagataaaggaagtca

SEQ ID NO: 3862658 - DNA, 14 bp, Homo sapiens
acaagatctttcag

SEQ ID NO: 3862659 - DNA, 22 bp, Homo sapiens
acaagatggaaaataaattata

SEQ ID NO: 3862660 - DNA, 15 bp, Homo sapiens
acaagattcccagag

SEQ ID NO: 3862661 - DNA, 17 bp, Homo sapiens
acaagattcccagagac

SEQ ID NO: 3862662 - DNA, 13 bp, Homo sapiens
acaagcaataatt

SEQ ID NO: 3862663 - DNA, 17 bp, Homo sapiens
acaagcatatttgagaa

SEQ ID NO: 3862664 - DNA, 14 bp, Homo sapiens
acaagccaacttgt

SEQ ID NO: 3862665 - DNA, 16 bp, Homo sapiens
acaagcccaggctgga

SEQ ID NO: 3862666 - DNA, 11 bp, Homo sapiens
acaagccctgg

SEQ ID NO: 3862667 - DNA, 18 bp, Homo sapiens
acaagcctggcaacacac

SEQ ID NO: 3862668 - DNA, 17 bp, Homo sapiens
acaagccttactcacct

SEQ ID NO: 3862669 - DNA, 16 bp, Homo sapiens
acaagctggaagcaca

SEQ ID NO: 3862670 - DNA, 12 bp, Homo sapiens
acaagcttgtat

SEQ ID NO: 3862671 - DNA, 15 bp, Homo sapiens
acaagcttgtatata

SEQ ID NO: 3862672 - DNA, 22 bp, Homo sapiens
acaagcttgtatatacatatta

SEQ ID NO: 3862673 - DNA, 18 bp, Homo sapiens
acaaggacaatgccttgg

SEQ ID NO: 3862674 - DNA, 19 bp, Homo sapiens
acaaggaccctgttttcca

SEQ ID NO: 3862675 - DNA, 16 bp, Homo sapiens
acaaggcagcaaggcc

SEQ ID NO: 3862676 - DNA, 18 bp, Homo sapiens
acaaggcagcaaggcccg

SEQ ID NO: 3862677 - DNA, 21 bp, Homo sapiens
acaaggcagcaaggcccgagc

SEQ ID NO: 3862678 - DNA, 20 bp, Homo sapiens
acaaggctgaccaagagaga

SEQ ID NO: 3862679 - DNA, 22 bp, Homo sapiens
acaaggctgaccaagagagaaa

SEQ ID NO: 3862680 - DNA, 18 bp, Homo sapiens
acaaggggagggccagga

SEQ ID NO: 3862681 - DNA, 18 bp, Homo sapiens
acaaggggctgttacata

SEQ ID NO: 3862682 - DNA, 21 bp, Homo sapiens
acaaggggctgttacataaca

SEQ ID NO: 3862683 - DNA, 17 bp, Homo sapiens
acaagggtctagggaga

SEQ ID NO: 3862684 - DNA, 20 bp, Homo sapiens
acaagggtctagggagagac

SEQ ID NO: 3862685 - DNA, 19 bp, Homo sapiens
acaaggttccctctgagaa

SEQ ID NO: 3862686 - DNA, 21 bp, Homo sapiens
acaagtatgaataaagacacc

SEQ ID NO: 3862687 - DNA, 16 bp, Homo sapiens
acaagtcacagctgca

SEQ ID NO: 3862688 - DNA, 17 bp, Homo sapiens
acaagtcacagctgcag

SEQ ID NO: 3862689 - DNA, 22 bp, Homo sapiens
acaagtgagttgttgccctggg

SEQ ID NO: 3862690 - DNA, 13 bp, Homo sapiens
acaagtggagggg

SEQ ID NO: 3862691 - DNA, 16 bp, Homo sapiens
acaagttccagctggt

SEQ ID NO: 3862692 - DNA, 12 bp, Homo sapiens
acaagttttgta

SEQ ID NO: 3862693 - DNA, 21 bp, Homo sapiens
acaagttttgtataaataata

SEQ ID NO: 3862694 - DNA, 13 bp, Homo sapiens
acaataaatattc

SEQ ID NO: 3862695 - DNA, 21 bp, Homo sapiens
acaataaatgctgaatgaatc

SEQ ID NO: 3862696 - DNA, 11 bp, Homo sapiens
acaataattaa

SEQ ID NO: 3862697 - DNA, 12 bp, Homo sapiens
acaataatttca

SEQ ID NO: 3862698 - DNA, 13 bp, Homo sapiens
acaataatttcag

SEQ ID NO: 3862699 - DNA, 17 bp, Homo sapiens
acaatacaacaagaaca

SEQ ID NO: 3862700 - DNA, 20 bp, Homo sapiens
acaataccactggttaaaat

SEQ ID NO: 3862701 - DNA, 17 bp, Homo sapiens
acaatagctattgcatg

SEQ ID NO: 3862702 - DNA, 20 bp, Homo sapiens
acaatagctattgcatgtaa

SEQ ID NO: 3862703 - DNA, 10 bp, Homo sapiens
acaatatata

SEQ ID NO: 3862704 - DNA, 16 bp, Homo sapiens
acaatatgattttaaa

SEQ ID NO: 3862705 - DNA, 20 bp, Homo sapiens
acaatcatgagtcagacatt

SEQ ID NO: 3862706 - DNA, 18 bp, Homo sapiens
acaatcatttgctttttg

SEQ ID NO: 3862707 - DNA, 16 bp, Homo sapiens
acaatctgggactttc

SEQ ID NO: 3862708 - DNA, 21 bp, Homo sapiens
acaatgatgattaaacacctg

SEQ ID NO: 3862709 - DNA, 22 bp, Homo sapiens
acaatgatgattaaacacctga

SEQ ID NO: 3862710 - DNA, 13 bp, Homo sapiens
acaatgcctctcc

SEQ ID NO: 3862711 - DNA, 18 bp, Homo sapiens
acaatgcctctcccacga

SEQ ID NO: 3862712 - DNA, 19 bp, Homo sapiens
acaatggtttacatgaaca

SEQ ID NO: 3862713 - DNA, 22 bp, Homo sapiens
acaatggtttacatgaacacag

SEQ ID NO: 3862714 - DNA, 18 bp, Homo sapiens
acaattactaaattgtat

SEQ ID NO: 3862715 - DNA, 17 bp, Homo sapiens
acaattatggaaatata

SEQ ID NO: 3862716 - DNA, 14 bp, Homo sapiens
acaattccaaagga

SEQ ID NO: 3862717 - DNA, 19 bp, Homo sapiens
acaattgtccatggtctca

SEQ ID NO: 3862718 - DNA, 13 bp, Homo sapiens
acaatttagaaaa

SEQ ID NO: 3862719 - DNA, 14 bp, Homo sapiens
acaatttagaaaac

SEQ ID NO: 3862720 - DNA, 17 bp, Homo sapiens
acaatttcctttatatt

SEQ ID NO: 3862721 - DNA, 17 bp, Homo sapiens
acaatttgagcaattca

SEQ ID NO: 3862722 - DNA, 15 bp, Homo sapiens
acaatttgcactgtt

SEQ ID NO: 3862723 - DNA, 22 bp, Homo sapiens
acaatttgcactgttacttttt

SEQ ID NO: 3862724 - DNA, 19 bp, Homo sapiens
acacaaaccacaactgaca

SEQ ID NO: 3862725 - DNA, 13 bp, Homo sapiens
acacaagccacag

SEQ ID NO: 3862726 - DNA, 15 bp, Homo sapiens
acacaagccacagaa

SEQ ID NO: 3862727 - DNA, 16 bp, Homo sapiens
acacaagccacagaag

SEQ ID NO: 3862728 - DNA, 14 bp, Homo sapiens
acacaagctggaag

SEQ ID NO: 3862729 - DNA, 13 bp, Homo sapiens
acacaaggctggg

SEQ ID NO: 3862730 - DNA, 21 bp, Homo sapiens
acacaagtttgtgctatctat

SEQ ID NO: 3862731 - DNA, 20 bp, Homo sapiens
acacaattgatacttcaggt

SEQ ID NO: 3862732 - DNA, 14 bp, Homo sapiens
acacacacacacac

SEQ ID NO: 3862733 - DNA, 13 bp, Homo sapiens
acacacacacata

SEQ ID NO: 3862734 - DNA, 11 bp, Homo sapiens
acacacagctc

SEQ ID NO: 3862735 - DNA, 15 bp, Homo sapiens
acacacatatacata

SEQ ID NO: 3862736 - DNA, 18 bp, Homo sapiens
acacacatggatgagcac

SEQ ID NO: 3862737 - DNA, 17 bp, Homo sapiens
acacaccggtcaccgag

SEQ ID NO: 3862738 - DNA, 20 bp, Homo sapiens
acacacgcaggaactcccag

SEQ ID NO: 3862739 - DNA, 15 bp, Homo sapiens
acacactcaaatcaa

SEQ ID NO: 3862740 - DNA, 20 bp, Homo sapiens
acacactcaaatcaagaaac

SEQ ID NO: 3862741 - DNA, 18 bp, Homo sapiens
acacactgtaaacccctg

SEQ ID NO: 3862742 - DNA, 20 bp, Homo sapiens
acacagagtggagccctcag

SEQ ID NO: 3862743 - DNA, 15 bp, Homo sapiens
acacagatatgcaca

SEQ ID NO: 3862744 - DNA, 13 bp, Homo sapiens
acacagcagcccc

SEQ ID NO: 3862745 - DNA, 16 bp, Homo sapiens
acacagccattataaa

SEQ ID NO: 3862746 - DNA, 24 bp, Homo sapiens
acacaggatcctattctcaccagg

SEQ ID NO: 3862747 - DNA, 20 bp, Homo sapiens
acacaggcatttcctgggtg

SEQ ID NO: 3862748 - DNA, 13 bp, Homo sapiens
aagggccaggaga

SEQ ID NO: 3862749 - DNA, 15 bp, Homo sapiens
aagggccaggagaga

SEQ ID NO: 3862750 - DNA, 14 bp, Homo sapiens
aagggccagtctgg

SEQ ID NO: 3862751 - DNA, 19 bp, Homo sapiens
aagggctagaacctggaga

SEQ ID NO: 3862752 - DNA, 13 bp, Homo sapiens
aagggctccagca

SEQ ID NO: 3862753 - DNA, 19 bp, Homo sapiens
aaggggacgcgggctgtgc

SEQ ID NO: 3862754 - DNA, 12 bp, Homo sapiens
aaggggagaagg

SEQ ID NO: 3862755 - DNA, 13 bp, Homo sapiens
aaggggagttgag

SEQ ID NO: 3862756 - DNA, 13 bp, Homo sapiens
aaggggcacctgg

SEQ ID NO: 3862757 - DNA, 16 bp, Homo sapiens
aaggggccccggggct

SEQ ID NO: 3862758 - DNA, 18 bp, Homo sapiens
aaggggccccggggctgg

SEQ ID NO: 3862759 - DNA, 16 bp, Homo sapiens
aaggggcgagcaccca

SEQ ID NO: 3862760 - DNA, 18 bp, Homo sapiens
aagggggtcaaaggaaga

SEQ ID NO: 3862761 - DNA, 20 bp, Homo sapiens
aaggggttggttgaggtgga

SEQ ID NO: 3862762 - DNA, 20 bp, Homo sapiens
aagggtctagggagagaccc

SEQ ID NO: 3862763 - DNA, 20 bp, Homo sapiens
aagggtctgttgtaaatgac

SEQ ID NO: 3862764 - DNA, 19 bp, Homo sapiens
aagggtgatgggaaagcat

SEQ ID NO: 3862765 - DNA, 23 bp, Homo sapiens
aagggtggggttttatgtgtggg

SEQ ID NO: 3862766 - DNA, 16 bp, Homo sapiens
aaggtagagatgtgtg

SEQ ID NO: 3862767 - DNA, 17 bp, Homo sapiens
aaggtagagatgtgtgt

SEQ ID NO: 3862768 - DNA, 11 bp, Homo sapiens
aaggtataatt

SEQ ID NO: 3862769 - DNA, 18 bp, Homo sapiens
aaggtattaaattgatgt

SEQ ID NO: 3862770 - DNA, 22 bp, Homo sapiens
aaggtattaaattgatgttgct

SEQ ID NO: 3862771 - DNA, 13 bp, Homo sapiens
aaggtcatcatcg

SEQ ID NO: 3862772 - DNA, 22 bp, Homo sapiens
aaggtctccttactctgagccc

SEQ ID NO: 3862773 - DNA, 23 bp, Homo sapiens
aaggtctccttactctgagccca

SEQ ID NO: 3862774 - DNA, 20 bp, Homo sapiens
aaggtctgggagtgttctgt

SEQ ID NO: 3862775 - DNA, 20 bp, Homo sapiens
aaggtgcctgtgaggcaggg

SEQ ID NO: 3862776 - DNA, 13 bp, Homo sapiens
aaggtgctaggat

SEQ ID NO: 3862777 - DNA, 24 bp, Homo sapiens
aaggtgggtccaggaaggcagctg

SEQ ID NO: 3862778 - DNA, 23 bp, Homo sapiens
aaggtggtctgcttttgctgggg

SEQ ID NO: 3862779 - DNA, 17 bp, Homo sapiens
aaggttcttcatccctt

SEQ ID NO: 3862780 - DNA, 18 bp, Homo sapiens
aaggtttggtccagcctg

SEQ ID NO: 3862781 - DNA, 14 bp, Homo sapiens
aaggttttctccac

SEQ ID NO: 3862782 - DNA, 15 bp, Homo sapiens
aagtaaaaaaatatg

SEQ ID NO: 3862783 - DNA, 15 bp, Homo sapiens
aagtaaaagctaatt

SEQ ID NO: 3862784 - DNA, 13 bp, Homo sapiens
aagtaaaccaaaa

SEQ ID NO: 3862785 - DNA, 21 bp, Homo sapiens
aagtaagagctaagttctaag

SEQ ID NO: 3862786 - DNA, 16 bp, Homo sapiens
aagtaatataatggaa

SEQ ID NO: 3862787 - DNA, 23 bp, Homo sapiens
aagtaatataatggaagagaaat

SEQ ID NO: 3862788 - DNA, 14 bp, Homo sapiens
aagtaattcctctc

SEQ ID NO: 3862789 - DNA, 18 bp, Homo sapiens
aagtaattgcatttctgc

SEQ ID NO: 3862790 - DNA, 20 bp, Homo sapiens
aagtaattgcatttctgctc

SEQ ID NO: 3862791 - DNA, 13 bp, Homo sapiens
aagtacatttaat

SEQ ID NO: 3862792 - DNA, 20 bp, Homo sapiens
aagtactgctgtaaataaat

SEQ ID NO: 3862793 - DNA, 23 bp, Homo sapiens
aagtactgctgtaaataaatgct

SEQ ID NO: 3862794 - DNA, 14 bp, Homo sapiens
aagtagaagaggag

SEQ ID NO: 3862795 - DNA, 19 bp, Homo sapiens
aagtagaattatatctaat

SEQ ID NO: 3862796 - DNA, 22 bp, Homo sapiens
aagtagaattatatctaattta

SEQ ID NO: 3862797 - DNA, 16 bp, Homo sapiens
aagtatatagtatatt

SEQ ID NO: 3862798 - DNA, 22 bp, Homo sapiens
aagtatatagtatatttatact

SEQ ID NO: 3862799 - DNA, 11 bp, Homo sapiens
aagtatcatgc

SEQ ID NO: 3862800 - DNA, 12 bp, Homo sapiens
aagtatgtaaag

SEQ ID NO: 3862801 - DNA, 18 bp, Homo sapiens
aagtattgcgaatgtgca

SEQ ID NO: 3862802 - DNA, 11 bp, Homo sapiens
aagtatttagg

SEQ ID NO: 3862803 - DNA, 16 bp, Homo sapiens
aagtatttaggttttt

SEQ ID NO: 3862804 - DNA, 16 bp, Homo sapiens
aagtcaaaaggtgcct

SEQ ID NO: 3862805 - DNA, 19 bp, Homo sapiens
aagtcaacactcttcttga

SEQ ID NO: 3862806 - DNA, 17 bp, Homo sapiens
aagtcacagctgcagct

SEQ ID NO: 3862807 - DNA, 22 bp, Homo sapiens
aagtcactgcacagtgcatctc

SEQ ID NO: 3862808 - DNA, 20 bp, Homo sapiens
aagtcagctttcagagccag

SEQ ID NO: 3862809 - DNA, 21 bp, Homo sapiens
aagtcaggcccttattttcaa

SEQ ID NO: 3862810 - DNA, 18 bp, Homo sapiens
aagtcagtgggaacgtga

SEQ ID NO: 3862811 - DNA, 13 bp, Homo sapiens
aagtccaggtcct

SEQ ID NO: 3862812 - DNA, 15 bp, Homo sapiens
aagtccaggtcctgg

SEQ ID NO: 3862813 - DNA, 16 bp, Homo sapiens
aagtccccaggtcatg

SEQ ID NO: 3862814 - DNA, 15 bp, Homo sapiens
aagtcgaattaatag

SEQ ID NO: 3862815 - DNA, 21 bp, Homo sapiens
aagtcgtccttactcctgtgg

SEQ ID NO: 3862816 - DNA, 15 bp, Homo sapiens
aagtcgttgtgaggg

SEQ ID NO: 3862817 - DNA, 19 bp, Homo sapiens
aagtcgtttcaggacatgg

SEQ ID NO: 3862818 - DNA, 17 bp, Homo sapiens
aagtctaaagtttacag

SEQ ID NO: 3862819 - DNA, 22 bp, Homo sapiens
aagtctaggagctgggaggaaa

SEQ ID NO: 3862820 - DNA, 19 bp, Homo sapiens
aagtctccaagaatacaga

SEQ ID NO: 3862821 - DNA, 21 bp, Homo sapiens
aagtctccaagaatacagaaa

SEQ ID NO: 3862822 - DNA, 15 bp, Homo sapiens
aagtctctgctgcta

SEQ ID NO: 3862823 - DNA, 21 bp, Homo sapiens
aagtctctttttttactctta

SEQ ID NO: 3862824 - DNA, 18 bp, Homo sapiens
aagtctggatctgggacc

SEQ ID NO: 3862825 - DNA, 17 bp, Homo sapiens
aagtcttacttaaaaaa

SEQ ID NO: 3862826 - DNA, 22 bp, Homo sapiens
aagtcttccctgatcaagtcac

SEQ ID NO: 3862827 - DNA, 18 bp, Homo sapiens
aagtgaaggagaaaggag

SEQ ID NO: 3862828 - DNA, 18 bp, Homo sapiens
aagtgaataaacttcagc

SEQ ID NO: 3862829 - DNA, 18 bp, Homo sapiens
aagtgaatacttggaagt

SEQ ID NO: 3862830 - DNA, 13 bp, Homo sapiens
aagtgacatgcca

SEQ ID NO: 3862831 - DNA, 15 bp, Homo sapiens
aagtgactctcagcg

SEQ ID NO: 3862832 - DNA, 18 bp, Homo sapiens
aagtgagggctgggcagc

SEQ ID NO: 3862833 - DNA, 14 bp, Homo sapiens
aagtgatatatgta

SEQ ID NO: 3862834 - DNA, 23 bp, Homo sapiens
acacaggcatttcctgggtggct

SEQ ID NO: 3862835 - DNA, 22 bp, Homo sapiens
acacagtaaaaacttgtactat

SEQ ID NO: 3862836 - DNA, 20 bp, Homo sapiens
acacagtgggaactctgaca

SEQ ID NO: 3862837 - DNA, 20 bp, Homo sapiens
acacagtgggtggtggatct

SEQ ID NO: 3862838 - DNA, 23 bp, Homo sapiens
acacagtgttccagctgcctggg

SEQ ID NO: 3862839 - DNA, 17 bp, Homo sapiens
acacatacatacacata

SEQ ID NO: 3862840 - DNA, 18 bp, Homo sapiens
acacatacatacacatac

SEQ ID NO: 3862841 - DNA, 20 bp, Homo sapiens
acacatagattaatggcact

SEQ ID NO: 3862842 - DNA, 13 bp, Homo sapiens
acacatatacata

SEQ ID NO: 3862843 - DNA, 21 bp, Homo sapiens
acacatatacctataatgtgt

SEQ ID NO: 3862844 - DNA, 23 bp, Homo sapiens
acacatatacctataatgtgtgt

SEQ ID NO: 3862845 - DNA, 14 bp, Homo sapiens
acacatcaaatgcc

SEQ ID NO: 3862846 - DNA, 15 bp, Homo sapiens
acacatcaaatgccc

SEQ ID NO: 3862847 - DNA, 17 bp, Homo sapiens
acacatcccggcctctt

SEQ ID NO: 3862848 - DNA, 17 bp, Homo sapiens
acacatccctaatgtgt

SEQ ID NO: 3862849 - DNA, 20 bp, Homo sapiens
acacatccctaatgtgtgcc

SEQ ID NO: 3862850 - DNA, 15 bp, Homo sapiens
acacattacttgcac

SEQ ID NO: 3862851 - DNA, 16 bp, Homo sapiens
acacattacttgcaca

SEQ ID NO: 3862852 - DNA, 18 bp, Homo sapiens
acacattacttgcacaag

SEQ ID NO: 3862853 - DNA, 17 bp, Homo sapiens
acacattctcctgtgcc

SEQ ID NO: 3862854 - DNA, 17 bp, Homo sapiens
acacattttctcctagg

SEQ ID NO: 3862855 - DNA, 22 bp, Homo sapiens
acacattttctcctaggagaag

SEQ ID NO: 3862856 - DNA, 13 bp, Homo sapiens
acaccaaaaaaat

SEQ ID NO: 3862857 - DNA, 18 bp, Homo sapiens
acaccacctcactcctgt

SEQ ID NO: 3862858 - DNA, 16 bp, Homo sapiens
acaccactctggcagc

SEQ ID NO: 3862859 - DNA, 19 bp, Homo sapiens
acaccactttgtctctgag

SEQ ID NO: 3862860 - DNA, 14 bp, Homo sapiens
acaccatgaatctt

SEQ ID NO: 3862861 - DNA, 11 bp, Homo sapiens
acacccactgg

SEQ ID NO: 3862862 - DNA, 13 bp, Homo sapiens
acacccactggcc

SEQ ID NO: 3862863 - DNA, 12 bp, Homo sapiens
acacccctgtgc

SEQ ID NO: 3862864 - DNA, 20 bp, Homo sapiens
acaccccttatccaggactc

SEQ ID NO: 3862865 - DNA, 17 bp, Homo sapiens
acacccgactcctcaaa

SEQ ID NO: 3862866 - DNA, 24 bp, Homo sapiens
acaccgagtctctgtataatctat

SEQ ID NO: 3862867 - DNA, 18 bp, Homo sapiens
acacctaccaaaaaataa

SEQ ID NO: 3862868 - DNA, 15 bp, Homo sapiens
acacctaccatgctg

SEQ ID NO: 3862869 - DNA, 14 bp, Homo sapiens
acacctccctactc

SEQ ID NO: 3862870 - DNA, 22 bp, Homo sapiens
acacctccctactcccctgggc

SEQ ID NO: 3862871 - DNA, 13 bp, Homo sapiens
acacctccctgaa

SEQ ID NO: 3862872 - DNA, 16 bp, Homo sapiens
acacctccctgaacca

SEQ ID NO: 3862873 - DNA, 22 bp, Homo sapiens
acacctcctagcaagacctgtt

SEQ ID NO: 3862874 - DNA, 17 bp, Homo sapiens
acacctctggatccctg

SEQ ID NO: 3862875 - DNA, 12 bp, Homo sapiens
acacctgacaca

SEQ ID NO: 3862876 - DNA, 17 bp, Homo sapiens
acacctgagccagcctg

SEQ ID NO: 3862877 - DNA, 12 bp, Homo sapiens
acacctgcacct

SEQ ID NO: 3862878 - DNA, 16 bp, Homo sapiens
acacctgcacctcccc

SEQ ID NO: 3862879 - DNA, 14 bp, Homo sapiens
acacctgccccagc

SEQ ID NO: 3862880 - DNA, 15 bp, Homo sapiens
acacctgccccagcg

SEQ ID NO: 3862881 - DNA, 19 bp, Homo sapiens
acacctgccccagcgcggc

SEQ ID NO: 3862882 - DNA, 12 bp, Homo sapiens
acacctgccctg

SEQ ID NO: 3862883 - DNA, 17 bp, Homo sapiens
acaccttcttggcttct

SEQ ID NO: 3862884 - DNA, 16 bp, Homo sapiens
acacgcaagggcatca

SEQ ID NO: 3862885 - DNA, 24 bp, Homo sapiens
acacgcaagggcatcaggcactgg

SEQ ID NO: 3862886 - DNA, 19 bp, Homo sapiens
acacgcttaaaacctagaa

SEQ ID NO: 3862887 - DNA, 17 bp, Homo sapiens
acacggcagctgtagct

SEQ ID NO: 3862888 - DNA, 16 bp, Homo sapiens
acacggggtattttag

SEQ ID NO: 3862889 - DNA, 18 bp, Homo sapiens
acacggtgaaatccaggt

SEQ ID NO: 3862890 - DNA, 22 bp, Homo sapiens
acacggtgaaatccaggtctcg

SEQ ID NO: 3862891 - DNA, 21 bp, Homo sapiens
acacgtatttatatttggaaa

SEQ ID NO: 3862892 - DNA, 23 bp, Homo sapiens
acacgtatttatatttggaaaga

SEQ ID NO: 3862893 - DNA, 14 bp, Homo sapiens
acactaaaaataaa

SEQ ID NO: 3862894 - DNA, 19 bp, Homo sapiens
acactaagttatagtatat

SEQ ID NO: 3862895 - DNA, 23 bp, Homo sapiens
acactaagttatagtatatctgg

SEQ ID NO: 3862896 - DNA, 23 bp, Homo sapiens
acactaattcctttctatcctac

SEQ ID NO: 3862897 - DNA, 15 bp, Homo sapiens
acactagcctctcca

SEQ ID NO: 3862898 - DNA, 18 bp, Homo sapiens
acactagttttgtgccag

SEQ ID NO: 3862899 - DNA, 17 bp, Homo sapiens
acactattgcattgttc

SEQ ID NO: 3862900 - DNA, 13 bp, Homo sapiens
acactcaaatcaa

SEQ ID NO: 3862901 - DNA, 15 bp, Homo sapiens
acactcagaagcctg

SEQ ID NO: 3862902 - DNA, 20 bp, Homo sapiens
acactcagaagcctgggggc

SEQ ID NO: 3862903 - DNA, 14 bp, Homo sapiens
acactcagcagccc

SEQ ID NO: 3862904 - DNA, 20 bp, Homo sapiens
acactctagtgacttcctgg

SEQ ID NO: 3862905 - DNA, 22 bp, Homo sapiens
acactctctgtacaaaaacaaa

SEQ ID NO: 3862906 - DNA, 20 bp, Homo sapiens
acactcttcttgagcagacc

SEQ ID NO: 3862907 - DNA, 15 bp, Homo sapiens
acactgctgcaccag

SEQ ID NO: 3862908 - DNA, 20 bp, Homo sapiens
acactggaaaataaattttg

SEQ ID NO: 3862909 - DNA, 11 bp, Homo sapiens
acactggatat

SEQ ID NO: 3862910 - DNA, 18 bp, Homo sapiens
acactgtaaatatccaca

SEQ ID NO: 3862911 - DNA, 14 bp, Homo sapiens
acactgtaatctta

SEQ ID NO: 3862912 - DNA, 15 bp, Homo sapiens
acactgtcagagctg

SEQ ID NO: 3862913 - DNA, 16 bp, Homo sapiens
acactgtcagagctgt

SEQ ID NO: 3862914 - DNA, 23 bp, Homo sapiens
acactgtcagagctgttggcctc

SEQ ID NO: 3862915 - DNA, 14 bp, Homo sapiens
acactgtcatccgt

SEQ ID NO: 3862916 - DNA, 13 bp, Homo sapiens
acactgtgctata

SEQ ID NO: 3862917 - DNA, 19 bp, Homo sapiens
acacttcaggctcttctcc

SEQ ID NO: 3862918 - DNA, 24 bp, Homo sapiens
acacttctcaggacacaggcctgt

SEQ ID NO: 3862919 - DNA, 15 bp, Homo sapiens
acacttggagcccgt

SEQ ID NO: 3862920 - DNA, 21 bp, Homo sapiens
cagcctccccctgctgctcat

SEQ ID NO: 3862921 - DNA, 13 bp, Homo sapiens
cagcctcctcctg

SEQ ID NO: 3862922 - DNA, 15 bp, Homo sapiens
cagcctcctcctgac

SEQ ID NO: 3862923 - DNA, 12 bp, Homo sapiens
cagcctctcccg

SEQ ID NO: 3862924 - DNA, 13 bp, Homo sapiens
cagcctctcccgg

SEQ ID NO: 3862925 - DNA, 15 bp, Homo sapiens
cagcctctctgctat

SEQ ID NO: 3862926 - DNA, 21 bp, Homo sapiens
cagcctcttaaagctgcctgt

SEQ ID NO: 3862927 - DNA, 16 bp, Homo sapiens
cagcctcttccccacc

SEQ ID NO: 3862928 - DNA, 17 bp, Homo sapiens
cagcctgagtctcctgt

SEQ ID NO: 3862929 - DNA, 19 bp, Homo sapiens
cagcctgagtctcctgtgc

SEQ ID NO: 3862930 - DNA, 22 bp, Homo sapiens
cagcctgagtctcctgtgccca

SEQ ID NO: 3862931 - DNA, 20 bp, Homo sapiens
cagcctgccgccgtctctgt

SEQ ID NO: 3862932 - DNA, 21 bp, Homo sapiens
cagcctgctccttcccaggag

SEQ ID NO: 3862933 - DNA, 10 bp, Homo sapiens
cagcctggca

SEQ ID NO: 3862934 - DNA, 13 bp, Homo sapiens
cagcctggcacag

SEQ ID NO: 3862935 - DNA, 11 bp, Homo sapiens
cagcctggcct

SEQ ID NO: 3862936 - DNA, 12 bp, Homo sapiens
cagcctggcctc

SEQ ID NO: 3862937 - DNA, 13 bp, Homo sapiens
cagcctggcctcc

SEQ ID NO: 3862938 - DNA, 14 bp, Homo sapiens
cagcctggcctcct

SEQ ID NO: 3862939 - DNA, 15 bp, Homo sapiens
cagcctggcggggca

SEQ ID NO: 3862940 - DNA, 16 bp, Homo sapiens
cagcctggcggggcag

SEQ ID NO: 3862941 - DNA, 18 bp, Homo sapiens
cagcctggcggggcagga

SEQ ID NO: 3862942 - DNA, 19 bp, Homo sapiens
cagcctggcggggcaggag

SEQ ID NO: 3862943 - DNA, 20 bp, Homo sapiens
cagcctggcggggcaggagg

SEQ ID NO: 3862944 - DNA, 23 bp, Homo sapiens
cagcctggcggggcaggaggcct

SEQ ID NO: 3862945 - DNA, 11 bp, Homo sapiens
cagcctgggcc

SEQ ID NO: 3862946 - DNA, 23 bp, Homo sapiens
cagcctgggcctatggagagccc

SEQ ID NO: 3862947 - DNA, 14 bp, Homo sapiens
cagcctgggtgacg

SEQ ID NO: 3862948 - DNA, 18 bp, Homo sapiens
cagcctggtagaattggg

SEQ ID NO: 3862949 - DNA, 17 bp, Homo sapiens
cagcctgtcctggtaca

SEQ ID NO: 3862950 - DNA, 18 bp, Homo sapiens
cagcctgtggcggtgcct

SEQ ID NO: 3862951 - DNA, 21 bp, Homo sapiens
cagcctgtggcggtgcctggg

SEQ ID NO: 3862952 - DNA, 22 bp, Homo sapiens
cagcctgtggcggtgcctgggt

SEQ ID NO: 3862953 - DNA, 24 bp, Homo sapiens
cagccttcataggcggtcatgtgt

SEQ ID NO: 3862954 - DNA, 22 bp, Homo sapiens
cagccttgcactgtgggggctg

SEQ ID NO: 3862955 - DNA, 22 bp, Homo sapiens
cagcgattccctctcccaggcc

SEQ ID NO: 3862956 - DNA, 23 bp, Homo sapiens
cagcgattccctctcccaggccc

SEQ ID NO: 3862957 - DNA, 17 bp, Homo sapiens
cagcgcagccgccgggc

SEQ ID NO: 3862958 - DNA, 23 bp, Homo sapiens
cagcgcctagtggggtctccctc

SEQ ID NO: 3862959 - DNA, 15 bp, Homo sapiens
cagcgcctgccctcc

SEQ ID NO: 3862960 - DNA, 20 bp, Homo sapiens
cagcgcctgccctccctggg

SEQ ID NO: 3862961 - DNA, 23 bp, Homo sapiens
cagcgcctgccctccctggggtc

SEQ ID NO: 3862962 - DNA, 22 bp, Homo sapiens
cagcgcctgtgctgaggactcc

SEQ ID NO: 3862963 - DNA, 20 bp, Homo sapiens
cagcgcgggcggaggcggct

SEQ ID NO: 3862964 - DNA, 21 bp, Homo sapiens
cagcgcgtgcacagcgcgggc

SEQ ID NO: 3862965 - DNA, 15 bp, Homo sapiens
cagcggcccctgcat

SEQ ID NO: 3862966 - DNA, 14 bp, Homo sapiens
cagcgtcccctgct

SEQ ID NO: 3862967 - DNA, 14 bp, Homo sapiens
cagcgtggccttgt

SEQ ID NO: 3862968 - DNA, 22 bp, Homo sapiens
cagcgtttagtttctagaggcc

SEQ ID NO: 3862969 - DNA, 18 bp, Homo sapiens
cagctaaagcccaacctc

SEQ ID NO: 3862970 - DNA, 23 bp, Homo sapiens
cagctaactccagtctcctgaca

SEQ ID NO: 3862971 - DNA, 15 bp, Homo sapiens
cagctaagctaggaa

SEQ ID NO: 3862972 - DNA, 21 bp, Homo sapiens
cagctacattcctcagctgcc

SEQ ID NO: 3862973 - DNA, 16 bp, Homo sapiens
cagctactctgtccag

SEQ ID NO: 3862974 - DNA, 18 bp, Homo sapiens
cagctactctgtccaggc

SEQ ID NO: 3862975 - DNA, 19 bp, Homo sapiens
cagctactctgtccaggcc

SEQ ID NO: 3862976 - DNA, 23 bp, Homo sapiens
cagctactctgtccaggccactg

SEQ ID NO: 3862977 - DNA, 19 bp, Homo sapiens
cagctactgatttttgtga

SEQ ID NO: 3862978 - DNA, 18 bp, Homo sapiens
cagctagactggagtgag

SEQ ID NO: 3862979 - DNA, 12 bp, Homo sapiens
cagctaggactg

SEQ ID NO: 3862980 - DNA, 14 bp, Homo sapiens
cagctagggctgga

SEQ ID NO: 3862981 - DNA, 13 bp, Homo sapiens
cagctagtgaccc

SEQ ID NO: 3862982 - DNA, 19 bp, Homo sapiens
cagctagtgacccacatgc

SEQ ID NO: 3862983 - DNA, 21 bp, Homo sapiens
cagctagtgacccacatgcca

SEQ ID NO: 3862984 - DNA, 14 bp, Homo sapiens
cagctatctgtcat

SEQ ID NO: 3862985 - DNA, 17 bp, Homo sapiens
cagctatgcactgtaaa

SEQ ID NO: 3862986 - DNA, 21 bp, Homo sapiens
cagctatggccccagggttga

SEQ ID NO: 3862987 - DNA, 13 bp, Homo sapiens
cagctcaagtctt

SEQ ID NO: 3862988 - DNA, 19 bp, Homo sapiens
cagctcaagtcttccctga

SEQ ID NO: 3862989 - DNA, 15 bp, Homo sapiens
cagctcacaagccca

SEQ ID NO: 3862990 - DNA, 16 bp, Homo sapiens
cagctcacaagcccag

SEQ ID NO: 3862991 - DNA, 17 bp, Homo sapiens
cagctcacaagcccagg

SEQ ID NO: 3862992 - DNA, 19 bp, Homo sapiens
cagctcacctctgaaggca

SEQ ID NO: 3862993 - DNA, 11 bp, Homo sapiens
cagctcagaga

SEQ ID NO: 3862994 - DNA, 13 bp, Homo sapiens
cagctcagagatg

SEQ ID NO: 3862995 - DNA, 14 bp, Homo sapiens
cagctcagcctccc

SEQ ID NO: 3862996 - DNA, 22 bp, Homo sapiens
cagctcagcctccccctgctgc

SEQ ID NO: 3862997 - DNA, 13 bp, Homo sapiens
cagctcaggtgac

SEQ ID NO: 3862998 - DNA, 14 bp, Homo sapiens
cagctccaacagct

SEQ ID NO: 3862999 - DNA, 20 bp, Homo sapiens
cagctccaacagcttgacca

SEQ ID NO: 3863000 - DNA, 22 bp, Homo sapiens
cagctccaacagcttgaccaga

SEQ ID NO: 3863001 - DNA, 16 bp, Homo sapiens
cagctccagaatacct

SEQ ID NO: 3863002 - DNA, 10 bp, Homo sapiens
cagctccagt

SEQ ID NO: 3863003 - DNA, 23 bp, Homo sapiens
cagctccagtttccaagttcctg

SEQ ID NO: 3863004 - DNA, 21 bp, Homo sapiens
cagctcccaaggctctgagca

SEQ ID NO: 3863005 - DNA, 19 bp, Homo sapiens
cagctcccaccccaccccc

SEQ ID NO: 3863006 - DNA, 20 bp, Homo sapiens
cagctcccaccccaccccct

SEQ ID NO: 3863007 - DNA, 23 bp, Homo sapiens
cagctcccaccccacccccttca

SEQ ID NO: 3863008 - DNA, 21 bp, Homo sapiens
cagctcccatagcgctggctc

SEQ ID NO: 3863009 - DNA, 17 bp, Homo sapiens
cagctcccctcggagaa

SEQ ID NO: 3863010 - DNA, 18 bp, Homo sapiens
cagctcccctcggagaag

SEQ ID NO: 3863011 - DNA, 20 bp, Homo sapiens
cagctcccttcccctgcctg

SEQ ID NO: 3863012 - DNA, 17 bp, Homo sapiens
cagctccgcctctgtcc

SEQ ID NO: 3863013 - DNA, 14 bp, Homo sapiens
cagctcctctcctt

SEQ ID NO: 3863014 - DNA, 17 bp, Homo sapiens
cagctcctctccttggg

SEQ ID NO: 3863015 - DNA, 18 bp, Homo sapiens
cagctcctctccttgggc

SEQ ID NO: 3863016 - DNA, 19 bp, Homo sapiens
cagctcctctccttgggct

SEQ ID NO: 3863017 - DNA, 22 bp, Homo sapiens
cagctcctctccttgggctcct

SEQ ID NO: 3863018 - DNA, 23 bp, Homo sapiens
cagctcctctccttgggctcctg

SEQ ID NO: 3863019 - DNA, 18 bp, Homo sapiens
cagctcctctgtctcgag

SEQ ID NO: 3863020 - DNA, 12 bp, Homo sapiens
cagctcctctta

SEQ ID NO: 3863021 - DNA, 23 bp, Homo sapiens
cagctccttttgtccccagggcc

SEQ ID NO: 3863022 - DNA, 15 bp, Homo sapiens
cagctctactggtct

SEQ ID NO: 3863023 - DNA, 20 bp, Homo sapiens
cagctctagacactgccaca

SEQ ID NO: 3863024 - DNA, 15 bp, Homo sapiens
cagctctccctctgg

SEQ ID NO: 3863025 - DNA, 19 bp, Homo sapiens
cagctctccctctggccct

SEQ ID NO: 3863026 - DNA, 16 bp, Homo sapiens
cagctctctgtataaa

SEQ ID NO: 3863027 - DNA, 16 bp, Homo sapiens
cagctctgctttttcc

SEQ ID NO: 3863028 - DNA, 14 bp, Homo sapiens
cagctctgtggcct

SEQ ID NO: 3863029 - DNA, 20 bp, Homo sapiens
cagctcttcactcagccaca

SEQ ID NO: 3863030 - DNA, 21 bp, Homo sapiens
cagctcttcactcagccacac

SEQ ID NO: 3863031 - DNA, 23 bp, Homo sapiens
cagctcttcactcagccacaccc

SEQ ID NO: 3863032 - DNA, 22 bp, Homo sapiens
cagctgaaacattccgaagagg

SEQ ID NO: 3863033 - DNA, 15 bp, Homo sapiens
cagctgaacagccaa

SEQ ID NO: 3863034 - DNA, 13 bp, Homo sapiens
cagctgacagctg

SEQ ID NO: 3863035 - DNA, 21 bp, Homo sapiens
cagctgagagacttttaatca

SEQ ID NO: 3863036 - DNA, 13 bp, Homo sapiens
cagctgaggctgg

SEQ ID NO: 3863037 - DNA, 23 bp, Homo sapiens
cagctgagtgaaaaatctgtgga

SEQ ID NO: 3863038 - DNA, 21 bp, Homo sapiens
cagctgatattatggcaagtg

SEQ ID NO: 3863039 - DNA, 15 bp, Homo sapiens
cagctgcacattcct

SEQ ID NO: 3863040 - DNA, 16 bp, Homo sapiens
cagctgcatctactca

SEQ ID NO: 3863041 - DNA, 22 bp, Homo sapiens
cagctgccaagcactcgagacc

SEQ ID NO: 3863042 - DNA, 18 bp, Homo sapiens
cagctgccgaccagagcc

SEQ ID NO: 3863043 - DNA, 19 bp, Homo sapiens
cagctgccgaccagagccc

SEQ ID NO: 3863044 - DNA, 12 bp, Homo sapiens
cagctgcctggg

SEQ ID NO: 3863045 - DNA, 13 bp, Homo sapiens
cagctgccttcct

SEQ ID NO: 3863046 - DNA, 18 bp, Homo sapiens
cagctgccttcctcatcc

SEQ ID NO: 3863047 - DNA, 14 bp, Homo sapiens
cagctgcgggtctg

SEQ ID NO: 3863048 - DNA, 20 bp, Homo sapiens
cagctgctgaaacaacaaat

SEQ ID NO: 3863049 - DNA, 17 bp, Homo sapiens
cagctgctgaagaggca

SEQ ID NO: 3863050 - DNA, 15 bp, Homo sapiens
cagctgcttgtcctg

SEQ ID NO: 3863051 - DNA, 21 bp, Homo sapiens
cagctgcttgtcctgctctct

SEQ ID NO: 3863052 - DNA, 23 bp, Homo sapiens
cagctgcttgtcctgctctcttc

SEQ ID NO: 3863053 - DNA, 16 bp, Homo sapiens
cagctgcttgtgggcc

SEQ ID NO: 3863054 - DNA, 14 bp, Homo sapiens
cagctggcctctag

SEQ ID NO: 3863055 - DNA, 15 bp, Homo sapiens
cagctggcctctaga

SEQ ID NO: 3863056 - DNA, 23 bp, Homo sapiens
cagctggcctctagaacacccac

SEQ ID NO: 3863057 - DNA, 16 bp, Homo sapiens
cagctggctctccacc

SEQ ID NO: 3863058 - DNA, 18 bp, Homo sapiens
cagctggctctccacctt

SEQ ID NO: 3863059 - DNA, 20 bp, Homo sapiens
cagctggctctccaccttgt

SEQ ID NO: 3863060 - DNA, 15 bp, Homo sapiens
cagctgggacccctc

SEQ ID NO: 3863061 - DNA, 23 bp, Homo sapiens
cagctgggacccctcccaacctc

SEQ ID NO: 3863062 - DNA, 20 bp, Homo sapiens
cagctgggccccatgctctg

SEQ ID NO: 3863063 - DNA, 22 bp, Homo sapiens
cagctgggccccatgctctgcc

SEQ ID NO: 3863064 - DNA, 17 bp, Homo sapiens
cagctgggccggccagc

SEQ ID NO: 3863065 - DNA, 18 bp, Homo sapiens
cagctgtaacacagctga

SEQ ID NO: 3863066 - DNA, 17 bp, Homo sapiens
cagctgtagccatggct

SEQ ID NO: 3863067 - DNA, 21 bp, Homo sapiens
cagctgtagccatggctcagg

SEQ ID NO: 3863068 - DNA, 23 bp, Homo sapiens
cagctgtagccatggctcaggca

SEQ ID NO: 3863069 - DNA, 15 bp, Homo sapiens
cagctgtcatggaaa

SEQ ID NO: 3863070 - DNA, 23 bp, Homo sapiens
cagctgtcatggaaaagcccagt

SEQ ID NO: 3863071 - DNA, 15 bp, Homo sapiens
cagctgtcattcagg

SEQ ID NO: 3863072 - DNA, 17 bp, Homo sapiens
cagctgtcccctctccc

SEQ ID NO: 3863073 - DNA, 20 bp, Homo sapiens
cagctgtcccctctccctgg

SEQ ID NO: 3863074 - DNA, 22 bp, Homo sapiens
cagctgtcccctctccctgggg

SEQ ID NO: 3863075 - DNA, 15 bp, Homo sapiens
cagctgtccctgtca

SEQ ID NO: 3863076 - DNA, 18 bp, Homo sapiens
cagctgtccctgtcacca

SEQ ID NO: 3863077 - DNA, 18 bp, Homo sapiens
cagctgtgaacatggact

SEQ ID NO: 3863078 - DNA, 17 bp, Homo sapiens
cagctgtttctggaaat

SEQ ID NO: 3863079 - DNA, 19 bp, Homo sapiens
cagcttaacattgacttct

SEQ ID NO: 3863080 - DNA, 18 bp, Homo sapiens
cagcttcatcaattttta

SEQ ID NO: 3863081 - DNA, 15 bp, Homo sapiens
cagcttcattatgca

SEQ ID NO: 3863082 - DNA, 22 bp, Homo sapiens
cagcttcattatgcagctgagg

SEQ ID NO: 3863083 - DNA, 13 bp, Homo sapiens
cagcttgaccaga

SEQ ID NO: 3863084 - DNA, 18 bp, Homo sapiens
cagcttgaccagacctag

SEQ ID NO: 3863085 - DNA, 19 bp, Homo sapiens
cagcttgtagccagccggg

SEQ ID NO: 3863086 - DNA, 19 bp, Homo sapiens
cagctttacatgcaattta

SEQ ID NO: 3863087 - DNA, 22 bp, Homo sapiens
cagctttgctaccaaagcacct

SEQ ID NO: 3863088 - DNA, 13 bp, Homo sapiens
cagcttttaataa

SEQ ID NO: 3863089 - DNA, 15 bp, Homo sapiens
cagcttttaataaaa

SEQ ID NO: 3863090 - DNA, 21 bp, Homo sapiens
cagcttttaataaaattgaca

SEQ ID NO: 3863091 - DNA, 15 bp, Homo sapiens
cagcttttgcttcat

SEQ ID NO: 3863092 - DNA, 19 bp, Homo sapiens
caggaaaactgacagagga

SEQ ID NO: 3863093 - DNA, 23 bp, Homo sapiens
caggaaaactgacagaggagggc

SEQ ID NO: 3863094 - DNA, 22 bp, Homo sapiens
caggaaaaggtagcttacctga

SEQ ID NO: 3863095 - DNA, 16 bp, Homo sapiens
caggaaaatcctctgg

SEQ ID NO: 3863096 - DNA, 13 bp, Homo sapiens
caggaaaccaaca

SEQ ID NO: 3863097 - DNA, 19 bp, Homo sapiens
caggaaagccctccccctt

SEQ ID NO: 3863098 - DNA, 13 bp, Homo sapiens
caggaacgagcac

SEQ ID NO: 3863099 - DNA, 17 bp, Homo sapiens
caggaacgagcactggc

SEQ ID NO: 3863100 - DNA, 17 bp, Homo sapiens
caggaactcccagcaac

SEQ ID NO: 3863101 - DNA, 13 bp, Homo sapiens
caggaagaaaccc

SEQ ID NO: 3863102 - DNA, 21 bp, Homo sapiens
caggaagatgaaagaggaggt

SEQ ID NO: 3863103 - DNA, 13 bp, Homo sapiens
caggaaggcagct

SEQ ID NO: 3863104 - DNA, 23 bp, Homo sapiens
caggaagggggtccacccagcaa

SEQ ID NO: 3863105 - DNA, 19 bp, Homo sapiens
caggaatgttaaagtcagt

SEQ ID NO: 3863106 - DNA, 16 bp, Homo sapiens
caggacacaggcctgt

SEQ ID NO: 3863107 - DNA, 17 bp, Homo sapiens
caggacacctgccccag

SEQ ID NO: 3863108 - DNA, 16 bp, Homo sapiens
caggacatgatactga

SEQ ID NO: 3863109 - DNA, 20 bp, Homo sapiens
caggaccagtcccagagcag

SEQ ID NO: 3863110 - DNA, 11 bp, Homo sapiens
caggacccagg

SEQ ID NO: 3863111 - DNA, 14 bp, Homo sapiens
caggacccaggccc

SEQ ID NO: 3863112 - DNA, 15 bp, Homo sapiens
caggacccaggccct

SEQ ID NO: 3863113 - DNA, 15 bp, Homo sapiens
caggaccccaacccc

SEQ ID NO: 3863114 - DNA, 20 bp, Homo sapiens
caggaccttttgaagtagtt

SEQ ID NO: 3863115 - DNA, 22 bp, Homo sapiens
caggactaacactcagaagcct

SEQ ID NO: 3863116 - DNA, 23 bp, Homo sapiens
caggactaacactcagaagcctg

SEQ ID NO: 3863117 - DNA, 18 bp, Homo sapiens
caggactatagcccaggt

SEQ ID NO: 3863118 - DNA, 21 bp, Homo sapiens
caggactatagcccaggtcct

SEQ ID NO: 3863119 - DNA, 15 bp, Homo sapiens
caggactccccaggc

SEQ ID NO: 3863120 - DNA, 17 bp, Homo sapiens
caggactccccaggcca

SEQ ID NO: 3863121 - DNA, 19 bp, Homo sapiens
caggactccccaggccagg

SEQ ID NO: 3863122 - DNA, 16 bp, Homo sapiens
caggactctgcctcct

SEQ ID NO: 3863123 - DNA, 12 bp, Homo sapiens
caggactggctc

SEQ ID NO: 3863124 - DNA, 13 bp, Homo sapiens
caggactggctca

SEQ ID NO: 3863125 - DNA, 14 bp, Homo sapiens
caggactggctcac

SEQ ID NO: 3863126 - DNA, 16 bp, Homo sapiens
caggactggctcaccc

SEQ ID NO: 3863127 - DNA, 21 bp, Homo sapiens
caggactttgatgcatttcca

SEQ ID NO: 3863128 - DNA, 23 bp, Homo sapiens
caggagaaatgcatccattcctc

SEQ ID NO: 3863129 - DNA, 20 bp, Homo sapiens
caggagaagaaagaggtgac

SEQ ID NO: 3863130 - DNA, 21 bp, Homo sapiens
caggagaagaaagaggtgacc

SEQ ID NO: 3863131 - DNA, 12 bp, Homo sapiens
caggagacaaga

SEQ ID NO: 3863132 - DNA, 14 bp, Homo sapiens
caggagacaggaag

SEQ ID NO: 3863133 - DNA, 18 bp, Homo sapiens
caggagagacgcagccct

SEQ ID NO: 3863134 - DNA, 23 bp, Homo sapiens
caggagagacgcagccctggggg

SEQ ID NO: 3863135 - DNA, 11 bp, Homo sapiens
caggagagaga

SEQ ID NO: 3863136 - DNA, 12 bp, Homo sapiens
caggagagagat

SEQ ID NO: 3863137 - DNA, 19 bp, Homo sapiens
caggagagccagccctccc

SEQ ID NO: 3863138 - DNA, 17 bp, Homo sapiens
caggagatcgagaccat

SEQ ID NO: 3863139 - DNA, 19 bp, Homo sapiens
caggagcaaatgtttctgc

SEQ ID NO: 3863140 - DNA, 22 bp, Homo sapiens
caggagcaaatgtttctgcagt

SEQ ID NO: 3863141 - DNA, 15 bp, Homo sapiens
caggagcacaggcag

SEQ ID NO: 3863142 - DNA, 23 bp, Homo sapiens
caggagcacaggcagctggatga

SEQ ID NO: 3863143 - DNA, 14 bp, Homo sapiens
caggagcagacaga

SEQ ID NO: 3863144 - DNA, 15 bp, Homo sapiens
caggagcagacagag

SEQ ID NO: 3863145 - DNA, 14 bp, Homo sapiens
caggagcaggaaca

SEQ ID NO: 3863146 - DNA, 22 bp, Homo sapiens
caggagcaggaacagagactct

SEQ ID NO: 3863147 - DNA, 24 bp, Homo sapiens
caggagcaggaacagagactctgg

SEQ ID NO: 3863148 - DNA, 12 bp, Homo sapiens
caggagcccaga

SEQ ID NO: 3863149 - DNA, 13 bp, Homo sapiens
caggagcccagag

SEQ ID NO: 3863150 - DNA, 12 bp, Homo sapiens
caggagcctggc

SEQ ID NO: 3863151 - DNA, 15 bp, Homo sapiens
caggagcctgtgcct

SEQ ID NO: 3863152 - DNA, 22 bp, Homo sapiens
caggagctacctgtgtggacag

SEQ ID NO: 3863153 - DNA, 23 bp, Homo sapiens
caggagctacctgtgtggacagg

SEQ ID NO: 3863154 - DNA, 12 bp, Homo sapiens
caggagctgagt

SEQ ID NO: 3863155 - DNA, 19 bp, Homo sapiens
caggagctgagtcacctcc

SEQ ID NO: 3863156 - DNA, 20 bp, Homo sapiens
caggaggcctggccttgtca

SEQ ID NO: 3863157 - DNA, 17 bp, Homo sapiens
caggaggcgaataaatg

SEQ ID NO: 3863158 - DNA, 22 bp, Homo sapiens
caggaggcgcagcccgaagccc

SEQ ID NO: 3863159 - DNA, 20 bp, Homo sapiens
caggaggcggaggttgcagt

SEQ ID NO: 3863160 - DNA, 13 bp, Homo sapiens
caggaggctgagg

SEQ ID NO: 3863161 - DNA, 16 bp, Homo sapiens
caggaggctgaggcag

SEQ ID NO: 3863162 - DNA, 21 bp, Homo sapiens
caggaggctgaggcagaagaa

SEQ ID NO: 3863163 - DNA, 15 bp, Homo sapiens
caggaggctgcggcc

SEQ ID NO: 3863164 - DNA, 18 bp, Homo sapiens
caggagggacaaaggagc

SEQ ID NO: 3863165 - DNA, 19 bp, Homo sapiens
caggagggacaaaggagcc

SEQ ID NO: 3863166 - DNA, 20 bp, Homo sapiens
caggagggacaaaggagcct

SEQ ID NO: 3863167 - DNA, 17 bp, Homo sapiens
caggaggggcctctgaa

SEQ ID NO: 3863168 - DNA, 16 bp, Homo sapiens
caggagggggtcgtgg

SEQ ID NO: 3863169 - DNA, 18 bp, Homo sapiens
caggagggggtcgtggag

SEQ ID NO: 3863170 - DNA, 20 bp, Homo sapiens
caggagggggtcgtggagag

SEQ ID NO: 3863171 - DNA, 20 bp, Homo sapiens
caggagggtccccagctggt

SEQ ID NO: 3863172 - DNA, 21 bp, Homo sapiens
caggagggtccccagctggtc

SEQ ID NO: 3863173 - DNA, 23 bp, Homo sapiens
caggagggtccccagctggtcca

SEQ ID NO: 3863174 - DNA, 15 bp, Homo sapiens
caggaggtggaggtt

SEQ ID NO: 3863175 - DNA, 18 bp, Homo sapiens
caggaggttggtgactga

SEQ ID NO: 3863176 - DNA, 20 bp, Homo sapiens
caggaggttggtgactgaaa

SEQ ID NO: 3863177 - DNA, 21 bp, Homo sapiens
caggaggttgtggatgctcca

SEQ ID NO: 3863178 - DNA, 13 bp, Homo sapiens
caggagtagctga

SEQ ID NO: 3863179 - DNA, 17 bp, Homo sapiens
caggagtagctgagctc

SEQ ID NO: 3863180 - DNA, 16 bp, Homo sapiens
caggagtctgtgctct

SEQ ID NO: 3863181 - DNA, 20 bp, Homo sapiens
caggagttcaagaccagcct

SEQ ID NO: 3863182 - DNA, 22 bp, Homo sapiens
caggagttcaagaccagcctgg

SEQ ID NO: 3863183 - DNA, 22 bp, Homo sapiens
caggagtttgagacaagccctg

SEQ ID NO: 3863184 - DNA, 18 bp, Homo sapiens
caggataataaagtgttt

SEQ ID NO: 3863185 - DNA, 17 bp, Homo sapiens
caggatactctgtcaga

SEQ ID NO: 3863186 - DNA, 14 bp, Homo sapiens
caggatcccagagc

SEQ ID NO: 3863187 - DNA, 16 bp, Homo sapiens
caggatccctcccaga

SEQ ID NO: 3863188 - DNA, 19 bp, Homo sapiens
caggatccgctgccaccac

SEQ ID NO: 3863189 - DNA, 13 bp, Homo sapiens
caggatcctgcag

SEQ ID NO: 3863190 - DNA, 14 bp, Homo sapiens
caggatcctgcagg

SEQ ID NO: 3863191 - DNA, 17 bp, Homo sapiens
caggatcctgcaggaac

SEQ ID NO: 3863192 - DNA, 20 bp, Homo sapiens
caggatgaaggcgtgcaagg

SEQ ID NO: 3863193 - DNA, 12 bp, Homo sapiens
caggatggcttt

SEQ ID NO: 3863194 - DNA, 15 bp, Homo sapiens
caggattcctctctc

SEQ ID NO: 3863195 - DNA, 13 bp, Homo sapiens
caggattgaagag

SEQ ID NO: 3863196 - DNA, 22 bp, Homo sapiens
caggattttaacaaaagcaaga

SEQ ID NO: 3863197 - DNA, 14 bp, Homo sapiens
caggcaaaatcctt

SEQ ID NO: 3863198 - DNA, 13 bp, Homo sapiens
caggcaagcccct

SEQ ID NO: 3863199 - DNA, 19 bp, Homo sapiens
caggcaagcccctcagccc

SEQ ID NO: 3863200 - DNA, 16 bp, Homo sapiens
caggcacacagcagcc

SEQ ID NO: 3863201 - DNA, 21 bp, Homo sapiens
caggcacacagcagcccccca

SEQ ID NO: 3863202 - DNA, 13 bp, Homo sapiens
caggcacaggcag

SEQ ID NO: 3863203 - DNA, 15 bp, Homo sapiens
caggcacctggcctg

SEQ ID NO: 3863204 - DNA, 17 bp, Homo sapiens
caggcacctggcctgct

SEQ ID NO: 3863205 - DNA, 19 bp, Homo sapiens
caggcacctggcctgctgg

SEQ ID NO: 3863206 - DNA, 22 bp, Homo sapiens
caggcacctggcctgctgggaa

SEQ ID NO: 3863207 - DNA, 20 bp, Homo sapiens
caggcacgaacccacctgct

SEQ ID NO: 3863208 - DNA, 21 bp, Homo sapiens
caggcacgaacccacctgctg

SEQ ID NO: 3863209 - DNA, 22 bp, Homo sapiens
caggcacgaacccacctgctga

SEQ ID NO: 3863210 - DNA, 18 bp, Homo sapiens
caggcagacaagagctgc

SEQ ID NO: 3863211 - DNA, 19 bp, Homo sapiens
caggcagacaagagctgct

SEQ ID NO: 3863212 - DNA, 21 bp, Homo sapiens
caggcagacaagagctgctgt

SEQ ID NO: 3863213 - DNA, 15 bp, Homo sapiens
caggcagagcgggga

SEQ ID NO: 3863214 - DNA, 12 bp, Homo sapiens
caggcagcgatg

SEQ ID NO: 3863215 - DNA, 21 bp, Homo sapiens
caggcagcgatggtctcagaa

SEQ ID NO: 3863216 - DNA, 15 bp, Homo sapiens
caggcagctggatga

SEQ ID NO: 3863217 - DNA, 17 bp, Homo sapiens
caggcaggaagagagag

SEQ ID NO: 3863218 - DNA, 15 bp, Homo sapiens
caggcagggctctcc

SEQ ID NO: 3863219 - DNA, 19 bp, Homo sapiens
caggcagggctctcctggc

SEQ ID NO: 3863220 - DNA, 14 bp, Homo sapiens
caggcatgctggcc

SEQ ID NO: 3863221 - DNA, 17 bp, Homo sapiens
caggcatttcctgggtg

SEQ ID NO: 3863222 - DNA, 19 bp, Homo sapiens
caggccaagaccccagctt

SEQ ID NO: 3863223 - DNA, 13 bp, Homo sapiens
caggccaccagga

SEQ ID NO: 3863224 - DNA, 16 bp, Homo sapiens
caggccacgctcaggc

SEQ ID NO: 3863225 - DNA, 12 bp, Homo sapiens
caggccactgtg

SEQ ID NO: 3863226 - DNA, 13 bp, Homo sapiens
caggccactgtgg

SEQ ID NO: 3863227 - DNA, 15 bp, Homo sapiens
caggccactgtggcc

SEQ ID NO: 3863228 - DNA, 22 bp, Homo sapiens
caggccactgtggccagagctg

SEQ ID NO: 3863229 - DNA, 12 bp, Homo sapiens
caggccagaaaa

SEQ ID NO: 3863230 - DNA, 21 bp, Homo sapiens
caggcccatctcaggtgccac

SEQ ID NO: 3863231 - DNA, 14 bp, Homo sapiens
caggccccatgacc

SEQ ID NO: 3863232 - DNA, 18 bp, Homo sapiens
caggccccatgacctcca

SEQ ID NO: 3863233 - DNA, 19 bp, Homo sapiens
caggccccgcttgtccagc

SEQ ID NO: 3863234 - DNA, 15 bp, Homo sapiens
caggcccctgaggac

SEQ ID NO: 3863235 - DNA, 17 bp, Homo sapiens
caggcccctgaggactg

SEQ ID NO: 3863236 - DNA, 20 bp, Homo sapiens
caggcccgacagagagatga

SEQ ID NO: 3863237 - DNA, 20 bp, Homo sapiens
caggcccggcatgcgggcca

SEQ ID NO: 3863238 - DNA, 21 bp, Homo sapiens
caggcccggcccagcctaggc

SEQ ID NO: 3863239 - DNA, 15 bp, Homo sapiens
caggcccggggctgg

SEQ ID NO: 3863240 - DNA, 20 bp, Homo sapiens
caggccctaagatgccttga

SEQ ID NO: 3863241 - DNA, 16 bp, Homo sapiens
caggccctccatgggc

SEQ ID NO: 3863242 - DNA, 17 bp, Homo sapiens
caggccctccatgggct

SEQ ID NO: 3863243 - DNA, 18 bp, Homo sapiens
caggccctccatgggcta

SEQ ID NO: 3863244 - DNA, 19 bp, Homo sapiens
caggccctccatgggctag

SEQ ID NO: 3863245 - DNA, 20 bp, Homo sapiens
caggccctccctgactccct

SEQ ID NO: 3863246 - DNA, 16 bp, Homo sapiens
caggcccttcctctcc

SEQ ID NO: 3863247 - DNA, 17 bp, Homo sapiens
caggcccttcctctcca

SEQ ID NO: 3863248 - DNA, 21 bp, Homo sapiens
caggcccttcctctccactgc

SEQ ID NO: 3863249 - DNA, 23 bp, Homo sapiens
caggcccttcctctccactgcct

SEQ ID NO: 3863250 - DNA, 15 bp, Homo sapiens
caggcccttggggtt

SEQ ID NO: 3863251 - DNA, 14 bp, Homo sapiens
caggccgcctgcca

SEQ ID NO: 3863252 - DNA, 19 bp, Homo sapiens
caggccgttccccttggct

SEQ ID NO: 3863253 - DNA, 11 bp, Homo sapiens
caggcctccag

SEQ ID NO: 3863254 - DNA, 18 bp, Homo sapiens
caggcctccagcctctcc

SEQ ID NO: 3863255 - DNA, 20 bp, Homo sapiens
caggcctccagcctctcccg

SEQ ID NO: 3863256 - DNA, 16 bp, Homo sapiens
caggcctgcgtgccgg

SEQ ID NO: 3863257 - DNA, 17 bp, Homo sapiens
caggcctggcaagtggg

SEQ ID NO: 3863258 - DNA, 13 bp, Homo sapiens
caggcctgggacc

SEQ ID NO: 3863259 - DNA, 21 bp, Homo sapiens
caggcctgggacccagctact

SEQ ID NO: 3863260 - DNA, 18 bp, Homo sapiens
caggcctgtgtagctgtg

SEQ ID NO: 3863261 - DNA, 21 bp, Homo sapiens
caggcctgtgtagctgtgacc

SEQ ID NO: 3863262 - DNA, 18 bp, Homo sapiens
caggcctttgagaaaggg

SEQ ID NO: 3863263 - DNA, 15 bp, Homo sapiens
caggcgccccttccc

SEQ ID NO: 3863264 - DNA, 16 bp, Homo sapiens
caggcgctggacagag

SEQ ID NO: 3863265 - DNA, 23 bp, Homo sapiens
caggcgggagatggacccctccc

SEQ ID NO: 3863266 - DNA, 15 bp, Homo sapiens
caggcgttggtgcca

SEQ ID NO: 3863267 - DNA, 20 bp, Homo sapiens
caggcgttggtgccacttct

SEQ ID NO: 3863268 - DNA, 14 bp, Homo sapiens
caggctactctcct

SEQ ID NO: 3863269 - DNA, 11 bp, Homo sapiens
caggctactgt

SEQ ID NO: 3863270 - DNA, 19 bp, Homo sapiens
caggctccatggggaagtg

SEQ ID NO: 3863271 - DNA, 13 bp, Homo sapiens
caggctccccctg

SEQ ID NO: 3863272 - DNA, 21 bp, Homo sapiens
caggctctgcctggaggatcc

SEQ ID NO: 3863273 - DNA, 19 bp, Homo sapiens
caggctctggagccagaga

SEQ ID NO: 3863274 - DNA, 14 bp, Homo sapiens
caggctctgggaag

SEQ ID NO: 3863275 - DNA, 16 bp, Homo sapiens
caggctctgggaaggg

SEQ ID NO: 3863276 - DNA, 18 bp, Homo sapiens
caggctctgggaaggggt

SEQ ID NO: 3863277 - DNA, 23 bp, Homo sapiens
caggctctgggaaggggtgccct

SEQ ID NO: 3863278 - DNA, 14 bp, Homo sapiens
caggctctgggctc

SEQ ID NO: 3863279 - DNA, 15 bp, Homo sapiens
caggctctgggctca

SEQ ID NO: 3863280 - DNA, 17 bp, Homo sapiens
caggctctgggctcagg

SEQ ID NO: 3863281 - DNA, 19 bp, Homo sapiens
caggctctgggctcagggc

SEQ ID NO: 3863282 - DNA, 14 bp, Homo sapiens
caggctcttcctgg

SEQ ID NO: 3863283 - DNA, 16 bp, Homo sapiens
caggctcttcctggac

SEQ ID NO: 3863284 - DNA, 17 bp, Homo sapiens
caggctcttcctggacc

SEQ ID NO: 3863285 - DNA, 20 bp, Homo sapiens
caggctcttcctggacctga

SEQ ID NO: 3863286 - DNA, 18 bp, Homo sapiens
caggctcttctcctttca

SEQ ID NO: 3863287 - DNA, 13 bp, Homo sapiens
caggctgaagagt

SEQ ID NO: 3863288 - DNA, 11 bp, Homo sapiens
caggctgaggt

SEQ ID NO: 3863289 - DNA, 22 bp, Homo sapiens
caggctgaggtcctgatcagct

SEQ ID NO: 3863290 - DNA, 16 bp, Homo sapiens
caggctgcactgcagt

SEQ ID NO: 3863291 - DNA, 20 bp, Homo sapiens
caggctgcactgcagtgatg

SEQ ID NO: 3863292 - DNA, 12 bp, Homo sapiens
caggctggcctg

SEQ ID NO: 3863293 - DNA, 15 bp, Homo sapiens
caggctgtaagcatt

SEQ ID NO: 3863294 - DNA, 20 bp, Homo sapiens
caggcttctttcaaagtgta

SEQ ID NO: 3863295 - DNA, 21 bp, Homo sapiens
caggcttggaatgaattctct

SEQ ID NO: 3863296 - DNA, 16 bp, Homo sapiens
cagggaaagctccacg

SEQ ID NO: 3863297 - DNA, 15 bp, Homo sapiens
cagggaaatggaggg

SEQ ID NO: 3863298 - DNA, 17 bp, Homo sapiens
cagggaaatggagggtg

SEQ ID NO: 3863299 - DNA, 18 bp, Homo sapiens
cagggaaatggagggtgg

SEQ ID NO: 3863300 - DNA, 23 bp, Homo sapiens
cagggaaatggagggtggggccg

SEQ ID NO: 3863301 - DNA, 15 bp, Homo sapiens
cagggaagagcagaa

SEQ ID NO: 3863302 - DNA, 22 bp, Homo sapiens
cagggaagagggcagtacctgg

SEQ ID NO: 3863303 - DNA, 17 bp, Homo sapiens
cagggaagcaggcagag

SEQ ID NO: 3863304 - DNA, 14 bp, Homo sapiens
cagggaaggcaggc

SEQ ID NO: 3863305 - DNA, 17 bp, Homo sapiens
cagggaaggcaggcagg

SEQ ID NO: 3863306 - DNA, 22 bp, Homo sapiens
cagggaatccgcctgcagagga

SEQ ID NO: 3863307 - DNA, 21 bp, Homo sapiens
cagggacaaaacactgtgtcc

SEQ ID NO: 3863308 - DNA, 23 bp, Homo sapiens
cagggacaaagaggcctttaacc

SEQ ID NO: 3863309 - DNA, 17 bp, Homo sapiens
cagggacggggactggc

SEQ ID NO: 3863310 - DNA, 20 bp, Homo sapiens
cagggacggggactggccct

SEQ ID NO: 3863311 - DNA, 19 bp, Homo sapiens
cagggagaccgagcgcttt

SEQ ID NO: 3863312 - DNA, 22 bp, Homo sapiens
cagggagaccgagcgctttctg

SEQ ID NO: 3863313 - DNA, 23 bp, Homo sapiens
cagggagaggagtgactgagctt

SEQ ID NO: 3863314 - DNA, 15 bp, Homo sapiens
cagggagcaatggga

SEQ ID NO: 3863315 - DNA, 17 bp, Homo sapiens
cagggagctgggcttcc

SEQ ID NO: 3863316 - DNA, 15 bp, Homo sapiens
cagggaggagaggaa

SEQ ID NO: 3863317 - DNA, 15 bp, Homo sapiens
cagggaggaggcaga

SEQ ID NO: 3863318 - DNA, 21 bp, Homo sapiens
cagggaggaggcagagaagaa

SEQ ID NO: 3863319 - DNA, 12 bp, Homo sapiens
cagggaggatgc

SEQ ID NO: 3863320 - DNA, 20 bp, Homo sapiens
cagggaggatgccacagccc

SEQ ID NO: 3863321 - DNA, 23 bp, Homo sapiens
cagggaggccgaagctaacaggg

SEQ ID NO: 3863322 - DNA, 12 bp, Homo sapiens
cagggaggggac

SEQ ID NO: 3863323 - DNA, 19 bp, Homo sapiens
cagggaggggactatttat

SEQ ID NO: 3863324 - DNA, 17 bp, Homo sapiens
cagggatgggggatggg

SEQ ID NO: 3863325 - DNA, 21 bp, Homo sapiens
cagggatgggggatgggccag

SEQ ID NO: 3863326 - DNA, 14 bp, Homo sapiens
cagggatttgagga

SEQ ID NO: 3863327 - DNA, 21 bp, Homo sapiens
cagggcaaatgacatgcactg

SEQ ID NO: 3863328 - DNA, 12 bp, Homo sapiens
cagggcacagga

SEQ ID NO: 3863329 - DNA, 14 bp, Homo sapiens
cagggcacaggagc

SEQ ID NO: 3863330 - DNA, 20 bp, Homo sapiens
cagggcacaggagctacctg

SEQ ID NO: 3863331 - DNA, 21 bp, Homo sapiens
cagggcacaggagctacctgt

SEQ ID NO: 3863332 - DNA, 13 bp, Homo sapiens
cagggcagaggga

SEQ ID NO: 3863333 - DNA, 18 bp, Homo sapiens
cagggcaggctacccctt

SEQ ID NO: 3863334 - DNA, 16 bp, Homo sapiens
cagggcagtgacaagt

SEQ ID NO: 3863335 - DNA, 21 bp, Homo sapiens
cagggcagtgacaagtggagg

SEQ ID NO: 3863336 - DNA, 19 bp, Homo sapiens
cagggcatccgcagcccag

SEQ ID NO: 3863337 - DNA, 20 bp, Homo sapiens
cagggcatccgcagcccagg

SEQ ID NO: 3863338 - DNA, 16 bp, Homo sapiens
cagggccacgtgccag

SEQ ID NO: 3863339 - DNA, 17 bp, Homo sapiens
cagggccacgtgccagg

SEQ ID NO: 3863340 - DNA, 21 bp, Homo sapiens
cagggccagaaggagggcaga

SEQ ID NO: 3863341 - DNA, 22 bp, Homo sapiens
cagggccagaaggagggcagag

SEQ ID NO: 3863342 - DNA, 15 bp, Homo sapiens
cagggcccctccctc

SEQ ID NO: 3863343 - DNA, 22 bp, Homo sapiens
cagggcccctccctctgcccca

SEQ ID NO: 3863344 - DNA, 23 bp, Homo sapiens
cagggccggggaactggccaagc

SEQ ID NO: 3863345 - DNA, 21 bp, Homo sapiens
cagggcctactgccacccgct

SEQ ID NO: 3863346 - DNA, 22 bp, Homo sapiens
cagggcctggggagatggagga

SEQ ID NO: 3863347 - DNA, 18 bp, Homo sapiens
cagggcctgggggcagtg

SEQ ID NO: 3863348 - DNA, 19 bp, Homo sapiens
cagggcctgggggcagtga

SEQ ID NO: 3863349 - DNA, 17 bp, Homo sapiens
cagggccttgcccagag

SEQ ID NO: 3863350 - DNA, 20 bp, Homo sapiens
cagggccttgcccagagatg

SEQ ID NO: 3863351 - DNA, 23 bp, Homo sapiens
cagggcgataaaactaaatatat

SEQ ID NO: 3863352 - DNA, 17 bp, Homo sapiens
cagggctaagagctagc

SEQ ID NO: 3863353 - DNA, 14 bp, Homo sapiens
cagggctccctcct

SEQ ID NO: 3863354 - DNA, 16 bp, Homo sapiens
cagggctccctcctgg

SEQ ID NO: 3863355 - DNA, 23 bp, Homo sapiens
cagggctccctcctggagcatcc

SEQ ID NO: 3863356 - DNA, 16 bp, Homo sapiens
cagggctctcctggct

SEQ ID NO: 3863357 - DNA, 20 bp, Homo sapiens
cagggctctgccccagaggc

SEQ ID NO: 3863358 - DNA, 21 bp, Homo sapiens
cagggctctgccccagaggcc

SEQ ID NO: 3863359 - DNA, 18 bp, Homo sapiens
cagggctgcccctgtagg

SEQ ID NO: 3863360 - DNA, 15 bp, Homo sapiens
caggggatcaaagtt

SEQ ID NO: 3863361 - DNA, 15 bp, Homo sapiens
caggggcaggcctgg

SEQ ID NO: 3863362 - DNA, 19 bp, Homo sapiens
caggggccccagatctgcc

SEQ ID NO: 3863363 - DNA, 21 bp, Homo sapiens
caggggccccagatctgcctg

SEQ ID NO: 3863364 - DNA, 18 bp, Homo sapiens
caggggcggggcaggaat

SEQ ID NO: 3863365 - DNA, 21 bp, Homo sapiens
caggggtcgtcaccacctctc

SEQ ID NO: 3863366 - DNA, 13 bp, Homo sapiens
caggggtggagaa

SEQ ID NO: 3863367 - DNA, 18 bp, Homo sapiens
cagggtccgcaccagctg

SEQ ID NO: 3863368 - DNA, 20 bp, Homo sapiens
cagggtccgcaccagctgct

SEQ ID NO: 3863369 - DNA, 22 bp, Homo sapiens
cagggtccgcaccagctgctct

SEQ ID NO: 3863370 - DNA, 23 bp, Homo sapiens
cagggtccgcaccagctgctctg

SEQ ID NO: 3863371 - DNA, 14 bp, Homo sapiens
cagggtcttgggct

SEQ ID NO: 3863372 - DNA, 15 bp, Homo sapiens
cagggtcttgggcta

SEQ ID NO: 3863373 - DNA, 21 bp, Homo sapiens
cagggtcttgggctactggca

SEQ ID NO: 3863374 - DNA, 23 bp, Homo sapiens
cagggtcttgggctactggcagc

SEQ ID NO: 3863375 - DNA, 15 bp, Homo sapiens
cagggtgagagctgc

SEQ ID NO: 3863376 - DNA, 22 bp, Homo sapiens
cagggtggccccctgtgccagc

SEQ ID NO: 3863377 - DNA, 20 bp, Homo sapiens
cagggtgggaagaaagaatg

SEQ ID NO: 3863378 - DNA, 15 bp, Homo sapiens
cagggtgggccactc

SEQ ID NO: 3863379 - DNA, 18 bp, Homo sapiens
cagggtgggccactctcc

SEQ ID NO: 3863380 - DNA, 19 bp, Homo sapiens
cagggtgggccactctccc

SEQ ID NO: 3863381 - DNA, 14 bp, Homo sapiens
cagggtgggggagg

SEQ ID NO: 3863382 - DNA, 20 bp, Homo sapiens
cagggtgtgagcgccacatc

SEQ ID NO: 3863383 - DNA, 20 bp, Homo sapiens
cagggtgttacaaggcactt

SEQ ID NO: 3863384 - DNA, 22 bp, Homo sapiens
cagggtttacccagtgggacag

SEQ ID NO: 3863385 - DNA, 19 bp, Homo sapiens
caggtacttcctcctgatg

SEQ ID NO: 3863386 - DNA, 23 bp, Homo sapiens
caggtacttcctcctgatggcca

SEQ ID NO: 3863387 - DNA, 21 bp, Homo sapiens
caggtagatcgcttgagccca

SEQ ID NO: 3863388 - DNA, 19 bp, Homo sapiens
caggtaggcccttgtcctg

SEQ ID NO: 3863389 - DNA, 21 bp, Homo sapiens
caggtaggcccttgtcctgcc

SEQ ID NO: 3863390 - DNA, 22 bp, Homo sapiens
caggtaggcccttgtcctgcca

SEQ ID NO: 3863391 - DNA, 16 bp, Homo sapiens
caggtatcaggcacag

SEQ ID NO: 3863392 - DNA, 22 bp, Homo sapiens
caggtatcaggcacaggcagga

SEQ ID NO: 3863393 - DNA, 15 bp, Homo sapiens
caggtatctccagga

SEQ ID NO: 3863394 - DNA, 23 bp, Homo sapiens
caggtccctcctttggaccctgt

SEQ ID NO: 3863395 - DNA, 13 bp, Homo sapiens
caggtccggaggg

SEQ ID NO: 3863396 - DNA, 15 bp, Homo sapiens
caggtcctcagagaa

SEQ ID NO: 3863397 - DNA, 22 bp, Homo sapiens
caggtcctcccgggagcacaga

SEQ ID NO: 3863398 - DNA, 21 bp, Homo sapiens
caggtcctctgatacccagag

SEQ ID NO: 3863399 - DNA, 23 bp, Homo sapiens
caggtcctgaaagtctgtgtcca

SEQ ID NO: 3863400 - DNA, 18 bp, Homo sapiens
caggtcctggtggggcag

SEQ ID NO: 3863401 - DNA, 19 bp, Homo sapiens
caggtcctggtggggcagc

SEQ ID NO: 3863402 - DNA, 13 bp, Homo sapiens
caggtctcccacg

SEQ ID NO: 3863403 - DNA, 19 bp, Homo sapiens
caggtctcccacgtgggag

SEQ ID NO: 3863404 - DNA, 22 bp, Homo sapiens
caggtctcccacgtgggagaca

SEQ ID NO: 3863405 - DNA, 20 bp, Homo sapiens
caggtgcaagagacagagcc

SEQ ID NO: 3863406 - DNA, 21 bp, Homo sapiens
caggtgcaagagacagagccc

SEQ ID NO: 3863407 - DNA, 17 bp, Homo sapiens
caggtgcagatgggctg

SEQ ID NO: 3863408 - DNA, 20 bp, Homo sapiens
caggtgccaccaataaaaat

SEQ ID NO: 3863409 - DNA, 16 bp, Homo sapiens
caggtgccactccctg

SEQ ID NO: 3863410 - DNA, 20 bp, Homo sapiens
caggtgccactccctgagct

SEQ ID NO: 3863411 - DNA, 12 bp, Homo sapiens
caggtgcctgga

SEQ ID NO: 3863412 - DNA, 24 bp, Homo sapiens
caggtggattttgtggaggtgaga

SEQ ID NO: 3863413 - DNA, 21 bp, Homo sapiens
caggtggcaggaccaggacta

SEQ ID NO: 3863414 - DNA, 19 bp, Homo sapiens
caggtggccactccagacc

SEQ ID NO: 3863415 - DNA, 21 bp, Homo sapiens
caggtggccactccagacccc

SEQ ID NO: 3863416 - DNA, 14 bp, Homo sapiens
caggtggctgaccc

SEQ ID NO: 3863417 - DNA, 23 bp, Homo sapiens
caggtggctgacccagtccctgg

SEQ ID NO: 3863418 - DNA, 19 bp, Homo sapiens
caggtgggagagacactcc

SEQ ID NO: 3863419 - DNA, 23 bp, Homo sapiens
caggtgggagagacactcccagg

SEQ ID NO: 3863420 - DNA, 16 bp, Homo sapiens
caggtggtcctgagac

SEQ ID NO: 3863421 - DNA, 12 bp, Homo sapiens
caggtgtaaata

SEQ ID NO: 3863422 - DNA, 16 bp, Homo sapiens
caggtgtggtggctca

SEQ ID NO: 3863423 - DNA, 20 bp, Homo sapiens
caggtgttgccatttctctg

SEQ ID NO: 3863424 - DNA, 22 bp, Homo sapiens
caggtgttgccatttctctgct

SEQ ID NO: 3863425 - DNA, 19 bp, Homo sapiens
caggttagaacctagaagg

SEQ ID NO: 3863426 - DNA, 20 bp, Homo sapiens
caggttagcctttgccctgt

SEQ ID NO: 3863427 - DNA, 14 bp, Homo sapiens
caggttccatcccg

SEQ ID NO: 3863428 - DNA, 14 bp, Homo sapiens
caggttcccagcag

SEQ ID NO: 3863429 - DNA, 18 bp, Homo sapiens
caggttcccagcagctgg

SEQ ID NO: 3863430 - DNA, 15 bp, Homo sapiens
caggttgaccgggac

SEQ ID NO: 3863431 - DNA, 15 bp, Homo sapiens
caggttgttctgtat

SEQ ID NO: 3863432 - DNA, 17 bp, Homo sapiens
caggtttcttaaaaaca

SEQ ID NO: 3863433 - DNA, 21 bp, Homo sapiens
caggtttgccagtgaagactt

SEQ ID NO: 3863434 - DNA, 21 bp, Homo sapiens
caggtttggggagggggaaga

SEQ ID NO: 3863435 - DNA, 19 bp, Homo sapiens
cagtaaagtttaaaaaata

SEQ ID NO: 3863436 - DNA, 21 bp, Homo sapiens
cagtaaagtttaaaaaataca

SEQ ID NO: 3863437 - DNA, 24 bp, Homo sapiens
cagtaaataaattgtttgaccatg

SEQ ID NO: 3863438 - DNA, 22 bp, Homo sapiens
cagtacagagaaattctgtggt

SEQ ID NO: 3863439 - DNA, 14 bp, Homo sapiens
cagtacatgggaaa

SEQ ID NO: 3863440 - DNA, 23 bp, Homo sapiens
cagtacctgggaaaggacccacc

SEQ ID NO: 3863441 - DNA, 12 bp, Homo sapiens
cagtactgggaa

SEQ ID NO: 3863442 - DNA, 13 bp, Homo sapiens
cagtacttctaag

SEQ ID NO: 3863443 - DNA, 17 bp, Homo sapiens
cagtagcttaaataaat

SEQ ID NO: 3863444 - DNA, 18 bp, Homo sapiens
cagtaggctttatgctgt

SEQ ID NO: 3863445 - DNA, 16 bp, Homo sapiens
cagtaggtccaagggc

SEQ ID NO: 3863446 - DNA, 21 bp, Homo sapiens
cagtagtaattgatttgaccc

SEQ ID NO: 3863447 - DNA, 23 bp, Homo sapiens
cagtagtctctgtgctttgactc

SEQ ID NO: 3863448 - DNA, 22 bp, Homo sapiens
cagtatagcattgaacatttct

SEQ ID NO: 3863449 - DNA, 15 bp, Homo sapiens
cagtatggaagggag

SEQ ID NO: 3863450 - DNA, 19 bp, Homo sapiens
cagtattaatactaaaata

SEQ ID NO: 3863451 - DNA, 18 bp, Homo sapiens
cagtattccatgggatgt

SEQ ID NO: 3863452 - DNA, 20 bp, Homo sapiens
cagtattgccacaatgcctc

SEQ ID NO: 3863453 - DNA, 15 bp, Homo sapiens
cagtattttattaaa

SEQ ID NO: 3863454 - DNA, 21 bp, Homo sapiens
cagtattttggagaaattatt

SEQ ID NO: 3863455 - DNA, 15 bp, Homo sapiens
cagtcaaaacagaga

SEQ ID NO: 3863456 - DNA, 15 bp, Homo sapiens
cagtcaattttacaa

SEQ ID NO: 3863457 - DNA, 17 bp, Homo sapiens
cagtcacccttctgggc

SEQ ID NO: 3863458 - DNA, 21 bp, Homo sapiens
cagtcactgtccctcaaatga

SEQ ID NO: 3863459 - DNA, 16 bp, Homo sapiens
cagtcagtaattgcca

SEQ ID NO: 3863460 - DNA, 18 bp, Homo sapiens
cagtcagttcccggagca

SEQ ID NO: 3863461 - DNA, 12 bp, Homo sapiens
cagtcatttaaa

SEQ ID NO: 3863462 - DNA, 18 bp, Homo sapiens
cagtccagaataagtgct

SEQ ID NO: 3863463 - DNA, 17 bp, Homo sapiens
cagtccagatgccttcc

SEQ ID NO: 3863464 - DNA, 21 bp, Homo sapiens
cagtcccagaaccacactgtt

SEQ ID NO: 3863465 - DNA, 14 bp, Homo sapiens
cagtcccagagcag

SEQ ID NO: 3863466 - DNA, 15 bp, Homo sapiens
cagtccccagccctt

SEQ ID NO: 3863467 - DNA, 16 bp, Homo sapiens
cagtccccctgcccca

SEQ ID NO: 3863468 - DNA, 14 bp, Homo sapiens
cagtcccgtggagg

SEQ ID NO: 3863469 - DNA, 15 bp, Homo sapiens
cagtcccgtggaggg

SEQ ID NO: 3863470 - DNA, 16 bp, Homo sapiens
cagtcccgtggagggt

SEQ ID NO: 3863471 - DNA, 22 bp, Homo sapiens
cagtccctgggggaagccctgg

SEQ ID NO: 3863472 - DNA, 18 bp, Homo sapiens
cagtccgcagtctggcct

SEQ ID NO: 3863473 - DNA, 22 bp, Homo sapiens
cagtcctcacagcctctccctt

SEQ ID NO: 3863474 - DNA, 22 bp, Homo sapiens
cagtcctcccaccctaccacag

SEQ ID NO: 3863475 - DNA, 12 bp, Homo sapiens
cagtcctggcca

SEQ ID NO: 3863476 - DNA, 24 bp, Homo sapiens
cagtcctggccattttcttgcctg

SEQ ID NO: 3863477 - DNA, 16 bp, Homo sapiens
cagtcgtaagggttgc

SEQ ID NO: 3863478 - DNA, 22 bp, Homo sapiens
cagtctacgttctccagcccac

SEQ ID NO: 3863479 - DNA, 14 bp, Homo sapiens
cagtctagctttta

SEQ ID NO: 3863480 - DNA, 19 bp, Homo sapiens
cagtctagtgaagatgttg

SEQ ID NO: 3863481 - DNA, 18 bp, Homo sapiens
cagtctcaagcactaaaa

SEQ ID NO: 3863482 - DNA, 15 bp, Homo sapiens
cagtctcagaaagcc

SEQ ID NO: 3863483 - DNA, 15 bp, Homo sapiens
cagtctcaggaaatc

SEQ ID NO: 3863484 - DNA, 13 bp, Homo sapiens
cagtctcagtcca

SEQ ID NO: 3863485 - DNA, 14 bp, Homo sapiens
cagtctcccattct

SEQ ID NO: 3863486 - DNA, 17 bp, Homo sapiens
cagtctctctctccctt

SEQ ID NO: 3863487 - DNA, 22 bp, Homo sapiens
cagtctgaacccttgtgcttgg

SEQ ID NO: 3863488 - DNA, 17 bp, Homo sapiens
cagtctggtttatataa

SEQ ID NO: 3863489 - DNA, 23 bp, Homo sapiens
cagtctggtttatataaggcagt

SEQ ID NO: 3863490 - DNA, 14 bp, Homo sapiens
cagtctgtgtttga

SEQ ID NO: 3863491 - DNA, 13 bp, Homo sapiens
cagtcttgcctag

SEQ ID NO: 3863492 - DNA, 17 bp, Homo sapiens
cagtcttgcctaggcca

SEQ ID NO: 3863493 - DNA, 23 bp, Homo sapiens
cagtgaaccaaagagactggagc

SEQ ID NO: 3863494 - DNA, 23 bp, Homo sapiens
cagtgaacttacacttggagccc

SEQ ID NO: 3863495 - DNA, 19 bp, Homo sapiens
cagtgagaaaaagctcctg

SEQ ID NO: 3863496 - DNA, 16 bp, Homo sapiens
cagtgagacacagagt

SEQ ID NO: 3863497 - DNA, 18 bp, Homo sapiens
cagtgagattacagagga

SEQ ID NO: 3863498 - DNA, 23 bp, Homo sapiens
cagtgagccaagatcgcgccact

SEQ ID NO: 3863499 - DNA, 12 bp, Homo sapiens
cagtgaggaggg

SEQ ID NO: 3863500 - DNA, 13 bp, Homo sapiens
cagtgaggagggt

SEQ ID NO: 3863501 - DNA, 13 bp, Homo sapiens
cagtgagggctgg

SEQ ID NO: 3863502 - DNA, 22 bp, Homo sapiens
cagtgagttacagcgagaggca

SEQ ID NO: 3863503 - DNA, 14 bp, Homo sapiens
cagtgcaacaaaat

SEQ ID NO: 3863504 - DNA, 18 bp, Homo sapiens
cagtgcaagagactctgg

SEQ ID NO: 3863505 - DNA, 21 bp, Homo sapiens
cagtgcacacggatgcacaga

SEQ ID NO: 3863506 - DNA, 17 bp, Homo sapiens
cagtgcatctcagccca

SEQ ID NO: 3863507 - DNA, 18 bp, Homo sapiens
cagtgcatctcagcccac

SEQ ID NO: 3863508 - DNA, 11 bp, Homo sapiens
cagtgccacag

SEQ ID NO: 3863509 - DNA, 19 bp, Homo sapiens
cagtgccacttgacattcc

SEQ ID NO: 3863510 - DNA, 15 bp, Homo sapiens
cagtgcccagctaat

SEQ ID NO: 3863511 - DNA, 14 bp, Homo sapiens
cagtgcctcgaggc

SEQ ID NO: 3863512 - DNA, 19 bp, Homo sapiens
cagtgcctcgaggcaccgg

SEQ ID NO: 3863513 - DNA, 19 bp, Homo sapiens
cagtgccttacctcctgcc

SEQ ID NO: 3863514 - DNA, 22 bp, Homo sapiens
cagtgccttacctcctgcccag

SEQ ID NO: 3863515 - DNA, 23 bp, Homo sapiens
cagtgccttacctcctgcccagg

SEQ ID NO: 3863516 - DNA, 21 bp, Homo sapiens
cagtgctgccatgccactgcc

SEQ ID NO: 3863517 - DNA, 14 bp, Homo sapiens
cagtgctgcttctc

SEQ ID NO: 3863518 - DNA, 18 bp, Homo sapiens
cagtgctgcttctcttgg

SEQ ID NO: 3863519 - DNA, 19 bp, Homo sapiens
cagtgctgcttctcttggg

SEQ ID NO: 3863520 - DNA, 17 bp, Homo sapiens
cagtgcttctctacaga

SEQ ID NO: 3863521 - DNA, 20 bp, Homo sapiens
cagtgcttgagtttggggaa

SEQ ID NO: 3863522 - DNA, 13 bp, Homo sapiens
cagtggagaatta

SEQ ID NO: 3863523 - DNA, 14 bp, Homo sapiens
cagtggagtgagat

SEQ ID NO: 3863524 - DNA, 20 bp, Homo sapiens
cagtggccgcaagcgcaggg

SEQ ID NO: 3863525 - DNA, 23 bp, Homo sapiens
cagtggccgcaagcgcagggagg

SEQ ID NO: 3863526 - DNA, 20 bp, Homo sapiens
cagtggcgagaggagaggaa

SEQ ID NO: 3863527 - DNA, 17 bp, Homo sapiens
cagtgggaactctgaca

SEQ ID NO: 3863528 - DNA, 20 bp, Homo sapiens
cagtgggacaaaccagagca

SEQ ID NO: 3863529 - DNA, 22 bp, Homo sapiens
cagtgggacaaaccagagcaga

SEQ ID NO: 3863530 - DNA, 13 bp, Homo sapiens
cagtgggacagag

SEQ ID NO: 3863531 - DNA, 19 bp, Homo sapiens
cagtgggacagggcatggc

SEQ ID NO: 3863532 - DNA, 13 bp, Homo sapiens
cagtgggagaaaa

SEQ ID NO: 3863533 - DNA, 14 bp, Homo sapiens
cagtgggagaaaac

SEQ ID NO: 3863534 - DNA, 21 bp, Homo sapiens
cagtgggaggtgagaccacct

SEQ ID NO: 3863535 - DNA, 16 bp, Homo sapiens
cagtgggtggcacctc

SEQ ID NO: 3863536 - DNA, 21 bp, Homo sapiens
cagtgggtggcacctcctgag

SEQ ID NO: 3863537 - DNA, 20 bp, Homo sapiens
cagtgggtgggagctccttt

SEQ ID NO: 3863538 - DNA, 14 bp, Homo sapiens
cagtggttgctgtt

SEQ ID NO: 3863539 - DNA, 17 bp, Homo sapiens
cagtgtatggaaataaa

SEQ ID NO: 3863540 - DNA, 19 bp, Homo sapiens
cagtgtcccctccactgtc

SEQ ID NO: 3863541 - DNA, 14 bp, Homo sapiens
cagtgtggagaggg

SEQ ID NO: 3863542 - DNA, 19 bp, Homo sapiens
cagtgtgtccttggggcac

SEQ ID NO: 3863543 - DNA, 22 bp, Homo sapiens
cagtgttggctgtgtgacagaa

SEQ ID NO: 3863544 - DNA, 19 bp, Homo sapiens
cagttaactttaagactga

SEQ ID NO: 3863545 - DNA, 16 bp, Homo sapiens
cagttactcagccctg

SEQ ID NO: 3863546 - DNA, 18 bp, Homo sapiens
cagttactcagccctggg

SEQ ID NO: 3863547 - DNA, 21 bp, Homo sapiens
cagttataagtagcaggccaa

SEQ ID NO: 3863548 - DNA, 14 bp, Homo sapiens
cagttatcagggat

SEQ ID NO: 3863549 - DNA, 13 bp, Homo sapiens
cagttatggctat

SEQ ID NO: 3863550 - DNA, 16 bp, Homo sapiens
cagttattcagattga

SEQ ID NO: 3863551 - DNA, 19 bp, Homo sapiens
cagttattcagattgacaa

SEQ ID NO: 3863552 - DNA, 15 bp, Homo sapiens
cagttcaaagcagga

SEQ ID NO: 3863553 - DNA, 17 bp, Homo sapiens
cagttcaaatcctcacc

SEQ ID NO: 3863554 - DNA, 22 bp, Homo sapiens
cagttcaacctggtggcaccag

SEQ ID NO: 3863555 - DNA, 23 bp, Homo sapiens
cagttcagagttgtacactgtgt

SEQ ID NO: 3863556 - DNA, 23 bp, Homo sapiens
cagttccgggagagcggctgccc

SEQ ID NO: 3863557 - DNA, 14 bp, Homo sapiens
cagttcctcgccct

SEQ ID NO: 3863558 - DNA, 17 bp, Homo sapiens
cagttcctcgccctggg

SEQ ID NO: 3863559 - DNA, 18 bp, Homo sapiens
cagttcctcgccctgggt

SEQ ID NO: 3863560 - DNA, 18 bp, Homo sapiens
cagttcgcagccaccctg

SEQ ID NO: 3863561 - DNA, 21 bp, Homo sapiens
cagttcgcagccaccctgagg

SEQ ID NO: 3863562 - DNA, 16 bp, Homo sapiens
cagttctgaactggaa

SEQ ID NO: 3863563 - DNA, 14 bp, Homo sapiens
cagttctgctcctc

SEQ ID NO: 3863564 - DNA, 15 bp, Homo sapiens
cagttctgctcctct

SEQ ID NO: 3863565 - DNA, 16 bp, Homo sapiens
cagttctgctcctctc

SEQ ID NO: 3863566 - DNA, 18 bp, Homo sapiens
cagttctgctcctctcca

SEQ ID NO: 3863567 - DNA, 19 bp, Homo sapiens
cagttctgctcctctccag

SEQ ID NO: 3863568 - DNA, 16 bp, Homo sapiens
cagttcttggtgactg

SEQ ID NO: 3863569 - DNA, 18 bp, Homo sapiens
cagttgaaaagactccaa

SEQ ID NO: 3863570 - DNA, 23 bp, Homo sapiens
cagttgaaaagactccaaagaaa

SEQ ID NO: 3863571 - DNA, 14 bp, Homo sapiens
cagttgacagcagg

SEQ ID NO: 3863572 - DNA, 20 bp, Homo sapiens
cagttgagtcgtcatcactt

SEQ ID NO: 3863573 - DNA, 21 bp, Homo sapiens
cagttggcagagaaggcctct

SEQ ID NO: 3863574 - DNA, 17 bp, Homo sapiens
cagttgggagcactgga

SEQ ID NO: 3863575 - DNA, 19 bp, Homo sapiens
cagttgtctattctgagcc

SEQ ID NO: 3863576 - DNA, 22 bp, Homo sapiens
cagttgtctattctgagccttg

SEQ ID NO: 3863577 - DNA, 12 bp, Homo sapiens
cagtttaaagca

SEQ ID NO: 3863578 - DNA, 17 bp, Homo sapiens
cagtttctccatcagct

SEQ ID NO: 3863579 - DNA, 23 bp, Homo sapiens
cagtttgcagaaaagcacctgcc

SEQ ID NO: 3863580 - DNA, 12 bp, Homo sapiens
cagtttgctttg

SEQ ID NO: 3863581 - DNA, 18 bp, Homo sapiens
cagttttatccacagaaa

SEQ ID NO: 3863582 - DNA, 20 bp, Homo sapiens
cagtttttcggtgggacagc

SEQ ID NO: 3863583 - DNA, 14 bp, Homo sapiens
cataaaatctgtga

SEQ ID NO: 3863584 - DNA, 19 bp, Homo sapiens
cataaaccaatgagctgta

SEQ ID NO: 3863585 - DNA, 12 bp, Homo sapiens
cataaacttcat

SEQ ID NO: 3863586 - DNA, 16 bp, Homo sapiens
cataaacttcatggtc

SEQ ID NO: 3863587 - DNA, 20 bp, Homo sapiens
cataaccattcccattggtt

SEQ ID NO: 3863588 - DNA, 19 bp, Homo sapiens
cataacttgctgaatttca

SEQ ID NO: 3863589 - DNA, 12 bp, Homo sapiens
cataagaatgaa

SEQ ID NO: 3863590 - DNA, 16 bp, Homo sapiens
cataagaccctaagcc

SEQ ID NO: 3863591 - DNA, 15 bp, Homo sapiens
cataagaccgtgtcc

SEQ ID NO: 3863592 - DNA, 22 bp, Homo sapiens
cataaggcatatacaaataaac

SEQ ID NO: 3863593 - DNA, 21 bp, Homo sapiens
cataaggcctgccctcccatg

SEQ ID NO: 3863594 - DNA, 16 bp, Homo sapiens
cataaggtgcagtagg

SEQ ID NO: 3863595 - DNA, 18 bp, Homo sapiens
cataatagttagccctca

SEQ ID NO: 3863596 - DNA, 14 bp, Homo sapiens
cataatcaaagcta

SEQ ID NO: 3863597 - DNA, 20 bp, Homo sapiens
cataatctggactcctctgt

SEQ ID NO: 3863598 - DNA, 21 bp, Homo sapiens
cataatctggactcctctgtc

SEQ ID NO: 3863599 - DNA, 13 bp, Homo sapiens
cataatgccactg

SEQ ID NO: 3863600 - DNA, 21 bp, Homo sapiens
cataatgctcccatctcctga

SEQ ID NO: 3863601 - DNA, 16 bp, Homo sapiens
cataattagaacaata

SEQ ID NO: 3863602 - DNA, 16 bp, Homo sapiens
cataattcttgtatat

SEQ ID NO: 3863603 - DNA, 13 bp, Homo sapiens
cataattttcaag

SEQ ID NO: 3863604 - DNA, 12 bp, Homo sapiens
catacaatttgc

SEQ ID NO: 3863605 - DNA, 21 bp, Homo sapiens
catacacttgtataaatgtat

SEQ ID NO: 3863606 - DNA, 14 bp, Homo sapiens
cagccaccctgagg

SEQ ID NO: 3863607 - DNA, 15 bp, Homo sapiens
cagccaccctgagga

SEQ ID NO: 3863608 - DNA, 16 bp, Homo sapiens
cagccacctctctttt

SEQ ID NO: 3863609 - DNA, 21 bp, Homo sapiens
cagccactcgggaggctgaga

SEQ ID NO: 3863610 - DNA, 22 bp, Homo sapiens
cagccacttggtttttggctct

SEQ ID NO: 3863611 - DNA, 14 bp, Homo sapiens
cagccagactggca

SEQ ID NO: 3863612 - DNA, 20 bp, Homo sapiens
cagccagactggcacagttt

SEQ ID NO: 3863613 - DNA, 20 bp, Homo sapiens
cagccagcaatgatgtccag

SEQ ID NO: 3863614 - DNA, 22 bp, Homo sapiens
cagccagcaatgatgtccagaa

SEQ ID NO: 3863615 - DNA, 17 bp, Homo sapiens
cagccagccagtcttgc

SEQ ID NO: 3863616 - DNA, 13 bp, Homo sapiens
cagccagcccagc

SEQ ID NO: 3863617 - DNA, 17 bp, Homo sapiens
cagccagcccagcccag

SEQ ID NO: 3863618 - DNA, 12 bp, Homo sapiens
cagccagccctg

SEQ ID NO: 3863619 - DNA, 17 bp, Homo sapiens
cagccagccctgcctgg

SEQ ID NO: 3863620 - DNA, 14 bp, Homo sapiens
cagccagccgccct

SEQ ID NO: 3863621 - DNA, 16 bp, Homo sapiens
cagccagccgccctgg

SEQ ID NO: 3863622 - DNA, 23 bp, Homo sapiens
cagccagccgccctgggctgtct

SEQ ID NO: 3863623 - DNA, 19 bp, Homo sapiens
cagccagccggtgcctggc

SEQ ID NO: 3863624 - DNA, 11 bp, Homo sapiens
cagccagggcc

SEQ ID NO: 3863625 - DNA, 20 bp, Homo sapiens
cagccagtcttgcctaggcc

SEQ ID NO: 3863626 - DNA, 16 bp, Homo sapiens
cagccatcacaagggg

SEQ ID NO: 3863627 - DNA, 22 bp, Homo sapiens
cagccatcacaaggggaacgca

SEQ ID NO: 3863628 - DNA, 22 bp, Homo sapiens
cagccatgaggagttgctgttt

SEQ ID NO: 3863629 - DNA, 12 bp, Homo sapiens
cagccatgcctc

SEQ ID NO: 3863630 - DNA, 17 bp, Homo sapiens
cagccatgcctcatgcc

SEQ ID NO: 3863631 - DNA, 18 bp, Homo sapiens
cagccatgcctcatgcca

SEQ ID NO: 3863632 - DNA, 20 bp, Homo sapiens
cagccatgcctcatgccaca

SEQ ID NO: 3863633 - DNA, 14 bp, Homo sapiens
cagccatgtttggt

SEQ ID NO: 3863634 - DNA, 17 bp, Homo sapiens
cagcccaacagaaggaa

SEQ ID NO: 3863635 - DNA, 21 bp, Homo sapiens
cagcccaagaggactgagact

SEQ ID NO: 3863636 - DNA, 16 bp, Homo sapiens
cagcccacacccctcc

SEQ ID NO: 3863637 - DNA, 17 bp, Homo sapiens
cagcccagcccagctgg

SEQ ID NO: 3863638 - DNA, 15 bp, Homo sapiens
cagcccaggtcctcc

SEQ ID NO: 3863639 - DNA, 18 bp, Homo sapiens
cagcccattctctctcct

SEQ ID NO: 3863640 - DNA, 18 bp, Homo sapiens
cagccccaaaccagggtg

SEQ ID NO: 3863641 - DNA, 13 bp, Homo sapiens
cagccccacagca

SEQ ID NO: 3863642 - DNA, 17 bp, Homo sapiens
cagccccacagcaccca

SEQ ID NO: 3863643 - DNA, 13 bp, Homo sapiens
cagccccagggcc

SEQ ID NO: 3863644 - DNA, 12 bp, Homo sapiens
cagccccagggg

SEQ ID NO: 3863645 - DNA, 13 bp, Homo sapiens
cagcccgaagccc

SEQ ID NO: 3863646 - DNA, 15 bp, Homo sapiens
cagcccgaagcccag

SEQ ID NO: 3863647 - DNA, 15 bp, Homo sapiens
cagcccgaatgcctg

SEQ ID NO: 3863648 - DNA, 16 bp, Homo sapiens
cagcccgaatgcctgt

SEQ ID NO: 3863649 - DNA, 15 bp, Homo sapiens
cagcccggcgccacc

SEQ ID NO: 3863650 - DNA, 21 bp, Homo sapiens
cagcccggcgccaccatcctg

SEQ ID NO: 3863651 - DNA, 22 bp, Homo sapiens
cagcccgtgaagcagtgcctcg

SEQ ID NO: 3863652 - DNA, 23 bp, Homo sapiens
cagcccgtgaagcagtgcctcga

SEQ ID NO: 3863653 - DNA, 17 bp, Homo sapiens
cagccctaaggatctct

SEQ ID NO: 3863654 - DNA, 18 bp, Homo sapiens
cagccctaaggatctctc

SEQ ID NO: 3863655 - DNA, 22 bp, Homo sapiens
cagccctaaggatctctcagga

SEQ ID NO: 3863656 - DNA, 19 bp, Homo sapiens
cagccctacatcttcagct

SEQ ID NO: 3863657 - DNA, 14 bp, Homo sapiens
cagccctatggatg

SEQ ID NO: 3863658 - DNA, 13 bp, Homo sapiens
cagccctccctgc

SEQ ID NO: 3863659 - DNA, 15 bp, Homo sapiens
cagccctccctgccc

SEQ ID NO: 3863660 - DNA, 14 bp, Homo sapiens
cagccctccctgtc

SEQ ID NO: 3863661 - DNA, 13 bp, Homo sapiens
cagccctcctcac

SEQ ID NO: 3863662 - DNA, 14 bp, Homo sapiens
cagccctcctcacc

SEQ ID NO: 3863663 - DNA, 17 bp, Homo sapiens
cagccctgcctggagga

SEQ ID NO: 3863664 - DNA, 19 bp, Homo sapiens
cagccctgctttgggctgc

SEQ ID NO: 3863665 - DNA, 13 bp, Homo sapiens
cagccctgggccc

SEQ ID NO: 3863666 - DNA, 17 bp, Homo sapiens
cagccctgggccccacc

SEQ ID NO: 3863667 - DNA, 18 bp, Homo sapiens
cagccctgggggccagct

SEQ ID NO: 3863668 - DNA, 23 bp, Homo sapiens
cagccctggggtatgagctgcca

SEQ ID NO: 3863669 - DNA, 23 bp, Homo sapiens
cagcccttcctcctgaagcctct

SEQ ID NO: 3863670 - DNA, 12 bp, Homo sapiens
cagcccttgccc

SEQ ID NO: 3863671 - DNA, 17 bp, Homo sapiens
cagccgagccgggcctg

SEQ ID NO: 3863672 - DNA, 19 bp, Homo sapiens
cagccgagccgggcctggg

SEQ ID NO: 3863673 - DNA, 21 bp, Homo sapiens
cagccgctaggagagactgaa

SEQ ID NO: 3863674 - DNA, 20 bp, Homo sapiens
cagccggcgtggcaaatata

SEQ ID NO: 3863675 - DNA, 20 bp, Homo sapiens
cagccggggcgagtggcacg

SEQ ID NO: 3863676 - DNA, 21 bp, Homo sapiens
cagccggtacctgggaagggg

SEQ ID NO: 3863677 - DNA, 17 bp, Homo sapiens
cagccgtgatgctcagg

SEQ ID NO: 3863678 - DNA, 9 bp, Homo sapiens
cagccgtgc

SEQ ID NO: 3863679 - DNA, 20 bp, Homo sapiens
cagccgtgccttcagctcta

SEQ ID NO: 3863680 - DNA, 12 bp, Homo sapiens
cagcctcacaga

SEQ ID NO: 3863681 - DNA, 17 bp, Homo sapiens
cagcctcagctcagcct

SEQ ID NO: 3863682 - DNA, 18 bp, Homo sapiens
cagcctcagctcagcctc

SEQ ID NO: 3863683 - DNA, 12 bp, Homo sapiens
cagcctcagtgc

SEQ ID NO: 3863684 - DNA, 17 bp, Homo sapiens
cagcctcagtgccactt

SEQ ID NO: 3863685 - DNA, 17 bp, Homo sapiens
cagcctccagagccagc

SEQ ID NO: 3863686 - DNA, 18 bp, Homo sapiens
cagcctccagagccagcc

SEQ ID NO: 3863687 - DNA, 22 bp, Homo sapiens
cagcctccagagccagcctggg

SEQ ID NO: 3863688 - DNA, 18 bp, Homo sapiens
cagcctccatgctgcctc

SEQ ID NO: 3863689 - DNA, 13 bp, Homo sapiens
cagcctcccagag

SEQ ID NO: 3863690 - DNA, 13 bp, Homo sapiens
cagcctcccccac

SEQ ID NO: 3863691 - DNA, 18 bp, Homo sapiens
cagcctccccctgctgct

SEQ ID NO: 3863692 - DNA, 16 bp, Homo sapiens
cagatctgcactgggt

SEQ ID NO: 3863693 - DNA, 17 bp, Homo sapiens
cagatctgcctgggcct

SEQ ID NO: 3863694 - DNA, 13 bp, Homo sapiens
cagatcttgacag

SEQ ID NO: 3863695 - DNA, 15 bp, Homo sapiens
cagatgataaatatt

SEQ ID NO: 3863696 - DNA, 16 bp, Homo sapiens
cagatgataaatattt

SEQ ID NO: 3863697 - DNA, 14 bp, Homo sapiens
cagatggaaagaaa

SEQ ID NO: 3863698 - DNA, 21 bp, Homo sapiens
cagatggaaagacgtttttgt

SEQ ID NO: 3863699 - DNA, 15 bp, Homo sapiens
cagatgggggactga

SEQ ID NO: 3863700 - DNA, 16 bp, Homo sapiens
cagatgggtattaaac

SEQ ID NO: 3863701 - DNA, 16 bp, Homo sapiens
cagattcctgggcctg

SEQ ID NO: 3863702 - DNA, 17 bp, Homo sapiens
cagattcctgggcctgt

SEQ ID NO: 3863703 - DNA, 20 bp, Homo sapiens
cagattcctgggcctgtccc

SEQ ID NO: 3863704 - DNA, 21 bp, Homo sapiens
cagattcctgggcctgtcccc

SEQ ID NO: 3863705 - DNA, 13 bp, Homo sapiens
cagattctgattt

SEQ ID NO: 3863706 - DNA, 11 bp, Homo sapiens
cagattcttcc

SEQ ID NO: 3863707 - DNA, 16 bp, Homo sapiens
cagattcttccactgg

SEQ ID NO: 3863708 - DNA, 17 bp, Homo sapiens
cagatttttgtaataaa

SEQ ID NO: 3863709 - DNA, 22 bp, Homo sapiens
cagattttttacagctgcctgc

SEQ ID NO: 3863710 - DNA, 17 bp, Homo sapiens
cagcaacagaaaaatgg

SEQ ID NO: 3863711 - DNA, 12 bp, Homo sapiens
cagcaactccca

SEQ ID NO: 3863712 - DNA, 12 bp, Homo sapiens
cagcaagccggc

SEQ ID NO: 3863713 - DNA, 20 bp, Homo sapiens
cagcaaggcccgagcagctg

SEQ ID NO: 3863714 - DNA, 23 bp, Homo sapiens
cagcaaggcccgagcagctgagc

SEQ ID NO: 3863715 - DNA, 16 bp, Homo sapiens
cagcaaggtgtgaatg

SEQ ID NO: 3863716 - DNA, 21 bp, Homo sapiens
cagcaaggtgtgaatgacctt

SEQ ID NO: 3863717 - DNA, 17 bp, Homo sapiens
cagcaagtttcaccttg

SEQ ID NO: 3863718 - DNA, 21 bp, Homo sapiens
cagcaatagggtgcagttttc

SEQ ID NO: 3863719 - DNA, 14 bp, Homo sapiens
cagcacaccccaag

SEQ ID NO: 3863720 - DNA, 16 bp, Homo sapiens
cagcacaccccaaggg

SEQ ID NO: 3863721 - DNA, 22 bp, Homo sapiens
cagcacaccccaagggacaacc

SEQ ID NO: 3863722 - DNA, 17 bp, Homo sapiens
cagcacaggggccccag

SEQ ID NO: 3863723 - DNA, 21 bp, Homo sapiens
cagcacaggggccccagatct

SEQ ID NO: 3863724 - DNA, 23 bp, Homo sapiens
cagcaccaattgtacattccctg

SEQ ID NO: 3863725 - DNA, 14 bp, Homo sapiens
cagcacccaggctc

SEQ ID NO: 3863726 - DNA, 12 bp, Homo sapiens
cagcaccctccc

SEQ ID NO: 3863727 - DNA, 14 bp, Homo sapiens
cagcaccctccccc

SEQ ID NO: 3863728 - DNA, 19 bp, Homo sapiens
cagcaccctcccccgcagc

SEQ ID NO: 3863729 - DNA, 14 bp, Homo sapiens
cagcaccctctcct

SEQ ID NO: 3863730 - DNA, 11 bp, Homo sapiens
cagcaccctgg

SEQ ID NO: 3863731 - DNA, 14 bp, Homo sapiens
cagcaccctgggtg

SEQ ID NO: 3863732 - DNA, 20 bp, Homo sapiens
cagcaccctgggtgccattc

SEQ ID NO: 3863733 - DNA, 16 bp, Homo sapiens
cagcactaaggccgtg

SEQ ID NO: 3863734 - DNA, 11 bp, Homo sapiens
cagcactgaaa

SEQ ID NO: 3863735 - DNA, 19 bp, Homo sapiens
cagcactttaaccctctct

SEQ ID NO: 3863736 - DNA, 20 bp, Homo sapiens
cagcactttaaccctctctt

SEQ ID NO: 3863737 - DNA, 14 bp, Homo sapiens
cagcagaaaagtgc

SEQ ID NO: 3863738 - DNA, 16 bp, Homo sapiens
cagcagaaaagtgctt

SEQ ID NO: 3863739 - DNA, 12 bp, Homo sapiens
cagcagaaagac

SEQ ID NO: 3863740 - DNA, 15 bp, Homo sapiens
cagcagaaagactgg

SEQ ID NO: 3863741 - DNA, 17 bp, Homo sapiens
cagcagatggaaagaaa

SEQ ID NO: 3863742 - DNA, 16 bp, Homo sapiens
cagcagcactgcagat

SEQ ID NO: 3863743 - DNA, 13 bp, Homo sapiens
cagcagccagccc

SEQ ID NO: 3863744 - DNA, 16 bp, Homo sapiens
cagcagccagccctgc

SEQ ID NO: 3863745 - DNA, 21 bp, Homo sapiens
cagcagccagccctgcctgga

SEQ ID NO: 3863746 - DNA, 23 bp, Homo sapiens
cagcagcccctctttaacctcat

SEQ ID NO: 3863747 - DNA, 13 bp, Homo sapiens
cagcagcccctgc

SEQ ID NO: 3863748 - DNA, 11 bp, Homo sapiens
cagcagcccta

SEQ ID NO: 3863749 - DNA, 15 bp, Homo sapiens
cagcagccctcctca

SEQ ID NO: 3863750 - DNA, 17 bp, Homo sapiens
cagcagccctcctcacc

SEQ ID NO: 3863751 - DNA, 20 bp, Homo sapiens
cagcagctgaacagccaaat

SEQ ID NO: 3863752 - DNA, 22 bp, Homo sapiens
cagcagctgcgggtctgaagga

SEQ ID NO: 3863753 - DNA, 14 bp, Homo sapiens
cagcagctgggacc

SEQ ID NO: 3863754 - DNA, 15 bp, Homo sapiens
cagcagctgggaccc

SEQ ID NO: 3863755 - DNA, 20 bp, Homo sapiens
cagcagctgggccggccagc

SEQ ID NO: 3863756 - DNA, 22 bp, Homo sapiens
cagcaggaacctgtactgggtt

SEQ ID NO: 3863757 - DNA, 15 bp, Homo sapiens
cagcagggcctcaaa

SEQ ID NO: 3863758 - DNA, 17 bp, Homo sapiens
cagcagggtcttgctgt

SEQ ID NO: 3863759 - DNA, 16 bp, Homo sapiens
cagcaggtgcaagaga

SEQ ID NO: 3863760 - DNA, 17 bp, Homo sapiens
cagcaggtgcaagagac

SEQ ID NO: 3863761 - DNA, 23 bp, Homo sapiens
cagcaggtgcaagagacagagcc

SEQ ID NO: 3863762 - DNA, 16 bp, Homo sapiens
cagcaggtgtggtggc

SEQ ID NO: 3863763 - DNA, 23 bp, Homo sapiens
cagcaggtgtggtggctcatggc

SEQ ID NO: 3863764 - DNA, 19 bp, Homo sapiens
cagcagtgttccccatctg

SEQ ID NO: 3863765 - DNA, 22 bp, Homo sapiens
cagcagtgttccccatctgggt

SEQ ID NO: 3863766 - DNA, 17 bp, Homo sapiens
cagcagttccatgaaga

SEQ ID NO: 3863767 - DNA, 15 bp, Homo sapiens
cagcataattcggaa

SEQ ID NO: 3863768 - DNA, 18 bp, Homo sapiens
cagcatacagagcaggcc

SEQ ID NO: 3863769 - DNA, 14 bp, Homo sapiens
cagcatatttatag

SEQ ID NO: 3863770 - DNA, 14 bp, Homo sapiens
cagcatccagcctg

SEQ ID NO: 3863771 - DNA, 20 bp, Homo sapiens
cagcatgggcccaggaatgc

SEQ ID NO: 3863772 - DNA, 19 bp, Homo sapiens
cagcattcagcacacccca

SEQ ID NO: 3863773 - DNA, 15 bp, Homo sapiens
cagcattctcactcc

SEQ ID NO: 3863774 - DNA, 23 bp, Homo sapiens
cagcattttactacttgttacct

SEQ ID NO: 3863775 - DNA, 18 bp, Homo sapiens
cagccaacaaacatagaa

SEQ ID NO: 3863776 - DNA, 22 bp, Homo sapiens
cagccaacaggtggcaggacca

SEQ ID NO: 3863777 - DNA, 20 bp, Homo sapiens
cagccacacttctcaggaca

SEQ ID NO: 3863778 - DNA, 21 bp, Homo sapiens
cactctttgctacaataaatg

SEQ ID NO: 3863779 - DNA, 12 bp, Homo sapiens
cactgaaaacat

SEQ ID NO: 3863780 - DNA, 22 bp, Homo sapiens
cactgaaaaggttcttcatccc

SEQ ID NO: 3863781 - DNA, 22 bp, Homo sapiens
cactgaagttaacagagacaga

SEQ ID NO: 3863782 - DNA, 19 bp, Homo sapiens
cactgacccacagcctctg

SEQ ID NO: 3863783 - DNA, 14 bp, Homo sapiens
cactgacccttcca

SEQ ID NO: 3863784 - DNA, 16 bp, Homo sapiens
cactgacccttccaga

SEQ ID NO: 3863785 - DNA, 14 bp, Homo sapiens
cactgactgggacc

SEQ ID NO: 3863786 - DNA, 20 bp, Homo sapiens
cactgaggatgtgagcctga

SEQ ID NO: 3863787 - DNA, 16 bp, Homo sapiens
cactgatttggagata

SEQ ID NO: 3863788 - DNA, 13 bp, Homo sapiens
cactgcaagagcc

SEQ ID NO: 3863789 - DNA, 15 bp, Homo sapiens
cactgcaagagcctt

SEQ ID NO: 3863790 - DNA, 16 bp, Homo sapiens
cactgcaagagccttg

SEQ ID NO: 3863791 - DNA, 21 bp, Homo sapiens
cactgcacagtgcatctcagc

SEQ ID NO: 3863792 - DNA, 23 bp, Homo sapiens
cactgcacagtgcatctcagccc

SEQ ID NO: 3863793 - DNA, 16 bp, Homo sapiens
cactgcactccagcct

SEQ ID NO: 3863794 - DNA, 21 bp, Homo sapiens
cactgcagatagccagacaca

SEQ ID NO: 3863795 - DNA, 23 bp, Homo sapiens
cactgcagtccgcagtctggcct

SEQ ID NO: 3863796 - DNA, 13 bp, Homo sapiens
cactgcagtgatg

SEQ ID NO: 3863797 - DNA, 15 bp, Homo sapiens
cactgcagtgatggc

SEQ ID NO: 3863798 - DNA, 14 bp, Homo sapiens
cactgccaggcacc

SEQ ID NO: 3863799 - DNA, 16 bp, Homo sapiens
cactgccaggcacctg

SEQ ID NO: 3863800 - DNA, 17 bp, Homo sapiens
cactgccaggcacctgg

SEQ ID NO: 3863801 - DNA, 11 bp, Homo sapiens
cactgccatgc

SEQ ID NO: 3863802 - DNA, 17 bp, Homo sapiens
cactgccctgcctgccc

SEQ ID NO: 3863803 - DNA, 16 bp, Homo sapiens
cactgcctcttcctcc

SEQ ID NO: 3863804 - DNA, 22 bp, Homo sapiens
cactgctcaagaagacatggag

SEQ ID NO: 3863805 - DNA, 14 bp, Homo sapiens
cactgctgcaccag

SEQ ID NO: 3863806 - DNA, 16 bp, Homo sapiens
cactgctgcaccagag

SEQ ID NO: 3863807 - DNA, 20 bp, Homo sapiens
cactgctgcaccagagtgaa

SEQ ID NO: 3863808 - DNA, 15 bp, Homo sapiens
cactgctgcccagcc

SEQ ID NO: 3863809 - DNA, 12 bp, Homo sapiens
cactgctggctg

SEQ ID NO: 3863810 - DNA, 15 bp, Homo sapiens
cactgctggctgcct

SEQ ID NO: 3863811 - DNA, 21 bp, Homo sapiens
cactgctggctgccttagaac

SEQ ID NO: 3863812 - DNA, 17 bp, Homo sapiens
cactggaaaataaattt

SEQ ID NO: 3863813 - DNA, 21 bp, Homo sapiens
cactggaatcgatctgtactg

SEQ ID NO: 3863814 - DNA, 22 bp, Homo sapiens
cactggaatcgatctgtactgt

SEQ ID NO: 3863815 - DNA, 17 bp, Homo sapiens
cactggagcaccaggca

SEQ ID NO: 3863816 - DNA, 23 bp, Homo sapiens
cactggagtgcagggaggagagg

SEQ ID NO: 3863817 - DNA, 22 bp, Homo sapiens
cactggagttacattaatgtta

SEQ ID NO: 3863818 - DNA, 11 bp, Homo sapiens
cactggccacc

SEQ ID NO: 3863819 - DNA, 15 bp, Homo sapiens
cactggccagagagg

SEQ ID NO: 3863820 - DNA, 16 bp, Homo sapiens
cactggccagagaggg

SEQ ID NO: 3863821 - DNA, 18 bp, Homo sapiens
cactggccagagagggcc

SEQ ID NO: 3863822 - DNA, 19 bp, Homo sapiens
cactggccagagagggccc

SEQ ID NO: 3863823 - DNA, 22 bp, Homo sapiens
cactggccagagagggcccagc

SEQ ID NO: 3863824 - DNA, 15 bp, Homo sapiens
cactggccagtccta

SEQ ID NO: 3863825 - DNA, 19 bp, Homo sapiens
cactggccagtcctagagc

SEQ ID NO: 3863826 - DNA, 16 bp, Homo sapiens
cactggctggggcaga

SEQ ID NO: 3863827 - DNA, 22 bp, Homo sapiens
cactggctggggcagaggggca

SEQ ID NO: 3863828 - DNA, 20 bp, Homo sapiens
cactgggatgagccgctgtg

SEQ ID NO: 3863829 - DNA, 17 bp, Homo sapiens
cactgggtctcactcct

SEQ ID NO: 3863830 - DNA, 18 bp, Homo sapiens
cactgggtctcactcctg

SEQ ID NO: 3863831 - DNA, 19 bp, Homo sapiens
cactgggtctcactcctga

SEQ ID NO: 3863832 - DNA, 23 bp, Homo sapiens
cactgggtgtggccccgcagtgc

SEQ ID NO: 3863833 - DNA, 16 bp, Homo sapiens
cactgggttctagaac

SEQ ID NO: 3863834 - DNA, 13 bp, Homo sapiens
cactggtggcccg

SEQ ID NO: 3863835 - DNA, 22 bp, Homo sapiens
cactggtggcccgacagcctgg

SEQ ID NO: 3863836 - DNA, 20 bp, Homo sapiens
cactggttaaaataaagcct

SEQ ID NO: 3863837 - DNA, 17 bp, Homo sapiens
cactggttgtaagtaat

SEQ ID NO: 3863838 - DNA, 15 bp, Homo sapiens
cactgtaaacccctg

SEQ ID NO: 3863839 - DNA, 18 bp, Homo sapiens
cactgtaaatatccacag

SEQ ID NO: 3863840 - DNA, 17 bp, Homo sapiens
cactgtaacctcaaact

SEQ ID NO: 3863841 - DNA, 21 bp, Homo sapiens
cactgtaatcttaaaagtgta

SEQ ID NO: 3863842 - DNA, 23 bp, Homo sapiens
cactgtccctcaaatgacccaaa

SEQ ID NO: 3863843 - DNA, 17 bp, Homo sapiens
cactgtccgcctctgcc

SEQ ID NO: 3863844 - DNA, 18 bp, Homo sapiens
cactgtccgcctctgccc

SEQ ID NO: 3863845 - DNA, 16 bp, Homo sapiens
cactgtgcttacagtg

SEQ ID NO: 3863846 - DNA, 17 bp, Homo sapiens
cactgtgcttacagtga

SEQ ID NO: 3863847 - DNA, 13 bp, Homo sapiens
cactgtggccaga

SEQ ID NO: 3863848 - DNA, 16 bp, Homo sapiens
cactgtggccagagct

SEQ ID NO: 3863849 - DNA, 18 bp, Homo sapiens
cactgtgggggctggtcc

SEQ ID NO: 3863850 - DNA, 19 bp, Homo sapiens
cactgtgttggccaggctg

SEQ ID NO: 3863851 - DNA, 20 bp, Homo sapiens
cactgtgttggccaggctgg

SEQ ID NO: 3863852 - DNA, 22 bp, Homo sapiens
cactgtgttggccaggctggtc

SEQ ID NO: 3863853 - DNA, 21 bp, Homo sapiens
cactgttactttttagtcttt

SEQ ID NO: 3863854 - DNA, 16 bp, Homo sapiens
cactgttgaaaattat

SEQ ID NO: 3863855 - DNA, 22 bp, Homo sapiens
cacttacttcgtgcgcaacaac

SEQ ID NO: 3863856 - DNA, 24 bp, Homo sapiens
cacttagaaattgcatttcctgac

SEQ ID NO: 3863857 - DNA, 23 bp, Homo sapiens
cacttagcccaagaggtctgagc

SEQ ID NO: 3863858 - DNA, 19 bp, Homo sapiens
cacttagccgtccatggca

SEQ ID NO: 3863859 - DNA, 20 bp, Homo sapiens
cacttattccccattcttcc

SEQ ID NO: 3863860 - DNA, 14 bp, Homo sapiens
cacttcactgtgag

SEQ ID NO: 3863861 - DNA, 14 bp, Homo sapiens
cacttcaggctctt

SEQ ID NO: 3863862 - DNA, 15 bp, Homo sapiens
cacttccctgggaac

SEQ ID NO: 3863863 - DNA, 18 bp, Homo sapiens
cacttctaaatgaagtgc

SEQ ID NO: 3863864 - DNA, 19 bp, Homo sapiens
cacttctcaggacacaggc

SEQ ID NO: 3863865 - DNA, 19 bp, Homo sapiens
cacttgcgtcctgcagagg

SEQ ID NO: 3863866 - DNA, 20 bp, Homo sapiens
cacttgcgtcctgcagagga

SEQ ID NO: 3863867 - DNA, 15 bp, Homo sapiens
cacttggagcccgtg

SEQ ID NO: 3863868 - DNA, 14 bp, Homo sapiens
cacttgtaaataaa

SEQ ID NO: 3863869 - DNA, 15 bp, Homo sapiens
cacttgtaaataaat

SEQ ID NO: 3863870 - DNA, 16 bp, Homo sapiens
cacttgtaaataaata

SEQ ID NO: 3863871 - DNA, 12 bp, Homo sapiens
cacttgtacaaa

SEQ ID NO: 3863872 - DNA, 15 bp, Homo sapiens
cacttgttccttctg

SEQ ID NO: 3863873 - DNA, 15 bp, Homo sapiens
cactttaaagtcttt

SEQ ID NO: 3863874 - DNA, 20 bp, Homo sapiens
cactttaattctcatgtgat

SEQ ID NO: 3863875 - DNA, 22 bp, Homo sapiens
cactttaattctcatgtgatcc

SEQ ID NO: 3863876 - DNA, 19 bp, Homo sapiens
cactttcctacaaaatgga

SEQ ID NO: 3863877 - DNA, 22 bp, Homo sapiens
cactttctcatgatttacagag

SEQ ID NO: 3863878 - DNA, 18 bp, Homo sapiens
cactttggagctttagct

SEQ ID NO: 3863879 - DNA, 19 bp, Homo sapiens
cactttggcttctcctgtg

SEQ ID NO: 3863880 - DNA, 19 bp, Homo sapiens
cagaaaaaaaaaaagaaac

SEQ ID NO: 3863881 - DNA, 21 bp, Homo sapiens
cagaaaacttagaaataagaa

SEQ ID NO: 3863882 - DNA, 21 bp, Homo sapiens
cagaaaagaggagaccctgga

SEQ ID NO: 3863883 - DNA, 13 bp, Homo sapiens
cagaaaagtgctt

SEQ ID NO: 3863884 - DNA, 22 bp, Homo sapiens
cagaaaagtgcttagaaagtta

SEQ ID NO: 3863885 - DNA, 18 bp, Homo sapiens
cagaaacaaaaacactaa

SEQ ID NO: 3863886 - DNA, 22 bp, Homo sapiens
cagaaaccaagtctacttcact

SEQ ID NO: 3863887 - DNA, 17 bp, Homo sapiens
cagaaactccttttgct

SEQ ID NO: 3863888 - DNA, 22 bp, Homo sapiens
cagaaagattctagctattatt

SEQ ID NO: 3863889 - DNA, 12 bp, Homo sapiens
cagaaagcaaca

SEQ ID NO: 3863890 - DNA, 17 bp, Homo sapiens
cagaaagccttccatta

SEQ ID NO: 3863891 - DNA, 18 bp, Homo sapiens
cagaaagggagggctctg

SEQ ID NO: 3863892 - DNA, 21 bp, Homo sapiens
cagaaagggagggctctgagg

SEQ ID NO: 3863893 - DNA, 23 bp, Homo sapiens
cagaaagggagggctctgaggcg

SEQ ID NO: 3863894 - DNA, 22 bp, Homo sapiens
cagaaagtggccatgccaccct

SEQ ID NO: 3863895 - DNA, 21 bp, Homo sapiens
cagaaataaaatgaaatgtct

SEQ ID NO: 3863896 - DNA, 22 bp, Homo sapiens
cagaaataaaatgaaatgtctt

SEQ ID NO: 3863897 - DNA, 16 bp, Homo sapiens
cagaaatactgctctg

SEQ ID NO: 3863898 - DNA, 16 bp, Homo sapiens
cagaaatatatataca

SEQ ID NO: 3863899 - DNA, 22 bp, Homo sapiens
cagaaatatatatacatatgta

SEQ ID NO: 3863900 - DNA, 16 bp, Homo sapiens
cagaaattccttccca

SEQ ID NO: 3863901 - DNA, 14 bp, Homo sapiens
cagaaatttttatt

SEQ ID NO: 3863902 - DNA, 21 bp, Homo sapiens
cagaacaaggttccctctgag

SEQ ID NO: 3863903 - DNA, 12 bp, Homo sapiens
cagaacagcaga

SEQ ID NO: 3863904 - DNA, 13 bp, Homo sapiens
cagaacagctgaa

SEQ ID NO: 3863905 - DNA, 14 bp, Homo sapiens
cagaaccacactgt

SEQ ID NO: 3863906 - DNA, 13 bp, Homo sapiens
cagaacctggagg

SEQ ID NO: 3863907 - DNA, 21 bp, Homo sapiens
cagaacggagccccaggcctc

SEQ ID NO: 3863908 - DNA, 21 bp, Homo sapiens
cagaactgaattaagttattg

SEQ ID NO: 3863909 - DNA, 15 bp, Homo sapiens
cagaactgaggtcac

SEQ ID NO: 3863910 - DNA, 17 bp, Homo sapiens
cagaactgaggtcactg

SEQ ID NO: 3863911 - DNA, 21 bp, Homo sapiens
cagaactgaggtcactgggtt

SEQ ID NO: 3863912 - DNA, 17 bp, Homo sapiens
cagaactgctaaatact

SEQ ID NO: 3863913 - DNA, 19 bp, Homo sapiens
cagaactggacgcccagct

SEQ ID NO: 3863914 - DNA, 22 bp, Homo sapiens
cagaagaaaaagttgcagtctc

SEQ ID NO: 3863915 - DNA, 18 bp, Homo sapiens
cagaagaatatgacagct

SEQ ID NO: 3863916 - DNA, 18 bp, Homo sapiens
cagaagaatattcaggac

SEQ ID NO: 3863917 - DNA, 15 bp, Homo sapiens
cagaagataacttga

SEQ ID NO: 3863918 - DNA, 18 bp, Homo sapiens
cagaagcaggttcttgat

SEQ ID NO: 3863919 - DNA, 15 bp, Homo sapiens
cagaagccaggagca

SEQ ID NO: 3863920 - DNA, 17 bp, Homo sapiens
cagaagccaggagcaaa

SEQ ID NO: 3863921 - DNA, 11 bp, Homo sapiens
cagaagcccca

SEQ ID NO: 3863922 - DNA, 22 bp, Homo sapiens
cagaagcctgggggcctggctg

SEQ ID NO: 3863923 - DNA, 20 bp, Homo sapiens
cagaaggaaggcagggagga

SEQ ID NO: 3863924 - DNA, 19 bp, Homo sapiens
cagaaggagggcagagcca

SEQ ID NO: 3863925 - DNA, 14 bp, Homo sapiens
cagaaggccaagaa

SEQ ID NO: 3863926 - DNA, 12 bp, Homo sapiens
cagaaggctggg

SEQ ID NO: 3863927 - DNA, 22 bp, Homo sapiens
cagaagtcagcccgaatgcctg

SEQ ID NO: 3863928 - DNA, 16 bp, Homo sapiens
cagaagtggggctctg

SEQ ID NO: 3863929 - DNA, 22 bp, Homo sapiens
cagaagtggggctctgggaggg

SEQ ID NO: 3863930 - DNA, 13 bp, Homo sapiens
cagaataagtgct

SEQ ID NO: 3863931 - DNA, 14 bp, Homo sapiens
cagaataagtgctg

SEQ ID NO: 3863932 - DNA, 24 bp, Homo sapiens
cagaataagtgctgtttgagatgt

SEQ ID NO: 3863933 - DNA, 16 bp, Homo sapiens
cagaatacaagccact

SEQ ID NO: 3863934 - DNA, 23 bp, Homo sapiens
cagaataccttcttcgctgctag

SEQ ID NO: 3863935 - DNA, 21 bp, Homo sapiens
cagaatccacaaagccgtgcc

SEQ ID NO: 3863936 - DNA, 14 bp, Homo sapiens
cagaatctgctgtt

SEQ ID NO: 3863937 - DNA, 17 bp, Homo sapiens
cagaatctgctgttgcc

SEQ ID NO: 3863938 - DNA, 22 bp, Homo sapiens
cagaatctgctgttgccatagc

SEQ ID NO: 3863939 - DNA, 19 bp, Homo sapiens
cagaatcttcgtcctgccc

SEQ ID NO: 3863940 - DNA, 18 bp, Homo sapiens
cagaatgaggaataataa

SEQ ID NO: 3863941 - DNA, 16 bp, Homo sapiens
cagaatgctgttttaa

SEQ ID NO: 3863942 - DNA, 14 bp, Homo sapiens
cagacaagagctgc

SEQ ID NO: 3863943 - DNA, 17 bp, Homo sapiens
cagacaagagctgctgt

SEQ ID NO: 3863944 - DNA, 16 bp, Homo sapiens
cagacaagtaatcact

SEQ ID NO: 3863945 - DNA, 18 bp, Homo sapiens
cagacaatccactctcag

SEQ ID NO: 3863946 - DNA, 22 bp, Homo sapiens
cagacacattctcctgtgcccc

SEQ ID NO: 3863947 - DNA, 23 bp, Homo sapiens
cagacaccgtttgtcccccgggg

SEQ ID NO: 3863948 - DNA, 21 bp, Homo sapiens
cagacactaagttatagtata

SEQ ID NO: 3863949 - DNA, 13 bp, Homo sapiens
cagacaggagaaa

SEQ ID NO: 3863950 - DNA, 21 bp, Homo sapiens
cagacaggagaaatgcatcca

SEQ ID NO: 3863951 - DNA, 12 bp, Homo sapiens
cagacaggagga

SEQ ID NO: 3863952 - DNA, 21 bp, Homo sapiens
cagacaggtaaatgggcagtg

SEQ ID NO: 3863953 - DNA, 19 bp, Homo sapiens
cagaccacctgccagccat

SEQ ID NO: 3863954 - DNA, 20 bp, Homo sapiens
cagaccacctgccagccatc

SEQ ID NO: 3863955 - DNA, 21 bp, Homo sapiens
cagaccacctgccagccatca

SEQ ID NO: 3863956 - DNA, 22 bp, Homo sapiens
cagaccacctgccagccatcac

SEQ ID NO: 3863957 - DNA, 17 bp, Homo sapiens
cagaccagtactgggaa

SEQ ID NO: 3863958 - DNA, 16 bp, Homo sapiens
cagacccacacatgtt

SEQ ID NO: 3863959 - DNA, 23 bp, Homo sapiens
cagacccactcccaaagctcaga

SEQ ID NO: 3863960 - DNA, 16 bp, Homo sapiens
cagaccccagcggctg

SEQ ID NO: 3863961 - DNA, 13 bp, Homo sapiens
cagacccccactc

SEQ ID NO: 3863962 - DNA, 23 bp, Homo sapiens
cagacccctggcttttcactgct

SEQ ID NO: 3863963 - DNA, 15 bp, Homo sapiens
cagaccccttggctt

SEQ ID NO: 3863964 - DNA, 23 bp, Homo sapiens
cagaccccttggcttttgcttgg

SEQ ID NO: 3863965 - DNA, 18 bp, Homo sapiens
cagaccctaccccaccac

SEQ ID NO: 3863966 - DNA, 19 bp, Homo sapiens
cagaccctgcctgagccca

SEQ ID NO: 3863967 - DNA, 15 bp, Homo sapiens
cagaccgggggccag

SEQ ID NO: 3863968 - DNA, 18 bp, Homo sapiens
cagaccgggggccagaca

SEQ ID NO: 3863969 - DNA, 16 bp, Homo sapiens
cagacctagacctggg

SEQ ID NO: 3863970 - DNA, 18 bp, Homo sapiens
cagacctctgatccctcg

SEQ ID NO: 3863971 - DNA, 21 bp, Homo sapiens
cagacctgacaccgtccctca

SEQ ID NO: 3863972 - DNA, 14 bp, Homo sapiens
cagactcaaactca

SEQ ID NO: 3863973 - DNA, 17 bp, Homo sapiens
cagactccctcccctgc

SEQ ID NO: 3863974 - DNA, 22 bp, Homo sapiens
cagactgatggcgattccctct

SEQ ID NO: 3863975 - DNA, 18 bp, Homo sapiens
cagactggcacagttttc

SEQ ID NO: 3863976 - DNA, 15 bp, Homo sapiens
cagacttctccagac

SEQ ID NO: 3863977 - DNA, 15 bp, Homo sapiens
cagacttctggaagg

SEQ ID NO: 3863978 - DNA, 20 bp, Homo sapiens
cagacttctggaaggctggc

SEQ ID NO: 3863979 - DNA, 21 bp, Homo sapiens
cagacttctggaaggctggct

SEQ ID NO: 3863980 - DNA, 19 bp, Homo sapiens
cagactttctacacctgtt

SEQ ID NO: 3863981 - DNA, 18 bp, Homo sapiens
cagagaaagaagagacag

SEQ ID NO: 3863982 - DNA, 21 bp, Homo sapiens
cagagaaatgtgaagggtggg

SEQ ID NO: 3863983 - DNA, 13 bp, Homo sapiens
cagagaagaaaga

SEQ ID NO: 3863984 - DNA, 17 bp, Homo sapiens
cagagaaggcaggaatg

SEQ ID NO: 3863985 - DNA, 19 bp, Homo sapiens
cagagaaggcctcttgtgc

SEQ ID NO: 3863986 - DNA, 15 bp, Homo sapiens
cagagaatttctacc

SEQ ID NO: 3863987 - DNA, 22 bp, Homo sapiens
cagagacagaccccttggcttt

SEQ ID NO: 3863988 - DNA, 23 bp, Homo sapiens
cagagacagaccccttggctttt

SEQ ID NO: 3863989 - DNA, 13 bp, Homo sapiens
cagagacagagag

SEQ ID NO: 3863990 - DNA, 16 bp, Homo sapiens
cagagacagagagaga

SEQ ID NO: 3863991 - DNA, 14 bp, Homo sapiens
cagagacaggaaaa

SEQ ID NO: 3863992 - DNA, 20 bp, Homo sapiens
cagagaccccttcctttcct

SEQ ID NO: 3863993 - DNA, 18 bp, Homo sapiens
cagagacctgaggcagat

SEQ ID NO: 3863994 - DNA, 17 bp, Homo sapiens
cagagacgcaagggaga

SEQ ID NO: 3863995 - DNA, 14 bp, Homo sapiens
cagagacttgggga

SEQ ID NO: 3863996 - DNA, 12 bp, Homo sapiens
cagagagaagcc

SEQ ID NO: 3863997 - DNA, 16 bp, Homo sapiens
cagagagacagaccgg

SEQ ID NO: 3863998 - DNA, 13 bp, Homo sapiens
cagagagagactg

SEQ ID NO: 3863999 - DNA, 13 bp, Homo sapiens
cagagagatgaag

SEQ ID NO: 3864000 - DNA, 13 bp, Homo sapiens
cagagaggaatca

SEQ ID NO: 3864001 - DNA, 20 bp, Homo sapiens
cagagaggagcacctgaacc

SEQ ID NO: 3864002 - DNA, 20 bp, Homo sapiens
cagagaggccttttggaatg

SEQ ID NO: 3864003 - DNA, 14 bp, Homo sapiens
cagagagggcccag

SEQ ID NO: 3864004 - DNA, 20 bp, Homo sapiens
cagagagggcccagctgtag

SEQ ID NO: 3864005 - DNA, 23 bp, Homo sapiens
cagagagggcccagctgtagcca

SEQ ID NO: 3864006 - DNA, 14 bp, Homo sapiens
cagagagtcctctg

SEQ ID NO: 3864007 - DNA, 16 bp, Homo sapiens
cagagagtcctctgga

SEQ ID NO: 3864008 - DNA, 18 bp, Homo sapiens
cagagagtcctctggatg

SEQ ID NO: 3864009 - DNA, 20 bp, Homo sapiens
cagagatatgcacacaccga

SEQ ID NO: 3864010 - DNA, 19 bp, Homo sapiens
cagagatgcatgcgcaggc

SEQ ID NO: 3864011 - DNA, 16 bp, Homo sapiens
cagagatgcctccacc

SEQ ID NO: 3864012 - DNA, 16 bp, Homo sapiens
cagagattgcttctca

SEQ ID NO: 3864013 - DNA, 13 bp, Homo sapiens
cagagcactgctc

SEQ ID NO: 3864014 - DNA, 15 bp, Homo sapiens
cagagcactgctcca

SEQ ID NO: 3864015 - DNA, 15 bp, Homo sapiens
cagagcagagagcag

SEQ ID NO: 3864016 - DNA, 19 bp, Homo sapiens
cagagcagagcaaatgagg

SEQ ID NO: 3864017 - DNA, 21 bp, Homo sapiens
cagagcagagcaaatgaggga

SEQ ID NO: 3864018 - DNA, 23 bp, Homo sapiens
cagagcaggggtccttggtgtga

SEQ ID NO: 3864019 - DNA, 18 bp, Homo sapiens
cagagcattacgtgagcc

SEQ ID NO: 3864020 - DNA, 22 bp, Homo sapiens
cagagcattacgtgagccaggt

SEQ ID NO: 3864021 - DNA, 23 bp, Homo sapiens
cagagcattacgtgagccaggta

SEQ ID NO: 3864022 - DNA, 14 bp, Homo sapiens
cagagccagcctgg

SEQ ID NO: 3864023 - DNA, 17 bp, Homo sapiens
cagagccagtgaaggag

SEQ ID NO: 3864024 - DNA, 11 bp, Homo sapiens
cagagccatgg

SEQ ID NO: 3864025 - DNA, 15 bp, Homo sapiens
cagagccatgggcct

SEQ ID NO: 3864026 - DNA, 18 bp, Homo sapiens
cagagccatgggcctggg

SEQ ID NO: 3864027 - DNA, 17 bp, Homo sapiens
cagagcccaagtgccat

SEQ ID NO: 3864028 - DNA, 18 bp, Homo sapiens
cagagccccactcccggc

SEQ ID NO: 3864029 - DNA, 14 bp, Homo sapiens
cagagcccccaagc

SEQ ID NO: 3864030 - DNA, 17 bp, Homo sapiens
cagagcccccaagcctc

SEQ ID NO: 3864031 - DNA, 21 bp, Homo sapiens
cagagcccccaaggactctgg

SEQ ID NO: 3864032 - DNA, 15 bp, Homo sapiens
cagagccccccacaa

SEQ ID NO: 3864033 - DNA, 17 bp, Homo sapiens
cagagcccctccctgct

SEQ ID NO: 3864034 - DNA, 13 bp, Homo sapiens
cagagcctagcca

SEQ ID NO: 3864035 - DNA, 17 bp, Homo sapiens
cagagcctagccacctc

SEQ ID NO: 3864036 - DNA, 19 bp, Homo sapiens
cagagcctagccacctccc

SEQ ID NO: 3864037 - DNA, 20 bp, Homo sapiens
cagagcctagccacctccca

SEQ ID NO: 3864038 - DNA, 21 bp, Homo sapiens
cagagcctagccacctcccac

SEQ ID NO: 3864039 - DNA, 23 bp, Homo sapiens
cagagcctagccacctcccaccc

SEQ ID NO: 3864040 - DNA, 14 bp, Homo sapiens
cagagcctggggct

SEQ ID NO: 3864041 - DNA, 16 bp, Homo sapiens
cagagcctggggctct

SEQ ID NO: 3864042 - DNA, 18 bp, Homo sapiens
cagagcctttggatgacc

SEQ ID NO: 3864043 - DNA, 20 bp, Homo sapiens
cagagcctttggatgaccag

SEQ ID NO: 3864044 - DNA, 13 bp, Homo sapiens
cagagcgggagtg

SEQ ID NO: 3864045 - DNA, 14 bp, Homo sapiens
cagagcgggcctct

SEQ ID NO: 3864046 - DNA, 16 bp, Homo sapiens
cagagcgggcctcttc

SEQ ID NO: 3864047 - DNA, 17 bp, Homo sapiens
cagagcgggcctcttcc

SEQ ID NO: 3864048 - DNA, 19 bp, Homo sapiens
cagagcgggcctcttccct

SEQ ID NO: 3864049 - DNA, 22 bp, Homo sapiens
cagagcgggcctcttccctcag

SEQ ID NO: 3864050 - DNA, 15 bp, Homo sapiens
cagagcggggaggtg

SEQ ID NO: 3864051 - DNA, 19 bp, Homo sapiens
cagagcggggaggtgcctg

SEQ ID NO: 3864052 - DNA, 16 bp, Homo sapiens
cagagctatggtgagg

SEQ ID NO: 3864053 - DNA, 19 bp, Homo sapiens
cagagctggaaggcagggc

SEQ ID NO: 3864054 - DNA, 21 bp, Homo sapiens
cagagctggaaggcagggcag

SEQ ID NO: 3864055 - DNA, 15 bp, Homo sapiens
cagagctggctgtct

SEQ ID NO: 3864056 - DNA, 17 bp, Homo sapiens
cagagctggctgtcttc

SEQ ID NO: 3864057 - DNA, 13 bp, Homo sapiens
cagagctgggagg

SEQ ID NO: 3864058 - DNA, 14 bp, Homo sapiens
cagagctgggaggc

SEQ ID NO: 3864059 - DNA, 18 bp, Homo sapiens
cagagctgttggcctcgc

SEQ ID NO: 3864060 - DNA, 17 bp, Homo sapiens
cagagcttattggccac

SEQ ID NO: 3864061 - DNA, 21 bp, Homo sapiens
cagagcttattggccactggg

SEQ ID NO: 3864062 - DNA, 12 bp, Homo sapiens
cagaggaagagc

SEQ ID NO: 3864063 - DNA, 15 bp, Homo sapiens
cagaggaccacagtg

SEQ ID NO: 3864064 - DNA, 13 bp, Homo sapiens
cagaggcagacag

SEQ ID NO: 3864065 - DNA, 14 bp, Homo sapiens
cagaggccaggaat

SEQ ID NO: 3864066 - DNA, 19 bp, Homo sapiens
cagaggcggaaaccttgca

SEQ ID NO: 3864067 - DNA, 20 bp, Homo sapiens
cagaggcggaaaccttgcag

SEQ ID NO: 3864068 - DNA, 21 bp, Homo sapiens
cagaggcggaaaccttgcagc

SEQ ID NO: 3864069 - DNA, 17 bp, Homo sapiens
cagaggctaagatgaga

SEQ ID NO: 3864070 - DNA, 14 bp, Homo sapiens
cagaggctggaggc

SEQ ID NO: 3864071 - DNA, 18 bp, Homo sapiens
cagaggctggaggcaggg

SEQ ID NO: 3864072 - DNA, 17 bp, Homo sapiens
cagagggaatgttccct

SEQ ID NO: 3864073 - DNA, 18 bp, Homo sapiens
cagagggaatgttccctg

SEQ ID NO: 3864074 - DNA, 16 bp, Homo sapiens
cagagggccaagagag

SEQ ID NO: 3864075 - DNA, 17 bp, Homo sapiens
cagagggccaagagaga

SEQ ID NO: 3864076 - DNA, 13 bp, Homo sapiens
cagagggccacac

SEQ ID NO: 3864077 - DNA, 14 bp, Homo sapiens
cagagggctaggga

SEQ ID NO: 3864078 - DNA, 16 bp, Homo sapiens
cagaggggcagccgct

SEQ ID NO: 3864079 - DNA, 12 bp, Homo sapiens
cagaggggcagg

SEQ ID NO: 3864080 - DNA, 17 bp, Homo sapiens
cagaggggcaggggagt

SEQ ID NO: 3864081 - DNA, 20 bp, Homo sapiens
cagaggggtaggcagagcct

SEQ ID NO: 3864082 - DNA, 20 bp, Homo sapiens
cagaggtaaaagtgtgagca

SEQ ID NO: 3864083 - DNA, 21 bp, Homo sapiens
cagaggtaaaagtgtgagcag

SEQ ID NO: 3864084 - DNA, 22 bp, Homo sapiens
cagaggtaactatcaatattta

SEQ ID NO: 3864085 - DNA, 21 bp, Homo sapiens
cagaggtgacccaatgctcct

SEQ ID NO: 3864086 - DNA, 15 bp, Homo sapiens
cagaggtgagcagag

SEQ ID NO: 3864087 - DNA, 22 bp, Homo sapiens
cagaggtgagcagaggagtcca

SEQ ID NO: 3864088 - DNA, 19 bp, Homo sapiens
cagaggtggccagagctgg

SEQ ID NO: 3864089 - DNA, 14 bp, Homo sapiens
cagaggtttcttga

SEQ ID NO: 3864090 - DNA, 18 bp, Homo sapiens
cagagtaacatgccagct

SEQ ID NO: 3864091 - DNA, 16 bp, Homo sapiens
cagagtataggatgga

SEQ ID NO: 3864092 - DNA, 18 bp, Homo sapiens
cagagtataggatggatt

SEQ ID NO: 3864093 - DNA, 22 bp, Homo sapiens
cagagtataggatggattgcag

SEQ ID NO: 3864094 - DNA, 17 bp, Homo sapiens
cagagtcagaggagaag

SEQ ID NO: 3864095 - DNA, 15 bp, Homo sapiens
cagagtgaaagggct

SEQ ID NO: 3864096 - DNA, 16 bp, Homo sapiens
cagagtggagccctca

SEQ ID NO: 3864097 - DNA, 13 bp, Homo sapiens
cagagtggagtct

SEQ ID NO: 3864098 - DNA, 15 bp, Homo sapiens
cagagtggagtctga

SEQ ID NO: 3864099 - DNA, 20 bp, Homo sapiens
cagagtgtgggaagggagag

SEQ ID NO: 3864100 - DNA, 20 bp, Homo sapiens
cagagttccacaaatctata

SEQ ID NO: 3864101 - DNA, 21 bp, Homo sapiens
cagataaagacagctgacaga

SEQ ID NO: 3864102 - DNA, 15 bp, Homo sapiens
cagataatcagcctc

SEQ ID NO: 3864103 - DNA, 23 bp, Homo sapiens
cagatacagccccaaaccagggt

SEQ ID NO: 3864104 - DNA, 14 bp, Homo sapiens
cagatacatgggga

SEQ ID NO: 3864105 - DNA, 16 bp, Homo sapiens
cagatagacagtgctg

SEQ ID NO: 3864106 - DNA, 17 bp, Homo sapiens
cagatagacagtgctgc

SEQ ID NO: 3864107 - DNA, 18 bp, Homo sapiens
cagatagacagtgctgcc

SEQ ID NO: 3864108 - DNA, 24 bp, Homo sapiens
cagatagacagtgctgccctgcga

SEQ ID NO: 3864109 - DNA, 17 bp, Homo sapiens
cagatagccagacacat

SEQ ID NO: 3864110 - DNA, 18 bp, Homo sapiens
cagatataaatggctggt

SEQ ID NO: 3864111 - DNA, 19 bp, Homo sapiens
cagatatacacatggatgc

SEQ ID NO: 3864112 - DNA, 15 bp, Homo sapiens
cagatatatttttca

SEQ ID NO: 3864113 - DNA, 19 bp, Homo sapiens
cagatatatttttcacagt

SEQ ID NO: 3864114 - DNA, 20 bp, Homo sapiens
cagatattttttcagaaata

SEQ ID NO: 3864115 - DNA, 22 bp, Homo sapiens
cagatcaccagcccggcctgct

SEQ ID NO: 3864116 - DNA, 16 bp, Homo sapiens
cagatcctcacaacca

SEQ ID NO: 3864117 - DNA, 18 bp, Homo sapiens
cagatcgtattaattatc

SEQ ID NO: 3864118 - DNA, 22 bp, Homo sapiens
cagatcgtattaattatctgat

SEQ ID NO: 3864119 - DNA, 13 bp, Homo sapiens
cagatctgcactg

SEQ ID NO: 3864120 - DNA, 15 bp, Homo sapiens
cacggagagaaggcc

SEQ ID NO: 3864121 - DNA, 16 bp, Homo sapiens
cacggatgcacagaga

SEQ ID NO: 3864122 - DNA, 19 bp, Homo sapiens
cacggcacctgggccctgg

SEQ ID NO: 3864123 - DNA, 12 bp, Homo sapiens
cacggcagctgt

SEQ ID NO: 3864124 - DNA, 11 bp, Homo sapiens
cacggccaccc

SEQ ID NO: 3864125 - DNA, 14 bp, Homo sapiens
cacggccaccctcc

SEQ ID NO: 3864126 - DNA, 22 bp, Homo sapiens
cacggccagctgcatctactca

SEQ ID NO: 3864127 - DNA, 12 bp, Homo sapiens
cacgggcctcag

SEQ ID NO: 3864128 - DNA, 14 bp, Homo sapiens
cacgggcctcagtt

SEQ ID NO: 3864129 - DNA, 16 bp, Homo sapiens
cacgggcctcagtttc

SEQ ID NO: 3864130 - DNA, 14 bp, Homo sapiens
cacggtgcgtggct

SEQ ID NO: 3864131 - DNA, 15 bp, Homo sapiens
cacggtgcgtggctg

SEQ ID NO: 3864132 - DNA, 16 bp, Homo sapiens
cacggtgcgtggctgt

SEQ ID NO: 3864133 - DNA, 19 bp, Homo sapiens
cacggtgcgtggctgtggc

SEQ ID NO: 3864134 - DNA, 12 bp, Homo sapiens
cacgtcccatgt

SEQ ID NO: 3864135 - DNA, 20 bp, Homo sapiens
cacgtccccctggggcttct

SEQ ID NO: 3864136 - DNA, 14 bp, Homo sapiens
cacgtctgccaggc

SEQ ID NO: 3864137 - DNA, 16 bp, Homo sapiens
cacgtctgccaggccc

SEQ ID NO: 3864138 - DNA, 17 bp, Homo sapiens
cacgtctgccaggccca

SEQ ID NO: 3864139 - DNA, 20 bp, Homo sapiens
cacgtctgccaggcccatct

SEQ ID NO: 3864140 - DNA, 12 bp, Homo sapiens
cacgtgaatggc

SEQ ID NO: 3864141 - DNA, 18 bp, Homo sapiens
cacgtgctcgcagcctgg

SEQ ID NO: 3864142 - DNA, 13 bp, Homo sapiens
cacgtggtgtccc

SEQ ID NO: 3864143 - DNA, 19 bp, Homo sapiens
cacgttccttactgcagaa

SEQ ID NO: 3864144 - DNA, 13 bp, Homo sapiens
cacgttctatata

SEQ ID NO: 3864145 - DNA, 17 bp, Homo sapiens
cactaaacagactattt

SEQ ID NO: 3864146 - DNA, 15 bp, Homo sapiens
cactaaagtatgtaa

SEQ ID NO: 3864147 - DNA, 22 bp, Homo sapiens
cactaaagtatgtaaagtatgt

SEQ ID NO: 3864148 - DNA, 17 bp, Homo sapiens
cactaagctttctcctt

SEQ ID NO: 3864149 - DNA, 21 bp, Homo sapiens
cactaaggccgtgtctctgag

SEQ ID NO: 3864150 - DNA, 20 bp, Homo sapiens
cactacatgtggtttataga

SEQ ID NO: 3864151 - DNA, 13 bp, Homo sapiens
cactagaaaacat

SEQ ID NO: 3864152 - DNA, 16 bp, Homo sapiens
cactagcctctccagg

SEQ ID NO: 3864153 - DNA, 16 bp, Homo sapiens
cactagcctgtgatta

SEQ ID NO: 3864154 - DNA, 20 bp, Homo sapiens
cactaggttctaggtcctgg

SEQ ID NO: 3864155 - DNA, 17 bp, Homo sapiens
cactagttttgtgccag

SEQ ID NO: 3864156 - DNA, 16 bp, Homo sapiens
cactatgaaaatcagt

SEQ ID NO: 3864157 - DNA, 19 bp, Homo sapiens
cactatgttgcccaggctg

SEQ ID NO: 3864158 - DNA, 15 bp, Homo sapiens
cactattgcattgtt

SEQ ID NO: 3864159 - DNA, 16 bp, Homo sapiens
cactattgcattgttc

SEQ ID NO: 3864160 - DNA, 13 bp, Homo sapiens
cactcaaacaatc

SEQ ID NO: 3864161 - DNA, 17 bp, Homo sapiens
cactcaaacaatcatga

SEQ ID NO: 3864162 - DNA, 16 bp, Homo sapiens
cactcaaatcaagaaa

SEQ ID NO: 3864163 - DNA, 15 bp, Homo sapiens
cactcaacaataaag

SEQ ID NO: 3864164 - DNA, 21 bp, Homo sapiens
cactcacccatgtgccaaggt

SEQ ID NO: 3864165 - DNA, 15 bp, Homo sapiens
cactcactcactcat

SEQ ID NO: 3864166 - DNA, 23 bp, Homo sapiens
cactcagaagcctgggggcctgg

SEQ ID NO: 3864167 - DNA, 12 bp, Homo sapiens
cactcagcagcc

SEQ ID NO: 3864168 - DNA, 12 bp, Homo sapiens
cactcagccaca

SEQ ID NO: 3864169 - DNA, 14 bp, Homo sapiens
cactcagccacacc

SEQ ID NO: 3864170 - DNA, 15 bp, Homo sapiens
cactcattcctgtag

SEQ ID NO: 3864171 - DNA, 10 bp, Homo sapiens
cactccacca

SEQ ID NO: 3864172 - DNA, 11 bp, Homo sapiens
cactccaccac

SEQ ID NO: 3864173 - DNA, 14 bp, Homo sapiens
cactccaccaccca

SEQ ID NO: 3864174 - DNA, 18 bp, Homo sapiens
cactccaccacccaaaag

SEQ ID NO: 3864175 - DNA, 19 bp, Homo sapiens
cactccaccacccaaaagt

SEQ ID NO: 3864176 - DNA, 19 bp, Homo sapiens
cactccaccccctccagct

SEQ ID NO: 3864177 - DNA, 13 bp, Homo sapiens
cactccagcccaa

SEQ ID NO: 3864178 - DNA, 12 bp, Homo sapiens
cactccagccct

SEQ ID NO: 3864179 - DNA, 13 bp, Homo sapiens
cactccagccctg

SEQ ID NO: 3864180 - DNA, 14 bp, Homo sapiens
cactccagccctgt

SEQ ID NO: 3864181 - DNA, 17 bp, Homo sapiens
cactccatggccacccc

SEQ ID NO: 3864182 - DNA, 12 bp, Homo sapiens
cactccattccc

SEQ ID NO: 3864183 - DNA, 14 bp, Homo sapiens
cactcccagggaca

SEQ ID NO: 3864184 - DNA, 15 bp, Homo sapiens
cactcccccacctga

SEQ ID NO: 3864185 - DNA, 21 bp, Homo sapiens
cactccccgcctgtcctgcct

SEQ ID NO: 3864186 - DNA, 14 bp, Homo sapiens
cactccctgagctt

SEQ ID NO: 3864187 - DNA, 20 bp, Homo sapiens
cactccggcctgatgacaga

SEQ ID NO: 3864188 - DNA, 14 bp, Homo sapiens
cactcctacctggt

SEQ ID NO: 3864189 - DNA, 13 bp, Homo sapiens
cactcctgtcccg

SEQ ID NO: 3864190 - DNA, 12 bp, Homo sapiens
cactccttcctg

SEQ ID NO: 3864191 - DNA, 17 bp, Homo sapiens
cactccttcctgcccca

SEQ ID NO: 3864192 - DNA, 21 bp, Homo sapiens
cactcgagaccatcctggccc

SEQ ID NO: 3864193 - DNA, 22 bp, Homo sapiens
cactctaggggtcaggctccat

SEQ ID NO: 3864194 - DNA, 18 bp, Homo sapiens
cactctagtgacttcctg

SEQ ID NO: 3864195 - DNA, 20 bp, Homo sapiens
cactctagtgacttcctggt

SEQ ID NO: 3864196 - DNA, 22 bp, Homo sapiens
cactctagtgacttcctggtga

SEQ ID NO: 3864197 - DNA, 17 bp, Homo sapiens
cactctcccctccctct

SEQ ID NO: 3864198 - DNA, 22 bp, Homo sapiens
cactctcccctccctcttcctt

SEQ ID NO: 3864199 - DNA, 15 bp, Homo sapiens
cactctcggggccct

SEQ ID NO: 3864200 - DNA, 20 bp, Homo sapiens
cactctctgtacaaaaacaa

SEQ ID NO: 3864201 - DNA, 21 bp, Homo sapiens
cactctctgtacaaaaacaaa

SEQ ID NO: 3864202 - DNA, 15 bp, Homo sapiens
cactctgctctgatg

SEQ ID NO: 3864203 - DNA, 16 bp, Homo sapiens
cactctgctctgatgc

SEQ ID NO: 3864204 - DNA, 14 bp, Homo sapiens
cactctggcagcca

SEQ ID NO: 3864205 - DNA, 16 bp, Homo sapiens
cactcttatgaaatgg

SEQ ID NO: 3864206 - DNA, 20 bp, Homo sapiens
cactcttcttgagcagaccg

SEQ ID NO: 3864207 - DNA, 18 bp, Homo sapiens
cacattaatatttgctga

SEQ ID NO: 3864208 - DNA, 19 bp, Homo sapiens
cacattaatatttgctgac

SEQ ID NO: 3864209 - DNA, 22 bp, Homo sapiens
cacattaatggtctaaaaataa

SEQ ID NO: 3864210 - DNA, 17 bp, Homo sapiens
cacattcaggaagatga

SEQ ID NO: 3864211 - DNA, 14 bp, Homo sapiens
cacattcctggccc

SEQ ID NO: 3864212 - DNA, 15 bp, Homo sapiens
cacattcctggcccc

SEQ ID NO: 3864213 - DNA, 21 bp, Homo sapiens
cacattcctggccccgggctc

SEQ ID NO: 3864214 - DNA, 17 bp, Homo sapiens
cacattctcctgtgccc

SEQ ID NO: 3864215 - DNA, 15 bp, Homo sapiens
cacatttatatatat

SEQ ID NO: 3864216 - DNA, 14 bp, Homo sapiens
cacatttgatgtac

SEQ ID NO: 3864217 - DNA, 20 bp, Homo sapiens
cacatttgttcatgagtgga

SEQ ID NO: 3864218 - DNA, 21 bp, Homo sapiens
cacattttgcctttctcgtgg

SEQ ID NO: 3864219 - DNA, 23 bp, Homo sapiens
caccaaaaaaatacttgagctgt

SEQ ID NO: 3864220 - DNA, 22 bp, Homo sapiens
caccaacatcccattgccctgg

SEQ ID NO: 3864221 - DNA, 15 bp, Homo sapiens
caccaactctgcact

SEQ ID NO: 3864222 - DNA, 18 bp, Homo sapiens
caccaactctgcactcca

SEQ ID NO: 3864223 - DNA, 19 bp, Homo sapiens
caccaactctgcactccat

SEQ ID NO: 3864224 - DNA, 20 bp, Homo sapiens
caccaactctgcactccatg

SEQ ID NO: 3864225 - DNA, 22 bp, Homo sapiens
caccaactctgcactccatggc

SEQ ID NO: 3864226 - DNA, 14 bp, Homo sapiens
caccaagctcacag

SEQ ID NO: 3864227 - DNA, 15 bp, Homo sapiens
caccaagctcacagt

SEQ ID NO: 3864228 - DNA, 14 bp, Homo sapiens
caccaaggtcttca

SEQ ID NO: 3864229 - DNA, 15 bp, Homo sapiens
caccaaggtcttcag

SEQ ID NO: 3864230 - DNA, 16 bp, Homo sapiens
caccaataaaaatcct

SEQ ID NO: 3864231 - DNA, 24 bp, Homo sapiens
caccaattggttaatctttcctga

SEQ ID NO: 3864232 - DNA, 24 bp, Homo sapiens
caccaattgtacattccctgcatc

SEQ ID NO: 3864233 - DNA, 12 bp, Homo sapiens
caccacctctcc

SEQ ID NO: 3864234 - DNA, 15 bp, Homo sapiens
caccaccttcccagc

SEQ ID NO: 3864235 - DNA, 22 bp, Homo sapiens
caccaccttcccagctctccct

SEQ ID NO: 3864236 - DNA, 20 bp, Homo sapiens
caccaccttggactcctccc

SEQ ID NO: 3864237 - DNA, 15 bp, Homo sapiens
caccacgatgtggcc

SEQ ID NO: 3864238 - DNA, 20 bp, Homo sapiens
caccacgatgtggccctggc

SEQ ID NO: 3864239 - DNA, 15 bp, Homo sapiens
caccacgtctgccag

SEQ ID NO: 3864240 - DNA, 16 bp, Homo sapiens
caccacgtctgccagg

SEQ ID NO: 3864241 - DNA, 17 bp, Homo sapiens
caccacgtctgccaggc

SEQ ID NO: 3864242 - DNA, 18 bp, Homo sapiens
caccacgtctgccaggcc

SEQ ID NO: 3864243 - DNA, 19 bp, Homo sapiens
caccacgtctgccaggccc

SEQ ID NO: 3864244 - DNA, 21 bp, Homo sapiens
caccacgtctgccaggcccat

SEQ ID NO: 3864245 - DNA, 12 bp, Homo sapiens
caccactctggc

SEQ ID NO: 3864246 - DNA, 13 bp, Homo sapiens
caccactctggca

SEQ ID NO: 3864247 - DNA, 15 bp, Homo sapiens
caccactctggcagc

SEQ ID NO: 3864248 - DNA, 17 bp, Homo sapiens
caccactctggcagcca

SEQ ID NO: 3864249 - DNA, 15 bp, Homo sapiens
caccactgccctgcc

SEQ ID NO: 3864250 - DNA, 19 bp, Homo sapiens
caccactgccctgcctgcc

SEQ ID NO: 3864251 - DNA, 20 bp, Homo sapiens
caccactgccctgcctgccc

SEQ ID NO: 3864252 - DNA, 18 bp, Homo sapiens
caccagaattgtgcaaat

SEQ ID NO: 3864253 - DNA, 16 bp, Homo sapiens
caccagaggctgcaga

SEQ ID NO: 3864254 - DNA, 23 bp, Homo sapiens
caccagagtgaaagggctatggc

SEQ ID NO: 3864255 - DNA, 17 bp, Homo sapiens
caccagcaacatctcga

SEQ ID NO: 3864256 - DNA, 16 bp, Homo sapiens
caccagcccggcctgc

SEQ ID NO: 3864257 - DNA, 17 bp, Homo sapiens
caccagcccggcctgct

SEQ ID NO: 3864258 - DNA, 18 bp, Homo sapiens
caccagcccggcctgctc

SEQ ID NO: 3864259 - DNA, 15 bp, Homo sapiens
caccagcccttccct

SEQ ID NO: 3864260 - DNA, 14 bp, Homo sapiens
caccagctatctgt

SEQ ID NO: 3864261 - DNA, 11 bp, Homo sapiens
caccagctctg

SEQ ID NO: 3864262 - DNA, 17 bp, Homo sapiens
caccagctctgtggcct

SEQ ID NO: 3864263 - DNA, 11 bp, Homo sapiens
caccagctgct

SEQ ID NO: 3864264 - DNA, 15 bp, Homo sapiens
caccagctgctctgc

SEQ ID NO: 3864265 - DNA, 16 bp, Homo sapiens
caccagcttctccagg

SEQ ID NO: 3864266 - DNA, 11 bp, Homo sapiens
caccaggaagg

SEQ ID NO: 3864267 - DNA, 12 bp, Homo sapiens
caccaggaatgt

SEQ ID NO: 3864268 - DNA, 21 bp, Homo sapiens
caccaggaatgttaaagtcag

SEQ ID NO: 3864269 - DNA, 21 bp, Homo sapiens
caccaggcacgaacccacctg

SEQ ID NO: 3864270 - DNA, 21 bp, Homo sapiens
caccaggctgaggtcctgatc

SEQ ID NO: 3864271 - DNA, 22 bp, Homo sapiens
caccaggggtgctatgacatgc

SEQ ID NO: 3864272 - DNA, 17 bp, Homo sapiens
caccagtcactgtccct

SEQ ID NO: 3864273 - DNA, 17 bp, Homo sapiens
caccagtttctgcggcc

SEQ ID NO: 3864274 - DNA, 14 bp, Homo sapiens
caccatggaggcag

SEQ ID NO: 3864275 - DNA, 17 bp, Homo sapiens
caccatgtaacaaccag

SEQ ID NO: 3864276 - DNA, 18 bp, Homo sapiens
caccatgtaacaaccaga

SEQ ID NO: 3864277 - DNA, 16 bp, Homo sapiens
caccattcacatttga

SEQ ID NO: 3864278 - DNA, 22 bp, Homo sapiens
cacccaaagaggtatttatctt

SEQ ID NO: 3864279 - DNA, 23 bp, Homo sapiens
cacccaataaacattaagattga

SEQ ID NO: 3864280 - DNA, 21 bp, Homo sapiens
cacccactctcctctgcctca

SEQ ID NO: 3864281 - DNA, 14 bp, Homo sapiens
cacccactggccag

SEQ ID NO: 3864282 - DNA, 20 bp, Homo sapiens
cacccagaaattccttccca

SEQ ID NO: 3864283 - DNA, 12 bp, Homo sapiens
cacccagagggt

SEQ ID NO: 3864284 - DNA, 11 bp, Homo sapiens
cacccagccca

SEQ ID NO: 3864285 - DNA, 15 bp, Homo sapiens
cacccagcccattct

SEQ ID NO: 3864286 - DNA, 16 bp, Homo sapiens
cacccaggctccatgg

SEQ ID NO: 3864287 - DNA, 23 bp, Homo sapiens
cacccaggctctggagccagaga

SEQ ID NO: 3864288 - DNA, 15 bp, Homo sapiens
cacccaggctgcact

SEQ ID NO: 3864289 - DNA, 16 bp, Homo sapiens
cacccaggctgcactg

SEQ ID NO: 3864290 - DNA, 20 bp, Homo sapiens
cacccaggctgcactgcagt

SEQ ID NO: 3864291 - DNA, 20 bp, Homo sapiens
cacccaggctggagtacagt

SEQ ID NO: 3864292 - DNA, 24 bp, Homo sapiens
cacccagggctccctcctggagca

SEQ ID NO: 3864293 - DNA, 17 bp, Homo sapiens
cacccagtcctggccat

SEQ ID NO: 3864294 - DNA, 14 bp, Homo sapiens
cacccatcttcctg

SEQ ID NO: 3864295 - DNA, 15 bp, Homo sapiens
cacccatcttcctgc

SEQ ID NO: 3864296 - DNA, 19 bp, Homo sapiens
cacccatcttcctgctgct

SEQ ID NO: 3864297 - DNA, 22 bp, Homo sapiens
cacccatcttcctgctgctgta

SEQ ID NO: 3864298 - DNA, 15 bp, Homo sapiens
cacccatgaatcaaa

SEQ ID NO: 3864299 - DNA, 21 bp, Homo sapiens
cacccattcccccatgtggct

SEQ ID NO: 3864300 - DNA, 23 bp, Homo sapiens
caccccaagggacaaccccatca

SEQ ID NO: 3864301 - DNA, 21 bp, Homo sapiens
caccccacattggacttcctt

SEQ ID NO: 3864302 - DNA, 23 bp, Homo sapiens
caccccacattggacttccttgg

SEQ ID NO: 3864303 - DNA, 13 bp, Homo sapiens
caccccaccaggg

SEQ ID NO: 3864304 - DNA, 16 bp, Homo sapiens
caccccactccagccc

SEQ ID NO: 3864305 - DNA, 15 bp, Homo sapiens
cacccccagcctggg

SEQ ID NO: 3864306 - DNA, 19 bp, Homo sapiens
cacccccagcctgggccta

SEQ ID NO: 3864307 - DNA, 17 bp, Homo sapiens
cacccccgccacggcca

SEQ ID NO: 3864308 - DNA, 16 bp, Homo sapiens
caccccctcattcccc

SEQ ID NO: 3864309 - DNA, 11 bp, Homo sapiens
caccccctccc

SEQ ID NO: 3864310 - DNA, 16 bp, Homo sapiens
caccccctccccaggg

SEQ ID NO: 3864311 - DNA, 17 bp, Homo sapiens
caccccctccccagggg

SEQ ID NO: 3864312 - DNA, 13 bp, Homo sapiens
caccccctgcagc

SEQ ID NO: 3864313 - DNA, 12 bp, Homo sapiens
caccccggcctc

SEQ ID NO: 3864314 - DNA, 16 bp, Homo sapiens
caccccggcctccact

SEQ ID NO: 3864315 - DNA, 23 bp, Homo sapiens
caccccgtctggggttcagcccc

SEQ ID NO: 3864316 - DNA, 14 bp, Homo sapiens
cacccctaaagaga

SEQ ID NO: 3864317 - DNA, 12 bp, Homo sapiens
cacccctcactc

SEQ ID NO: 3864318 - DNA, 13 bp, Homo sapiens
cacccctccaaag

SEQ ID NO: 3864319 - DNA, 11 bp, Homo sapiens
cacccctgcac

SEQ ID NO: 3864320 - DNA, 12 bp, Homo sapiens
cacccctgcact

SEQ ID NO: 3864321 - DNA, 16 bp, Homo sapiens
caccccttatccagga

SEQ ID NO: 3864322 - DNA, 19 bp, Homo sapiens
caccccttatccaggactc

SEQ ID NO: 3864323 - DNA, 16 bp, Homo sapiens
caccccttcctgtccc

SEQ ID NO: 3864324 - DNA, 18 bp, Homo sapiens
caccccttgaagcctttt

SEQ ID NO: 3864325 - DNA, 16 bp, Homo sapiens
cacccgactcctcaaa

SEQ ID NO: 3864326 - DNA, 15 bp, Homo sapiens
cacccgcttcctgtt

SEQ ID NO: 3864327 - DNA, 18 bp, Homo sapiens
cacccgtaggcagcctct

SEQ ID NO: 3864328 - DNA, 20 bp, Homo sapiens
cacccgtcttggggctcgcc

SEQ ID NO: 3864329 - DNA, 21 bp, Homo sapiens
cacccgttctgctggcctgga

SEQ ID NO: 3864330 - DNA, 15 bp, Homo sapiens
caccctaaaatgaca

SEQ ID NO: 3864331 - DNA, 21 bp, Homo sapiens
caccctatccctgtacagagt

SEQ ID NO: 3864332 - DNA, 16 bp, Homo sapiens
caccctcaaatgtcag

SEQ ID NO: 3864333 - DNA, 20 bp, Homo sapiens
caccctcaaatgtcagagct

SEQ ID NO: 3864334 - DNA, 17 bp, Homo sapiens
caccctcaccaggatga

SEQ ID NO: 3864335 - DNA, 20 bp, Homo sapiens
caccctcccctgtcttctct

SEQ ID NO: 3864336 - DNA, 14 bp, Homo sapiens
caccctccttcccg

SEQ ID NO: 3864337 - DNA, 15 bp, Homo sapiens
caccctccttcccgc

SEQ ID NO: 3864338 - DNA, 17 bp, Homo sapiens
caccctcgtggacacct

SEQ ID NO: 3864339 - DNA, 18 bp, Homo sapiens
caccctctccatgcccaa

SEQ ID NO: 3864340 - DNA, 22 bp, Homo sapiens
caccctctccatgcccaaccta

SEQ ID NO: 3864341 - DNA, 17 bp, Homo sapiens
caccctctgggcagctg

SEQ ID NO: 3864342 - DNA, 16 bp, Homo sapiens
caccctgaggagtctg

SEQ ID NO: 3864343 - DNA, 21 bp, Homo sapiens
caccctgaggagtctgaggtc

SEQ ID NO: 3864344 - DNA, 12 bp, Homo sapiens
caccctgcagag

SEQ ID NO: 3864345 - DNA, 13 bp, Homo sapiens
caccctgcagagc

SEQ ID NO: 3864346 - DNA, 16 bp, Homo sapiens
caccctggcccgcccc

SEQ ID NO: 3864347 - DNA, 12 bp, Homo sapiens
caccctgggtgc

SEQ ID NO: 3864348 - DNA, 18 bp, Homo sapiens
caccctgggtgccattcc

SEQ ID NO: 3864349 - DNA, 21 bp, Homo sapiens
cacccttctttcctcttcccc

SEQ ID NO: 3864350 - DNA, 14 bp, Homo sapiens
cacccttggacttg

SEQ ID NO: 3864351 - DNA, 16 bp, Homo sapiens
cacccttggacttgag

SEQ ID NO: 3864352 - DNA, 14 bp, Homo sapiens
caccgcagaaggaa

SEQ ID NO: 3864353 - DNA, 15 bp, Homo sapiens
caccgcagaaggaag

SEQ ID NO: 3864354 - DNA, 22 bp, Homo sapiens
caccgctgcctaagtggctgct

SEQ ID NO: 3864355 - DNA, 23 bp, Homo sapiens
caccgctgccttttgctgctgct

SEQ ID NO: 3864356 - DNA, 13 bp, Homo sapiens
caccgggagcctc

SEQ ID NO: 3864357 - DNA, 15 bp, Homo sapiens
caccgggagcctccc

SEQ ID NO: 3864358 - DNA, 13 bp, Homo sapiens
caccgggcctgga

SEQ ID NO: 3864359 - DNA, 20 bp, Homo sapiens
caccgtggaccttcctgcca

SEQ ID NO: 3864360 - DNA, 23 bp, Homo sapiens
caccgtggaccttcctgccacca

SEQ ID NO: 3864361 - DNA, 15 bp, Homo sapiens
cacctaccatgctgc

SEQ ID NO: 3864362 - DNA, 18 bp, Homo sapiens
cacctactcacacaggca

SEQ ID NO: 3864363 - DNA, 12 bp, Homo sapiens
cacctactgagt

SEQ ID NO: 3864364 - DNA, 21 bp, Homo sapiens
cacctacttgtgactgaaggg

SEQ ID NO: 3864365 - DNA, 18 bp, Homo sapiens
cacctaggccactcctcc

SEQ ID NO: 3864366 - DNA, 19 bp, Homo sapiens
cacctaggccactcctcca

SEQ ID NO: 3864367 - DNA, 17 bp, Homo sapiens
cacctagtgcttccact

SEQ ID NO: 3864368 - DNA, 16 bp, Homo sapiens
cacctcacgctctgga

SEQ ID NO: 3864369 - DNA, 19 bp, Homo sapiens
cacctcacgctctggacat

SEQ ID NO: 3864370 - DNA, 13 bp, Homo sapiens
cacctcactcctg

SEQ ID NO: 3864371 - DNA, 17 bp, Homo sapiens
cacctcagcctcccaga

SEQ ID NO: 3864372 - DNA, 23 bp, Homo sapiens
cacctcagcctcccagagtgcta

SEQ ID NO: 3864373 - DNA, 14 bp, Homo sapiens
cacctcatgcctgg

SEQ ID NO: 3864374 - DNA, 19 bp, Homo sapiens
cacctccacccccgccacg

SEQ ID NO: 3864375 - DNA, 23 bp, Homo sapiens
cacctccacccccgccacggcca

SEQ ID NO: 3864376 - DNA, 17 bp, Homo sapiens
cacctcccaccccactc

SEQ ID NO: 3864377 - DNA, 19 bp, Homo sapiens
cacctcccaccccactcca

SEQ ID NO: 3864378 - DNA, 23 bp, Homo sapiens
cacctcccaccccactccagccc

SEQ ID NO: 3864379 - DNA, 11 bp, Homo sapiens
cacctcccagg

SEQ ID NO: 3864380 - DNA, 12 bp, Homo sapiens
cacctcccagga

SEQ ID NO: 3864381 - DNA, 15 bp, Homo sapiens
cacctccccccactg

SEQ ID NO: 3864382 - DNA, 21 bp, Homo sapiens
cacctccccccactgcaggcc

SEQ ID NO: 3864383 - DNA, 13 bp, Homo sapiens
cacctcccctatc

SEQ ID NO: 3864384 - DNA, 18 bp, Homo sapiens
cacctcccctatccaccc

SEQ ID NO: 3864385 - DNA, 19 bp, Homo sapiens
cacctcccctatccaccca

SEQ ID NO: 3864386 - DNA, 19 bp, Homo sapiens
cacctccctgaaccatccc

SEQ ID NO: 3864387 - DNA, 23 bp, Homo sapiens
cacctcctagaggtgggcagctg

SEQ ID NO: 3864388 - DNA, 22 bp, Homo sapiens
cacctcctagcaagacctgttg

SEQ ID NO: 3864389 - DNA, 14 bp, Homo sapiens
cacctcctccactc

SEQ ID NO: 3864390 - DNA, 17 bp, Homo sapiens
cacctcctccactcact

SEQ ID NO: 3864391 - DNA, 23 bp, Homo sapiens
cacctcctgagaaggcgaggaga

SEQ ID NO: 3864392 - DNA, 16 bp, Homo sapiens
cacctccttgctttgc

SEQ ID NO: 3864393 - DNA, 15 bp, Homo sapiens
cacctctagtgctac

SEQ ID NO: 3864394 - DNA, 13 bp, Homo sapiens
cacctctcaatat

SEQ ID NO: 3864395 - DNA, 22 bp, Homo sapiens
cacctctcaatattcaataaag

SEQ ID NO: 3864396 - DNA, 14 bp, Homo sapiens
cacctctgcctcaa

SEQ ID NO: 3864397 - DNA, 17 bp, Homo sapiens
cacctctggatccctgg

SEQ ID NO: 3864398 - DNA, 18 bp, Homo sapiens
cacctctggatccctgga

SEQ ID NO: 3864399 - DNA, 23 bp, Homo sapiens
cacctctggctttgtctctagcc

SEQ ID NO: 3864400 - DNA, 13 bp, Homo sapiens
cacctcttccttc

SEQ ID NO: 3864401 - DNA, 16 bp, Homo sapiens
cacctcttccttccgc

SEQ ID NO: 3864402 - DNA, 16 bp, Homo sapiens
cacctcttctgccagc

SEQ ID NO: 3864403 - DNA, 20 bp, Homo sapiens
cacctgacaatggcagctag

SEQ ID NO: 3864404 - DNA, 13 bp, Homo sapiens
cacctgacacatc

SEQ ID NO: 3864405 - DNA, 23 bp, Homo sapiens
cacctgagtcaccctacctgtgc

SEQ ID NO: 3864406 - DNA, 17 bp, Homo sapiens
cacctgcaagccccagg

SEQ ID NO: 3864407 - DNA, 23 bp, Homo sapiens
cacctgcaagccccagggcctgg

SEQ ID NO: 3864408 - DNA, 19 bp, Homo sapiens
cacctgcacgtgatctgct

SEQ ID NO: 3864409 - DNA, 22 bp, Homo sapiens
cacctgccccagcgcggcttgg

SEQ ID NO: 3864410 - DNA, 19 bp, Homo sapiens
cacctgccctgccctgcca

SEQ ID NO: 3864411 - DNA, 20 bp, Homo sapiens
cacctgcctatccatcctgc

SEQ ID NO: 3864412 - DNA, 19 bp, Homo sapiens
cacctgctgagagacccaa

SEQ ID NO: 3864413 - DNA, 22 bp, Homo sapiens
cacctgctgagagacccaagga

SEQ ID NO: 3864414 - DNA, 12 bp, Homo sapiens
cacctggagggc

SEQ ID NO: 3864415 - DNA, 16 bp, Homo sapiens
cacctggccccatgtc

SEQ ID NO: 3864416 - DNA, 20 bp, Homo sapiens
cacctgggccctggggcctg

SEQ ID NO: 3864417 - DNA, 21 bp, Homo sapiens
cacctgggccctggggcctgt

SEQ ID NO: 3864418 - DNA, 23 bp, Homo sapiens
cacctgggccctggggcctgtac

SEQ ID NO: 3864419 - DNA, 14 bp, Homo sapiens
cacctgtctgtctg

SEQ ID NO: 3864420 - DNA, 16 bp, Homo sapiens
cacctgtctgtctgtc

SEQ ID NO: 3864421 - DNA, 15 bp, Homo sapiens
cacctgttaaaatgt

SEQ ID NO: 3864422 - DNA, 14 bp, Homo sapiens
caccttacattcct

SEQ ID NO: 3864423 - DNA, 13 bp, Homo sapiens
caccttagctggc

SEQ ID NO: 3864424 - DNA, 15 bp, Homo sapiens
caccttagtggcttt

SEQ ID NO: 3864425 - DNA, 22 bp, Homo sapiens
caccttatgtattattttctat

SEQ ID NO: 3864426 - DNA, 21 bp, Homo sapiens
caccttcccagctctccctct

SEQ ID NO: 3864427 - DNA, 11 bp, Homo sapiens
caccttcccca

SEQ ID NO: 3864428 - DNA, 16 bp, Homo sapiens
caccttccctctttct

SEQ ID NO: 3864429 - DNA, 19 bp, Homo sapiens
caccttcttggcttctggg

SEQ ID NO: 3864430 - DNA, 21 bp, Homo sapiens
caccttcttggcttctgggac

SEQ ID NO: 3864431 - DNA, 12 bp, Homo sapiens
caccttgctctt

SEQ ID NO: 3864432 - DNA, 22 bp, Homo sapiens
caccttgctcttctttctgaga

SEQ ID NO: 3864433 - DNA, 16 bp, Homo sapiens
caccttggactcctcc

SEQ ID NO: 3864434 - DNA, 22 bp, Homo sapiens
caccttggactcctcccacaat

SEQ ID NO: 3864435 - DNA, 12 bp, Homo sapiens
caccttgggacc

SEQ ID NO: 3864436 - DNA, 17 bp, Homo sapiens
caccttgggtttgtatt

SEQ ID NO: 3864437 - DNA, 18 bp, Homo sapiens
cacctttgggatcagcct

SEQ ID NO: 3864438 - DNA, 16 bp, Homo sapiens
caccttttccaggagt

SEQ ID NO: 3864439 - DNA, 21 bp, Homo sapiens
caccttttccaggagttctga

SEQ ID NO: 3864440 - DNA, 21 bp, Homo sapiens
caccttttgtatttaaaacct

SEQ ID NO: 3864441 - DNA, 14 bp, Homo sapiens
cacgaacccacctg

SEQ ID NO: 3864442 - DNA, 16 bp, Homo sapiens
cacgaacccacctgct

SEQ ID NO: 3864443 - DNA, 18 bp, Homo sapiens
cacgaacccacctgctga

SEQ ID NO: 3864444 - DNA, 22 bp, Homo sapiens
cacgaacccacctgctgagaga

SEQ ID NO: 3864445 - DNA, 20 bp, Homo sapiens
cacgactgttgtacaagctc

SEQ ID NO: 3864446 - DNA, 21 bp, Homo sapiens
cacgactgttgtacaagctca

SEQ ID NO: 3864447 - DNA, 22 bp, Homo sapiens
cacgactgttgtacaagctcag

SEQ ID NO: 3864448 - DNA, 12 bp, Homo sapiens
cacgatgaaaaa

SEQ ID NO: 3864449 - DNA, 16 bp, Homo sapiens
cacgatgtggccctgg

SEQ ID NO: 3864450 - DNA, 21 bp, Homo sapiens
cacgatgtggccctggcctgc

SEQ ID NO: 3864451 - DNA, 14 bp, Homo sapiens
cacgcaacccttgc

SEQ ID NO: 3864452 - DNA, 13 bp, Homo sapiens
cacgcacacatgg

SEQ ID NO: 3864453 - DNA, 23 bp, Homo sapiens
cacgcacatgccaatgcacgcac

SEQ ID NO: 3864454 - DNA, 16 bp, Homo sapiens
cacgcaggaactccca

SEQ ID NO: 3864455 - DNA, 17 bp, Homo sapiens
cacgcaggaactcccag

SEQ ID NO: 3864456 - DNA, 19 bp, Homo sapiens
cacgcaggaactcccagca

SEQ ID NO: 3864457 - DNA, 19 bp, Homo sapiens
cacgccagtttcaccattt

SEQ ID NO: 3864458 - DNA, 15 bp, Homo sapiens
cacgcctcctggcca

SEQ ID NO: 3864459 - DNA, 17 bp, Homo sapiens
cacgcctgtaatcccag

SEQ ID NO: 3864460 - DNA, 22 bp, Homo sapiens
cacgcctgtaatcccagcactt

SEQ ID NO: 3864461 - DNA, 20 bp, Homo sapiens
cacgcctgtaatcccagcag

SEQ ID NO: 3864462 - DNA, 13 bp, Homo sapiens
cacgctgtcctct

SEQ ID NO: 3864463 - DNA, 23 bp, Homo sapiens
cacgctgtcctctcgagcccaga

SEQ ID NO: 3864464 - DNA, 19 bp, Homo sapiens
cacggaccatgtggtatgt

SEQ ID NO: 3864465 - DNA, 14 bp, Homo sapiens
cacaattaattgtc

SEQ ID NO: 3864466 - DNA, 18 bp, Homo sapiens
cacaattgatacttcagg

SEQ ID NO: 3864467 - DNA, 21 bp, Homo sapiens
cacaattgatacttcaggtgc

SEQ ID NO: 3864468 - DNA, 22 bp, Homo sapiens
cacaatttagaaaacattcatc

SEQ ID NO: 3864469 - DNA, 16 bp, Homo sapiens
cacaatttgagcaatt

SEQ ID NO: 3864470 - DNA, 20 bp, Homo sapiens
cacaatttgagcaattcatt

SEQ ID NO: 3864471 - DNA, 9 bp, Homo sapiens
cacacacac

SEQ ID NO: 3864472 - DNA, 15 bp, Homo sapiens
cacacacacacacat

SEQ ID NO: 3864473 - DNA, 21 bp, Homo sapiens
cacacacagagatatgcacac

SEQ ID NO: 3864474 - DNA, 13 bp, Homo sapiens
cacacacagctcc

SEQ ID NO: 3864475 - DNA, 13 bp, Homo sapiens
cacacacaggagc

SEQ ID NO: 3864476 - DNA, 14 bp, Homo sapiens
cacacagaaatata

SEQ ID NO: 3864477 - DNA, 18 bp, Homo sapiens
cacacagaaatatatata

SEQ ID NO: 3864478 - DNA, 21 bp, Homo sapiens
cacacagaaatatatatacat

SEQ ID NO: 3864479 - DNA, 22 bp, Homo sapiens
cacacagagatatgcacacaca

SEQ ID NO: 3864480 - DNA, 18 bp, Homo sapiens
cacacagaggaagagcag

SEQ ID NO: 3864481 - DNA, 13 bp, Homo sapiens
cacacagatgcac

SEQ ID NO: 3864482 - DNA, 18 bp, Homo sapiens
cacacagatgcacacaca

SEQ ID NO: 3864483 - DNA, 19 bp, Homo sapiens
cacacagatggtcacacag

SEQ ID NO: 3864484 - DNA, 19 bp, Homo sapiens
cacacagcagcactgcaga

SEQ ID NO: 3864485 - DNA, 14 bp, Homo sapiens
cacacagcagcccc

SEQ ID NO: 3864486 - DNA, 20 bp, Homo sapiens
cacacagcagccccccagca

SEQ ID NO: 3864487 - DNA, 21 bp, Homo sapiens
cacacagcagccccccagcac

SEQ ID NO: 3864488 - DNA, 23 bp, Homo sapiens
cacacagcagccccccagcacta

SEQ ID NO: 3864489 - DNA, 21 bp, Homo sapiens
cacacaggcatttcctgggtg

SEQ ID NO: 3864490 - DNA, 20 bp, Homo sapiens
cacacagtctcagtccagat

SEQ ID NO: 3864491 - DNA, 17 bp, Homo sapiens
cacacatggatgagcac

SEQ ID NO: 3864492 - DNA, 14 bp, Homo sapiens
cacacatggatgca

SEQ ID NO: 3864493 - DNA, 17 bp, Homo sapiens
cacacatggatgcacac

SEQ ID NO: 3864494 - DNA, 17 bp, Homo sapiens
cacaccactgccctgcc

SEQ ID NO: 3864495 - DNA, 20 bp, Homo sapiens
cacaccactgccctgcctgc

SEQ ID NO: 3864496 - DNA, 21 bp, Homo sapiens
cacacccagagggtagggcag

SEQ ID NO: 3864497 - DNA, 23 bp, Homo sapiens
cacacccagagggtagggcagca

SEQ ID NO: 3864498 - DNA, 15 bp, Homo sapiens
cacaccgtgagcaga

SEQ ID NO: 3864499 - DNA, 17 bp, Homo sapiens
cacacctcacgctctgg

SEQ ID NO: 3864500 - DNA, 19 bp, Homo sapiens
cacacctcacgctctggac

SEQ ID NO: 3864501 - DNA, 11 bp, Homo sapiens
cacacctgagc

SEQ ID NO: 3864502 - DNA, 22 bp, Homo sapiens
cacacctgtaatcccagcactt

SEQ ID NO: 3864503 - DNA, 12 bp, Homo sapiens
cacaccttaggt

SEQ ID NO: 3864504 - DNA, 14 bp, Homo sapiens
cacacgcaggaact

SEQ ID NO: 3864505 - DNA, 19 bp, Homo sapiens
cacacgcaggaactcccag

SEQ ID NO: 3864506 - DNA, 22 bp, Homo sapiens
cacacgcaggaactcccagcaa

SEQ ID NO: 3864507 - DNA, 14 bp, Homo sapiens
cacacgctgtctct

SEQ ID NO: 3864508 - DNA, 21 bp, Homo sapiens
cacacgggaagatcatttctt

SEQ ID NO: 3864509 - DNA, 20 bp, Homo sapiens
cacacgtgctcgcagcctgg

SEQ ID NO: 3864510 - DNA, 21 bp, Homo sapiens
cacacgtgctcgcagcctggc

SEQ ID NO: 3864511 - DNA, 19 bp, Homo sapiens
cacactagcctctccagga

SEQ ID NO: 3864512 - DNA, 19 bp, Homo sapiens
cacactattaccatgagaa

SEQ ID NO: 3864513 - DNA, 20 bp, Homo sapiens
cacactattaccatgagaag

SEQ ID NO: 3864514 - DNA, 17 bp, Homo sapiens
cacactgcaagagcctt

SEQ ID NO: 3864515 - DNA, 20 bp, Homo sapiens
cacactgcaagagccttggt

SEQ ID NO: 3864516 - DNA, 10 bp, Homo sapiens
cacactgtaa

SEQ ID NO: 3864517 - DNA, 11 bp, Homo sapiens
cacactgtaaa

SEQ ID NO: 3864518 - DNA, 17 bp, Homo sapiens
cacactgtaaacccctg

SEQ ID NO: 3864519 - DNA, 20 bp, Homo sapiens
cacactgtaaacccctgggt

SEQ ID NO: 3864520 - DNA, 15 bp, Homo sapiens
cacactgtcagagct

SEQ ID NO: 3864521 - DNA, 14 bp, Homo sapiens
cacacttcaggctc

SEQ ID NO: 3864522 - DNA, 18 bp, Homo sapiens
cacacttcaggctcttct

SEQ ID NO: 3864523 - DNA, 17 bp, Homo sapiens
cacacttctcaggacac

SEQ ID NO: 3864524 - DNA, 22 bp, Homo sapiens
cacacttcttgaaacagcctgg

SEQ ID NO: 3864525 - DNA, 13 bp, Homo sapiens
cacagaaacacaa

SEQ ID NO: 3864526 - DNA, 18 bp, Homo sapiens
cacagaaacacaatattt

SEQ ID NO: 3864527 - DNA, 13 bp, Homo sapiens
cacagaaatatat

SEQ ID NO: 3864528 - DNA, 18 bp, Homo sapiens
cacagaagccaggagcaa

SEQ ID NO: 3864529 - DNA, 15 bp, Homo sapiens
cacagacagatccca

SEQ ID NO: 3864530 - DNA, 17 bp, Homo sapiens
cacagacagatcccatc

SEQ ID NO: 3864531 - DNA, 19 bp, Homo sapiens
cacagactccctcccctgc

SEQ ID NO: 3864532 - DNA, 13 bp, Homo sapiens
cacagactctttc

SEQ ID NO: 3864533 - DNA, 20 bp, Homo sapiens
cacagagaagacgggatttg

SEQ ID NO: 3864534 - DNA, 14 bp, Homo sapiens
cacagagagagtca

SEQ ID NO: 3864535 - DNA, 21 bp, Homo sapiens
cacagagcactaggttcaatt

SEQ ID NO: 3864536 - DNA, 20 bp, Homo sapiens
cacagagctggcgactgcag

SEQ ID NO: 3864537 - DNA, 22 bp, Homo sapiens
cacagagtggagccctcagttt

SEQ ID NO: 3864538 - DNA, 18 bp, Homo sapiens
cacagatatacacatgga

SEQ ID NO: 3864539 - DNA, 22 bp, Homo sapiens
cacagatatgcacacacatgga

SEQ ID NO: 3864540 - DNA, 18 bp, Homo sapiens
cacagatgcacacacaga

SEQ ID NO: 3864541 - DNA, 19 bp, Homo sapiens
cacagatgggtattaaact

SEQ ID NO: 3864542 - DNA, 20 bp, Homo sapiens
cacagatgggtattaaactt

SEQ ID NO: 3864543 - DNA, 22 bp, Homo sapiens
cacagatgggtattaaacttgt

SEQ ID NO: 3864544 - DNA, 20 bp, Homo sapiens
cacagatggtcacacagaga

SEQ ID NO: 3864545 - DNA, 14 bp, Homo sapiens
cacagcacccaggc

SEQ ID NO: 3864546 - DNA, 15 bp, Homo sapiens
cacagcacccaggct

SEQ ID NO: 3864547 - DNA, 12 bp, Homo sapiens
cacagcagcact

SEQ ID NO: 3864548 - DNA, 12 bp, Homo sapiens
cacagcagcccc

SEQ ID NO: 3864549 - DNA, 15 bp, Homo sapiens
cacagccaacaaaca

SEQ ID NO: 3864550 - DNA, 18 bp, Homo sapiens
cacagccccacagcaccc

SEQ ID NO: 3864551 - DNA, 13 bp, Homo sapiens
cacagcccgggtg

SEQ ID NO: 3864552 - DNA, 12 bp, Homo sapiens
cacagccctggg

SEQ ID NO: 3864553 - DNA, 17 bp, Homo sapiens
cacagccctgggagggg

SEQ ID NO: 3864554 - DNA, 13 bp, Homo sapiens
cacagcctctccc

SEQ ID NO: 3864555 - DNA, 16 bp, Homo sapiens
cacagcgcgggcggag

SEQ ID NO: 3864556 - DNA, 16 bp, Homo sapiens
cacagcggcccctgca

SEQ ID NO: 3864557 - DNA, 22 bp, Homo sapiens
cacagcgtccctagcagtgaac

SEQ ID NO: 3864558 - DNA, 19 bp, Homo sapiens
cacagctcccaccccaccc

SEQ ID NO: 3864559 - DNA, 22 bp, Homo sapiens
cacagctcccaccccaccccct

SEQ ID NO: 3864560 - DNA, 22 bp, Homo sapiens
cacagctcctcttaccgtagcc

SEQ ID NO: 3864561 - DNA, 21 bp, Homo sapiens
cacagctctccggtctctctc

SEQ ID NO: 3864562 - DNA, 14 bp, Homo sapiens
cacagctgcagctg

SEQ ID NO: 3864563 - DNA, 15 bp, Homo sapiens
cacagctgcagctgg

SEQ ID NO: 3864564 - DNA, 12 bp, Homo sapiens
cacagctgcttg

SEQ ID NO: 3864565 - DNA, 16 bp, Homo sapiens
cacaggactctgcctc

SEQ ID NO: 3864566 - DNA, 21 bp, Homo sapiens
cacaggactgattctgggatg

SEQ ID NO: 3864567 - DNA, 21 bp, Homo sapiens
cacaggagacactgtgctata

SEQ ID NO: 3864568 - DNA, 23 bp, Homo sapiens
cacaggagcagacagagaaatgt

SEQ ID NO: 3864569 - DNA, 14 bp, Homo sapiens
cacaggagctacct

SEQ ID NO: 3864570 - DNA, 18 bp, Homo sapiens
cacaggagctacctgtgt

SEQ ID NO: 3864571 - DNA, 20 bp, Homo sapiens
cacaggagctacctgtgtgg

SEQ ID NO: 3864572 - DNA, 19 bp, Homo sapiens
cacaggatcctattctcac

SEQ ID NO: 3864573 - DNA, 24 bp, Homo sapiens
cacaggatcctattctcaccagga

SEQ ID NO: 3864574 - DNA, 16 bp, Homo sapiens
cacaggcagctggatg

SEQ ID NO: 3864575 - DNA, 18 bp, Homo sapiens
cacaggcaggaagagaga

SEQ ID NO: 3864576 - DNA, 16 bp, Homo sapiens
cacaggcatttcctgg

SEQ ID NO: 3864577 - DNA, 19 bp, Homo sapiens
cacaggcccttcctctcca

SEQ ID NO: 3864578 - DNA, 23 bp, Homo sapiens
cacaggcccttcctctccactgc

SEQ ID NO: 3864579 - DNA, 15 bp, Homo sapiens
cacaggcccttgggg

SEQ ID NO: 3864580 - DNA, 16 bp, Homo sapiens
cacaggcccttggggt

SEQ ID NO: 3864581 - DNA, 14 bp, Homo sapiens
cacaggcctgtgta

SEQ ID NO: 3864582 - DNA, 21 bp, Homo sapiens
cacaggcctgtgtagctgtga

SEQ ID NO: 3864583 - DNA, 24 bp, Homo sapiens
cacaggcctgtgtagctgtgacct

SEQ ID NO: 3864584 - DNA, 16 bp, Homo sapiens
cacagggctctttgat

SEQ ID NO: 3864585 - DNA, 15 bp, Homo sapiens
cacaggggcaggcct

SEQ ID NO: 3864586 - DNA, 15 bp, Homo sapiens
cacaggggccccaga

SEQ ID NO: 3864587 - DNA, 16 bp, Homo sapiens
cacaggggcggggcag

SEQ ID NO: 3864588 - DNA, 16 bp, Homo sapiens
cacagggttttgtatt

SEQ ID NO: 3864589 - DNA, 13 bp, Homo sapiens
cacaggtgtaaat

SEQ ID NO: 3864590 - DNA, 14 bp, Homo sapiens
cacaggtgtaaata

SEQ ID NO: 3864591 - DNA, 14 bp, Homo sapiens
cacaggttccatag

SEQ ID NO: 3864592 - DNA, 14 bp, Homo sapiens
cacagtgcatctca

SEQ ID NO: 3864593 - DNA, 18 bp, Homo sapiens
cacagtgcccagctaatt

SEQ ID NO: 3864594 - DNA, 15 bp, Homo sapiens
cacagtgctgcttct

SEQ ID NO: 3864595 - DNA, 20 bp, Homo sapiens
cacagtggcacggagagaag

SEQ ID NO: 3864596 - DNA, 20 bp, Homo sapiens
cacagtggcgagaggagagg

SEQ ID NO: 3864597 - DNA, 17 bp, Homo sapiens
cacagtgggtggcacct

SEQ ID NO: 3864598 - DNA, 19 bp, Homo sapiens
cacagttcctcgccctggg

SEQ ID NO: 3864599 - DNA, 22 bp, Homo sapiens
cacagttcctcgccctgggtct

SEQ ID NO: 3864600 - DNA, 22 bp, Homo sapiens
cacagttcttggtgactgtccc

SEQ ID NO: 3864601 - DNA, 20 bp, Homo sapiens
cacagtttagtgctttacat

SEQ ID NO: 3864602 - DNA, 20 bp, Homo sapiens
cacagttttctgagaaagac

SEQ ID NO: 3864603 - DNA, 22 bp, Homo sapiens
cacagttttctgagaaagacta

SEQ ID NO: 3864604 - DNA, 13 bp, Homo sapiens
cacatacaatttg

SEQ ID NO: 3864605 - DNA, 19 bp, Homo sapiens
cacatacaatttgcactgt

SEQ ID NO: 3864606 - DNA, 13 bp, Homo sapiens
cacatacatacat

SEQ ID NO: 3864607 - DNA, 14 bp, Homo sapiens
cacatacatacata

SEQ ID NO: 3864608 - DNA, 15 bp, Homo sapiens
cacataccctccccc

SEQ ID NO: 3864609 - DNA, 23 bp, Homo sapiens
cacatacgtgttaggaggctgca

SEQ ID NO: 3864610 - DNA, 15 bp, Homo sapiens
cacatactagaaagc

SEQ ID NO: 3864611 - DNA, 14 bp, Homo sapiens
cacatagagatatg

SEQ ID NO: 3864612 - DNA, 18 bp, Homo sapiens
cacatagattaatggcac

SEQ ID NO: 3864613 - DNA, 12 bp, Homo sapiens
cacatatacata

SEQ ID NO: 3864614 - DNA, 17 bp, Homo sapiens
cacatatgggtgctggc

SEQ ID NO: 3864615 - DNA, 22 bp, Homo sapiens
cacatcaagcatgcaataatgt

SEQ ID NO: 3864616 - DNA, 12 bp, Homo sapiens
cacatcccaggc

SEQ ID NO: 3864617 - DNA, 14 bp, Homo sapiens
cacatcccggcctc

SEQ ID NO: 3864618 - DNA, 15 bp, Homo sapiens
cacatcccggcctct

SEQ ID NO: 3864619 - DNA, 17 bp, Homo sapiens
cacatcccggcctcttc

SEQ ID NO: 3864620 - DNA, 16 bp, Homo sapiens
cacatccctgccctcc

SEQ ID NO: 3864621 - DNA, 12 bp, Homo sapiens
cacatccctggg

SEQ ID NO: 3864622 - DNA, 14 bp, Homo sapiens
cacatccctgggcc

SEQ ID NO: 3864623 - DNA, 15 bp, Homo sapiens
cacatccctgggcct

SEQ ID NO: 3864624 - DNA, 16 bp, Homo sapiens
cacatccctgggcctg

SEQ ID NO: 3864625 - DNA, 18 bp, Homo sapiens
cacatccctgggcctgct

SEQ ID NO: 3864626 - DNA, 20 bp, Homo sapiens
cacatccctgggcctgctgc

SEQ ID NO: 3864627 - DNA, 22 bp, Homo sapiens
cacatccctgggcctgctgctg

SEQ ID NO: 3864628 - DNA, 21 bp, Homo sapiens
cacatctctgaaagcacagga

SEQ ID NO: 3864629 - DNA, 14 bp, Homo sapiens
cacatctctgcagt

SEQ ID NO: 3864630 - DNA, 12 bp, Homo sapiens
cacatcttctca

SEQ ID NO: 3864631 - DNA, 18 bp, Homo sapiens
cacatgcatcatcagcct

SEQ ID NO: 3864632 - DNA, 16 bp, Homo sapiens
cacatgcgtatatgtg

SEQ ID NO: 3864633 - DNA, 21 bp, Homo sapiens
cacatggctatcctagagagg

SEQ ID NO: 3864634 - DNA, 19 bp, Homo sapiens
cacatgtcaccgtggacct

SEQ ID NO: 3864635 - DNA, 23 bp, Homo sapiens
cacatgtcaccgtggaccttcct

SEQ ID NO: 3864636 - DNA, 16 bp, Homo sapiens
cacatgtttattcatg

SEQ ID NO: 3864637 - DNA, 19 bp, Homo sapiens
caaggccgctgttcaccca

SEQ ID NO: 3864638 - DNA, 18 bp, Homo sapiens
caaggctgaccaagagag

SEQ ID NO: 3864639 - DNA, 19 bp, Homo sapiens
caaggctgaccaagagaga

SEQ ID NO: 3864640 - DNA, 21 bp, Homo sapiens
caaggctgaccaagagagaaa

SEQ ID NO: 3864641 - DNA, 23 bp, Homo sapiens
caagggaaggaagggacacacac

SEQ ID NO: 3864642 - DNA, 23 bp, Homo sapiens
caagggcatcaggcactggtggc

SEQ ID NO: 3864643 - DNA, 14 bp, Homo sapiens
caagggccatgctg

SEQ ID NO: 3864644 - DNA, 20 bp, Homo sapiens
caagggccatgctgaaggga

SEQ ID NO: 3864645 - DNA, 12 bp, Homo sapiens
caagggctccag

SEQ ID NO: 3864646 - DNA, 21 bp, Homo sapiens
caagggggtgtcatctgagga

SEQ ID NO: 3864647 - DNA, 19 bp, Homo sapiens
caagggtatgggaagccat

SEQ ID NO: 3864648 - DNA, 16 bp, Homo sapiens
caagggtctagggaga

SEQ ID NO: 3864649 - DNA, 22 bp, Homo sapiens
caaggtctccttactctgagcc

SEQ ID NO: 3864650 - DNA, 14 bp, Homo sapiens
caaggtctttggtt

SEQ ID NO: 3864651 - DNA, 19 bp, Homo sapiens
caaggtggccaaattattt

SEQ ID NO: 3864652 - DNA, 22 bp, Homo sapiens
caaggtggggggatcacaaggt

SEQ ID NO: 3864653 - DNA, 21 bp, Homo sapiens
caaggtgtttccatttctcaa

SEQ ID NO: 3864654 - DNA, 21 bp, Homo sapiens
caaggttatatgcactttctc

SEQ ID NO: 3864655 - DNA, 19 bp, Homo sapiens
caaggttccctctgagaat

SEQ ID NO: 3864656 - DNA, 21 bp, Homo sapiens
caagtatgaataaagacacct

SEQ ID NO: 3864657 - DNA, 20 bp, Homo sapiens
caagtattgcgaatgtgcag

SEQ ID NO: 3864658 - DNA, 18 bp, Homo sapiens
caagtattttatctgtgt

SEQ ID NO: 3864659 - DNA, 19 bp, Homo sapiens
caagtcaaccaatgtagaa

SEQ ID NO: 3864660 - DNA, 14 bp, Homo sapiens
caagtcacagctgc

SEQ ID NO: 3864661 - DNA, 16 bp, Homo sapiens
caagtcacagctgcag

SEQ ID NO: 3864662 - DNA, 19 bp, Homo sapiens
caagtcacagctgcagctg

SEQ ID NO: 3864663 - DNA, 20 bp, Homo sapiens
caagtcacagctgcagctgg

SEQ ID NO: 3864664 - DNA, 22 bp, Homo sapiens
caagtcacagctgcagctgggc

SEQ ID NO: 3864665 - DNA, 19 bp, Homo sapiens
caagtcaggcccttatttt

SEQ ID NO: 3864666 - DNA, 13 bp, Homo sapiens
caagtccaacctg

SEQ ID NO: 3864667 - DNA, 14 bp, Homo sapiens
caagtccaacctgc

SEQ ID NO: 3864668 - DNA, 20 bp, Homo sapiens
caagtccaacctgcctgtgc

SEQ ID NO: 3864669 - DNA, 16 bp, Homo sapiens
caagtccaggtcctgg

SEQ ID NO: 3864670 - DNA, 15 bp, Homo sapiens
caagtcctgtgaatt

SEQ ID NO: 3864671 - DNA, 14 bp, Homo sapiens
caagtctccttccc

SEQ ID NO: 3864672 - DNA, 18 bp, Homo sapiens
caagtctggatctgggac

SEQ ID NO: 3864673 - DNA, 20 bp, Homo sapiens
caagtgatatatgtatttat

SEQ ID NO: 3864674 - DNA, 21 bp, Homo sapiens
caagtgatatcacctctcttc

SEQ ID NO: 3864675 - DNA, 19 bp, Homo sapiens
caagtgcatgctctctgca

SEQ ID NO: 3864676 - DNA, 15 bp, Homo sapiens
caagtgcctcttgtt

SEQ ID NO: 3864677 - DNA, 14 bp, Homo sapiens
caagtggagggggt

SEQ ID NO: 3864678 - DNA, 19 bp, Homo sapiens
caagtggctcccacaccct

SEQ ID NO: 3864679 - DNA, 16 bp, Homo sapiens
caagtgggggtcgaga

SEQ ID NO: 3864680 - DNA, 14 bp, Homo sapiens
caagtgtatatcag

SEQ ID NO: 3864681 - DNA, 22 bp, Homo sapiens
caagtgtggtagggacttaaaa

SEQ ID NO: 3864682 - DNA, 14 bp, Homo sapiens
caagttatattgaa

SEQ ID NO: 3864683 - DNA, 23 bp, Homo sapiens
caagttattaatcttatgtgttt

SEQ ID NO: 3864684 - DNA, 14 bp, Homo sapiens
caagttcagggaag

SEQ ID NO: 3864685 - DNA, 15 bp, Homo sapiens
caagttcctgcactc

SEQ ID NO: 3864686 - DNA, 19 bp, Homo sapiens
caagttcctgcactccaga

SEQ ID NO: 3864687 - DNA, 20 bp, Homo sapiens
caagttcctgcactccagaa

SEQ ID NO: 3864688 - DNA, 12 bp, Homo sapiens
caagttttgtat

SEQ ID NO: 3864689 - DNA, 21 bp, Homo sapiens
caataaaaaaaagaaatgaaa

SEQ ID NO: 3864690 - DNA, 11 bp, Homo sapiens
caataaaagtg

SEQ ID NO: 3864691 - DNA, 21 bp, Homo sapiens
caataaaatagtattgaaagt

SEQ ID NO: 3864692 - DNA, 20 bp, Homo sapiens
caataaaatcttgaaaatgc

SEQ ID NO: 3864693 - DNA, 23 bp, Homo sapiens
caataaagctgctgagaatctag

SEQ ID NO: 3864694 - DNA, 23 bp, Homo sapiens
caataaagctggacaagaagctg

SEQ ID NO: 3864695 - DNA, 17 bp, Homo sapiens
caataaatgctgaatga

SEQ ID NO: 3864696 - DNA, 20 bp, Homo sapiens
caataattaggatctatgca

SEQ ID NO: 3864697 - DNA, 14 bp, Homo sapiens
caataatttcaggt

SEQ ID NO: 3864698 - DNA, 14 bp, Homo sapiens
caatacaacaagaa

SEQ ID NO: 3864699 - DNA, 15 bp, Homo sapiens
caatacaacaagaac

SEQ ID NO: 3864700 - DNA, 15 bp, Homo sapiens
caatacatgctgcta

SEQ ID NO: 3864701 - DNA, 22 bp, Homo sapiens
caatagactgaagagaccacag

SEQ ID NO: 3864702 - DNA, 16 bp, Homo sapiens
caatagctattgcatg

SEQ ID NO: 3864703 - DNA, 20 bp, Homo sapiens
caatatataaaaatatatat

SEQ ID NO: 3864704 - DNA, 17 bp, Homo sapiens
caatatgtgatttttgt

SEQ ID NO: 3864705 - DNA, 12 bp, Homo sapiens
caatattaaata

SEQ ID NO: 3864706 - DNA, 21 bp, Homo sapiens
caatattaaatacagacacta

SEQ ID NO: 3864707 - DNA, 22 bp, Homo sapiens
caatattaaatacagacactaa

SEQ ID NO: 3864708 - DNA, 15 bp, Homo sapiens
caatattcaataaag

SEQ ID NO: 3864709 - DNA, 17 bp, Homo sapiens
caatattcaataaagct

SEQ ID NO: 3864710 - DNA, 15 bp, Homo sapiens
caatcactgctcccc

SEQ ID NO: 3864711 - DNA, 20 bp, Homo sapiens
caatccaggtgggagagaca

SEQ ID NO: 3864712 - DNA, 23 bp, Homo sapiens
caatcccaccaaccctcagagcc

SEQ ID NO: 3864713 - DNA, 21 bp, Homo sapiens
caatcccctcattcaggaaaa

SEQ ID NO: 3864714 - DNA, 20 bp, Homo sapiens
caatcctagaaccaagcttc

SEQ ID NO: 3864715 - DNA, 23 bp, Homo sapiens
caatcctagaaccaagcttcaga

SEQ ID NO: 3864716 - DNA, 14 bp, Homo sapiens
caatcctgccccca

SEQ ID NO: 3864717 - DNA, 17 bp, Homo sapiens
caatcctgcccccagcc

SEQ ID NO: 3864718 - DNA, 21 bp, Homo sapiens
caatctcaaattctcaaccta

SEQ ID NO: 3864719 - DNA, 20 bp, Homo sapiens
caatctgctcagcaggccct

SEQ ID NO: 3864720 - DNA, 21 bp, Homo sapiens
caatcttcggggtgtgatgaa

SEQ ID NO: 3864721 - DNA, 16 bp, Homo sapiens
caatcttgtccacagt

SEQ ID NO: 3864722 - DNA, 15 bp, Homo sapiens
caatgaaaccaaagc

SEQ ID NO: 3864723 - DNA, 19 bp, Homo sapiens
caatgaaatgctctccttt

SEQ ID NO: 3864724 - DNA, 15 bp, Homo sapiens
caatgaaatgcttgt

SEQ ID NO: 3864725 - DNA, 15 bp, Homo sapiens
caatgacctgtattt

SEQ ID NO: 3864726 - DNA, 19 bp, Homo sapiens
caatgagctgtatctgtaa

SEQ ID NO: 3864727 - DNA, 21 bp, Homo sapiens
caatgatgattaaacacctga

SEQ ID NO: 3864728 - DNA, 16 bp, Homo sapiens
caatgatggcaatttt

SEQ ID NO: 3864729 - DNA, 24 bp, Homo sapiens
caatgatggcaattttgtaacgaa

SEQ ID NO: 3864730 - DNA, 13 bp, Homo sapiens
caatgattatttt

SEQ ID NO: 3864731 - DNA, 15 bp, Homo sapiens
caatgattattttca

SEQ ID NO: 3864732 - DNA, 18 bp, Homo sapiens
caatgcacacacacagag

SEQ ID NO: 3864733 - DNA, 20 bp, Homo sapiens
caatgcccgtaatgcttaga

SEQ ID NO: 3864734 - DNA, 20 bp, Homo sapiens
caatgccctaattagggcat

SEQ ID NO: 3864735 - DNA, 14 bp, Homo sapiens
caatgccctgccat

SEQ ID NO: 3864736 - DNA, 14 bp, Homo sapiens
caatgcctctccca

SEQ ID NO: 3864737 - DNA, 17 bp, Homo sapiens
caatgccttgacaacag

SEQ ID NO: 3864738 - DNA, 17 bp, Homo sapiens
caatgccttgggagaga

SEQ ID NO: 3864739 - DNA, 18 bp, Homo sapiens
caatgctttgggaggcca

SEQ ID NO: 3864740 - DNA, 19 bp, Homo sapiens
caatggcagctagactgga

SEQ ID NO: 3864741 - DNA, 18 bp, Homo sapiens
caatggctaattcccaga

SEQ ID NO: 3864742 - DNA, 14 bp, Homo sapiens
caatggctgtaaac

SEQ ID NO: 3864743 - DNA, 22 bp, Homo sapiens
caatgggagggggctccatgga

SEQ ID NO: 3864744 - DNA, 15 bp, Homo sapiens
caatgggcactggga

SEQ ID NO: 3864745 - DNA, 17 bp, Homo sapiens
caatgggcactgggatg

SEQ ID NO: 3864746 - DNA, 16 bp, Homo sapiens
caatggggtgggccca

SEQ ID NO: 3864747 - DNA, 22 bp, Homo sapiens
caatggtgttcaccatcggcag

SEQ ID NO: 3864748 - DNA, 11 bp, Homo sapiens
caatgtgaaaa

SEQ ID NO: 3864749 - DNA, 18 bp, Homo sapiens
caatgtgaaaaatgtgtc

SEQ ID NO: 3864750 - DNA, 14 bp, Homo sapiens
caatgtgaatcaga

SEQ ID NO: 3864751 - DNA, 18 bp, Homo sapiens
caatgtgaatcagaccct

SEQ ID NO: 3864752 - DNA, 21 bp, Homo sapiens
caatgtggcctaaaaatgcaa

SEQ ID NO: 3864753 - DNA, 13 bp, Homo sapiens
caatgttgtgatt

SEQ ID NO: 3864754 - DNA, 13 bp, Homo sapiens
caatgttttcctt

SEQ ID NO: 3864755 - DNA, 15 bp, Homo sapiens
caattaaaatatata

SEQ ID NO: 3864756 - DNA, 13 bp, Homo sapiens
caattagtacagt

SEQ ID NO: 3864757 - DNA, 14 bp, Homo sapiens
caattcaacacatt

SEQ ID NO: 3864758 - DNA, 14 bp, Homo sapiens
caattcaggactgg

SEQ ID NO: 3864759 - DNA, 16 bp, Homo sapiens
caattcaggactggct

SEQ ID NO: 3864760 - DNA, 21 bp, Homo sapiens
caattcagtgctgtacttgat

SEQ ID NO: 3864761 - DNA, 17 bp, Homo sapiens
caattctctttagttct

SEQ ID NO: 3864762 - DNA, 16 bp, Homo sapiens
caattgatacttcagg

SEQ ID NO: 3864763 - DNA, 12 bp, Homo sapiens
caattgtaaaaa

SEQ ID NO: 3864764 - DNA, 17 bp, Homo sapiens
caattgtacattccctg

SEQ ID NO: 3864765 - DNA, 18 bp, Homo sapiens
caattgtacattccctgc

SEQ ID NO: 3864766 - DNA, 14 bp, Homo sapiens
caatttaattccat

SEQ ID NO: 3864767 - DNA, 16 bp, Homo sapiens
caatttagaaaacatt

SEQ ID NO: 3864768 - DNA, 23 bp, Homo sapiens
caatttattaaaatgattgtaaa

SEQ ID NO: 3864769 - DNA, 13 bp, Homo sapiens
caatttcccagaa

SEQ ID NO: 3864770 - DNA, 20 bp, Homo sapiens
caatttcccctctgtgtcct

SEQ ID NO: 3864771 - DNA, 22 bp, Homo sapiens
caatttcccctctgtgtcctct

SEQ ID NO: 3864772 - DNA, 21 bp, Homo sapiens
caatttcctttatatttagtg

SEQ ID NO: 3864773 - DNA, 18 bp, Homo sapiens
caatttgagcaattcatt

SEQ ID NO: 3864774 - DNA, 23 bp, Homo sapiens
caatttgtaattgcttacatttt

SEQ ID NO: 3864775 - DNA, 12 bp, Homo sapiens
caatttttaaac

SEQ ID NO: 3864776 - DNA, 16 bp, Homo sapiens
caatttttatacatat

SEQ ID NO: 3864777 - DNA, 14 bp, Homo sapiens
caatttttttatac

SEQ ID NO: 3864778 - DNA, 12 bp, Homo sapiens
cacaaaaaagaa

SEQ ID NO: 3864779 - DNA, 13 bp, Homo sapiens
cacaaaaaagaag

SEQ ID NO: 3864780 - DNA, 14 bp, Homo sapiens
cacaaaagccaaaa

SEQ ID NO: 3864781 - DNA, 15 bp, Homo sapiens
cacaaacacctccta

SEQ ID NO: 3864782 - DNA, 20 bp, Homo sapiens
cacaaaccaccctaaaatga

SEQ ID NO: 3864783 - DNA, 15 bp, Homo sapiens
cacaaagccgtgcct

SEQ ID NO: 3864784 - DNA, 21 bp, Homo sapiens
cacaaataatgaacagcagaa

SEQ ID NO: 3864785 - DNA, 13 bp, Homo sapiens
cacaaatatttat

SEQ ID NO: 3864786 - DNA, 23 bp, Homo sapiens
cacaaatctatattaaagtgtta

SEQ ID NO: 3864787 - DNA, 16 bp, Homo sapiens
cacaactgacacagga

SEQ ID NO: 3864788 - DNA, 20 bp, Homo sapiens
cacaagaaatttgatttcta

SEQ ID NO: 3864789 - DNA, 20 bp, Homo sapiens
cacaagagcccagcagggcc

SEQ ID NO: 3864790 - DNA, 16 bp, Homo sapiens
cacaagattcccagag

SEQ ID NO: 3864791 - DNA, 17 bp, Homo sapiens
cacaagattcccagaga

SEQ ID NO: 3864792 - DNA, 15 bp, Homo sapiens
cacaagcaataatta

SEQ ID NO: 3864793 - DNA, 23 bp, Homo sapiens
cacaagccattttttgaggagag

SEQ ID NO: 3864794 - DNA, 18 bp, Homo sapiens
cacaagccttactcacct

SEQ ID NO: 3864795 - DNA, 19 bp, Homo sapiens
cacaagccttactcacctc

SEQ ID NO: 3864796 - DNA, 20 bp, Homo sapiens
cacaagccttactcacctct

SEQ ID NO: 3864797 - DNA, 16 bp, Homo sapiens
cacaagcttgtatata

SEQ ID NO: 3864798 - DNA, 18 bp, Homo sapiens
cacaaggcagcaaggccc

SEQ ID NO: 3864799 - DNA, 19 bp, Homo sapiens
cacaaggctgaccaagaga

SEQ ID NO: 3864800 - DNA, 12 bp, Homo sapiens
cacaaggctggg

SEQ ID NO: 3864801 - DNA, 16 bp, Homo sapiens
cacaagttccagctgg

SEQ ID NO: 3864802 - DNA, 19 bp, Homo sapiens
cacaatctttccttgtctc

SEQ ID NO: 3864803 - DNA, 21 bp, Homo sapiens
cacaatctttccttgtctctc

SEQ ID NO: 3864804 - DNA, 22 bp, Homo sapiens
cacaatgaaatgctctcctttc

SEQ ID NO: 3864805 - DNA, 22 bp, Homo sapiens
cacaatgatgattaaacacctg

SEQ ID NO: 3864806 - DNA, 16 bp, Homo sapiens
cacaatgctattgaaa

SEQ ID NO: 3864807 - DNA, 18 bp, Homo sapiens
cacaatggagtgggagat

SEQ ID NO: 3864808 - DNA, 12 bp, Homo sapiens
caaaatattttc

SEQ ID NO: 3864809 - DNA, 17 bp, Homo sapiens
caaaatcacaagcaata

SEQ ID NO: 3864810 - DNA, 17 bp, Homo sapiens
caaaatgacaaggggag

SEQ ID NO: 3864811 - DNA, 12 bp, Homo sapiens
caaaatggaagg

SEQ ID NO: 3864812 - DNA, 21 bp, Homo sapiens
caaaatttctttttttaaatt

SEQ ID NO: 3864813 - DNA, 13 bp, Homo sapiens
caaaattttattc

SEQ ID NO: 3864814 - DNA, 14 bp, Homo sapiens
caaaattttattcc

SEQ ID NO: 3864815 - DNA, 17 bp, Homo sapiens
caaacaagaatgtccct

SEQ ID NO: 3864816 - DNA, 13 bp, Homo sapiens
caaacacactgta

SEQ ID NO: 3864817 - DNA, 16 bp, Homo sapiens
caaacacactgtaaat

SEQ ID NO: 3864818 - DNA, 15 bp, Homo sapiens
caaacacctcccagg

SEQ ID NO: 3864819 - DNA, 16 bp, Homo sapiens
caaacactgaatcatg

SEQ ID NO: 3864820 - DNA, 19 bp, Homo sapiens
caaacactgaatcatgtta

SEQ ID NO: 3864821 - DNA, 16 bp, Homo sapiens
caaacagtctcaggaa

SEQ ID NO: 3864822 - DNA, 12 bp, Homo sapiens
caaacatgaagt

SEQ ID NO: 3864823 - DNA, 19 bp, Homo sapiens
caaacatgtggcaacctgt

SEQ ID NO: 3864824 - DNA, 22 bp, Homo sapiens
caaacatgtggcaacctgttct

SEQ ID NO: 3864825 - DNA, 14 bp, Homo sapiens
caaaccacaactga

SEQ ID NO: 3864826 - DNA, 15 bp, Homo sapiens
caaaccacaactgac

SEQ ID NO: 3864827 - DNA, 14 bp, Homo sapiens
caaaccactgtaca

SEQ ID NO: 3864828 - DNA, 16 bp, Homo sapiens
caaaccactgtacata

SEQ ID NO: 3864829 - DNA, 18 bp, Homo sapiens
caaaccactgtacatata

SEQ ID NO: 3864830 - DNA, 13 bp, Homo sapiens
caaaccaggactc

SEQ ID NO: 3864831 - DNA, 12 bp, Homo sapiens
caaaccagggtg

SEQ ID NO: 3864832 - DNA, 13 bp, Homo sapiens
caaaccagggtgc

SEQ ID NO: 3864833 - DNA, 15 bp, Homo sapiens
caaaccagggtgcat

SEQ ID NO: 3864834 - DNA, 18 bp, Homo sapiens
caaaccatttaattcata

SEQ ID NO: 3864835 - DNA, 20 bp, Homo sapiens
caaaccatttaattcataat

SEQ ID NO: 3864836 - DNA, 14 bp, Homo sapiens
caaaccatttcaaa

SEQ ID NO: 3864837 - DNA, 18 bp, Homo sapiens
caaaccccgaccacctgc

SEQ ID NO: 3864838 - DNA, 21 bp, Homo sapiens
caaaccccgaccacctgccca

SEQ ID NO: 3864839 - DNA, 16 bp, Homo sapiens
caaactcctgcctgtg

SEQ ID NO: 3864840 - DNA, 21 bp, Homo sapiens
caaactgagtaaattggaaac

SEQ ID NO: 3864841 - DNA, 23 bp, Homo sapiens
caaactgagtaaattggaaacat

SEQ ID NO: 3864842 - DNA, 22 bp, Homo sapiens
caaactgcacacacagctcctc

SEQ ID NO: 3864843 - DNA, 17 bp, Homo sapiens
caaactgtgccctgcct

SEQ ID NO: 3864844 - DNA, 18 bp, Homo sapiens
caaactgtgccctgcctt

SEQ ID NO: 3864845 - DNA, 21 bp, Homo sapiens
caaactgtgccctgccttcag

SEQ ID NO: 3864846 - DNA, 20 bp, Homo sapiens
caaactgttcaagaaataat

SEQ ID NO: 3864847 - DNA, 12 bp, Homo sapiens
caaactttattt

SEQ ID NO: 3864848 - DNA, 17 bp, Homo sapiens
caaagaaggaattctag

SEQ ID NO: 3864849 - DNA, 21 bp, Homo sapiens
caaagaaggcacaggtgtaaa

SEQ ID NO: 3864850 - DNA, 17 bp, Homo sapiens
caaagagaaaaagaaat

SEQ ID NO: 3864851 - DNA, 19 bp, Homo sapiens
caaagagaaaaagaaatgc

SEQ ID NO: 3864852 - DNA, 15 bp, Homo sapiens
caaagagaataaaga

SEQ ID NO: 3864853 - DNA, 16 bp, Homo sapiens
caaagagactggagca

SEQ ID NO: 3864854 - DNA, 18 bp, Homo sapiens
caaagagactggagcatc

SEQ ID NO: 3864855 - DNA, 20 bp, Homo sapiens
caaagagtgggctgcatctg

SEQ ID NO: 3864856 - DNA, 22 bp, Homo sapiens
caaagatgtttgtcagatatga

SEQ ID NO: 3864857 - DNA, 14 bp, Homo sapiens
caaagcaaaagaag

SEQ ID NO: 3864858 - DNA, 13 bp, Homo sapiens
caaagcaagggct

SEQ ID NO: 3864859 - DNA, 21 bp, Homo sapiens
caaagcaccagcttctccagg

SEQ ID NO: 3864860 - DNA, 20 bp, Homo sapiens
caaagcactgacttctaagt

SEQ ID NO: 3864861 - DNA, 14 bp, Homo sapiens
caaagcatggacta

SEQ ID NO: 3864862 - DNA, 22 bp, Homo sapiens
caaagccccacctttaagtcct

SEQ ID NO: 3864863 - DNA, 21 bp, Homo sapiens
caaagccgtgcctttctctgg

SEQ ID NO: 3864864 - DNA, 19 bp, Homo sapiens
caaagcgagatcccatctc

SEQ ID NO: 3864865 - DNA, 18 bp, Homo sapiens
caaagcttctatcccagg

SEQ ID NO: 3864866 - DNA, 16 bp, Homo sapiens
caaaggaagtctagga

SEQ ID NO: 3864867 - DNA, 22 bp, Homo sapiens
caaaggaatcgtttcaaatgga

SEQ ID NO: 3864868 - DNA, 19 bp, Homo sapiens
caaaggaatctccagtttt

SEQ ID NO: 3864869 - DNA, 17 bp, Homo sapiens
caaaggacattatgtgt

SEQ ID NO: 3864870 - DNA, 16 bp, Homo sapiens
caaaggagcctgtgaa

SEQ ID NO: 3864871 - DNA, 17 bp, Homo sapiens
caaagggctgaaagcca

SEQ ID NO: 3864872 - DNA, 23 bp, Homo sapiens
caaaggggagaagggccagccct

SEQ ID NO: 3864873 - DNA, 17 bp, Homo sapiens
caaaggggctgctgggg

SEQ ID NO: 3864874 - DNA, 16 bp, Homo sapiens
caaagtaaaacttgct

SEQ ID NO: 3864875 - DNA, 20 bp, Homo sapiens
caaagtcttaaaataactta

SEQ ID NO: 3864876 - DNA, 22 bp, Homo sapiens
caaagtcttaaaataacttata

SEQ ID NO: 3864877 - DNA, 22 bp, Homo sapiens
caaagtgccactcattcctgta

SEQ ID NO: 3864878 - DNA, 21 bp, Homo sapiens
caaagtgctgtacccttccac

SEQ ID NO: 3864879 - DNA, 19 bp, Homo sapiens
caaagtgtaagcacttctg

SEQ ID NO: 3864880 - DNA, 15 bp, Homo sapiens
caaagttgtagttct

SEQ ID NO: 3864881 - DNA, 18 bp, Homo sapiens
caaataaactctaaacat

SEQ ID NO: 3864882 - DNA, 13 bp, Homo sapiens
caaataaatgtgt

SEQ ID NO: 3864883 - DNA, 14 bp, Homo sapiens
caaataaatgtgta

SEQ ID NO: 3864884 - DNA, 17 bp, Homo sapiens
caaataaatgtgtaaat

SEQ ID NO: 3864885 - DNA, 14 bp, Homo sapiens
caaatactccaagc

SEQ ID NO: 3864886 - DNA, 21 bp, Homo sapiens
caaatactccaagcttcaagt

SEQ ID NO: 3864887 - DNA, 22 bp, Homo sapiens
caaatatagagatatttttgta

SEQ ID NO: 3864888 - DNA, 19 bp, Homo sapiens
caaatatagcgttcccaac

SEQ ID NO: 3864889 - DNA, 13 bp, Homo sapiens
caaatatgcaaag

SEQ ID NO: 3864890 - DNA, 16 bp, Homo sapiens
caaatatgcaaagcac

SEQ ID NO: 3864891 - DNA, 19 bp, Homo sapiens
caaatatgcaaagcactga

SEQ ID NO: 3864892 - DNA, 21 bp, Homo sapiens
caaatatgcaaagcactgact

SEQ ID NO: 3864893 - DNA, 23 bp, Homo sapiens
caaatattaccaaaaaagtattt

SEQ ID NO: 3864894 - DNA, 12 bp, Homo sapiens
attttcagaccc

SEQ ID NO: 3864895 - DNA, 19 bp, Homo sapiens
attttcaggtttcttaaaa

SEQ ID NO: 3864896 - DNA, 12 bp, Homo sapiens
attttcagtatt

SEQ ID NO: 3864897 - DNA, 14 bp, Homo sapiens
attttcagtatttt

SEQ ID NO: 3864898 - DNA, 20 bp, Homo sapiens
attttcatgacttttccatg

SEQ ID NO: 3864899 - DNA, 15 bp, Homo sapiens
attttcattaaaagc

SEQ ID NO: 3864900 - DNA, 16 bp, Homo sapiens
attttcccctgaagac

SEQ ID NO: 3864901 - DNA, 19 bp, Homo sapiens
attttcctgaatattaatc

SEQ ID NO: 3864902 - DNA, 21 bp, Homo sapiens
attttcttccaagcaaaggtg

SEQ ID NO: 3864903 - DNA, 13 bp, Homo sapiens
attttgagtgact

SEQ ID NO: 3864904 - DNA, 23 bp, Homo sapiens
attttgagtgactcgagggttgg

SEQ ID NO: 3864905 - DNA, 15 bp, Homo sapiens
attttgccagactta

SEQ ID NO: 3864906 - DNA, 13 bp, Homo sapiens
attttgcctgtgt

SEQ ID NO: 3864907 - DNA, 20 bp, Homo sapiens
attttggaagttttcaggac

SEQ ID NO: 3864908 - DNA, 20 bp, Homo sapiens
attttgtaaactcaaaatat

SEQ ID NO: 3864909 - DNA, 19 bp, Homo sapiens
attttgtaacgaagacaca

SEQ ID NO: 3864910 - DNA, 13 bp, Homo sapiens
attttgtacagaa

SEQ ID NO: 3864911 - DNA, 14 bp, Homo sapiens
attttgtacagaat

SEQ ID NO: 3864912 - DNA, 19 bp, Homo sapiens
attttgtattacatctaat

SEQ ID NO: 3864913 - DNA, 15 bp, Homo sapiens
attttgtcactgtct

SEQ ID NO: 3864914 - DNA, 15 bp, Homo sapiens
attttgtccatttta

SEQ ID NO: 3864915 - DNA, 14 bp, Homo sapiens
attttgttgtgatt

SEQ ID NO: 3864916 - DNA, 21 bp, Homo sapiens
attttgttgtgattttgtaca

SEQ ID NO: 3864917 - DNA, 23 bp, Homo sapiens
attttgttgtgattttgtacaga

SEQ ID NO: 3864918 - DNA, 24 bp, Homo sapiens
attttgttgtgattttgtacagaa

SEQ ID NO: 3864919 - DNA, 21 bp, Homo sapiens
attttgtttcagaattttgta

SEQ ID NO: 3864920 - DNA, 14 bp, Homo sapiens
attttgtttgtaat

SEQ ID NO: 3864921 - DNA, 14 bp, Homo sapiens
atttttaaaagttg

SEQ ID NO: 3864922 - DNA, 15 bp, Homo sapiens
atttttaaactagta

SEQ ID NO: 3864923 - DNA, 16 bp, Homo sapiens
atttttaaactagtaa

SEQ ID NO: 3864924 - DNA, 13 bp, Homo sapiens
atttttacaataa

SEQ ID NO: 3864925 - DNA, 14 bp, Homo sapiens
atttttacaataat

SEQ ID NO: 3864926 - DNA, 22 bp, Homo sapiens
atttttagaattttagaagaga

SEQ ID NO: 3864927 - DNA, 23 bp, Homo sapiens
atttttagctctgttctttataa

SEQ ID NO: 3864928 - DNA, 22 bp, Homo sapiens
atttttatacatatcagaaaag

SEQ ID NO: 3864929 - DNA, 16 bp, Homo sapiens
atttttatcttacttt

SEQ ID NO: 3864930 - DNA, 16 bp, Homo sapiens
atttttcaaccagcat

SEQ ID NO: 3864931 - DNA, 22 bp, Homo sapiens
atttttcaaccagcattttact

SEQ ID NO: 3864932 - DNA, 19 bp, Homo sapiens
atttttcttatttcatttc

SEQ ID NO: 3864933 - DNA, 20 bp, Homo sapiens
atttttcttatttcatttct

SEQ ID NO: 3864934 - DNA, 13 bp, Homo sapiens
atttttgaggaat

SEQ ID NO: 3864935 - DNA, 13 bp, Homo sapiens
atttttgatttat

SEQ ID NO: 3864936 - DNA, 23 bp, Homo sapiens
atttttgatttatgcatggaaac

SEQ ID NO: 3864937 - DNA, 23 bp, Homo sapiens
atttttgtaataaaaggtatgaa

SEQ ID NO: 3864938 - DNA, 23 bp, Homo sapiens
atttttgtcattttaaaatctga

SEQ ID NO: 3864939 - DNA, 15 bp, Homo sapiens
atttttgtccctgct

SEQ ID NO: 3864940 - DNA, 23 bp, Homo sapiens
atttttgtccctgctcctcccaa

SEQ ID NO: 3864941 - DNA, 19 bp, Homo sapiens
attttttgatgtcagcctt

SEQ ID NO: 3864942 - DNA, 15 bp, Homo sapiens
attttttttgtaact

SEQ ID NO: 3864943 - DNA, 17 bp, Homo sapiens
atttttttttcctagcc

SEQ ID NO: 3864944 - DNA, 17 bp, Homo sapiens
attttttttttaaaact

SEQ ID NO: 3864945 - DNA, 16 bp, Homo sapiens
caaaaaattagccggg

SEQ ID NO: 3864946 - DNA, 12 bp, Homo sapiens
caaaaaattgtc

SEQ ID NO: 3864947 - DNA, 15 bp, Homo sapiens
caaaaacacagcaag

SEQ ID NO: 3864948 - DNA, 17 bp, Homo sapiens
caaaaacacagcaaggg

SEQ ID NO: 3864949 - DNA, 15 bp, Homo sapiens
caaaaacagcctcac

SEQ ID NO: 3864950 - DNA, 14 bp, Homo sapiens
caaaaaccagcagg

SEQ ID NO: 3864951 - DNA, 20 bp, Homo sapiens
caaaaagggaaactattgtc

SEQ ID NO: 3864952 - DNA, 16 bp, Homo sapiens
caaaaagtttcctttt

SEQ ID NO: 3864953 - DNA, 20 bp, Homo sapiens
caaaaatggtggtttgtcat

SEQ ID NO: 3864954 - DNA, 15 bp, Homo sapiens
caaaaattagccggg

SEQ ID NO: 3864955 - DNA, 14 bp, Homo sapiens
caaaacaaaacaac

SEQ ID NO: 3864956 - DNA, 18 bp, Homo sapiens
caaaacaaaacaacaaca

SEQ ID NO: 3864957 - DNA, 15 bp, Homo sapiens
caaaacaagaaagaa

SEQ ID NO: 3864958 - DNA, 17 bp, Homo sapiens
caaaacaagaaagaaac

SEQ ID NO: 3864959 - DNA, 19 bp, Homo sapiens
caaaacaagaaagaaacgt

SEQ ID NO: 3864960 - DNA, 14 bp, Homo sapiens
caaaacatatcaat

SEQ ID NO: 3864961 - DNA, 18 bp, Homo sapiens
caaaacctttccccagac

SEQ ID NO: 3864962 - DNA, 11 bp, Homo sapiens
caaaagacagc

SEQ ID NO: 3864963 - DNA, 12 bp, Homo sapiens
caaaagagaaaa

SEQ ID NO: 3864964 - DNA, 19 bp, Homo sapiens
caaaagagaaaaaaaatta

SEQ ID NO: 3864965 - DNA, 13 bp, Homo sapiens
caaaagagagaat

SEQ ID NO: 3864966 - DNA, 14 bp, Homo sapiens
caaaagcaagactg

SEQ ID NO: 3864967 - DNA, 19 bp, Homo sapiens
caaaaggcagccctttggg

SEQ ID NO: 3864968 - DNA, 22 bp, Homo sapiens
caaaaggtgcctgtgaggcagg

SEQ ID NO: 3864969 - DNA, 17 bp, Homo sapiens
caaaagtgatctgtccc

SEQ ID NO: 3864970 - DNA, 20 bp, Homo sapiens
caaaagtgatctgtcccctc

SEQ ID NO: 3864971 - DNA, 21 bp, Homo sapiens
caaaagtgatctgtcccctct

SEQ ID NO: 3864972 - DNA, 17 bp, Homo sapiens
caaaagttttcctgaga

SEQ ID NO: 3864973 - DNA, 18 bp, Homo sapiens
caaaataaattgaaatat

SEQ ID NO: 3864974 - DNA, 21 bp, Homo sapiens
caaaataaggggcacctggga

SEQ ID NO: 3864975 - DNA, 15 bp, Homo sapiens
caaaataatttaact

SEQ ID NO: 3864976 - DNA, 19 bp, Homo sapiens
caaaataatttaactaatt

SEQ ID NO: 3864977 - DNA, 20 bp, Homo sapiens
caaaataatttaactaattt

SEQ ID NO: 3864978 - DNA, 21 bp, Homo sapiens
caaaataatttaactaattta

SEQ ID NO: 3864979 - DNA, 13 bp, Homo sapiens
caaaatagaagct

SEQ ID NO: 3864980 - DNA, 20 bp, Homo sapiens
caaatattattcaagtgcct

SEQ ID NO: 3864981 - DNA, 19 bp, Homo sapiens
caaatattgttaccatgaa

SEQ ID NO: 3864982 - DNA, 15 bp, Homo sapiens
caaatatttattttc

SEQ ID NO: 3864983 - DNA, 20 bp, Homo sapiens
caaatatttattttctttct

SEQ ID NO: 3864984 - DNA, 16 bp, Homo sapiens
caaatcaaagcaaggg

SEQ ID NO: 3864985 - DNA, 17 bp, Homo sapiens
caaatcacacctctggg

SEQ ID NO: 3864986 - DNA, 18 bp, Homo sapiens
caaatcacacctctgggc

SEQ ID NO: 3864987 - DNA, 13 bp, Homo sapiens
caaatctatatta

SEQ ID NO: 3864988 - DNA, 21 bp, Homo sapiens
caaatctatattaaagtgtta

SEQ ID NO: 3864989 - DNA, 14 bp, Homo sapiens
caaatctattcaga

SEQ ID NO: 3864990 - DNA, 19 bp, Homo sapiens
caaatctgtatatgttgta

SEQ ID NO: 3864991 - DNA, 21 bp, Homo sapiens
caaatcttaacttgaaggagt

SEQ ID NO: 3864992 - DNA, 10 bp, Homo sapiens
caaatgacat

SEQ ID NO: 3864993 - DNA, 19 bp, Homo sapiens
caaatgacatgcactgacc

SEQ ID NO: 3864994 - DNA, 21 bp, Homo sapiens
caaatgacatgcactgaccct

SEQ ID NO: 3864995 - DNA, 15 bp, Homo sapiens
caaatgagggagggg

SEQ ID NO: 3864996 - DNA, 20 bp, Homo sapiens
caaatgattttcatcaattt

SEQ ID NO: 3864997 - DNA, 18 bp, Homo sapiens
caaatgcatggtgcagtt

SEQ ID NO: 3864998 - DNA, 13 bp, Homo sapiens
caaatgctgtctc

SEQ ID NO: 3864999 - DNA, 21 bp, Homo sapiens
caaatggcagcagttccatga

SEQ ID NO: 3865000 - DNA, 18 bp, Homo sapiens
caaatgggtgatatcctg

SEQ ID NO: 3865001 - DNA, 21 bp, Homo sapiens
caaatgtcattatgtagaaat

SEQ ID NO: 3865002 - DNA, 11 bp, Homo sapiens
caaatgtttct

SEQ ID NO: 3865003 - DNA, 14 bp, Homo sapiens
caaatgtttctgca

SEQ ID NO: 3865004 - DNA, 23 bp, Homo sapiens
caaattattttaatattttgtat

SEQ ID NO: 3865005 - DNA, 21 bp, Homo sapiens
caaattcaaggagatataaaa

SEQ ID NO: 3865006 - DNA, 14 bp, Homo sapiens
caaattcatttttt

SEQ ID NO: 3865007 - DNA, 21 bp, Homo sapiens
caaattctcaacctaccaccc

SEQ ID NO: 3865008 - DNA, 15 bp, Homo sapiens
caaattctcaccaaa

SEQ ID NO: 3865009 - DNA, 17 bp, Homo sapiens
caaattgtaactacact

SEQ ID NO: 3865010 - DNA, 17 bp, Homo sapiens
caaatttcaaaagacat

SEQ ID NO: 3865011 - DNA, 17 bp, Homo sapiens
caaattttgcatttagt

SEQ ID NO: 3865012 - DNA, 13 bp, Homo sapiens
caacaacaacaat

SEQ ID NO: 3865013 - DNA, 17 bp, Homo sapiens
caacaacaaggaccctg

SEQ ID NO: 3865014 - DNA, 13 bp, Homo sapiens
caacaacatccat

SEQ ID NO: 3865015 - DNA, 14 bp, Homo sapiens
caacaagagcgaaa

SEQ ID NO: 3865016 - DNA, 14 bp, Homo sapiens
caacaagagtttat

SEQ ID NO: 3865017 - DNA, 15 bp, Homo sapiens
caacaagagtttatt

SEQ ID NO: 3865018 - DNA, 12 bp, Homo sapiens
caacaaggaccc

SEQ ID NO: 3865019 - DNA, 16 bp, Homo sapiens
caacaaggaccctgtt

SEQ ID NO: 3865020 - DNA, 20 bp, Homo sapiens
caacaaggaccctgttttcc

SEQ ID NO: 3865021 - DNA, 16 bp, Homo sapiens
caacaataaagagctc

SEQ ID NO: 3865022 - DNA, 17 bp, Homo sapiens
caacaataaagagctca

SEQ ID NO: 3865023 - DNA, 11 bp, Homo sapiens
caacaataaca

SEQ ID NO: 3865024 - DNA, 14 bp, Homo sapiens
caacaatacaacaa

SEQ ID NO: 3865025 - DNA, 18 bp, Homo sapiens
caacaatacaacaagaac

SEQ ID NO: 3865026 - DNA, 19 bp, Homo sapiens
caacaatacaacaagaaca

SEQ ID NO: 3865027 - DNA, 12 bp, Homo sapiens
caacacaaagag

SEQ ID NO: 3865028 - DNA, 15 bp, Homo sapiens
caacacaaagagaaa

SEQ ID NO: 3865029 - DNA, 21 bp, Homo sapiens
caacacaagacaccttttgta

SEQ ID NO: 3865030 - DNA, 17 bp, Homo sapiens
caacacaagctggaagc

SEQ ID NO: 3865031 - DNA, 20 bp, Homo sapiens
caacacattacttgcacaag

SEQ ID NO: 3865032 - DNA, 21 bp, Homo sapiens
caacacattacttgcacaagc

SEQ ID NO: 3865033 - DNA, 19 bp, Homo sapiens
caacacctccttgctttgc

SEQ ID NO: 3865034 - DNA, 12 bp, Homo sapiens
caacaccttctt

SEQ ID NO: 3865035 - DNA, 14 bp, Homo sapiens
caacactcttcttg

SEQ ID NO: 3865036 - DNA, 15 bp, Homo sapiens
caacactcttcttga

SEQ ID NO: 3865037 - DNA, 20 bp, Homo sapiens
caacactcttcttgagcaga

SEQ ID NO: 3865038 - DNA, 12 bp, Homo sapiens
caacagaagcag

SEQ ID NO: 3865039 - DNA, 10 bp, Homo sapiens
caacagcagc

SEQ ID NO: 3865040 - DNA, 15 bp, Homo sapiens
caacagctcaagtct

SEQ ID NO: 3865041 - DNA, 23 bp, Homo sapiens
caacaggctgttctgcactgaaa

SEQ ID NO: 3865042 - DNA, 24 bp, Homo sapiens
caacaggctgttctgcactgaaaa

SEQ ID NO: 3865043 - DNA, 14 bp, Homo sapiens
caacagttccttca

SEQ ID NO: 3865044 - DNA, 18 bp, Homo sapiens
caacatacccttctttaa

SEQ ID NO: 3865045 - DNA, 21 bp, Homo sapiens
caacatacccttctttaaatc

SEQ ID NO: 3865046 - DNA, 23 bp, Homo sapiens
caacatagtaagaccccatctct

SEQ ID NO: 3865047 - DNA, 22 bp, Homo sapiens
caacatagtgagatcccatttc

SEQ ID NO: 3865048 - DNA, 21 bp, Homo sapiens
caacatccatgtcctatgtgt

SEQ ID NO: 3865049 - DNA, 16 bp, Homo sapiens
caacatcccacagtgg

SEQ ID NO: 3865050 - DNA, 17 bp, Homo sapiens
caacatcccacagtggc

SEQ ID NO: 3865051 - DNA, 20 bp, Homo sapiens
caacatcccattgccctggt

SEQ ID NO: 3865052 - DNA, 19 bp, Homo sapiens
caacatctcgagccccctg

SEQ ID NO: 3865053 - DNA, 13 bp, Homo sapiens
caacatcttctct

SEQ ID NO: 3865054 - DNA, 14 bp, Homo sapiens
caacatcttctctc

SEQ ID NO: 3865055 - DNA, 23 bp, Homo sapiens
caacatctttttcctccctttcc

SEQ ID NO: 3865056 - DNA, 13 bp, Homo sapiens
caacatggagaaa

SEQ ID NO: 3865057 - DNA, 23 bp, Homo sapiens
caacatggagaaaccctgtctct

SEQ ID NO: 3865058 - DNA, 14 bp, Homo sapiens
caacattctttgca

SEQ ID NO: 3865059 - DNA, 20 bp, Homo sapiens
caaccaagagcacattctta

SEQ ID NO: 3865060 - DNA, 14 bp, Homo sapiens
caaccacacacctc

SEQ ID NO: 3865061 - DNA, 12 bp, Homo sapiens
caaccatcaatg

SEQ ID NO: 3865062 - DNA, 24 bp, Homo sapiens
caaccatcaatggaaacagggcag

SEQ ID NO: 3865063 - DNA, 14 bp, Homo sapiens
caaccattccagac

SEQ ID NO: 3865064 - DNA, 14 bp, Homo sapiens
caaccattccccat

SEQ ID NO: 3865065 - DNA, 22 bp, Homo sapiens
caacccatgatgagctcctctt

SEQ ID NO: 3865066 - DNA, 16 bp, Homo sapiens
caaccccagctggcct

SEQ ID NO: 3865067 - DNA, 14 bp, Homo sapiens
caaccccagttctg

SEQ ID NO: 3865068 - DNA, 23 bp, Homo sapiens
caaccccatcatatgacatgcca

SEQ ID NO: 3865069 - DNA, 18 bp, Homo sapiens
caaccccgcggtgctctg

SEQ ID NO: 3865070 - DNA, 21 bp, Homo sapiens
caaccccgcggtgctctggcg

SEQ ID NO: 3865071 - DNA, 12 bp, Homo sapiens
caacccctgtac

SEQ ID NO: 3865072 - DNA, 13 bp, Homo sapiens
caacccctgtacc

SEQ ID NO: 3865073 - DNA, 20 bp, Homo sapiens
caacccctgtacccagctcc

SEQ ID NO: 3865074 - DNA, 23 bp, Homo sapiens
caacccgtgccaagtccaggtcc

SEQ ID NO: 3865075 - DNA, 21 bp, Homo sapiens
caacccgtggaggctgctcgg

SEQ ID NO: 3865076 - DNA, 21 bp, Homo sapiens
caaccctcagagccaccccta

SEQ ID NO: 3865077 - DNA, 16 bp, Homo sapiens
caaccctgtttcctga

SEQ ID NO: 3865078 - DNA, 17 bp, Homo sapiens
caaccctgtttcctgag

SEQ ID NO: 3865079 - DNA, 19 bp, Homo sapiens
caaccctgttttatactgt

SEQ ID NO: 3865080 - DNA, 23 bp, Homo sapiens
caacccttagagattgccccaga

SEQ ID NO: 3865081 - DNA, 15 bp, Homo sapiens
caacccttgctgctg

SEQ ID NO: 3865082 - DNA, 22 bp, Homo sapiens
caaccgccacacacacaggagc

SEQ ID NO: 3865083 - DNA, 18 bp, Homo sapiens
caaccgtggcccttcctg

SEQ ID NO: 3865084 - DNA, 19 bp, Homo sapiens
caacctcaatgccctgcca

SEQ ID NO: 3865085 - DNA, 21 bp, Homo sapiens
caacctcaatgccctgccatt

SEQ ID NO: 3865086 - DNA, 15 bp, Homo sapiens
caacctcttcctcct

SEQ ID NO: 3865087 - DNA, 15 bp, Homo sapiens
caacctgaccaacat

SEQ ID NO: 3865088 - DNA, 14 bp, Homo sapiens
caacctgcctgtgc

SEQ ID NO: 3865089 - DNA, 18 bp, Homo sapiens
caacctgctctcctcttg

SEQ ID NO: 3865090 - DNA, 15 bp, Homo sapiens
caacctggtggcacc

SEQ ID NO: 3865091 - DNA, 22 bp, Homo sapiens
caacctggtggcaccagatgca

SEQ ID NO: 3865092 - DNA, 16 bp, Homo sapiens
caacctttaaaaaagc

SEQ ID NO: 3865093 - DNA, 20 bp, Homo sapiens
caacgggaccccctggccct

SEQ ID NO: 3865094 - DNA, 15 bp, Homo sapiens
caactagacattacc

SEQ ID NO: 3865095 - DNA, 13 bp, Homo sapiens
caactatttataa

SEQ ID NO: 3865096 - DNA, 17 bp, Homo sapiens
caactcccacgactgtt

SEQ ID NO: 3865097 - DNA, 22 bp, Homo sapiens
caactcctggagatttcagtta

SEQ ID NO: 3865098 - DNA, 16 bp, Homo sapiens
caactctccactccat

SEQ ID NO: 3865099 - DNA, 14 bp, Homo sapiens
caactctgactctt

SEQ ID NO: 3865100 - DNA, 15 bp, Homo sapiens
caactctgcactcca

SEQ ID NO: 3865101 - DNA, 13 bp, Homo sapiens
caactgaaaagac

SEQ ID NO: 3865102 - DNA, 22 bp, Homo sapiens
caactgaaaagactcagtgttc

SEQ ID NO: 3865103 - DNA, 13 bp, Homo sapiens
caactggctggga

SEQ ID NO: 3865104 - DNA, 15 bp, Homo sapiens
caactggctgggaca

SEQ ID NO: 3865105 - DNA, 17 bp, Homo sapiens
caactggcttctgtgca

SEQ ID NO: 3865106 - DNA, 14 bp, Homo sapiens
caactggtcactgt

SEQ ID NO: 3865107 - DNA, 16 bp, Homo sapiens
caactgtgttcattag

SEQ ID NO: 3865108 - DNA, 17 bp, Homo sapiens
caacttcaagtgcatgc

SEQ ID NO: 3865109 - DNA, 12 bp, Homo sapiens
caacttggaaaa

SEQ ID NO: 3865110 - DNA, 12 bp, Homo sapiens
caacttggcttt

SEQ ID NO: 3865111 - DNA, 17 bp, Homo sapiens
caacttggctttcccgg

SEQ ID NO: 3865112 - DNA, 11 bp, Homo sapiens
caactttctgt

SEQ ID NO: 3865113 - DNA, 15 bp, Homo sapiens
caagaaaaaataaat

SEQ ID NO: 3865114 - DNA, 15 bp, Homo sapiens
caagaaaaagaaaaa

SEQ ID NO: 3865115 - DNA, 19 bp, Homo sapiens
caagaaaagaggaaaaaaa

SEQ ID NO: 3865116 - DNA, 19 bp, Homo sapiens
caagaaactgaggaatttt

SEQ ID NO: 3865117 - DNA, 12 bp, Homo sapiens
caagaaagaaac

SEQ ID NO: 3865118 - DNA, 17 bp, Homo sapiens
caagaaagatccaccct

SEQ ID NO: 3865119 - DNA, 21 bp, Homo sapiens
caagaaagccgtactgtctat

SEQ ID NO: 3865120 - DNA, 14 bp, Homo sapiens
caagaaatccctgt

SEQ ID NO: 3865121 - DNA, 22 bp, Homo sapiens
caagaacaacaacaacaataac

SEQ ID NO: 3865122 - DNA, 18 bp, Homo sapiens
caagaagacatggagact

SEQ ID NO: 3865123 - DNA, 12 bp, Homo sapiens
caagaagctgct

SEQ ID NO: 3865124 - DNA, 17 bp, Homo sapiens
caagaaggaaggaggca

SEQ ID NO: 3865125 - DNA, 19 bp, Homo sapiens
caagaaggaaggaggcaga

SEQ ID NO: 3865126 - DNA, 22 bp, Homo sapiens
caagaagtacatgaagagcagc

SEQ ID NO: 3865127 - DNA, 18 bp, Homo sapiens
caagaatagatgctgact

SEQ ID NO: 3865128 - DNA, 16 bp, Homo sapiens
caagaatattcaaatg

SEQ ID NO: 3865129 - DNA, 15 bp, Homo sapiens
caagaatattgtatg

SEQ ID NO: 3865130 - DNA, 17 bp, Homo sapiens
caagaatattgtatgtt

SEQ ID NO: 3865131 - DNA, 15 bp, Homo sapiens
caagaatcctctggg

SEQ ID NO: 3865132 - DNA, 19 bp, Homo sapiens
caagaattctagaaaattt

SEQ ID NO: 3865133 - DNA, 13 bp, Homo sapiens
caagacacctttt

SEQ ID NO: 3865134 - DNA, 14 bp, Homo sapiens
caagacctgttggt

SEQ ID NO: 3865135 - DNA, 17 bp, Homo sapiens
caagactgttgctcaaa

SEQ ID NO: 3865136 - DNA, 14 bp, Homo sapiens
caagagaagaaaaa

SEQ ID NO: 3865137 - DNA, 21 bp, Homo sapiens
caagagaagaaaaaattaaga

SEQ ID NO: 3865138 - DNA, 21 bp, Homo sapiens
caagagacagagcccccaagc

SEQ ID NO: 3865139 - DNA, 13 bp, Homo sapiens
caagagagaaaga

SEQ ID NO: 3865140 - DNA, 22 bp, Homo sapiens
caagagagagctcgctcttggg

SEQ ID NO: 3865141 - DNA, 20 bp, Homo sapiens
caagagagggccatgcaatt

SEQ ID NO: 3865142 - DNA, 13 bp, Homo sapiens
caagagcaaaatg

SEQ ID NO: 3865143 - DNA, 22 bp, Homo sapiens
caagagcacattcttaaaggaa

SEQ ID NO: 3865144 - DNA, 18 bp, Homo sapiens
caagagcatcatgcctct

SEQ ID NO: 3865145 - DNA, 20 bp, Homo sapiens
caagagcatcatgcctctga

SEQ ID NO: 3865146 - DNA, 21 bp, Homo sapiens
caagagcatcatgcctctgag

SEQ ID NO: 3865147 - DNA, 22 bp, Homo sapiens
caagagcatcatgcctctgagg

SEQ ID NO: 3865148 - DNA, 18 bp, Homo sapiens
caagagccttggtgtcca

SEQ ID NO: 3865149 - DNA, 21 bp, Homo sapiens
caagagccttggtgtccacct

SEQ ID NO: 3865150 - DNA, 22 bp, Homo sapiens
caagagccttggtgtccacctg

SEQ ID NO: 3865151 - DNA, 23 bp, Homo sapiens
caagagccttggtgtccacctgg

SEQ ID NO: 3865152 - DNA, 13 bp, Homo sapiens
caagagctgctgt

SEQ ID NO: 3865153 - DNA, 22 bp, Homo sapiens
caagaggaataagaatggagca

SEQ ID NO: 3865154 - DNA, 13 bp, Homo sapiens
caagaggcccagg

SEQ ID NO: 3865155 - DNA, 15 bp, Homo sapiens
caagaggcccaggga

SEQ ID NO: 3865156 - DNA, 17 bp, Homo sapiens
caagaggcccagggagc

SEQ ID NO: 3865157 - DNA, 13 bp, Homo sapiens
caagagggcactg

SEQ ID NO: 3865158 - DNA, 14 bp, Homo sapiens
caagagggcactgg

SEQ ID NO: 3865159 - DNA, 18 bp, Homo sapiens
caagagggcactggtggc

SEQ ID NO: 3865160 - DNA, 18 bp, Homo sapiens
caagaggtctgagccctg

SEQ ID NO: 3865161 - DNA, 20 bp, Homo sapiens
caagaggtctgagccctggt

SEQ ID NO: 3865162 - DNA, 22 bp, Homo sapiens
caagagtggactgaatgtgcct

SEQ ID NO: 3865163 - DNA, 16 bp, Homo sapiens
caagataactgagaat

SEQ ID NO: 3865164 - DNA, 16 bp, Homo sapiens
caagatcgcgccactg

SEQ ID NO: 3865165 - DNA, 14 bp, Homo sapiens
caagatctttcagg

SEQ ID NO: 3865166 - DNA, 16 bp, Homo sapiens
caagatgggcacatga

SEQ ID NO: 3865167 - DNA, 17 bp, Homo sapiens
caagattcccagagaca

SEQ ID NO: 3865168 - DNA, 23 bp, Homo sapiens
caagattcccagagacaggaaaa

SEQ ID NO: 3865169 - DNA, 13 bp, Homo sapiens
caagattgcttaa

SEQ ID NO: 3865170 - DNA, 18 bp, Homo sapiens
caagattgcttaaaatag

SEQ ID NO: 3865171 - DNA, 17 bp, Homo sapiens
caagatttcagaagcca

SEQ ID NO: 3865172 - DNA, 22 bp, Homo sapiens
caagcaagaggtggtagaacca

SEQ ID NO: 3865173 - DNA, 12 bp, Homo sapiens
caagcaataatt

SEQ ID NO: 3865174 - DNA, 14 bp, Homo sapiens
caagcacagacatt

SEQ ID NO: 3865175 - DNA, 12 bp, Homo sapiens
caagcacctgca

SEQ ID NO: 3865176 - DNA, 22 bp, Homo sapiens
caagcactcgagaccatcctgg

SEQ ID NO: 3865177 - DNA, 20 bp, Homo sapiens
caagcagaggtggccagagc

SEQ ID NO: 3865178 - DNA, 18 bp, Homo sapiens
caagcagccagccagtct

SEQ ID NO: 3865179 - DNA, 14 bp, Homo sapiens
caagcagcctcctg

SEQ ID NO: 3865180 - DNA, 16 bp, Homo sapiens
caagcataccaacacg

SEQ ID NO: 3865181 - DNA, 21 bp, Homo sapiens
caagcataccaacacgagcag

SEQ ID NO: 3865182 - DNA, 22 bp, Homo sapiens
caagcatatttgagaacccttc

SEQ ID NO: 3865183 - DNA, 21 bp, Homo sapiens
caagccaacttgtaaatacac

SEQ ID NO: 3865184 - DNA, 13 bp, Homo sapiens
caagccacagaag

SEQ ID NO: 3865185 - DNA, 15 bp, Homo sapiens
caagccactatgtcc

SEQ ID NO: 3865186 - DNA, 13 bp, Homo sapiens
caagccatggtga

SEQ ID NO: 3865187 - DNA, 20 bp, Homo sapiens
caagccatggtgacacacag

SEQ ID NO: 3865188 - DNA, 21 bp, Homo sapiens
caagccattttttgaggagag

SEQ ID NO: 3865189 - DNA, 14 bp, Homo sapiens
caagccccagggcc

SEQ ID NO: 3865190 - DNA, 17 bp, Homo sapiens
caagccccagggcctgg

SEQ ID NO: 3865191 - DNA, 18 bp, Homo sapiens
caagccccagggcctggg

SEQ ID NO: 3865192 - DNA, 19 bp, Homo sapiens
caagccccagggcctgggg

SEQ ID NO: 3865193 - DNA, 21 bp, Homo sapiens
caagccccagggcctgggggc

SEQ ID NO: 3865194 - DNA, 17 bp, Homo sapiens
caagcccctcagccctt

SEQ ID NO: 3865195 - DNA, 20 bp, Homo sapiens
caagcccctcagcccttgcc

SEQ ID NO: 3865196 - DNA, 10 bp, Homo sapiens
caagccctgg

SEQ ID NO: 3865197 - DNA, 11 bp, Homo sapiens
caagccctggc

SEQ ID NO: 3865198 - DNA, 15 bp, Homo sapiens
caagccctggcaaca

SEQ ID NO: 3865199 - DNA, 17 bp, Homo sapiens
caagccgtggcttcccg

SEQ ID NO: 3865200 - DNA, 17 bp, Homo sapiens
caagcctctgccccaag

SEQ ID NO: 3865201 - DNA, 22 bp, Homo sapiens
caagcctctgccccaaggggcc

SEQ ID NO: 3865202 - DNA, 21 bp, Homo sapiens
caagcctgtaatcccagctac

SEQ ID NO: 3865203 - DNA, 12 bp, Homo sapiens
caagcctgtggg

SEQ ID NO: 3865204 - DNA, 14 bp, Homo sapiens
caagccttactcac

SEQ ID NO: 3865205 - DNA, 21 bp, Homo sapiens
caagcgattcttgtgcctcag

SEQ ID NO: 3865206 - DNA, 20 bp, Homo sapiens
caagcgcagggaggatgcca

SEQ ID NO: 3865207 - DNA, 19 bp, Homo sapiens
caagctcacagttcctcgc

SEQ ID NO: 3865208 - DNA, 22 bp, Homo sapiens
caagctcacagttcctcgccct

SEQ ID NO: 3865209 - DNA, 19 bp, Homo sapiens
caagctgaagtgaaggaga

SEQ ID NO: 3865210 - DNA, 20 bp, Homo sapiens
caagctgaggtgcccaggag

SEQ ID NO: 3865211 - DNA, 12 bp, Homo sapiens
caagctggaagc

SEQ ID NO: 3865212 - DNA, 18 bp, Homo sapiens
caagctggaagcacatgt

SEQ ID NO: 3865213 - DNA, 20 bp, Homo sapiens
caagctgtcccctctgtcat

SEQ ID NO: 3865214 - DNA, 20 bp, Homo sapiens
caagcttcagagcctagcca

SEQ ID NO: 3865215 - DNA, 14 bp, Homo sapiens
caagcttgtatata

SEQ ID NO: 3865216 - DNA, 21 bp, Homo sapiens
caagcttgtatatacatatta

SEQ ID NO: 3865217 - DNA, 21 bp, Homo sapiens
caagctttgaatacccccaga

SEQ ID NO: 3865218 - DNA, 15 bp, Homo sapiens
caaggaacaagagaa

SEQ ID NO: 3865219 - DNA, 17 bp, Homo sapiens
caaggaacaagagaaaa

SEQ ID NO: 3865220 - DNA, 23 bp, Homo sapiens
caaggacaacctgcccctcccca

SEQ ID NO: 3865221 - DNA, 19 bp, Homo sapiens
caaggaccctgttttccac

SEQ ID NO: 3865222 - DNA, 21 bp, Homo sapiens
caaggactacgttaagggaag

SEQ ID NO: 3865223 - DNA, 12 bp, Homo sapiens
caaggactcctg

SEQ ID NO: 3865224 - DNA, 14 bp, Homo sapiens
caaggagaaacaga

SEQ ID NO: 3865225 - DNA, 18 bp, Homo sapiens
caaggagaaacagagaca

SEQ ID NO: 3865226 - DNA, 13 bp, Homo sapiens
caaggaggaaaaa

SEQ ID NO: 3865227 - DNA, 20 bp, Homo sapiens
caaggaggaaaaacagacaa

SEQ ID NO: 3865228 - DNA, 17 bp, Homo sapiens
caaggaggtctgtgcca

SEQ ID NO: 3865229 - DNA, 14 bp, Homo sapiens
caaggcagcaaggc

SEQ ID NO: 3865230 - DNA, 16 bp, Homo sapiens
caaggcagcaaggccc

SEQ ID NO: 3865231 - DNA, 17 bp, Homo sapiens
caaggcagcaaggcccg

SEQ ID NO: 3865232 - DNA, 13 bp, Homo sapiens
caaggcagcctcc

SEQ ID NO: 3865233 - DNA, 17 bp, Homo sapiens
caaggcagcctccagag

SEQ ID NO: 3865234 - DNA, 18 bp, Homo sapiens
caaggcagcctccagagc

SEQ ID NO: 3865235 - DNA, 20 bp, Homo sapiens
caaggcagcctccagagcca

SEQ ID NO: 3865236 - DNA, 22 bp, Homo sapiens
caaggcagcctccagagccagc

SEQ ID NO: 3865237 - DNA, 12 bp, Homo sapiens
caaggcccagct

SEQ ID NO: 3865238 - DNA, 21 bp, Homo sapiens
atttccccaggggaaaatgaa

SEQ ID NO: 3865239 - DNA, 18 bp, Homo sapiens
atttcccctctgtgtcct

SEQ ID NO: 3865240 - DNA, 22 bp, Homo sapiens
atttcccctctgtgtcctctcc

SEQ ID NO: 3865241 - DNA, 23 bp, Homo sapiens
atttcccctctgtgtcctctccc

SEQ ID NO: 3865242 - DNA, 21 bp, Homo sapiens
atttccctcatcttgccccct

SEQ ID NO: 3865243 - DNA, 18 bp, Homo sapiens
atttccctgactcctcta

SEQ ID NO: 3865244 - DNA, 14 bp, Homo sapiens
atttccgggtggaa

SEQ ID NO: 3865245 - DNA, 13 bp, Homo sapiens
atttcctatctgt

SEQ ID NO: 3865246 - DNA, 14 bp, Homo sapiens
atttcctatctgta

SEQ ID NO: 3865247 - DNA, 16 bp, Homo sapiens
atttcctccatggtgg

SEQ ID NO: 3865248 - DNA, 23 bp, Homo sapiens
atttcctgctacacaaaagccaa

SEQ ID NO: 3865249 - DNA, 12 bp, Homo sapiens
atttctaaaaga

SEQ ID NO: 3865250 - DNA, 12 bp, Homo sapiens
atttctaacata

SEQ ID NO: 3865251 - DNA, 18 bp, Homo sapiens
atttctaacatatgtatt

SEQ ID NO: 3865252 - DNA, 19 bp, Homo sapiens
atttctaacatatgtatta

SEQ ID NO: 3865253 - DNA, 19 bp, Homo sapiens
atttctacacagtgggaac

SEQ ID NO: 3865254 - DNA, 15 bp, Homo sapiens
atttctactgtgact

SEQ ID NO: 3865255 - DNA, 16 bp, Homo sapiens
atttctactgtgactg

SEQ ID NO: 3865256 - DNA, 13 bp, Homo sapiens
atttcttatactt

SEQ ID NO: 3865257 - DNA, 13 bp, Homo sapiens
atttcttcactgt

SEQ ID NO: 3865258 - DNA, 17 bp, Homo sapiens
atttcttcgctgctcta

SEQ ID NO: 3865259 - DNA, 21 bp, Homo sapiens
atttcttcgctgctctagctg

SEQ ID NO: 3865260 - DNA, 22 bp, Homo sapiens
atttcttcgctgctctagctgg

SEQ ID NO: 3865261 - DNA, 17 bp, Homo sapiens
atttctttgtgataaca

SEQ ID NO: 3865262 - DNA, 20 bp, Homo sapiens
atttctttttttaaattgta

SEQ ID NO: 3865263 - DNA, 21 bp, Homo sapiens
atttgaaattttatttagttc

SEQ ID NO: 3865264 - DNA, 16 bp, Homo sapiens
atttgaagctgtaccc

SEQ ID NO: 3865265 - DNA, 15 bp, Homo sapiens
atttgagaattattc

SEQ ID NO: 3865266 - DNA, 14 bp, Homo sapiens
atttgagcaattca

SEQ ID NO: 3865267 - DNA, 21 bp, Homo sapiens
atttgagcaattcatttcact

SEQ ID NO: 3865268 - DNA, 22 bp, Homo sapiens
atttgaggacaaccattccaga

SEQ ID NO: 3865269 - DNA, 12 bp, Homo sapiens
atttgatcacag

SEQ ID NO: 3865270 - DNA, 13 bp, Homo sapiens
atttgatgtacat

SEQ ID NO: 3865271 - DNA, 20 bp, Homo sapiens
atttgattgtaaaaacaaaa

SEQ ID NO: 3865272 - DNA, 17 bp, Homo sapiens
atttgcacaggttttca

SEQ ID NO: 3865273 - DNA, 11 bp, Homo sapiens
atttgccagca

SEQ ID NO: 3865274 - DNA, 14 bp, Homo sapiens
atttgccagcacag

SEQ ID NO: 3865275 - DNA, 16 bp, Homo sapiens
atttgccttctccctg

SEQ ID NO: 3865276 - DNA, 15 bp, Homo sapiens
atttgccttgctgga

SEQ ID NO: 3865277 - DNA, 18 bp, Homo sapiens
atttgctttttcaccaga

SEQ ID NO: 3865278 - DNA, 20 bp, Homo sapiens
atttggaagagaggcacctg

SEQ ID NO: 3865279 - DNA, 21 bp, Homo sapiens
atttggaagagaggcacctgc

SEQ ID NO: 3865280 - DNA, 14 bp, Homo sapiens
atttggacaaaatg

SEQ ID NO: 3865281 - DNA, 16 bp, Homo sapiens
atttggacaaaatgga

SEQ ID NO: 3865282 - DNA, 22 bp, Homo sapiens
atttggatacactctctagctt

SEQ ID NO: 3865283 - DNA, 18 bp, Homo sapiens
atttggtgtggctgtatt

SEQ ID NO: 3865284 - DNA, 20 bp, Homo sapiens
atttggtgtggctgtattca

SEQ ID NO: 3865285 - DNA, 22 bp, Homo sapiens
atttggtgtggctgtattcaga

SEQ ID NO: 3865286 - DNA, 18 bp, Homo sapiens
atttgtacatatgtaaaa

SEQ ID NO: 3865287 - DNA, 21 bp, Homo sapiens
atttgtataatgggaagcctg

SEQ ID NO: 3865288 - DNA, 22 bp, Homo sapiens
atttgtccaatggctgtaaact

SEQ ID NO: 3865289 - DNA, 24 bp, Homo sapiens
atttgtggcccaagcctggtctcc

SEQ ID NO: 3865290 - DNA, 19 bp, Homo sapiens
atttgtgtatgtgtatttg

SEQ ID NO: 3865291 - DNA, 17 bp, Homo sapiens
atttgttatttgtacag

SEQ ID NO: 3865292 - DNA, 16 bp, Homo sapiens
atttgttgaaattatg

SEQ ID NO: 3865293 - DNA, 18 bp, Homo sapiens
atttgttgaaattatgta

SEQ ID NO: 3865294 - DNA, 15 bp, Homo sapiens
atttgttggaatgaa

SEQ ID NO: 3865295 - DNA, 18 bp, Homo sapiens
atttgttttgacggatga

SEQ ID NO: 3865296 - DNA, 12 bp, Homo sapiens
attttaaaatct

SEQ ID NO: 3865297 - DNA, 14 bp, Homo sapiens
attttaaaatctga

SEQ ID NO: 3865298 - DNA, 19 bp, Homo sapiens
attttaaaatctgatttaa

SEQ ID NO: 3865299 - DNA, 23 bp, Homo sapiens
attttaaaatctgatttaatgtt

SEQ ID NO: 3865300 - DNA, 13 bp, Homo sapiens
attttaaacaaag

SEQ ID NO: 3865301 - DNA, 15 bp, Homo sapiens
attttaaatgttcac

SEQ ID NO: 3865302 - DNA, 14 bp, Homo sapiens
attttaaatgtttt

SEQ ID NO: 3865303 - DNA, 16 bp, Homo sapiens
attttaacaaaagcaa

SEQ ID NO: 3865304 - DNA, 18 bp, Homo sapiens
attttaacaaaagcaaga

SEQ ID NO: 3865305 - DNA, 17 bp, Homo sapiens
attttaacttaaatttt

SEQ ID NO: 3865306 - DNA, 17 bp, Homo sapiens
attttaagaagacatga

SEQ ID NO: 3865307 - DNA, 19 bp, Homo sapiens
attttaagaagacatgaca

SEQ ID NO: 3865308 - DNA, 17 bp, Homo sapiens
attttaatattttgtat

SEQ ID NO: 3865309 - DNA, 18 bp, Homo sapiens
attttaattatcttttct

SEQ ID NO: 3865310 - DNA, 18 bp, Homo sapiens
attttagccttaaatttt

SEQ ID NO: 3865311 - DNA, 15 bp, Homo sapiens
attttagctgcagaa

SEQ ID NO: 3865312 - DNA, 21 bp, Homo sapiens
attttaggcagggatttgagg

SEQ ID NO: 3865313 - DNA, 15 bp, Homo sapiens
attttagtgactgta

SEQ ID NO: 3865314 - DNA, 16 bp, Homo sapiens
attttatgaatgtctt

SEQ ID NO: 3865315 - DNA, 18 bp, Homo sapiens
attttattaaagcaacat

SEQ ID NO: 3865316 - DNA, 22 bp, Homo sapiens
attttcaaagctttttccagag

SEQ ID NO: 3865317 - DNA, 18 bp, Homo sapiens
attttcaacgcagccctg

SEQ ID NO: 3865318 - DNA, 20 bp, Homo sapiens
attttcaacgcagccctgct

SEQ ID NO: 3865319 - DNA, 13 bp, Homo sapiens
attttcaagaaac

SEQ ID NO: 3865320 - DNA, 16 bp, Homo sapiens
attttcaagaaactga

SEQ ID NO: 3865321 - DNA, 22 bp, Homo sapiens
attttcaagagaagaaaaaatt

SEQ ID NO: 3865322 - DNA, 20 bp, Homo sapiens
attttcacatgacgtaaaat

SEQ ID NO: 3865323 - DNA, 13 bp, Homo sapiens
attttcactgtag

SEQ ID NO: 3865324 - DNA, 14 bp, Homo sapiens
attgaatatatcag

SEQ ID NO: 3865325 - DNA, 21 bp, Homo sapiens
attgaatatatcagaatctgt

SEQ ID NO: 3865326 - DNA, 17 bp, Homo sapiens
attgacaataatttcag

SEQ ID NO: 3865327 - DNA, 22 bp, Homo sapiens
attgacttcttggtttggggag

SEQ ID NO: 3865328 - DNA, 17 bp, Homo sapiens
attgagaattttaaatt

SEQ ID NO: 3865329 - DNA, 17 bp, Homo sapiens
attgagctgcagaaacg

SEQ ID NO: 3865330 - DNA, 20 bp, Homo sapiens
attgatacttcaggtgcttt

SEQ ID NO: 3865331 - DNA, 19 bp, Homo sapiens
attgatcggagcctcctct

SEQ ID NO: 3865332 - DNA, 23 bp, Homo sapiens
attgatcggagcctcctctctca

SEQ ID NO: 3865333 - DNA, 20 bp, Homo sapiens
attgatgtttccagaaaata

SEQ ID NO: 3865334 - DNA, 21 bp, Homo sapiens
attgatttttgtaataaaagg

SEQ ID NO: 3865335 - DNA, 10 bp, Homo sapiens
attgcacaat

SEQ ID NO: 3865336 - DNA, 12 bp, Homo sapiens
attgcacaattt

SEQ ID NO: 3865337 - DNA, 21 bp, Homo sapiens
attgcagttcaaatcctcacc

SEQ ID NO: 3865338 - DNA, 15 bp, Homo sapiens
attgcatgtaaaatg

SEQ ID NO: 3865339 - DNA, 16 bp, Homo sapiens
attgcatttcctgaca

SEQ ID NO: 3865340 - DNA, 21 bp, Homo sapiens
attgccacaatgcctctccca

SEQ ID NO: 3865341 - DNA, 15 bp, Homo sapiens
attgccccagagccc

SEQ ID NO: 3865342 - DNA, 22 bp, Homo sapiens
attgcctccacctctccttgga

SEQ ID NO: 3865343 - DNA, 11 bp, Homo sapiens
attgcctctga

SEQ ID NO: 3865344 - DNA, 21 bp, Homo sapiens
attgctattttatttgtattc

SEQ ID NO: 3865345 - DNA, 12 bp, Homo sapiens
attgctccttga

SEQ ID NO: 3865346 - DNA, 23 bp, Homo sapiens
attgctggagacagtagaggcat

SEQ ID NO: 3865347 - DNA, 14 bp, Homo sapiens
attgctgttgttgc

SEQ ID NO: 3865348 - DNA, 17 bp, Homo sapiens
attgctgttgttgcagg

SEQ ID NO: 3865349 - DNA, 19 bp, Homo sapiens
attgctgttgttgcaggga

SEQ ID NO: 3865350 - DNA, 20 bp, Homo sapiens
attgcttaaaagacattttt

SEQ ID NO: 3865351 - DNA, 13 bp, Homo sapiens
attgcttacattt

SEQ ID NO: 3865352 - DNA, 14 bp, Homo sapiens
attgcttacatttt

SEQ ID NO: 3865353 - DNA, 19 bp, Homo sapiens
attgcttacatttttacaa

SEQ ID NO: 3865354 - DNA, 20 bp, Homo sapiens
attgcttacatttttacaat

SEQ ID NO: 3865355 - DNA, 22 bp, Homo sapiens
attgcttacatttttacaataa

SEQ ID NO: 3865356 - DNA, 23 bp, Homo sapiens
attgcttcttgtgaaaccacagg

SEQ ID NO: 3865357 - DNA, 19 bp, Homo sapiens
attggaagaaattcctgta

SEQ ID NO: 3865358 - DNA, 19 bp, Homo sapiens
attggacttccttggtttg

SEQ ID NO: 3865359 - DNA, 22 bp, Homo sapiens
attggatacaaggatcagaatg

SEQ ID NO: 3865360 - DNA, 18 bp, Homo sapiens
attggattattcatttaa

SEQ ID NO: 3865361 - DNA, 23 bp, Homo sapiens
attggcgttgtttgtggctgttg

SEQ ID NO: 3865362 - DNA, 20 bp, Homo sapiens
attggctcccaactcctccc

SEQ ID NO: 3865363 - DNA, 22 bp, Homo sapiens
attggctcctccatctagagat

SEQ ID NO: 3865364 - DNA, 19 bp, Homo sapiens
attggtaggatttatatct

SEQ ID NO: 3865365 - DNA, 14 bp, Homo sapiens
attggtccagcttg

SEQ ID NO: 3865366 - DNA, 17 bp, Homo sapiens
attggtccagcttgctc

SEQ ID NO: 3865367 - DNA, 13 bp, Homo sapiens
attggtgataagt

SEQ ID NO: 3865368 - DNA, 19 bp, Homo sapiens
attggtgataagtggaaaa

SEQ ID NO: 3865369 - DNA, 17 bp, Homo sapiens
attgtaaaattgtatag

SEQ ID NO: 3865370 - DNA, 14 bp, Homo sapiens
attgtaaatgtgct

SEQ ID NO: 3865371 - DNA, 15 bp, Homo sapiens
attgtaaatgtgctt

SEQ ID NO: 3865372 - DNA, 17 bp, Homo sapiens
attgtaaatgtgctttt

SEQ ID NO: 3865373 - DNA, 19 bp, Homo sapiens
attgtaaattttagagcat

SEQ ID NO: 3865374 - DNA, 14 bp, Homo sapiens
attgtacagctgtt

SEQ ID NO: 3865375 - DNA, 17 bp, Homo sapiens
attgtacagctgtttaa

SEQ ID NO: 3865376 - DNA, 20 bp, Homo sapiens
attgtacagctgtttaagat

SEQ ID NO: 3865377 - DNA, 19 bp, Homo sapiens
attgtagggttattagtcc

SEQ ID NO: 3865378 - DNA, 22 bp, Homo sapiens
attgtataaactatcagtttgt

SEQ ID NO: 3865379 - DNA, 15 bp, Homo sapiens
attgtatacattttg

SEQ ID NO: 3865380 - DNA, 15 bp, Homo sapiens
attgtatagagatat

SEQ ID NO: 3865381 - DNA, 21 bp, Homo sapiens
attgtatagagatatgcagaa

SEQ ID NO: 3865382 - DNA, 11 bp, Homo sapiens
attgtatatat

SEQ ID NO: 3865383 - DNA, 15 bp, Homo sapiens
attgtatatatgtgt

SEQ ID NO: 3865384 - DNA, 14 bp, Homo sapiens
attgtatattctgg

SEQ ID NO: 3865385 - DNA, 15 bp, Homo sapiens
attgtatattctgga

SEQ ID NO: 3865386 - DNA, 14 bp, Homo sapiens
attgtatgtaagta

SEQ ID NO: 3865387 - DNA, 16 bp, Homo sapiens
attgtcattactgcct

SEQ ID NO: 3865388 - DNA, 18 bp, Homo sapiens
attgtcattactgccttt

SEQ ID NO: 3865389 - DNA, 22 bp, Homo sapiens
attgtccatatcagacctctga

SEQ ID NO: 3865390 - DNA, 23 bp, Homo sapiens
attgtccatatcagacctctgat

SEQ ID NO: 3865391 - DNA, 17 bp, Homo sapiens
attgtccatgtgcttcc

SEQ ID NO: 3865392 - DNA, 21 bp, Homo sapiens
attgtcctcccctattttaag

SEQ ID NO: 3865393 - DNA, 16 bp, Homo sapiens
attgtcttccaacccc

SEQ ID NO: 3865394 - DNA, 23 bp, Homo sapiens
attgtgtaacaattttaatgcta

SEQ ID NO: 3865395 - DNA, 12 bp, Homo sapiens
attgtgtgttag

SEQ ID NO: 3865396 - DNA, 22 bp, Homo sapiens
attgtttaaaaacaggaaaaaa

SEQ ID NO: 3865397 - DNA, 19 bp, Homo sapiens
attgtttctttaagaaagt

SEQ ID NO: 3865398 - DNA, 24 bp, Homo sapiens
attgtttgttgattttctagactt

SEQ ID NO: 3865399 - DNA, 19 bp, Homo sapiens
attgttttagagactatgg

SEQ ID NO: 3865400 - DNA, 13 bp, Homo sapiens
attgttttatcat

SEQ ID NO: 3865401 - DNA, 14 bp, Homo sapiens
atttaaaaaaatca

SEQ ID NO: 3865402 - DNA, 21 bp, Homo sapiens
atttaaaatcattcaatatct

SEQ ID NO: 3865403 - DNA, 21 bp, Homo sapiens
atttaaaatgtgtttcttaca

SEQ ID NO: 3865404 - DNA, 14 bp, Homo sapiens
atttaaacagcagt

SEQ ID NO: 3865405 - DNA, 12 bp, Homo sapiens
atttaaaccagc

SEQ ID NO: 3865406 - DNA, 14 bp, Homo sapiens
atttaaaccagcag

SEQ ID NO: 3865407 - DNA, 17 bp, Homo sapiens
atttaaaccagcagaaa

SEQ ID NO: 3865408 - DNA, 21 bp, Homo sapiens
atttaaaccagcagaaaagtg

SEQ ID NO: 3865409 - DNA, 12 bp, Homo sapiens
atttaactaatt

SEQ ID NO: 3865410 - DNA, 20 bp, Homo sapiens
atttaactaatttaaaccag

SEQ ID NO: 3865411 - DNA, 13 bp, Homo sapiens
atttaactggctt

SEQ ID NO: 3865412 - DNA, 18 bp, Homo sapiens
atttaacttgagggtaat

SEQ ID NO: 3865413 - DNA, 20 bp, Homo sapiens
atttaacttgagggtaataa

SEQ ID NO: 3865414 - DNA, 21 bp, Homo sapiens
atttaacttgagggtaataaa

SEQ ID NO: 3865415 - DNA, 23 bp, Homo sapiens
atttaacttgagggtaataaact

SEQ ID NO: 3865416 - DNA, 17 bp, Homo sapiens
atttaacttttagtaaa

SEQ ID NO: 3865417 - DNA, 21 bp, Homo sapiens
atttaacttttagtaaagtca

SEQ ID NO: 3865418 - DNA, 23 bp, Homo sapiens
atttaacttttagtaaagtcaag

SEQ ID NO: 3865419 - DNA, 21 bp, Homo sapiens
atttaagaaggagttctgaca

SEQ ID NO: 3865420 - DNA, 21 bp, Homo sapiens
atttaagcctcatatttaaag

SEQ ID NO: 3865421 - DNA, 21 bp, Homo sapiens
atttaagtttgttgctgtcaa

SEQ ID NO: 3865422 - DNA, 13 bp, Homo sapiens
atttaatacagca

SEQ ID NO: 3865423 - DNA, 15 bp, Homo sapiens
atttaatacagcagt

SEQ ID NO: 3865424 - DNA, 15 bp, Homo sapiens
atttaatacctttgg

SEQ ID NO: 3865425 - DNA, 20 bp, Homo sapiens
atttaatggtttttatttct

SEQ ID NO: 3865426 - DNA, 16 bp, Homo sapiens
atttaatgtttgattt

SEQ ID NO: 3865427 - DNA, 15 bp, Homo sapiens
atttaatgttttctg

SEQ ID NO: 3865428 - DNA, 21 bp, Homo sapiens
atttaatgttttctgctgttt

SEQ ID NO: 3865429 - DNA, 17 bp, Homo sapiens
atttaattcataattag

SEQ ID NO: 3865430 - DNA, 20 bp, Homo sapiens
atttaattcataattagaac

SEQ ID NO: 3865431 - DNA, 23 bp, Homo sapiens
atttaattcataattagaacaat

SEQ ID NO: 3865432 - DNA, 14 bp, Homo sapiens
atttacaataaata

SEQ ID NO: 3865433 - DNA, 18 bp, Homo sapiens
atttacaataaatattct

SEQ ID NO: 3865434 - DNA, 21 bp, Homo sapiens
atttacaataaatattctgca

SEQ ID NO: 3865435 - DNA, 18 bp, Homo sapiens
atttacatgaattgcatt

SEQ ID NO: 3865436 - DNA, 20 bp, Homo sapiens
atttacatgaattgcatttt

SEQ ID NO: 3865437 - DNA, 21 bp, Homo sapiens
atttacatgaattgcatttta

SEQ ID NO: 3865438 - DNA, 15 bp, Homo sapiens
atttaccacagcagc

SEQ ID NO: 3865439 - DNA, 18 bp, Homo sapiens
atttaccagggatgtaga

SEQ ID NO: 3865440 - DNA, 13 bp, Homo sapiens
atttactaaaaga

SEQ ID NO: 3865441 - DNA, 15 bp, Homo sapiens
atttactaaaagaat

SEQ ID NO: 3865442 - DNA, 22 bp, Homo sapiens
atttactaagccacaagaaatt

SEQ ID NO: 3865443 - DNA, 13 bp, Homo sapiens
atttacttgaaag

SEQ ID NO: 3865444 - DNA, 18 bp, Homo sapiens
atttacttgtagaaatct

SEQ ID NO: 3865445 - DNA, 12 bp, Homo sapiens
atttagaaaaca

SEQ ID NO: 3865446 - DNA, 19 bp, Homo sapiens
atttagaaaacattcatcc

SEQ ID NO: 3865447 - DNA, 23 bp, Homo sapiens
atttagaaaacattcatccagtt

SEQ ID NO: 3865448 - DNA, 15 bp, Homo sapiens
atttagtgaactacg

SEQ ID NO: 3865449 - DNA, 13 bp, Homo sapiens
atttagttatagt

SEQ ID NO: 3865450 - DNA, 14 bp, Homo sapiens
atttagttatagtt

SEQ ID NO: 3865451 - DNA, 16 bp, Homo sapiens
atttagttatagtttc

SEQ ID NO: 3865452 - DNA, 14 bp, Homo sapiens
atttataagcagat

SEQ ID NO: 3865453 - DNA, 16 bp, Homo sapiens
atttatacaaaataat

SEQ ID NO: 3865454 - DNA, 22 bp, Homo sapiens
atttatacaaaataatttaact

SEQ ID NO: 3865455 - DNA, 11 bp, Homo sapiens
atttatactct

SEQ ID NO: 3865456 - DNA, 14 bp, Homo sapiens
atttatagtttgta

SEQ ID NO: 3865457 - DNA, 15 bp, Homo sapiens
atttatatatatatg

SEQ ID NO: 3865458 - DNA, 16 bp, Homo sapiens
atttatatatatatgt

SEQ ID NO: 3865459 - DNA, 17 bp, Homo sapiens
atttatatatatatgta

SEQ ID NO: 3865460 - DNA, 18 bp, Homo sapiens
atttatatatatatgtat

SEQ ID NO: 3865461 - DNA, 19 bp, Homo sapiens
atttatatatatatgtata

SEQ ID NO: 3865462 - DNA, 16 bp, Homo sapiens
atttatatatggcata

SEQ ID NO: 3865463 - DNA, 19 bp, Homo sapiens
atttatatatggcatattt

SEQ ID NO: 3865464 - DNA, 15 bp, Homo sapiens
atttatatattggta

SEQ ID NO: 3865465 - DNA, 12 bp, Homo sapiens
atttatatattt

SEQ ID NO: 3865466 - DNA, 13 bp, Homo sapiens
atttatatctata

SEQ ID NO: 3865467 - DNA, 16 bp, Homo sapiens
atttatatctatagta

SEQ ID NO: 3865468 - DNA, 18 bp, Homo sapiens
atttatatctatagtagt

SEQ ID NO: 3865469 - DNA, 15 bp, Homo sapiens
atttatatttggaaa

SEQ ID NO: 3865470 - DNA, 17 bp, Homo sapiens
atttatatttggaaaga

SEQ ID NO: 3865471 - DNA, 22 bp, Homo sapiens
atttatctttacttttaaacag

SEQ ID NO: 3865472 - DNA, 22 bp, Homo sapiens
atttatgcttaaaatatgtatg

SEQ ID NO: 3865473 - DNA, 12 bp, Homo sapiens
atttatggagga

SEQ ID NO: 3865474 - DNA, 13 bp, Homo sapiens
atttatggcttat

SEQ ID NO: 3865475 - DNA, 22 bp, Homo sapiens
atttatgtctatttaagcctca

SEQ ID NO: 3865476 - DNA, 23 bp, Homo sapiens
atttattagttaggtgtgccaaa

SEQ ID NO: 3865477 - DNA, 14 bp, Homo sapiens
atttattcactgta

SEQ ID NO: 3865478 - DNA, 20 bp, Homo sapiens
atttattcactgtaagttta

SEQ ID NO: 3865479 - DNA, 14 bp, Homo sapiens
atttattcattcag

SEQ ID NO: 3865480 - DNA, 13 bp, Homo sapiens
atttattggggat

SEQ ID NO: 3865481 - DNA, 19 bp, Homo sapiens
atttattgtcattactgcc

SEQ ID NO: 3865482 - DNA, 22 bp, Homo sapiens
atttattttaaaaaatgaaaat

SEQ ID NO: 3865483 - DNA, 21 bp, Homo sapiens
atttcaacaagaatattgtat

SEQ ID NO: 3865484 - DNA, 20 bp, Homo sapiens
atttcaagaaaaaataaatg

SEQ ID NO: 3865485 - DNA, 15 bp, Homo sapiens
atttcacaacagatc

SEQ ID NO: 3865486 - DNA, 16 bp, Homo sapiens
atttcactttaaagtc

SEQ ID NO: 3865487 - DNA, 12 bp, Homo sapiens
atttcatttctt

SEQ ID NO: 3865488 - DNA, 16 bp, Homo sapiens
atttccaaagagaaaa

SEQ ID NO: 3865489 - DNA, 13 bp, Homo sapiens
atttccaaatgaa

SEQ ID NO: 3865490 - DNA, 19 bp, Homo sapiens
atttccaagtaatataatg

SEQ ID NO: 3865491 - DNA, 11 bp, Homo sapiens
atttccaggcc

SEQ ID NO: 3865492 - DNA, 15 bp, Homo sapiens
atttccaggcccctg

SEQ ID NO: 3865493 - DNA, 23 bp, Homo sapiens
atttccaggcccctgaggactgg

SEQ ID NO: 3865494 - DNA, 19 bp, Homo sapiens
atttccaggggcacacaat

SEQ ID NO: 3865495 - DNA, 20 bp, Homo sapiens
atttccccaggggaaaatga

SEQ ID NO: 3865496 - DNA, 20 bp, Homo sapiens
attcatttcacattaatggt

SEQ ID NO: 3865497 - DNA, 15 bp, Homo sapiens
attcatttcacttta

SEQ ID NO: 3865498 - DNA, 14 bp, Homo sapiens
attcatttcatcta

SEQ ID NO: 3865499 - DNA, 19 bp, Homo sapiens
attcatttgagttatttta

SEQ ID NO: 3865500 - DNA, 16 bp, Homo sapiens
attcattttcattgtt

SEQ ID NO: 3865501 - DNA, 15 bp, Homo sapiens
attccaacagtgagt

SEQ ID NO: 3865502 - DNA, 19 bp, Homo sapiens
attccaagtcaacactctt

SEQ ID NO: 3865503 - DNA, 21 bp, Homo sapiens
attccaagtcaacactcttct

SEQ ID NO: 3865504 - DNA, 22 bp, Homo sapiens
attccacagtgcccagctaatt

SEQ ID NO: 3865505 - DNA, 18 bp, Homo sapiens
attccaccattcacattt

SEQ ID NO: 3865506 - DNA, 23 bp, Homo sapiens
attccagactgcttccaattttc

SEQ ID NO: 3865507 - DNA, 19 bp, Homo sapiens
attccagagagtggctcct

SEQ ID NO: 3865508 - DNA, 13 bp, Homo sapiens
attccatgatttt

SEQ ID NO: 3865509 - DNA, 17 bp, Homo sapiens
attccatgggatgttaa

SEQ ID NO: 3865510 - DNA, 14 bp, Homo sapiens
attccatgtccctg

SEQ ID NO: 3865511 - DNA, 16 bp, Homo sapiens
attcccaactgctctg

SEQ ID NO: 3865512 - DNA, 19 bp, Homo sapiens
attcccaactgctctgccc

SEQ ID NO: 3865513 - DNA, 13 bp, Homo sapiens
attcccaatcttg

SEQ ID NO: 3865514 - DNA, 14 bp, Homo sapiens
attcccaccaaggt

SEQ ID NO: 3865515 - DNA, 23 bp, Homo sapiens
attcccactaagctttctccttt

SEQ ID NO: 3865516 - DNA, 16 bp, Homo sapiens
attcccagagacagga

SEQ ID NO: 3865517 - DNA, 16 bp, Homo sapiens
attcccagctgtctgt

SEQ ID NO: 3865518 - DNA, 17 bp, Homo sapiens
attcccagctgtctgtg

SEQ ID NO: 3865519 - DNA, 15 bp, Homo sapiens
attcccatctgtcac

SEQ ID NO: 3865520 - DNA, 17 bp, Homo sapiens
attcccattggttctcc

SEQ ID NO: 3865521 - DNA, 22 bp, Homo sapiens
attccccaggtggctgacccag

SEQ ID NO: 3865522 - DNA, 21 bp, Homo sapiens
attcccccatgtggctgaaga

SEQ ID NO: 3865523 - DNA, 17 bp, Homo sapiens
attccctagatctttct

SEQ ID NO: 3865524 - DNA, 14 bp, Homo sapiens
attccctatcaaaa

SEQ ID NO: 3865525 - DNA, 20 bp, Homo sapiens
attccctatcaaaacatatc

SEQ ID NO: 3865526 - DNA, 14 bp, Homo sapiens
attccctctcccag

SEQ ID NO: 3865527 - DNA, 15 bp, Homo sapiens
attccctctcccagg

SEQ ID NO: 3865528 - DNA, 16 bp, Homo sapiens
attccctctcccaggc

SEQ ID NO: 3865529 - DNA, 18 bp, Homo sapiens
attccctctcccaggccc

SEQ ID NO: 3865530 - DNA, 15 bp, Homo sapiens
attccgaagagggaa

SEQ ID NO: 3865531 - DNA, 19 bp, Homo sapiens
attcctaagcagtgcttgt

SEQ ID NO: 3865532 - DNA, 16 bp, Homo sapiens
attcctagagagcaga

SEQ ID NO: 3865533 - DNA, 17 bp, Homo sapiens
attcctatctgtggatg

SEQ ID NO: 3865534 - DNA, 13 bp, Homo sapiens
attcctctctcag

SEQ ID NO: 3865535 - DNA, 19 bp, Homo sapiens
attcctcttgcctctctca

SEQ ID NO: 3865536 - DNA, 12 bp, Homo sapiens
attcctgaccct

SEQ ID NO: 3865537 - DNA, 16 bp, Homo sapiens
attcctggcatgacac

SEQ ID NO: 3865538 - DNA, 17 bp, Homo sapiens
attcctggccccgggct

SEQ ID NO: 3865539 - DNA, 21 bp, Homo sapiens
attcctgggcaagaacctaaa

SEQ ID NO: 3865540 - DNA, 17 bp, Homo sapiens
attcctgggcctgtccc

SEQ ID NO: 3865541 - DNA, 22 bp, Homo sapiens
attcctgggctcaagcagtcct

SEQ ID NO: 3865542 - DNA, 17 bp, Homo sapiens
attcctgtagcatcttc

SEQ ID NO: 3865543 - DNA, 14 bp, Homo sapiens
attccttcactcat

SEQ ID NO: 3865544 - DNA, 17 bp, Homo sapiens
attccttcactcatcca

SEQ ID NO: 3865545 - DNA, 12 bp, Homo sapiens
attccttctgga

SEQ ID NO: 3865546 - DNA, 19 bp, Homo sapiens
attccttttgatggggaga

SEQ ID NO: 3865547 - DNA, 18 bp, Homo sapiens
attccttttgtgtacagt

SEQ ID NO: 3865548 - DNA, 22 bp, Homo sapiens
attcgcctgtgggaagagaagg

SEQ ID NO: 3865549 - DNA, 22 bp, Homo sapiens
attctacagcatacagagcagg

SEQ ID NO: 3865550 - DNA, 20 bp, Homo sapiens
attctagccaaactattcta

SEQ ID NO: 3865551 - DNA, 16 bp, Homo sapiens
attctaggcatcccag

SEQ ID NO: 3865552 - DNA, 21 bp, Homo sapiens
attctcatatgtagccctcat

SEQ ID NO: 3865553 - DNA, 20 bp, Homo sapiens
attctccctaaggaatctga

SEQ ID NO: 3865554 - DNA, 17 bp, Homo sapiens
attctctctaaaaataa

SEQ ID NO: 3865555 - DNA, 22 bp, Homo sapiens
attctctctaaaaataaaatga

SEQ ID NO: 3865556 - DNA, 22 bp, Homo sapiens
attctctttctttttctgtctc

SEQ ID NO: 3865557 - DNA, 20 bp, Homo sapiens
attctgaccacccttctcat

SEQ ID NO: 3865558 - DNA, 17 bp, Homo sapiens
attctgacttctcccat

SEQ ID NO: 3865559 - DNA, 16 bp, Homo sapiens
attctgcaactagcca

SEQ ID NO: 3865560 - DNA, 22 bp, Homo sapiens
attctggaaaaaaaatatatat

SEQ ID NO: 3865561 - DNA, 20 bp, Homo sapiens
attctggaactgtggctttg

SEQ ID NO: 3865562 - DNA, 14 bp, Homo sapiens
attctggctgaaaa

SEQ ID NO: 3865563 - DNA, 19 bp, Homo sapiens
attctgggctcctggaacc

SEQ ID NO: 3865564 - DNA, 16 bp, Homo sapiens
attctggtcttcactg

SEQ ID NO: 3865565 - DNA, 16 bp, Homo sapiens
attctgtgaagaatga

SEQ ID NO: 3865566 - DNA, 23 bp, Homo sapiens
attctgttgcccaggctggcctg

SEQ ID NO: 3865567 - DNA, 17 bp, Homo sapiens
attcttaccgagaaaag

SEQ ID NO: 3865568 - DNA, 19 bp, Homo sapiens
attcttaccgagaaaagga

SEQ ID NO: 3865569 - DNA, 16 bp, Homo sapiens
attcttattttttaaa

SEQ ID NO: 3865570 - DNA, 12 bp, Homo sapiens
attcttccactg

SEQ ID NO: 3865571 - DNA, 14 bp, Homo sapiens
attcttctgcctca

SEQ ID NO: 3865572 - DNA, 15 bp, Homo sapiens
attcttgtgcctcag

SEQ ID NO: 3865573 - DNA, 16 bp, Homo sapiens
attcttgtgcctcagc

SEQ ID NO: 3865574 - DNA, 17 bp, Homo sapiens
attctttaaatttcatc

SEQ ID NO: 3865575 - DNA, 20 bp, Homo sapiens
attctttcccctcagagctc

SEQ ID NO: 3865576 - DNA, 21 bp, Homo sapiens
attctttcccctcagagctct

SEQ ID NO: 3865577 - DNA, 14 bp, Homo sapiens
attctttttaaagt

SEQ ID NO: 3865578 - DNA, 16 bp, Homo sapiens
attgaaattactgaaa

SEQ ID NO: 3865579 - DNA, 15 bp, Homo sapiens
attgaacccaggagg

SEQ ID NO: 3865580 - DNA, 14 bp, Homo sapiens
attgaactgagcca

SEQ ID NO: 3865581 - DNA, 13 bp, Homo sapiens
attgaatatatca

SEQ ID NO: 3865582 - DNA, 15 bp, Homo sapiens
atgtgttttctgaat

SEQ ID NO: 3865583 - DNA, 15 bp, Homo sapiens
atgtgttttgcacgt

SEQ ID NO: 3865584 - DNA, 22 bp, Homo sapiens
atgttaagcaaaggaaaccaaa

SEQ ID NO: 3865585 - DNA, 13 bp, Homo sapiens
atgttaatttgtt

SEQ ID NO: 3865586 - DNA, 14 bp, Homo sapiens
atgttaatttgtta

SEQ ID NO: 3865587 - DNA, 16 bp, Homo sapiens
atgttaggagaactac

SEQ ID NO: 3865588 - DNA, 14 bp, Homo sapiens
atgttatgtgacta

SEQ ID NO: 3865589 - DNA, 20 bp, Homo sapiens
atgttatttgttattttcag

SEQ ID NO: 3865590 - DNA, 22 bp, Homo sapiens
atgttatttgttattttcagta

SEQ ID NO: 3865591 - DNA, 16 bp, Homo sapiens
atgttcatcaattccc

SEQ ID NO: 3865592 - DNA, 13 bp, Homo sapiens
atgttccctgcac

SEQ ID NO: 3865593 - DNA, 14 bp, Homo sapiens
atgttccctgcacc

SEQ ID NO: 3865594 - DNA, 14 bp, Homo sapiens
atgttctcagaatc

SEQ ID NO: 3865595 - DNA, 23 bp, Homo sapiens
atgttctggctttacattttatt

SEQ ID NO: 3865596 - DNA, 18 bp, Homo sapiens
atgttcttttttgttaca

SEQ ID NO: 3865597 - DNA, 12 bp, Homo sapiens
atgttgaaatct

SEQ ID NO: 3865598 - DNA, 13 bp, Homo sapiens
atgttgataaaga

SEQ ID NO: 3865599 - DNA, 21 bp, Homo sapiens
atgttgggatttatatctata

SEQ ID NO: 3865600 - DNA, 23 bp, Homo sapiens
atgttgggatttatatctatagt

SEQ ID NO: 3865601 - DNA, 15 bp, Homo sapiens
atgttgttaaacacg

SEQ ID NO: 3865602 - DNA, 15 bp, Homo sapiens
atgttgttcaaatgc

SEQ ID NO: 3865603 - DNA, 20 bp, Homo sapiens
atgttgttcaaatgcatttt

SEQ ID NO: 3865604 - DNA, 16 bp, Homo sapiens
atgttgtttgggagag

SEQ ID NO: 3865605 - DNA, 15 bp, Homo sapiens
atgtttaaattgtaa

SEQ ID NO: 3865606 - DNA, 17 bp, Homo sapiens
atgtttaaattgtaaat

SEQ ID NO: 3865607 - DNA, 14 bp, Homo sapiens
atgtttattccttg

SEQ ID NO: 3865608 - DNA, 21 bp, Homo sapiens
atgtttcacataaaacctcat

SEQ ID NO: 3865609 - DNA, 13 bp, Homo sapiens
atgtttccaacct

SEQ ID NO: 3865610 - DNA, 14 bp, Homo sapiens
atgtttccagaaaa

SEQ ID NO: 3865611 - DNA, 15 bp, Homo sapiens
atgtttccagaaaat

SEQ ID NO: 3865612 - DNA, 20 bp, Homo sapiens
atgtttccagaaaatataaa

SEQ ID NO: 3865613 - DNA, 18 bp, Homo sapiens
atgtttgaggttaaaata

SEQ ID NO: 3865614 - DNA, 14 bp, Homo sapiens
atgtttgtaaaact

SEQ ID NO: 3865615 - DNA, 19 bp, Homo sapiens
atgtttgtaaattaatact

SEQ ID NO: 3865616 - DNA, 21 bp, Homo sapiens
atgttttaaacatagaaagtt

SEQ ID NO: 3865617 - DNA, 17 bp, Homo sapiens
atgttttgtacaattac

SEQ ID NO: 3865618 - DNA, 16 bp, Homo sapiens
atgtttttatgatatc

SEQ ID NO: 3865619 - DNA, 15 bp, Homo sapiens
attaaaatatatata

SEQ ID NO: 3865620 - DNA, 18 bp, Homo sapiens
attaaaatatatataaat

SEQ ID NO: 3865621 - DNA, 20 bp, Homo sapiens
attaaaatatatataaatat

SEQ ID NO: 3865622 - DNA, 21 bp, Homo sapiens
attaaaatatatataaatata

SEQ ID NO: 3865623 - DNA, 22 bp, Homo sapiens
attaaaatatatataaatatat

SEQ ID NO: 3865624 - DNA, 19 bp, Homo sapiens
attaaaatgattgtaaaat

SEQ ID NO: 3865625 - DNA, 20 bp, Homo sapiens
attaaaatgattgtaaaata

SEQ ID NO: 3865626 - DNA, 15 bp, Homo sapiens
attaaacacctgaca

SEQ ID NO: 3865627 - DNA, 15 bp, Homo sapiens
attaaacactgtaat

SEQ ID NO: 3865628 - DNA, 14 bp, Homo sapiens
attaaagatgtgtt

SEQ ID NO: 3865629 - DNA, 19 bp, Homo sapiens
attaaagcaacattttatt

SEQ ID NO: 3865630 - DNA, 12 bp, Homo sapiens
attaaagtgtta

SEQ ID NO: 3865631 - DNA, 19 bp, Homo sapiens
attaaatacagacactaag

SEQ ID NO: 3865632 - DNA, 14 bp, Homo sapiens
attaaatgtcttat

SEQ ID NO: 3865633 - DNA, 15 bp, Homo sapiens
attaaatttctggat

SEQ ID NO: 3865634 - DNA, 17 bp, Homo sapiens
attaacttaaaagattc

SEQ ID NO: 3865635 - DNA, 17 bp, Homo sapiens
attaagataaatagagt

SEQ ID NO: 3865636 - DNA, 19 bp, Homo sapiens
attaagatacactcctgct

SEQ ID NO: 3865637 - DNA, 15 bp, Homo sapiens
attaaggtttgccct

SEQ ID NO: 3865638 - DNA, 19 bp, Homo sapiens
attaagttctcaatgtgaa

SEQ ID NO: 3865639 - DNA, 22 bp, Homo sapiens
attaataaaaaatggaaagaat

SEQ ID NO: 3865640 - DNA, 17 bp, Homo sapiens
attaataccaaatattt

SEQ ID NO: 3865641 - DNA, 13 bp, Homo sapiens
attaatactaaaa

SEQ ID NO: 3865642 - DNA, 20 bp, Homo sapiens
attaatactaaaatatgtct

SEQ ID NO: 3865643 - DNA, 16 bp, Homo sapiens
attaatattgtgctta

SEQ ID NO: 3865644 - DNA, 18 bp, Homo sapiens
attaatattgtgcttaaa

SEQ ID NO: 3865645 - DNA, 21 bp, Homo sapiens
attaatcgtgtcttcaattaa

SEQ ID NO: 3865646 - DNA, 15 bp, Homo sapiens
attaatggtctaaaa

SEQ ID NO: 3865647 - DNA, 20 bp, Homo sapiens
attaatgtgtgtctgaagac

SEQ ID NO: 3865648 - DNA, 12 bp, Homo sapiens
attaatgttaat

SEQ ID NO: 3865649 - DNA, 13 bp, Homo sapiens
attaatgttaatt

SEQ ID NO: 3865650 - DNA, 15 bp, Homo sapiens
attaatgttttgtac

SEQ ID NO: 3865651 - DNA, 18 bp, Homo sapiens
attaatgttttgtacaat

SEQ ID NO: 3865652 - DNA, 18 bp, Homo sapiens
attaattcttaataggct

SEQ ID NO: 3865653 - DNA, 12 bp, Homo sapiens
attaatttatgg

SEQ ID NO: 3865654 - DNA, 12 bp, Homo sapiens
attacaatggaa

SEQ ID NO: 3865655 - DNA, 17 bp, Homo sapiens
attacaatggaaacaat

SEQ ID NO: 3865656 - DNA, 21 bp, Homo sapiens
attacaggccttttgactctt

SEQ ID NO: 3865657 - DNA, 20 bp, Homo sapiens
attacatgtttaaattgtaa

SEQ ID NO: 3865658 - DNA, 22 bp, Homo sapiens
attacatgtttaaattgtaaat

SEQ ID NO: 3865659 - DNA, 14 bp, Homo sapiens
attacatttataca

SEQ ID NO: 3865660 - DNA, 15 bp, Homo sapiens
attacatttccaaat

SEQ ID NO: 3865661 - DNA, 17 bp, Homo sapiens
attaccaaaaaagtatt

SEQ ID NO: 3865662 - DNA, 18 bp, Homo sapiens
attaccaaaaatcttggg

SEQ ID NO: 3865663 - DNA, 13 bp, Homo sapiens
attacgtgagcca

SEQ ID NO: 3865664 - DNA, 16 bp, Homo sapiens
attacgtgagccaggt

SEQ ID NO: 3865665 - DNA, 18 bp, Homo sapiens
attactaaagacagaaaa

SEQ ID NO: 3865666 - DNA, 18 bp, Homo sapiens
attactatgactgctccc

SEQ ID NO: 3865667 - DNA, 22 bp, Homo sapiens
attactctgcggtggtgccaga

SEQ ID NO: 3865668 - DNA, 24 bp, Homo sapiens
attactgcctttggaagaaacagg

SEQ ID NO: 3865669 - DNA, 15 bp, Homo sapiens
attacttatttttga

SEQ ID NO: 3865670 - DNA, 18 bp, Homo sapiens
attacttgaactttccaa

SEQ ID NO: 3865671 - DNA, 14 bp, Homo sapiens
attactttaaaata

SEQ ID NO: 3865672 - DNA, 22 bp, Homo sapiens
attactttaatactcacctcct

SEQ ID NO: 3865673 - DNA, 20 bp, Homo sapiens
attagaaattagctgtgtga

SEQ ID NO: 3865674 - DNA, 23 bp, Homo sapiens
attagaaattagctgtgtgaaat

SEQ ID NO: 3865675 - DNA, 13 bp, Homo sapiens
attagaacaatag

SEQ ID NO: 3865676 - DNA, 18 bp, Homo sapiens
attagaacaatagctatt

SEQ ID NO: 3865677 - DNA, 14 bp, Homo sapiens
attagaatgaaaat

SEQ ID NO: 3865678 - DNA, 19 bp, Homo sapiens
attagatcttcaaacagaa

SEQ ID NO: 3865679 - DNA, 20 bp, Homo sapiens
attagctgtaaatacatgtg

SEQ ID NO: 3865680 - DNA, 21 bp, Homo sapiens
attagctgtaaatacatgtgt

SEQ ID NO: 3865681 - DNA, 17 bp, Homo sapiens
attaggaggctcaacaa

SEQ ID NO: 3865682 - DNA, 15 bp, Homo sapiens
attagtaattgtaag

SEQ ID NO: 3865683 - DNA, 13 bp, Homo sapiens
attataaataaat

SEQ ID NO: 3865684 - DNA, 17 bp, Homo sapiens
attataaataaatgcca

SEQ ID NO: 3865685 - DNA, 18 bp, Homo sapiens
attataaatccaaagtaa

SEQ ID NO: 3865686 - DNA, 16 bp, Homo sapiens
attataacttaaaata

SEQ ID NO: 3865687 - DNA, 16 bp, Homo sapiens
attataataatgttct

SEQ ID NO: 3865688 - DNA, 15 bp, Homo sapiens
attataatttaatgc

SEQ ID NO: 3865689 - DNA, 20 bp, Homo sapiens
attatactgtagctgatgaa

SEQ ID NO: 3865690 - DNA, 20 bp, Homo sapiens
attatagtatgatttttaca

SEQ ID NO: 3865691 - DNA, 13 bp, Homo sapiens
attatataggttg

SEQ ID NO: 3865692 - DNA, 14 bp, Homo sapiens
attatatctaattt

SEQ ID NO: 3865693 - DNA, 15 bp, Homo sapiens
attatattataataa

SEQ ID NO: 3865694 - DNA, 14 bp, Homo sapiens
attatcacatcaag

SEQ ID NO: 3865695 - DNA, 17 bp, Homo sapiens
attatcattcaaaacaa

SEQ ID NO: 3865696 - DNA, 20 bp, Homo sapiens
attatgagtctctatgatct

SEQ ID NO: 3865697 - DNA, 14 bp, Homo sapiens
attatgccactgct

SEQ ID NO: 3865698 - DNA, 16 bp, Homo sapiens
attatggaagatttta

SEQ ID NO: 3865699 - DNA, 15 bp, Homo sapiens
attatggtgaaatta

SEQ ID NO: 3865700 - DNA, 17 bp, Homo sapiens
attatggtgtaatgcac

SEQ ID NO: 3865701 - DNA, 20 bp, Homo sapiens
attatggtgtaatgcacaat

SEQ ID NO: 3865702 - DNA, 14 bp, Homo sapiens
attatgtagaaata

SEQ ID NO: 3865703 - DNA, 19 bp, Homo sapiens
attatgtgtgcatgtgtgt

SEQ ID NO: 3865704 - DNA, 19 bp, Homo sapiens
attattaataccaaatatt

SEQ ID NO: 3865705 - DNA, 21 bp, Homo sapiens
attattagtaagaaaacatca

SEQ ID NO: 3865706 - DNA, 17 bp, Homo sapiens
attattcaagtgcctct

SEQ ID NO: 3865707 - DNA, 15 bp, Homo sapiens
attattcatttaaaa

SEQ ID NO: 3865708 - DNA, 16 bp, Homo sapiens
attattcatttaaaat

SEQ ID NO: 3865709 - DNA, 20 bp, Homo sapiens
attattcatttaaaatgatt

SEQ ID NO: 3865710 - DNA, 13 bp, Homo sapiens
attatttaataaa

SEQ ID NO: 3865711 - DNA, 15 bp, Homo sapiens
attattttaaacaaa

SEQ ID NO: 3865712 - DNA, 18 bp, Homo sapiens
attattttaatattttgt

SEQ ID NO: 3865713 - DNA, 15 bp, Homo sapiens
attcaaacagtctca

SEQ ID NO: 3865714 - DNA, 14 bp, Homo sapiens
attcaaaccattta

SEQ ID NO: 3865715 - DNA, 20 bp, Homo sapiens
attcaaatgggtgatatcct

SEQ ID NO: 3865716 - DNA, 15 bp, Homo sapiens
attcaacacattact

SEQ ID NO: 3865717 - DNA, 16 bp, Homo sapiens
attcaagcctgtgaat

SEQ ID NO: 3865718 - DNA, 17 bp, Homo sapiens
attcaaggagatataaa

SEQ ID NO: 3865719 - DNA, 15 bp, Homo sapiens
attcaaggtggccaa

SEQ ID NO: 3865720 - DNA, 12 bp, Homo sapiens
attcaagtatta

SEQ ID NO: 3865721 - DNA, 20 bp, Homo sapiens
attcaagtattaggggtaat

SEQ ID NO: 3865722 - DNA, 21 bp, Homo sapiens
attcaataaaaaaaagaaatg

SEQ ID NO: 3865723 - DNA, 13 bp, Homo sapiens
attcaatatctga

SEQ ID NO: 3865724 - DNA, 13 bp, Homo sapiens
attcacaatagaa

SEQ ID NO: 3865725 - DNA, 19 bp, Homo sapiens
attcacacctcacgctctg

SEQ ID NO: 3865726 - DNA, 21 bp, Homo sapiens
attcacatccaatgcatagtt

SEQ ID NO: 3865727 - DNA, 13 bp, Homo sapiens
attcacatttgat

SEQ ID NO: 3865728 - DNA, 16 bp, Homo sapiens
attcagagaatatcaa

SEQ ID NO: 3865729 - DNA, 18 bp, Homo sapiens
attcagatatatttttca

SEQ ID NO: 3865730 - DNA, 20 bp, Homo sapiens
attcagcacaccccaaggga

SEQ ID NO: 3865731 - DNA, 16 bp, Homo sapiens
attcagcaccctgggt

SEQ ID NO: 3865732 - DNA, 21 bp, Homo sapiens
attcagcaccctgggtgccat

SEQ ID NO: 3865733 - DNA, 21 bp, Homo sapiens
attcagcactgatttcacaac

SEQ ID NO: 3865734 - DNA, 17 bp, Homo sapiens
attcaggaaaaggcctg

SEQ ID NO: 3865735 - DNA, 16 bp, Homo sapiens
attcaggaagatgaaa

SEQ ID NO: 3865736 - DNA, 16 bp, Homo sapiens
attcaggactggctca

SEQ ID NO: 3865737 - DNA, 19 bp, Homo sapiens
attcaggactggctcaccc

SEQ ID NO: 3865738 - DNA, 18 bp, Homo sapiens
attcaggtgaaaatgttc

SEQ ID NO: 3865739 - DNA, 17 bp, Homo sapiens
attcaggtgttctcttc

SEQ ID NO: 3865740 - DNA, 14 bp, Homo sapiens
attcagtaacattt

SEQ ID NO: 3865741 - DNA, 12 bp, Homo sapiens
attcataaatct

SEQ ID NO: 3865742 - DNA, 20 bp, Homo sapiens
attcatccagttgcaataaa

SEQ ID NO: 3865743 - DNA, 21 bp, Homo sapiens
attcatccagttgcaataaaa

SEQ ID NO: 3865744 - DNA, 21 bp, Homo sapiens
attcatgccaaagcaaaagaa

SEQ ID NO: 3865745 - DNA, 14 bp, Homo sapiens
attcatgccatctg

SEQ ID NO: 3865746 - DNA, 15 bp, Homo sapiens
attcatgccatctgt

SEQ ID NO: 3865747 - DNA, 20 bp, Homo sapiens
attcatgccatctgttttca

SEQ ID NO: 3865748 - DNA, 14 bp, Homo sapiens
attcatgctttctc

SEQ ID NO: 3865749 - DNA, 19 bp, Homo sapiens
attcatgctttctcctttt

SEQ ID NO: 3865750 - DNA, 15 bp, Homo sapiens
attcatgtaataaat

SEQ ID NO: 3865751 - DNA, 14 bp, Homo sapiens
attcatttaaaatg

SEQ ID NO: 3865752 - DNA, 15 bp, Homo sapiens
attcatttaaaatga

SEQ ID NO: 3865753 - DNA, 12 bp, Homo sapiens
attcatttcaca

SEQ ID NO: 3865754 - DNA, 23 bp, Homo sapiens
atgtattattttctatagctctt

SEQ ID NO: 3865755 - DNA, 20 bp, Homo sapiens
atgtcaaagagaaaacttat

SEQ ID NO: 3865756 - DNA, 16 bp, Homo sapiens
atgtcaagtaccaaaa

SEQ ID NO: 3865757 - DNA, 16 bp, Homo sapiens
atgtcaatttgtatat

SEQ ID NO: 3865758 - DNA, 18 bp, Homo sapiens
atgtcaccaccttcccag

SEQ ID NO: 3865759 - DNA, 19 bp, Homo sapiens
atgtcaccaccttcccagc

SEQ ID NO: 3865760 - DNA, 21 bp, Homo sapiens
atgtcaccgtggaccttcctg

SEQ ID NO: 3865761 - DNA, 22 bp, Homo sapiens
atgtcaccgtggaccttcctgc

SEQ ID NO: 3865762 - DNA, 19 bp, Homo sapiens
atgtcagacaataccactg

SEQ ID NO: 3865763 - DNA, 23 bp, Homo sapiens
atgtcagacatccatgtttgtaa

SEQ ID NO: 3865764 - DNA, 22 bp, Homo sapiens
atgtcagagctatgttccctcc

SEQ ID NO: 3865765 - DNA, 19 bp, Homo sapiens
atgtcagccgagccgggcc

SEQ ID NO: 3865766 - DNA, 14 bp, Homo sapiens
atgtcagccttgca

SEQ ID NO: 3865767 - DNA, 16 bp, Homo sapiens
atgtcaggcctgtgtg

SEQ ID NO: 3865768 - DNA, 15 bp, Homo sapiens
atgtcatcatacatg

SEQ ID NO: 3865769 - DNA, 13 bp, Homo sapiens
atgtccaaaatgt

SEQ ID NO: 3865770 - DNA, 23 bp, Homo sapiens
atgtccaagtccaacctgcctgt

SEQ ID NO: 3865771 - DNA, 23 bp, Homo sapiens
atgtccagaagaatattcaggac

SEQ ID NO: 3865772 - DNA, 14 bp, Homo sapiens
atgtcccctgtccc

SEQ ID NO: 3865773 - DNA, 16 bp, Homo sapiens
atgtcccctgtcccac

SEQ ID NO: 3865774 - DNA, 14 bp, Homo sapiens
atgtcccttctcat

SEQ ID NO: 3865775 - DNA, 20 bp, Homo sapiens
atgtcccttttcctaagtca

SEQ ID NO: 3865776 - DNA, 16 bp, Homo sapiens
atgtcctaaggacaca

SEQ ID NO: 3865777 - DNA, 13 bp, Homo sapiens
atgtcctatgtgt

SEQ ID NO: 3865778 - DNA, 15 bp, Homo sapiens
atgtctatagagaaa

SEQ ID NO: 3865779 - DNA, 12 bp, Homo sapiens
atgtctatttaa

SEQ ID NO: 3865780 - DNA, 13 bp, Homo sapiens
atgtctatttaag

SEQ ID NO: 3865781 - DNA, 18 bp, Homo sapiens
atgtctcagcctcctcag

SEQ ID NO: 3865782 - DNA, 15 bp, Homo sapiens
atgtctcgctagtga

SEQ ID NO: 3865783 - DNA, 15 bp, Homo sapiens
atgtctcttcctctg

SEQ ID NO: 3865784 - DNA, 16 bp, Homo sapiens
atgtctcttgtagaag

SEQ ID NO: 3865785 - DNA, 12 bp, Homo sapiens
atgtctgcttct

SEQ ID NO: 3865786 - DNA, 20 bp, Homo sapiens
atgtctgcttctgtccagga

SEQ ID NO: 3865787 - DNA, 21 bp, Homo sapiens
atgtctgcttctgtccaggac

SEQ ID NO: 3865788 - DNA, 24 bp, Homo sapiens
atgtctgtgtgtgtgtgtgtatgt

SEQ ID NO: 3865789 - DNA, 23 bp, Homo sapiens
atgtctttgttggaaaagaatac

SEQ ID NO: 3865790 - DNA, 18 bp, Homo sapiens
atgtgaaaaggcaaaaag

SEQ ID NO: 3865791 - DNA, 17 bp, Homo sapiens
atgtgaaagtgtaaaat

SEQ ID NO: 3865792 - DNA, 15 bp, Homo sapiens
atgtgaacacatcag

SEQ ID NO: 3865793 - DNA, 18 bp, Homo sapiens
atgtgaattctgtgaaga

SEQ ID NO: 3865794 - DNA, 20 bp, Homo sapiens
atgtgaattctgtgaagaat

SEQ ID NO: 3865795 - DNA, 12 bp, Homo sapiens
atgtgagcctga

SEQ ID NO: 3865796 - DNA, 23 bp, Homo sapiens
atgtgagtacccaggatgatttc

SEQ ID NO: 3865797 - DNA, 17 bp, Homo sapiens
atgtgatcaactgttca

SEQ ID NO: 3865798 - DNA, 16 bp, Homo sapiens
atgtgatcactgagac

SEQ ID NO: 3865799 - DNA, 18 bp, Homo sapiens
atgtgatccttttatgtt

SEQ ID NO: 3865800 - DNA, 18 bp, Homo sapiens
atgtgatgttaactatta

SEQ ID NO: 3865801 - DNA, 16 bp, Homo sapiens
atgtgcacatgtgtct

SEQ ID NO: 3865802 - DNA, 18 bp, Homo sapiens
atgtgcacatgtgtctgt

SEQ ID NO: 3865803 - DNA, 15 bp, Homo sapiens
atgtgccaaggtggg

SEQ ID NO: 3865804 - DNA, 19 bp, Homo sapiens
atgtgcctaatggagaaga

SEQ ID NO: 3865805 - DNA, 15 bp, Homo sapiens
atgtggaatataaag

SEQ ID NO: 3865806 - DNA, 14 bp, Homo sapiens
atgtggagtggaca

SEQ ID NO: 3865807 - DNA, 20 bp, Homo sapiens
atgtggatttcctattttaa

SEQ ID NO: 3865808 - DNA, 17 bp, Homo sapiens
atgtggcaaagtgctgt

SEQ ID NO: 3865809 - DNA, 18 bp, Homo sapiens
atgtggcccctgaacaag

SEQ ID NO: 3865810 - DNA, 10 bp, Homo sapiens
atgtgggagg

SEQ ID NO: 3865811 - DNA, 11 bp, Homo sapiens
atgtgggaggg

SEQ ID NO: 3865812 - DNA, 20 bp, Homo sapiens
atgtggttgcaaggccgctg

SEQ ID NO: 3865813 - DNA, 13 bp, Homo sapiens
atgtggtttatag

SEQ ID NO: 3865814 - DNA, 20 bp, Homo sapiens
atgtgtaaatggagcttgta

SEQ ID NO: 3865815 - DNA, 19 bp, Homo sapiens
atgtgtaaatgtggacaca

SEQ ID NO: 3865816 - DNA, 16 bp, Homo sapiens
atgtgtaagcattgta

SEQ ID NO: 3865817 - DNA, 15 bp, Homo sapiens
atgtgtattctggct

SEQ ID NO: 3865818 - DNA, 19 bp, Homo sapiens
atgtgtattctggctgcaa

SEQ ID NO: 3865819 - DNA, 16 bp, Homo sapiens
atgtgtcacagctctg

SEQ ID NO: 3865820 - DNA, 11 bp, Homo sapiens
atgtgtcccct

SEQ ID NO: 3865821 - DNA, 14 bp, Homo sapiens
atgtgtcccctcac

SEQ ID NO: 3865822 - DNA, 15 bp, Homo sapiens
atgtgtcccctcact

SEQ ID NO: 3865823 - DNA, 19 bp, Homo sapiens
atgtgtcccctcactctgt

SEQ ID NO: 3865824 - DNA, 22 bp, Homo sapiens
atgtgtcccctcactctgtcag

SEQ ID NO: 3865825 - DNA, 20 bp, Homo sapiens
atgtgtctttatcagtgatg

SEQ ID NO: 3865826 - DNA, 14 bp, Homo sapiens
atgtgtgcatgtga

SEQ ID NO: 3865827 - DNA, 17 bp, Homo sapiens
atgtgtgcatgtgtgta

SEQ ID NO: 3865828 - DNA, 18 bp, Homo sapiens
atgtgtgcatgtgtgtat

SEQ ID NO: 3865829 - DNA, 11 bp, Homo sapiens
atgtgtgccat

SEQ ID NO: 3865830 - DNA, 20 bp, Homo sapiens
atgtgtgccatagagtttaa

SEQ ID NO: 3865831 - DNA, 22 bp, Homo sapiens
atgtgtgccatagagtttaaca

SEQ ID NO: 3865832 - DNA, 16 bp, Homo sapiens
atgtgtgcctgtggca

SEQ ID NO: 3865833 - DNA, 13 bp, Homo sapiens
atgtgtgggaaag

SEQ ID NO: 3865834 - DNA, 14 bp, Homo sapiens
atgtgtgggaaagg

SEQ ID NO: 3865835 - DNA, 15 bp, Homo sapiens
atgtgtggggcatgg

SEQ ID NO: 3865836 - DNA, 16 bp, Homo sapiens
atgtgtggtgctaact

SEQ ID NO: 3865837 - DNA, 12 bp, Homo sapiens
atgtgtgtatat

SEQ ID NO: 3865838 - DNA, 13 bp, Homo sapiens
atgtgtgtctcac

SEQ ID NO: 3865839 - DNA, 13 bp, Homo sapiens
atgtgtgtgtgta

SEQ ID NO: 3865840 - DNA, 23 bp, Homo sapiens
atgctggcctcccaataaagctg

SEQ ID NO: 3865841 - DNA, 14 bp, Homo sapiens
atgctgtatatgtt

SEQ ID NO: 3865842 - DNA, 23 bp, Homo sapiens
atgctgtctccataatgccactg

SEQ ID NO: 3865843 - DNA, 14 bp, Homo sapiens
atgctgtgctcttt

SEQ ID NO: 3865844 - DNA, 15 bp, Homo sapiens
atgctgttgcctcat

SEQ ID NO: 3865845 - DNA, 18 bp, Homo sapiens
atgctgttgcctcatcta

SEQ ID NO: 3865846 - DNA, 18 bp, Homo sapiens
atgcttaaaatatgtatg

SEQ ID NO: 3865847 - DNA, 22 bp, Homo sapiens
atgcttaaaatatgtatgtcta

SEQ ID NO: 3865848 - DNA, 16 bp, Homo sapiens
atgctttctccttttt

SEQ ID NO: 3865849 - DNA, 21 bp, Homo sapiens
atgctttgaagtacaattgtg

SEQ ID NO: 3865850 - DNA, 16 bp, Homo sapiens
atggaaaagggtcttc

SEQ ID NO: 3865851 - DNA, 23 bp, Homo sapiens
atggaaacctgaaaaaaagttta

SEQ ID NO: 3865852 - DNA, 14 bp, Homo sapiens
atggaaccttccct

SEQ ID NO: 3865853 - DNA, 15 bp, Homo sapiens
atggaaccttccctc

SEQ ID NO: 3865854 - DNA, 17 bp, Homo sapiens
atggaagattttaaatt

SEQ ID NO: 3865855 - DNA, 16 bp, Homo sapiens
atggaaggagacttag

SEQ ID NO: 3865856 - DNA, 17 bp, Homo sapiens
atggaaggtttgtatat

SEQ ID NO: 3865857 - DNA, 15 bp, Homo sapiens
atggaataaaccatt

SEQ ID NO: 3865858 - DNA, 15 bp, Homo sapiens
atggaatacagtgtt

SEQ ID NO: 3865859 - DNA, 14 bp, Homo sapiens
atggaatagaaaag

SEQ ID NO: 3865860 - DNA, 17 bp, Homo sapiens
atggaatttctcccagt

SEQ ID NO: 3865861 - DNA, 21 bp, Homo sapiens
atggaatttgtaagtttatgt

SEQ ID NO: 3865862 - DNA, 18 bp, Homo sapiens
atggacaatataaactga

SEQ ID NO: 3865863 - DNA, 22 bp, Homo sapiens
atggacacagacccacacatgt

SEQ ID NO: 3865864 - DNA, 18 bp, Homo sapiens
atggacacattttctcct

SEQ ID NO: 3865865 - DNA, 22 bp, Homo sapiens
atggacaccccttatccaggac

SEQ ID NO: 3865866 - DNA, 14 bp, Homo sapiens
atggacccctccct

SEQ ID NO: 3865867 - DNA, 15 bp, Homo sapiens
atggaccctcgcagc

SEQ ID NO: 3865868 - DNA, 18 bp, Homo sapiens
atggaccgggtgggcctg

SEQ ID NO: 3865869 - DNA, 23 bp, Homo sapiens
atggaccgggtgggcctggcctg

SEQ ID NO: 3865870 - DNA, 18 bp, Homo sapiens
atggactctgaaaaacat

SEQ ID NO: 3865871 - DNA, 16 bp, Homo sapiens
atggacttttgggggt

SEQ ID NO: 3865872 - DNA, 20 bp, Homo sapiens
atggagaaacatcctaagtg

SEQ ID NO: 3865873 - DNA, 15 bp, Homo sapiens
atggagaaggaaggc

SEQ ID NO: 3865874 - DNA, 18 bp, Homo sapiens
atggagactcctgccctg

SEQ ID NO: 3865875 - DNA, 20 bp, Homo sapiens
atggagactcctgccctgtt

SEQ ID NO: 3865876 - DNA, 23 bp, Homo sapiens
atggagacttcaggttgttctgt

SEQ ID NO: 3865877 - DNA, 21 bp, Homo sapiens
atggagagagactcaaagaga

SEQ ID NO: 3865878 - DNA, 17 bp, Homo sapiens
atggagagaggggaata

SEQ ID NO: 3865879 - DNA, 16 bp, Homo sapiens
atggagagccctggga

SEQ ID NO: 3865880 - DNA, 19 bp, Homo sapiens
atggagcagtacatgggaa

SEQ ID NO: 3865881 - DNA, 20 bp, Homo sapiens
atggagcctggcacaggact

SEQ ID NO: 3865882 - DNA, 21 bp, Homo sapiens
atggagcctggcacaggactg

SEQ ID NO: 3865883 - DNA, 13 bp, Homo sapiens
atggaggagaaat

SEQ ID NO: 3865884 - DNA, 14 bp, Homo sapiens
atggaggagaaata

SEQ ID NO: 3865885 - DNA, 18 bp, Homo sapiens
atggaggatggagagagg

SEQ ID NO: 3865886 - DNA, 21 bp, Homo sapiens
atggagggattattcttccag

SEQ ID NO: 3865887 - DNA, 17 bp, Homo sapiens
atggagtaatggtcacg

SEQ ID NO: 3865888 - DNA, 22 bp, Homo sapiens
atggagtgacggtcccacactg

SEQ ID NO: 3865889 - DNA, 19 bp, Homo sapiens
atggagtgggagatcagcc

SEQ ID NO: 3865890 - DNA, 20 bp, Homo sapiens
atggagtgggagatcagcca

SEQ ID NO: 3865891 - DNA, 21 bp, Homo sapiens
atggagtgtcaccagctgcca

SEQ ID NO: 3865892 - DNA, 18 bp, Homo sapiens
atggataacctatatgat

SEQ ID NO: 3865893 - DNA, 16 bp, Homo sapiens
atggatcctggaggat

SEQ ID NO: 3865894 - DNA, 14 bp, Homo sapiens
atggatggacagaa

SEQ ID NO: 3865895 - DNA, 13 bp, Homo sapiens
atggatggggaga

SEQ ID NO: 3865896 - DNA, 12 bp, Homo sapiens
atggatgtgctt

SEQ ID NO: 3865897 - DNA, 17 bp, Homo sapiens
atggatgtggggtcccc

SEQ ID NO: 3865898 - DNA, 14 bp, Homo sapiens
atggatttgaagca

SEQ ID NO: 3865899 - DNA, 13 bp, Homo sapiens
atggatttttaaa

SEQ ID NO: 3865900 - DNA, 24 bp, Homo sapiens
atggcaaagcggttgcttctggct

SEQ ID NO: 3865901 - DNA, 18 bp, Homo sapiens
atggcaccagccccctgg

SEQ ID NO: 3865902 - DNA, 22 bp, Homo sapiens
atggcacttagctatcagaaga

SEQ ID NO: 3865903 - DNA, 14 bp, Homo sapiens
atggcagatgtagg

SEQ ID NO: 3865904 - DNA, 19 bp, Homo sapiens
atggcatgatttatatatg

SEQ ID NO: 3865905 - DNA, 20 bp, Homo sapiens
atggcatgatttatatatgg

SEQ ID NO: 3865906 - DNA, 23 bp, Homo sapiens
atggcatgatttatatatggcat

SEQ ID NO: 3865907 - DNA, 22 bp, Homo sapiens
atggccaccccgtgccacccgt

SEQ ID NO: 3865908 - DNA, 18 bp, Homo sapiens
atggccctgcaaaaatat

SEQ ID NO: 3865909 - DNA, 17 bp, Homo sapiens
atggcctctggccaggc

SEQ ID NO: 3865910 - DNA, 14 bp, Homo sapiens
atggccttccctcc

SEQ ID NO: 3865911 - DNA, 18 bp, Homo sapiens
atggcctttgataaatgt

SEQ ID NO: 3865912 - DNA, 23 bp, Homo sapiens
atggcgcgggaggcaccagctct

SEQ ID NO: 3865913 - DNA, 19 bp, Homo sapiens
atggcgtaatgggcctgcc

SEQ ID NO: 3865914 - DNA, 13 bp, Homo sapiens
atggctataaata

SEQ ID NO: 3865915 - DNA, 14 bp, Homo sapiens
atggctataaatat

SEQ ID NO: 3865916 - DNA, 15 bp, Homo sapiens
atggctataaatata

SEQ ID NO: 3865917 - DNA, 21 bp, Homo sapiens
atggctataaatatataaaaa

SEQ ID NO: 3865918 - DNA, 21 bp, Homo sapiens
atggctataggtgctacaaaa

SEQ ID NO: 3865919 - DNA, 19 bp, Homo sapiens
atggctatatggcaagaaa

SEQ ID NO: 3865920 - DNA, 22 bp, Homo sapiens
atggctcaggcaagcccctcag

SEQ ID NO: 3865921 - DNA, 20 bp, Homo sapiens
atggctgtaaactataaact

SEQ ID NO: 3865922 - DNA, 13 bp, Homo sapiens
atggctgtgagga

SEQ ID NO: 3865923 - DNA, 15 bp, Homo sapiens
atggctgtgaggatg

SEQ ID NO: 3865924 - DNA, 20 bp, Homo sapiens
atggctgtgcctctgcctgt

SEQ ID NO: 3865925 - DNA, 14 bp, Homo sapiens
atctgcagggagca

SEQ ID NO: 3865926 - DNA, 22 bp, Homo sapiens
atctgcattccccgctgcccaa

SEQ ID NO: 3865927 - DNA, 21 bp, Homo sapiens
atctgcatttataaatgtgtg

SEQ ID NO: 3865928 - DNA, 24 bp, Homo sapiens
atctgcatttataaatgtgtggtg

SEQ ID NO: 3865929 - DNA, 11 bp, Homo sapiens
atctgcctggc

SEQ ID NO: 3865930 - DNA, 17 bp, Homo sapiens
atctgcctggcctggct

SEQ ID NO: 3865931 - DNA, 18 bp, Homo sapiens
atctgcctgggcctgtgc

SEQ ID NO: 3865932 - DNA, 15 bp, Homo sapiens
atctgcctgtggcct

SEQ ID NO: 3865933 - DNA, 20 bp, Homo sapiens
atctgcctgtggccttgccc

SEQ ID NO: 3865934 - DNA, 19 bp, Homo sapiens
atctgctgttgccatagcc

SEQ ID NO: 3865935 - DNA, 22 bp, Homo sapiens
atctgctgttgccatagcccca

SEQ ID NO: 3865936 - DNA, 14 bp, Homo sapiens
atctgcttcagtgg

SEQ ID NO: 3865937 - DNA, 17 bp, Homo sapiens
atctgcttggttggctg

SEQ ID NO: 3865938 - DNA, 17 bp, Homo sapiens
atctggactcctctgtc

SEQ ID NO: 3865939 - DNA, 20 bp, Homo sapiens
atctggagagctagaacctg

SEQ ID NO: 3865940 - DNA, 15 bp, Homo sapiens
atctggattccagag

SEQ ID NO: 3865941 - DNA, 14 bp, Homo sapiens
atctgggactttca

SEQ ID NO: 3865942 - DNA, 22 bp, Homo sapiens
atctgggattcccaccaaggtc

SEQ ID NO: 3865943 - DNA, 17 bp, Homo sapiens
atctggtagatttttaa

SEQ ID NO: 3865944 - DNA, 15 bp, Homo sapiens
atctgtacgtaagaa

SEQ ID NO: 3865945 - DNA, 14 bp, Homo sapiens
atctgtactgtaat

SEQ ID NO: 3865946 - DNA, 15 bp, Homo sapiens
atctgtactgtaatt

SEQ ID NO: 3865947 - DNA, 16 bp, Homo sapiens
atctgtactgtaattt

SEQ ID NO: 3865948 - DNA, 18 bp, Homo sapiens
atctgtagggctggacct

SEQ ID NO: 3865949 - DNA, 22 bp, Homo sapiens
atctgtatttaatggtttttat

SEQ ID NO: 3865950 - DNA, 18 bp, Homo sapiens
atctgtcacacaaggctg

SEQ ID NO: 3865951 - DNA, 19 bp, Homo sapiens
atctgtcatctctctgggg

SEQ ID NO: 3865952 - DNA, 15 bp, Homo sapiens
atctgtcccctctcc

SEQ ID NO: 3865953 - DNA, 16 bp, Homo sapiens
atctgtccctgcctca

SEQ ID NO: 3865954 - DNA, 13 bp, Homo sapiens
atctgtgggccca

SEQ ID NO: 3865955 - DNA, 14 bp, Homo sapiens
atctgttactgaaa

SEQ ID NO: 3865956 - DNA, 22 bp, Homo sapiens
atctgttttgtatatgatctaa

SEQ ID NO: 3865957 - DNA, 15 bp, Homo sapiens
atcttaaaattcttg

SEQ ID NO: 3865958 - DNA, 15 bp, Homo sapiens
atcttcaaggtgtaa

SEQ ID NO: 3865959 - DNA, 19 bp, Homo sapiens
atcttcacatagttctcca

SEQ ID NO: 3865960 - DNA, 14 bp, Homo sapiens
atcttcagctccca

SEQ ID NO: 3865961 - DNA, 16 bp, Homo sapiens
atcttcagctcccata

SEQ ID NO: 3865962 - DNA, 12 bp, Homo sapiens
atcttcctgctg

SEQ ID NO: 3865963 - DNA, 15 bp, Homo sapiens
atcttcggggtgtga

SEQ ID NO: 3865964 - DNA, 19 bp, Homo sapiens
atcttctccatctggcagg

SEQ ID NO: 3865965 - DNA, 22 bp, Homo sapiens
atcttctccatctggcagggtg

SEQ ID NO: 3865966 - DNA, 18 bp, Homo sapiens
atcttctccattctagat

SEQ ID NO: 3865967 - DNA, 17 bp, Homo sapiens
atcttctgcaattgctt

SEQ ID NO: 3865968 - DNA, 17 bp, Homo sapiens
atcttcttatgcaattt

SEQ ID NO: 3865969 - DNA, 12 bp, Homo sapiens
atcttgaaggaa

SEQ ID NO: 3865970 - DNA, 16 bp, Homo sapiens
atcttgaatttcatgc

SEQ ID NO: 3865971 - DNA, 22 bp, Homo sapiens
atcttgacacggtgaaatccag

SEQ ID NO: 3865972 - DNA, 24 bp, Homo sapiens
atcttgcccctccagagacaggaa

SEQ ID NO: 3865973 - DNA, 20 bp, Homo sapiens
atcttgtccacagtctccca

SEQ ID NO: 3865974 - DNA, 21 bp, Homo sapiens
atcttgtccacagtctcccat

SEQ ID NO: 3865975 - DNA, 12 bp, Homo sapiens
atctttcaggaa

SEQ ID NO: 3865976 - DNA, 11 bp, Homo sapiens
atctttcctgt

SEQ ID NO: 3865977 - DNA, 19 bp, Homo sapiens
atctttccttgtctctcat

SEQ ID NO: 3865978 - DNA, 14 bp, Homo sapiens
atctttctttacct

SEQ ID NO: 3865979 - DNA, 17 bp, Homo sapiens
atctttctttacctgag

SEQ ID NO: 3865980 - DNA, 21 bp, Homo sapiens
atctttcttttgattcttcct

SEQ ID NO: 3865981 - DNA, 15 bp, Homo sapiens
atctttttcctccct

SEQ ID NO: 3865982 - DNA, 13 bp, Homo sapiens
atctttttctaac

SEQ ID NO: 3865983 - DNA, 20 bp, Homo sapiens
atgaaaaacaaaaataacat

SEQ ID NO: 3865984 - DNA, 19 bp, Homo sapiens
atgaaaaacacggcagctg

SEQ ID NO: 3865985 - DNA, 13 bp, Homo sapiens
atgaaaaattctc

SEQ ID NO: 3865986 - DNA, 12 bp, Homo sapiens
atgaaaactcat

SEQ ID NO: 3865987 - DNA, 23 bp, Homo sapiens
atgaaaattatctcccttagtaa

SEQ ID NO: 3865988 - DNA, 22 bp, Homo sapiens
atgaaacagaaacaaaaacact

SEQ ID NO: 3865989 - DNA, 21 bp, Homo sapiens
atgaaacagatgataaatatt

SEQ ID NO: 3865990 - DNA, 11 bp, Homo sapiens
atgaaaccaaa

SEQ ID NO: 3865991 - DNA, 17 bp, Homo sapiens
atgaaactcctgatttt

SEQ ID NO: 3865992 - DNA, 13 bp, Homo sapiens
atgaaagaggagg

SEQ ID NO: 3865993 - DNA, 20 bp, Homo sapiens
atgaaagatggctgtgcctc

SEQ ID NO: 3865994 - DNA, 20 bp, Homo sapiens
atgaaataaattggtgataa

SEQ ID NO: 3865995 - DNA, 19 bp, Homo sapiens
atgaaatacacaagtaaac

SEQ ID NO: 3865996 - DNA, 12 bp, Homo sapiens
atgaaatgtctt

SEQ ID NO: 3865997 - DNA, 16 bp, Homo sapiens
atgaaattgaacctgg

SEQ ID NO: 3865998 - DNA, 19 bp, Homo sapiens
atgaaattttctagacttt

SEQ ID NO: 3865999 - DNA, 23 bp, Homo sapiens
atgaaattttctagactttctgt

SEQ ID NO: 3866000 - DNA, 13 bp, Homo sapiens
atgaacaaactat

SEQ ID NO: 3866001 - DNA, 17 bp, Homo sapiens
atgaacctggagggcta

SEQ ID NO: 3866002 - DNA, 21 bp, Homo sapiens
atgaacttgaggacacatgtc

SEQ ID NO: 3866003 - DNA, 14 bp, Homo sapiens
atgaagagaagctg

SEQ ID NO: 3866004 - DNA, 15 bp, Homo sapiens
atgaagagaagctga

SEQ ID NO: 3866005 - DNA, 18 bp, Homo sapiens
atgaagagactctcttag

SEQ ID NO: 3866006 - DNA, 23 bp, Homo sapiens
atgaagtgtgtttccttcagtgc

SEQ ID NO: 3866007 - DNA, 18 bp, Homo sapiens
atgaagtttgaacttcat

SEQ ID NO: 3866008 - DNA, 19 bp, Homo sapiens
atgaagtttgaacttcata

SEQ ID NO: 3866009 - DNA, 14 bp, Homo sapiens
atgaatcaaagaca

SEQ ID NO: 3866010 - DNA, 15 bp, Homo sapiens
atgaatgcacactag

SEQ ID NO: 3866011 - DNA, 14 bp, Homo sapiens
atgaattaaataaa

SEQ ID NO: 3866012 - DNA, 20 bp, Homo sapiens
atgaattctctctaaaaata

SEQ ID NO: 3866013 - DNA, 17 bp, Homo sapiens
atgaattcttatgctta

SEQ ID NO: 3866014 - DNA, 21 bp, Homo sapiens
atgaattttatcagccatgtt

SEQ ID NO: 3866015 - DNA, 14 bp, Homo sapiens
atgacaacagaagc

SEQ ID NO: 3866016 - DNA, 19 bp, Homo sapiens
atgacaatgcaatgaaaca

SEQ ID NO: 3866017 - DNA, 17 bp, Homo sapiens
atgacacatttggcagt

SEQ ID NO: 3866018 - DNA, 18 bp, Homo sapiens
atgacacggtaggccaag

SEQ ID NO: 3866019 - DNA, 22 bp, Homo sapiens
atgacactctagtgacttcctg

SEQ ID NO: 3866020 - DNA, 12 bp, Homo sapiens
atgacagagcga

SEQ ID NO: 3866021 - DNA, 12 bp, Homo sapiens
atgacagtgaat

SEQ ID NO: 3866022 - DNA, 17 bp, Homo sapiens
atgacatgcactgaccc

SEQ ID NO: 3866023 - DNA, 15 bp, Homo sapiens
atgaccaagaaaaag

SEQ ID NO: 3866024 - DNA, 14 bp, Homo sapiens
atgaccagcaaata

SEQ ID NO: 3866025 - DNA, 16 bp, Homo sapiens
atgactaaaaatatta

SEQ ID NO: 3866026 - DNA, 14 bp, Homo sapiens
atgactcctttctc

SEQ ID NO: 3866027 - DNA, 21 bp, Homo sapiens
atgactgctccccagccctgg

SEQ ID NO: 3866028 - DNA, 22 bp, Homo sapiens
atgactggatacagaatgaatc

SEQ ID NO: 3866029 - DNA, 17 bp, Homo sapiens
atgactgtgattttcag

SEQ ID NO: 3866030 - DNA, 18 bp, Homo sapiens
atgacttgggcaccccca

SEQ ID NO: 3866031 - DNA, 21 bp, Homo sapiens
atgacttgggcacccccagcc

SEQ ID NO: 3866032 - DNA, 17 bp, Homo sapiens
atgacttttccatgtat

SEQ ID NO: 3866033 - DNA, 21 bp, Homo sapiens
atgagacccattcctatttct

SEQ ID NO: 3866034 - DNA, 19 bp, Homo sapiens
atgagagtggcttaaaaac

SEQ ID NO: 3866035 - DNA, 19 bp, Homo sapiens
atgagatcccgcctcttct

SEQ ID NO: 3866036 - DNA, 22 bp, Homo sapiens
atgagattgttttatcatgaca

SEQ ID NO: 3866037 - DNA, 14 bp, Homo sapiens
atgagctctgaaca

SEQ ID NO: 3866038 - DNA, 16 bp, Homo sapiens
atgagctctgaacaaa

SEQ ID NO: 3866039 - DNA, 19 bp, Homo sapiens
atgagctctgaacaaacac

SEQ ID NO: 3866040 - DNA, 12 bp, Homo sapiens
atgagctgaggg

SEQ ID NO: 3866041 - DNA, 14 bp, Homo sapiens
atgagctgtatctg

SEQ ID NO: 3866042 - DNA, 19 bp, Homo sapiens
atgaggaacctcaaactgg

SEQ ID NO: 3866043 - DNA, 15 bp, Homo sapiens
atgaggactcatata

SEQ ID NO: 3866044 - DNA, 18 bp, Homo sapiens
atgaggaggattgcttct

SEQ ID NO: 3866045 - DNA, 13 bp, Homo sapiens
atgagggactgga

SEQ ID NO: 3866046 - DNA, 16 bp, Homo sapiens
atgagggatcacaggg

SEQ ID NO: 3866047 - DNA, 20 bp, Homo sapiens
atgagggcagcagccagccc

SEQ ID NO: 3866048 - DNA, 22 bp, Homo sapiens
atgagggcagcagccagccctg

SEQ ID NO: 3866049 - DNA, 17 bp, Homo sapiens
atgagggtttcattgtg

SEQ ID NO: 3866050 - DNA, 14 bp, Homo sapiens
atgagtacctcaaa

SEQ ID NO: 3866051 - DNA, 14 bp, Homo sapiens
atgagtatacaata

SEQ ID NO: 3866052 - DNA, 20 bp, Homo sapiens
atgagttgttttcagactca

SEQ ID NO: 3866053 - DNA, 16 bp, Homo sapiens
atgatactgatgccat

SEQ ID NO: 3866054 - DNA, 21 bp, Homo sapiens
atgatatccagtaagcacatg

SEQ ID NO: 3866055 - DNA, 14 bp, Homo sapiens
atgatatccctgat

SEQ ID NO: 3866056 - DNA, 13 bp, Homo sapiens
atgatatgtaaac

SEQ ID NO: 3866057 - DNA, 21 bp, Homo sapiens
atgatatgtaaacataattct

SEQ ID NO: 3866058 - DNA, 17 bp, Homo sapiens
atgatcgagccactgca

SEQ ID NO: 3866059 - DNA, 16 bp, Homo sapiens
atgatctactcagaaa

SEQ ID NO: 3866060 - DNA, 14 bp, Homo sapiens
atgatctctgatga

SEQ ID NO: 3866061 - DNA, 14 bp, Homo sapiens
atgatctgaaaaat

SEQ ID NO: 3866062 - DNA, 16 bp, Homo sapiens
atgatctttaaaatac

SEQ ID NO: 3866063 - DNA, 16 bp, Homo sapiens
atgatgaaaataataa

SEQ ID NO: 3866064 - DNA, 14 bp, Homo sapiens
atgatgatgatgat

SEQ ID NO: 3866065 - DNA, 22 bp, Homo sapiens
atgatgattaaacacctgacac

SEQ ID NO: 3866066 - DNA, 23 bp, Homo sapiens
atgatgattccttgagcatttta

SEQ ID NO: 3866067 - DNA, 16 bp, Homo sapiens
atgatggtgctgacct

SEQ ID NO: 3866068 - DNA, 18 bp, Homo sapiens
atgatggttgcaaaagac

SEQ ID NO: 3866069 - DNA, 15 bp, Homo sapiens
atgatgtatttttgt

SEQ ID NO: 3866070 - DNA, 23 bp, Homo sapiens
atgatgtccagaagaatattcag

SEQ ID NO: 3866071 - DNA, 15 bp, Homo sapiens
atgatgtctcttgta

SEQ ID NO: 3866072 - DNA, 19 bp, Homo sapiens
atgatgtctcttgtagaag

SEQ ID NO: 3866073 - DNA, 16 bp, Homo sapiens
atgattactttaaaat

SEQ ID NO: 3866074 - DNA, 17 bp, Homo sapiens
atgattatgccactgct

SEQ ID NO: 3866075 - DNA, 22 bp, Homo sapiens
atgattggattattcatttaaa

SEQ ID NO: 3866076 - DNA, 14 bp, Homo sapiens
atgatttatagttt

SEQ ID NO: 3866077 - DNA, 15 bp, Homo sapiens
atgatttatagtttg

SEQ ID NO: 3866078 - DNA, 15 bp, Homo sapiens
atgatttatatatgg

SEQ ID NO: 3866079 - DNA, 20 bp, Homo sapiens
atgatttccaaagagaaaaa

SEQ ID NO: 3866080 - DNA, 12 bp, Homo sapiens
atgattttatac

SEQ ID NO: 3866081 - DNA, 13 bp, Homo sapiens
atgattttataca

SEQ ID NO: 3866082 - DNA, 14 bp, Homo sapiens
atgattttatacat

SEQ ID NO: 3866083 - DNA, 15 bp, Homo sapiens
atgattttatacata

SEQ ID NO: 3866084 - DNA, 17 bp, Homo sapiens
atgattttatacatagt

SEQ ID NO: 3866085 - DNA, 18 bp, Homo sapiens
atgatttttacaataatt

SEQ ID NO: 3866086 - DNA, 13 bp, Homo sapiens
atgcaaacactgt

SEQ ID NO: 3866087 - DNA, 16 bp, Homo sapiens
atgcaaacactgtgta

SEQ ID NO: 3866088 - DNA, 16 bp, Homo sapiens
atgcaacaaatattta

SEQ ID NO: 3866089 - DNA, 16 bp, Homo sapiens
atgcaataatgtgcaa

SEQ ID NO: 3866090 - DNA, 20 bp, Homo sapiens
atgcaattttgcatttgaat

SEQ ID NO: 3866091 - DNA, 14 bp, Homo sapiens
atgcaatttttaaa

SEQ ID NO: 3866092 - DNA, 17 bp, Homo sapiens
atgcaatttttaaacta

SEQ ID NO: 3866093 - DNA, 19 bp, Homo sapiens
atgcaatttttaaactagt

SEQ ID NO: 3866094 - DNA, 20 bp, Homo sapiens
atgcaatttttaaactagta

SEQ ID NO: 3866095 - DNA, 17 bp, Homo sapiens
atgcacacacacagaga

SEQ ID NO: 3866096 - DNA, 19 bp, Homo sapiens
atgcacacacacagagata

SEQ ID NO: 3866097 - DNA, 18 bp, Homo sapiens
atcgaacaaactgatgcg

SEQ ID NO: 3866098 - DNA, 17 bp, Homo sapiens
atcgagaactgccattg

SEQ ID NO: 3866099 - DNA, 12 bp, Homo sapiens
atcgattggctt

SEQ ID NO: 3866100 - DNA, 22 bp, Homo sapiens
atcgcaccttttataccagaga

SEQ ID NO: 3866101 - DNA, 14 bp, Homo sapiens
atcgcttgagccca

SEQ ID NO: 3866102 - DNA, 16 bp, Homo sapiens
atcgcttgagcccagg

SEQ ID NO: 3866103 - DNA, 15 bp, Homo sapiens
atcggagcctcctct

SEQ ID NO: 3866104 - DNA, 12 bp, Homo sapiens
atcggaggtggt

SEQ ID NO: 3866105 - DNA, 22 bp, Homo sapiens
atcggaggtggtggaggaggag

SEQ ID NO: 3866106 - DNA, 20 bp, Homo sapiens
atcgggataacaaaatcaca

SEQ ID NO: 3866107 - DNA, 22 bp, Homo sapiens
atcgggataacaaaatcacaag

SEQ ID NO: 3866108 - DNA, 17 bp, Homo sapiens
atcggggcactgcaggg

SEQ ID NO: 3866109 - DNA, 13 bp, Homo sapiens
atcgtagaagaga

SEQ ID NO: 3866110 - DNA, 14 bp, Homo sapiens
atcgtattaattat

SEQ ID NO: 3866111 - DNA, 13 bp, Homo sapiens
atcgtccttcctc

SEQ ID NO: 3866112 - DNA, 16 bp, Homo sapiens
atcgtccttcctctca

SEQ ID NO: 3866113 - DNA, 16 bp, Homo sapiens
atcgtgacccttcagg

SEQ ID NO: 3866114 - DNA, 20 bp, Homo sapiens
atcgtttattgcttaatccc

SEQ ID NO: 3866115 - DNA, 18 bp, Homo sapiens
atctaaagccagtggcag

SEQ ID NO: 3866116 - DNA, 19 bp, Homo sapiens
atctaaagccagtggcagt

SEQ ID NO: 3866117 - DNA, 16 bp, Homo sapiens
atctaagctgcagctt

SEQ ID NO: 3866118 - DNA, 21 bp, Homo sapiens
atctaatcaggttgttaatgt

SEQ ID NO: 3866119 - DNA, 14 bp, Homo sapiens
atctaatttataca

SEQ ID NO: 3866120 - DNA, 19 bp, Homo sapiens
atctaatttatacaaaata

SEQ ID NO: 3866121 - DNA, 22 bp, Homo sapiens
atctaatttatacaaaataatt

SEQ ID NO: 3866122 - DNA, 23 bp, Homo sapiens
atctaatttatacaaaataattt

SEQ ID NO: 3866123 - DNA, 16 bp, Homo sapiens
atctacctgccctctc

SEQ ID NO: 3866124 - DNA, 20 bp, Homo sapiens
atctacctgccctctctcag

SEQ ID NO: 3866125 - DNA, 21 bp, Homo sapiens
atctacctgccctctctcagt

SEQ ID NO: 3866126 - DNA, 21 bp, Homo sapiens
atctagaatgtgttttctgaa

SEQ ID NO: 3866127 - DNA, 23 bp, Homo sapiens
atctagtttacttcctaaatttc

SEQ ID NO: 3866128 - DNA, 15 bp, Homo sapiens
atctatgcaattttt

SEQ ID NO: 3866129 - DNA, 19 bp, Homo sapiens
atctatgcaatttttaaac

SEQ ID NO: 3866130 - DNA, 21 bp, Homo sapiens
atctatgcaatttttaaacta

SEQ ID NO: 3866131 - DNA, 24 bp, Homo sapiens
atctatgcaatttttaaactagta

SEQ ID NO: 3866132 - DNA, 15 bp, Homo sapiens
atctattcagacaag

SEQ ID NO: 3866133 - DNA, 12 bp, Homo sapiens
atctatttacat

SEQ ID NO: 3866134 - DNA, 14 bp, Homo sapiens
atctatttacataa

SEQ ID NO: 3866135 - DNA, 15 bp, Homo sapiens
atctatttacataaa

SEQ ID NO: 3866136 - DNA, 16 bp, Homo sapiens
atctatttattaagtt

SEQ ID NO: 3866137 - DNA, 12 bp, Homo sapiens
atctcactgccc

SEQ ID NO: 3866138 - DNA, 11 bp, Homo sapiens
atctcagccca

SEQ ID NO: 3866139 - DNA, 17 bp, Homo sapiens
atctcataggttgccaa

SEQ ID NO: 3866140 - DNA, 22 bp, Homo sapiens
atctcattcaggtgttctcttc

SEQ ID NO: 3866141 - DNA, 16 bp, Homo sapiens
atctccaaggaccagg

SEQ ID NO: 3866142 - DNA, 17 bp, Homo sapiens
atctccagcatcctgct

SEQ ID NO: 3866143 - DNA, 12 bp, Homo sapiens
atctccaggatt

SEQ ID NO: 3866144 - DNA, 18 bp, Homo sapiens
atctccagggctgcccct

SEQ ID NO: 3866145 - DNA, 20 bp, Homo sapiens
atctccagggctgcccctgt

SEQ ID NO: 3866146 - DNA, 17 bp, Homo sapiens
atctccatttcacacag

SEQ ID NO: 3866147 - DNA, 22 bp, Homo sapiens
atctccatttcacacaggtcct

SEQ ID NO: 3866148 - DNA, 12 bp, Homo sapiens
atctccccaggc

SEQ ID NO: 3866149 - DNA, 13 bp, Homo sapiens
atctccccaggcc

SEQ ID NO: 3866150 - DNA, 14 bp, Homo sapiens
atctccccaggcct

SEQ ID NO: 3866151 - DNA, 17 bp, Homo sapiens
atctccccaggcctcca

SEQ ID NO: 3866152 - DNA, 18 bp, Homo sapiens
atctccccaggcctccag

SEQ ID NO: 3866153 - DNA, 15 bp, Homo sapiens
atctccctgccgcct

SEQ ID NO: 3866154 - DNA, 12 bp, Homo sapiens
atctcccttcct

SEQ ID NO: 3866155 - DNA, 17 bp, Homo sapiens
atctcctcccatggcct

SEQ ID NO: 3866156 - DNA, 14 bp, Homo sapiens
atctcctgatttct

SEQ ID NO: 3866157 - DNA, 18 bp, Homo sapiens
atctcgagccccctggat

SEQ ID NO: 3866158 - DNA, 23 bp, Homo sapiens
atctcgtttttcttcttaagact

SEQ ID NO: 3866159 - DNA, 23 bp, Homo sapiens
atctctaattggaagaaattcct

SEQ ID NO: 3866160 - DNA, 15 bp, Homo sapiens
atctctatttaatat

SEQ ID NO: 3866161 - DNA, 17 bp, Homo sapiens
atctctatttaatattt

SEQ ID NO: 3866162 - DNA, 18 bp, Homo sapiens
atctctatttaatattta

SEQ ID NO: 3866163 - DNA, 13 bp, Homo sapiens
atctctcaggagc

SEQ ID NO: 3866164 - DNA, 18 bp, Homo sapiens
atctctcaggagcacagg

SEQ ID NO: 3866165 - DNA, 19 bp, Homo sapiens
atctctcggttccacgtcc

SEQ ID NO: 3866166 - DNA, 22 bp, Homo sapiens
atctctctggggccctgggcct

SEQ ID NO: 3866167 - DNA, 23 bp, Homo sapiens
atctctctggggccctgggcctc

SEQ ID NO: 3866168 - DNA, 13 bp, Homo sapiens
atctctgtaaaat

SEQ ID NO: 3866169 - DNA, 15 bp, Homo sapiens
atctctgtgtgcaca

SEQ ID NO: 3866170 - DNA, 21 bp, Homo sapiens
atctcttttttcaactggctg

SEQ ID NO: 3866171 - DNA, 19 bp, Homo sapiens
atctgaaaaatacttttgg

SEQ ID NO: 3866172 - DNA, 15 bp, Homo sapiens
atctgaagctattga

SEQ ID NO: 3866173 - DNA, 23 bp, Homo sapiens
atctgaagcttcactcactgtca

SEQ ID NO: 3866174 - DNA, 13 bp, Homo sapiens
atctgaaggagat

SEQ ID NO: 3866175 - DNA, 18 bp, Homo sapiens
atctgactcacaagaaga

SEQ ID NO: 3866176 - DNA, 20 bp, Homo sapiens
atctgagatctccctccagg

SEQ ID NO: 3866177 - DNA, 17 bp, Homo sapiens
atctgagcctaaatcta

SEQ ID NO: 3866178 - DNA, 19 bp, Homo sapiens
atctgagcctaaatctaat

SEQ ID NO: 3866179 - DNA, 21 bp, Homo sapiens
atctgagcctaaatctaatca

SEQ ID NO: 3866180 - DNA, 15 bp, Homo sapiens
atctgataaaattgt

SEQ ID NO: 3866181 - DNA, 21 bp, Homo sapiens
atctgatttaatgttttctgc

SEQ ID NO: 3866182 - DNA, 14 bp, Homo sapiens
atctgcactgggtg

SEQ ID NO: 3866183 - DNA, 23 bp, Homo sapiens
atatttactaagccacaagaaat

SEQ ID NO: 3866184 - DNA, 15 bp, Homo sapiens
atatttagaccctgt

SEQ ID NO: 3866185 - DNA, 22 bp, Homo sapiens
atatttagttatagtttcagat

SEQ ID NO: 3866186 - DNA, 20 bp, Homo sapiens
atatttatactctagaacat

SEQ ID NO: 3866187 - DNA, 20 bp, Homo sapiens
atatttatattgtatattct

SEQ ID NO: 3866188 - DNA, 22 bp, Homo sapiens
atatttatcaaacttgtgctga

SEQ ID NO: 3866189 - DNA, 12 bp, Homo sapiens
atatttatgctt

SEQ ID NO: 3866190 - DNA, 19 bp, Homo sapiens
atatttatgcttaaaatat

SEQ ID NO: 3866191 - DNA, 21 bp, Homo sapiens
atatttatgcttaaaatatgt

SEQ ID NO: 3866192 - DNA, 23 bp, Homo sapiens
atatttatgcttaaaatatgtat

SEQ ID NO: 3866193 - DNA, 13 bp, Homo sapiens
atatttcaaatga

SEQ ID NO: 3866194 - DNA, 13 bp, Homo sapiens
atatttgaaactg

SEQ ID NO: 3866195 - DNA, 21 bp, Homo sapiens
atatttgattgtaaaaacaaa

SEQ ID NO: 3866196 - DNA, 13 bp, Homo sapiens
atatttggaaaga

SEQ ID NO: 3866197 - DNA, 17 bp, Homo sapiens
atatttgtgtatgtgta

SEQ ID NO: 3866198 - DNA, 23 bp, Homo sapiens
atattttacattcttggaaagtc

SEQ ID NO: 3866199 - DNA, 19 bp, Homo sapiens
atattttcaacgcagccct

SEQ ID NO: 3866200 - DNA, 15 bp, Homo sapiens
atatttttagctctg

SEQ ID NO: 3866201 - DNA, 16 bp, Homo sapiens
atatttttatatttag

SEQ ID NO: 3866202 - DNA, 18 bp, Homo sapiens
atatttttatatttagtt

SEQ ID NO: 3866203 - DNA, 12 bp, Homo sapiens
atatttttcaac

SEQ ID NO: 3866204 - DNA, 20 bp, Homo sapiens
atatttttcaaccagcattt

SEQ ID NO: 3866205 - DNA, 22 bp, Homo sapiens
atatttttcaaccagcatttta

SEQ ID NO: 3866206 - DNA, 24 bp, Homo sapiens
atatttttcaaccagcattttact

SEQ ID NO: 3866207 - DNA, 16 bp, Homo sapiens
atcaaaaataaactag

SEQ ID NO: 3866208 - DNA, 19 bp, Homo sapiens
atcaaaaataaactagttt

SEQ ID NO: 3866209 - DNA, 12 bp, Homo sapiens
atcaaaacatat

SEQ ID NO: 3866210 - DNA, 17 bp, Homo sapiens
atcaaaacatatcaatt

SEQ ID NO: 3866211 - DNA, 21 bp, Homo sapiens
atcaaaacctttcaaatatca

SEQ ID NO: 3866212 - DNA, 11 bp, Homo sapiens
atcaaaatctt

SEQ ID NO: 3866213 - DNA, 15 bp, Homo sapiens
atcaaagcaagggct

SEQ ID NO: 3866214 - DNA, 20 bp, Homo sapiens
atcaaagcaagggctccagc

SEQ ID NO: 3866215 - DNA, 15 bp, Homo sapiens
atcaaagtaaaaaat

SEQ ID NO: 3866216 - DNA, 14 bp, Homo sapiens
atcaaatatgcaaa

SEQ ID NO: 3866217 - DNA, 18 bp, Homo sapiens
atcaaatatgcaaagcac

SEQ ID NO: 3866218 - DNA, 17 bp, Homo sapiens
atcaaatctgtatatgt

SEQ ID NO: 3866219 - DNA, 21 bp, Homo sapiens
atcaaatctgtatatgttgta

SEQ ID NO: 3866220 - DNA, 22 bp, Homo sapiens
atcaaatctgtatatgttgtaa

SEQ ID NO: 3866221 - DNA, 21 bp, Homo sapiens
atcaacatctttttcctccct

SEQ ID NO: 3866222 - DNA, 16 bp, Homo sapiens
atcaaccccagactca

SEQ ID NO: 3866223 - DNA, 13 bp, Homo sapiens
atcaagtccagag

SEQ ID NO: 3866224 - DNA, 20 bp, Homo sapiens
atcaatcatctgtgtgaaaa

SEQ ID NO: 3866225 - DNA, 13 bp, Homo sapiens
atcaatcctgccc

SEQ ID NO: 3866226 - DNA, 16 bp, Homo sapiens
atcaatcctgccccca

SEQ ID NO: 3866227 - DNA, 17 bp, Homo sapiens
atcaatcctgcccccag

SEQ ID NO: 3866228 - DNA, 16 bp, Homo sapiens
atcaatccttgttcag

SEQ ID NO: 3866229 - DNA, 17 bp, Homo sapiens
atcaattaattcttaat

SEQ ID NO: 3866230 - DNA, 16 bp, Homo sapiens
atcaattattacattt

SEQ ID NO: 3866231 - DNA, 21 bp, Homo sapiens
atcaatttaaaatcattcaat

SEQ ID NO: 3866232 - DNA, 20 bp, Homo sapiens
atcaatttgtaattgcttac

SEQ ID NO: 3866233 - DNA, 24 bp, Homo sapiens
atcaatttttatacatatcagaaa

SEQ ID NO: 3866234 - DNA, 14 bp, Homo sapiens
atcaatttttctta

SEQ ID NO: 3866235 - DNA, 20 bp, Homo sapiens
atcacaagaatcacctcaaa

SEQ ID NO: 3866236 - DNA, 14 bp, Homo sapiens
atcacaagcaataa

SEQ ID NO: 3866237 - DNA, 18 bp, Homo sapiens
atcacaagcaataattag

SEQ ID NO: 3866238 - DNA, 13 bp, Homo sapiens
atcacaaggggaa

SEQ ID NO: 3866239 - DNA, 14 bp, Homo sapiens
atcacacctctggg

SEQ ID NO: 3866240 - DNA, 12 bp, Homo sapiens
atcacagggccc

SEQ ID NO: 3866241 - DNA, 16 bp, Homo sapiens
atcacagggccccaga

SEQ ID NO: 3866242 - DNA, 22 bp, Homo sapiens
atcacagggccccagaaggcag

SEQ ID NO: 3866243 - DNA, 12 bp, Homo sapiens
atcacaggggcg

SEQ ID NO: 3866244 - DNA, 15 bp, Homo sapiens
atcacaggggcgggg

SEQ ID NO: 3866245 - DNA, 12 bp, Homo sapiens
atcacatacaat

SEQ ID NO: 3866246 - DNA, 15 bp, Homo sapiens
atcacatacaatttg

SEQ ID NO: 3866247 - DNA, 18 bp, Homo sapiens
atcacatacaatttgcac

SEQ ID NO: 3866248 - DNA, 12 bp, Homo sapiens
atcacccaggct

SEQ ID NO: 3866249 - DNA, 10 bp, Homo sapiens
atcacccagt

SEQ ID NO: 3866250 - DNA, 20 bp, Homo sapiens
atcaccgacgcgtctcctgt

SEQ ID NO: 3866251 - DNA, 15 bp, Homo sapiens
atcacctctcttcag

SEQ ID NO: 3866252 - DNA, 21 bp, Homo sapiens
atcacctttttgacttttcca

SEQ ID NO: 3866253 - DNA, 20 bp, Homo sapiens
atcactaatactaattcatt

SEQ ID NO: 3866254 - DNA, 16 bp, Homo sapiens
atcactccctggatgt

SEQ ID NO: 3866255 - DNA, 13 bp, Homo sapiens
atcactctgtcct

SEQ ID NO: 3866256 - DNA, 23 bp, Homo sapiens
atcactgattgggtgccatgtgg

SEQ ID NO: 3866257 - DNA, 12 bp, Homo sapiens
atcactgctccc

SEQ ID NO: 3866258 - DNA, 23 bp, Homo sapiens
atcactggagcaccaggcacgaa

SEQ ID NO: 3866259 - DNA, 18 bp, Homo sapiens
atcactggcaatgaaaaa

SEQ ID NO: 3866260 - DNA, 13 bp, Homo sapiens
atcactgtatttt

SEQ ID NO: 3866261 - DNA, 11 bp, Homo sapiens
atcacttgtaa

SEQ ID NO: 3866262 - DNA, 12 bp, Homo sapiens
atcacttgtaaa

SEQ ID NO: 3866263 - DNA, 16 bp, Homo sapiens
atcactttgttaaaaa

SEQ ID NO: 3866264 - DNA, 19 bp, Homo sapiens
atcactttgttaaaaatat

SEQ ID NO: 3866265 - DNA, 13 bp, Homo sapiens
atcagaaaaggga

SEQ ID NO: 3866266 - DNA, 13 bp, Homo sapiens
atcagaaaagtag

SEQ ID NO: 3866267 - DNA, 14 bp, Homo sapiens
atcagaaagaggca

SEQ ID NO: 3866268 - DNA, 20 bp, Homo sapiens
atcagaaagggagggctctg

SEQ ID NO: 3866269 - DNA, 13 bp, Homo sapiens
atgcacagagata

SEQ ID NO: 3866270 - DNA, 19 bp, Homo sapiens
atgcacagagatatgcaca

SEQ ID NO: 3866271 - DNA, 22 bp, Homo sapiens
atgcacagctgcttgtcctgct

SEQ ID NO: 3866272 - DNA, 17 bp, Homo sapiens
atgcacatccattccca

SEQ ID NO: 3866273 - DNA, 17 bp, Homo sapiens
atgcacatttatatata

SEQ ID NO: 3866274 - DNA, 22 bp, Homo sapiens
atgcacatttatatatatatgt

SEQ ID NO: 3866275 - DNA, 14 bp, Homo sapiens
atgcacgaccttgg

SEQ ID NO: 3866276 - DNA, 19 bp, Homo sapiens
atgcacggtgaggccgggc

SEQ ID NO: 3866277 - DNA, 21 bp, Homo sapiens
atgcagactcctcagatctga

SEQ ID NO: 3866278 - DNA, 15 bp, Homo sapiens
atgcagagtatttct

SEQ ID NO: 3866279 - DNA, 19 bp, Homo sapiens
atgcagattcctgggcctg

SEQ ID NO: 3866280 - DNA, 15 bp, Homo sapiens
atgcagtattgagca

SEQ ID NO: 3866281 - DNA, 17 bp, Homo sapiens
atgcagtattgccacaa

SEQ ID NO: 3866282 - DNA, 17 bp, Homo sapiens
atgcagtccagaataag

SEQ ID NO: 3866283 - DNA, 22 bp, Homo sapiens
atgcagtccagaataagtgctg

SEQ ID NO: 3866284 - DNA, 23 bp, Homo sapiens
atgcagtccagaataagtgctgt

SEQ ID NO: 3866285 - DNA, 23 bp, Homo sapiens
atgcatccattcctcagggacag

SEQ ID NO: 3866286 - DNA, 17 bp, Homo sapiens
atgcatgattttataca

SEQ ID NO: 3866287 - DNA, 20 bp, Homo sapiens
atgcatgattttatacatag

SEQ ID NO: 3866288 - DNA, 23 bp, Homo sapiens
atgcatggagggctgccctgtac

SEQ ID NO: 3866289 - DNA, 23 bp, Homo sapiens
atgcatggtgcagttgacagcag

SEQ ID NO: 3866290 - DNA, 21 bp, Homo sapiens
atgcatgtaaggtcttcttgt

SEQ ID NO: 3866291 - DNA, 21 bp, Homo sapiens
atgcatttccacactgtcaga

SEQ ID NO: 3866292 - DNA, 23 bp, Homo sapiens
atgcattttattttagacacaaa

SEQ ID NO: 3866293 - DNA, 20 bp, Homo sapiens
atgccaaattgtagttcttg

SEQ ID NO: 3866294 - DNA, 18 bp, Homo sapiens
atgccaacaccttcttgg

SEQ ID NO: 3866295 - DNA, 21 bp, Homo sapiens
atgccaacatacccttcttta

SEQ ID NO: 3866296 - DNA, 13 bp, Homo sapiens
atgccacagcccc

SEQ ID NO: 3866297 - DNA, 14 bp, Homo sapiens
atgccacagcccca

SEQ ID NO: 3866298 - DNA, 17 bp, Homo sapiens
atgccacagccccacag

SEQ ID NO: 3866299 - DNA, 18 bp, Homo sapiens
atgccacagccccacagc

SEQ ID NO: 3866300 - DNA, 15 bp, Homo sapiens
atgccacccagcaac

SEQ ID NO: 3866301 - DNA, 20 bp, Homo sapiens
atgccacccagcaacacaga

SEQ ID NO: 3866302 - DNA, 16 bp, Homo sapiens
atgccaccctctccat

SEQ ID NO: 3866303 - DNA, 19 bp, Homo sapiens
atgccactgccaggcacct

SEQ ID NO: 3866304 - DNA, 20 bp, Homo sapiens
atgccactgccaggcacctg

SEQ ID NO: 3866305 - DNA, 21 bp, Homo sapiens
atgccactgccaggcacctgg

SEQ ID NO: 3866306 - DNA, 22 bp, Homo sapiens
atgccactgccaggcacctggc

SEQ ID NO: 3866307 - DNA, 22 bp, Homo sapiens
atgccagagacggaagcctttt

SEQ ID NO: 3866308 - DNA, 15 bp, Homo sapiens
atgccagcttcctgt

SEQ ID NO: 3866309 - DNA, 22 bp, Homo sapiens
atgccatgtttagattccagga

SEQ ID NO: 3866310 - DNA, 18 bp, Homo sapiens
atgcccctctgcctgggc

SEQ ID NO: 3866311 - DNA, 22 bp, Homo sapiens
atgccgtataggatgtcagaca

SEQ ID NO: 3866312 - DNA, 23 bp, Homo sapiens
atgccgtataggatgtcagacaa

SEQ ID NO: 3866313 - DNA, 18 bp, Homo sapiens
atgcctcaagaacacctt

SEQ ID NO: 3866314 - DNA, 19 bp, Homo sapiens
atgcctcaagaacaccttt

SEQ ID NO: 3866315 - DNA, 18 bp, Homo sapiens
atgcctcatgccacacct

SEQ ID NO: 3866316 - DNA, 21 bp, Homo sapiens
atgcctccaccgctgcctaag

SEQ ID NO: 3866317 - DNA, 11 bp, Homo sapiens
atgcctctccc

SEQ ID NO: 3866318 - DNA, 12 bp, Homo sapiens
atgcctctgagg

SEQ ID NO: 3866319 - DNA, 17 bp, Homo sapiens
atgcctctgaggccagc

SEQ ID NO: 3866320 - DNA, 19 bp, Homo sapiens
atgcctctgaggccagcct

SEQ ID NO: 3866321 - DNA, 23 bp, Homo sapiens
atgcctctgaggccagcctggcc

SEQ ID NO: 3866322 - DNA, 22 bp, Homo sapiens
atgcctctgatatgggactgag

SEQ ID NO: 3866323 - DNA, 15 bp, Homo sapiens
atgcctgagggtgga

SEQ ID NO: 3866324 - DNA, 17 bp, Homo sapiens
atgcctgagggtggaga

SEQ ID NO: 3866325 - DNA, 19 bp, Homo sapiens
atgccttgacaacagactg

SEQ ID NO: 3866326 - DNA, 15 bp, Homo sapiens
atgcgcaatgtggca

SEQ ID NO: 3866327 - DNA, 13 bp, Homo sapiens
atgcgtatatgtg

SEQ ID NO: 3866328 - DNA, 13 bp, Homo sapiens
atgctaagaaatg

SEQ ID NO: 3866329 - DNA, 15 bp, Homo sapiens
atgctattgaaatta

SEQ ID NO: 3866330 - DNA, 17 bp, Homo sapiens
atgctattgaaattact

SEQ ID NO: 3866331 - DNA, 15 bp, Homo sapiens
atgctcaagtttttc

SEQ ID NO: 3866332 - DNA, 13 bp, Homo sapiens
atgctccagggca

SEQ ID NO: 3866333 - DNA, 18 bp, Homo sapiens
atgctccagggcagcctc

SEQ ID NO: 3866334 - DNA, 19 bp, Homo sapiens
atgctctctgcagccagcc

SEQ ID NO: 3866335 - DNA, 13 bp, Homo sapiens
atgctctgcccca

SEQ ID NO: 3866336 - DNA, 12 bp, Homo sapiens
atgctctggaag

SEQ ID NO: 3866337 - DNA, 16 bp, Homo sapiens
atgctctggaagcctg

SEQ ID NO: 3866338 - DNA, 12 bp, Homo sapiens
atgctgaaggga

SEQ ID NO: 3866339 - DNA, 14 bp, Homo sapiens
atgctgaatgaatc

SEQ ID NO: 3866340 - DNA, 13 bp, Homo sapiens
atgctgaattatt

SEQ ID NO: 3866341 - DNA, 15 bp, Homo sapiens
atgctgaattatttt

SEQ ID NO: 3866342 - DNA, 17 bp, Homo sapiens
atgctgaattattttgt

SEQ ID NO: 3866343 - DNA, 22 bp, Homo sapiens
atgctgaattattttgttgtga

SEQ ID NO: 3866344 - DNA, 22 bp, Homo sapiens
atgctgccccgttccctgtcag

SEQ ID NO: 3866345 - DNA, 12 bp, Homo sapiens
atgctgcctcca

SEQ ID NO: 3866346 - DNA, 15 bp, Homo sapiens
atgctgcctccagaa

SEQ ID NO: 3866347 - DNA, 19 bp, Homo sapiens
atgctgctaattcaaagct

SEQ ID NO: 3866348 - DNA, 20 bp, Homo sapiens
atgctgctttttggcacagt

SEQ ID NO: 3866349 - DNA, 22 bp, Homo sapiens
atgctgctttttggcacagttg

SEQ ID NO: 3866350 - DNA, 16 bp, Homo sapiens
atgctggccagcaccc

SEQ ID NO: 3866351 - DNA, 17 bp, Homo sapiens
atgctggccagcaccct

SEQ ID NO: 3866352 - DNA, 21 bp, Homo sapiens
atgctggccagcaccctctcc

SEQ ID NO: 3866353 - DNA, 22 bp, Homo sapiens
atgctggccagcaccctctcct

SEQ ID NO: 3866354 - DNA, 18 bp, Homo sapiens
atccatgttagtttttac

SEQ ID NO: 3866355 - DNA, 19 bp, Homo sapiens
atccattcccaagaaatgc

SEQ ID NO: 3866356 - DNA, 17 bp, Homo sapiens
atccatttggacaaaat

SEQ ID NO: 3866357 - DNA, 19 bp, Homo sapiens
atccatttggacaaaatgg

SEQ ID NO: 3866358 - DNA, 13 bp, Homo sapiens
atcccaaaagtca

SEQ ID NO: 3866359 - DNA, 20 bp, Homo sapiens
atcccaaaggacagccgcct

SEQ ID NO: 3866360 - DNA, 16 bp, Homo sapiens
atcccaattcatttca

SEQ ID NO: 3866361 - DNA, 23 bp, Homo sapiens
atcccacagtggcacggagagaa

SEQ ID NO: 3866362 - DNA, 23 bp, Homo sapiens
atcccacattcggaccctgccca

SEQ ID NO: 3866363 - DNA, 17 bp, Homo sapiens
atcccagaaattagaaa

SEQ ID NO: 3866364 - DNA, 19 bp, Homo sapiens
atcccagagcttcccagga

SEQ ID NO: 3866365 - DNA, 21 bp, Homo sapiens
atcccagagcttcccaggatc

SEQ ID NO: 3866366 - DNA, 20 bp, Homo sapiens
atcccagctactcaggaggc

SEQ ID NO: 3866367 - DNA, 12 bp, Homo sapiens
atcccaggggac

SEQ ID NO: 3866368 - DNA, 11 bp, Homo sapiens
atcccagtttg

SEQ ID NO: 3866369 - DNA, 15 bp, Homo sapiens
atcccatccatcagc

SEQ ID NO: 3866370 - DNA, 18 bp, Homo sapiens
atcccatctaagctgcag

SEQ ID NO: 3866371 - DNA, 19 bp, Homo sapiens
atcccatgtcacctcagct

SEQ ID NO: 3866372 - DNA, 14 bp, Homo sapiens
atcccattgccctg

SEQ ID NO: 3866373 - DNA, 18 bp, Homo sapiens
atccccaagctggcagct

SEQ ID NO: 3866374 - DNA, 19 bp, Homo sapiens
atcccctcgtcctgtccca

SEQ ID NO: 3866375 - DNA, 18 bp, Homo sapiens
atcccctggactgggagg

SEQ ID NO: 3866376 - DNA, 21 bp, Homo sapiens
atccccttgtgtcagagacag

SEQ ID NO: 3866377 - DNA, 22 bp, Homo sapiens
atcccctttattaattcattaa

SEQ ID NO: 3866378 - DNA, 14 bp, Homo sapiens
atcccgaaaatctc

SEQ ID NO: 3866379 - DNA, 13 bp, Homo sapiens
atcccggcctctt

SEQ ID NO: 3866380 - DNA, 14 bp, Homo sapiens
atcccggcctcttc

SEQ ID NO: 3866381 - DNA, 16 bp, Homo sapiens
atcccggcctcttcca

SEQ ID NO: 3866382 - DNA, 11 bp, Homo sapiens
atccctgggcc

SEQ ID NO: 3866383 - DNA, 19 bp, Homo sapiens
atccctgttacccagagaa

SEQ ID NO: 3866384 - DNA, 13 bp, Homo sapiens
atccctgtttaat

SEQ ID NO: 3866385 - DNA, 14 bp, Homo sapiens
atccctgtttaata

SEQ ID NO: 3866386 - DNA, 16 bp, Homo sapiens
atccctgtttaatatt

SEQ ID NO: 3866387 - DNA, 20 bp, Homo sapiens
atccctgtttaatatttaaa

SEQ ID NO: 3866388 - DNA, 22 bp, Homo sapiens
atccctttcccatgatccagaa

SEQ ID NO: 3866389 - DNA, 10 bp, Homo sapiens
atccgcctgc

SEQ ID NO: 3866390 - DNA, 13 bp, Homo sapiens
atccgctgccacc

SEQ ID NO: 3866391 - DNA, 14 bp, Homo sapiens
atccgctgccacca

SEQ ID NO: 3866392 - DNA, 16 bp, Homo sapiens
atccgggacgcttcca

SEQ ID NO: 3866393 - DNA, 19 bp, Homo sapiens
atccgggacgcttccagac

SEQ ID NO: 3866394 - DNA, 21 bp, Homo sapiens
atccgggacgcttccagacca

SEQ ID NO: 3866395 - DNA, 16 bp, Homo sapiens
atccgtagttccctga

SEQ ID NO: 3866396 - DNA, 23 bp, Homo sapiens
atccgtttcagctgacagctgct

SEQ ID NO: 3866397 - DNA, 21 bp, Homo sapiens
atcctaatgacttctaaaaat

SEQ ID NO: 3866398 - DNA, 14 bp, Homo sapiens
atcctaccaatgca

SEQ ID NO: 3866399 - DNA, 15 bp, Homo sapiens
atcctaccaatgcat

SEQ ID NO: 3866400 - DNA, 16 bp, Homo sapiens
atcctagaaccaagct

SEQ ID NO: 3866401 - DNA, 19 bp, Homo sapiens
atcctagaaccaagcttca

SEQ ID NO: 3866402 - DNA, 21 bp, Homo sapiens
atcctagaaccaagcttcaga

SEQ ID NO: 3866403 - DNA, 14 bp, Homo sapiens
atcctagagaggct

SEQ ID NO: 3866404 - DNA, 15 bp, Homo sapiens
atcctaggtgctgga

SEQ ID NO: 3866405 - DNA, 14 bp, Homo sapiens
atcctcacaggagc

SEQ ID NO: 3866406 - DNA, 20 bp, Homo sapiens
atcctcacaggagcagacag

SEQ ID NO: 3866407 - DNA, 21 bp, Homo sapiens
atcctcacaggagcagacaga

SEQ ID NO: 3866408 - DNA, 23 bp, Homo sapiens
atcctcacaggagcagacagaga

SEQ ID NO: 3866409 - DNA, 22 bp, Homo sapiens
atcctcaccatccacagcaaga

SEQ ID NO: 3866410 - DNA, 20 bp, Homo sapiens
atcctccttataagcccagc

SEQ ID NO: 3866411 - DNA, 14 bp, Homo sapiens
atcctgaaatttca

SEQ ID NO: 3866412 - DNA, 16 bp, Homo sapiens
atcctgaaatttcaga

SEQ ID NO: 3866413 - DNA, 17 bp, Homo sapiens
atcctgaaatttcagat

SEQ ID NO: 3866414 - DNA, 18 bp, Homo sapiens
atcctgaagaaaccacag

SEQ ID NO: 3866415 - DNA, 19 bp, Homo sapiens
atcctgcaggaacgagcac

SEQ ID NO: 3866416 - DNA, 22 bp, Homo sapiens
atcctgcaggaacgagcactgg

SEQ ID NO: 3866417 - DNA, 14 bp, Homo sapiens
atcctgcccccagc

SEQ ID NO: 3866418 - DNA, 16 bp, Homo sapiens
atcctgctagctgtag

SEQ ID NO: 3866419 - DNA, 20 bp, Homo sapiens
atcctgctcataacatcttt

SEQ ID NO: 3866420 - DNA, 13 bp, Homo sapiens
atcctgctgtggc

SEQ ID NO: 3866421 - DNA, 14 bp, Homo sapiens
atcctgctgtggcc

SEQ ID NO: 3866422 - DNA, 14 bp, Homo sapiens
atcctgcttcctag

SEQ ID NO: 3866423 - DNA, 21 bp, Homo sapiens
atcctgcttcctaggccccag

SEQ ID NO: 3866424 - DNA, 22 bp, Homo sapiens
atcctgcttcctaggccccaga

SEQ ID NO: 3866425 - DNA, 17 bp, Homo sapiens
atcctgtatattatggt

SEQ ID NO: 3866426 - DNA, 21 bp, Homo sapiens
atccttaggaaaatgcttctg

SEQ ID NO: 3866427 - DNA, 14 bp, Homo sapiens
atccttatttatat

SEQ ID NO: 3866428 - DNA, 11 bp, Homo sapiens
atccttctgcc

SEQ ID NO: 3866429 - DNA, 13 bp, Homo sapiens
atccttctgcctt

SEQ ID NO: 3866430 - DNA, 19 bp, Homo sapiens
atccttcttatgtttgctt

SEQ ID NO: 3866431 - DNA, 19 bp, Homo sapiens
atccttgagcactcagtct

SEQ ID NO: 3866432 - DNA, 14 bp, Homo sapiens
atccttggagagca

SEQ ID NO: 3866433 - DNA, 16 bp, Homo sapiens
atccttggagagcagc

SEQ ID NO: 3866434 - DNA, 18 bp, Homo sapiens
atccttggagagcagctg

SEQ ID NO: 3866435 - DNA, 23 bp, Homo sapiens
atccttgtctttactgacaagaa

SEQ ID NO: 3866436 - DNA, 17 bp, Homo sapiens
atccttttatgttattt

SEQ ID NO: 3866437 - DNA, 22 bp, Homo sapiens
atccttttttaaaagtaaatgt

SEQ ID NO: 3866438 - DNA, 16 bp, Homo sapiens
atcgaacaaactgatg

SEQ ID NO: 3866439 - DNA, 17 bp, Homo sapiens
atcgaacaaactgatgc

SEQ ID NO: 3866440 - DNA, 23 bp, Homo sapiens
atcagaaagggagggctctgagg

SEQ ID NO: 3866441 - DNA, 20 bp, Homo sapiens
atcagaaatgtcatcaaata

SEQ ID NO: 3866442 - DNA, 12 bp, Homo sapiens
atcagaacagga

SEQ ID NO: 3866443 - DNA, 13 bp, Homo sapiens
atcagaagataac

SEQ ID NO: 3866444 - DNA, 17 bp, Homo sapiens
atcagaagataacttga

SEQ ID NO: 3866445 - DNA, 13 bp, Homo sapiens
atcagaaggctgg

SEQ ID NO: 3866446 - DNA, 18 bp, Homo sapiens
atcagaagtttctcagct

SEQ ID NO: 3866447 - DNA, 13 bp, Homo sapiens
atcagacctctga

SEQ ID NO: 3866448 - DNA, 15 bp, Homo sapiens
atcagacctctgatc

SEQ ID NO: 3866449 - DNA, 15 bp, Homo sapiens
atcagcactgaaaat

SEQ ID NO: 3866450 - DNA, 20 bp, Homo sapiens
atcagcccaacgggaagcaa

SEQ ID NO: 3866451 - DNA, 17 bp, Homo sapiens
atcagccccgctcctcc

SEQ ID NO: 3866452 - DNA, 23 bp, Homo sapiens
atcagccccgctcctcccctctt

SEQ ID NO: 3866453 - DNA, 20 bp, Homo sapiens
atcagcctccgccattccaa

SEQ ID NO: 3866454 - DNA, 17 bp, Homo sapiens
atcagcctgagtctcct

SEQ ID NO: 3866455 - DNA, 19 bp, Homo sapiens
atcagcctgagtctcctgt

SEQ ID NO: 3866456 - DNA, 22 bp, Homo sapiens
atcagcctgagtctcctgtgcc

SEQ ID NO: 3866457 - DNA, 13 bp, Homo sapiens
atcagcgtggcct

SEQ ID NO: 3866458 - DNA, 21 bp, Homo sapiens
atcagcgtggccttgttctgt

SEQ ID NO: 3866459 - DNA, 19 bp, Homo sapiens
atcagctacttaagagaaa

SEQ ID NO: 3866460 - DNA, 11 bp, Homo sapiens
atcagctccct

SEQ ID NO: 3866461 - DNA, 23 bp, Homo sapiens
atcagctcccttcccctgcctgg

SEQ ID NO: 3866462 - DNA, 19 bp, Homo sapiens
atcaggaagagaaggagca

SEQ ID NO: 3866463 - DNA, 23 bp, Homo sapiens
atcaggcacaggcaggaagagag

SEQ ID NO: 3866464 - DNA, 12 bp, Homo sapiens
atcaggccaaga

SEQ ID NO: 3866465 - DNA, 18 bp, Homo sapiens
atcaggcctaatctcata

SEQ ID NO: 3866466 - DNA, 13 bp, Homo sapiens
atcaggctgaggt

SEQ ID NO: 3866467 - DNA, 17 bp, Homo sapiens
atcaggcttggaatgaa

SEQ ID NO: 3866468 - DNA, 20 bp, Homo sapiens
atcagggtgggccactctcc

SEQ ID NO: 3866469 - DNA, 15 bp, Homo sapiens
atcaggttgttaatg

SEQ ID NO: 3866470 - DNA, 22 bp, Homo sapiens
atcagtattaatactaaaatat

SEQ ID NO: 3866471 - DNA, 23 bp, Homo sapiens
atcagtattaatactaaaatatg

SEQ ID NO: 3866472 - DNA, 18 bp, Homo sapiens
atcagttactcagccctg

SEQ ID NO: 3866473 - DNA, 21 bp, Homo sapiens
atcagttactcagccctgggc

SEQ ID NO: 3866474 - DNA, 19 bp, Homo sapiens
atcagttataattattcca

SEQ ID NO: 3866475 - DNA, 17 bp, Homo sapiens
atcagttatattcttta

SEQ ID NO: 3866476 - DNA, 19 bp, Homo sapiens
atcagttatattctttaaa

SEQ ID NO: 3866477 - DNA, 21 bp, Homo sapiens
atcagttatattctttaaatt

SEQ ID NO: 3866478 - DNA, 17 bp, Homo sapiens
atcataaggaagttatt

SEQ ID NO: 3866479 - DNA, 15 bp, Homo sapiens
atcatagaaatgtaa

SEQ ID NO: 3866480 - DNA, 18 bp, Homo sapiens
atcataggtatttcaaaa

SEQ ID NO: 3866481 - DNA, 21 bp, Homo sapiens
atcatattggtattcactaat

SEQ ID NO: 3866482 - DNA, 22 bp, Homo sapiens
atcatcagcatacctttattgt

SEQ ID NO: 3866483 - DNA, 23 bp, Homo sapiens
atcatcccatctaagctgcagct

SEQ ID NO: 3866484 - DNA, 13 bp, Homo sapiens
atcatctgtgtga

SEQ ID NO: 3866485 - DNA, 18 bp, Homo sapiens
atcatctgtgtgaaaatg

SEQ ID NO: 3866486 - DNA, 19 bp, Homo sapiens
atcatctgtgtgaaaatgg

SEQ ID NO: 3866487 - DNA, 15 bp, Homo sapiens
atcatgaaaagtgct

SEQ ID NO: 3866488 - DNA, 13 bp, Homo sapiens
atcatgaaacact

SEQ ID NO: 3866489 - DNA, 19 bp, Homo sapiens
atcatgaaacacttctcat

SEQ ID NO: 3866490 - DNA, 17 bp, Homo sapiens
atcatgaccagcaaata

SEQ ID NO: 3866491 - DNA, 19 bp, Homo sapiens
atcatgcctctgaggccag

SEQ ID NO: 3866492 - DNA, 20 bp, Homo sapiens
atcatgcctctgaggccagc

SEQ ID NO: 3866493 - DNA, 22 bp, Homo sapiens
atcatgcctctgaggccagcct

SEQ ID NO: 3866494 - DNA, 20 bp, Homo sapiens
atcatgctttaaagtgtaat

SEQ ID NO: 3866495 - DNA, 15 bp, Homo sapiens
atcatggagctgagg

SEQ ID NO: 3866496 - DNA, 12 bp, Homo sapiens
atcatggagtga

SEQ ID NO: 3866497 - DNA, 16 bp, Homo sapiens
atcattaaattggaat

SEQ ID NO: 3866498 - DNA, 11 bp, Homo sapiens
atcattaatac

SEQ ID NO: 3866499 - DNA, 16 bp, Homo sapiens
atcattatgtaatgtc

SEQ ID NO: 3866500 - DNA, 15 bp, Homo sapiens
atcattcaaaacaac

SEQ ID NO: 3866501 - DNA, 18 bp, Homo sapiens
atcattcaatatctgaca

SEQ ID NO: 3866502 - DNA, 14 bp, Homo sapiens
atcattctttcccc

SEQ ID NO: 3866503 - DNA, 16 bp, Homo sapiens
atcattctttcccctc

SEQ ID NO: 3866504 - DNA, 22 bp, Homo sapiens
atcattctttcccctcagagct

SEQ ID NO: 3866505 - DNA, 18 bp, Homo sapiens
atcattgtatatatgtgt

SEQ ID NO: 3866506 - DNA, 17 bp, Homo sapiens
atcatttgaacaactag

SEQ ID NO: 3866507 - DNA, 12 bp, Homo sapiens
atcattttaaga

SEQ ID NO: 3866508 - DNA, 23 bp, Homo sapiens
atccaagcttttttaaagtaaaa

SEQ ID NO: 3866509 - DNA, 18 bp, Homo sapiens
atccacaaagccgtgcct

SEQ ID NO: 3866510 - DNA, 16 bp, Homo sapiens
atccacacacagagga

SEQ ID NO: 3866511 - DNA, 19 bp, Homo sapiens
atccacacacgcaggaact

SEQ ID NO: 3866512 - DNA, 13 bp, Homo sapiens
atccacagactcc

SEQ ID NO: 3866513 - DNA, 14 bp, Homo sapiens
atccacccagccca

SEQ ID NO: 3866514 - DNA, 20 bp, Homo sapiens
atccacccagtgctgccatg

SEQ ID NO: 3866515 - DNA, 20 bp, Homo sapiens
atccaccctcaaatgtcaga

SEQ ID NO: 3866516 - DNA, 13 bp, Homo sapiens
atccaggactctg

SEQ ID NO: 3866517 - DNA, 15 bp, Homo sapiens
atccaggtgggagag

SEQ ID NO: 3866518 - DNA, 18 bp, Homo sapiens
atccagtgatgtgctgga

SEQ ID NO: 3866519 - DNA, 19 bp, Homo sapiens
atccagtgatgtgctggag

SEQ ID NO: 3866520 - DNA, 17 bp, Homo sapiens
atccagttgcaataaaa

SEQ ID NO: 3866521 - DNA, 15 bp, Homo sapiens
atccagtttcccacc

SEQ ID NO: 3866522 - DNA, 15 bp, Homo sapiens
atccatcagctccct

SEQ ID NO: 3866523 - DNA, 21 bp, Homo sapiens
atccatcagctcccttttctt

SEQ ID NO: 3866524 - DNA, 13 bp, Homo sapiens
atccatcaggcca

SEQ ID NO: 3866525 - DNA, 18 bp, Homo sapiens
atccatgtcctatgtgtg

SEQ ID NO: 3866526 - DNA, 16 bp, Homo sapiens
ataaccttcatgatga

SEQ ID NO: 3866527 - DNA, 19 bp, Homo sapiens
ataactagtgttgcttgga

SEQ ID NO: 3866528 - DNA, 13 bp, Homo sapiens
ataactagtttaa

SEQ ID NO: 3866529 - DNA, 18 bp, Homo sapiens
ataactgaaggagaaggt

SEQ ID NO: 3866530 - DNA, 20 bp, Homo sapiens
ataactgcaaagtgaagttg

SEQ ID NO: 3866531 - DNA, 17 bp, Homo sapiens
ataacttcttaaaagtt

SEQ ID NO: 3866532 - DNA, 21 bp, Homo sapiens
ataacttgctgaatttcaggc

SEQ ID NO: 3866533 - DNA, 19 bp, Homo sapiens
ataactttagaaataagaa

SEQ ID NO: 3866534 - DNA, 18 bp, Homo sapiens
ataagagaaagaaaatga

SEQ ID NO: 3866535 - DNA, 20 bp, Homo sapiens
ataagagagaacaactactg

SEQ ID NO: 3866536 - DNA, 17 bp, Homo sapiens
ataagattagaatgaaa

SEQ ID NO: 3866537 - DNA, 17 bp, Homo sapiens
ataagcaaattagtaat

SEQ ID NO: 3866538 - DNA, 20 bp, Homo sapiens
ataagcaaattagtaattgt

SEQ ID NO: 3866539 - DNA, 14 bp, Homo sapiens
ataagcaaatttca

SEQ ID NO: 3866540 - DNA, 15 bp, Homo sapiens
ataagcaaatttcaa

SEQ ID NO: 3866541 - DNA, 22 bp, Homo sapiens
ataagcaaatttcaaaagacat

SEQ ID NO: 3866542 - DNA, 13 bp, Homo sapiens
ataaggaagttat

SEQ ID NO: 3866543 - DNA, 14 bp, Homo sapiens
ataaggaagttatt

SEQ ID NO: 3866544 - DNA, 13 bp, Homo sapiens
ataaggaggaaaa

SEQ ID NO: 3866545 - DNA, 14 bp, Homo sapiens
ataaggaggaaaac

SEQ ID NO: 3866546 - DNA, 20 bp, Homo sapiens
ataaggatcagaacagcaga

SEQ ID NO: 3866547 - DNA, 17 bp, Homo sapiens
ataaggggcacctggga

SEQ ID NO: 3866548 - DNA, 18 bp, Homo sapiens
ataaggggcacctgggaa

SEQ ID NO: 3866549 - DNA, 15 bp, Homo sapiens
ataagtgaataataa

SEQ ID NO: 3866550 - DNA, 20 bp, Homo sapiens
ataagtgcacacagaaatat

SEQ ID NO: 3866551 - DNA, 21 bp, Homo sapiens
ataagtgcacacagaaatata

SEQ ID NO: 3866552 - DNA, 13 bp, Homo sapiens
ataagtggaaaaa

SEQ ID NO: 3866553 - DNA, 21 bp, Homo sapiens
ataagtggaaaaaagagaaaa

SEQ ID NO: 3866554 - DNA, 21 bp, Homo sapiens
ataataaagaactccttattt

SEQ ID NO: 3866555 - DNA, 23 bp, Homo sapiens
ataataaattgtttggcttcctc

SEQ ID NO: 3866556 - DNA, 14 bp, Homo sapiens
ataatactaaagtg

SEQ ID NO: 3866557 - DNA, 12 bp, Homo sapiens
ataatagaagaa

SEQ ID NO: 3866558 - DNA, 20 bp, Homo sapiens
ataataggatataaaacaca

SEQ ID NO: 3866559 - DNA, 13 bp, Homo sapiens
ataatatgatttt

SEQ ID NO: 3866560 - DNA, 18 bp, Homo sapiens
ataatcaaagctacctgt

SEQ ID NO: 3866561 - DNA, 15 bp, Homo sapiens
ataatcagcctctta

SEQ ID NO: 3866562 - DNA, 16 bp, Homo sapiens
ataatcagcctcttaa

SEQ ID NO: 3866563 - DNA, 18 bp, Homo sapiens
ataatgctgttgcctcat

SEQ ID NO: 3866564 - DNA, 17 bp, Homo sapiens
ataatggaagagaaatc

SEQ ID NO: 3866565 - DNA, 16 bp, Homo sapiens
ataatgtatataaagt

SEQ ID NO: 3866566 - DNA, 19 bp, Homo sapiens
ataatgtgcaaattttgca

SEQ ID NO: 3866567 - DNA, 13 bp, Homo sapiens
ataatgtgtgtat

SEQ ID NO: 3866568 - DNA, 14 bp, Homo sapiens
ataatgtgtgtatg

SEQ ID NO: 3866569 - DNA, 23 bp, Homo sapiens
ataattaatgtgtgtctgaagac

SEQ ID NO: 3866570 - DNA, 15 bp, Homo sapiens
ataattagaacaata

SEQ ID NO: 3866571 - DNA, 18 bp, Homo sapiens
ataattagaacaatagct

SEQ ID NO: 3866572 - DNA, 21 bp, Homo sapiens
ataattagaacaatagctatt

SEQ ID NO: 3866573 - DNA, 18 bp, Homo sapiens
ataattaggatctatgca

SEQ ID NO: 3866574 - DNA, 19 bp, Homo sapiens
ataattaggatctatgcaa

SEQ ID NO: 3866575 - DNA, 16 bp, Homo sapiens
ataattaggttaacat

SEQ ID NO: 3866576 - DNA, 22 bp, Homo sapiens
ataattgaaaggaaatgtttga

SEQ ID NO: 3866577 - DNA, 17 bp, Homo sapiens
ataatttaactaattta

SEQ ID NO: 3866578 - DNA, 22 bp, Homo sapiens
ataatttaactaatttaaacca

SEQ ID NO: 3866579 - DNA, 15 bp, Homo sapiens
ataattttaaacaaa

SEQ ID NO: 3866580 - DNA, 23 bp, Homo sapiens
ataattttcaagagaagaaaaaa

SEQ ID NO: 3866581 - DNA, 19 bp, Homo sapiens
ataatttttaaagtatata

SEQ ID NO: 3866582 - DNA, 23 bp, Homo sapiens
ataatttttttattactgatttt

SEQ ID NO: 3866583 - DNA, 12 bp, Homo sapiens
atacaaaataat

SEQ ID NO: 3866584 - DNA, 19 bp, Homo sapiens
atacaaaataatttaacta

SEQ ID NO: 3866585 - DNA, 16 bp, Homo sapiens
atacaaacatgtggca

SEQ ID NO: 3866586 - DNA, 13 bp, Homo sapiens
atacaacaagaac

SEQ ID NO: 3866587 - DNA, 16 bp, Homo sapiens
atacaacacaaagaga

SEQ ID NO: 3866588 - DNA, 16 bp, Homo sapiens
atacaatgacaagtat

SEQ ID NO: 3866589 - DNA, 13 bp, Homo sapiens
atacacaacattt

SEQ ID NO: 3866590 - DNA, 12 bp, Homo sapiens
atacacacatat

SEQ ID NO: 3866591 - DNA, 13 bp, Homo sapiens
atacacacatata

SEQ ID NO: 3866592 - DNA, 15 bp, Homo sapiens
atacacacatataca

SEQ ID NO: 3866593 - DNA, 18 bp, Homo sapiens
atacacacatatacatat

SEQ ID NO: 3866594 - DNA, 12 bp, Homo sapiens
atacacatacat

SEQ ID NO: 3866595 - DNA, 23 bp, Homo sapiens
atacacatatacctataatgtgt

SEQ ID NO: 3866596 - DNA, 21 bp, Homo sapiens
atacaccacctcactcctgtt

SEQ ID NO: 3866597 - DNA, 19 bp, Homo sapiens
atacactaattcctttcta

SEQ ID NO: 3866598 - DNA, 15 bp, Homo sapiens
atacactcctgctgt

SEQ ID NO: 3866599 - DNA, 13 bp, Homo sapiens
atacactctctag

SEQ ID NO: 3866600 - DNA, 21 bp, Homo sapiens
atacactgaagttaacagaga

SEQ ID NO: 3866601 - DNA, 14 bp, Homo sapiens
atacagaaaatgct

SEQ ID NO: 3866602 - DNA, 20 bp, Homo sapiens
atacagaactgaattaagtt

SEQ ID NO: 3866603 - DNA, 15 bp, Homo sapiens
atacagacactaagt

SEQ ID NO: 3866604 - DNA, 15 bp, Homo sapiens
atacagaggtaacta

SEQ ID NO: 3866605 - DNA, 13 bp, Homo sapiens
atacagtaaagtt

SEQ ID NO: 3866606 - DNA, 14 bp, Homo sapiens
atacagtgttattt

SEQ ID NO: 3866607 - DNA, 14 bp, Homo sapiens
atacataactagtt

SEQ ID NO: 3866608 - DNA, 14 bp, Homo sapiens
atacatacacttgt

SEQ ID NO: 3866609 - DNA, 13 bp, Homo sapiens
atacatacataca

SEQ ID NO: 3866610 - DNA, 14 bp, Homo sapiens
atacatacatacat

SEQ ID NO: 3866611 - DNA, 17 bp, Homo sapiens
atacatacatacatata

SEQ ID NO: 3866612 - DNA, 18 bp, Homo sapiens
atacatacatacatatat

SEQ ID NO: 3866613 - DNA, 19 bp, Homo sapiens
atacatacatacatatata

SEQ ID NO: 3866614 - DNA, 13 bp, Homo sapiens
atacatacatata

SEQ ID NO: 3866615 - DNA, 15 bp, Homo sapiens
atacatacatatata

SEQ ID NO: 3866616 - DNA, 22 bp, Homo sapiens
atacatatatatatacacatac

SEQ ID NO: 3866617 - DNA, 16 bp, Homo sapiens
atacatatatatctga

SEQ ID NO: 3866618 - DNA, 23 bp, Homo sapiens
atacatatatgtatatatatgca

SEQ ID NO: 3866619 - DNA, 14 bp, Homo sapiens
atacatatcagaaa

SEQ ID NO: 3866620 - DNA, 15 bp, Homo sapiens
atacatatcagaaaa

SEQ ID NO: 3866621 - DNA, 18 bp, Homo sapiens
atacatattataaataaa

SEQ ID NO: 3866622 - DNA, 20 bp, Homo sapiens
atacatattataaataaatg

SEQ ID NO: 3866623 - DNA, 22 bp, Homo sapiens
atacatattataaataaatgcc

SEQ ID NO: 3866624 - DNA, 23 bp, Homo sapiens
atacatcctgctttccctcccca

SEQ ID NO: 3866625 - DNA, 15 bp, Homo sapiens
atacatgtgtggatg

SEQ ID NO: 3866626 - DNA, 18 bp, Homo sapiens
atacatgtgtgtatatat

SEQ ID NO: 3866627 - DNA, 19 bp, Homo sapiens
atacatgtgtgtatatatg

SEQ ID NO: 3866628 - DNA, 21 bp, Homo sapiens
atacatgtgtgtatatatgtg

SEQ ID NO: 3866629 - DNA, 19 bp, Homo sapiens
atacattttgttatagaat

SEQ ID NO: 3866630 - DNA, 21 bp, Homo sapiens
atacattttgttatagaatac

SEQ ID NO: 3866631 - DNA, 20 bp, Homo sapiens
ataccagtgaaccaaagaga

SEQ ID NO: 3866632 - DNA, 17 bp, Homo sapiens
ataccatactcatttct

SEQ ID NO: 3866633 - DNA, 21 bp, Homo sapiens
ataccatatgtctgcttctgt

SEQ ID NO: 3866634 - DNA, 15 bp, Homo sapiens
ataccatcctgccca

SEQ ID NO: 3866635 - DNA, 14 bp, Homo sapiens
atacccctgcctgg

SEQ ID NO: 3866636 - DNA, 22 bp, Homo sapiens
atacccctgcctgggttttcta

SEQ ID NO: 3866637 - DNA, 21 bp, Homo sapiens
atacccttctttaaatcaaaa

SEQ ID NO: 3866638 - DNA, 24 bp, Homo sapiens
atacccttctttaaatcaaaagct

SEQ ID NO: 3866639 - DNA, 13 bp, Homo sapiens
atacctataatgt

SEQ ID NO: 3866640 - DNA, 15 bp, Homo sapiens
atacctataatgtgt

SEQ ID NO: 3866641 - DNA, 18 bp, Homo sapiens
atacctataatgtgtgta

SEQ ID NO: 3866642 - DNA, 13 bp, Homo sapiens
atacctctgacca

SEQ ID NO: 3866643 - DNA, 16 bp, Homo sapiens
atacgcactacatgtg

SEQ ID NO: 3866644 - DNA, 17 bp, Homo sapiens
atacgcactacatgtgg

SEQ ID NO: 3866645 - DNA, 17 bp, Homo sapiens
atacgtgttaggaggct

SEQ ID NO: 3866646 - DNA, 14 bp, Homo sapiens
atactaaaatatgt

SEQ ID NO: 3866647 - DNA, 17 bp, Homo sapiens
atactatggaatttctc

SEQ ID NO: 3866648 - DNA, 17 bp, Homo sapiens
atactcacctcctccca

SEQ ID NO: 3866649 - DNA, 16 bp, Homo sapiens
atactcatttctaaaa

SEQ ID NO: 3866650 - DNA, 20 bp, Homo sapiens
atactcatttctaaaagaat

SEQ ID NO: 3866651 - DNA, 22 bp, Homo sapiens
atactcatttctaaaagaatat

SEQ ID NO: 3866652 - DNA, 23 bp, Homo sapiens
atactcatttctaaaagaatatt

SEQ ID NO: 3866653 - DNA, 21 bp, Homo sapiens
atactccaagcttcaagtgat

SEQ ID NO: 3866654 - DNA, 15 bp, Homo sapiens
atactccatacataa

SEQ ID NO: 3866655 - DNA, 18 bp, Homo sapiens
atactctagaacatgcac

SEQ ID NO: 3866656 - DNA, 22 bp, Homo sapiens
atactctccctgacatttctaa

SEQ ID NO: 3866657 - DNA, 12 bp, Homo sapiens
atactctgtcag

SEQ ID NO: 3866658 - DNA, 22 bp, Homo sapiens
atactgccggtcacccaggctc

SEQ ID NO: 3866659 - DNA, 21 bp, Homo sapiens
atactgcgggcaccagaatgc

SEQ ID NO: 3866660 - DNA, 11 bp, Homo sapiens
atactgctctg

SEQ ID NO: 3866661 - DNA, 16 bp, Homo sapiens
atactgtacttaataa

SEQ ID NO: 3866662 - DNA, 16 bp, Homo sapiens
atacttcaggtgcttt

SEQ ID NO: 3866663 - DNA, 13 bp, Homo sapiens
atacttttttcta

SEQ ID NO: 3866664 - DNA, 15 bp, Homo sapiens
atagaaacatgacac

SEQ ID NO: 3866665 - DNA, 21 bp, Homo sapiens
atagaaactgaggagtagctg

SEQ ID NO: 3866666 - DNA, 14 bp, Homo sapiens
atagaaagcaataa

SEQ ID NO: 3866667 - DNA, 15 bp, Homo sapiens
atagaaatacctcat

SEQ ID NO: 3866668 - DNA, 18 bp, Homo sapiens
atagaaatacctcattcg

SEQ ID NO: 3866669 - DNA, 13 bp, Homo sapiens
atagaagctgtag

SEQ ID NO: 3866670 - DNA, 14 bp, Homo sapiens
atagaagctgtagt

SEQ ID NO: 3866671 - DNA, 21 bp, Homo sapiens
atagaatacttttttctagtt

SEQ ID NO: 3866672 - DNA, 22 bp, Homo sapiens
atagaatacttttttctagttt

SEQ ID NO: 3866673 - DNA, 18 bp, Homo sapiens
atagacacatcaaatgcc

SEQ ID NO: 3866674 - DNA, 19 bp, Homo sapiens
atagagaaaaactttcatt

SEQ ID NO: 3866675 - DNA, 21 bp, Homo sapiens
atagagcacctagtccagtga

SEQ ID NO: 3866676 - DNA, 16 bp, Homo sapiens
atagaggtaccagcaa

SEQ ID NO: 3866677 - DNA, 17 bp, Homo sapiens
atagagtatactaaaaa

SEQ ID NO: 3866678 - DNA, 22 bp, Homo sapiens
atagatccatttggacaaaatg

SEQ ID NO: 3866679 - DNA, 17 bp, Homo sapiens
atagatcctaggtgctg

SEQ ID NO: 3866680 - DNA, 23 bp, Homo sapiens
atagatgggtctggctgagctga

SEQ ID NO: 3866681 - DNA, 17 bp, Homo sapiens
atagattaatggcactg

SEQ ID NO: 3866682 - DNA, 23 bp, Homo sapiens
atagatttgtattttaaaacata

SEQ ID NO: 3866683 - DNA, 16 bp, Homo sapiens
atagcaacactctata

SEQ ID NO: 3866684 - DNA, 22 bp, Homo sapiens
atagcaatccatgttagttttt

SEQ ID NO: 3866685 - DNA, 21 bp, Homo sapiens
atagcactgggaactctggct

SEQ ID NO: 3866686 - DNA, 20 bp, Homo sapiens
atagcagaagaaaaagttgc

SEQ ID NO: 3866687 - DNA, 15 bp, Homo sapiens
atagcagcaaaaata

SEQ ID NO: 3866688 - DNA, 19 bp, Homo sapiens
atagcatttttgatttatg

SEQ ID NO: 3866689 - DNA, 13 bp, Homo sapiens
atagccagacaca

SEQ ID NO: 3866690 - DNA, 14 bp, Homo sapiens
atagccagacacat

SEQ ID NO: 3866691 - DNA, 16 bp, Homo sapiens
atagccagacacatgg

SEQ ID NO: 3866692 - DNA, 15 bp, Homo sapiens
atagccagagaggag

SEQ ID NO: 3866693 - DNA, 22 bp, Homo sapiens
atagccagagaggagcacctga

SEQ ID NO: 3866694 - DNA, 15 bp, Homo sapiens
atagcgctggctcag

SEQ ID NO: 3866695 - DNA, 19 bp, Homo sapiens
atagcgctggctcaggaag

SEQ ID NO: 3866696 - DNA, 16 bp, Homo sapiens
atagctacccaaaaga

SEQ ID NO: 3866697 - DNA, 21 bp, Homo sapiens
atagctacccaaaagagaaaa

SEQ ID NO: 3866698 - DNA, 14 bp, Homo sapiens
atagctattactgt

SEQ ID NO: 3866699 - DNA, 16 bp, Homo sapiens
atagctattgcatgta

SEQ ID NO: 3866700 - DNA, 20 bp, Homo sapiens
atagctattgcatgtaaaat

SEQ ID NO: 3866701 - DNA, 23 bp, Homo sapiens
atagctattgcatgtaaaatgca

SEQ ID NO: 3866702 - DNA, 16 bp, Homo sapiens
atagctcttctattta

SEQ ID NO: 3866703 - DNA, 18 bp, Homo sapiens
atagctcttctatttaaa

SEQ ID NO: 3866704 - DNA, 17 bp, Homo sapiens
atagcttgtatagtgta

SEQ ID NO: 3866705 - DNA, 20 bp, Homo sapiens
atagcttgtatagtgtaaaa

SEQ ID NO: 3866706 - DNA, 17 bp, Homo sapiens
atagcttttattgtata

SEQ ID NO: 3866707 - DNA, 18 bp, Homo sapiens
ataggaaaagtacattta

SEQ ID NO: 3866708 - DNA, 14 bp, Homo sapiens
ataggctggagaag

SEQ ID NO: 3866709 - DNA, 18 bp, Homo sapiens
ataggctggagaagctca

SEQ ID NO: 3866710 - DNA, 15 bp, Homo sapiens
atagggagaaaccaa

SEQ ID NO: 3866711 - DNA, 15 bp, Homo sapiens
ataggtgctacaaaa

SEQ ID NO: 3866712 - DNA, 21 bp, Homo sapiens
atagtaactactttttatact

SEQ ID NO: 3866713 - DNA, 13 bp, Homo sapiens
atagtaactctta

SEQ ID NO: 3866714 - DNA, 18 bp, Homo sapiens
atagtaagcctccctcct

SEQ ID NO: 3866715 - DNA, 16 bp, Homo sapiens
atagtagggttggggt

SEQ ID NO: 3866716 - DNA, 17 bp, Homo sapiens
atagtatatctggacaa

SEQ ID NO: 3866717 - DNA, 17 bp, Homo sapiens
atagtatatttatactc

SEQ ID NO: 3866718 - DNA, 19 bp, Homo sapiens
atagtcaatgtttctttta

SEQ ID NO: 3866719 - DNA, 14 bp, Homo sapiens
atagtcacaaaaat

SEQ ID NO: 3866720 - DNA, 18 bp, Homo sapiens
atagtcacaaaaatggtg

SEQ ID NO: 3866721 - DNA, 21 bp, Homo sapiens
atagtcacaaaaatggtggtt

SEQ ID NO: 3866722 - DNA, 14 bp, Homo sapiens
atagtcacaagagc

SEQ ID NO: 3866723 - DNA, 21 bp, Homo sapiens
atagtcagctgtaccaagccc

SEQ ID NO: 3866724 - DNA, 16 bp, Homo sapiens
atagtccaatatttgg

SEQ ID NO: 3866725 - DNA, 19 bp, Homo sapiens
atagtctgtgtgcacaatg

SEQ ID NO: 3866726 - DNA, 23 bp, Homo sapiens
atagttaggatagcatttttgat

SEQ ID NO: 3866727 - DNA, 21 bp, Homo sapiens
atagttctccagttgtatgga

SEQ ID NO: 3866728 - DNA, 21 bp, Homo sapiens
atagtttcagatatatatcat

SEQ ID NO: 3866729 - DNA, 20 bp, Homo sapiens
atataaaaagaaaagataaa

SEQ ID NO: 3866730 - DNA, 14 bp, Homo sapiens
atataaaatagttg

SEQ ID NO: 3866731 - DNA, 16 bp, Homo sapiens
atataaacttgtgtat

SEQ ID NO: 3866732 - DNA, 13 bp, Homo sapiens
atataaagttaaa

SEQ ID NO: 3866733 - DNA, 13 bp, Homo sapiens
atataaatatttg

SEQ ID NO: 3866734 - DNA, 13 bp, Homo sapiens
atataaatgcatg

SEQ ID NO: 3866735 - DNA, 17 bp, Homo sapiens
atataaatgcatgattt

SEQ ID NO: 3866736 - DNA, 15 bp, Homo sapiens
atataaatggctggt

SEQ ID NO: 3866737 - DNA, 19 bp, Homo sapiens
atataaccattacatgttt

SEQ ID NO: 3866738 - DNA, 21 bp, Homo sapiens
atataaccattacatgtttaa

SEQ ID NO: 3866739 - DNA, 14 bp, Homo sapiens
atataaggaggaaa

SEQ ID NO: 3866740 - DNA, 15 bp, Homo sapiens
atataatactaaagt

SEQ ID NO: 3866741 - DNA, 19 bp, Homo sapiens
atataatggaagagaaatc

SEQ ID NO: 3866742 - DNA, 22 bp, Homo sapiens
atataatggaagagaaatctca

SEQ ID NO: 3866743 - DNA, 18 bp, Homo sapiens
atatacaataacataatt

SEQ ID NO: 3866744 - DNA, 19 bp, Homo sapiens
atatacacaggatcctatt

SEQ ID NO: 3866745 - DNA, 13 bp, Homo sapiens
atatacacataca

SEQ ID NO: 3866746 - DNA, 17 bp, Homo sapiens
atatacacatacataca

SEQ ID NO: 3866747 - DNA, 18 bp, Homo sapiens
atatacacatggatgcac

SEQ ID NO: 3866748 - DNA, 12 bp, Homo sapiens
atatacatacac

SEQ ID NO: 3866749 - DNA, 13 bp, Homo sapiens
atatacatacact

SEQ ID NO: 3866750 - DNA, 21 bp, Homo sapiens
atatacatacacttgtataaa

SEQ ID NO: 3866751 - DNA, 15 bp, Homo sapiens
atatacatattataa

SEQ ID NO: 3866752 - DNA, 13 bp, Homo sapiens
atatacatgtgtg

SEQ ID NO: 3866753 - DNA, 14 bp, Homo sapiens
atatacatgtgtgt

SEQ ID NO: 3866754 - DNA, 23 bp, Homo sapiens
atatacatgtgtgtatatatgtg

SEQ ID NO: 3866755 - DNA, 14 bp, Homo sapiens
atatacctataatg

SEQ ID NO: 3866756 - DNA, 18 bp, Homo sapiens
atatacctataatgtgtg

SEQ ID NO: 3866757 - DNA, 21 bp, Homo sapiens
atatacctataatgtgtgtat

SEQ ID NO: 3866758 - DNA, 21 bp, Homo sapiens
atatagcgttcccaacaacat

SEQ ID NO: 3866759 - DNA, 15 bp, Homo sapiens
atataggttgtgcaa

SEQ ID NO: 3866760 - DNA, 16 bp, Homo sapiens
atatagtatatttata

SEQ ID NO: 3866761 - DNA, 19 bp, Homo sapiens
atatataaaaagaaaagat

SEQ ID NO: 3866762 - DNA, 21 bp, Homo sapiens
atatataaaaagaaaagataa

SEQ ID NO: 3866763 - DNA, 17 bp, Homo sapiens
atatataaatatatatt

SEQ ID NO: 3866764 - DNA, 17 bp, Homo sapiens
atatatacacatacata

SEQ ID NO: 3866765 - DNA, 18 bp, Homo sapiens
atatatacacatacatac

SEQ ID NO: 3866766 - DNA, 14 bp, Homo sapiens
atatatacatatgt

SEQ ID NO: 3866767 - DNA, 14 bp, Homo sapiens
atatatagtgctat

SEQ ID NO: 3866768 - DNA, 16 bp, Homo sapiens
atatatatacacatac

SEQ ID NO: 3866769 - DNA, 14 bp, Homo sapiens
atatatatatattt

SEQ ID NO: 3866770 - DNA, 12 bp, Homo sapiens
atatatatatgt

SEQ ID NO: 3866771 - DNA, 22 bp, Homo sapiens
atatatatgtatatgtatatat

SEQ ID NO: 3866772 - DNA, 11 bp, Homo sapiens
atatatattta

SEQ ID NO: 3866773 - DNA, 15 bp, Homo sapiens
atatatatttaaagg

SEQ ID NO: 3866774 - DNA, 15 bp, Homo sapiens
atatatctgcttcag

SEQ ID NO: 3866775 - DNA, 18 bp, Homo sapiens
atatatgctcaaccagaa

SEQ ID NO: 3866776 - DNA, 14 bp, Homo sapiens
atatatggcatatt

SEQ ID NO: 3866777 - DNA, 19 bp, Homo sapiens
atatatggcatatttatat

SEQ ID NO: 3866778 - DNA, 15 bp, Homo sapiens
atatatgtatatgta

SEQ ID NO: 3866779 - DNA, 16 bp, Homo sapiens
atatatgtgcagtatt

SEQ ID NO: 3866780 - DNA, 12 bp, Homo sapiens
atatatgtgtgt

SEQ ID NO: 3866781 - DNA, 13 bp, Homo sapiens
atatatgtgtgtg

SEQ ID NO: 3866782 - DNA, 14 bp, Homo sapiens
atatatgtgtgtgt

SEQ ID NO: 3866783 - DNA, 20 bp, Homo sapiens
atatatgtgtgtttaaataa

SEQ ID NO: 3866784 - DNA, 13 bp, Homo sapiens
atatattcatgta

SEQ ID NO: 3866785 - DNA, 12 bp, Homo sapiens
atatattgctgc

SEQ ID NO: 3866786 - DNA, 22 bp, Homo sapiens
atatatttgattgtaaaaacaa

SEQ ID NO: 3866787 - DNA, 15 bp, Homo sapiens
atatatttttggttg

SEQ ID NO: 3866788 - DNA, 20 bp, Homo sapiens
atatatttttggttgtcaat

SEQ ID NO: 3866789 - DNA, 14 bp, Homo sapiens
atatcaaaaagact

SEQ ID NO: 3866790 - DNA, 15 bp, Homo sapiens
atatcaagatgattc

SEQ ID NO: 3866791 - DNA, 16 bp, Homo sapiens
atatcaagatgattct

SEQ ID NO: 3866792 - DNA, 14 bp, Homo sapiens
atatcaaggatgtt

SEQ ID NO: 3866793 - DNA, 15 bp, Homo sapiens
atatcaaggatgttc

SEQ ID NO: 3866794 - DNA, 12 bp, Homo sapiens
atatcaattcaa

SEQ ID NO: 3866795 - DNA, 12 bp, Homo sapiens
atatcagaaaag

SEQ ID NO: 3866796 - DNA, 14 bp, Homo sapiens
atatcagaaaaggg

SEQ ID NO: 3866797 - DNA, 19 bp, Homo sapiens
atatcagaaaagtagaatt

SEQ ID NO: 3866798 - DNA, 22 bp, Homo sapiens
atatcagaaaagtagaattata

SEQ ID NO: 3866799 - DNA, 18 bp, Homo sapiens
atatcagagctcttaatg

SEQ ID NO: 3866800 - DNA, 21 bp, Homo sapiens
atatcagagctcttaatgttg

SEQ ID NO: 3866801 - DNA, 14 bp, Homo sapiens
atatcagcctgagt

SEQ ID NO: 3866802 - DNA, 20 bp, Homo sapiens
atatcagttactcagccctg

SEQ ID NO: 3866803 - DNA, 23 bp, Homo sapiens
atatcagttactcagccctgggc

SEQ ID NO: 3866804 - DNA, 15 bp, Homo sapiens
atatcatgaaacact

SEQ ID NO: 3866805 - DNA, 20 bp, Homo sapiens
atatcatgctttaaagtgta

SEQ ID NO: 3866806 - DNA, 21 bp, Homo sapiens
atatcggaggtggtggaggag

SEQ ID NO: 3866807 - DNA, 14 bp, Homo sapiens
atatctaatttata

SEQ ID NO: 3866808 - DNA, 15 bp, Homo sapiens
atatctaatttatac

SEQ ID NO: 3866809 - DNA, 18 bp, Homo sapiens
atatctaatttatacaaa

SEQ ID NO: 3866810 - DNA, 22 bp, Homo sapiens
atatctaatttatacaaaataa

SEQ ID NO: 3866811 - DNA, 20 bp, Homo sapiens
atatctatagtagtcaatta

SEQ ID NO: 3866812 - DNA, 14 bp, Homo sapiens
atatctgataaaat

SEQ ID NO: 3866813 - DNA, 20 bp, Homo sapiens
atatctgataaaattgtgat

SEQ ID NO: 3866814 - DNA, 13 bp, Homo sapiens
atatctgcttcag

SEQ ID NO: 3866815 - DNA, 16 bp, Homo sapiens
atatctgcttcagtgg

SEQ ID NO: 3866816 - DNA, 22 bp, Homo sapiens
atatcttgctggattaatgttt

SEQ ID NO: 3866817 - DNA, 14 bp, Homo sapiens
atatgacagctgtc

SEQ ID NO: 3866818 - DNA, 14 bp, Homo sapiens
atatgacatgccac

SEQ ID NO: 3866819 - DNA, 16 bp, Homo sapiens
atatgagtatacaata

SEQ ID NO: 3866820 - DNA, 16 bp, Homo sapiens
atatgatatgtaaaca

SEQ ID NO: 3866821 - DNA, 16 bp, Homo sapiens
atatgatctaatacaa

SEQ ID NO: 3866822 - DNA, 14 bp, Homo sapiens
atatgatttatagt

SEQ ID NO: 3866823 - DNA, 22 bp, Homo sapiens
atatgattttatttgacaaaat

SEQ ID NO: 3866824 - DNA, 17 bp, Homo sapiens
atatgattttttaaaag

SEQ ID NO: 3866825 - DNA, 23 bp, Homo sapiens
atatgcaaagcactgacttctaa

SEQ ID NO: 3866826 - DNA, 16 bp, Homo sapiens
atatggaaccttccct

SEQ ID NO: 3866827 - DNA, 13 bp, Homo sapiens
atatggcaagaaa

SEQ ID NO: 3866828 - DNA, 17 bp, Homo sapiens
atatggcaagaaagctg

SEQ ID NO: 3866829 - DNA, 17 bp, Homo sapiens
atatggcatatttatat

SEQ ID NO: 3866830 - DNA, 16 bp, Homo sapiens
atatgggtgctggcag

SEQ ID NO: 3866831 - DNA, 12 bp, Homo sapiens
atatgtaaaata

SEQ ID NO: 3866832 - DNA, 17 bp, Homo sapiens
atatgtagactatatac

SEQ ID NO: 3866833 - DNA, 19 bp, Homo sapiens
atatgtagactatatacat

SEQ ID NO: 3866834 - DNA, 22 bp, Homo sapiens
atatgtagccttgccttttaaa

SEQ ID NO: 3866835 - DNA, 16 bp, Homo sapiens
atatgtatatgtatat

SEQ ID NO: 3866836 - DNA, 18 bp, Homo sapiens
atatgtctgccacagaga

SEQ ID NO: 3866837 - DNA, 13 bp, Homo sapiens
atatgtgtatata

SEQ ID NO: 3866838 - DNA, 15 bp, Homo sapiens
atatgtgtatatata

SEQ ID NO: 3866839 - DNA, 19 bp, Homo sapiens
atatgtgtatatatacata

SEQ ID NO: 3866840 - DNA, 20 bp, Homo sapiens
atatgtgtatatatacatac

SEQ ID NO: 3866841 - DNA, 14 bp, Homo sapiens
atatgtgtgtgtgt

SEQ ID NO: 3866842 - DNA, 19 bp, Homo sapiens
atatgtgtgtttaaataaa

SEQ ID NO: 3866843 - DNA, 12 bp, Homo sapiens
atatgttcaact

SEQ ID NO: 3866844 - DNA, 20 bp, Homo sapiens
atattaaatacagacactaa

SEQ ID NO: 3866845 - DNA, 14 bp, Homo sapiens
atattaatcccagc

SEQ ID NO: 3866846 - DNA, 18 bp, Homo sapiens
atattaccaaaaaagtat

SEQ ID NO: 3866847 - DNA, 13 bp, Homo sapiens
atattataaataa

SEQ ID NO: 3866848 - DNA, 20 bp, Homo sapiens
atattataaatccaaagtaa

SEQ ID NO: 3866849 - DNA, 14 bp, Homo sapiens
atattataataatg

SEQ ID NO: 3866850 - DNA, 15 bp, Homo sapiens
atattatggtgtaat

SEQ ID NO: 3866851 - DNA, 18 bp, Homo sapiens
atattatggtgtaatgca

SEQ ID NO: 3866852 - DNA, 17 bp, Homo sapiens
atattattcattcattt

SEQ ID NO: 3866853 - DNA, 14 bp, Homo sapiens
atattattggggtt

SEQ ID NO: 3866854 - DNA, 22 bp, Homo sapiens
atattcacacctcacgctctgg

SEQ ID NO: 3866855 - DNA, 14 bp, Homo sapiens
atattcagagaata

SEQ ID NO: 3866856 - DNA, 11 bp, Homo sapiens
atattctggaa

SEQ ID NO: 3866857 - DNA, 23 bp, Homo sapiens
atattctggaaaaaaaatatata

SEQ ID NO: 3866858 - DNA, 13 bp, Homo sapiens
atattgaatatat

SEQ ID NO: 3866859 - DNA, 14 bp, Homo sapiens
atattgaatatatc

SEQ ID NO: 3866860 - DNA, 18 bp, Homo sapiens
atattgaatgtttccaac

SEQ ID NO: 3866861 - DNA, 16 bp, Homo sapiens
atattgcactaggtca

SEQ ID NO: 3866862 - DNA, 21 bp, Homo sapiens
atattgctgctggtaatttgt

SEQ ID NO: 3866863 - DNA, 16 bp, Homo sapiens
atattgtatattctgg

SEQ ID NO: 3866864 - DNA, 16 bp, Homo sapiens
atattgtattatgcta

SEQ ID NO: 3866865 - DNA, 9 bp, Homo sapiens
atatttaaa

SEQ ID NO: 3866866 - DNA, 14 bp, Homo sapiens
atatttaaacagca

SEQ ID NO: 3866867 - DNA, 14 bp, Homo sapiens
atatttaagtatat

SEQ ID NO: 3866868 - DNA, 14 bp, Homo sapiens
atatttaagtttgt

SEQ ID NO: 3866869 - DNA, 21 bp, Homo sapiens
atatttacatgaattgcattt

SEQ ID NO: 3866870 - DNA, 19 bp, Homo sapiens
agtgaactatttctacaca

SEQ ID NO: 3866871 - DNA, 23 bp, Homo sapiens
agtgaacttacacttggagcccg

SEQ ID NO: 3866872 - DNA, 16 bp, Homo sapiens
agtgaagacttcttgg

SEQ ID NO: 3866873 - DNA, 17 bp, Homo sapiens
agtgaagacttcttggg

SEQ ID NO: 3866874 - DNA, 21 bp, Homo sapiens
agtgaagccccttgtcctctc

SEQ ID NO: 3866875 - DNA, 23 bp, Homo sapiens
agtgaagccccttgtcctctccc

SEQ ID NO: 3866876 - DNA, 15 bp, Homo sapiens
agtgaaggagaaagg

SEQ ID NO: 3866877 - DNA, 17 bp, Homo sapiens
agtgaaggagccacgtg

SEQ ID NO: 3866878 - DNA, 20 bp, Homo sapiens
agtgaaggagccacgtgaat

SEQ ID NO: 3866879 - DNA, 15 bp, Homo sapiens
agtgaataaacttca

SEQ ID NO: 3866880 - DNA, 21 bp, Homo sapiens
agtgaataaacttcagcacca

SEQ ID NO: 3866881 - DNA, 18 bp, Homo sapiens
agtgaataactgcaaagt

SEQ ID NO: 3866882 - DNA, 17 bp, Homo sapiens
agtgacaaattgtaact

SEQ ID NO: 3866883 - DNA, 16 bp, Homo sapiens
agtgacaagtggaggg

SEQ ID NO: 3866884 - DNA, 17 bp, Homo sapiens
agtgacaagtggagggg

SEQ ID NO: 3866885 - DNA, 16 bp, Homo sapiens
agtgacgggagcctcc

SEQ ID NO: 3866886 - DNA, 16 bp, Homo sapiens
agtgactccaagaaca

SEQ ID NO: 3866887 - DNA, 15 bp, Homo sapiens
agtgactcggtgtaa

SEQ ID NO: 3866888 - DNA, 17 bp, Homo sapiens
agtgactcggtgtaaaa

SEQ ID NO: 3866889 - DNA, 20 bp, Homo sapiens
agtgactcggtgtaaaacca

SEQ ID NO: 3866890 - DNA, 21 bp, Homo sapiens
agtgactcggtgtaaaaccat

SEQ ID NO: 3866891 - DNA, 19 bp, Homo sapiens
agtgactgtcgtgtttaca

SEQ ID NO: 3866892 - DNA, 13 bp, Homo sapiens
agtgacttcctgg

SEQ ID NO: 3866893 - DNA, 18 bp, Homo sapiens
agtgacttcctggtgagg

SEQ ID NO: 3866894 - DNA, 17 bp, Homo sapiens
agtgactttacaggagg

SEQ ID NO: 3866895 - DNA, 18 bp, Homo sapiens
agtgactttacaggaggt

SEQ ID NO: 3866896 - DNA, 19 bp, Homo sapiens
agtgactttttctgagctt

SEQ ID NO: 3866897 - DNA, 14 bp, Homo sapiens
agtgagaaaaagct

SEQ ID NO: 3866898 - DNA, 19 bp, Homo sapiens
agtgagaaaaagctcctgt

SEQ ID NO: 3866899 - DNA, 22 bp, Homo sapiens
agtgagaaaaagctcctgtcct

SEQ ID NO: 3866900 - DNA, 15 bp, Homo sapiens
agtgagacacagagt

SEQ ID NO: 3866901 - DNA, 13 bp, Homo sapiens
agtgagacagaag

SEQ ID NO: 3866902 - DNA, 22 bp, Homo sapiens
agtgagccgcatcttctccatc

SEQ ID NO: 3866903 - DNA, 24 bp, Homo sapiens
agtgagccgcatcttctccatctg

SEQ ID NO: 3866904 - DNA, 11 bp, Homo sapiens
agtgagcctga

SEQ ID NO: 3866905 - DNA, 12 bp, Homo sapiens
agtgaggagggt

SEQ ID NO: 3866906 - DNA, 14 bp, Homo sapiens
agtgaggcttccag

SEQ ID NO: 3866907 - DNA, 17 bp, Homo sapiens
agtgaggcttccaggct

SEQ ID NO: 3866908 - DNA, 18 bp, Homo sapiens
agtgaggcttccaggctc

SEQ ID NO: 3866909 - DNA, 15 bp, Homo sapiens
agtgagggctgggca

SEQ ID NO: 3866910 - DNA, 18 bp, Homo sapiens
agtgagttgttgccctgg

SEQ ID NO: 3866911 - DNA, 22 bp, Homo sapiens
agtgatatatgtatttattgtc

SEQ ID NO: 3866912 - DNA, 23 bp, Homo sapiens
agtgatggcgcgggaggcaccag

SEQ ID NO: 3866913 - DNA, 19 bp, Homo sapiens
agtgatgtgctggagctgg

SEQ ID NO: 3866914 - DNA, 22 bp, Homo sapiens
agtgatgtgctggagctggctt

SEQ ID NO: 3866915 - DNA, 20 bp, Homo sapiens
agtgatgttgtttgggagag

SEQ ID NO: 3866916 - DNA, 18 bp, Homo sapiens
agtgcaaagtgccctcat

SEQ ID NO: 3866917 - DNA, 18 bp, Homo sapiens
agtgcaaccacacacctc

SEQ ID NO: 3866918 - DNA, 14 bp, Homo sapiens
agtgcaatgcgtgt

SEQ ID NO: 3866919 - DNA, 19 bp, Homo sapiens
agtgcaatgcgtgttgtac

SEQ ID NO: 3866920 - DNA, 21 bp, Homo sapiens
agtgcaatttcccctctgtgt

SEQ ID NO: 3866921 - DNA, 17 bp, Homo sapiens
agtgcacacagaaatat

SEQ ID NO: 3866922 - DNA, 14 bp, Homo sapiens
agtgcagcccttcc

SEQ ID NO: 3866923 - DNA, 20 bp, Homo sapiens
agtgcatgctctctgcagcc

SEQ ID NO: 3866924 - DNA, 15 bp, Homo sapiens
agtgccaagtttgtt

SEQ ID NO: 3866925 - DNA, 18 bp, Homo sapiens
agtgccacttgacattcc

SEQ ID NO: 3866926 - DNA, 19 bp, Homo sapiens
agtgccaggactccccagg

SEQ ID NO: 3866927 - DNA, 19 bp, Homo sapiens
agtgcccgcctaggagttg

SEQ ID NO: 3866928 - DNA, 14 bp, Homo sapiens
agtgcctcctggcc

SEQ ID NO: 3866929 - DNA, 13 bp, Homo sapiens
agtgcctcgaggc

SEQ ID NO: 3866930 - DNA, 14 bp, Homo sapiens
agtgcctcgaggca

SEQ ID NO: 3866931 - DNA, 15 bp, Homo sapiens
agtgcctcgaggcac

SEQ ID NO: 3866932 - DNA, 13 bp, Homo sapiens
agtgcctcttgtt

SEQ ID NO: 3866933 - DNA, 16 bp, Homo sapiens
agtgccttacctcctg

SEQ ID NO: 3866934 - DNA, 17 bp, Homo sapiens
agtgccttacctcctgc

SEQ ID NO: 3866935 - DNA, 21 bp, Homo sapiens
agtgccttacctcctgcccag

SEQ ID NO: 3866936 - DNA, 23 bp, Homo sapiens
agtgccttacctcctgcccagga

SEQ ID NO: 3866937 - DNA, 22 bp, Homo sapiens
agtgcgctcattttaggcctcc

SEQ ID NO: 3866938 - DNA, 21 bp, Homo sapiens
agtgcgctcttggtccctggt

SEQ ID NO: 3866939 - DNA, 13 bp, Homo sapiens
agtgctatatata

SEQ ID NO: 3866940 - DNA, 16 bp, Homo sapiens
agtgctatatatataa

SEQ ID NO: 3866941 - DNA, 17 bp, Homo sapiens
agtgctatatatataaa

SEQ ID NO: 3866942 - DNA, 19 bp, Homo sapiens
agtgctatatatataaata

SEQ ID NO: 3866943 - DNA, 22 bp, Homo sapiens
agtgctatatatataaatattt

SEQ ID NO: 3866944 - DNA, 16 bp, Homo sapiens
agtgctgccatgccac

SEQ ID NO: 3866945 - DNA, 13 bp, Homo sapiens
agtgctgccctgc

SEQ ID NO: 3866946 - DNA, 22 bp, Homo sapiens
agtgctgccctgcgaagtggct

SEQ ID NO: 3866947 - DNA, 15 bp, Homo sapiens
agtgctgcttctctt

SEQ ID NO: 3866948 - DNA, 20 bp, Homo sapiens
agtgctgggattacaggcat

SEQ ID NO: 3866949 - DNA, 22 bp, Homo sapiens
agtgctgggattacaggcatga

SEQ ID NO: 3866950 - DNA, 17 bp, Homo sapiens
agtgctgtacccttcca

SEQ ID NO: 3866951 - DNA, 22 bp, Homo sapiens
agtgctgtacccttccacctcc

SEQ ID NO: 3866952 - DNA, 13 bp, Homo sapiens
agtgcttagaaag

SEQ ID NO: 3866953 - DNA, 16 bp, Homo sapiens
agtgcttagaaagtta

SEQ ID NO: 3866954 - DNA, 20 bp, Homo sapiens
agtgcttagaaagttattgt

SEQ ID NO: 3866955 - DNA, 12 bp, Homo sapiens
agtggaaaaaag

SEQ ID NO: 3866956 - DNA, 16 bp, Homo sapiens
agtggaaattttctac

SEQ ID NO: 3866957 - DNA, 17 bp, Homo sapiens
agtggaagagcagcctg

SEQ ID NO: 3866958 - DNA, 19 bp, Homo sapiens
agtggaagagcagcctgat

SEQ ID NO: 3866959 - DNA, 22 bp, Homo sapiens
agtggaagagcagcctgatggc

SEQ ID NO: 3866960 - DNA, 17 bp, Homo sapiens
agtggaatacagtgagt

SEQ ID NO: 3866961 - DNA, 15 bp, Homo sapiens
agtggaatgcaggga

SEQ ID NO: 3866962 - DNA, 18 bp, Homo sapiens
agtggagagtgttcctgt

SEQ ID NO: 3866963 - DNA, 13 bp, Homo sapiens
agtggagccctca

SEQ ID NO: 3866964 - DNA, 18 bp, Homo sapiens
agtggagtctgagtctga

SEQ ID NO: 3866965 - DNA, 19 bp, Homo sapiens
agtggagtctgagtctgag

SEQ ID NO: 3866966 - DNA, 23 bp, Homo sapiens
agtggatctccaaggaccaggtt

SEQ ID NO: 3866967 - DNA, 17 bp, Homo sapiens
agtggatggatggacag

SEQ ID NO: 3866968 - DNA, 19 bp, Homo sapiens
agtggatggatggacagaa

SEQ ID NO: 3866969 - DNA, 12 bp, Homo sapiens
agtggcagccat

SEQ ID NO: 3866970 - DNA, 14 bp, Homo sapiens
agtggcagccatgc

SEQ ID NO: 3866971 - DNA, 15 bp, Homo sapiens
agtggcagccatgcc

SEQ ID NO: 3866972 - DNA, 16 bp, Homo sapiens
agtggcagccatgcct

SEQ ID NO: 3866973 - DNA, 17 bp, Homo sapiens
agtggcagccatgcctc

SEQ ID NO: 3866974 - DNA, 20 bp, Homo sapiens
agtggcagtgaaaaatatgt

SEQ ID NO: 3866975 - DNA, 18 bp, Homo sapiens
agtggcccctcacctggg

SEQ ID NO: 3866976 - DNA, 22 bp, Homo sapiens
agtggcccctcacctgggcctt

SEQ ID NO: 3866977 - DNA, 20 bp, Homo sapiens
agtggccgcaagcgcaggga

SEQ ID NO: 3866978 - DNA, 23 bp, Homo sapiens
agtggccgcaagcgcagggagga

SEQ ID NO: 3866979 - DNA, 16 bp, Homo sapiens
agtggcgagaggagag

SEQ ID NO: 3866980 - DNA, 23 bp, Homo sapiens
agtggctcttctaacctcagcca

SEQ ID NO: 3866981 - DNA, 14 bp, Homo sapiens
agtggctgctgact

SEQ ID NO: 3866982 - DNA, 21 bp, Homo sapiens
agtggcttgtgattctgggat

SEQ ID NO: 3866983 - DNA, 15 bp, Homo sapiens
agtgggaagtgaatc

SEQ ID NO: 3866984 - DNA, 12 bp, Homo sapiens
agtgggagaaaa

SEQ ID NO: 3866985 - DNA, 13 bp, Homo sapiens
agtgggagaaaac

SEQ ID NO: 3866986 - DNA, 18 bp, Homo sapiens
agtggggtaattctgctt

SEQ ID NO: 3866987 - DNA, 19 bp, Homo sapiens
agtggggtctccctctcct

SEQ ID NO: 3866988 - DNA, 22 bp, Homo sapiens
agtggggtctccctctcctgcc

SEQ ID NO: 3866989 - DNA, 22 bp, Homo sapiens
agtggggttgcaaccactgcaa

SEQ ID NO: 3866990 - DNA, 14 bp, Homo sapiens
agtgggtggcacct

SEQ ID NO: 3866991 - DNA, 15 bp, Homo sapiens
agtgggtggcacctc

SEQ ID NO: 3866992 - DNA, 21 bp, Homo sapiens
agtgggttcactagagctggg

SEQ ID NO: 3866993 - DNA, 16 bp, Homo sapiens
agtggtaagctctggc

SEQ ID NO: 3866994 - DNA, 19 bp, Homo sapiens
agtggtaagctctggcttt

SEQ ID NO: 3866995 - DNA, 20 bp, Homo sapiens
agtggtctttcctatcatgg

SEQ ID NO: 3866996 - DNA, 15 bp, Homo sapiens
agtggttctggatat

SEQ ID NO: 3866997 - DNA, 11 bp, Homo sapiens
agtgtaaaata

SEQ ID NO: 3866998 - DNA, 13 bp, Homo sapiens
agtgtaaaataga

SEQ ID NO: 3866999 - DNA, 18 bp, Homo sapiens
agtgtaaagaataaatga

SEQ ID NO: 3867000 - DNA, 19 bp, Homo sapiens
agtgtaaagaataaatgaa

SEQ ID NO: 3867001 - DNA, 22 bp, Homo sapiens
agtgtaaagaataaatgaatct

SEQ ID NO: 3867002 - DNA, 21 bp, Homo sapiens
agtgtaaatcctttttcttta

SEQ ID NO: 3867003 - DNA, 15 bp, Homo sapiens
agtgtaataatatga

SEQ ID NO: 3867004 - DNA, 23 bp, Homo sapiens
agtgtaccgcgtctaccctggga

SEQ ID NO: 3867005 - DNA, 14 bp, Homo sapiens
agtgtatatcagaa

SEQ ID NO: 3867006 - DNA, 21 bp, Homo sapiens
agtgtatggaaataaatgtat

SEQ ID NO: 3867007 - DNA, 13 bp, Homo sapiens
agtgtcccctcca

SEQ ID NO: 3867008 - DNA, 19 bp, Homo sapiens
agtgtcccctccactgtca

SEQ ID NO: 3867009 - DNA, 15 bp, Homo sapiens
agtgtcttaattaaa

SEQ ID NO: 3867010 - DNA, 16 bp, Homo sapiens
agtgtgagcagtgagt

SEQ ID NO: 3867011 - DNA, 14 bp, Homo sapiens
agtgtgcagactga

SEQ ID NO: 3867012 - DNA, 13 bp, Homo sapiens
agtgtggagaggg

SEQ ID NO: 3867013 - DNA, 21 bp, Homo sapiens
agtgtggagaggggtgcaccc

SEQ ID NO: 3867014 - DNA, 19 bp, Homo sapiens
agtgtgggtgatcagaagg

SEQ ID NO: 3867015 - DNA, 18 bp, Homo sapiens
agtgtgtgtgcatgtgtg

SEQ ID NO: 3867016 - DNA, 17 bp, Homo sapiens
agtgttccagctgcctg

SEQ ID NO: 3867017 - DNA, 16 bp, Homo sapiens
agtgttcctatttggg

SEQ ID NO: 3867018 - DNA, 14 bp, Homo sapiens
agtgttggctgtgt

SEQ ID NO: 3867019 - DNA, 19 bp, Homo sapiens
agtgtttcgacagctgatt

SEQ ID NO: 3867020 - DNA, 19 bp, Homo sapiens
agttaacattaacatctat

SEQ ID NO: 3867021 - DNA, 14 bp, Homo sapiens
agttaagagtagca

SEQ ID NO: 3867022 - DNA, 19 bp, Homo sapiens
agttaaggaccgtggccct

SEQ ID NO: 3867023 - DNA, 21 bp, Homo sapiens
agttaatggggtagaggaggg

SEQ ID NO: 3867024 - DNA, 16 bp, Homo sapiens
agttacattaatgtta

SEQ ID NO: 3867025 - DNA, 13 bp, Homo sapiens
agttacggaggga

SEQ ID NO: 3867026 - DNA, 18 bp, Homo sapiens
agttactcagccctgggc

SEQ ID NO: 3867027 - DNA, 23 bp, Homo sapiens
agttactcagccctgggccccac

SEQ ID NO: 3867028 - DNA, 17 bp, Homo sapiens
agttacttgtctgaggc

SEQ ID NO: 3867029 - DNA, 18 bp, Homo sapiens
agttacttgtctgaggcc

SEQ ID NO: 3867030 - DNA, 19 bp, Homo sapiens
agttacttgtctgaggcct

SEQ ID NO: 3867031 - DNA, 12 bp, Homo sapiens
agttagccctca

SEQ ID NO: 3867032 - DNA, 14 bp, Homo sapiens
agttagccctcagt

SEQ ID NO: 3867033 - DNA, 12 bp, Homo sapiens
agttaggaaata

SEQ ID NO: 3867034 - DNA, 20 bp, Homo sapiens
agttaggaaataaaaccttt

SEQ ID NO: 3867035 - DNA, 13 bp, Homo sapiens
agttatagtttca

SEQ ID NO: 3867036 - DNA, 18 bp, Homo sapiens
agttatattgaatatatc

SEQ ID NO: 3867037 - DNA, 14 bp, Homo sapiens
agttatgttaaaat

SEQ ID NO: 3867038 - DNA, 13 bp, Homo sapiens
agttattgtacag

SEQ ID NO: 3867039 - DNA, 21 bp, Homo sapiens
agttattgtacagctgtttaa

SEQ ID NO: 3867040 - DNA, 19 bp, Homo sapiens
agttattgttttatgttct

SEQ ID NO: 3867041 - DNA, 17 bp, Homo sapiens
agttatttacttgaaag

SEQ ID NO: 3867042 - DNA, 19 bp, Homo sapiens
agttattttaattatcttt

SEQ ID NO: 3867043 - DNA, 18 bp, Homo sapiens
agttattttaggagacag

SEQ ID NO: 3867044 - DNA, 20 bp, Homo sapiens
agttattttaggagacagtc

SEQ ID NO: 3867045 - DNA, 18 bp, Homo sapiens
agttcaaattttgcattg

SEQ ID NO: 3867046 - DNA, 22 bp, Homo sapiens
agttcaacctggtggcaccaga

SEQ ID NO: 3867047 - DNA, 20 bp, Homo sapiens
agttcaagaccagcctggcc

SEQ ID NO: 3867048 - DNA, 16 bp, Homo sapiens
agttcagggaagcagg

SEQ ID NO: 3867049 - DNA, 17 bp, Homo sapiens
agttcagggaagcaggc

SEQ ID NO: 3867050 - DNA, 24 bp, Homo sapiens
agttcagttcctctttgcatggaa

SEQ ID NO: 3867051 - DNA, 17 bp, Homo sapiens
agttcatggtgatcagt

SEQ ID NO: 3867052 - DNA, 19 bp, Homo sapiens
agttcccggagcacagccc

SEQ ID NO: 3867053 - DNA, 22 bp, Homo sapiens
agttcccggagcacagccctgg

SEQ ID NO: 3867054 - DNA, 14 bp, Homo sapiens
agttccctgaaaac

SEQ ID NO: 3867055 - DNA, 19 bp, Homo sapiens
agttccctgaaaacccaga

SEQ ID NO: 3867056 - DNA, 21 bp, Homo sapiens
agttccctgaaaacccagaga

SEQ ID NO: 3867057 - DNA, 13 bp, Homo sapiens
agttcctcgccct

SEQ ID NO: 3867058 - DNA, 14 bp, Homo sapiens
agttcctcgccctg

SEQ ID NO: 3867059 - DNA, 15 bp, Homo sapiens
agttcctctttgcat

SEQ ID NO: 3867060 - DNA, 21 bp, Homo sapiens
agttcctctttgcatggaatt

SEQ ID NO: 3867061 - DNA, 20 bp, Homo sapiens
agttcctgagtaccttctac

SEQ ID NO: 3867062 - DNA, 19 bp, Homo sapiens
agttcctgttcaccttatg

SEQ ID NO: 3867063 - DNA, 20 bp, Homo sapiens
agttcgtggctgcaaaagaa

SEQ ID NO: 3867064 - DNA, 17 bp, Homo sapiens
agttctacaagcatatt

SEQ ID NO: 3867065 - DNA, 18 bp, Homo sapiens
agttctacaagcatattt

SEQ ID NO: 3867066 - DNA, 14 bp, Homo sapiens
agttctagagaaga

SEQ ID NO: 3867067 - DNA, 15 bp, Homo sapiens
agttctcaatgtgaa

SEQ ID NO: 3867068 - DNA, 23 bp, Homo sapiens
agttctcaattattggcctgcta

SEQ ID NO: 3867069 - DNA, 19 bp, Homo sapiens
agttctgaactggaacatg

SEQ ID NO: 3867070 - DNA, 14 bp, Homo sapiens
agttctgagtgttt

SEQ ID NO: 3867071 - DNA, 12 bp, Homo sapiens
agttctgctcct

SEQ ID NO: 3867072 - DNA, 16 bp, Homo sapiens
agttctgctcctctcc

SEQ ID NO: 3867073 - DNA, 22 bp, Homo sapiens
agttcttaaggattgtgatatt

SEQ ID NO: 3867074 - DNA, 13 bp, Homo sapiens
agttcttctccaa

SEQ ID NO: 3867075 - DNA, 21 bp, Homo sapiens
agttcttggtgactgtcccac

SEQ ID NO: 3867076 - DNA, 13 bp, Homo sapiens
agttcttgtgcat

SEQ ID NO: 3867077 - DNA, 16 bp, Homo sapiens
agttcttgtgcatgtt

SEQ ID NO: 3867078 - DNA, 18 bp, Homo sapiens
agttcttgtgcatgttta

SEQ ID NO: 3867079 - DNA, 18 bp, Homo sapiens
agttgaaaagactccaaa

SEQ ID NO: 3867080 - DNA, 20 bp, Homo sapiens
agttgaaaatggatttttaa

SEQ ID NO: 3867081 - DNA, 15 bp, Homo sapiens
agttgaatggggcgg

SEQ ID NO: 3867082 - DNA, 13 bp, Homo sapiens
agttgacagcagg

SEQ ID NO: 3867083 - DNA, 16 bp, Homo sapiens
agttgaccgttttcat

SEQ ID NO: 3867084 - DNA, 19 bp, Homo sapiens
agttgaccgttttcatcct

SEQ ID NO: 3867085 - DNA, 20 bp, Homo sapiens
agttgagtacagtgaggagg

SEQ ID NO: 3867086 - DNA, 18 bp, Homo sapiens
agttgcaataaaatagta

SEQ ID NO: 3867087 - DNA, 13 bp, Homo sapiens
agttgcagtctca

SEQ ID NO: 3867088 - DNA, 17 bp, Homo sapiens
agttgctcactcaggac

SEQ ID NO: 3867089 - DNA, 14 bp, Homo sapiens
agttgctgtcataa

SEQ ID NO: 3867090 - DNA, 20 bp, Homo sapiens
agttggcagagaaggcctct

SEQ ID NO: 3867091 - DNA, 20 bp, Homo sapiens
agttgtacgtaatgtattta

SEQ ID NO: 3867092 - DNA, 20 bp, Homo sapiens
agttgtccatattttcacag

SEQ ID NO: 3867093 - DNA, 13 bp, Homo sapiens
agttgtcttgtcc

SEQ ID NO: 3867094 - DNA, 18 bp, Homo sapiens
agttgtgccttttatagc

SEQ ID NO: 3867095 - DNA, 15 bp, Homo sapiens
agttgttcacatata

SEQ ID NO: 3867096 - DNA, 19 bp, Homo sapiens
agttgttttcagactcaga

SEQ ID NO: 3867097 - DNA, 16 bp, Homo sapiens
agtttacaagtgtata

SEQ ID NO: 3867098 - DNA, 21 bp, Homo sapiens
agtttacaagtgtatatcaga

SEQ ID NO: 3867099 - DNA, 16 bp, Homo sapiens
agtttacagtaaataa

SEQ ID NO: 3867100 - DNA, 18 bp, Homo sapiens
agtttacttcctaaattt

SEQ ID NO: 3867101 - DNA, 16 bp, Homo sapiens
agtttagaagcgctca

SEQ ID NO: 3867102 - DNA, 19 bp, Homo sapiens
agtttagaggaaaaaaatg

SEQ ID NO: 3867103 - DNA, 21 bp, Homo sapiens
agtttagaggaaaaaaatgac

SEQ ID NO: 3867104 - DNA, 14 bp, Homo sapiens
agtttagatttcaa

SEQ ID NO: 3867105 - DNA, 21 bp, Homo sapiens
agtttagatttcaagaaaaaa

SEQ ID NO: 3867106 - DNA, 15 bp, Homo sapiens
agtttatgtctaaag

SEQ ID NO: 3867107 - DNA, 16 bp, Homo sapiens
agtttatgtctaaaga

SEQ ID NO: 3867108 - DNA, 15 bp, Homo sapiens
agtttattggaagtg

SEQ ID NO: 3867109 - DNA, 17 bp, Homo sapiens
agtttattttttctaca

SEQ ID NO: 3867110 - DNA, 19 bp, Homo sapiens
agtttattttttctacaca

SEQ ID NO: 3867111 - DNA, 14 bp, Homo sapiens
agtttcagatatat

SEQ ID NO: 3867112 - DNA, 17 bp, Homo sapiens
agtttcattctcctgcc

SEQ ID NO: 3867113 - DNA, 20 bp, Homo sapiens
agtttcattctcctgcctgt

SEQ ID NO: 3867114 - DNA, 15 bp, Homo sapiens
agtttctagaggcct

SEQ ID NO: 3867115 - DNA, 17 bp, Homo sapiens
agtttctagaggcctca

SEQ ID NO: 3867116 - DNA, 18 bp, Homo sapiens
agtttctagaggcctcag

SEQ ID NO: 3867117 - DNA, 21 bp, Homo sapiens
agtttctagctagaaatatga

SEQ ID NO: 3867118 - DNA, 22 bp, Homo sapiens
agtttctgattcactattagag

SEQ ID NO: 3867119 - DNA, 23 bp, Homo sapiens
agtttctggagcaagagagagct

SEQ ID NO: 3867120 - DNA, 23 bp, Homo sapiens
agtttgagacaagccctggcaac

SEQ ID NO: 3867121 - DNA, 17 bp, Homo sapiens
agtttgatattaaagga

SEQ ID NO: 3867122 - DNA, 21 bp, Homo sapiens
agtttgcagaaaagcacctgc

SEQ ID NO: 3867123 - DNA, 23 bp, Homo sapiens
agtttgcagaaaagcacctgccg

SEQ ID NO: 3867124 - DNA, 18 bp, Homo sapiens
agtttgtacatgcattca

SEQ ID NO: 3867125 - DNA, 15 bp, Homo sapiens
agttttataaaactc

SEQ ID NO: 3867126 - DNA, 20 bp, Homo sapiens
agttttatggcatgatttat

SEQ ID NO: 3867127 - DNA, 15 bp, Homo sapiens
agaggcggaaacctt

SEQ ID NO: 3867128 - DNA, 20 bp, Homo sapiens
agaggcggaaaccttgcagc

SEQ ID NO: 3867129 - DNA, 12 bp, Homo sapiens
agaggcggcctc

SEQ ID NO: 3867130 - DNA, 16 bp, Homo sapiens
agaggcggcctcgtgc

SEQ ID NO: 3867131 - DNA, 13 bp, Homo sapiens
agaggctgcagaa

SEQ ID NO: 3867132 - DNA, 21 bp, Homo sapiens
agaggctgcagaaggccaaga

SEQ ID NO: 3867133 - DNA, 17 bp, Homo sapiens
agaggctggaggcaggg

SEQ ID NO: 3867134 - DNA, 16 bp, Homo sapiens
agaggctggtgctgtg

SEQ ID NO: 3867135 - DNA, 21 bp, Homo sapiens
agaggctggtgctgtggccag

SEQ ID NO: 3867136 - DNA, 22 bp, Homo sapiens
agaggctggtgctgtggccagg

SEQ ID NO: 3867137 - DNA, 17 bp, Homo sapiens
agagggaatggatgggg

SEQ ID NO: 3867138 - DNA, 19 bp, Homo sapiens
agagggaatgttccctgca

SEQ ID NO: 3867139 - DNA, 23 bp, Homo sapiens
agagggcatgcgcacaaggctga

SEQ ID NO: 3867140 - DNA, 19 bp, Homo sapiens
agagggccaagagagacat

SEQ ID NO: 3867141 - DNA, 13 bp, Homo sapiens
agagggcccagct

SEQ ID NO: 3867142 - DNA, 16 bp, Homo sapiens
agagggcccagctgta

SEQ ID NO: 3867143 - DNA, 16 bp, Homo sapiens
agagggcctgtgggag

SEQ ID NO: 3867144 - DNA, 21 bp, Homo sapiens
agagggctgttggacagctgc

SEQ ID NO: 3867145 - DNA, 14 bp, Homo sapiens
agaggggcagccgc

SEQ ID NO: 3867146 - DNA, 15 bp, Homo sapiens
agaggggcagccgct

SEQ ID NO: 3867147 - DNA, 12 bp, Homo sapiens
agaggggcaggg

SEQ ID NO: 3867148 - DNA, 17 bp, Homo sapiens
agaggggcaggggagtg

SEQ ID NO: 3867149 - DNA, 12 bp, Homo sapiens
agaggggcctgg

SEQ ID NO: 3867150 - DNA, 17 bp, Homo sapiens
agaggggcctgggaaag

SEQ ID NO: 3867151 - DNA, 22 bp, Homo sapiens
agaggggcctgggaaaggaaaa

SEQ ID NO: 3867152 - DNA, 19 bp, Homo sapiens
agaggggtacatttccctg

SEQ ID NO: 3867153 - DNA, 16 bp, Homo sapiens
agaggggtgcacccac

SEQ ID NO: 3867154 - DNA, 23 bp, Homo sapiens
agaggggtgcacccactcaccag

SEQ ID NO: 3867155 - DNA, 22 bp, Homo sapiens
agagggtctggagaagcagtga

SEQ ID NO: 3867156 - DNA, 20 bp, Homo sapiens
agaggtaaaagtgtgagcag

SEQ ID NO: 3867157 - DNA, 15 bp, Homo sapiens
agaggtagcgagctg

SEQ ID NO: 3867158 - DNA, 17 bp, Homo sapiens
agaggtatttatcttta

SEQ ID NO: 3867159 - DNA, 22 bp, Homo sapiens
agaggtctccatcatggcagtg

SEQ ID NO: 3867160 - DNA, 20 bp, Homo sapiens
agaggtgacccaatgctcct

SEQ ID NO: 3867161 - DNA, 18 bp, Homo sapiens
agaggtgaccccagggca

SEQ ID NO: 3867162 - DNA, 13 bp, Homo sapiens
agaggtggccaga

SEQ ID NO: 3867163 - DNA, 13 bp, Homo sapiens
agaggtggggagg

SEQ ID NO: 3867164 - DNA, 15 bp, Homo sapiens
agaggttctggggag

SEQ ID NO: 3867165 - DNA, 16 bp, Homo sapiens
agaggttctggggagg

SEQ ID NO: 3867166 - DNA, 20 bp, Homo sapiens
agaggttctggggaggaagg

SEQ ID NO: 3867167 - DNA, 21 bp, Homo sapiens
agaggttctggggaggaaggg

SEQ ID NO: 3867168 - DNA, 14 bp, Homo sapiens
agaggtttcttgaa

SEQ ID NO: 3867169 - DNA, 19 bp, Homo sapiens
agagtacagtgagccaaga

SEQ ID NO: 3867170 - DNA, 22 bp, Homo sapiens
agagtagatggtgaaatttatt

SEQ ID NO: 3867171 - DNA, 22 bp, Homo sapiens
agagtagcaagttctagagaag

SEQ ID NO: 3867172 - DNA, 23 bp, Homo sapiens
agagtagcaagttctagagaaga

SEQ ID NO: 3867173 - DNA, 17 bp, Homo sapiens
agagtagccgagagcct

SEQ ID NO: 3867174 - DNA, 19 bp, Homo sapiens
agagtagccgagagcctgc

SEQ ID NO: 3867175 - DNA, 22 bp, Homo sapiens
agagtagccgagagcctgctcc

SEQ ID NO: 3867176 - DNA, 23 bp, Homo sapiens
agagtagccgagagcctgctccc

SEQ ID NO: 3867177 - DNA, 15 bp, Homo sapiens
agagtataggatgga

SEQ ID NO: 3867178 - DNA, 23 bp, Homo sapiens
agagtataggatggattgcagtc

SEQ ID NO: 3867179 - DNA, 12 bp, Homo sapiens
agagtcctttgg

SEQ ID NO: 3867180 - DNA, 14 bp, Homo sapiens
agagtctgagcccc

SEQ ID NO: 3867181 - DNA, 15 bp, Homo sapiens
agagtctgagccccc

SEQ ID NO: 3867182 - DNA, 14 bp, Homo sapiens
agagtgaaagggct

SEQ ID NO: 3867183 - DNA, 20 bp, Homo sapiens
agagtgaaataattaaaaac

SEQ ID NO: 3867184 - DNA, 19 bp, Homo sapiens
agagtgagactcgtctcaa

SEQ ID NO: 3867185 - DNA, 20 bp, Homo sapiens
agagtgagactcgtctcaaa

SEQ ID NO: 3867186 - DNA, 21 bp, Homo sapiens
agagtgagagggcatgcgcac

SEQ ID NO: 3867187 - DNA, 13 bp, Homo sapiens
agagtggctcctc

SEQ ID NO: 3867188 - DNA, 23 bp, Homo sapiens
agagtggctcctcccggtgccca

SEQ ID NO: 3867189 - DNA, 16 bp, Homo sapiens
agagtgtgcagactga

SEQ ID NO: 3867190 - DNA, 16 bp, Homo sapiens
agagttcaagcctgtg

SEQ ID NO: 3867191 - DNA, 17 bp, Homo sapiens
agagttccacaaatcta

SEQ ID NO: 3867192 - DNA, 22 bp, Homo sapiens
agagtttaactttgggcccaga

SEQ ID NO: 3867193 - DNA, 14 bp, Homo sapiens
agataaagacagct

SEQ ID NO: 3867194 - DNA, 18 bp, Homo sapiens
agataacaagatctttca

SEQ ID NO: 3867195 - DNA, 16 bp, Homo sapiens
agataatgtatataaa

SEQ ID NO: 3867196 - DNA, 19 bp, Homo sapiens
agatacagccccaaaccag

SEQ ID NO: 3867197 - DNA, 16 bp, Homo sapiens
agatacatagatggac

SEQ ID NO: 3867198 - DNA, 19 bp, Homo sapiens
agataccatactcatttct

SEQ ID NO: 3867199 - DNA, 22 bp, Homo sapiens
agatacggttgcttcaccttgg

SEQ ID NO: 3867200 - DNA, 23 bp, Homo sapiens
agatagacagtgctgccctgcga

SEQ ID NO: 3867201 - DNA, 15 bp, Homo sapiens
agatagccagacaca

SEQ ID NO: 3867202 - DNA, 22 bp, Homo sapiens
agataggtttgagttcaaattt

SEQ ID NO: 3867203 - DNA, 18 bp, Homo sapiens
agatagttaaaagactgc

SEQ ID NO: 3867204 - DNA, 17 bp, Homo sapiens
agatataaatggctggt

SEQ ID NO: 3867205 - DNA, 23 bp, Homo sapiens
agatatatatttactaaaagaat

SEQ ID NO: 3867206 - DNA, 16 bp, Homo sapiens
agatatcagagctctt

SEQ ID NO: 3867207 - DNA, 17 bp, Homo sapiens
agatatgatatgtaaac

SEQ ID NO: 3867208 - DNA, 11 bp, Homo sapiens
agatatgcaca

SEQ ID NO: 3867209 - DNA, 19 bp, Homo sapiens
agatatgcacacacagatg

SEQ ID NO: 3867210 - DNA, 16 bp, Homo sapiens
agatattatttaaatg

SEQ ID NO: 3867211 - DNA, 13 bp, Homo sapiens
agatatttatata

SEQ ID NO: 3867212 - DNA, 16 bp, Homo sapiens
agatcaccagcccggc

SEQ ID NO: 3867213 - DNA, 18 bp, Homo sapiens
agttttctgagaaagact

SEQ ID NO: 3867214 - DNA, 16 bp, Homo sapiens
agttttctttgtaaag

SEQ ID NO: 3867215 - DNA, 14 bp, Homo sapiens
agttttgaaagaaa

SEQ ID NO: 3867216 - DNA, 15 bp, Homo sapiens
agttttgatgaaatt

SEQ ID NO: 3867217 - DNA, 21 bp, Homo sapiens
agttttgatgaaattcttgaa

SEQ ID NO: 3867218 - DNA, 11 bp, Homo sapiens
agttttgtata

SEQ ID NO: 3867219 - DNA, 17 bp, Homo sapiens
agttttgtataaataat

SEQ ID NO: 3867220 - DNA, 20 bp, Homo sapiens
agttttgtataaataataaa

SEQ ID NO: 3867221 - DNA, 14 bp, Homo sapiens
agtttttagtttgt

SEQ ID NO: 3867222 - DNA, 14 bp, Homo sapiens
agttttttttgtaa

SEQ ID NO: 3867223 - DNA, 17 bp, Homo sapiens
ataaaaaaacaatcatt

SEQ ID NO: 3867224 - DNA, 16 bp, Homo sapiens
ataaaaaaatacagta

SEQ ID NO: 3867225 - DNA, 17 bp, Homo sapiens
ataaaaaaatacagtaa

SEQ ID NO: 3867226 - DNA, 16 bp, Homo sapiens
ataaaaacataaaata

SEQ ID NO: 3867227 - DNA, 17 bp, Homo sapiens
ataaaaaccagaatcat

SEQ ID NO: 3867228 - DNA, 21 bp, Homo sapiens
ataaaaagactattaagagca

SEQ ID NO: 3867229 - DNA, 18 bp, Homo sapiens
ataaaaataatatatgct

SEQ ID NO: 3867230 - DNA, 15 bp, Homo sapiens
ataaaaataccttaa

SEQ ID NO: 3867231 - DNA, 13 bp, Homo sapiens
ataaaacctttca

SEQ ID NO: 3867232 - DNA, 17 bp, Homo sapiens
ataaaactaaatatatg

SEQ ID NO: 3867233 - DNA, 19 bp, Homo sapiens
ataaaatatacaaacatgt

SEQ ID NO: 3867234 - DNA, 14 bp, Homo sapiens
ataaaatatcctca

SEQ ID NO: 3867235 - DNA, 11 bp, Homo sapiens
ataaaatctgt

SEQ ID NO: 3867236 - DNA, 16 bp, Homo sapiens
ataaaattagaaagca

SEQ ID NO: 3867237 - DNA, 15 bp, Homo sapiens
ataaaattatggtga

SEQ ID NO: 3867238 - DNA, 11 bp, Homo sapiens
ataaaattgta

SEQ ID NO: 3867239 - DNA, 21 bp, Homo sapiens
ataaaattgtaaaattgtata

SEQ ID NO: 3867240 - DNA, 23 bp, Homo sapiens
ataaaattgtaaaattgtataga

SEQ ID NO: 3867241 - DNA, 16 bp, Homo sapiens
ataaacatgagcgctg

SEQ ID NO: 3867242 - DNA, 14 bp, Homo sapiens
ataaacattaaaca

SEQ ID NO: 3867243 - DNA, 15 bp, Homo sapiens
ataaacattaaacac

SEQ ID NO: 3867244 - DNA, 15 bp, Homo sapiens
ataaaccaaaggaca

SEQ ID NO: 3867245 - DNA, 14 bp, Homo sapiens
ataaacctggagat

SEQ ID NO: 3867246 - DNA, 15 bp, Homo sapiens
ataaacctggagatg

SEQ ID NO: 3867247 - DNA, 13 bp, Homo sapiens
ataaactactgta

SEQ ID NO: 3867248 - DNA, 15 bp, Homo sapiens
ataaactactgtaat

SEQ ID NO: 3867249 - DNA, 14 bp, Homo sapiens
ataaactagatctc

SEQ ID NO: 3867250 - DNA, 12 bp, Homo sapiens
ataaactagttt

SEQ ID NO: 3867251 - DNA, 22 bp, Homo sapiens
ataaactagtttccagtggatc

SEQ ID NO: 3867252 - DNA, 16 bp, Homo sapiens
ataaactgaaaaatgt

SEQ ID NO: 3867253 - DNA, 17 bp, Homo sapiens
ataaactgaaaaatgtc

SEQ ID NO: 3867254 - DNA, 19 bp, Homo sapiens
ataaactgaaaaatgtcag

SEQ ID NO: 3867255 - DNA, 13 bp, Homo sapiens
ataaacttcagca

SEQ ID NO: 3867256 - DNA, 13 bp, Homo sapiens
ataaacttgtgta

SEQ ID NO: 3867257 - DNA, 16 bp, Homo sapiens
ataaagacttcatgtt

SEQ ID NO: 3867258 - DNA, 15 bp, Homo sapiens
ataaagataaaatat

SEQ ID NO: 3867259 - DNA, 23 bp, Homo sapiens
ataaagatgtcaaatatctcaga

SEQ ID NO: 3867260 - DNA, 14 bp, Homo sapiens
ataaagcaaataga

SEQ ID NO: 3867261 - DNA, 14 bp, Homo sapiens
ataaagcctgcttt

SEQ ID NO: 3867262 - DNA, 23 bp, Homo sapiens
ataaagctggacaagaagctgct

SEQ ID NO: 3867263 - DNA, 23 bp, Homo sapiens
ataaagtactttagcctggtacc

SEQ ID NO: 3867264 - DNA, 19 bp, Homo sapiens
ataaagtcacttccagtgt

SEQ ID NO: 3867265 - DNA, 21 bp, Homo sapiens
ataaagttctgagtgttttta

SEQ ID NO: 3867266 - DNA, 21 bp, Homo sapiens
ataaatagatttgattatttc

SEQ ID NO: 3867267 - DNA, 19 bp, Homo sapiens
ataaatatatatttttcaa

SEQ ID NO: 3867268 - DNA, 15 bp, Homo sapiens
ataaatattctgcat

SEQ ID NO: 3867269 - DNA, 22 bp, Homo sapiens
ataaatgcatgattttatacat

SEQ ID NO: 3867270 - DNA, 23 bp, Homo sapiens
ataaatgcatgattttatacata

SEQ ID NO: 3867271 - DNA, 17 bp, Homo sapiens
ataaatgccaacatacc

SEQ ID NO: 3867272 - DNA, 12 bp, Homo sapiens
ataaatgctgaa

SEQ ID NO: 3867273 - DNA, 18 bp, Homo sapiens
ataaatgctgaatgaatc

SEQ ID NO: 3867274 - DNA, 16 bp, Homo sapiens
ataaatgtatatacac

SEQ ID NO: 3867275 - DNA, 19 bp, Homo sapiens
ataaatgtatatacacata

SEQ ID NO: 3867276 - DNA, 15 bp, Homo sapiens
ataaatgtgtaaatg

SEQ ID NO: 3867277 - DNA, 12 bp, Homo sapiens
ataaatgttcaa

SEQ ID NO: 3867278 - DNA, 13 bp, Homo sapiens
ataaatgttcaaa

SEQ ID NO: 3867279 - DNA, 12 bp, Homo sapiens
ataaatgtttgt

SEQ ID NO: 3867280 - DNA, 15 bp, Homo sapiens
ataaatgtttttatt

SEQ ID NO: 3867281 - DNA, 13 bp, Homo sapiens
ataaattcaaacc

SEQ ID NO: 3867282 - DNA, 14 bp, Homo sapiens
ataaattcaaacca

SEQ ID NO: 3867283 - DNA, 13 bp, Homo sapiens
ataaattcagata

SEQ ID NO: 3867284 - DNA, 16 bp, Homo sapiens
ataaattcagatatat

SEQ ID NO: 3867285 - DNA, 22 bp, Homo sapiens
ataaattgaaatataatgcaaa

SEQ ID NO: 3867286 - DNA, 18 bp, Homo sapiens
ataaattggtgataagtg

SEQ ID NO: 3867287 - DNA, 22 bp, Homo sapiens
ataaattggtgataagtggaaa

SEQ ID NO: 3867288 - DNA, 15 bp, Homo sapiens
ataaattgtttgacc

SEQ ID NO: 3867289 - DNA, 13 bp, Homo sapiens
ataacaaaatcac

SEQ ID NO: 3867290 - DNA, 22 bp, Homo sapiens
ataacaaaatcacaagcaataa

SEQ ID NO: 3867291 - DNA, 23 bp, Homo sapiens
ataacaaaatcacaagcaataat

SEQ ID NO: 3867292 - DNA, 14 bp, Homo sapiens
ataacaacttcata

SEQ ID NO: 3867293 - DNA, 12 bp, Homo sapiens
ataacaagaaaa

SEQ ID NO: 3867294 - DNA, 21 bp, Homo sapiens
ataacaaggttcttctaaaat

SEQ ID NO: 3867295 - DNA, 14 bp, Homo sapiens
ataacaatgtatgt

SEQ ID NO: 3867296 - DNA, 23 bp, Homo sapiens
ataacactataaaggttgacaat

SEQ ID NO: 3867297 - DNA, 22 bp, Homo sapiens
ataacatctttgaaaagaaaaa

SEQ ID NO: 3867298 - DNA, 16 bp, Homo sapiens
ataaccattacatgtt

SEQ ID NO: 3867299 - DNA, 12 bp, Homo sapiens
ataaccccacct

SEQ ID NO: 3867300 - DNA, 17 bp, Homo sapiens
aggtattttaactgtgt

SEQ ID NO: 3867301 - DNA, 14 bp, Homo sapiens
aggtcaacagagaa

SEQ ID NO: 3867302 - DNA, 19 bp, Homo sapiens
aggtcaacagagaaggcag

SEQ ID NO: 3867303 - DNA, 21 bp, Homo sapiens
aggtcaacagagaaggcagga

SEQ ID NO: 3867304 - DNA, 15 bp, Homo sapiens
aggtcacattcagga

SEQ ID NO: 3867305 - DNA, 18 bp, Homo sapiens
aggtcacattcaggaaga

SEQ ID NO: 3867306 - DNA, 21 bp, Homo sapiens
aggtcactcttcctgcaagga

SEQ ID NO: 3867307 - DNA, 23 bp, Homo sapiens
aggtcactcttcctgcaaggact

SEQ ID NO: 3867308 - DNA, 13 bp, Homo sapiens
aggtcactgggtt

SEQ ID NO: 3867309 - DNA, 14 bp, Homo sapiens
aggtcactgggttc

SEQ ID NO: 3867310 - DNA, 22 bp, Homo sapiens
aggtccctcctttggaccctgt

SEQ ID NO: 3867311 - DNA, 20 bp, Homo sapiens
aggtcctctgatacccagag

SEQ ID NO: 3867312 - DNA, 22 bp, Homo sapiens
aggtcctgagcactgccaggag

SEQ ID NO: 3867313 - DNA, 23 bp, Homo sapiens
aggtcctgagcactgccaggagg

SEQ ID NO: 3867314 - DNA, 15 bp, Homo sapiens
aggtcctgcccatgt

SEQ ID NO: 3867315 - DNA, 20 bp, Homo sapiens
aggtcctgcccatgtgtccc

SEQ ID NO: 3867316 - DNA, 23 bp, Homo sapiens
aggtcctgcccatgtgtcccctc

SEQ ID NO: 3867317 - DNA, 20 bp, Homo sapiens
aggtcctggtggggcagctc

SEQ ID NO: 3867318 - DNA, 13 bp, Homo sapiens
aggtctagacttt

SEQ ID NO: 3867319 - DNA, 16 bp, Homo sapiens
aggtctagactttctc

SEQ ID NO: 3867320 - DNA, 16 bp, Homo sapiens
aggtctcagcccggga

SEQ ID NO: 3867321 - DNA, 19 bp, Homo sapiens
aggtctccttactctgagc

SEQ ID NO: 3867322 - DNA, 23 bp, Homo sapiens
aggtctccttactctgagcccag

SEQ ID NO: 3867323 - DNA, 15 bp, Homo sapiens
aggtctgagccctgg

SEQ ID NO: 3867324 - DNA, 22 bp, Homo sapiens
aggtctgagccctggtgtgttt

SEQ ID NO: 3867325 - DNA, 16 bp, Homo sapiens
aggtcttcagccatca

SEQ ID NO: 3867326 - DNA, 22 bp, Homo sapiens
aggtcttgggaggctttcaatt

SEQ ID NO: 3867327 - DNA, 16 bp, Homo sapiens
aggtctttgcacatgt

SEQ ID NO: 3867328 - DNA, 17 bp, Homo sapiens
aggtctttgcacatgtg

SEQ ID NO: 3867329 - DNA, 18 bp, Homo sapiens
aggtctttgcacatgtga

SEQ ID NO: 3867330 - DNA, 13 bp, Homo sapiens
aggtgaaaatgtt

SEQ ID NO: 3867331 - DNA, 21 bp, Homo sapiens
aggtgacccaatgctcctgga

SEQ ID NO: 3867332 - DNA, 13 bp, Homo sapiens
aggtgaccccagg

SEQ ID NO: 3867333 - DNA, 15 bp, Homo sapiens
aggtgaccccagggc

SEQ ID NO: 3867334 - DNA, 17 bp, Homo sapiens
aggtgaccccagggcac

SEQ ID NO: 3867335 - DNA, 18 bp, Homo sapiens
aggtgaccccagggcaca

SEQ ID NO: 3867336 - DNA, 14 bp, Homo sapiens
aggtgagaccacct

SEQ ID NO: 3867337 - DNA, 15 bp, Homo sapiens
aggtgcagatgggct

SEQ ID NO: 3867338 - DNA, 20 bp, Homo sapiens
aggtgccaccaataaaaatc

SEQ ID NO: 3867339 - DNA, 15 bp, Homo sapiens
aggtgccactccctg

SEQ ID NO: 3867340 - DNA, 16 bp, Homo sapiens
aggtgccactccctga

SEQ ID NO: 3867341 - DNA, 15 bp, Homo sapiens
aggtgcccaggagaa

SEQ ID NO: 3867342 - DNA, 15 bp, Homo sapiens
aggtgcctgagctgg

SEQ ID NO: 3867343 - DNA, 19 bp, Homo sapiens
aggtgcctgagctggggcc

SEQ ID NO: 3867344 - DNA, 11 bp, Homo sapiens
aggtgcctgtg

SEQ ID NO: 3867345 - DNA, 17 bp, Homo sapiens
aggtgcctgtgaggcag

SEQ ID NO: 3867346 - DNA, 19 bp, Homo sapiens
aggtgcctgtgaggcaggg

SEQ ID NO: 3867347 - DNA, 20 bp, Homo sapiens
aggtgcctgtgaggcagggg

SEQ ID NO: 3867348 - DNA, 21 bp, Homo sapiens
aggtgcctgtgaggcaggggc

SEQ ID NO: 3867349 - DNA, 16 bp, Homo sapiens
aggtgctacaaaaaca

SEQ ID NO: 3867350 - DNA, 18 bp, Homo sapiens
aggtgctacaaaaacaca

SEQ ID NO: 3867351 - DNA, 24 bp, Homo sapiens
aggtgctacaaaaacacagcaagg

SEQ ID NO: 3867352 - DNA, 12 bp, Homo sapiens
aggtgctgagct

SEQ ID NO: 3867353 - DNA, 17 bp, Homo sapiens
aggtgctgagcttagcc

SEQ ID NO: 3867354 - DNA, 20 bp, Homo sapiens
aggtgctggatgctttgtca

SEQ ID NO: 3867355 - DNA, 13 bp, Homo sapiens
aggtggaagccct

SEQ ID NO: 3867356 - DNA, 15 bp, Homo sapiens
aggtggaagccctcc

SEQ ID NO: 3867357 - DNA, 19 bp, Homo sapiens
aggtggaagccctccttcc

SEQ ID NO: 3867358 - DNA, 20 bp, Homo sapiens
aggtggaagccctccttcca

SEQ ID NO: 3867359 - DNA, 13 bp, Homo sapiens
aggtggagtctca

SEQ ID NO: 3867360 - DNA, 16 bp, Homo sapiens
aggtggatcacagagg

SEQ ID NO: 3867361 - DNA, 17 bp, Homo sapiens
aggtggatcacctgagg

SEQ ID NO: 3867362 - DNA, 14 bp, Homo sapiens
aggtggcaggacca

SEQ ID NO: 3867363 - DNA, 19 bp, Homo sapiens
aggtggcaggaccaggact

SEQ ID NO: 3867364 - DNA, 15 bp, Homo sapiens
aggtggctctccagt

SEQ ID NO: 3867365 - DNA, 19 bp, Homo sapiens
aggtggctctccagttagt

SEQ ID NO: 3867366 - DNA, 20 bp, Homo sapiens
aggtggctgacccagtccct

SEQ ID NO: 3867367 - DNA, 22 bp, Homo sapiens
aggtggctgacccagtccctgg

SEQ ID NO: 3867368 - DNA, 23 bp, Homo sapiens
aggtggctgacccagtccctggg

SEQ ID NO: 3867369 - DNA, 22 bp, Homo sapiens
aggtgggagagacactcccagg

SEQ ID NO: 3867370 - DNA, 14 bp, Homo sapiens
aggtgggcagctgg

SEQ ID NO: 3867371 - DNA, 21 bp, Homo sapiens
aggtggggtctttgtgagagt

SEQ ID NO: 3867372 - DNA, 22 bp, Homo sapiens
aggtgggtccaggaaggcagct

SEQ ID NO: 3867373 - DNA, 19 bp, Homo sapiens
aggtgggttttcttcccat

SEQ ID NO: 3867374 - DNA, 22 bp, Homo sapiens
aggtgggttttcttcccatcac

SEQ ID NO: 3867375 - DNA, 15 bp, Homo sapiens
aggtggtgccttctc

SEQ ID NO: 3867376 - DNA, 15 bp, Homo sapiens
aggtggtggaggagg

SEQ ID NO: 3867377 - DNA, 17 bp, Homo sapiens
aggtgtcaccctgcaga

SEQ ID NO: 3867378 - DNA, 20 bp, Homo sapiens
aggtgtcaccctgcagagct

SEQ ID NO: 3867379 - DNA, 14 bp, Homo sapiens
aggtgtcccaagct

SEQ ID NO: 3867380 - DNA, 13 bp, Homo sapiens
aggtgtgccaaac

SEQ ID NO: 3867381 - DNA, 14 bp, Homo sapiens
aggtgtggctgtca

SEQ ID NO: 3867382 - DNA, 16 bp, Homo sapiens
aggtgtggtggctcat

SEQ ID NO: 3867383 - DNA, 14 bp, Homo sapiens
aggtgttgaaaatg

SEQ ID NO: 3867384 - DNA, 12 bp, Homo sapiens
aggtgtttatac

SEQ ID NO: 3867385 - DNA, 16 bp, Homo sapiens
aggtgtttccatttct

SEQ ID NO: 3867386 - DNA, 18 bp, Homo sapiens
aggtgtttccatttctca

SEQ ID NO: 3867387 - DNA, 19 bp, Homo sapiens
aggttaaaatataaattaa

SEQ ID NO: 3867388 - DNA, 16 bp, Homo sapiens
aggttaaggtgggtcc

SEQ ID NO: 3867389 - DNA, 18 bp, Homo sapiens
aggttactcataaggcat

SEQ ID NO: 3867390 - DNA, 20 bp, Homo sapiens
aggttagaacctagaagggc

SEQ ID NO: 3867391 - DNA, 21 bp, Homo sapiens
aggttagcctttgccctgtca

SEQ ID NO: 3867392 - DNA, 16 bp, Homo sapiens
aggttcccagcagctg

SEQ ID NO: 3867393 - DNA, 13 bp, Homo sapiens
aggttcctgagga

SEQ ID NO: 3867394 - DNA, 19 bp, Homo sapiens
aggttctaggtcctggctt

SEQ ID NO: 3867395 - DNA, 21 bp, Homo sapiens
aggttctaggtcctggcttct

SEQ ID NO: 3867396 - DNA, 14 bp, Homo sapiens
aggttcttgatgtc

SEQ ID NO: 3867397 - DNA, 21 bp, Homo sapiens
aggttgacaataaatgtgctt

SEQ ID NO: 3867398 - DNA, 17 bp, Homo sapiens
aggttgcagtgagctga

SEQ ID NO: 3867399 - DNA, 13 bp, Homo sapiens
aggttggtgactg

SEQ ID NO: 3867400 - DNA, 14 bp, Homo sapiens
aggttggtgactga

SEQ ID NO: 3867401 - DNA, 23 bp, Homo sapiens
aggttgtggatgctccagggcag

SEQ ID NO: 3867402 - DNA, 21 bp, Homo sapiens
aggtttggatgggagtgagac

SEQ ID NO: 3867403 - DNA, 21 bp, Homo sapiens
aggtttggggagggggaagag

SEQ ID NO: 3867404 - DNA, 12 bp, Homo sapiens
aggttttgttgt

SEQ ID NO: 3867405 - DNA, 21 bp, Homo sapiens
aggtttttttgtatagtaaag

SEQ ID NO: 3867406 - DNA, 18 bp, Homo sapiens
agtaaaaaattaaagccc

SEQ ID NO: 3867407 - DNA, 17 bp, Homo sapiens
agtaaaaccacagcagt

SEQ ID NO: 3867408 - DNA, 16 bp, Homo sapiens
agtaaaggcctcatct

SEQ ID NO: 3867409 - DNA, 20 bp, Homo sapiens
agtaaaggcctcatctcctt

SEQ ID NO: 3867410 - DNA, 16 bp, Homo sapiens
agtaaataaattgttt

SEQ ID NO: 3867411 - DNA, 12 bp, Homo sapiens
agtaaattggaa

SEQ ID NO: 3867412 - DNA, 14 bp, Homo sapiens
agtaaattggaaac

SEQ ID NO: 3867413 - DNA, 15 bp, Homo sapiens
agtaacatgccagct

SEQ ID NO: 3867414 - DNA, 16 bp, Homo sapiens
agtaacatgccagctt

SEQ ID NO: 3867415 - DNA, 19 bp, Homo sapiens
agtaagatattatttaaat

SEQ ID NO: 3867416 - DNA, 20 bp, Homo sapiens
agtaagatattatttaaatg

SEQ ID NO: 3867417 - DNA, 23 bp, Homo sapiens
agtaagtggggttgcaaccactg

SEQ ID NO: 3867418 - DNA, 20 bp, Homo sapiens
agtaatagtccaatatttgg

SEQ ID NO: 3867419 - DNA, 20 bp, Homo sapiens
agtaatataatggaagagaa

SEQ ID NO: 3867420 - DNA, 17 bp, Homo sapiens
agtaattgcatttctgc

SEQ ID NO: 3867421 - DNA, 16 bp, Homo sapiens
agtacaatgtttcaga

SEQ ID NO: 3867422 - DNA, 20 bp, Homo sapiens
agtacagtagcttaaataaa

SEQ ID NO: 3867423 - DNA, 22 bp, Homo sapiens
agtacagtagcttaaataaatt

SEQ ID NO: 3867424 - DNA, 12 bp, Homo sapiens
agtacatttaat

SEQ ID NO: 3867425 - DNA, 20 bp, Homo sapiens
agtacctgggaaaggaccca

SEQ ID NO: 3867426 - DNA, 17 bp, Homo sapiens
agtactagaatttgtat

SEQ ID NO: 3867427 - DNA, 15 bp, Homo sapiens
agtactctctgctct

SEQ ID NO: 3867428 - DNA, 16 bp, Homo sapiens
agtactctctgctcta

SEQ ID NO: 3867429 - DNA, 15 bp, Homo sapiens
agtactgggaaggag

SEQ ID NO: 3867430 - DNA, 12 bp, Homo sapiens
agtacttctaag

SEQ ID NO: 3867431 - DNA, 14 bp, Homo sapiens
agtagaaattgttc

SEQ ID NO: 3867432 - DNA, 16 bp, Homo sapiens
agtagaattatatcta

SEQ ID NO: 3867433 - DNA, 15 bp, Homo sapiens
agtagatggtgaaat

SEQ ID NO: 3867434 - DNA, 16 bp, Homo sapiens
agtagcaagttctaga

SEQ ID NO: 3867435 - DNA, 18 bp, Homo sapiens
agtagcaccctggattga

SEQ ID NO: 3867436 - DNA, 17 bp, Homo sapiens
agtagccgagagcctgc

SEQ ID NO: 3867437 - DNA, 19 bp, Homo sapiens
agtagccgagagcctgctc

SEQ ID NO: 3867438 - DNA, 22 bp, Homo sapiens
agtagctaatgaaattgagaag

SEQ ID NO: 3867439 - DNA, 14 bp, Homo sapiens
agtagctgagagga

SEQ ID NO: 3867440 - DNA, 21 bp, Homo sapiens
agtagctgagaggaagatgaa

SEQ ID NO: 3867441 - DNA, 14 bp, Homo sapiens
agtagcttaaataa

SEQ ID NO: 3867442 - DNA, 16 bp, Homo sapiens
agtaggaccaatgttg

SEQ ID NO: 3867443 - DNA, 13 bp, Homo sapiens
agtaggtccaagg

SEQ ID NO: 3867444 - DNA, 13 bp, Homo sapiens
agtagtttttcag

SEQ ID NO: 3867445 - DNA, 13 bp, Homo sapiens
agtataaaaacaa

SEQ ID NO: 3867446 - DNA, 18 bp, Homo sapiens
agtataaatggttgtctg

SEQ ID NO: 3867447 - DNA, 18 bp, Homo sapiens
agtataccatacattatc

SEQ ID NO: 3867448 - DNA, 16 bp, Homo sapiens
agtatagcattgaaca

SEQ ID NO: 3867449 - DNA, 21 bp, Homo sapiens
agtatatagtatatttatact

SEQ ID NO: 3867450 - DNA, 13 bp, Homo sapiens
agtatatctggac

SEQ ID NO: 3867451 - DNA, 15 bp, Homo sapiens
agtatcaggtctccc

SEQ ID NO: 3867452 - DNA, 21 bp, Homo sapiens
agtatcttacctgtaaagtct

SEQ ID NO: 3867453 - DNA, 14 bp, Homo sapiens
agtatcttttaaaa

SEQ ID NO: 3867454 - DNA, 15 bp, Homo sapiens
agtatgaatgatgtt

SEQ ID NO: 3867455 - DNA, 19 bp, Homo sapiens
agtatgatttttacaataa

SEQ ID NO: 3867456 - DNA, 12 bp, Homo sapiens
agtatgtgtggg

SEQ ID NO: 3867457 - DNA, 21 bp, Homo sapiens
agtattgccacaatgcctctc

SEQ ID NO: 3867458 - DNA, 22 bp, Homo sapiens
agtattgtccatatcagacctc

SEQ ID NO: 3867459 - DNA, 18 bp, Homo sapiens
agtatttgtacaaatact

SEQ ID NO: 3867460 - DNA, 19 bp, Homo sapiens
agtatttttttaagttaga

SEQ ID NO: 3867461 - DNA, 22 bp, Homo sapiens
agtattttttttactgtgcata

SEQ ID NO: 3867462 - DNA, 14 bp, Homo sapiens
agtcaaaacagaga

SEQ ID NO: 3867463 - DNA, 16 bp, Homo sapiens
agtcaaaaggtgcctg

SEQ ID NO: 3867464 - DNA, 15 bp, Homo sapiens
agtcaacactcttct

SEQ ID NO: 3867465 - DNA, 14 bp, Homo sapiens
agtcaactggagca

SEQ ID NO: 3867466 - DNA, 17 bp, Homo sapiens
agtcaattagtacagta

SEQ ID NO: 3867467 - DNA, 21 bp, Homo sapiens
agtcaattagtacagtagctt

SEQ ID NO: 3867468 - DNA, 16 bp, Homo sapiens
agtcacaagagcccag

SEQ ID NO: 3867469 - DNA, 11 bp, Homo sapiens
agtcacagctg

SEQ ID NO: 3867470 - DNA, 12 bp, Homo sapiens
agtcacagctgc

SEQ ID NO: 3867471 - DNA, 15 bp, Homo sapiens
agtcacagctgcagc

SEQ ID NO: 3867472 - DNA, 17 bp, Homo sapiens
agtcacagctgcagctg

SEQ ID NO: 3867473 - DNA, 13 bp, Homo sapiens
agtcaccaggaat

SEQ ID NO: 3867474 - DNA, 19 bp, Homo sapiens
agtcaccaggaatgttaaa

SEQ ID NO: 3867475 - DNA, 12 bp, Homo sapiens
agtcacctcctc

SEQ ID NO: 3867476 - DNA, 13 bp, Homo sapiens
agtcacctgcaag

SEQ ID NO: 3867477 - DNA, 17 bp, Homo sapiens
agtcacctgcaagcccc

SEQ ID NO: 3867478 - DNA, 18 bp, Homo sapiens
agtcacctgcaagcccca

SEQ ID NO: 3867479 - DNA, 20 bp, Homo sapiens
agtcacctgcaagccccagg

SEQ ID NO: 3867480 - DNA, 13 bp, Homo sapiens
agtcactgcacag

SEQ ID NO: 3867481 - DNA, 15 bp, Homo sapiens
agtcacttccagtgt

SEQ ID NO: 3867482 - DNA, 20 bp, Homo sapiens
agtcagaagcaggttcttga

SEQ ID NO: 3867483 - DNA, 19 bp, Homo sapiens
agtcagcccgaatgcctgt

SEQ ID NO: 3867484 - DNA, 21 bp, Homo sapiens
agtcagggtgggaagaaagaa

SEQ ID NO: 3867485 - DNA, 19 bp, Homo sapiens
agtcagtaggtccaagggc

SEQ ID NO: 3867486 - DNA, 22 bp, Homo sapiens
agtcagtaggtccaagggccat

SEQ ID NO: 3867487 - DNA, 15 bp, Homo sapiens
agtcagttcccggag

SEQ ID NO: 3867488 - DNA, 17 bp, Homo sapiens
agtcatgatctccctgc

SEQ ID NO: 3867489 - DNA, 19 bp, Homo sapiens
agtcatgatctccctgccg

SEQ ID NO: 3867490 - DNA, 21 bp, Homo sapiens
agtcatgatctccctgccgcc

SEQ ID NO: 3867491 - DNA, 23 bp, Homo sapiens
agtcatgatctccctgccgcctc

SEQ ID NO: 3867492 - DNA, 20 bp, Homo sapiens
agtccaaatgtgatcaactg

SEQ ID NO: 3867493 - DNA, 17 bp, Homo sapiens
agtccaacaatgttgtt

SEQ ID NO: 3867494 - DNA, 15 bp, Homo sapiens
agtccaacctgcctg

SEQ ID NO: 3867495 - DNA, 20 bp, Homo sapiens
agtccacatcttctcagtgt

SEQ ID NO: 3867496 - DNA, 22 bp, Homo sapiens
agtccacctgcctatccatcct

SEQ ID NO: 3867497 - DNA, 17 bp, Homo sapiens
agtccagaataagtgct

SEQ ID NO: 3867498 - DNA, 20 bp, Homo sapiens
agtccccagcccttctgcct

SEQ ID NO: 3867499 - DNA, 18 bp, Homo sapiens
agtccccgtgccccgcct

SEQ ID NO: 3867500 - DNA, 15 bp, Homo sapiens
agtcccgtggagggt

SEQ ID NO: 3867501 - DNA, 21 bp, Homo sapiens
agtccctgggggaagccctgg

SEQ ID NO: 3867502 - DNA, 17 bp, Homo sapiens
agtccgcagtctggcct

SEQ ID NO: 3867503 - DNA, 18 bp, Homo sapiens
agtccgccaaacactcca

SEQ ID NO: 3867504 - DNA, 12 bp, Homo sapiens
agtccgtccacc

SEQ ID NO: 3867505 - DNA, 13 bp, Homo sapiens
agtcctagagctc

SEQ ID NO: 3867506 - DNA, 14 bp, Homo sapiens
agtcctagagctcc

SEQ ID NO: 3867507 - DNA, 18 bp, Homo sapiens
agtcctagagctcctgtc

SEQ ID NO: 3867508 - DNA, 19 bp, Homo sapiens
agtcctagagctcctgtcc

SEQ ID NO: 3867509 - DNA, 22 bp, Homo sapiens
agtcctagagctcctgtcccta

SEQ ID NO: 3867510 - DNA, 16 bp, Homo sapiens
agtcctcacagcctct

SEQ ID NO: 3867511 - DNA, 12 bp, Homo sapiens
agtcctctcttc

SEQ ID NO: 3867512 - DNA, 22 bp, Homo sapiens
agtcctctggatggcaccagag

SEQ ID NO: 3867513 - DNA, 17 bp, Homo sapiens
agtcctgcagaggattt

SEQ ID NO: 3867514 - DNA, 23 bp, Homo sapiens
agtcctggccattttcttgcctg

SEQ ID NO: 3867515 - DNA, 21 bp, Homo sapiens
agtcctgtctctgcctgcggc

SEQ ID NO: 3867516 - DNA, 21 bp, Homo sapiens
agtccttggtctgctggtgtc

SEQ ID NO: 3867517 - DNA, 18 bp, Homo sapiens
agtcgaattaatagcttt

SEQ ID NO: 3867518 - DNA, 20 bp, Homo sapiens
agtcgcaggatccgctgcca

SEQ ID NO: 3867519 - DNA, 13 bp, Homo sapiens
agtcgtaagggtt

SEQ ID NO: 3867520 - DNA, 21 bp, Homo sapiens
agtcgtccttactcctgtggg

SEQ ID NO: 3867521 - DNA, 14 bp, Homo sapiens
agtcgttgtgaggg

SEQ ID NO: 3867522 - DNA, 12 bp, Homo sapiens
agtctaaagttt

SEQ ID NO: 3867523 - DNA, 20 bp, Homo sapiens
agtctaattttgtcaaatca

SEQ ID NO: 3867524 - DNA, 15 bp, Homo sapiens
agtctacgctctcct

SEQ ID NO: 3867525 - DNA, 22 bp, Homo sapiens
agtctacttcactaatgacgat

SEQ ID NO: 3867526 - DNA, 14 bp, Homo sapiens
agtctagaaaccag

SEQ ID NO: 3867527 - DNA, 20 bp, Homo sapiens
agtctaggagctgggaggaa

SEQ ID NO: 3867528 - DNA, 18 bp, Homo sapiens
agtctcagaaagccttcc

SEQ ID NO: 3867529 - DNA, 14 bp, Homo sapiens
agtctcaggccctg

SEQ ID NO: 3867530 - DNA, 15 bp, Homo sapiens
agtctcagtccagat

SEQ ID NO: 3867531 - DNA, 19 bp, Homo sapiens
agtctccagtggttgctgt

SEQ ID NO: 3867532 - DNA, 18 bp, Homo sapiens
agtctcctttgcactgag

SEQ ID NO: 3867533 - DNA, 19 bp, Homo sapiens
agtctcctttgcactgagg

SEQ ID NO: 3867534 - DNA, 16 bp, Homo sapiens
agtctctgtgctttga

SEQ ID NO: 3867535 - DNA, 15 bp, Homo sapiens
agtctgaaagacaga

SEQ ID NO: 3867536 - DNA, 12 bp, Homo sapiens
agtctgagcccc

SEQ ID NO: 3867537 - DNA, 13 bp, Homo sapiens
agtctgagtcctg

SEQ ID NO: 3867538 - DNA, 20 bp, Homo sapiens
agtctgagtcctgtctctgc

SEQ ID NO: 3867539 - DNA, 15 bp, Homo sapiens
agtctggcctgggcg

SEQ ID NO: 3867540 - DNA, 23 bp, Homo sapiens
agtctgggcaatgaaaccaaagc

SEQ ID NO: 3867541 - DNA, 14 bp, Homo sapiens
agtctgggctgccg

SEQ ID NO: 3867542 - DNA, 23 bp, Homo sapiens
agtcttaaaataacttatatcat

SEQ ID NO: 3867543 - DNA, 21 bp, Homo sapiens
agtcttcggtgtttaaagtca

SEQ ID NO: 3867544 - DNA, 21 bp, Homo sapiens
agtcttcttcacccgctgcag

SEQ ID NO: 3867545 - DNA, 18 bp, Homo sapiens
agtcttgctttgctgtct

SEQ ID NO: 3867546 - DNA, 13 bp, Homo sapiens
agtcttgtcagaa

SEQ ID NO: 3867547 - DNA, 15 bp, Homo sapiens
agtcttgtcagaatt

SEQ ID NO: 3867548 - DNA, 14 bp, Homo sapiens
agtcttgttaatta

SEQ ID NO: 3867549 - DNA, 16 bp, Homo sapiens
agtctttaatcccagt

SEQ ID NO: 3867550 - DNA, 20 bp, Homo sapiens
agtctttcttagtgcctgtg

SEQ ID NO: 3867551 - DNA, 14 bp, Homo sapiens
agtgaaaaatatgt

SEQ ID NO: 3867552 - DNA, 17 bp, Homo sapiens
agtgaaaaatatgttga

SEQ ID NO: 3867553 - DNA, 16 bp, Homo sapiens
agtgaaagctagagat

SEQ ID NO: 3867554 - DNA, 15 bp, Homo sapiens
agtgaacaactattt

SEQ ID NO: 3867555 - DNA, 13 bp, Homo sapiens
agtgaaccaaaga

SEQ ID NO: 3867556 - DNA, 23 bp, Homo sapiens
agtgaaccaaagagactggagca

SEQ ID NO: 3867557 - DNA, 20 bp, Homo sapiens
agtgaactacgcttgctcat

SEQ ID NO: 3867558 - DNA, 14 bp, Homo sapiens
aggctgctcttgaa

SEQ ID NO: 3867559 - DNA, 18 bp, Homo sapiens
aggctggaagctgggagg

SEQ ID NO: 3867560 - DNA, 13 bp, Homo sapiens
aggctggaggcag

SEQ ID NO: 3867561 - DNA, 14 bp, Homo sapiens
aggctggaggcagg

SEQ ID NO: 3867562 - DNA, 18 bp, Homo sapiens
aggctggaggcagggcct

SEQ ID NO: 3867563 - DNA, 20 bp, Homo sapiens
aggctggagtggagtggcac

SEQ ID NO: 3867564 - DNA, 18 bp, Homo sapiens
aggctggctgagtggaat

SEQ ID NO: 3867565 - DNA, 22 bp, Homo sapiens
aggctgggccagcctcagctca

SEQ ID NO: 3867566 - DNA, 15 bp, Homo sapiens
aggctgggcccctgg

SEQ ID NO: 3867567 - DNA, 12 bp, Homo sapiens
aggctggggcca

SEQ ID NO: 3867568 - DNA, 13 bp, Homo sapiens
aggctggggccag

SEQ ID NO: 3867569 - DNA, 20 bp, Homo sapiens
aggctggggctcgtaaatat

SEQ ID NO: 3867570 - DNA, 23 bp, Homo sapiens
aggctggtcgtgaactcctgagc

SEQ ID NO: 3867571 - DNA, 20 bp, Homo sapiens
aggctggtgctgtggccagg

SEQ ID NO: 3867572 - DNA, 16 bp, Homo sapiens
aggctgttctgcactg

SEQ ID NO: 3867573 - DNA, 18 bp, Homo sapiens
aggctgttctgcactgaa

SEQ ID NO: 3867574 - DNA, 19 bp, Homo sapiens
aggctgttctgcactgaaa

SEQ ID NO: 3867575 - DNA, 22 bp, Homo sapiens
aggcttaaggagaggagaaact

SEQ ID NO: 3867576 - DNA, 23 bp, Homo sapiens
aggcttaaggagaggagaaactg

SEQ ID NO: 3867577 - DNA, 17 bp, Homo sapiens
aggcttaggtgccaggc

SEQ ID NO: 3867578 - DNA, 18 bp, Homo sapiens
aggcttaggtgccaggct

SEQ ID NO: 3867579 - DNA, 15 bp, Homo sapiens
aggcttatcaaaatc

SEQ ID NO: 3867580 - DNA, 17 bp, Homo sapiens
aggcttatcaaaatctt

SEQ ID NO: 3867581 - DNA, 14 bp, Homo sapiens
aggcttccaggctc

SEQ ID NO: 3867582 - DNA, 18 bp, Homo sapiens
aggcttccaggctcttcc

SEQ ID NO: 3867583 - DNA, 23 bp, Homo sapiens
aggcttcggacagtgcccatgca

SEQ ID NO: 3867584 - DNA, 23 bp, Homo sapiens
aggcttcttcagatcagtgcttg

SEQ ID NO: 3867585 - DNA, 17 bp, Homo sapiens
aggcttggaatgaattc

SEQ ID NO: 3867586 - DNA, 19 bp, Homo sapiens
aggctttcaattgtatttt

SEQ ID NO: 3867587 - DNA, 22 bp, Homo sapiens
aggctttcaattgtattttata

SEQ ID NO: 3867588 - DNA, 18 bp, Homo sapiens
aggctttgccatgggcct

SEQ ID NO: 3867589 - DNA, 16 bp, Homo sapiens
agggaaactattgtcc

SEQ ID NO: 3867590 - DNA, 15 bp, Homo sapiens
agggaaactgccagc

SEQ ID NO: 3867591 - DNA, 21 bp, Homo sapiens
agggaaactgccagcaacgca

SEQ ID NO: 3867592 - DNA, 22 bp, Homo sapiens
agggaaaggctctgaaagccag

SEQ ID NO: 3867593 - DNA, 14 bp, Homo sapiens
agggaaatggaggg

SEQ ID NO: 3867594 - DNA, 15 bp, Homo sapiens
agggaaatggagggt

SEQ ID NO: 3867595 - DNA, 18 bp, Homo sapiens
agggaaatggagggtggg

SEQ ID NO: 3867596 - DNA, 14 bp, Homo sapiens
agggaacagacagg

SEQ ID NO: 3867597 - DNA, 19 bp, Homo sapiens
agggaacagacaggagaaa

SEQ ID NO: 3867598 - DNA, 21 bp, Homo sapiens
agggaacagacaggagaaatg

SEQ ID NO: 3867599 - DNA, 19 bp, Homo sapiens
agggaaccgtctgttttta

SEQ ID NO: 3867600 - DNA, 21 bp, Homo sapiens
agggaagacaggtctagactt

SEQ ID NO: 3867601 - DNA, 12 bp, Homo sapiens
agggaagagcag

SEQ ID NO: 3867602 - DNA, 12 bp, Homo sapiens
agggaagagggc

SEQ ID NO: 3867603 - DNA, 14 bp, Homo sapiens
agggaagagtgcat

SEQ ID NO: 3867604 - DNA, 13 bp, Homo sapiens
agggaagcaggca

SEQ ID NO: 3867605 - DNA, 12 bp, Homo sapiens
agggaagcaggg

SEQ ID NO: 3867606 - DNA, 15 bp, Homo sapiens
agggaagcctcttca

SEQ ID NO: 3867607 - DNA, 23 bp, Homo sapiens
agggaaggaactctggcttccag

SEQ ID NO: 3867608 - DNA, 14 bp, Homo sapiens
agggaaggcaggca

SEQ ID NO: 3867609 - DNA, 19 bp, Homo sapiens
agggaatccgcctgcagag

SEQ ID NO: 3867610 - DNA, 22 bp, Homo sapiens
agggaatgttccctgcaccctg

SEQ ID NO: 3867611 - DNA, 14 bp, Homo sapiens
agggacaaaggagc

SEQ ID NO: 3867612 - DNA, 18 bp, Homo sapiens
agggacaaaggagcctgt

SEQ ID NO: 3867613 - DNA, 19 bp, Homo sapiens
agggacaaaggagcctgtg

SEQ ID NO: 3867614 - DNA, 14 bp, Homo sapiens
agggacaacatttt

SEQ ID NO: 3867615 - DNA, 12 bp, Homo sapiens
agggacacacac

SEQ ID NO: 3867616 - DNA, 13 bp, Homo sapiens
agggacacacaca

SEQ ID NO: 3867617 - DNA, 10 bp, Homo sapiens
agggacagag

SEQ ID NO: 3867618 - DNA, 18 bp, Homo sapiens
agggacagagacacctgc

SEQ ID NO: 3867619 - DNA, 19 bp, Homo sapiens
agggacagagacacctgca

SEQ ID NO: 3867620 - DNA, 17 bp, Homo sapiens
agggacagagatggagg

SEQ ID NO: 3867621 - DNA, 21 bp, Homo sapiens
agggactcaagggtccagaag

SEQ ID NO: 3867622 - DNA, 23 bp, Homo sapiens
agggactgccagtccccctgccc

SEQ ID NO: 3867623 - DNA, 16 bp, Homo sapiens
agggagaagaaatcca

SEQ ID NO: 3867624 - DNA, 15 bp, Homo sapiens
agggagaaggatcta

SEQ ID NO: 3867625 - DNA, 13 bp, Homo sapiens
agggagaatgcag

SEQ ID NO: 3867626 - DNA, 14 bp, Homo sapiens
agggagagcacctt

SEQ ID NO: 3867627 - DNA, 16 bp, Homo sapiens
agggagcaactctcca

SEQ ID NO: 3867628 - DNA, 13 bp, Homo sapiens
agggagcactggg

SEQ ID NO: 3867629 - DNA, 19 bp, Homo sapiens
agggagcccctaggaaagc

SEQ ID NO: 3867630 - DNA, 14 bp, Homo sapiens
agggaggatgccac

SEQ ID NO: 3867631 - DNA, 23 bp, Homo sapiens
agggaggccgaagctaacaggga

SEQ ID NO: 3867632 - DNA, 13 bp, Homo sapiens
agggagggagagg

SEQ ID NO: 3867633 - DNA, 18 bp, Homo sapiens
agggagggctctgaggcg

SEQ ID NO: 3867634 - DNA, 20 bp, Homo sapiens
agggagggggcgctcaggac

SEQ ID NO: 3867635 - DNA, 23 bp, Homo sapiens
agggagggggcgctcaggaccca

SEQ ID NO: 3867636 - DNA, 15 bp, Homo sapiens
agggaggggtcctga

SEQ ID NO: 3867637 - DNA, 21 bp, Homo sapiens
agggagttgctcactcaggac

SEQ ID NO: 3867638 - DNA, 23 bp, Homo sapiens
agggagttgctcactcaggactt

SEQ ID NO: 3867639 - DNA, 17 bp, Homo sapiens
agggatcacagggcccc

SEQ ID NO: 3867640 - DNA, 22 bp, Homo sapiens
agggatcacagggccccagaag

SEQ ID NO: 3867641 - DNA, 22 bp, Homo sapiens
agggatgactaaaatatttatt

SEQ ID NO: 3867642 - DNA, 18 bp, Homo sapiens
agggatggagaggcggcc

SEQ ID NO: 3867643 - DNA, 15 bp, Homo sapiens
agggattagggagag

SEQ ID NO: 3867644 - DNA, 21 bp, Homo sapiens
agggcaaatgacatgcactga

SEQ ID NO: 3867645 - DNA, 14 bp, Homo sapiens
agggcaaattattt

SEQ ID NO: 3867646 - DNA, 13 bp, Homo sapiens
agggcaagggcca

SEQ ID NO: 3867647 - DNA, 22 bp, Homo sapiens
agggcaagggccatgctgaagg

SEQ ID NO: 3867648 - DNA, 14 bp, Homo sapiens
agggcacaggagct

SEQ ID NO: 3867649 - DNA, 18 bp, Homo sapiens
agggcacaggagctacct

SEQ ID NO: 3867650 - DNA, 22 bp, Homo sapiens
agggcacaggagctacctgtgt

SEQ ID NO: 3867651 - DNA, 13 bp, Homo sapiens
agggcagaagggg

SEQ ID NO: 3867652 - DNA, 15 bp, Homo sapiens
agggcagagccatgg

SEQ ID NO: 3867653 - DNA, 14 bp, Homo sapiens
agggcagaggctgg

SEQ ID NO: 3867654 - DNA, 13 bp, Homo sapiens
agggcagagggaa

SEQ ID NO: 3867655 - DNA, 12 bp, Homo sapiens
agggcagcagcc

SEQ ID NO: 3867656 - DNA, 13 bp, Homo sapiens
agggcagcagcca

SEQ ID NO: 3867657 - DNA, 16 bp, Homo sapiens
agggcagcagccagcc

SEQ ID NO: 3867658 - DNA, 19 bp, Homo sapiens
agggcagccaggggctgct

SEQ ID NO: 3867659 - DNA, 18 bp, Homo sapiens
agggcagtacctgggaaa

SEQ ID NO: 3867660 - DNA, 19 bp, Homo sapiens
agggcagttcgcagccacc

SEQ ID NO: 3867661 - DNA, 23 bp, Homo sapiens
agggcagttcgcagccaccctga

SEQ ID NO: 3867662 - DNA, 14 bp, Homo sapiens
agggcatcaggcac

SEQ ID NO: 3867663 - DNA, 17 bp, Homo sapiens
agggcatcaggcactgg

SEQ ID NO: 3867664 - DNA, 22 bp, Homo sapiens
agggcatcaggcactggtggca

SEQ ID NO: 3867665 - DNA, 18 bp, Homo sapiens
agggcatccttctgcctt

SEQ ID NO: 3867666 - DNA, 17 bp, Homo sapiens
agggcatcttagcttct

SEQ ID NO: 3867667 - DNA, 17 bp, Homo sapiens
agggcatgggagggagg

SEQ ID NO: 3867668 - DNA, 15 bp, Homo sapiens
agggccaagagagac

SEQ ID NO: 3867669 - DNA, 18 bp, Homo sapiens
agggccacactattacca

SEQ ID NO: 3867670 - DNA, 24 bp, Homo sapiens
agggccacactattaccatgagaa

SEQ ID NO: 3867671 - DNA, 18 bp, Homo sapiens
agggccacgtgccaggcc

SEQ ID NO: 3867672 - DNA, 20 bp, Homo sapiens
agggccagaaggagggcaga

SEQ ID NO: 3867673 - DNA, 18 bp, Homo sapiens
agggccagagttccacaa

SEQ ID NO: 3867674 - DNA, 11 bp, Homo sapiens
agggccagccc

SEQ ID NO: 3867675 - DNA, 17 bp, Homo sapiens
agggccagccctacatc

SEQ ID NO: 3867676 - DNA, 17 bp, Homo sapiens
agggccaggagagagat

SEQ ID NO: 3867677 - DNA, 10 bp, Homo sapiens
agggccaggc

SEQ ID NO: 3867678 - DNA, 13 bp, Homo sapiens
agggccaggcagg

SEQ ID NO: 3867679 - DNA, 22 bp, Homo sapiens
agggccaggcaggtgcctggac

SEQ ID NO: 3867680 - DNA, 22 bp, Homo sapiens
agggccatacttttgagagggg

SEQ ID NO: 3867681 - DNA, 19 bp, Homo sapiens
agggccatgctgaagggac

SEQ ID NO: 3867682 - DNA, 13 bp, Homo sapiens
agggcccagctgt

SEQ ID NO: 3867683 - DNA, 14 bp, Homo sapiens
agggcccagctgta

SEQ ID NO: 3867684 - DNA, 23 bp, Homo sapiens
agggcccagctgtagccatggct

SEQ ID NO: 3867685 - DNA, 17 bp, Homo sapiens
agggcccctccctctgc

SEQ ID NO: 3867686 - DNA, 18 bp, Homo sapiens
agggcccctccctctgcc

SEQ ID NO: 3867687 - DNA, 19 bp, Homo sapiens
agggccggggaactggcca

SEQ ID NO: 3867688 - DNA, 21 bp, Homo sapiens
agggccggggaactggccaag

SEQ ID NO: 3867689 - DNA, 20 bp, Homo sapiens
agggcctgacaggttcccag

SEQ ID NO: 3867690 - DNA, 21 bp, Homo sapiens
agggcctgacaggttcccagc

SEQ ID NO: 3867691 - DNA, 12 bp, Homo sapiens
agggcctgtggg

SEQ ID NO: 3867692 - DNA, 18 bp, Homo sapiens
agggcctgtgggagcctg

SEQ ID NO: 3867693 - DNA, 19 bp, Homo sapiens
agggcctgtgggagcctgc

SEQ ID NO: 3867694 - DNA, 22 bp, Homo sapiens
agggcgataaaactaaatatat

SEQ ID NO: 3867695 - DNA, 21 bp, Homo sapiens
agggcgcccattcgtctgtcc

SEQ ID NO: 3867696 - DNA, 14 bp, Homo sapiens
agggcggggtgggg

SEQ ID NO: 3867697 - DNA, 17 bp, Homo sapiens
agggctagaacctggaa

SEQ ID NO: 3867698 - DNA, 22 bp, Homo sapiens
agggctagaacctggaagggct

SEQ ID NO: 3867699 - DNA, 18 bp, Homo sapiens
agggctagaacctggaga

SEQ ID NO: 3867700 - DNA, 19 bp, Homo sapiens
agggctagaacctggagaa

SEQ ID NO: 3867701 - DNA, 17 bp, Homo sapiens
agggctagaactggaga

SEQ ID NO: 3867702 - DNA, 18 bp, Homo sapiens
agggctagaatctggaga

SEQ ID NO: 3867703 - DNA, 18 bp, Homo sapiens
agggctccagcatccagc

SEQ ID NO: 3867704 - DNA, 22 bp, Homo sapiens
agggctccagcatccagcctgt

SEQ ID NO: 3867705 - DNA, 19 bp, Homo sapiens
agggctcctctccagtctg

SEQ ID NO: 3867706 - DNA, 15 bp, Homo sapiens
agggctctcctggct

SEQ ID NO: 3867707 - DNA, 12 bp, Homo sapiens
agggctctgagg

SEQ ID NO: 3867708 - DNA, 13 bp, Homo sapiens
agggctctgaggc

SEQ ID NO: 3867709 - DNA, 19 bp, Homo sapiens
agggctgacctgcctctca

SEQ ID NO: 3867710 - DNA, 13 bp, Homo sapiens
agggctgctgtga

SEQ ID NO: 3867711 - DNA, 12 bp, Homo sapiens
agggctggacct

SEQ ID NO: 3867712 - DNA, 19 bp, Homo sapiens
agggctggagtgcgctctt

SEQ ID NO: 3867713 - DNA, 12 bp, Homo sapiens
agggctgggccc

SEQ ID NO: 3867714 - DNA, 19 bp, Homo sapiens
aggggaataatagaagaac

SEQ ID NO: 3867715 - DNA, 17 bp, Homo sapiens
aggggacgcgggctgtg

SEQ ID NO: 3867716 - DNA, 16 bp, Homo sapiens
aggggacttgtgccag

SEQ ID NO: 3867717 - DNA, 16 bp, Homo sapiens
aggggagaagggccag

SEQ ID NO: 3867718 - DNA, 15 bp, Homo sapiens
aggggagtgtgggtg

SEQ ID NO: 3867719 - DNA, 19 bp, Homo sapiens
aggggatgaggggcttcct

SEQ ID NO: 3867720 - DNA, 15 bp, Homo sapiens
aggggcacaccactg

SEQ ID NO: 3867721 - DNA, 16 bp, Homo sapiens
aggggcacaccactgc

SEQ ID NO: 3867722 - DNA, 21 bp, Homo sapiens
aggggcacaccactgccctgc

SEQ ID NO: 3867723 - DNA, 22 bp, Homo sapiens
aggggcacaccactgccctgcc

SEQ ID NO: 3867724 - DNA, 20 bp, Homo sapiens
aggggcacctgggaaaacag

SEQ ID NO: 3867725 - DNA, 22 bp, Homo sapiens
aggggcacctgggaaaacagag

SEQ ID NO: 3867726 - DNA, 13 bp, Homo sapiens
aggggcagccgct

SEQ ID NO: 3867727 - DNA, 13 bp, Homo sapiens
aggggcaggcctg

SEQ ID NO: 3867728 - DNA, 18 bp, Homo sapiens
aggggcaggcctgggacc

SEQ ID NO: 3867729 - DNA, 23 bp, Homo sapiens
aggggcaggcctgggacccagct

SEQ ID NO: 3867730 - DNA, 12 bp, Homo sapiens
aggggcccacaa

SEQ ID NO: 3867731 - DNA, 22 bp, Homo sapiens
aggggcccacaaaggggagaag

SEQ ID NO: 3867732 - DNA, 19 bp, Homo sapiens
aggggcccacagggaaccc

SEQ ID NO: 3867733 - DNA, 20 bp, Homo sapiens
aggggccccagatctgcctg

SEQ ID NO: 3867734 - DNA, 22 bp, Homo sapiens
aggggccccagatctgcctggg

SEQ ID NO: 3867735 - DNA, 20 bp, Homo sapiens
aggggccccggggctggcaa

SEQ ID NO: 3867736 - DNA, 23 bp, Homo sapiens
aggggcctctgaaatttcccaca

SEQ ID NO: 3867737 - DNA, 15 bp, Homo sapiens
aggggcctggcagcc

SEQ ID NO: 3867738 - DNA, 21 bp, Homo sapiens
aggggcctgggaaaggaaaac

SEQ ID NO: 3867739 - DNA, 21 bp, Homo sapiens
aggggctgctcatcacccagt

SEQ ID NO: 3867740 - DNA, 17 bp, Homo sapiens
aggggctggtccttctc

SEQ ID NO: 3867741 - DNA, 21 bp, Homo sapiens
agggggagtttttagtttgtt

SEQ ID NO: 3867742 - DNA, 11 bp, Homo sapiens
agggggctctc

SEQ ID NO: 3867743 - DNA, 22 bp, Homo sapiens
agggggctctccaaaggggctg

SEQ ID NO: 3867744 - DNA, 17 bp, Homo sapiens
agggggtcgtggagagc

SEQ ID NO: 3867745 - DNA, 23 bp, Homo sapiens
agggggtcgtggagagctaggag

SEQ ID NO: 3867746 - DNA, 19 bp, Homo sapiens
agggggtgtcatctgagga

SEQ ID NO: 3867747 - DNA, 22 bp, Homo sapiens
agggggtgtctggaagctgagc

SEQ ID NO: 3867748 - DNA, 19 bp, Homo sapiens
agggggtgtgcgtgcgtgt

SEQ ID NO: 3867749 - DNA, 17 bp, Homo sapiens
aggggtctccctggagt

SEQ ID NO: 3867750 - DNA, 19 bp, Homo sapiens
aggggtctccctggagtgc

SEQ ID NO: 3867751 - DNA, 21 bp, Homo sapiens
aggggtctgtatatacatttc

SEQ ID NO: 3867752 - DNA, 18 bp, Homo sapiens
aggggtgacagtggagga

SEQ ID NO: 3867753 - DNA, 16 bp, Homo sapiens
aggggtgccctctgga

SEQ ID NO: 3867754 - DNA, 19 bp, Homo sapiens
aggggttggttgaggtgga

SEQ ID NO: 3867755 - DNA, 20 bp, Homo sapiens
aggggttggttgaggtggaa

SEQ ID NO: 3867756 - DNA, 21 bp, Homo sapiens
agggtaagggagagggaggga

SEQ ID NO: 3867757 - DNA, 22 bp, Homo sapiens
agggtaataaacttagaataaa

SEQ ID NO: 3867758 - DNA, 21 bp, Homo sapiens
agggtaggaggtttggatggg

SEQ ID NO: 3867759 - DNA, 19 bp, Homo sapiens
agggtaggggagtgtgggt

SEQ ID NO: 3867760 - DNA, 17 bp, Homo sapiens
agggtatgggaagccat

SEQ ID NO: 3867761 - DNA, 19 bp, Homo sapiens
agggtccagaagtccctcc

SEQ ID NO: 3867762 - DNA, 15 bp, Homo sapiens
agggtccccacctgg

SEQ ID NO: 3867763 - DNA, 17 bp, Homo sapiens
agggtccgcaccagctg

SEQ ID NO: 3867764 - DNA, 24 bp, Homo sapiens
agggtccgcaccagctgctctgcc

SEQ ID NO: 3867765 - DNA, 15 bp, Homo sapiens
agggtctagggagag

SEQ ID NO: 3867766 - DNA, 16 bp, Homo sapiens
agggtctagggagaga

SEQ ID NO: 3867767 - DNA, 13 bp, Homo sapiens
agggtctggagaa

SEQ ID NO: 3867768 - DNA, 19 bp, Homo sapiens
agggtctggagaagcagtg

SEQ ID NO: 3867769 - DNA, 21 bp, Homo sapiens
agggtctgttgtaaatgacca

SEQ ID NO: 3867770 - DNA, 13 bp, Homo sapiens
agggtcttcttgg

SEQ ID NO: 3867771 - DNA, 16 bp, Homo sapiens
agggtcttcttggcag

SEQ ID NO: 3867772 - DNA, 14 bp, Homo sapiens
agggtcttgggcta

SEQ ID NO: 3867773 - DNA, 13 bp, Homo sapiens
agggtgacatccc

SEQ ID NO: 3867774 - DNA, 15 bp, Homo sapiens
agggtgacatcccag

SEQ ID NO: 3867775 - DNA, 14 bp, Homo sapiens
agggtgcatggctt

SEQ ID NO: 3867776 - DNA, 21 bp, Homo sapiens
agggtgccctcctagctccac

SEQ ID NO: 3867777 - DNA, 20 bp, Homo sapiens
agggtggaccccctgagtca

SEQ ID NO: 3867778 - DNA, 12 bp, Homo sapiens
agggtggagact

SEQ ID NO: 3867779 - DNA, 21 bp, Homo sapiens
agggtggccccctgtgccagc

SEQ ID NO: 3867780 - DNA, 23 bp, Homo sapiens
agggtggccccctgtgccagctc

SEQ ID NO: 3867781 - DNA, 17 bp, Homo sapiens
agggtgggaagaaagaa

SEQ ID NO: 3867782 - DNA, 18 bp, Homo sapiens
agggtgggaagaaagaat

SEQ ID NO: 3867783 - DNA, 14 bp, Homo sapiens
agggtgggagccta

SEQ ID NO: 3867784 - DNA, 18 bp, Homo sapiens
agggtgggatggaggaga

SEQ ID NO: 3867785 - DNA, 17 bp, Homo sapiens
agggtgggccactctcc

SEQ ID NO: 3867786 - DNA, 23 bp, Homo sapiens
agggtgggccactctcccctccc

SEQ ID NO: 3867787 - DNA, 18 bp, Homo sapiens
agggtgggggagggaggt

SEQ ID NO: 3867788 - DNA, 17 bp, Homo sapiens
agggtggtctgagcacc

SEQ ID NO: 3867789 - DNA, 23 bp, Homo sapiens
agggttgggttcatctgagcaag

SEQ ID NO: 3867790 - DNA, 21 bp, Homo sapiens
agggttggtgggctggcccag

SEQ ID NO: 3867791 - DNA, 21 bp, Homo sapiens
agggttgtactattgtttaaa

SEQ ID NO: 3867792 - DNA, 18 bp, Homo sapiens
agggtttacccagtggga

SEQ ID NO: 3867793 - DNA, 14 bp, Homo sapiens
agggtttcattgtg

SEQ ID NO: 3867794 - DNA, 11 bp, Homo sapiens
agggttttgta

SEQ ID NO: 3867795 - DNA, 22 bp, Homo sapiens
aggtaaatgggcagtgcctcct

SEQ ID NO: 3867796 - DNA, 17 bp, Homo sapiens
aggtaactatcaatatt

SEQ ID NO: 3867797 - DNA, 16 bp, Homo sapiens
aggtaagggccgccgg

SEQ ID NO: 3867798 - DNA, 16 bp, Homo sapiens
aggtacacagctctag

SEQ ID NO: 3867799 - DNA, 13 bp, Homo sapiens
aggtacttcctcc

SEQ ID NO: 3867800 - DNA, 19 bp, Homo sapiens
aggtacttcctcctgatgg

SEQ ID NO: 3867801 - DNA, 15 bp, Homo sapiens
aggtagaacctcacc

SEQ ID NO: 3867802 - DNA, 20 bp, Homo sapiens
aggtagatcgcttgagccca

SEQ ID NO: 3867803 - DNA, 18 bp, Homo sapiens
aggtagcttacctgacac

SEQ ID NO: 3867804 - DNA, 13 bp, Homo sapiens
aggtaggcccttg

SEQ ID NO: 3867805 - DNA, 17 bp, Homo sapiens
aggtaggcccttgtcct

SEQ ID NO: 3867806 - DNA, 19 bp, Homo sapiens
aggtaggcccttgtcctgc

SEQ ID NO: 3867807 - DNA, 23 bp, Homo sapiens
aggtaggcccttgtcctgccagc

SEQ ID NO: 3867808 - DNA, 21 bp, Homo sapiens
aggtatagctgacatctcctc

SEQ ID NO: 3867809 - DNA, 15 bp, Homo sapiens
aggtatcaggcacag

SEQ ID NO: 3867810 - DNA, 19 bp, Homo sapiens
aggtatcaggcacaggcag

SEQ ID NO: 3867811 - DNA, 21 bp, Homo sapiens
aggtatcaggcacaggcagga

SEQ ID NO: 3867812 - DNA, 22 bp, Homo sapiens
aggtatcaggcacaggcaggaa

SEQ ID NO: 3867813 - DNA, 14 bp, Homo sapiens
aggtattaaagatg

SEQ ID NO: 3867814 - DNA, 14 bp, Homo sapiens
aggtatttatcttt

SEQ ID NO: 3867815 - DNA, 17 bp, Homo sapiens
aggccctccatgggcta

SEQ ID NO: 3867816 - DNA, 17 bp, Homo sapiens
aggccctccctgactcc

SEQ ID NO: 3867817 - DNA, 18 bp, Homo sapiens
aggccctggatcagcgtg

SEQ ID NO: 3867818 - DNA, 19 bp, Homo sapiens
aggccctggtgtcaggcag

SEQ ID NO: 3867819 - DNA, 20 bp, Homo sapiens
aggcccttattttcaagaaa

SEQ ID NO: 3867820 - DNA, 15 bp, Homo sapiens
aggcccttcctctcc

SEQ ID NO: 3867821 - DNA, 19 bp, Homo sapiens
aggcccttgtcctgccagc

SEQ ID NO: 3867822 - DNA, 21 bp, Homo sapiens
aggcccttgtcctgccagctg

SEQ ID NO: 3867823 - DNA, 14 bp, Homo sapiens
aggccgcctgccat

SEQ ID NO: 3867824 - DNA, 15 bp, Homo sapiens
aggccgcctgccata

SEQ ID NO: 3867825 - DNA, 23 bp, Homo sapiens
aggccgttccccttggcttcctc

SEQ ID NO: 3867826 - DNA, 19 bp, Homo sapiens
aggcctaatctcatacctc

SEQ ID NO: 3867827 - DNA, 12 bp, Homo sapiens
aggcctcagttc

SEQ ID NO: 3867828 - DNA, 13 bp, Homo sapiens
aggcctcagttct

SEQ ID NO: 3867829 - DNA, 15 bp, Homo sapiens
aggcctcatccctcg

SEQ ID NO: 3867830 - DNA, 14 bp, Homo sapiens
aggcctcatctcct

SEQ ID NO: 3867831 - DNA, 17 bp, Homo sapiens
aggcctccagcctctcc

SEQ ID NO: 3867832 - DNA, 15 bp, Homo sapiens
aggcctcctctctgc

SEQ ID NO: 3867833 - DNA, 18 bp, Homo sapiens
aggcctcctctctgccac

SEQ ID NO: 3867834 - DNA, 18 bp, Homo sapiens
aggcctcgtaccagccag

SEQ ID NO: 3867835 - DNA, 20 bp, Homo sapiens
aggcctcgtaccagccagga

SEQ ID NO: 3867836 - DNA, 21 bp, Homo sapiens
aggcctcgtaccagccaggat

SEQ ID NO: 3867837 - DNA, 14 bp, Homo sapiens
aggcctctgtgtcc

SEQ ID NO: 3867838 - DNA, 16 bp, Homo sapiens
aggcctctgtgtcctt

SEQ ID NO: 3867839 - DNA, 23 bp, Homo sapiens
aggcctctgtgtccttccctgca

SEQ ID NO: 3867840 - DNA, 22 bp, Homo sapiens
aggcctcttggacctctgctct

SEQ ID NO: 3867841 - DNA, 15 bp, Homo sapiens
aggcctcttgtgctc

SEQ ID NO: 3867842 - DNA, 20 bp, Homo sapiens
aggcctcttgtgctcacgct

SEQ ID NO: 3867843 - DNA, 16 bp, Homo sapiens
aggcctgatgctgccc

SEQ ID NO: 3867844 - DNA, 22 bp, Homo sapiens
aggcctgccctcagggatcttg

SEQ ID NO: 3867845 - DNA, 19 bp, Homo sapiens
aggcctgccctcccatgtt

SEQ ID NO: 3867846 - DNA, 15 bp, Homo sapiens
aggcctgctcaggga

SEQ ID NO: 3867847 - DNA, 17 bp, Homo sapiens
aggcctggaaccaggga

SEQ ID NO: 3867848 - DNA, 15 bp, Homo sapiens
aggcctggccttgtc

SEQ ID NO: 3867849 - DNA, 16 bp, Homo sapiens
aggcctggccttgtca

SEQ ID NO: 3867850 - DNA, 18 bp, Homo sapiens
aggcctgggacccagcta

SEQ ID NO: 3867851 - DNA, 23 bp, Homo sapiens
aggcctgggacccagctactctg

SEQ ID NO: 3867852 - DNA, 21 bp, Homo sapiens
aggcctggggtgacccggcac

SEQ ID NO: 3867853 - DNA, 23 bp, Homo sapiens
aggcctgtgtgtgaaaggaagct

SEQ ID NO: 3867854 - DNA, 14 bp, Homo sapiens
aggcctttaaccat

SEQ ID NO: 3867855 - DNA, 13 bp, Homo sapiens
aggcgaataaatg

SEQ ID NO: 3867856 - DNA, 21 bp, Homo sapiens
aggcgaataaatgttcaaact

SEQ ID NO: 3867857 - DNA, 24 bp, Homo sapiens
aggcgagtgccaggactccccagg

SEQ ID NO: 3867858 - DNA, 16 bp, Homo sapiens
aggcgcagcccgaagc

SEQ ID NO: 3867859 - DNA, 22 bp, Homo sapiens
aggcgcagcccgaagcccagtt

SEQ ID NO: 3867860 - DNA, 21 bp, Homo sapiens
aggcgccccaacccgtggagg

SEQ ID NO: 3867861 - DNA, 14 bp, Homo sapiens
aggcgccccttccc

SEQ ID NO: 3867862 - DNA, 20 bp, Homo sapiens
aggcgcgtctgccccaccct

SEQ ID NO: 3867863 - DNA, 18 bp, Homo sapiens
aggcggaaaccttgcagc

SEQ ID NO: 3867864 - DNA, 20 bp, Homo sapiens
aggcggaaaccttgcagcat

SEQ ID NO: 3867865 - DNA, 16 bp, Homo sapiens
aggcggctccaggtcc

SEQ ID NO: 3867866 - DNA, 15 bp, Homo sapiens
aggcggtcatgtgtg

SEQ ID NO: 3867867 - DNA, 19 bp, Homo sapiens
aggcggtcatgtgtgcatg

SEQ ID NO: 3867868 - DNA, 18 bp, Homo sapiens
aggcgttcttcgaggtgg

SEQ ID NO: 3867869 - DNA, 19 bp, Homo sapiens
aggcgttcttcgaggtgga

SEQ ID NO: 3867870 - DNA, 18 bp, Homo sapiens
aggctaagttcagttctg

SEQ ID NO: 3867871 - DNA, 21 bp, Homo sapiens
aggctaagttcagttctgttt

SEQ ID NO: 3867872 - DNA, 14 bp, Homo sapiens
aggctagttccttt

SEQ ID NO: 3867873 - DNA, 13 bp, Homo sapiens
aggctatttaaaa

SEQ ID NO: 3867874 - DNA, 14 bp, Homo sapiens
aggctatttgttca

SEQ ID NO: 3867875 - DNA, 19 bp, Homo sapiens
aggctatttgttcagagag

SEQ ID NO: 3867876 - DNA, 21 bp, Homo sapiens
aggctcaggacggaaggtcag

SEQ ID NO: 3867877 - DNA, 16 bp, Homo sapiens
aggctccatggggaag

SEQ ID NO: 3867878 - DNA, 13 bp, Homo sapiens
aggctcctgtgct

SEQ ID NO: 3867879 - DNA, 19 bp, Homo sapiens
aggctcctgtgctactttg

SEQ ID NO: 3867880 - DNA, 18 bp, Homo sapiens
aggctctgaaatcttggg

SEQ ID NO: 3867881 - DNA, 15 bp, Homo sapiens
aggctctgcctggag

SEQ ID NO: 3867882 - DNA, 16 bp, Homo sapiens
aggctctgcctggagg

SEQ ID NO: 3867883 - DNA, 19 bp, Homo sapiens
aggctctggagccagagag

SEQ ID NO: 3867884 - DNA, 13 bp, Homo sapiens
aggctctgggctc

SEQ ID NO: 3867885 - DNA, 17 bp, Homo sapiens
aggctctgggctcaggg

SEQ ID NO: 3867886 - DNA, 22 bp, Homo sapiens
aggctctgggctcagggctgga

SEQ ID NO: 3867887 - DNA, 17 bp, Homo sapiens
aggctcttccatcccca

SEQ ID NO: 3867888 - DNA, 17 bp, Homo sapiens
aggctcttcctggacct

SEQ ID NO: 3867889 - DNA, 22 bp, Homo sapiens
aggctcttcctggacctgagtc

SEQ ID NO: 3867890 - DNA, 21 bp, Homo sapiens
aggctctttggggtcagccag

SEQ ID NO: 3867891 - DNA, 23 bp, Homo sapiens
aggctctttggggtcagccaggg

SEQ ID NO: 3867892 - DNA, 19 bp, Homo sapiens
aggctgaccaagagagaaa

SEQ ID NO: 3867893 - DNA, 11 bp, Homo sapiens
aggctgaggac

SEQ ID NO: 3867894 - DNA, 15 bp, Homo sapiens
aggctgaggcagaag

SEQ ID NO: 3867895 - DNA, 14 bp, Homo sapiens
aggctgaggcagga

SEQ ID NO: 3867896 - DNA, 11 bp, Homo sapiens
aggctgcactg

SEQ ID NO: 3867897 - DNA, 15 bp, Homo sapiens
aggctgcactgcagt

SEQ ID NO: 3867898 - DNA, 17 bp, Homo sapiens
aggctgcactgcagtga

SEQ ID NO: 3867899 - DNA, 20 bp, Homo sapiens
aggctgcagagctgacccag

SEQ ID NO: 3867900 - DNA, 16 bp, Homo sapiens
aggctgcatgctctgg

SEQ ID NO: 3867901 - DNA, 15 bp, Homo sapiens
aggcacacagcagcc

SEQ ID NO: 3867902 - DNA, 16 bp, Homo sapiens
aggcacacagcagccc

SEQ ID NO: 3867903 - DNA, 17 bp, Homo sapiens
aggcacacagcagcccc

SEQ ID NO: 3867904 - DNA, 20 bp, Homo sapiens
aggcacacagcagcccccca

SEQ ID NO: 3867905 - DNA, 20 bp, Homo sapiens
aggcacaggcaggaagagag

SEQ ID NO: 3867906 - DNA, 22 bp, Homo sapiens
aggcacaggcaggaagagagag

SEQ ID NO: 3867907 - DNA, 14 bp, Homo sapiens
aggcaccagctctg

SEQ ID NO: 3867908 - DNA, 20 bp, Homo sapiens
aggcaccagctctgtggcct

SEQ ID NO: 3867909 - DNA, 19 bp, Homo sapiens
aggcaccccctggagagaa

SEQ ID NO: 3867910 - DNA, 13 bp, Homo sapiens
aggcaccggcgct

SEQ ID NO: 3867911 - DNA, 15 bp, Homo sapiens
aggcaccggcgctgc

SEQ ID NO: 3867912 - DNA, 17 bp, Homo sapiens
aggcacctggcctgctg

SEQ ID NO: 3867913 - DNA, 19 bp, Homo sapiens
aggcaccttagtggctttt

SEQ ID NO: 3867914 - DNA, 18 bp, Homo sapiens
aggcacgaacccacctgc

SEQ ID NO: 3867915 - DNA, 23 bp, Homo sapiens
aggcacgccagtttcaccatttc

SEQ ID NO: 3867916 - DNA, 16 bp, Homo sapiens
aggcactgctgcccag

SEQ ID NO: 3867917 - DNA, 15 bp, Homo sapiens
aggcagaagaattga

SEQ ID NO: 3867918 - DNA, 18 bp, Homo sapiens
aggcagaataagaaaaca

SEQ ID NO: 3867919 - DNA, 19 bp, Homo sapiens
aggcagacgtggggagggt

SEQ ID NO: 3867920 - DNA, 17 bp, Homo sapiens
aggcagagaaagaagag

SEQ ID NO: 3867921 - DNA, 19 bp, Homo sapiens
aggcagagaaagaagagac

SEQ ID NO: 3867922 - DNA, 23 bp, Homo sapiens
aggcagagcggggaggtgcctga

SEQ ID NO: 3867923 - DNA, 16 bp, Homo sapiens
aggcagcaaggcccga

SEQ ID NO: 3867924 - DNA, 13 bp, Homo sapiens
aggcagcctccag

SEQ ID NO: 3867925 - DNA, 17 bp, Homo sapiens
aggcagcctccagagcc

SEQ ID NO: 3867926 - DNA, 18 bp, Homo sapiens
aggcagcctccagagcca

SEQ ID NO: 3867927 - DNA, 12 bp, Homo sapiens
aggcagcctgcc

SEQ ID NO: 3867928 - DNA, 23 bp, Homo sapiens
aggcagctgctcttagtgcccgc

SEQ ID NO: 3867929 - DNA, 18 bp, Homo sapiens
aggcagctggatgagact

SEQ ID NO: 3867930 - DNA, 22 bp, Homo sapiens
aggcagctggatgagacttcca

SEQ ID NO: 3867931 - DNA, 13 bp, Homo sapiens
aggcaggagtggc

SEQ ID NO: 3867932 - DNA, 20 bp, Homo sapiens
aggcaggcagggctctcctg

SEQ ID NO: 3867933 - DNA, 13 bp, Homo sapiens
aggcagggagggg

SEQ ID NO: 3867934 - DNA, 15 bp, Homo sapiens
aggcagggcagaggg

SEQ ID NO: 3867935 - DNA, 22 bp, Homo sapiens
aggcagggccttgcccagagat

SEQ ID NO: 3867936 - DNA, 23 bp, Homo sapiens
aggcagggccttgcccagagatg

SEQ ID NO: 3867937 - DNA, 12 bp, Homo sapiens
aggcagggctct

SEQ ID NO: 3867938 - DNA, 18 bp, Homo sapiens
aggcagggctctcctggc

SEQ ID NO: 3867939 - DNA, 23 bp, Homo sapiens
aggcagggctctcctggcttccc

SEQ ID NO: 3867940 - DNA, 18 bp, Homo sapiens
aggcaggggtgggagagc

SEQ ID NO: 3867941 - DNA, 19 bp, Homo sapiens
aggcaggggtgggagagcc

SEQ ID NO: 3867942 - DNA, 22 bp, Homo sapiens
aggcaggggtgggagagccagc

SEQ ID NO: 3867943 - DNA, 15 bp, Homo sapiens
aggcagtctgaaccc

SEQ ID NO: 3867944 - DNA, 16 bp, Homo sapiens
aggcatagggaatatg

SEQ ID NO: 3867945 - DNA, 21 bp, Homo sapiens
aggcatccatagtgcactagc

SEQ ID NO: 3867946 - DNA, 22 bp, Homo sapiens
aggcatgagggatcacagggcc

SEQ ID NO: 3867947 - DNA, 18 bp, Homo sapiens
aggcatgctggcctccca

SEQ ID NO: 3867948 - DNA, 14 bp, Homo sapiens
aggcattatttaat

SEQ ID NO: 3867949 - DNA, 13 bp, Homo sapiens
aggcatttcctgg

SEQ ID NO: 3867950 - DNA, 20 bp, Homo sapiens
aggcatttctatcacatatt

SEQ ID NO: 3867951 - DNA, 23 bp, Homo sapiens
aggcatttgcctaattcctggca

SEQ ID NO: 3867952 - DNA, 23 bp, Homo sapiens
aggccaaaattaccaaaaatctt

SEQ ID NO: 3867953 - DNA, 14 bp, Homo sapiens
aggccaaatgcaca

SEQ ID NO: 3867954 - DNA, 16 bp, Homo sapiens
aggccaaatgcacaag

SEQ ID NO: 3867955 - DNA, 17 bp, Homo sapiens
aggccaaatgcacaagc

SEQ ID NO: 3867956 - DNA, 14 bp, Homo sapiens
aggccaagaatcaa

SEQ ID NO: 3867957 - DNA, 15 bp, Homo sapiens
aggccaagctgaagt

SEQ ID NO: 3867958 - DNA, 22 bp, Homo sapiens
aggccaagctgaagtgaaggag

SEQ ID NO: 3867959 - DNA, 14 bp, Homo sapiens
aggccaaggcaggt

SEQ ID NO: 3867960 - DNA, 22 bp, Homo sapiens
aggccaagtgtgataaataaac

SEQ ID NO: 3867961 - DNA, 19 bp, Homo sapiens
aggccacgctcaggcccgg

SEQ ID NO: 3867962 - DNA, 14 bp, Homo sapiens
aggccactcctcca

SEQ ID NO: 3867963 - DNA, 19 bp, Homo sapiens
aggccactcctccaaagga

SEQ ID NO: 3867964 - DNA, 23 bp, Homo sapiens
aggccactgtggccagagctgga

SEQ ID NO: 3867965 - DNA, 13 bp, Homo sapiens
aggccagcctggc

SEQ ID NO: 3867966 - DNA, 18 bp, Homo sapiens
aggccaggaatctgccat

SEQ ID NO: 3867967 - DNA, 12 bp, Homo sapiens
aggcccaagaga

SEQ ID NO: 3867968 - DNA, 17 bp, Homo sapiens
aggcccagcctgtcctg

SEQ ID NO: 3867969 - DNA, 19 bp, Homo sapiens
aggcccagcctgtcctggt

SEQ ID NO: 3867970 - DNA, 15 bp, Homo sapiens
aggcccagggagcaa

SEQ ID NO: 3867971 - DNA, 20 bp, Homo sapiens
aggcccagggagcaatggga

SEQ ID NO: 3867972 - DNA, 20 bp, Homo sapiens
aggcccatctcaggtgccac

SEQ ID NO: 3867973 - DNA, 21 bp, Homo sapiens
aggcccatctcaggtgccact

SEQ ID NO: 3867974 - DNA, 22 bp, Homo sapiens
aggcccatctcaggtgccactc

SEQ ID NO: 3867975 - DNA, 12 bp, Homo sapiens
aggccccagagc

SEQ ID NO: 3867976 - DNA, 14 bp, Homo sapiens
aggccccaggccct

SEQ ID NO: 3867977 - DNA, 17 bp, Homo sapiens
aggccccatgacctcca

SEQ ID NO: 3867978 - DNA, 17 bp, Homo sapiens
aggcccctgaggactgg

SEQ ID NO: 3867979 - DNA, 21 bp, Homo sapiens
aggcccctgaggactggagac

SEQ ID NO: 3867980 - DNA, 14 bp, Homo sapiens
aggcccgacagaga

SEQ ID NO: 3867981 - DNA, 17 bp, Homo sapiens
aggcccgacagagagat

SEQ ID NO: 3867982 - DNA, 18 bp, Homo sapiens
aggcccgacagagagatg

SEQ ID NO: 3867983 - DNA, 14 bp, Homo sapiens
aggcccgagcagct

SEQ ID NO: 3867984 - DNA, 19 bp, Homo sapiens
aggcccgagcagctgagca

SEQ ID NO: 3867985 - DNA, 13 bp, Homo sapiens
aggcccggggctg

SEQ ID NO: 3867986 - DNA, 22 bp, Homo sapiens
aggccctaggattcctccccca

SEQ ID NO: 3867987 - DNA, 17 bp, Homo sapiens
aggagcaaatgtttctg

SEQ ID NO: 3867988 - DNA, 18 bp, Homo sapiens
aggagcaagagagggcaa

SEQ ID NO: 3867989 - DNA, 13 bp, Homo sapiens
aggagcagacaga

SEQ ID NO: 3867990 - DNA, 19 bp, Homo sapiens
aggagcagagggcctagga

SEQ ID NO: 3867991 - DNA, 18 bp, Homo sapiens
aggagcaggaacagagac

SEQ ID NO: 3867992 - DNA, 19 bp, Homo sapiens
aggagcaggaacagagact

SEQ ID NO: 3867993 - DNA, 19 bp, Homo sapiens
aggagccggaccaagatgg

SEQ ID NO: 3867994 - DNA, 11 bp, Homo sapiens
aggagcctgtg

SEQ ID NO: 3867995 - DNA, 12 bp, Homo sapiens
aggagcctgtga

SEQ ID NO: 3867996 - DNA, 17 bp, Homo sapiens
aggagcctgtgaaccca

SEQ ID NO: 3867997 - DNA, 23 bp, Homo sapiens
aggagctctgaatctgataggaa

SEQ ID NO: 3867998 - DNA, 19 bp, Homo sapiens
aggagctgatttccaggcc

SEQ ID NO: 3867999 - DNA, 20 bp, Homo sapiens
aggagctgatttccaggccc

SEQ ID NO: 3868000 - DNA, 23 bp, Homo sapiens
aggagctgatttccaggcccctg

SEQ ID NO: 3868001 - DNA, 16 bp, Homo sapiens
aggagctgggaggaaa

SEQ ID NO: 3868002 - DNA, 23 bp, Homo sapiens
aggaggaaggcaaagcccctgga

SEQ ID NO: 3868003 - DNA, 22 bp, Homo sapiens
aggaggaatcatgtcaggcctg

SEQ ID NO: 3868004 - DNA, 15 bp, Homo sapiens
aggaggaggaaggca

SEQ ID NO: 3868005 - DNA, 15 bp, Homo sapiens
aggaggaggaggaag

SEQ ID NO: 3868006 - DNA, 15 bp, Homo sapiens
aggaggaggaggagg

SEQ ID NO: 3868007 - DNA, 20 bp, Homo sapiens
aggaggattgcttcttgtga

SEQ ID NO: 3868008 - DNA, 22 bp, Homo sapiens
aggaggcagaataagaaaacaa

SEQ ID NO: 3868009 - DNA, 22 bp, Homo sapiens
aggaggccctggtgtcaggcag

SEQ ID NO: 3868010 - DNA, 23 bp, Homo sapiens
aggaggccctggtgtcaggcagg

SEQ ID NO: 3868011 - DNA, 11 bp, Homo sapiens
aggaggcctgg

SEQ ID NO: 3868012 - DNA, 13 bp, Homo sapiens
aggaggcctggcc

SEQ ID NO: 3868013 - DNA, 19 bp, Homo sapiens
aggaggcgaataaatgttc

SEQ ID NO: 3868014 - DNA, 17 bp, Homo sapiens
aggaggcgcagcccgaa

SEQ ID NO: 3868015 - DNA, 20 bp, Homo sapiens
aggaggcggaggttgcagtg

SEQ ID NO: 3868016 - DNA, 20 bp, Homo sapiens
aggaggctcaacaataaaac

SEQ ID NO: 3868017 - DNA, 13 bp, Homo sapiens
aggaggctgcatg

SEQ ID NO: 3868018 - DNA, 19 bp, Homo sapiens
aggaggctgcatgctctgg

SEQ ID NO: 3868019 - DNA, 20 bp, Homo sapiens
aggaggctgcatgctctgga

SEQ ID NO: 3868020 - DNA, 14 bp, Homo sapiens
aggagggacaaagg

SEQ ID NO: 3868021 - DNA, 20 bp, Homo sapiens
aggagggacaaaggagcctg

SEQ ID NO: 3868022 - DNA, 21 bp, Homo sapiens
aggagggacaaaggagcctgt

SEQ ID NO: 3868023 - DNA, 13 bp, Homo sapiens
aggagggcagagc

SEQ ID NO: 3868024 - DNA, 17 bp, Homo sapiens
aggagggcagagccatg

SEQ ID NO: 3868025 - DNA, 17 bp, Homo sapiens
aggagggcgtgactcac

SEQ ID NO: 3868026 - DNA, 21 bp, Homo sapiens
aggagggggtcgtggagagct

SEQ ID NO: 3868027 - DNA, 14 bp, Homo sapiens
aggaggtgagggat

SEQ ID NO: 3868028 - DNA, 17 bp, Homo sapiens
aggaggtgtcccaagct

SEQ ID NO: 3868029 - DNA, 17 bp, Homo sapiens
aggaggttggtgactga

SEQ ID NO: 3868030 - DNA, 18 bp, Homo sapiens
aggaggttgtggatgctc

SEQ ID NO: 3868031 - DNA, 14 bp, Homo sapiens
aggagtagctgaga

SEQ ID NO: 3868032 - DNA, 16 bp, Homo sapiens
aggagtctgaggtcct

SEQ ID NO: 3868033 - DNA, 17 bp, Homo sapiens
aggagtctgaggtcctg

SEQ ID NO: 3868034 - DNA, 18 bp, Homo sapiens
aggagtctgaggtcctga

SEQ ID NO: 3868035 - DNA, 19 bp, Homo sapiens
aggagtctgaggtcctgag

SEQ ID NO: 3868036 - DNA, 14 bp, Homo sapiens
aggagtctgtgctc

SEQ ID NO: 3868037 - DNA, 16 bp, Homo sapiens
aggagtctgtgctctt

SEQ ID NO: 3868038 - DNA, 21 bp, Homo sapiens
aggagtgagatcattttctta

SEQ ID NO: 3868039 - DNA, 23 bp, Homo sapiens
aggagttagaaatctccagtgtg

SEQ ID NO: 3868040 - DNA, 20 bp, Homo sapiens
aggagttcaagaccagcctg

SEQ ID NO: 3868041 - DNA, 17 bp, Homo sapiens
aggagttctgacattca

SEQ ID NO: 3868042 - DNA, 21 bp, Homo sapiens
aggagtttgagacaagccctg

SEQ ID NO: 3868043 - DNA, 13 bp, Homo sapiens
aggatactctgtc

SEQ ID NO: 3868044 - DNA, 23 bp, Homo sapiens
aggatactgcgggcaccagaatg

SEQ ID NO: 3868045 - DNA, 12 bp, Homo sapiens
aggatccgctgc

SEQ ID NO: 3868046 - DNA, 16 bp, Homo sapiens
aggatccgctgccacc

SEQ ID NO: 3868047 - DNA, 20 bp, Homo sapiens
aggatcctattctcaccagg

SEQ ID NO: 3868048 - DNA, 17 bp, Homo sapiens
aggatcctcacaggagc

SEQ ID NO: 3868049 - DNA, 21 bp, Homo sapiens
aggatcctcacaggagcagac

SEQ ID NO: 3868050 - DNA, 12 bp, Homo sapiens
aggatcctgcag

SEQ ID NO: 3868051 - DNA, 16 bp, Homo sapiens
aggatctagaatgtgt

SEQ ID NO: 3868052 - DNA, 20 bp, Homo sapiens
aggatctatgcaatttttaa

SEQ ID NO: 3868053 - DNA, 14 bp, Homo sapiens
aggatctctcagga

SEQ ID NO: 3868054 - DNA, 15 bp, Homo sapiens
aggatctctcaggag

SEQ ID NO: 3868055 - DNA, 19 bp, Homo sapiens
aggatctctcaggagcaca

SEQ ID NO: 3868056 - DNA, 22 bp, Homo sapiens
aggatgaggaacctcaaactgg

SEQ ID NO: 3868057 - DNA, 13 bp, Homo sapiens
aggatgcagaggg

SEQ ID NO: 3868058 - DNA, 15 bp, Homo sapiens
aggatgccacagccc

SEQ ID NO: 3868059 - DNA, 17 bp, Homo sapiens
aggatgccacagcccca

SEQ ID NO: 3868060 - DNA, 14 bp, Homo sapiens
aggatggagagagg

SEQ ID NO: 3868061 - DNA, 22 bp, Homo sapiens
aggatgtaaacagtgcctgctg

SEQ ID NO: 3868062 - DNA, 18 bp, Homo sapiens
aggatgtaactttataaa

SEQ ID NO: 3868063 - DNA, 12 bp, Homo sapiens
aggatgttctgg

SEQ ID NO: 3868064 - DNA, 21 bp, Homo sapiens
aggattaagatacactcctgc

SEQ ID NO: 3868065 - DNA, 15 bp, Homo sapiens
aggattcctccccca

SEQ ID NO: 3868066 - DNA, 18 bp, Homo sapiens
aggattcctctctcaggt

SEQ ID NO: 3868067 - DNA, 22 bp, Homo sapiens
aggattgaagagcattgcatgg

SEQ ID NO: 3868068 - DNA, 20 bp, Homo sapiens
aggatttaacagtcatttaa

SEQ ID NO: 3868069 - DNA, 18 bp, Homo sapiens
aggcaaagcccctggaaa

SEQ ID NO: 3868070 - DNA, 17 bp, Homo sapiens
aggcaagagacagaatg

SEQ ID NO: 3868071 - DNA, 15 bp, Homo sapiens
aggcaagtttctagc

SEQ ID NO: 3868072 - DNA, 18 bp, Homo sapiens
aggcaagtttctagctag

SEQ ID NO: 3868073 - DNA, 17 bp, Homo sapiens
agctgtcccctctgtca

SEQ ID NO: 3868074 - DNA, 17 bp, Homo sapiens
agctgtgacctgctgag

SEQ ID NO: 3868075 - DNA, 19 bp, Homo sapiens
agctgtgacctgctgagct

SEQ ID NO: 3868076 - DNA, 23 bp, Homo sapiens
agctgtgacctgctgagctctga

SEQ ID NO: 3868077 - DNA, 19 bp, Homo sapiens
agctgtggactttgttcac

SEQ ID NO: 3868078 - DNA, 15 bp, Homo sapiens
agctgtgtccttgca

SEQ ID NO: 3868079 - DNA, 18 bp, Homo sapiens
agctgtgtccttgcacct

SEQ ID NO: 3868080 - DNA, 23 bp, Homo sapiens
agctgtgtgaaataccagtgtgg

SEQ ID NO: 3868081 - DNA, 20 bp, Homo sapiens
agctgttggcctcgcctggg

SEQ ID NO: 3868082 - DNA, 17 bp, Homo sapiens
agctgtttatttattca

SEQ ID NO: 3868083 - DNA, 18 bp, Homo sapiens
agctgtttatttattcac

SEQ ID NO: 3868084 - DNA, 20 bp, Homo sapiens
agctgtttatttattcactg

SEQ ID NO: 3868085 - DNA, 14 bp, Homo sapiens
agctgttttcttct

SEQ ID NO: 3868086 - DNA, 19 bp, Homo sapiens
agcttaaataaattcaaac

SEQ ID NO: 3868087 - DNA, 24 bp, Homo sapiens
agcttaaattgcttttgttgtgac

SEQ ID NO: 3868088 - DNA, 18 bp, Homo sapiens
agcttaagtataattaat

SEQ ID NO: 3868089 - DNA, 15 bp, Homo sapiens
agcttacctgacaca

SEQ ID NO: 3868090 - DNA, 17 bp, Homo sapiens
agcttacctgacacaag

SEQ ID NO: 3868091 - DNA, 21 bp, Homo sapiens
agcttagccttgtgccctgcc

SEQ ID NO: 3868092 - DNA, 22 bp, Homo sapiens
agcttagccttgtgccctgccc

SEQ ID NO: 3868093 - DNA, 22 bp, Homo sapiens
agcttatgggatccttgtcttt

SEQ ID NO: 3868094 - DNA, 20 bp, Homo sapiens
agcttattaaaactcatttt

SEQ ID NO: 3868095 - DNA, 15 bp, Homo sapiens
agcttcaagtgatat

SEQ ID NO: 3868096 - DNA, 22 bp, Homo sapiens
agcttcaagtgatatatgtatt

SEQ ID NO: 3868097 - DNA, 16 bp, Homo sapiens
agcttcagaagtttgg

SEQ ID NO: 3868098 - DNA, 21 bp, Homo sapiens
agcttcagaagtttggcaata

SEQ ID NO: 3868099 - DNA, 23 bp, Homo sapiens
agcttcagacttttatcaaaatc

SEQ ID NO: 3868100 - DNA, 15 bp, Homo sapiens
agcttcagagcctag

SEQ ID NO: 3868101 - DNA, 17 bp, Homo sapiens
agcttcagagcctagcc

SEQ ID NO: 3868102 - DNA, 16 bp, Homo sapiens
agcttcatgcctcagt

SEQ ID NO: 3868103 - DNA, 17 bp, Homo sapiens
agcttcatgcctcagtt

SEQ ID NO: 3868104 - DNA, 23 bp, Homo sapiens
agcttctattatagccacatccc

SEQ ID NO: 3868105 - DNA, 18 bp, Homo sapiens
agcttctctgccaagccc

SEQ ID NO: 3868106 - DNA, 13 bp, Homo sapiens
agcttgaccagac

SEQ ID NO: 3868107 - DNA, 14 bp, Homo sapiens
agcttgaccagacc

SEQ ID NO: 3868108 - DNA, 17 bp, Homo sapiens
agcttgaccagacctag

SEQ ID NO: 3868109 - DNA, 22 bp, Homo sapiens
agcttgaccagacctagacctg

SEQ ID NO: 3868110 - DNA, 23 bp, Homo sapiens
agcttgaccagacctagacctgg

SEQ ID NO: 3868111 - DNA, 14 bp, Homo sapiens
agcttgctcttcag

SEQ ID NO: 3868112 - DNA, 19 bp, Homo sapiens
agcttgctcttcagtggga

SEQ ID NO: 3868113 - DNA, 16 bp, Homo sapiens
agcttggagggatgga

SEQ ID NO: 3868114 - DNA, 18 bp, Homo sapiens
agcttgtatagtgtaaaa

SEQ ID NO: 3868115 - DNA, 21 bp, Homo sapiens
agctttcccaaataaactcta

SEQ ID NO: 3868116 - DNA, 12 bp, Homo sapiens
agctttctcctt

SEQ ID NO: 3868117 - DNA, 19 bp, Homo sapiens
agctttgaatacccccaga

SEQ ID NO: 3868118 - DNA, 20 bp, Homo sapiens
agctttgaatacccccagag

SEQ ID NO: 3868119 - DNA, 10 bp, Homo sapiens
agctttgcta

SEQ ID NO: 3868120 - DNA, 21 bp, Homo sapiens
agctttgctaccaaagcacct

SEQ ID NO: 3868121 - DNA, 18 bp, Homo sapiens
agctttgctctttggtag

SEQ ID NO: 3868122 - DNA, 21 bp, Homo sapiens
agctttgctctttggtagaaa

SEQ ID NO: 3868123 - DNA, 23 bp, Homo sapiens
agctttgctctttggtagaaaag

SEQ ID NO: 3868124 - DNA, 17 bp, Homo sapiens
agctttggtgcaatggc

SEQ ID NO: 3868125 - DNA, 19 bp, Homo sapiens
agcttttaataaaattgac

SEQ ID NO: 3868126 - DNA, 17 bp, Homo sapiens
agcttttcatggaagtg

SEQ ID NO: 3868127 - DNA, 23 bp, Homo sapiens
agcttttcatggaagtggcagtg

SEQ ID NO: 3868128 - DNA, 13 bp, Homo sapiens
agcttttcccttc

SEQ ID NO: 3868129 - DNA, 16 bp, Homo sapiens
agcttttcccttcttt

SEQ ID NO: 3868130 - DNA, 15 bp, Homo sapiens
aggaaaaaaaataat

SEQ ID NO: 3868131 - DNA, 19 bp, Homo sapiens
aggaaaaccaagccgtggc

SEQ ID NO: 3868132 - DNA, 23 bp, Homo sapiens
aggaaaaccaagccgtggcttcc

SEQ ID NO: 3868133 - DNA, 16 bp, Homo sapiens
aggaaaaccagggata

SEQ ID NO: 3868134 - DNA, 18 bp, Homo sapiens
aggaaaacgggaaagaat

SEQ ID NO: 3868135 - DNA, 22 bp, Homo sapiens
aggaaaacgggaaagaatataa

SEQ ID NO: 3868136 - DNA, 15 bp, Homo sapiens
aggaaaaggcctggg

SEQ ID NO: 3868137 - DNA, 19 bp, Homo sapiens
aggaaaagtacatttaata

SEQ ID NO: 3868138 - DNA, 16 bp, Homo sapiens
aggaaaagtgcaatgc

SEQ ID NO: 3868139 - DNA, 18 bp, Homo sapiens
aggaaaagtgcaatgcgt

SEQ ID NO: 3868140 - DNA, 18 bp, Homo sapiens
aggaaagaaaactaacaa

SEQ ID NO: 3868141 - DNA, 13 bp, Homo sapiens
aggaaagccctcc

SEQ ID NO: 3868142 - DNA, 17 bp, Homo sapiens
aggaaagccctccccct

SEQ ID NO: 3868143 - DNA, 21 bp, Homo sapiens
aggaaagcgtggttccaagaa

SEQ ID NO: 3868144 - DNA, 14 bp, Homo sapiens
aggaaataaaacct

SEQ ID NO: 3868145 - DNA, 19 bp, Homo sapiens
aggaaataaaacctttcaa

SEQ ID NO: 3868146 - DNA, 21 bp, Homo sapiens
aggaaatcaaatatgcaaagc

SEQ ID NO: 3868147 - DNA, 13 bp, Homo sapiens
aggaacaagagaa

SEQ ID NO: 3868148 - DNA, 23 bp, Homo sapiens
aggaacactggaaaataaatttt

SEQ ID NO: 3868149 - DNA, 21 bp, Homo sapiens
aggaacgagcactggccagag

SEQ ID NO: 3868150 - DNA, 16 bp, Homo sapiens
aggaagaaaccccaag

SEQ ID NO: 3868151 - DNA, 12 bp, Homo sapiens
aggaagagaagg

SEQ ID NO: 3868152 - DNA, 16 bp, Homo sapiens
aggaagagaaggagca

SEQ ID NO: 3868153 - DNA, 15 bp, Homo sapiens
aggaagatgaaagag

SEQ ID NO: 3868154 - DNA, 15 bp, Homo sapiens
aggaagatgaagaga

SEQ ID NO: 3868155 - DNA, 16 bp, Homo sapiens
aggaagatgaagagaa

SEQ ID NO: 3868156 - DNA, 22 bp, Homo sapiens
aggaagatgaagagaagctgag

SEQ ID NO: 3868157 - DNA, 16 bp, Homo sapiens
aggaagccccaagcca

SEQ ID NO: 3868158 - DNA, 15 bp, Homo sapiens
aggaagcgtggggta

SEQ ID NO: 3868159 - DNA, 23 bp, Homo sapiens
aggaaggagactcacctctgcct

SEQ ID NO: 3868160 - DNA, 21 bp, Homo sapiens
aggaaggcaaagcccctggaa

SEQ ID NO: 3868161 - DNA, 13 bp, Homo sapiens
aggaaggcagctg

SEQ ID NO: 3868162 - DNA, 16 bp, Homo sapiens
aggaaggcagggagga

SEQ ID NO: 3868163 - DNA, 18 bp, Homo sapiens
aggaaggcagggaggagg

SEQ ID NO: 3868164 - DNA, 22 bp, Homo sapiens
aggaaggcagggaggaggcaga

SEQ ID NO: 3868165 - DNA, 20 bp, Homo sapiens
aggaagggcatccttctgcc

SEQ ID NO: 3868166 - DNA, 18 bp, Homo sapiens
aggaagggccaggagaga

SEQ ID NO: 3868167 - DNA, 21 bp, Homo sapiens
aggaagggccaggagagagat

SEQ ID NO: 3868168 - DNA, 15 bp, Homo sapiens
aggaaggtgctgagc

SEQ ID NO: 3868169 - DNA, 23 bp, Homo sapiens
aggaagttattaacgggcatgta

SEQ ID NO: 3868170 - DNA, 20 bp, Homo sapiens
aggaagttttgagtttctct

SEQ ID NO: 3868171 - DNA, 19 bp, Homo sapiens
aggaataaattgctccttg

SEQ ID NO: 3868172 - DNA, 22 bp, Homo sapiens
aggaatcatgtcaggcctgtgt

SEQ ID NO: 3868173 - DNA, 17 bp, Homo sapiens
aggaatctacctgtggt

SEQ ID NO: 3868174 - DNA, 19 bp, Homo sapiens
aggaatctgaaagtatatt

SEQ ID NO: 3868175 - DNA, 14 bp, Homo sapiens
aggaatgttaaagt

SEQ ID NO: 3868176 - DNA, 16 bp, Homo sapiens
aggaattttctttgtg

SEQ ID NO: 3868177 - DNA, 21 bp, Homo sapiens
aggacaacctgcccctcccca

SEQ ID NO: 3868178 - DNA, 19 bp, Homo sapiens
aggacaatgccttgggaga

SEQ ID NO: 3868179 - DNA, 20 bp, Homo sapiens
aggacacacagtctcagtcc

SEQ ID NO: 3868180 - DNA, 23 bp, Homo sapiens
aggacacacagtctcagtccaga

SEQ ID NO: 3868181 - DNA, 23 bp, Homo sapiens
aggacacactaatcgaactatga

SEQ ID NO: 3868182 - DNA, 13 bp, Homo sapiens
aggacacaggcct

SEQ ID NO: 3868183 - DNA, 15 bp, Homo sapiens
aggacacaggcctgt

SEQ ID NO: 3868184 - DNA, 12 bp, Homo sapiens
aggacacatgtc

SEQ ID NO: 3868185 - DNA, 18 bp, Homo sapiens
aggacacctgccccagcg

SEQ ID NO: 3868186 - DNA, 22 bp, Homo sapiens
aggacacctgccccagcgcggc

SEQ ID NO: 3868187 - DNA, 16 bp, Homo sapiens
aggacacgtggcctgc

SEQ ID NO: 3868188 - DNA, 23 bp, Homo sapiens
aggacagcctgtggcggtgcctg

SEQ ID NO: 3868189 - DNA, 18 bp, Homo sapiens
aggacaggaccagatttt

SEQ ID NO: 3868190 - DNA, 22 bp, Homo sapiens
aggacatgatactgatgccatg

SEQ ID NO: 3868191 - DNA, 22 bp, Homo sapiens
aggacatgtgctattgaactga

SEQ ID NO: 3868192 - DNA, 17 bp, Homo sapiens
aggacattatgtgtgca

SEQ ID NO: 3868193 - DNA, 23 bp, Homo sapiens
aggaccaactggcttctgtgcac

SEQ ID NO: 3868194 - DNA, 16 bp, Homo sapiens
aggaccacagtgggtg

SEQ ID NO: 3868195 - DNA, 22 bp, Homo sapiens
aggaccacagtgggtggcacct

SEQ ID NO: 3868196 - DNA, 22 bp, Homo sapiens
aggaccaggactatagcccagg

SEQ ID NO: 3868197 - DNA, 16 bp, Homo sapiens
aggaccagtcccagag

SEQ ID NO: 3868198 - DNA, 17 bp, Homo sapiens
aggaccagtcccagagc

SEQ ID NO: 3868199 - DNA, 20 bp, Homo sapiens
aggacccacccatcttcctg

SEQ ID NO: 3868200 - DNA, 13 bp, Homo sapiens
aggacccaggccc

SEQ ID NO: 3868201 - DNA, 20 bp, Homo sapiens
aggacccaggccgcctgcca

SEQ ID NO: 3868202 - DNA, 19 bp, Homo sapiens
aggaccctgttttccacac

SEQ ID NO: 3868203 - DNA, 13 bp, Homo sapiens
aggaccgggctgg

SEQ ID NO: 3868204 - DNA, 19 bp, Homo sapiens
aggaccgtggccctgccct

SEQ ID NO: 3868205 - DNA, 21 bp, Homo sapiens
aggactaacactcagaagcct

SEQ ID NO: 3868206 - DNA, 23 bp, Homo sapiens
aggactaacactcagaagcctgg

SEQ ID NO: 3868207 - DNA, 17 bp, Homo sapiens
aggactaatgcatgtgg

SEQ ID NO: 3868208 - DNA, 19 bp, Homo sapiens
aggactacgttaagggaag

SEQ ID NO: 3868209 - DNA, 21 bp, Homo sapiens
aggactagaaaaacttgggtc

SEQ ID NO: 3868210 - DNA, 18 bp, Homo sapiens
aggactagaacctggagg

SEQ ID NO: 3868211 - DNA, 22 bp, Homo sapiens
aggactagaacctggagggctg

SEQ ID NO: 3868212 - DNA, 20 bp, Homo sapiens
aggactccccaggccaggcc

SEQ ID NO: 3868213 - DNA, 20 bp, Homo sapiens
aggactccctccatgtggcc

SEQ ID NO: 3868214 - DNA, 17 bp, Homo sapiens
aggactctgccccttct

SEQ ID NO: 3868215 - DNA, 20 bp, Homo sapiens
aggactctgccccttctgtt

SEQ ID NO: 3868216 - DNA, 14 bp, Homo sapiens
aggactctgcctcc

SEQ ID NO: 3868217 - DNA, 17 bp, Homo sapiens
aggactctgcctcctct

SEQ ID NO: 3868218 - DNA, 19 bp, Homo sapiens
aggactctgcctcctcttc

SEQ ID NO: 3868219 - DNA, 13 bp, Homo sapiens
aggactctgcctt

SEQ ID NO: 3868220 - DNA, 15 bp, Homo sapiens
aggactctggcctct

SEQ ID NO: 3868221 - DNA, 16 bp, Homo sapiens
aggactggagaccgct

SEQ ID NO: 3868222 - DNA, 15 bp, Homo sapiens
aggactggctcaccc

SEQ ID NO: 3868223 - DNA, 16 bp, Homo sapiens
aggactggctcacccc

SEQ ID NO: 3868224 - DNA, 18 bp, Homo sapiens
aggacttaacggctccag

SEQ ID NO: 3868225 - DNA, 21 bp, Homo sapiens
aggacttaacggctccaggat

SEQ ID NO: 3868226 - DNA, 15 bp, Homo sapiens
aggacttctgcagct

SEQ ID NO: 3868227 - DNA, 16 bp, Homo sapiens
aggacttggtctgatt

SEQ ID NO: 3868228 - DNA, 18 bp, Homo sapiens
aggagaaacagagacagg

SEQ ID NO: 3868229 - DNA, 16 bp, Homo sapiens
aggagaaaggagccgg

SEQ ID NO: 3868230 - DNA, 12 bp, Homo sapiens
aggagaaggaag

SEQ ID NO: 3868231 - DNA, 20 bp, Homo sapiens
aggagaatggtgtgaacccg

SEQ ID NO: 3868232 - DNA, 11 bp, Homo sapiens
aggagactcac

SEQ ID NO: 3868233 - DNA, 14 bp, Homo sapiens
aggagactcacctc

SEQ ID NO: 3868234 - DNA, 18 bp, Homo sapiens
aggagactcacctctgcc

SEQ ID NO: 3868235 - DNA, 16 bp, Homo sapiens
aggagagactgaaagc

SEQ ID NO: 3868236 - DNA, 19 bp, Homo sapiens
aggagagactgaaagcagc

SEQ ID NO: 3868237 - DNA, 16 bp, Homo sapiens
aggagagccagccctc

SEQ ID NO: 3868238 - DNA, 16 bp, Homo sapiens
aggagagcccttcatt

SEQ ID NO: 3868239 - DNA, 19 bp, Homo sapiens
aggagaggggaagggccag

SEQ ID NO: 3868240 - DNA, 15 bp, Homo sapiens
aggagatataaaatc

SEQ ID NO: 3868241 - DNA, 15 bp, Homo sapiens
aggagattttccttc

SEQ ID NO: 3868242 - DNA, 13 bp, Homo sapiens
aggagcaaagcct

SEQ ID NO: 3868243 - DNA, 14 bp, Homo sapiens
agcccctggtcctg

SEQ ID NO: 3868244 - DNA, 13 bp, Homo sapiens
agcccgaagccca

SEQ ID NO: 3868245 - DNA, 15 bp, Homo sapiens
agcccgaagcccagt

SEQ ID NO: 3868246 - DNA, 18 bp, Homo sapiens
agcccggccagggcctgg

SEQ ID NO: 3868247 - DNA, 22 bp, Homo sapiens
agcccggccagggcctggtgtg

SEQ ID NO: 3868248 - DNA, 19 bp, Homo sapiens
agcccggcctgctcccagc

SEQ ID NO: 3868249 - DNA, 22 bp, Homo sapiens
agcccggcctgctcccagcagc

SEQ ID NO: 3868250 - DNA, 21 bp, Homo sapiens
agcccggcgccaccatcctgc

SEQ ID NO: 3868251 - DNA, 17 bp, Homo sapiens
agcccgtgaagcagtgc

SEQ ID NO: 3868252 - DNA, 21 bp, Homo sapiens
agccctacatcttcagctccc

SEQ ID NO: 3868253 - DNA, 16 bp, Homo sapiens
agccctcccccttccc

SEQ ID NO: 3868254 - DNA, 20 bp, Homo sapiens
agccctcccccttccccttc

SEQ ID NO: 3868255 - DNA, 13 bp, Homo sapiens
agccctccctgcc

SEQ ID NO: 3868256 - DNA, 16 bp, Homo sapiens
agccctccctgcccct

SEQ ID NO: 3868257 - DNA, 19 bp, Homo sapiens
agccctccctgcccctccc

SEQ ID NO: 3868258 - DNA, 22 bp, Homo sapiens
agccctccctgcccctcccttc

SEQ ID NO: 3868259 - DNA, 14 bp, Homo sapiens
agccctccctgtcc

SEQ ID NO: 3868260 - DNA, 17 bp, Homo sapiens
agccctccctgtcctcc

SEQ ID NO: 3868261 - DNA, 19 bp, Homo sapiens
agccctccctgtcctcctc

SEQ ID NO: 3868262 - DNA, 22 bp, Homo sapiens
agccctccctgtcctcctcgga

SEQ ID NO: 3868263 - DNA, 17 bp, Homo sapiens
agccctccttccacgga

SEQ ID NO: 3868264 - DNA, 18 bp, Homo sapiens
agccctcgaaccaaggca

SEQ ID NO: 3868265 - DNA, 19 bp, Homo sapiens
agccctcgaaccaaggcag

SEQ ID NO: 3868266 - DNA, 23 bp, Homo sapiens
agccctcgaaccaaggcagcctc

SEQ ID NO: 3868267 - DNA, 14 bp, Homo sapiens
agccctgccaggag

SEQ ID NO: 3868268 - DNA, 17 bp, Homo sapiens
agccctgccaggaggct

SEQ ID NO: 3868269 - DNA, 23 bp, Homo sapiens
agccctggatttcagaaagagca

SEQ ID NO: 3868270 - DNA, 14 bp, Homo sapiens
agccctgggaccgc

SEQ ID NO: 3868271 - DNA, 19 bp, Homo sapiens
agccctgggccccaccacc

SEQ ID NO: 3868272 - DNA, 18 bp, Homo sapiens
agccctgggggccagctg

SEQ ID NO: 3868273 - DNA, 19 bp, Homo sapiens
agccctgggggccagctgg

SEQ ID NO: 3868274 - DNA, 23 bp, Homo sapiens
agccctgggggccagctggtgct

SEQ ID NO: 3868275 - DNA, 13 bp, Homo sapiens
agccctgtcccct

SEQ ID NO: 3868276 - DNA, 17 bp, Homo sapiens
agccctgtcgagacact

SEQ ID NO: 3868277 - DNA, 23 bp, Homo sapiens
agccctgtcgagacacttgcctt

SEQ ID NO: 3868278 - DNA, 13 bp, Homo sapiens
agcccttcatttg

SEQ ID NO: 3868279 - DNA, 16 bp, Homo sapiens
agcccttccctgcttt

SEQ ID NO: 3868280 - DNA, 17 bp, Homo sapiens
agcccttctgcctttct

SEQ ID NO: 3868281 - DNA, 18 bp, Homo sapiens
agcccttgcccccatccc

SEQ ID NO: 3868282 - DNA, 20 bp, Homo sapiens
agcccttgcccccatccctc

SEQ ID NO: 3868283 - DNA, 21 bp, Homo sapiens
agccctttgcaggcccagcag

SEQ ID NO: 3868284 - DNA, 22 bp, Homo sapiens
agcccttttacagctcttggca

SEQ ID NO: 3868285 - DNA, 14 bp, Homo sapiens
agccgagagcctgc

SEQ ID NO: 3868286 - DNA, 15 bp, Homo sapiens
agccgagagcctgct

SEQ ID NO: 3868287 - DNA, 18 bp, Homo sapiens
agccgagattgcgccact

SEQ ID NO: 3868288 - DNA, 17 bp, Homo sapiens
agccgagccgggcctgg

SEQ ID NO: 3868289 - DNA, 19 bp, Homo sapiens
agccgccgggcaggcctgc

SEQ ID NO: 3868290 - DNA, 18 bp, Homo sapiens
agccgctaggagagactg

SEQ ID NO: 3868291 - DNA, 21 bp, Homo sapiens
agccggcgtggcaaatataaa

SEQ ID NO: 3868292 - DNA, 13 bp, Homo sapiens
agccgggcctggg

SEQ ID NO: 3868293 - DNA, 14 bp, Homo sapiens
agccgtccatggca

SEQ ID NO: 3868294 - DNA, 18 bp, Homo sapiens
agccgtccatggcaccag

SEQ ID NO: 3868295 - DNA, 19 bp, Homo sapiens
agccgtccatggcaccagc

SEQ ID NO: 3868296 - DNA, 21 bp, Homo sapiens
agccgtccatggcaccagccc

SEQ ID NO: 3868297 - DNA, 22 bp, Homo sapiens
agccgtctgactccagagtctg

SEQ ID NO: 3868298 - DNA, 23 bp, Homo sapiens
agccgtctgactccagagtctga

SEQ ID NO: 3868299 - DNA, 20 bp, Homo sapiens
agccgtgatgctcaggcttg

SEQ ID NO: 3868300 - DNA, 23 bp, Homo sapiens
agccgtgcctttctctggctcca

SEQ ID NO: 3868301 - DNA, 23 bp, Homo sapiens
agccgtgctcgcccacaaactga

SEQ ID NO: 3868302 - DNA, 14 bp, Homo sapiens
agcctaaatctaat

SEQ ID NO: 3868303 - DNA, 16 bp, Homo sapiens
agcctagccacctccc

SEQ ID NO: 3868304 - DNA, 17 bp, Homo sapiens
agcctagccacctccca

SEQ ID NO: 3868305 - DNA, 15 bp, Homo sapiens
agcctatttttcaaa

SEQ ID NO: 3868306 - DNA, 21 bp, Homo sapiens
agcctcaagtcttatttcctc

SEQ ID NO: 3868307 - DNA, 15 bp, Homo sapiens
agcctcacagaagaa

SEQ ID NO: 3868308 - DNA, 15 bp, Homo sapiens
agcctcagctcagcc

SEQ ID NO: 3868309 - DNA, 14 bp, Homo sapiens
agcctcagtgccac

SEQ ID NO: 3868310 - DNA, 14 bp, Homo sapiens
agcctcatatttaa

SEQ ID NO: 3868311 - DNA, 20 bp, Homo sapiens
agcctcatatttaaagacag

SEQ ID NO: 3868312 - DNA, 21 bp, Homo sapiens
agcctccaagctccatctcca

SEQ ID NO: 3868313 - DNA, 18 bp, Homo sapiens
agcctccaccttgctctt

SEQ ID NO: 3868314 - DNA, 14 bp, Homo sapiens
agcctccagagcca

SEQ ID NO: 3868315 - DNA, 17 bp, Homo sapiens
agcctccagagccagcc

SEQ ID NO: 3868316 - DNA, 17 bp, Homo sapiens
agcctccatgctgcctc

SEQ ID NO: 3868317 - DNA, 11 bp, Homo sapiens
agcctcccaga

SEQ ID NO: 3868318 - DNA, 15 bp, Homo sapiens
agcctccccctcaga

SEQ ID NO: 3868319 - DNA, 17 bp, Homo sapiens
agcctccccctgctgct

SEQ ID NO: 3868320 - DNA, 17 bp, Homo sapiens
agcctcccgagtagctg

SEQ ID NO: 3868321 - DNA, 14 bp, Homo sapiens
agcctccctcctcg

SEQ ID NO: 3868322 - DNA, 18 bp, Homo sapiens
agcctccctcctcgtccc

SEQ ID NO: 3868323 - DNA, 19 bp, Homo sapiens
agcctccgtttatgggcct

SEQ ID NO: 3868324 - DNA, 22 bp, Homo sapiens
agcctccgtttatgggccttgc

SEQ ID NO: 3868325 - DNA, 12 bp, Homo sapiens
agcctcctcctg

SEQ ID NO: 3868326 - DNA, 13 bp, Homo sapiens
agcctcctctctc

SEQ ID NO: 3868327 - DNA, 14 bp, Homo sapiens
agcctcctgacctg

SEQ ID NO: 3868328 - DNA, 19 bp, Homo sapiens
agcctcctgacctgaggct

SEQ ID NO: 3868329 - DNA, 12 bp, Homo sapiens
agctgagaggaa

SEQ ID NO: 3868330 - DNA, 13 bp, Homo sapiens
agctgagaggaag

SEQ ID NO: 3868331 - DNA, 15 bp, Homo sapiens
agctgagaggaagat

SEQ ID NO: 3868332 - DNA, 23 bp, Homo sapiens
agctgagaggaagatgaagagaa

SEQ ID NO: 3868333 - DNA, 22 bp, Homo sapiens
agctgagagtctgaaagacaga

SEQ ID NO: 3868334 - DNA, 22 bp, Homo sapiens
agctgagcaggcccgacagaga

SEQ ID NO: 3868335 - DNA, 17 bp, Homo sapiens
agctgagctcacaaggc

SEQ ID NO: 3868336 - DNA, 20 bp, Homo sapiens
agctgagctcacaaggcagc

SEQ ID NO: 3868337 - DNA, 21 bp, Homo sapiens
agctgagctcacaaggcagca

SEQ ID NO: 3868338 - DNA, 22 bp, Homo sapiens
agctgagctcacaaggcagcaa

SEQ ID NO: 3868339 - DNA, 24 bp, Homo sapiens
agctgaggatcctcacaggagcag

SEQ ID NO: 3868340 - DNA, 12 bp, Homo sapiens
agctgaggtgcc

SEQ ID NO: 3868341 - DNA, 15 bp, Homo sapiens
agctgaggtgcccag

SEQ ID NO: 3868342 - DNA, 17 bp, Homo sapiens
agctgaggtgcccagga

SEQ ID NO: 3868343 - DNA, 18 bp, Homo sapiens
agctgaggtgcccaggag

SEQ ID NO: 3868344 - DNA, 18 bp, Homo sapiens
agctgagtcacctcctcc

SEQ ID NO: 3868345 - DNA, 23 bp, Homo sapiens
agctgagtgactgtaggcaggga

SEQ ID NO: 3868346 - DNA, 20 bp, Homo sapiens
agctgatattatggcaagtg

SEQ ID NO: 3868347 - DNA, 22 bp, Homo sapiens
agctgatgaaactcctgatttt

SEQ ID NO: 3868348 - DNA, 14 bp, Homo sapiens
agctgatggagaag

SEQ ID NO: 3868349 - DNA, 17 bp, Homo sapiens
agctgatggagaaggaa

SEQ ID NO: 3868350 - DNA, 19 bp, Homo sapiens
agctgatggagaaggaagg

SEQ ID NO: 3868351 - DNA, 18 bp, Homo sapiens
agctgatttccaggcccc

SEQ ID NO: 3868352 - DNA, 17 bp, Homo sapiens
agctgcagctgggcccc

SEQ ID NO: 3868353 - DNA, 22 bp, Homo sapiens
agctgcagctgggccccatgct

SEQ ID NO: 3868354 - DNA, 15 bp, Homo sapiens
agctgcagcttcctg

SEQ ID NO: 3868355 - DNA, 17 bp, Homo sapiens
agctgcagcttcctgtc

SEQ ID NO: 3868356 - DNA, 15 bp, Homo sapiens
agctgcatctactca

SEQ ID NO: 3868357 - DNA, 13 bp, Homo sapiens
agctgccagccgg

SEQ ID NO: 3868358 - DNA, 15 bp, Homo sapiens
agctgcctgtagtta

SEQ ID NO: 3868359 - DNA, 18 bp, Homo sapiens
agctgcctgtagttagga

SEQ ID NO: 3868360 - DNA, 19 bp, Homo sapiens
agctgccttcctcatcccc

SEQ ID NO: 3868361 - DNA, 18 bp, Homo sapiens
agctgcgggtctgaagga

SEQ ID NO: 3868362 - DNA, 14 bp, Homo sapiens
agctgctcaaatca

SEQ ID NO: 3868363 - DNA, 15 bp, Homo sapiens
agctgctctgcccct

SEQ ID NO: 3868364 - DNA, 21 bp, Homo sapiens
agctgctctgccccttgggca

SEQ ID NO: 3868365 - DNA, 13 bp, Homo sapiens
agctgctctgcta

SEQ ID NO: 3868366 - DNA, 19 bp, Homo sapiens
agctgctcttagtgcccgc

SEQ ID NO: 3868367 - DNA, 14 bp, Homo sapiens
agctgctgaaacaa

SEQ ID NO: 3868368 - DNA, 15 bp, Homo sapiens
agctgctgaaacaac

SEQ ID NO: 3868369 - DNA, 16 bp, Homo sapiens
agctgctgaaacaaca

SEQ ID NO: 3868370 - DNA, 13 bp, Homo sapiens
agctgctgaagag

SEQ ID NO: 3868371 - DNA, 14 bp, Homo sapiens
agctgcttgactat

SEQ ID NO: 3868372 - DNA, 16 bp, Homo sapiens
agctgcttgactatca

SEQ ID NO: 3868373 - DNA, 19 bp, Homo sapiens
agctgcttgactatcacat

SEQ ID NO: 3868374 - DNA, 15 bp, Homo sapiens
agctgcttgtgggcc

SEQ ID NO: 3868375 - DNA, 10 bp, Homo sapiens
agctggaaat

SEQ ID NO: 3868376 - DNA, 12 bp, Homo sapiens
agctggaaataa

SEQ ID NO: 3868377 - DNA, 12 bp, Homo sapiens
agctggaagcac

SEQ ID NO: 3868378 - DNA, 17 bp, Homo sapiens
agctggaaggcagggca

SEQ ID NO: 3868379 - DNA, 22 bp, Homo sapiens
agctggaaggcagggcagaggg

SEQ ID NO: 3868380 - DNA, 16 bp, Homo sapiens
agctggaattctaaat

SEQ ID NO: 3868381 - DNA, 16 bp, Homo sapiens
agctggacaagaagct

SEQ ID NO: 3868382 - DNA, 16 bp, Homo sapiens
agctggagctcttgga

SEQ ID NO: 3868383 - DNA, 22 bp, Homo sapiens
agctggaggactagaacctgga

SEQ ID NO: 3868384 - DNA, 19 bp, Homo sapiens
agctggcaaaggtggctct

SEQ ID NO: 3868385 - DNA, 15 bp, Homo sapiens
agctggcaggacaca

SEQ ID NO: 3868386 - DNA, 23 bp, Homo sapiens
agctggcaggacacatcccggcc

SEQ ID NO: 3868387 - DNA, 15 bp, Homo sapiens
agctggcattacagc

SEQ ID NO: 3868388 - DNA, 18 bp, Homo sapiens
agctggcattggtctgct

SEQ ID NO: 3868389 - DNA, 16 bp, Homo sapiens
agctggcgactgcagc

SEQ ID NO: 3868390 - DNA, 15 bp, Homo sapiens
agctggctgtcttcc

SEQ ID NO: 3868391 - DNA, 15 bp, Homo sapiens
agctgggacccctcc

SEQ ID NO: 3868392 - DNA, 14 bp, Homo sapiens
agctgggaggaaaa

SEQ ID NO: 3868393 - DNA, 14 bp, Homo sapiens
agctgggaggcatg

SEQ ID NO: 3868394 - DNA, 19 bp, Homo sapiens
agctgggaggcatggccct

SEQ ID NO: 3868395 - DNA, 22 bp, Homo sapiens
agctgggaggcatggccctggg

SEQ ID NO: 3868396 - DNA, 15 bp, Homo sapiens
agctgggagtagcat

SEQ ID NO: 3868397 - DNA, 21 bp, Homo sapiens
agctgggccccatgctctgcc

SEQ ID NO: 3868398 - DNA, 22 bp, Homo sapiens
agctgggccccatgctctgccc

SEQ ID NO: 3868399 - DNA, 17 bp, Homo sapiens
agctgggccggccagcc

SEQ ID NO: 3868400 - DNA, 18 bp, Homo sapiens
agctgggccggccagcct

SEQ ID NO: 3868401 - DNA, 18 bp, Homo sapiens
agctgggggaagggtggt

SEQ ID NO: 3868402 - DNA, 16 bp, Homo sapiens
agctggtgctgcaagg

SEQ ID NO: 3868403 - DNA, 13 bp, Homo sapiens
agctggtgggaag

SEQ ID NO: 3868404 - DNA, 15 bp, Homo sapiens
agctggttagaaatg

SEQ ID NO: 3868405 - DNA, 23 bp, Homo sapiens
agctggttgctacattttcagga

SEQ ID NO: 3868406 - DNA, 15 bp, Homo sapiens
agctgtaaaaagaga

SEQ ID NO: 3868407 - DNA, 16 bp, Homo sapiens
agctgtaactaactca

SEQ ID NO: 3868408 - DNA, 16 bp, Homo sapiens
agctgtagaaatgtat

SEQ ID NO: 3868409 - DNA, 19 bp, Homo sapiens
agctgtagccatggctcag

SEQ ID NO: 3868410 - DNA, 23 bp, Homo sapiens
agctgtagtagccctttctgtgt

SEQ ID NO: 3868411 - DNA, 10 bp, Homo sapiens
agctgtcatg

SEQ ID NO: 3868412 - DNA, 19 bp, Homo sapiens
agctgtcatggaaaagccc

SEQ ID NO: 3868413 - DNA, 23 bp, Homo sapiens
agctgtcatggaaaagcccagtg

SEQ ID NO: 3868414 - DNA, 17 bp, Homo sapiens
agctgtcccctctccct

SEQ ID NO: 3868415 - DNA, 18 bp, Homo sapiens
agcaaatgtttctgcagt

SEQ ID NO: 3868416 - DNA, 18 bp, Homo sapiens
agcaaatttcaaaagaca

SEQ ID NO: 3868417 - DNA, 19 bp, Homo sapiens
agcaacaggttttataatt

SEQ ID NO: 3868418 - DNA, 21 bp, Homo sapiens
agcaaccgtggcccttcctgg

SEQ ID NO: 3868419 - DNA, 12 bp, Homo sapiens
agcaagagagag

SEQ ID NO: 3868420 - DNA, 17 bp, Homo sapiens
agcaagagctggcaaag

SEQ ID NO: 3868421 - DNA, 23 bp, Homo sapiens
agcaagagctggcaaaggtggct

SEQ ID NO: 3868422 - DNA, 20 bp, Homo sapiens
agcaaggacaacctgcccct

SEQ ID NO: 3868423 - DNA, 21 bp, Homo sapiens
agcaaggcccgagcagctgag

SEQ ID NO: 3868424 - DNA, 16 bp, Homo sapiens
agcaaggtgtgaatga

SEQ ID NO: 3868425 - DNA, 21 bp, Homo sapiens
agcaaggtttaaatttgttat

SEQ ID NO: 3868426 - DNA, 20 bp, Homo sapiens
agcaagttctagagaagagg

SEQ ID NO: 3868427 - DNA, 18 bp, Homo sapiens
agcaataattaggatcta

SEQ ID NO: 3868428 - DNA, 23 bp, Homo sapiens
agcaatccatgttagtttttact

SEQ ID NO: 3868429 - DNA, 19 bp, Homo sapiens
agcaatgatgtccagaaga

SEQ ID NO: 3868430 - DNA, 20 bp, Homo sapiens
agcaatgcccgtaatgctta

SEQ ID NO: 3868431 - DNA, 21 bp, Homo sapiens
agcaatgcccgtaatgcttag

SEQ ID NO: 3868432 - DNA, 13 bp, Homo sapiens
agcaatgggaggg

SEQ ID NO: 3868433 - DNA, 16 bp, Homo sapiens
agcaatgggagggggc

SEQ ID NO: 3868434 - DNA, 20 bp, Homo sapiens
agcaatgggagggggctcca

SEQ ID NO: 3868435 - DNA, 23 bp, Homo sapiens
agcaatgggagggggctccatgg

SEQ ID NO: 3868436 - DNA, 15 bp, Homo sapiens
agcaattatattgtc

SEQ ID NO: 3868437 - DNA, 14 bp, Homo sapiens
agcaattcatttca

SEQ ID NO: 3868438 - DNA, 18 bp, Homo sapiens
agcaattcatttcacttt

SEQ ID NO: 3868439 - DNA, 20 bp, Homo sapiens
agcaattcatttcactttaa

SEQ ID NO: 3868440 - DNA, 14 bp, Homo sapiens
agcaattgccctgt

SEQ ID NO: 3868441 - DNA, 19 bp, Homo sapiens
agcacaagttccagctggt

SEQ ID NO: 3868442 - DNA, 20 bp, Homo sapiens
agcacaagttccagctggtc

SEQ ID NO: 3868443 - DNA, 14 bp, Homo sapiens
agcacaccccaagg

SEQ ID NO: 3868444 - DNA, 15 bp, Homo sapiens
agcacaccccaaggg

SEQ ID NO: 3868445 - DNA, 13 bp, Homo sapiens
agcacagccctgg

SEQ ID NO: 3868446 - DNA, 15 bp, Homo sapiens
agcacagccctggga

SEQ ID NO: 3868447 - DNA, 22 bp, Homo sapiens
agcacagccctgggagggggct

SEQ ID NO: 3868448 - DNA, 13 bp, Homo sapiens
agcacaggagaca

SEQ ID NO: 3868449 - DNA, 12 bp, Homo sapiens
agcacaggcagc

SEQ ID NO: 3868450 - DNA, 20 bp, Homo sapiens
agcacaggggccccagatct

SEQ ID NO: 3868451 - DNA, 19 bp, Homo sapiens
agcacattcttaaaggaaa

SEQ ID NO: 3868452 - DNA, 20 bp, Homo sapiens
agcacattcttaaaggaaaa

SEQ ID NO: 3868453 - DNA, 18 bp, Homo sapiens
agcaccagcttctccagg

SEQ ID NO: 3868454 - DNA, 19 bp, Homo sapiens
agcaccagcttctccaggc

SEQ ID NO: 3868455 - DNA, 21 bp, Homo sapiens
agcaccatggaggcaggctcc

SEQ ID NO: 3868456 - DNA, 10 bp, Homo sapiens
agcacccagg

SEQ ID NO: 3868457 - DNA, 11 bp, Homo sapiens
agcacccaggc

SEQ ID NO: 3868458 - DNA, 13 bp, Homo sapiens
agcacccaggctc

SEQ ID NO: 3868459 - DNA, 18 bp, Homo sapiens
agcacccaggctccatgg

SEQ ID NO: 3868460 - DNA, 16 bp, Homo sapiens
agcaccccctcattcc

SEQ ID NO: 3868461 - DNA, 13 bp, Homo sapiens
agcaccctccccc

SEQ ID NO: 3868462 - DNA, 14 bp, Homo sapiens
agcaccctcccccg

SEQ ID NO: 3868463 - DNA, 12 bp, Homo sapiens
agcaccctctcc

SEQ ID NO: 3868464 - DNA, 13 bp, Homo sapiens
agcaccctctccg

SEQ ID NO: 3868465 - DNA, 13 bp, Homo sapiens
agcaccctctcct

SEQ ID NO: 3868466 - DNA, 18 bp, Homo sapiens
agcaccctctcctggggg

SEQ ID NO: 3868467 - DNA, 13 bp, Homo sapiens
agcaccctgggtg

SEQ ID NO: 3868468 - DNA, 15 bp, Homo sapiens
agcacctgaacccca

SEQ ID NO: 3868469 - DNA, 13 bp, Homo sapiens
agcacctgcagat

SEQ ID NO: 3868470 - DNA, 15 bp, Homo sapiens
agcacctgccgacct

SEQ ID NO: 3868471 - DNA, 21 bp, Homo sapiens
agcacctgccgacctcgtcct

SEQ ID NO: 3868472 - DNA, 22 bp, Homo sapiens
agcacctgccgacctcgtcctc

SEQ ID NO: 3868473 - DNA, 22 bp, Homo sapiens
agcaccttaatattattggggt

SEQ ID NO: 3868474 - DNA, 21 bp, Homo sapiens
agcacgtaaatgcgtccctgt

SEQ ID NO: 3868475 - DNA, 17 bp, Homo sapiens
agcactaaggccgtgtc

SEQ ID NO: 3868476 - DNA, 22 bp, Homo sapiens
agcactcccttaggcattattt

SEQ ID NO: 3868477 - DNA, 18 bp, Homo sapiens
agcactcgagaccatcct

SEQ ID NO: 3868478 - DNA, 21 bp, Homo sapiens
agcactcgagaccatcctggc

SEQ ID NO: 3868479 - DNA, 14 bp, Homo sapiens
agcactgatgttgt

SEQ ID NO: 3868480 - DNA, 13 bp, Homo sapiens
agcactgatttca

SEQ ID NO: 3868481 - DNA, 19 bp, Homo sapiens
agcactgcagatagccaga

SEQ ID NO: 3868482 - DNA, 14 bp, Homo sapiens
agcactgccaggag

SEQ ID NO: 3868483 - DNA, 15 bp, Homo sapiens
agcactgccaggagg

SEQ ID NO: 3868484 - DNA, 12 bp, Homo sapiens
agcactgctcca

SEQ ID NO: 3868485 - DNA, 17 bp, Homo sapiens
agcactggagtgcaggg

SEQ ID NO: 3868486 - DNA, 23 bp, Homo sapiens
agcactggagtgcagggaggaga

SEQ ID NO: 3868487 - DNA, 15 bp, Homo sapiens
agcactggccagaga

SEQ ID NO: 3868488 - DNA, 14 bp, Homo sapiens
agcacttgcgtcct

SEQ ID NO: 3868489 - DNA, 13 bp, Homo sapiens
agcacttgctgta

SEQ ID NO: 3868490 - DNA, 17 bp, Homo sapiens
agcacttgttccttctg

SEQ ID NO: 3868491 - DNA, 23 bp, Homo sapiens
agcagaaaagtgcttagaaagtt

SEQ ID NO: 3868492 - DNA, 16 bp, Homo sapiens
agcagacagagaaatg

SEQ ID NO: 3868493 - DNA, 17 bp, Homo sapiens
agcagagcaaatgaggg

SEQ ID NO: 3868494 - DNA, 21 bp, Homo sapiens
agcagagctgatggagaagga

SEQ ID NO: 3868495 - DNA, 23 bp, Homo sapiens
agcagagctgatggagaaggaag

SEQ ID NO: 3868496 - DNA, 13 bp, Homo sapiens
agcagatctgaaa

SEQ ID NO: 3868497 - DNA, 17 bp, Homo sapiens
agcagcaaaaatataaa

SEQ ID NO: 3868498 - DNA, 19 bp, Homo sapiens
agcagcacgattttgcaca

SEQ ID NO: 3868499 - DNA, 19 bp, Homo sapiens
agcagcattcagcacaccc

SEQ ID NO: 3868500 - DNA, 13 bp, Homo sapiens
agcagccagccag

SEQ ID NO: 3868501 - DNA, 14 bp, Homo sapiens
agcagccagccagt

SEQ ID NO: 3868502 - DNA, 16 bp, Homo sapiens
agcagccagccagtct

SEQ ID NO: 3868503 - DNA, 12 bp, Homo sapiens
agcagccagccc

SEQ ID NO: 3868504 - DNA, 20 bp, Homo sapiens
agcagccagccctgcctgga

SEQ ID NO: 3868505 - DNA, 21 bp, Homo sapiens
agcagccagccctgcctggag

SEQ ID NO: 3868506 - DNA, 13 bp, Homo sapiens
agcagcccaaatt

SEQ ID NO: 3868507 - DNA, 18 bp, Homo sapiens
agcagcccatggcctctg

SEQ ID NO: 3868508 - DNA, 12 bp, Homo sapiens
agcagccctcct

SEQ ID NO: 3868509 - DNA, 14 bp, Homo sapiens
agcagccctcctca

SEQ ID NO: 3868510 - DNA, 23 bp, Homo sapiens
agcagcggtaccccagggcctac

SEQ ID NO: 3868511 - DNA, 18 bp, Homo sapiens
agcagctgaacagccaaa

SEQ ID NO: 3868512 - DNA, 20 bp, Homo sapiens
agcagctggctctccacctt

SEQ ID NO: 3868513 - DNA, 21 bp, Homo sapiens
agcagctgggacccctcccaa

SEQ ID NO: 3868514 - DNA, 13 bp, Homo sapiens
agcagctggtcaa

SEQ ID NO: 3868515 - DNA, 18 bp, Homo sapiens
agcaggaacagagactct

SEQ ID NO: 3868516 - DNA, 20 bp, Homo sapiens
agcaggaacagagactctgg

SEQ ID NO: 3868517 - DNA, 19 bp, Homo sapiens
agcaggaaggatggcaagc

SEQ ID NO: 3868518 - DNA, 16 bp, Homo sapiens
agcaggcacatggagg

SEQ ID NO: 3868519 - DNA, 19 bp, Homo sapiens
agcaggcacatggaggagc

SEQ ID NO: 3868520 - DNA, 17 bp, Homo sapiens
agcaggcccgacagaga

SEQ ID NO: 3868521 - DNA, 23 bp, Homo sapiens
agcaggcccgacagagagatgaa

SEQ ID NO: 3868522 - DNA, 17 bp, Homo sapiens
agcagggaaagctccac

SEQ ID NO: 3868523 - DNA, 21 bp, Homo sapiens
agcagggaaagctccacggtg

SEQ ID NO: 3868524 - DNA, 14 bp, Homo sapiens
agcaggtaccactg

SEQ ID NO: 3868525 - DNA, 19 bp, Homo sapiens
agcaggtgcaagagacaga

SEQ ID NO: 3868526 - DNA, 18 bp, Homo sapiens
agcaggtggtcctgagac

SEQ ID NO: 3868527 - DNA, 21 bp, Homo sapiens
agcaggtggtcctgagacctg

SEQ ID NO: 3868528 - DNA, 18 bp, Homo sapiens
agcaggtgtggtggctca

SEQ ID NO: 3868529 - DNA, 19 bp, Homo sapiens
agcagtaaactttctctgc

SEQ ID NO: 3868530 - DNA, 18 bp, Homo sapiens
agcagtcagggtgggaag

SEQ ID NO: 3868531 - DNA, 22 bp, Homo sapiens
agcagtgagaaaaagctcctgt

SEQ ID NO: 3868532 - DNA, 22 bp, Homo sapiens
agcagtgagccgcatcttctcc

SEQ ID NO: 3868533 - DNA, 19 bp, Homo sapiens
agcagtgcctcgaggcacc

SEQ ID NO: 3868534 - DNA, 21 bp, Homo sapiens
agcagtgcctcgaggcaccgg

SEQ ID NO: 3868535 - DNA, 16 bp, Homo sapiens
agcagtgcttgtaaac

SEQ ID NO: 3868536 - DNA, 17 bp, Homo sapiens
agcagtggagagtgttc

SEQ ID NO: 3868537 - DNA, 13 bp, Homo sapiens
agcagtgtcatca

SEQ ID NO: 3868538 - DNA, 16 bp, Homo sapiens
agcagttctgcagagg

SEQ ID NO: 3868539 - DNA, 23 bp, Homo sapiens
agcagttgagtcgtcatcacttt

SEQ ID NO: 3868540 - DNA, 15 bp, Homo sapiens
agcatcatgcctctg

SEQ ID NO: 3868541 - DNA, 18 bp, Homo sapiens
agcatcatgcctctgagg

SEQ ID NO: 3868542 - DNA, 19 bp, Homo sapiens
agcatcatgcctctgaggc

SEQ ID NO: 3868543 - DNA, 13 bp, Homo sapiens
agcatccagcctg

SEQ ID NO: 3868544 - DNA, 14 bp, Homo sapiens
agcatccagcctgt

SEQ ID NO: 3868545 - DNA, 19 bp, Homo sapiens
agcatcgtgacccttcagg

SEQ ID NO: 3868546 - DNA, 23 bp, Homo sapiens
agcatcgtgacccttcagggcca

SEQ ID NO: 3868547 - DNA, 20 bp, Homo sapiens
agcatctcagcctaccatga

SEQ ID NO: 3868548 - DNA, 12 bp, Homo sapiens
agcatcttctgg

SEQ ID NO: 3868549 - DNA, 21 bp, Homo sapiens
agcatgcaataatgtgcaaat

SEQ ID NO: 3868550 - DNA, 17 bp, Homo sapiens
agcatgcacagctgctt

SEQ ID NO: 3868551 - DNA, 20 bp, Homo sapiens
agcatgcacagctgcttgtc

SEQ ID NO: 3868552 - DNA, 21 bp, Homo sapiens
agcatgcctccaaaaattcac

SEQ ID NO: 3868553 - DNA, 15 bp, Homo sapiens
agcatggactctggg

SEQ ID NO: 3868554 - DNA, 16 bp, Homo sapiens
agcatggctgtgagga

SEQ ID NO: 3868555 - DNA, 17 bp, Homo sapiens
agcatggctgtgaggat

SEQ ID NO: 3868556 - DNA, 22 bp, Homo sapiens
agcatggtcccacatccctggg

SEQ ID NO: 3868557 - DNA, 11 bp, Homo sapiens
agcatgtacaa

SEQ ID NO: 3868558 - DNA, 12 bp, Homo sapiens
agcatgtacaaa

SEQ ID NO: 3868559 - DNA, 21 bp, Homo sapiens
agcatgtacaaaagtaccata

SEQ ID NO: 3868560 - DNA, 18 bp, Homo sapiens
agcattacgtgagccagg

SEQ ID NO: 3868561 - DNA, 13 bp, Homo sapiens
agcattcagcaca

SEQ ID NO: 3868562 - DNA, 21 bp, Homo sapiens
agcattcagcacaccccaagg

SEQ ID NO: 3868563 - DNA, 18 bp, Homo sapiens
agcattctcactcctacc

SEQ ID NO: 3868564 - DNA, 20 bp, Homo sapiens
agcattctcactcctacctg

SEQ ID NO: 3868565 - DNA, 17 bp, Homo sapiens
agcattctgagctgggc

SEQ ID NO: 3868566 - DNA, 13 bp, Homo sapiens
agcatttatgttt

SEQ ID NO: 3868567 - DNA, 19 bp, Homo sapiens
agcattttactacttgtta

SEQ ID NO: 3868568 - DNA, 11 bp, Homo sapiens
agcattttata

SEQ ID NO: 3868569 - DNA, 19 bp, Homo sapiens
agcattttatatccacatc

SEQ ID NO: 3868570 - DNA, 16 bp, Homo sapiens
agcatttttgatttat

SEQ ID NO: 3868571 - DNA, 20 bp, Homo sapiens
agccaaacacactgtaaata

SEQ ID NO: 3868572 - DNA, 12 bp, Homo sapiens
agccaacagcag

SEQ ID NO: 3868573 - DNA, 15 bp, Homo sapiens
agccaacaggtggca

SEQ ID NO: 3868574 - DNA, 14 bp, Homo sapiens
agccaactcctcct

SEQ ID NO: 3868575 - DNA, 15 bp, Homo sapiens
agccaactcctcctt

SEQ ID NO: 3868576 - DNA, 19 bp, Homo sapiens
agccacaaaataaatgttg

SEQ ID NO: 3868577 - DNA, 17 bp, Homo sapiens
agccacacttctcagga

SEQ ID NO: 3868578 - DNA, 10 bp, Homo sapiens
agccacagaa

SEQ ID NO: 3868579 - DNA, 17 bp, Homo sapiens
agccacagaagccagga

SEQ ID NO: 3868580 - DNA, 22 bp, Homo sapiens
agccacagaagccaggagcaaa

SEQ ID NO: 3868581 - DNA, 11 bp, Homo sapiens
agccacatccc

SEQ ID NO: 3868582 - DNA, 14 bp, Homo sapiens
agccaccctgagga

SEQ ID NO: 3868583 - DNA, 13 bp, Homo sapiens
agccacctcccac

SEQ ID NO: 3868584 - DNA, 14 bp, Homo sapiens
agccacctcccacc

SEQ ID NO: 3868585 - DNA, 16 bp, Homo sapiens
agccacctcccacccc

SEQ ID NO: 3868586 - DNA, 17 bp, Homo sapiens
agccacctcccacccca

SEQ ID NO: 3868587 - DNA, 22 bp, Homo sapiens
agccacctcccaccccactcca

SEQ ID NO: 3868588 - DNA, 14 bp, Homo sapiens
agccacctctcttt

SEQ ID NO: 3868589 - DNA, 18 bp, Homo sapiens
agccacctctctttttca

SEQ ID NO: 3868590 - DNA, 23 bp, Homo sapiens
agccacgctgtcctctcgagccc

SEQ ID NO: 3868591 - DNA, 14 bp, Homo sapiens
agccacgtgaatgg

SEQ ID NO: 3868592 - DNA, 15 bp, Homo sapiens
agccacgtgaatggc

SEQ ID NO: 3868593 - DNA, 21 bp, Homo sapiens
agccacgttccttactgcaga

SEQ ID NO: 3868594 - DNA, 18 bp, Homo sapiens
agccactgtgctgaattc

SEQ ID NO: 3868595 - DNA, 22 bp, Homo sapiens
agccagaatcttcgtcctgccc

SEQ ID NO: 3868596 - DNA, 14 bp, Homo sapiens
agccagactggcac

SEQ ID NO: 3868597 - DNA, 15 bp, Homo sapiens
agccagagagacaga

SEQ ID NO: 3868598 - DNA, 17 bp, Homo sapiens
agccagagaggagcacc

SEQ ID NO: 3868599 - DNA, 17 bp, Homo sapiens
agccagcccagcccagc

SEQ ID NO: 3868600 - DNA, 16 bp, Homo sapiens
agccagccctccctgt

SEQ ID NO: 3868601 - DNA, 18 bp, Homo sapiens
agccagccctccctgtcc

SEQ ID NO: 3868602 - DNA, 14 bp, Homo sapiens
agccagccctgcct

SEQ ID NO: 3868603 - DNA, 17 bp, Homo sapiens
agccagccctgcctgga

SEQ ID NO: 3868604 - DNA, 18 bp, Homo sapiens
agccagccctgcctggag

SEQ ID NO: 3868605 - DNA, 24 bp, Homo sapiens
agccagccctgcctggaggacctg

SEQ ID NO: 3868606 - DNA, 15 bp, Homo sapiens
agccagccgccctgg

SEQ ID NO: 3868607 - DNA, 22 bp, Homo sapiens
agccagccgccctgggctgtct

SEQ ID NO: 3868608 - DNA, 19 bp, Homo sapiens
agccagccggggcgagtgg

SEQ ID NO: 3868609 - DNA, 15 bp, Homo sapiens
agccagccggtgcct

SEQ ID NO: 3868610 - DNA, 13 bp, Homo sapiens
agccagcctggga

SEQ ID NO: 3868611 - DNA, 13 bp, Homo sapiens
agccaggagcaaa

SEQ ID NO: 3868612 - DNA, 22 bp, Homo sapiens
agccaggagcaaatgtttctgc

SEQ ID NO: 3868613 - DNA, 16 bp, Homo sapiens
agccaggagtctgtgc

SEQ ID NO: 3868614 - DNA, 11 bp, Homo sapiens
agccagggcca

SEQ ID NO: 3868615 - DNA, 14 bp, Homo sapiens
agccagggccaggg

SEQ ID NO: 3868616 - DNA, 16 bp, Homo sapiens
agccaggggctgctca

SEQ ID NO: 3868617 - DNA, 17 bp, Homo sapiens
agccaggggctgctcat

SEQ ID NO: 3868618 - DNA, 18 bp, Homo sapiens
agccagtcttgcctaggc

SEQ ID NO: 3868619 - DNA, 12 bp, Homo sapiens
agccagtgactt

SEQ ID NO: 3868620 - DNA, 14 bp, Homo sapiens
agccagtgactttt

SEQ ID NO: 3868621 - DNA, 14 bp, Homo sapiens
agccatcacaaggg

SEQ ID NO: 3868622 - DNA, 15 bp, Homo sapiens
agccatcacaagggg

SEQ ID NO: 3868623 - DNA, 23 bp, Homo sapiens
agccatcacaaggggaacgcaga

SEQ ID NO: 3868624 - DNA, 22 bp, Homo sapiens
agccatctccatcttgaaggaa

SEQ ID NO: 3868625 - DNA, 18 bp, Homo sapiens
agccatgaggagttgctg

SEQ ID NO: 3868626 - DNA, 12 bp, Homo sapiens
agccatggctca

SEQ ID NO: 3868627 - DNA, 20 bp, Homo sapiens
agccatgggcctgggcctgc

SEQ ID NO: 3868628 - DNA, 17 bp, Homo sapiens
agccatttgttggggca

SEQ ID NO: 3868629 - DNA, 18 bp, Homo sapiens
agccatttgttggggcag

SEQ ID NO: 3868630 - DNA, 19 bp, Homo sapiens
agcccaagaggtctgagcc

SEQ ID NO: 3868631 - DNA, 14 bp, Homo sapiens
agcccaagtgccat

SEQ ID NO: 3868632 - DNA, 17 bp, Homo sapiens
agcccaagtgccatccc

SEQ ID NO: 3868633 - DNA, 14 bp, Homo sapiens
agcccacacccctc

SEQ ID NO: 3868634 - DNA, 15 bp, Homo sapiens
agcccacacccctcc

SEQ ID NO: 3868635 - DNA, 22 bp, Homo sapiens
agcccacgcccgactagcaggc

SEQ ID NO: 3868636 - DNA, 23 bp, Homo sapiens
agcccagagggccaagagagaca

SEQ ID NO: 3868637 - DNA, 22 bp, Homo sapiens
agcccagctacattcctcagct

SEQ ID NO: 3868638 - DNA, 17 bp, Homo sapiens
agcccagctctgctttt

SEQ ID NO: 3868639 - DNA, 14 bp, Homo sapiens
agcccagcttcctg

SEQ ID NO: 3868640 - DNA, 17 bp, Homo sapiens
agcccagcttcctggtg

SEQ ID NO: 3868641 - DNA, 23 bp, Homo sapiens
agcccaggagctgagtcacctcc

SEQ ID NO: 3868642 - DNA, 11 bp, Homo sapiens
agcccaggccg

SEQ ID NO: 3868643 - DNA, 17 bp, Homo sapiens
agcccagtgacctgacc

SEQ ID NO: 3868644 - DNA, 21 bp, Homo sapiens
agcccataaggccagaaactc

SEQ ID NO: 3868645 - DNA, 16 bp, Homo sapiens
agcccatggcctctgg

SEQ ID NO: 3868646 - DNA, 22 bp, Homo sapiens
agcccatggcctctggccaggc

SEQ ID NO: 3868647 - DNA, 17 bp, Homo sapiens
agcccattctctctcct

SEQ ID NO: 3868648 - DNA, 19 bp, Homo sapiens
agcccattctctctcctgt

SEQ ID NO: 3868649 - DNA, 22 bp, Homo sapiens
agcccattctctctcctgtcca

SEQ ID NO: 3868650 - DNA, 13 bp, Homo sapiens
agcccatttcaat

SEQ ID NO: 3868651 - DNA, 22 bp, Homo sapiens
agccccaaaccagggtgcatgg

SEQ ID NO: 3868652 - DNA, 23 bp, Homo sapiens
agccccaaagtcaattaaaggct

SEQ ID NO: 3868653 - DNA, 12 bp, Homo sapiens
agccccacagca

SEQ ID NO: 3868654 - DNA, 18 bp, Homo sapiens
agccccacagcacccagg

SEQ ID NO: 3868655 - DNA, 19 bp, Homo sapiens
agccccacagcacccaggc

SEQ ID NO: 3868656 - DNA, 13 bp, Homo sapiens
agccccactcccg

SEQ ID NO: 3868657 - DNA, 19 bp, Homo sapiens
agccccactcccggccagg

SEQ ID NO: 3868658 - DNA, 12 bp, Homo sapiens
agccccagggcc

SEQ ID NO: 3868659 - DNA, 20 bp, Homo sapiens
agccccagggcctgggggca

SEQ ID NO: 3868660 - DNA, 16 bp, Homo sapiens
agccccccacaatgat

SEQ ID NO: 3868661 - DNA, 16 bp, Homo sapiens
agccccccacctttct

SEQ ID NO: 3868662 - DNA, 22 bp, Homo sapiens
agccccccccttgaatctgcag

SEQ ID NO: 3868663 - DNA, 23 bp, Homo sapiens
agccccctggatgtcccctgtcc

SEQ ID NO: 3868664 - DNA, 21 bp, Homo sapiens
agccccgctcctcccctcttg

SEQ ID NO: 3868665 - DNA, 19 bp, Homo sapiens
agcccctaggaaagcagtg

SEQ ID NO: 3868666 - DNA, 13 bp, Homo sapiens
agcccctcagccc

SEQ ID NO: 3868667 - DNA, 16 bp, Homo sapiens
agcccctcagcccttg

SEQ ID NO: 3868668 - DNA, 21 bp, Homo sapiens
agcccctcagcccttgccccc

SEQ ID NO: 3868669 - DNA, 11 bp, Homo sapiens
agcccctcctc

SEQ ID NO: 3868670 - DNA, 19 bp, Homo sapiens
agcccctcctctgccacct

SEQ ID NO: 3868671 - DNA, 20 bp, Homo sapiens
agcccctcctctgccacctc

SEQ ID NO: 3868672 - DNA, 21 bp, Homo sapiens
agcccctcctctgccacctcc

SEQ ID NO: 3868673 - DNA, 18 bp, Homo sapiens
agatcaggaagagaagga

SEQ ID NO: 3868674 - DNA, 15 bp, Homo sapiens
agatccacacacaga

SEQ ID NO: 3868675 - DNA, 17 bp, Homo sapiens
agatccacacacagagg

SEQ ID NO: 3868676 - DNA, 13 bp, Homo sapiens
agatccaccctca

SEQ ID NO: 3868677 - DNA, 14 bp, Homo sapiens
agatccaccctcaa

SEQ ID NO: 3868678 - DNA, 22 bp, Homo sapiens
agatccatttggacaaaatgga

SEQ ID NO: 3868679 - DNA, 22 bp, Homo sapiens
agatcccatgtcacctcagctg

SEQ ID NO: 3868680 - DNA, 19 bp, Homo sapiens
agatcccgcctcttcttct

SEQ ID NO: 3868681 - DNA, 15 bp, Homo sapiens
agatcgcgccactgc

SEQ ID NO: 3868682 - DNA, 16 bp, Homo sapiens
agatcgcttgagccca

SEQ ID NO: 3868683 - DNA, 17 bp, Homo sapiens
agatcgcttgagcccag

SEQ ID NO: 3868684 - DNA, 20 bp, Homo sapiens
agatcgtattaattatctga

SEQ ID NO: 3868685 - DNA, 13 bp, Homo sapiens
agatctcctattt

SEQ ID NO: 3868686 - DNA, 20 bp, Homo sapiens
agatctgatggtgagctggg

SEQ ID NO: 3868687 - DNA, 15 bp, Homo sapiens
agatctgcactgggt

SEQ ID NO: 3868688 - DNA, 16 bp, Homo sapiens
agatctgcactgggtg

SEQ ID NO: 3868689 - DNA, 21 bp, Homo sapiens
agatctgcagggggtgtgtct

SEQ ID NO: 3868690 - DNA, 12 bp, Homo sapiens
agatctgcctgg

SEQ ID NO: 3868691 - DNA, 13 bp, Homo sapiens
agatctgcctggg

SEQ ID NO: 3868692 - DNA, 23 bp, Homo sapiens
agatctggaaccttaccacgtta

SEQ ID NO: 3868693 - DNA, 16 bp, Homo sapiens
agatcttacatctgca

SEQ ID NO: 3868694 - DNA, 16 bp, Homo sapiens
agatcttctttataac

SEQ ID NO: 3868695 - DNA, 13 bp, Homo sapiens
agatctttcagga

SEQ ID NO: 3868696 - DNA, 12 bp, Homo sapiens
agatgaagagaa

SEQ ID NO: 3868697 - DNA, 16 bp, Homo sapiens
agatgagaggcagagg

SEQ ID NO: 3868698 - DNA, 17 bp, Homo sapiens
agatgagatttgccagc

SEQ ID NO: 3868699 - DNA, 15 bp, Homo sapiens
agatgatctctccac

SEQ ID NO: 3868700 - DNA, 19 bp, Homo sapiens
agatgatgatgatctttaa

SEQ ID NO: 3868701 - DNA, 15 bp, Homo sapiens
agatgatgatgatga

SEQ ID NO: 3868702 - DNA, 17 bp, Homo sapiens
agatgatgatgatgatg

SEQ ID NO: 3868703 - DNA, 16 bp, Homo sapiens
agatgcaacctcacta

SEQ ID NO: 3868704 - DNA, 19 bp, Homo sapiens
agatgcaacctcactatgg

SEQ ID NO: 3868705 - DNA, 13 bp, Homo sapiens
agatgcctccacc

SEQ ID NO: 3868706 - DNA, 14 bp, Homo sapiens
agatgcctccaccg

SEQ ID NO: 3868707 - DNA, 17 bp, Homo sapiens
agatggaaagaaagcac

SEQ ID NO: 3868708 - DNA, 17 bp, Homo sapiens
agatggaatagaaaaga

SEQ ID NO: 3868709 - DNA, 14 bp, Homo sapiens
agatggacccctcc

SEQ ID NO: 3868710 - DNA, 17 bp, Homo sapiens
agatggacccctccctt

SEQ ID NO: 3868711 - DNA, 18 bp, Homo sapiens
agatggacccctcccttg

SEQ ID NO: 3868712 - DNA, 22 bp, Homo sapiens
agatggctgtgcctctgcctgt

SEQ ID NO: 3868713 - DNA, 21 bp, Homo sapiens
agatgggcacatgaggagggt

SEQ ID NO: 3868714 - DNA, 16 bp, Homo sapiens
agatgggtattaaact

SEQ ID NO: 3868715 - DNA, 17 bp, Homo sapiens
agatgggtctggctgag

SEQ ID NO: 3868716 - DNA, 21 bp, Homo sapiens
agatgggtctggctgagctga

SEQ ID NO: 3868717 - DNA, 22 bp, Homo sapiens
agatgggtctggctgagctgaa

SEQ ID NO: 3868718 - DNA, 23 bp, Homo sapiens
agatgggtctggctgagctgaac

SEQ ID NO: 3868719 - DNA, 16 bp, Homo sapiens
agatggtagcagataa

SEQ ID NO: 3868720 - DNA, 23 bp, Homo sapiens
agatggtcagtgtggagaggggt

SEQ ID NO: 3868721 - DNA, 15 bp, Homo sapiens
agatggtgaaattta

SEQ ID NO: 3868722 - DNA, 22 bp, Homo sapiens
agatggttagtggggtaattct

SEQ ID NO: 3868723 - DNA, 17 bp, Homo sapiens
agatgtaaaaggtatta

SEQ ID NO: 3868724 - DNA, 20 bp, Homo sapiens
agatgtcagccgagccgggc

SEQ ID NO: 3868725 - DNA, 22 bp, Homo sapiens
agatgtgaacacatcagcttgc

SEQ ID NO: 3868726 - DNA, 12 bp, Homo sapiens
agatgtgatgct

SEQ ID NO: 3868727 - DNA, 13 bp, Homo sapiens
agatgtgatgctg

SEQ ID NO: 3868728 - DNA, 16 bp, Homo sapiens
agatgtgcaaatgcaa

SEQ ID NO: 3868729 - DNA, 18 bp, Homo sapiens
agatgtgcaaatgcaagc

SEQ ID NO: 3868730 - DNA, 15 bp, Homo sapiens
agatgtttgtcagat

SEQ ID NO: 3868731 - DNA, 17 bp, Homo sapiens
agatgtttgtcagatat

SEQ ID NO: 3868732 - DNA, 12 bp, Homo sapiens
agattaaaggaa

SEQ ID NO: 3868733 - DNA, 14 bp, Homo sapiens
agattaaaggaagg

SEQ ID NO: 3868734 - DNA, 17 bp, Homo sapiens
agattaaaggaaggaaa

SEQ ID NO: 3868735 - DNA, 14 bp, Homo sapiens
agattaatggcact

SEQ ID NO: 3868736 - DNA, 14 bp, Homo sapiens
agattagctctgga

SEQ ID NO: 3868737 - DNA, 15 bp, Homo sapiens
agattagctctggac

SEQ ID NO: 3868738 - DNA, 22 bp, Homo sapiens
agattccagagagtggctcctc

SEQ ID NO: 3868739 - DNA, 12 bp, Homo sapiens
agattccaggat

SEQ ID NO: 3868740 - DNA, 12 bp, Homo sapiens
agattcccagag

SEQ ID NO: 3868741 - DNA, 20 bp, Homo sapiens
agattcctcttgcctctctc

SEQ ID NO: 3868742 - DNA, 19 bp, Homo sapiens
agattctacatattcttta

SEQ ID NO: 3868743 - DNA, 22 bp, Homo sapiens
agattgagaagttttgtacaga

SEQ ID NO: 3868744 - DNA, 18 bp, Homo sapiens
agattgagagaagagaca

SEQ ID NO: 3868745 - DNA, 13 bp, Homo sapiens
agattgaggcctg

SEQ ID NO: 3868746 - DNA, 20 bp, Homo sapiens
agattggacatggtctcctc

SEQ ID NO: 3868747 - DNA, 15 bp, Homo sapiens
agattgtgtaacaat

SEQ ID NO: 3868748 - DNA, 22 bp, Homo sapiens
agatttaccttttctgttgtac

SEQ ID NO: 3868749 - DNA, 13 bp, Homo sapiens
agatttcaacata

SEQ ID NO: 3868750 - DNA, 13 bp, Homo sapiens
agatttcttttaa

SEQ ID NO: 3868751 - DNA, 21 bp, Homo sapiens
agattttacctgggatatgac

SEQ ID NO: 3868752 - DNA, 18 bp, Homo sapiens
agattttgtcgggacaga

SEQ ID NO: 3868753 - DNA, 16 bp, Homo sapiens
agatttttaacgaatg

SEQ ID NO: 3868754 - DNA, 15 bp, Homo sapiens
agatttttgggctcc

SEQ ID NO: 3868755 - DNA, 21 bp, Homo sapiens
agcaaaataattttaaacaaa

SEQ ID NO: 3868756 - DNA, 16 bp, Homo sapiens
agcaaagagtgggctg

SEQ ID NO: 3868757 - DNA, 14 bp, Homo sapiens
agcaaaggaaacca

SEQ ID NO: 3868758 - DNA, 23 bp, Homo sapiens
agcaaagtctaaagtttacagta

SEQ ID NO: 3868759 - DNA, 18 bp, Homo sapiens
agaccctgagactccaga

SEQ ID NO: 3868760 - DNA, 11 bp, Homo sapiens
agaccctgcct

SEQ ID NO: 3868761 - DNA, 14 bp, Homo sapiens
agaccctgcctgag

SEQ ID NO: 3868762 - DNA, 22 bp, Homo sapiens
agaccctgcctgagcccaggag

SEQ ID NO: 3868763 - DNA, 20 bp, Homo sapiens
agaccctggaattcagcacc

SEQ ID NO: 3868764 - DNA, 17 bp, Homo sapiens
agaccgcttcacccctg

SEQ ID NO: 3868765 - DNA, 15 bp, Homo sapiens
agaccgggggccaga

SEQ ID NO: 3868766 - DNA, 17 bp, Homo sapiens
agaccgggggccagaca

SEQ ID NO: 3868767 - DNA, 19 bp, Homo sapiens
agaccgtgatttggaagag

SEQ ID NO: 3868768 - DNA, 14 bp, Homo sapiens
agacctagacctgg

SEQ ID NO: 3868769 - DNA, 19 bp, Homo sapiens
agacctagacctgggccaa

SEQ ID NO: 3868770 - DNA, 12 bp, Homo sapiens
agacctcagcca

SEQ ID NO: 3868771 - DNA, 13 bp, Homo sapiens
agacctccccacc

SEQ ID NO: 3868772 - DNA, 20 bp, Homo sapiens
agacctctcaacagatctgt

SEQ ID NO: 3868773 - DNA, 14 bp, Homo sapiens
agacctctgatccc

SEQ ID NO: 3868774 - DNA, 23 bp, Homo sapiens
agacctctgtgaggaaagcacac

SEQ ID NO: 3868775 - DNA, 19 bp, Homo sapiens
agacctgacaagcactgct

SEQ ID NO: 3868776 - DNA, 20 bp, Homo sapiens
agacctgacaccgtccctca

SEQ ID NO: 3868777 - DNA, 22 bp, Homo sapiens
agacctgacaccgtccctcagt

SEQ ID NO: 3868778 - DNA, 23 bp, Homo sapiens
agacctgacaccgtccctcagtg

SEQ ID NO: 3868779 - DNA, 16 bp, Homo sapiens
agacctgggccaaaag

SEQ ID NO: 3868780 - DNA, 23 bp, Homo sapiens
agacctgggccaaaagggcagcc

SEQ ID NO: 3868781 - DNA, 16 bp, Homo sapiens
agaccttttctctccc

SEQ ID NO: 3868782 - DNA, 22 bp, Homo sapiens
agaccttttctctcccatacca

SEQ ID NO: 3868783 - DNA, 23 bp, Homo sapiens
agaccttttctctcccataccat

SEQ ID NO: 3868784 - DNA, 13 bp, Homo sapiens
agacgctcctgaa

SEQ ID NO: 3868785 - DNA, 14 bp, Homo sapiens
agacggattgcatt

SEQ ID NO: 3868786 - DNA, 23 bp, Homo sapiens
agacggtgctcgcttctcctcca

SEQ ID NO: 3868787 - DNA, 12 bp, Homo sapiens
agacgtgaatgt

SEQ ID NO: 3868788 - DNA, 17 bp, Homo sapiens
agacgttaccaattatg

SEQ ID NO: 3868789 - DNA, 15 bp, Homo sapiens
agactaacctgccca

SEQ ID NO: 3868790 - DNA, 15 bp, Homo sapiens
agactaagccctgtc

SEQ ID NO: 3868791 - DNA, 20 bp, Homo sapiens
agactaatagagacacagag

SEQ ID NO: 3868792 - DNA, 14 bp, Homo sapiens
agactaattaaaat

SEQ ID NO: 3868793 - DNA, 16 bp, Homo sapiens
agactaattaaaatct

SEQ ID NO: 3868794 - DNA, 20 bp, Homo sapiens
agactaattaaaatctggaa

SEQ ID NO: 3868795 - DNA, 14 bp, Homo sapiens
agactaatttaaaa

SEQ ID NO: 3868796 - DNA, 18 bp, Homo sapiens
agactatatacatgtgtg

SEQ ID NO: 3868797 - DNA, 21 bp, Homo sapiens
agactatatacatgtgtgtat

SEQ ID NO: 3868798 - DNA, 16 bp, Homo sapiens
agactatggagcctgg

SEQ ID NO: 3868799 - DNA, 12 bp, Homo sapiens
agactattcaaa

SEQ ID NO: 3868800 - DNA, 18 bp, Homo sapiens
agactattcaaacagtct

SEQ ID NO: 3868801 - DNA, 17 bp, Homo sapiens
agactatttaacttgag

SEQ ID NO: 3868802 - DNA, 18 bp, Homo sapiens
agactcacctctgcctca

SEQ ID NO: 3868803 - DNA, 19 bp, Homo sapiens
agactcacctctgcctcaa

SEQ ID NO: 3868804 - DNA, 11 bp, Homo sapiens
agactcagctc

SEQ ID NO: 3868805 - DNA, 13 bp, Homo sapiens
agactcagtgttc

SEQ ID NO: 3868806 - DNA, 15 bp, Homo sapiens
agactcatctacaca

SEQ ID NO: 3868807 - DNA, 14 bp, Homo sapiens
agactccaaagaaa

SEQ ID NO: 3868808 - DNA, 16 bp, Homo sapiens
agactccaaagaaatg

SEQ ID NO: 3868809 - DNA, 23 bp, Homo sapiens
agactccaagattcaaagagact

SEQ ID NO: 3868810 - DNA, 24 bp, Homo sapiens
agactccagaatctgctgttgcca

SEQ ID NO: 3868811 - DNA, 16 bp, Homo sapiens
agactcctgccctgtt

SEQ ID NO: 3868812 - DNA, 16 bp, Homo sapiens
agactctgaaatctca

SEQ ID NO: 3868813 - DNA, 20 bp, Homo sapiens
agactctgaaatctcagaat

SEQ ID NO: 3868814 - DNA, 12 bp, Homo sapiens
agactctggaag

SEQ ID NO: 3868815 - DNA, 16 bp, Homo sapiens
agactctggaagcccc

SEQ ID NO: 3868816 - DNA, 21 bp, Homo sapiens
agactctgggtccctcggagc

SEQ ID NO: 3868817 - DNA, 16 bp, Homo sapiens
agactgaaagcagcag

SEQ ID NO: 3868818 - DNA, 17 bp, Homo sapiens
agactgaaagcagcagc

SEQ ID NO: 3868819 - DNA, 13 bp, Homo sapiens
agactgaagagac

SEQ ID NO: 3868820 - DNA, 15 bp, Homo sapiens
agactgagaggcaga

SEQ ID NO: 3868821 - DNA, 13 bp, Homo sapiens
agactgagggaga

SEQ ID NO: 3868822 - DNA, 12 bp, Homo sapiens
agactgattacc

SEQ ID NO: 3868823 - DNA, 14 bp, Homo sapiens
agactgcagctgct

SEQ ID NO: 3868824 - DNA, 16 bp, Homo sapiens
agactgcagctgctga

SEQ ID NO: 3868825 - DNA, 17 bp, Homo sapiens
agactgcagctgctgaa

SEQ ID NO: 3868826 - DNA, 23 bp, Homo sapiens
agactgcgatttgtcccaggtcc

SEQ ID NO: 3868827 - DNA, 19 bp, Homo sapiens
agactgcttccaattttct

SEQ ID NO: 3868828 - DNA, 19 bp, Homo sapiens
agactggagtgaggcttcc

SEQ ID NO: 3868829 - DNA, 23 bp, Homo sapiens
agactggcacagttttctgagaa

SEQ ID NO: 3868830 - DNA, 18 bp, Homo sapiens
agactgttaaatgaaacc

SEQ ID NO: 3868831 - DNA, 15 bp, Homo sapiens
agactgttgctcaaa

SEQ ID NO: 3868832 - DNA, 19 bp, Homo sapiens
agacttaagattaaattat

SEQ ID NO: 3868833 - DNA, 18 bp, Homo sapiens
agacttacttattcttcc

SEQ ID NO: 3868834 - DNA, 20 bp, Homo sapiens
agacttcagaacatgctgga

SEQ ID NO: 3868835 - DNA, 24 bp, Homo sapiens
agacttcaggttgttctgtataaa

SEQ ID NO: 3868836 - DNA, 15 bp, Homo sapiens
agacttccctgaatg

SEQ ID NO: 3868837 - DNA, 19 bp, Homo sapiens
agacttccctgaatgtatt

SEQ ID NO: 3868838 - DNA, 16 bp, Homo sapiens
agacttcgactcagga

SEQ ID NO: 3868839 - DNA, 21 bp, Homo sapiens
agacttctggaaggctggctg

SEQ ID NO: 3868840 - DNA, 22 bp, Homo sapiens
agacttgacaacatcccacagt

SEQ ID NO: 3868841 - DNA, 13 bp, Homo sapiens
agactttagctta

SEQ ID NO: 3868842 - DNA, 18 bp, Homo sapiens
agacttttatcaaaatcc

SEQ ID NO: 3868843 - DNA, 18 bp, Homo sapiens
agagaaaaaccaatgatt

SEQ ID NO: 3868844 - DNA, 16 bp, Homo sapiens
agagaaaaagaaatgc

SEQ ID NO: 3868845 - DNA, 11 bp, Homo sapiens
agagaaatctc

SEQ ID NO: 3868846 - DNA, 13 bp, Homo sapiens
agagaaatggcaa

SEQ ID NO: 3868847 - DNA, 20 bp, Homo sapiens
agagaaatttttatttttga

SEQ ID NO: 3868848 - DNA, 14 bp, Homo sapiens
agagaagaaagtgt

SEQ ID NO: 3868849 - DNA, 20 bp, Homo sapiens
agagaagccacgctgtcctc

SEQ ID NO: 3868850 - DNA, 20 bp, Homo sapiens
agagaagctaaaacctgagc

SEQ ID NO: 3868851 - DNA, 14 bp, Homo sapiens
agagaagctgagaa

SEQ ID NO: 3868852 - DNA, 13 bp, Homo sapiens
agagaaggagcca

SEQ ID NO: 3868853 - DNA, 13 bp, Homo sapiens
agagaaggcagga

SEQ ID NO: 3868854 - DNA, 20 bp, Homo sapiens
agagaaggcaggaatgtgtg

SEQ ID NO: 3868855 - DNA, 22 bp, Homo sapiens
agagaaggcccataccttctgg

SEQ ID NO: 3868856 - DNA, 23 bp, Homo sapiens
agagaaggcccataccttctggt

SEQ ID NO: 3868857 - DNA, 13 bp, Homo sapiens
agagaaggcctct

SEQ ID NO: 3868858 - DNA, 19 bp, Homo sapiens
agagaataaagacttcatg

SEQ ID NO: 3868859 - DNA, 18 bp, Homo sapiens
agagaatatatttttgat

SEQ ID NO: 3868860 - DNA, 13 bp, Homo sapiens
agagaatatttca

SEQ ID NO: 3868861 - DNA, 22 bp, Homo sapiens
agagaatctgaagctattgatg

SEQ ID NO: 3868862 - DNA, 13 bp, Homo sapiens
agagaatctgcct

SEQ ID NO: 3868863 - DNA, 20 bp, Homo sapiens
agagacaaacacctcccagg

SEQ ID NO: 3868864 - DNA, 16 bp, Homo sapiens
agagacacctgcacct

SEQ ID NO: 3868865 - DNA, 15 bp, Homo sapiens
agagacagagagaga

SEQ ID NO: 3868866 - DNA, 13 bp, Homo sapiens
agagacaggaaaa

SEQ ID NO: 3868867 - DNA, 14 bp, Homo sapiens
agagacaggagggc

SEQ ID NO: 3868868 - DNA, 20 bp, Homo sapiens
agagacaggcccaagagatg

SEQ ID NO: 3868869 - DNA, 21 bp, Homo sapiens
agagacattgcctccacctct

SEQ ID NO: 3868870 - DNA, 14 bp, Homo sapiens
agagaccacagcaa

SEQ ID NO: 3868871 - DNA, 13 bp, Homo sapiens
agagacccaagga

SEQ ID NO: 3868872 - DNA, 21 bp, Homo sapiens
agagacccaaggaggaaaaac

SEQ ID NO: 3868873 - DNA, 14 bp, Homo sapiens
agagaccccttcct

SEQ ID NO: 3868874 - DNA, 19 bp, Homo sapiens
agagaccttttctctccca

SEQ ID NO: 3868875 - DNA, 20 bp, Homo sapiens
agagaccttttctctcccat

SEQ ID NO: 3868876 - DNA, 20 bp, Homo sapiens
agagacgcagccctgggggc

SEQ ID NO: 3868877 - DNA, 15 bp, Homo sapiens
agagactcaaagaga

SEQ ID NO: 3868878 - DNA, 22 bp, Homo sapiens
agagactctggcctccacagtt

SEQ ID NO: 3868879 - DNA, 13 bp, Homo sapiens
agagactgaaagc

SEQ ID NO: 3868880 - DNA, 16 bp, Homo sapiens
agagactgaaagcagc

SEQ ID NO: 3868881 - DNA, 18 bp, Homo sapiens
agagactgaaagcagcag

SEQ ID NO: 3868882 - DNA, 19 bp, Homo sapiens
agagactgaaagcagcagc

SEQ ID NO: 3868883 - DNA, 20 bp, Homo sapiens
agagactgaaagcagcagct

SEQ ID NO: 3868884 - DNA, 20 bp, Homo sapiens
agagactgagggagagactc

SEQ ID NO: 3868885 - DNA, 13 bp, Homo sapiens
agagactggagca

SEQ ID NO: 3868886 - DNA, 17 bp, Homo sapiens
agagactggagcatctg

SEQ ID NO: 3868887 - DNA, 21 bp, Homo sapiens
agagagaaagaagtaggcatg

SEQ ID NO: 3868888 - DNA, 20 bp, Homo sapiens
agagagaacaactactgtga

SEQ ID NO: 3868889 - DNA, 18 bp, Homo sapiens
agagagactcaaagagac

SEQ ID NO: 3868890 - DNA, 12 bp, Homo sapiens
agagagagactg

SEQ ID NO: 3868891 - DNA, 14 bp, Homo sapiens
agagagaggcagaa

SEQ ID NO: 3868892 - DNA, 15 bp, Homo sapiens
agagagaggttctgg

SEQ ID NO: 3868893 - DNA, 14 bp, Homo sapiens
agagagagtgtttg

SEQ ID NO: 3868894 - DNA, 22 bp, Homo sapiens
agagagctcgctcttgggagtc

SEQ ID NO: 3868895 - DNA, 17 bp, Homo sapiens
agagaggaatcagactt

SEQ ID NO: 3868896 - DNA, 18 bp, Homo sapiens
agagaggaccccactgga

SEQ ID NO: 3868897 - DNA, 17 bp, Homo sapiens
agagaggcacctgctgg

SEQ ID NO: 3868898 - DNA, 20 bp, Homo sapiens
agagaggccttttggaatgt

SEQ ID NO: 3868899 - DNA, 22 bp, Homo sapiens
agagaggggaataatagaagaa

SEQ ID NO: 3868900 - DNA, 12 bp, Homo sapiens
agagagggggct

SEQ ID NO: 3868901 - DNA, 17 bp, Homo sapiens
agagaggtagcgagctg

SEQ ID NO: 3868902 - DNA, 22 bp, Homo sapiens
agagaggtagcgagctgctctg

SEQ ID NO: 3868903 - DNA, 17 bp, Homo sapiens
agagaggttctggggag

SEQ ID NO: 3868904 - DNA, 15 bp, Homo sapiens
agagagtcctctgga

SEQ ID NO: 3868905 - DNA, 22 bp, Homo sapiens
agagagtcctctggatggcacc

SEQ ID NO: 3868906 - DNA, 14 bp, Homo sapiens
agagagtggctcct

SEQ ID NO: 3868907 - DNA, 21 bp, Homo sapiens
agagatacattccctatcaaa

SEQ ID NO: 3868908 - DNA, 16 bp, Homo sapiens
agagatctagaaagtg

SEQ ID NO: 3868909 - DNA, 18 bp, Homo sapiens
agagatctagaaagtggg

SEQ ID NO: 3868910 - DNA, 19 bp, Homo sapiens
agagatctagaaagtgggt

SEQ ID NO: 3868911 - DNA, 23 bp, Homo sapiens
agagatgatcgtgcctataaata

SEQ ID NO: 3868912 - DNA, 14 bp, Homo sapiens
agagatgcctccac

SEQ ID NO: 3868913 - DNA, 17 bp, Homo sapiens
agagatgcctccaccgc

SEQ ID NO: 3868914 - DNA, 17 bp, Homo sapiens
agagatgggatttcatc

SEQ ID NO: 3868915 - DNA, 12 bp, Homo sapiens
agagatgtagca

SEQ ID NO: 3868916 - DNA, 15 bp, Homo sapiens
agagattaattttaa

SEQ ID NO: 3868917 - DNA, 15 bp, Homo sapiens
agagattgcttctca

SEQ ID NO: 3868918 - DNA, 18 bp, Homo sapiens
agagatttcaacaagaat

SEQ ID NO: 3868919 - DNA, 21 bp, Homo sapiens
agagatttcctccatggtgga

SEQ ID NO: 3868920 - DNA, 18 bp, Homo sapiens
agagattttgtcgggaca

SEQ ID NO: 3868921 - DNA, 16 bp, Homo sapiens
agagcaaatgagggag

SEQ ID NO: 3868922 - DNA, 19 bp, Homo sapiens
agagcacaagttccagctg

SEQ ID NO: 3868923 - DNA, 12 bp, Homo sapiens
agagcactgctc

SEQ ID NO: 3868924 - DNA, 20 bp, Homo sapiens
agagcagaacggagccccag

SEQ ID NO: 3868925 - DNA, 13 bp, Homo sapiens
agagcagagagca

SEQ ID NO: 3868926 - DNA, 11 bp, Homo sapiens
agagcagcctg

SEQ ID NO: 3868927 - DNA, 11 bp, Homo sapiens
agagcagctgg

SEQ ID NO: 3868928 - DNA, 12 bp, Homo sapiens
agagcagctggc

SEQ ID NO: 3868929 - DNA, 13 bp, Homo sapiens
agagcagctggct

SEQ ID NO: 3868930 - DNA, 14 bp, Homo sapiens
agagcaggaatggg

SEQ ID NO: 3868931 - DNA, 20 bp, Homo sapiens
agagcaggcacatggaggag

SEQ ID NO: 3868932 - DNA, 13 bp, Homo sapiens
agagcaggctcag

SEQ ID NO: 3868933 - DNA, 15 bp, Homo sapiens
agagcatcatgcctc

SEQ ID NO: 3868934 - DNA, 20 bp, Homo sapiens
agagcatcatgcctctgagg

SEQ ID NO: 3868935 - DNA, 21 bp, Homo sapiens
agagcatcatgcctctgaggc

SEQ ID NO: 3868936 - DNA, 22 bp, Homo sapiens
agagcatcatgcctctgaggcc

SEQ ID NO: 3868937 - DNA, 16 bp, Homo sapiens
agagcatcgtgaccct

SEQ ID NO: 3868938 - DNA, 19 bp, Homo sapiens
agagcatcgtgacccttca

SEQ ID NO: 3868939 - DNA, 17 bp, Homo sapiens
agagcattacgtgagcc

SEQ ID NO: 3868940 - DNA, 22 bp, Homo sapiens
agagcattacgtgagccaggta

SEQ ID NO: 3868941 - DNA, 22 bp, Homo sapiens
agagccagaacctggagggcta

SEQ ID NO: 3868942 - DNA, 17 bp, Homo sapiens
agagccagccctccctg

SEQ ID NO: 3868943 - DNA, 20 bp, Homo sapiens
agagccagccctccctgtcc

SEQ ID NO: 3868944 - DNA, 13 bp, Homo sapiens
agagccagcctgg

SEQ ID NO: 3868945 - DNA, 13 bp, Homo sapiens
agagccagctctc

SEQ ID NO: 3868946 - DNA, 14 bp, Homo sapiens
agagccagctctct

SEQ ID NO: 3868947 - DNA, 16 bp, Homo sapiens
agagccagctctctct

SEQ ID NO: 3868948 - DNA, 17 bp, Homo sapiens
agagccaggctctgcct

SEQ ID NO: 3868949 - DNA, 18 bp, Homo sapiens
agagccaggctctgcctg

SEQ ID NO: 3868950 - DNA, 19 bp, Homo sapiens
agagccatgggcctgggcc

SEQ ID NO: 3868951 - DNA, 22 bp, Homo sapiens
agagccatgggcctgggcctgc

SEQ ID NO: 3868952 - DNA, 15 bp, Homo sapiens
agagccccacacgga

SEQ ID NO: 3868953 - DNA, 13 bp, Homo sapiens
agagcccccaagg

SEQ ID NO: 3868954 - DNA, 18 bp, Homo sapiens
agagccccccgtgtggct

SEQ ID NO: 3868955 - DNA, 22 bp, Homo sapiens
agagccccccgtgtggcttaca

SEQ ID NO: 3868956 - DNA, 20 bp, Homo sapiens
agagccctgctgtgggagag

SEQ ID NO: 3868957 - DNA, 15 bp, Homo sapiens
agagcccttcatttg

SEQ ID NO: 3868958 - DNA, 15 bp, Homo sapiens
agagccgggccccgg

SEQ ID NO: 3868959 - DNA, 17 bp, Homo sapiens
agagcctagccacctcc

SEQ ID NO: 3868960 - DNA, 20 bp, Homo sapiens
agagcctagccacctcccac

SEQ ID NO: 3868961 - DNA, 19 bp, Homo sapiens
agagcctgctcccccaccc

SEQ ID NO: 3868962 - DNA, 20 bp, Homo sapiens
agagcctgctcccccacccc

SEQ ID NO: 3868963 - DNA, 15 bp, Homo sapiens
agagcctggagaagc

SEQ ID NO: 3868964 - DNA, 13 bp, Homo sapiens
agagcctggggct

SEQ ID NO: 3868965 - DNA, 23 bp, Homo sapiens
agagcctggggctctaacgcctg

SEQ ID NO: 3868966 - DNA, 18 bp, Homo sapiens
agagcctgtgctaaagaa

SEQ ID NO: 3868967 - DNA, 17 bp, Homo sapiens
agagccttggtgtccac

SEQ ID NO: 3868968 - DNA, 19 bp, Homo sapiens
agagccttggtgtccacct

SEQ ID NO: 3868969 - DNA, 23 bp, Homo sapiens
agagcctttggatgaccagaaca

SEQ ID NO: 3868970 - DNA, 19 bp, Homo sapiens
agagcggggaggtgcctga

SEQ ID NO: 3868971 - DNA, 20 bp, Homo sapiens
agagcgtggctgtgctctca

SEQ ID NO: 3868972 - DNA, 23 bp, Homo sapiens
agagctagaacccggcaggctag

SEQ ID NO: 3868973 - DNA, 16 bp, Homo sapiens
agagctagaacctgga

SEQ ID NO: 3868974 - DNA, 19 bp, Homo sapiens
agagctagaacctggagag

SEQ ID NO: 3868975 - DNA, 13 bp, Homo sapiens
agagctagcgctg

SEQ ID NO: 3868976 - DNA, 14 bp, Homo sapiens
agagctagcgctgc

SEQ ID NO: 3868977 - DNA, 16 bp, Homo sapiens
agagctagcgctgccg

SEQ ID NO: 3868978 - DNA, 21 bp, Homo sapiens
agagctagcgctgccgcaccc

SEQ ID NO: 3868979 - DNA, 15 bp, Homo sapiens
agagctatggtgagg

SEQ ID NO: 3868980 - DNA, 14 bp, Homo sapiens
agagctcctgtccc

SEQ ID NO: 3868981 - DNA, 20 bp, Homo sapiens
agagctcctgtccctaccca

SEQ ID NO: 3868982 - DNA, 21 bp, Homo sapiens
agagctcctgtccctacccac

SEQ ID NO: 3868983 - DNA, 22 bp, Homo sapiens
agagctcctgtccctacccact

SEQ ID NO: 3868984 - DNA, 23 bp, Homo sapiens
agagctcctgtccctacccactc

SEQ ID NO: 3868985 - DNA, 21 bp, Homo sapiens
agagctcttcggtttctgagc

SEQ ID NO: 3868986 - DNA, 18 bp, Homo sapiens
agagctgatggagaagga

SEQ ID NO: 3868987 - DNA, 22 bp, Homo sapiens
agagctgctctggaaaatgtga

SEQ ID NO: 3868988 - DNA, 22 bp, Homo sapiens
agagctgctgtccttttaggaa

SEQ ID NO: 3868989 - DNA, 16 bp, Homo sapiens
agagctggaaggcagg

SEQ ID NO: 3868990 - DNA, 23 bp, Homo sapiens
agagctggaaggcagggcagagg

SEQ ID NO: 3868991 - DNA, 14 bp, Homo sapiens
agagctggctgtct

SEQ ID NO: 3868992 - DNA, 20 bp, Homo sapiens
agagctgggaaacagggagc

SEQ ID NO: 3868993 - DNA, 18 bp, Homo sapiens
agagcttattggccactg

SEQ ID NO: 3868994 - DNA, 19 bp, Homo sapiens
agagcttattggccactgg

SEQ ID NO: 3868995 - DNA, 22 bp, Homo sapiens
agagcttggacagtctgagctg

SEQ ID NO: 3868996 - DNA, 20 bp, Homo sapiens
agagcttggtggctgagctt

SEQ ID NO: 3868997 - DNA, 14 bp, Homo sapiens
agagctttctttca

SEQ ID NO: 3868998 - DNA, 16 bp, Homo sapiens
agaggaaaaaaatgac

SEQ ID NO: 3868999 - DNA, 22 bp, Homo sapiens
agaggaagatgaagagaagctg

SEQ ID NO: 3869000 - DNA, 20 bp, Homo sapiens
agaggaccacagtgggtggc

SEQ ID NO: 3869001 - DNA, 21 bp, Homo sapiens
agaggactacacatcagggct

SEQ ID NO: 3869002 - DNA, 12 bp, Homo sapiens
agaggactctgc

SEQ ID NO: 3869003 - DNA, 12 bp, Homo sapiens
agaggagaggaa

SEQ ID NO: 3869004 - DNA, 13 bp, Homo sapiens
agaggatgttctg

SEQ ID NO: 3869005 - DNA, 14 bp, Homo sapiens
agaggatgttctgg

SEQ ID NO: 3869006 - DNA, 18 bp, Homo sapiens
agaggcaagagacagaat

SEQ ID NO: 3869007 - DNA, 17 bp, Homo sapiens
agaggcagagaaagaag

SEQ ID NO: 3869008 - DNA, 22 bp, Homo sapiens
agaggcatgtgatgtgcaagga

SEQ ID NO: 3869009 - DNA, 13 bp, Homo sapiens
agaggcccaggga

SEQ ID NO: 3869010 - DNA, 16 bp, Homo sapiens
agaggcccagggagca

SEQ ID NO: 3869011 - DNA, 12 bp, Homo sapiens
agaggccctgga

SEQ ID NO: 3869012 - DNA, 23 bp, Homo sapiens
agaggccctggatcagcgtggcc

SEQ ID NO: 3869013 - DNA, 21 bp, Homo sapiens
agaggcctttaaccatggtgc

SEQ ID NO: 3869014 - DNA, 19 bp, Homo sapiens
agaggccttttggaatgtg

SEQ ID NO: 3869015 - DNA, 21 bp, Homo sapiens
agaggcgcgtctgccccaccc

SEQ ID NO: 3869016 - DNA, 14 bp, Homo sapiens
actttgggcccaga

SEQ ID NO: 3869017 - DNA, 13 bp, Homo sapiens
actttgtcccgct

SEQ ID NO: 3869018 - DNA, 13 bp, Homo sapiens
actttgtctctga

SEQ ID NO: 3869019 - DNA, 11 bp, Homo sapiens
actttgttcac

SEQ ID NO: 3869020 - DNA, 12 bp, Homo sapiens
acttttaaacag

SEQ ID NO: 3869021 - DNA, 15 bp, Homo sapiens
acttttaaacagtga

SEQ ID NO: 3869022 - DNA, 16 bp, Homo sapiens
acttttccaagccctt

SEQ ID NO: 3869023 - DNA, 17 bp, Homo sapiens
acttttccattcccaat

SEQ ID NO: 3869024 - DNA, 21 bp, Homo sapiens
acttttctttattgctgtgaa

SEQ ID NO: 3869025 - DNA, 12 bp, Homo sapiens
acttttgtaaga

SEQ ID NO: 3869026 - DNA, 17 bp, Homo sapiens
acttttgtcttcctcac

SEQ ID NO: 3869027 - DNA, 10 bp, Homo sapiens
actttttagc

SEQ ID NO: 3869028 - DNA, 22 bp, Homo sapiens
actttttagccagtgacttttt

SEQ ID NO: 3869029 - DNA, 17 bp, Homo sapiens
actttttagtcttttac

SEQ ID NO: 3869030 - DNA, 18 bp, Homo sapiens
actttttagtcttttact

SEQ ID NO: 3869031 - DNA, 19 bp, Homo sapiens
actttttataatgtggatt

SEQ ID NO: 3869032 - DNA, 17 bp, Homo sapiens
actttttctgagctttt

SEQ ID NO: 3869033 - DNA, 15 bp, Homo sapiens
agaaaaaataaatgg

SEQ ID NO: 3869034 - DNA, 21 bp, Homo sapiens
agaaaaaattaagagatacat

SEQ ID NO: 3869035 - DNA, 19 bp, Homo sapiens
agaaaaaccaatgattcat

SEQ ID NO: 3869036 - DNA, 23 bp, Homo sapiens
agaaaaatatatatgtgcagtat

SEQ ID NO: 3869037 - DNA, 19 bp, Homo sapiens
agaaaaatttacatggcaa

SEQ ID NO: 3869038 - DNA, 17 bp, Homo sapiens
agaaaacaaatcttcaa

SEQ ID NO: 3869039 - DNA, 22 bp, Homo sapiens
agaaaacattcatccagttgca

SEQ ID NO: 3869040 - DNA, 21 bp, Homo sapiens
agaaaacggagagtgcttggg

SEQ ID NO: 3869041 - DNA, 16 bp, Homo sapiens
agaaaagaaaaccatt

SEQ ID NO: 3869042 - DNA, 18 bp, Homo sapiens
agaaaagaccctgagact

SEQ ID NO: 3869043 - DNA, 18 bp, Homo sapiens
agaaaagaggagaccctg

SEQ ID NO: 3869044 - DNA, 19 bp, Homo sapiens
agaaaagatgagaggcaga

SEQ ID NO: 3869045 - DNA, 18 bp, Homo sapiens
agaaaagcacctgccgac

SEQ ID NO: 3869046 - DNA, 23 bp, Homo sapiens
agaaaagggaagttgtgcctttt

SEQ ID NO: 3869047 - DNA, 14 bp, Homo sapiens
agaaaagtagaatt

SEQ ID NO: 3869048 - DNA, 19 bp, Homo sapiens
agaaaagtagaattatatc

SEQ ID NO: 3869049 - DNA, 22 bp, Homo sapiens
agaaaagtgcttagaaagttat

SEQ ID NO: 3869050 - DNA, 18 bp, Homo sapiens
agaaaatgcaaaatgaaa

SEQ ID NO: 3869051 - DNA, 23 bp, Homo sapiens
agaaacacaaatgtaaaataagt

SEQ ID NO: 3869052 - DNA, 19 bp, Homo sapiens
agaaacacagggttttgta

SEQ ID NO: 3869053 - DNA, 14 bp, Homo sapiens
agaaacagatacca

SEQ ID NO: 3869054 - DNA, 16 bp, Homo sapiens
agaaacagataccata

SEQ ID NO: 3869055 - DNA, 13 bp, Homo sapiens
agaaacatgacac

SEQ ID NO: 3869056 - DNA, 14 bp, Homo sapiens
agaaacatgacact

SEQ ID NO: 3869057 - DNA, 15 bp, Homo sapiens
agaaaccagtatgga

SEQ ID NO: 3869058 - DNA, 17 bp, Homo sapiens
agaaaccagtatggaag

SEQ ID NO: 3869059 - DNA, 18 bp, Homo sapiens
agaaaccagtatggaagg

SEQ ID NO: 3869060 - DNA, 17 bp, Homo sapiens
agaaaccgtaattttat

SEQ ID NO: 3869061 - DNA, 18 bp, Homo sapiens
agaaaccgtaattttatt

SEQ ID NO: 3869062 - DNA, 17 bp, Homo sapiens
agaaaccttaatatgtg

SEQ ID NO: 3869063 - DNA, 21 bp, Homo sapiens
agaaactcaaccatcaatgga

SEQ ID NO: 3869064 - DNA, 14 bp, Homo sapiens
agaaactccttttg

SEQ ID NO: 3869065 - DNA, 12 bp, Homo sapiens
agaaactgagga

SEQ ID NO: 3869066 - DNA, 16 bp, Homo sapiens
agaaactgaggagtag

SEQ ID NO: 3869067 - DNA, 18 bp, Homo sapiens
agaaactgaggagtagct

SEQ ID NO: 3869068 - DNA, 22 bp, Homo sapiens
agaaactgaggagtagctgaga

SEQ ID NO: 3869069 - DNA, 23 bp, Homo sapiens
agaaacttaaggttacctttgtt

SEQ ID NO: 3869070 - DNA, 17 bp, Homo sapiens
agaaagaaaagaccctg

SEQ ID NO: 3869071 - DNA, 13 bp, Homo sapiens
agaaagaaacact

SEQ ID NO: 3869072 - DNA, 16 bp, Homo sapiens
agaaagaatgcaagag

SEQ ID NO: 3869073 - DNA, 16 bp, Homo sapiens
agaaagactattcaaa

SEQ ID NO: 3869074 - DNA, 19 bp, Homo sapiens
agaaagaggtgaccccagg

SEQ ID NO: 3869075 - DNA, 22 bp, Homo sapiens
agaaagatccaccctcaaatgt

SEQ ID NO: 3869076 - DNA, 16 bp, Homo sapiens
agaaagcattacattt

SEQ ID NO: 3869077 - DNA, 19 bp, Homo sapiens
agaaagctctgcatgtgtg

SEQ ID NO: 3869078 - DNA, 20 bp, Homo sapiens
agaaagctggtaaactattt

SEQ ID NO: 3869079 - DNA, 20 bp, Homo sapiens
agaaagggagggctctgagg

SEQ ID NO: 3869080 - DNA, 14 bp, Homo sapiens
agaaagggcaaatt

SEQ ID NO: 3869081 - DNA, 15 bp, Homo sapiens
agaaagggtctgata

SEQ ID NO: 3869082 - DNA, 23 bp, Homo sapiens
agaaagggtctgataaacacaga

SEQ ID NO: 3869083 - DNA, 21 bp, Homo sapiens
agaaagtggccatgccaccct

SEQ ID NO: 3869084 - DNA, 14 bp, Homo sapiens
agaaagtgggttca

SEQ ID NO: 3869085 - DNA, 22 bp, Homo sapiens
agaaagttattgtgttgcctta

SEQ ID NO: 3869086 - DNA, 11 bp, Homo sapiens
agaaataaact

SEQ ID NO: 3869087 - DNA, 15 bp, Homo sapiens
agaaataaattttgt

SEQ ID NO: 3869088 - DNA, 16 bp, Homo sapiens
agaaataattgttgat

SEQ ID NO: 3869089 - DNA, 15 bp, Homo sapiens
agaaatactgctctg

SEQ ID NO: 3869090 - DNA, 23 bp, Homo sapiens
agaaatactgctctgaatatttt

SEQ ID NO: 3869091 - DNA, 19 bp, Homo sapiens
agaaatagctccgtggagc

SEQ ID NO: 3869092 - DNA, 22 bp, Homo sapiens
agaaatatgattttatttgaca

SEQ ID NO: 3869093 - DNA, 14 bp, Homo sapiens
agaaatatgtggtt

SEQ ID NO: 3869094 - DNA, 18 bp, Homo sapiens
agaaatattataaatcca

SEQ ID NO: 3869095 - DNA, 17 bp, Homo sapiens
agaaatcattgtagaaa

SEQ ID NO: 3869096 - DNA, 19 bp, Homo sapiens
agaaatccctgtttaatat

SEQ ID NO: 3869097 - DNA, 13 bp, Homo sapiens
agaaatctgaaaa

SEQ ID NO: 3869098 - DNA, 12 bp, Homo sapiens
agaaatgcagaa

SEQ ID NO: 3869099 - DNA, 17 bp, Homo sapiens
agaaatgtgaagggtgg

SEQ ID NO: 3869100 - DNA, 20 bp, Homo sapiens
agaaatgtgaagggtggggt

SEQ ID NO: 3869101 - DNA, 17 bp, Homo sapiens
agaaattagaaacctta

SEQ ID NO: 3869102 - DNA, 15 bp, Homo sapiens
agaaattagctgtgt

SEQ ID NO: 3869103 - DNA, 16 bp, Homo sapiens
agaaattatttaataa

SEQ ID NO: 3869104 - DNA, 17 bp, Homo sapiens
agaaattatttaataaa

SEQ ID NO: 3869105 - DNA, 19 bp, Homo sapiens
agaaattcctgtagcatct

SEQ ID NO: 3869106 - DNA, 23 bp, Homo sapiens
agaaattcctgtagcatcttctg

SEQ ID NO: 3869107 - DNA, 19 bp, Homo sapiens
agaaatttttatttttgaa

SEQ ID NO: 3869108 - DNA, 17 bp, Homo sapiens
agaacaagtcacagctg

SEQ ID NO: 3869109 - DNA, 19 bp, Homo sapiens
agaacaagtcacagctgca

SEQ ID NO: 3869110 - DNA, 22 bp, Homo sapiens
agaacacagtgcctggcaaggc

SEQ ID NO: 3869111 - DNA, 13 bp, Homo sapiens
agaacacccactg

SEQ ID NO: 3869112 - DNA, 14 bp, Homo sapiens
agaacacccactgg

SEQ ID NO: 3869113 - DNA, 15 bp, Homo sapiens
agaacacccactggc

SEQ ID NO: 3869114 - DNA, 11 bp, Homo sapiens
agaacaccttt

SEQ ID NO: 3869115 - DNA, 13 bp, Homo sapiens
agaacagcagagg

SEQ ID NO: 3869116 - DNA, 18 bp, Homo sapiens
agaacagcagaggttctt

SEQ ID NO: 3869117 - DNA, 18 bp, Homo sapiens
agaacatctgtcctgtga

SEQ ID NO: 3869118 - DNA, 20 bp, Homo sapiens
agaaccaaaagttttcctga

SEQ ID NO: 3869119 - DNA, 15 bp, Homo sapiens
agaaccacttggctg

SEQ ID NO: 3869120 - DNA, 17 bp, Homo sapiens
agaacccctacatgaaa

SEQ ID NO: 3869121 - DNA, 18 bp, Homo sapiens
agaacctcctattttaat

SEQ ID NO: 3869122 - DNA, 16 bp, Homo sapiens
agaacctggaagggct

SEQ ID NO: 3869123 - DNA, 17 bp, Homo sapiens
agaacctggagagctag

SEQ ID NO: 3869124 - DNA, 12 bp, Homo sapiens
agaacctggagg

SEQ ID NO: 3869125 - DNA, 23 bp, Homo sapiens
agaacctggagggctagaactgg

SEQ ID NO: 3869126 - DNA, 17 bp, Homo sapiens
agaacctggagggctgg

SEQ ID NO: 3869127 - DNA, 12 bp, Homo sapiens
agaacctggcct

SEQ ID NO: 3869128 - DNA, 14 bp, Homo sapiens
agaacctggccttc

SEQ ID NO: 3869129 - DNA, 17 bp, Homo sapiens
agaacctgtagagctag

SEQ ID NO: 3869130 - DNA, 12 bp, Homo sapiens
agaacggaagaa

SEQ ID NO: 3869131 - DNA, 22 bp, Homo sapiens
agaacgtattggtccagcttgc

SEQ ID NO: 3869132 - DNA, 20 bp, Homo sapiens
agaacgtattttaaaagcca

SEQ ID NO: 3869133 - DNA, 14 bp, Homo sapiens
agaactgccccatc

SEQ ID NO: 3869134 - DNA, 22 bp, Homo sapiens
agaactgctaaatactgtacat

SEQ ID NO: 3869135 - DNA, 22 bp, Homo sapiens
agaacttcgaccctttctctga

SEQ ID NO: 3869136 - DNA, 16 bp, Homo sapiens
agaactttgaaggaca

SEQ ID NO: 3869137 - DNA, 13 bp, Homo sapiens
agaagaaatccat

SEQ ID NO: 3869138 - DNA, 17 bp, Homo sapiens
agaagaattgaacccag

SEQ ID NO: 3869139 - DNA, 22 bp, Homo sapiens
agaagaattttcagaccccagc

SEQ ID NO: 3869140 - DNA, 22 bp, Homo sapiens
agaagacatggagactcctgcc

SEQ ID NO: 3869141 - DNA, 21 bp, Homo sapiens
agaagacgggatttgaagctg

SEQ ID NO: 3869142 - DNA, 19 bp, Homo sapiens
agaagactgggctagggag

SEQ ID NO: 3869143 - DNA, 24 bp, Homo sapiens
agaagagatgggatttcatcatgt

SEQ ID NO: 3869144 - DNA, 15 bp, Homo sapiens
agaagagatgtggca

SEQ ID NO: 3869145 - DNA, 13 bp, Homo sapiens
agaagagctgttc

SEQ ID NO: 3869146 - DNA, 20 bp, Homo sapiens
agaagagctgttcacagcca

SEQ ID NO: 3869147 - DNA, 18 bp, Homo sapiens
agaagagggcctgtggga

SEQ ID NO: 3869148 - DNA, 13 bp, Homo sapiens
agaagatagcagg

SEQ ID NO: 3869149 - DNA, 13 bp, Homo sapiens
agaagcaggttct

SEQ ID NO: 3869150 - DNA, 19 bp, Homo sapiens
agaagccctgctgggccca

SEQ ID NO: 3869151 - DNA, 11 bp, Homo sapiens
agaagcctggg

SEQ ID NO: 3869152 - DNA, 14 bp, Homo sapiens
agaagcctgggggc

SEQ ID NO: 3869153 - DNA, 17 bp, Homo sapiens
agaagcctgggggcctg

SEQ ID NO: 3869154 - DNA, 16 bp, Homo sapiens
agaagctgaggatcct

SEQ ID NO: 3869155 - DNA, 16 bp, Homo sapiens
agaagcttcagaagtt

SEQ ID NO: 3869156 - DNA, 17 bp, Homo sapiens
agaagcttcagaagttt

SEQ ID NO: 3869157 - DNA, 15 bp, Homo sapiens
agaaggaaggaggca

SEQ ID NO: 3869158 - DNA, 11 bp, Homo sapiens
agaaggaaggc

SEQ ID NO: 3869159 - DNA, 18 bp, Homo sapiens
agaaggacatgtgctatt

SEQ ID NO: 3869160 - DNA, 17 bp, Homo sapiens
agaaggagggcagagcc

SEQ ID NO: 3869161 - DNA, 19 bp, Homo sapiens
agaaggctgcctaaggagg

SEQ ID NO: 3869162 - DNA, 16 bp, Homo sapiens
agaaggctggggccag

SEQ ID NO: 3869163 - DNA, 15 bp, Homo sapiens
agaagggaaatctta

SEQ ID NO: 3869164 - DNA, 14 bp, Homo sapiens
agaagggccagccc

SEQ ID NO: 3869165 - DNA, 16 bp, Homo sapiens
agaagggccagcccta

SEQ ID NO: 3869166 - DNA, 22 bp, Homo sapiens
agaaggtttggtccagcctggt

SEQ ID NO: 3869167 - DNA, 16 bp, Homo sapiens
agaagtaaatttgtcc

SEQ ID NO: 3869168 - DNA, 19 bp, Homo sapiens
agaagtaaatttgtccaat

SEQ ID NO: 3869169 - DNA, 17 bp, Homo sapiens
agaagtaggcatgaggg

SEQ ID NO: 3869170 - DNA, 14 bp, Homo sapiens
agaagtcaaagtaa

SEQ ID NO: 3869171 - DNA, 22 bp, Homo sapiens
agaagtccctcccatctctacc

SEQ ID NO: 3869172 - DNA, 20 bp, Homo sapiens
agaagtcctatcgactttat

SEQ ID NO: 3869173 - DNA, 17 bp, Homo sapiens
agaagtgagggctgggc

SEQ ID NO: 3869174 - DNA, 18 bp, Homo sapiens
agaagtgagggctgggca

SEQ ID NO: 3869175 - DNA, 21 bp, Homo sapiens
agaagtgagggctgggcagct

SEQ ID NO: 3869176 - DNA, 22 bp, Homo sapiens
agaagtgagggctgggcagctg

SEQ ID NO: 3869177 - DNA, 23 bp, Homo sapiens
agaagtttctggagcaagagaga

SEQ ID NO: 3869178 - DNA, 13 bp, Homo sapiens
agaataaaattgt

SEQ ID NO: 3869179 - DNA, 15 bp, Homo sapiens
agaataagaaaacaa

SEQ ID NO: 3869180 - DNA, 12 bp, Homo sapiens
agaataagtgct

SEQ ID NO: 3869181 - DNA, 13 bp, Homo sapiens
agaataagtgctg

SEQ ID NO: 3869182 - DNA, 14 bp, Homo sapiens
agaataagtgctgt

SEQ ID NO: 3869183 - DNA, 16 bp, Homo sapiens
agaataataataaaaa

SEQ ID NO: 3869184 - DNA, 17 bp, Homo sapiens
agaataatgtgttaaac

SEQ ID NO: 3869185 - DNA, 20 bp, Homo sapiens
agaatacagaaaatgctttt

SEQ ID NO: 3869186 - DNA, 18 bp, Homo sapiens
agaatacagaaagatgga

SEQ ID NO: 3869187 - DNA, 13 bp, Homo sapiens
agaatataaagtt

SEQ ID NO: 3869188 - DNA, 17 bp, Homo sapiens
actagtttccagtggat

SEQ ID NO: 3869189 - DNA, 15 bp, Homo sapiens
actataaactactgt

SEQ ID NO: 3869190 - DNA, 17 bp, Homo sapiens
actataaactactgtaa

SEQ ID NO: 3869191 - DNA, 13 bp, Homo sapiens
actatacaacaat

SEQ ID NO: 3869192 - DNA, 15 bp, Homo sapiens
actatacaacaatgt

SEQ ID NO: 3869193 - DNA, 13 bp, Homo sapiens
actatatacatgt

SEQ ID NO: 3869194 - DNA, 14 bp, Homo sapiens
actatatacatgtg

SEQ ID NO: 3869195 - DNA, 16 bp, Homo sapiens
actatatacatgtgtg

SEQ ID NO: 3869196 - DNA, 20 bp, Homo sapiens
actatattttagatgcaatg

SEQ ID NO: 3869197 - DNA, 16 bp, Homo sapiens
actatcaatatttaag

SEQ ID NO: 3869198 - DNA, 17 bp, Homo sapiens
actatcaatatttaagt

SEQ ID NO: 3869199 - DNA, 16 bp, Homo sapiens
actatcacatacaatt

SEQ ID NO: 3869200 - DNA, 17 bp, Homo sapiens
actatcacatacaattt

SEQ ID NO: 3869201 - DNA, 20 bp, Homo sapiens
actatcacatacaatttgca

SEQ ID NO: 3869202 - DNA, 23 bp, Homo sapiens
actatctctagagtgagaatctg

SEQ ID NO: 3869203 - DNA, 16 bp, Homo sapiens
actatcttggtgaatt

SEQ ID NO: 3869204 - DNA, 16 bp, Homo sapiens
actatgatcacagtga

SEQ ID NO: 3869205 - DNA, 23 bp, Homo sapiens
actatgctatttctggcctcagc

SEQ ID NO: 3869206 - DNA, 19 bp, Homo sapiens
actatggttcccaataaaa

SEQ ID NO: 3869207 - DNA, 22 bp, Homo sapiens
actatggttcccaataaaagtg

SEQ ID NO: 3869208 - DNA, 16 bp, Homo sapiens
actatgtgatgttaac

SEQ ID NO: 3869209 - DNA, 17 bp, Homo sapiens
actattaagagcaataa

SEQ ID NO: 3869210 - DNA, 14 bp, Homo sapiens
actattagagaaac

SEQ ID NO: 3869211 - DNA, 17 bp, Homo sapiens
actattataatttaatg

SEQ ID NO: 3869212 - DNA, 16 bp, Homo sapiens
actattattaataaat

SEQ ID NO: 3869213 - DNA, 14 bp, Homo sapiens
actattcaaacagt

SEQ ID NO: 3869214 - DNA, 18 bp, Homo sapiens
actattcaaacagtctca

SEQ ID NO: 3869215 - DNA, 14 bp, Homo sapiens
actattgggaggga

SEQ ID NO: 3869216 - DNA, 19 bp, Homo sapiens
actattgtttaaaaacagg

SEQ ID NO: 3869217 - DNA, 14 bp, Homo sapiens
actatttaacttga

SEQ ID NO: 3869218 - DNA, 18 bp, Homo sapiens
actatttaacttgagggt

SEQ ID NO: 3869219 - DNA, 18 bp, Homo sapiens
actatttgtctttcagga

SEQ ID NO: 3869220 - DNA, 19 bp, Homo sapiens
actcaaattaatctttctt

SEQ ID NO: 3869221 - DNA, 20 bp, Homo sapiens
actcaaccatcaatggaaac

SEQ ID NO: 3869222 - DNA, 13 bp, Homo sapiens
actcaataaaaga

SEQ ID NO: 3869223 - DNA, 18 bp, Homo sapiens
actcacaagaagaccaga

SEQ ID NO: 3869224 - DNA, 13 bp, Homo sapiens
actcacacaggca

SEQ ID NO: 3869225 - DNA, 22 bp, Homo sapiens
actcacacaggcatttcctggg

SEQ ID NO: 3869226 - DNA, 19 bp, Homo sapiens
actcaccagggtccgcacc

SEQ ID NO: 3869227 - DNA, 23 bp, Homo sapiens
actcaccagtgtcccctccactg

SEQ ID NO: 3869228 - DNA, 11 bp, Homo sapiens
actcacctcct

SEQ ID NO: 3869229 - DNA, 14 bp, Homo sapiens
actcacctcctccc

SEQ ID NO: 3869230 - DNA, 23 bp, Homo sapiens
actcacgataaataatcggccca

SEQ ID NO: 3869231 - DNA, 15 bp, Homo sapiens
actcacgatgaaatt

SEQ ID NO: 3869232 - DNA, 13 bp, Homo sapiens
actcagaagcctg

SEQ ID NO: 3869233 - DNA, 22 bp, Homo sapiens
actcagaagcctgggggcctgg

SEQ ID NO: 3869234 - DNA, 23 bp, Homo sapiens
actcagaagcctgggggcctggc

SEQ ID NO: 3869235 - DNA, 15 bp, Homo sapiens
actcagagcagagca

SEQ ID NO: 3869236 - DNA, 15 bp, Homo sapiens
actcagcagccctcc

SEQ ID NO: 3869237 - DNA, 18 bp, Homo sapiens
actcagcagccctcctca

SEQ ID NO: 3869238 - DNA, 21 bp, Homo sapiens
actcagcagccctcctcaccc

SEQ ID NO: 3869239 - DNA, 15 bp, Homo sapiens
actcagccctgggcc

SEQ ID NO: 3869240 - DNA, 22 bp, Homo sapiens
actcagccctgggccccaccac

SEQ ID NO: 3869241 - DNA, 23 bp, Homo sapiens
actcagccggcgtggcaaatata

SEQ ID NO: 3869242 - DNA, 14 bp, Homo sapiens
actcagctccagaa

SEQ ID NO: 3869243 - DNA, 20 bp, Homo sapiens
actcaggaggctgaggcaga

SEQ ID NO: 3869244 - DNA, 16 bp, Homo sapiens
actcagggctgccact

SEQ ID NO: 3869245 - DNA, 23 bp, Homo sapiens
actcagtatagcattgaacattt

SEQ ID NO: 3869246 - DNA, 14 bp, Homo sapiens
actcatctgttatc

SEQ ID NO: 3869247 - DNA, 19 bp, Homo sapiens
actcatgttgttcccacac

SEQ ID NO: 3869248 - DNA, 14 bp, Homo sapiens
actcatttctaaaa

SEQ ID NO: 3869249 - DNA, 17 bp, Homo sapiens
actcatttctaaaagaa

SEQ ID NO: 3869250 - DNA, 19 bp, Homo sapiens
actcatttctaaaagaata

SEQ ID NO: 3869251 - DNA, 21 bp, Homo sapiens
actcatttctaaaagaatatt

SEQ ID NO: 3869252 - DNA, 14 bp, Homo sapiens
actccaaagaaatg

SEQ ID NO: 3869253 - DNA, 15 bp, Homo sapiens
actccaaagaaatgt

SEQ ID NO: 3869254 - DNA, 23 bp, Homo sapiens
actccaagcttcaagtgatatat

SEQ ID NO: 3869255 - DNA, 14 bp, Homo sapiens
actccaccacccaa

SEQ ID NO: 3869256 - DNA, 16 bp, Homo sapiens
actccactctccttcg

SEQ ID NO: 3869257 - DNA, 16 bp, Homo sapiens
actccagaatctgctg

SEQ ID NO: 3869258 - DNA, 23 bp, Homo sapiens
actccagaatctgctgttgccat

SEQ ID NO: 3869259 - DNA, 19 bp, Homo sapiens
actccagacccctggcttt

SEQ ID NO: 3869260 - DNA, 18 bp, Homo sapiens
actccagagtctgagccc

SEQ ID NO: 3869261 - DNA, 9 bp, Homo sapiens
actccagcc

SEQ ID NO: 3869262 - DNA, 10 bp, Homo sapiens
actccagccc

SEQ ID NO: 3869263 - DNA, 22 bp, Homo sapiens
actccagccctgtcccctgaaa

SEQ ID NO: 3869264 - DNA, 16 bp, Homo sapiens
actccagcgcctgccc

SEQ ID NO: 3869265 - DNA, 17 bp, Homo sapiens
actccagcgcctgccct

SEQ ID NO: 3869266 - DNA, 16 bp, Homo sapiens
actccagtctcctgac

SEQ ID NO: 3869267 - DNA, 16 bp, Homo sapiens
actccagtggtgaaga

SEQ ID NO: 3869268 - DNA, 15 bp, Homo sapiens
actccatatggaggc

SEQ ID NO: 3869269 - DNA, 18 bp, Homo sapiens
actccatatttatttaaa

SEQ ID NO: 3869270 - DNA, 14 bp, Homo sapiens
actccatggccacc

SEQ ID NO: 3869271 - DNA, 18 bp, Homo sapiens
actccattactaaagaca

SEQ ID NO: 3869272 - DNA, 14 bp, Homo sapiens
actccattcccaac

SEQ ID NO: 3869273 - DNA, 12 bp, Homo sapiens
actccccaggcc

SEQ ID NO: 3869274 - DNA, 16 bp, Homo sapiens
agaatatttcaaatga

SEQ ID NO: 3869275 - DNA, 17 bp, Homo sapiens
agaatccctgcagcctg

SEQ ID NO: 3869276 - DNA, 12 bp, Homo sapiens
agaatcctgcct

SEQ ID NO: 3869277 - DNA, 15 bp, Homo sapiens
agaatcctgcctctc

SEQ ID NO: 3869278 - DNA, 17 bp, Homo sapiens
agaatcctgcctctccc

SEQ ID NO: 3869279 - DNA, 18 bp, Homo sapiens
agaatctatatttaacaa

SEQ ID NO: 3869280 - DNA, 18 bp, Homo sapiens
agaatctgaagctattga

SEQ ID NO: 3869281 - DNA, 12 bp, Homo sapiens
agaatctgcctg

SEQ ID NO: 3869282 - DNA, 17 bp, Homo sapiens
agaatctggctcctgtt

SEQ ID NO: 3869283 - DNA, 13 bp, Homo sapiens
agaatctgtgtga

SEQ ID NO: 3869284 - DNA, 22 bp, Homo sapiens
agaatctgtgtgaagttacaca

SEQ ID NO: 3869285 - DNA, 17 bp, Homo sapiens
agaatgaaaattgtatg

SEQ ID NO: 3869286 - DNA, 16 bp, Homo sapiens
agaatgatttttagat

SEQ ID NO: 3869287 - DNA, 19 bp, Homo sapiens
agaatgcagattcctgggc

SEQ ID NO: 3869288 - DNA, 17 bp, Homo sapiens
agaatgcccaactcttc

SEQ ID NO: 3869289 - DNA, 14 bp, Homo sapiens
agaatggaatagaa

SEQ ID NO: 3869290 - DNA, 21 bp, Homo sapiens
agaatggttgccttaaagaaa

SEQ ID NO: 3869291 - DNA, 17 bp, Homo sapiens
agaatgtgttttctgaa

SEQ ID NO: 3869292 - DNA, 22 bp, Homo sapiens
agaattatataggttgtgcaaa

SEQ ID NO: 3869293 - DNA, 15 bp, Homo sapiens
agaattatatctaat

SEQ ID NO: 3869294 - DNA, 19 bp, Homo sapiens
agaattatatctaatttat

SEQ ID NO: 3869295 - DNA, 15 bp, Homo sapiens
agaattcacacctta

SEQ ID NO: 3869296 - DNA, 18 bp, Homo sapiens
agaattgaacccaggagg

SEQ ID NO: 3869297 - DNA, 21 bp, Homo sapiens
agaattggagagtaaaaactg

SEQ ID NO: 3869298 - DNA, 12 bp, Homo sapiens
agaattggcctc

SEQ ID NO: 3869299 - DNA, 13 bp, Homo sapiens
agaattgggaagc

SEQ ID NO: 3869300 - DNA, 18 bp, Homo sapiens
agaattgtgcaaatggaa

SEQ ID NO: 3869301 - DNA, 17 bp, Homo sapiens
agaatttgtattttgct

SEQ ID NO: 3869302 - DNA, 22 bp, Homo sapiens
agaattttcctaaaaataagct

SEQ ID NO: 3869303 - DNA, 13 bp, Homo sapiens
agaattttgtata

SEQ ID NO: 3869304 - DNA, 14 bp, Homo sapiens
agaatttttaatga

SEQ ID NO: 3869305 - DNA, 17 bp, Homo sapiens
agacaaaaacagcctca

SEQ ID NO: 3869306 - DNA, 21 bp, Homo sapiens
agacaaaacttcctgtttgtg

SEQ ID NO: 3869307 - DNA, 14 bp, Homo sapiens
agacaaaatgtttt

SEQ ID NO: 3869308 - DNA, 19 bp, Homo sapiens
agacaaacacctcccagga

SEQ ID NO: 3869309 - DNA, 18 bp, Homo sapiens
agacaaaggttttcctct

SEQ ID NO: 3869310 - DNA, 20 bp, Homo sapiens
agacaactcttccatttatt

SEQ ID NO: 3869311 - DNA, 17 bp, Homo sapiens
agacaagaaatccctgt

SEQ ID NO: 3869312 - DNA, 13 bp, Homo sapiens
agacaagagctgc

SEQ ID NO: 3869313 - DNA, 14 bp, Homo sapiens
agacaagagctgct

SEQ ID NO: 3869314 - DNA, 14 bp, Homo sapiens
agacaagccctggc

SEQ ID NO: 3869315 - DNA, 15 bp, Homo sapiens
agacaagccctggca

SEQ ID NO: 3869316 - DNA, 17 bp, Homo sapiens
agacaagccctggcaac

SEQ ID NO: 3869317 - DNA, 14 bp, Homo sapiens
agacaatccactct

SEQ ID NO: 3869318 - DNA, 12 bp, Homo sapiens
agacacagactg

SEQ ID NO: 3869319 - DNA, 21 bp, Homo sapiens
agacacagtcatactgtcact

SEQ ID NO: 3869320 - DNA, 22 bp, Homo sapiens
agacacatggctatcctagaga

SEQ ID NO: 3869321 - DNA, 20 bp, Homo sapiens
agacacctgcacctcccccc

SEQ ID NO: 3869322 - DNA, 15 bp, Homo sapiens
agacactaagttata

SEQ ID NO: 3869323 - DNA, 13 bp, Homo sapiens
agacactgcttgg

SEQ ID NO: 3869324 - DNA, 14 bp, Homo sapiens
agacagaatgtcac

SEQ ID NO: 3869325 - DNA, 14 bp, Homo sapiens
agacagagaaatgt

SEQ ID NO: 3869326 - DNA, 21 bp, Homo sapiens
agacagagaaatgtgaagggt

SEQ ID NO: 3869327 - DNA, 17 bp, Homo sapiens
agacagagcccccaagc

SEQ ID NO: 3869328 - DNA, 12 bp, Homo sapiens
agacagatacag

SEQ ID NO: 3869329 - DNA, 18 bp, Homo sapiens
agacagctgacagataca

SEQ ID NO: 3869330 - DNA, 19 bp, Homo sapiens
agacagctgacagatacat

SEQ ID NO: 3869331 - DNA, 18 bp, Homo sapiens
agacaggaaaatcctctg

SEQ ID NO: 3869332 - DNA, 11 bp, Homo sapiens
agacagggcaa

SEQ ID NO: 3869333 - DNA, 17 bp, Homo sapiens
agacaggtaaatgggca

SEQ ID NO: 3869334 - DNA, 15 bp, Homo sapiens
agacaggtctagact

SEQ ID NO: 3869335 - DNA, 17 bp, Homo sapiens
agacagtagaggcatga

SEQ ID NO: 3869336 - DNA, 17 bp, Homo sapiens
agacagtatatttatag

SEQ ID NO: 3869337 - DNA, 18 bp, Homo sapiens
agacagtcctaacaatat

SEQ ID NO: 3869338 - DNA, 16 bp, Homo sapiens
agacagtgctgccctg

SEQ ID NO: 3869339 - DNA, 19 bp, Homo sapiens
agacagtgctgccctgcga

SEQ ID NO: 3869340 - DNA, 18 bp, Homo sapiens
agacatccatgtttgtaa

SEQ ID NO: 3869341 - DNA, 13 bp, Homo sapiens
agacattgcctcc

SEQ ID NO: 3869342 - DNA, 13 bp, Homo sapiens
agaccaaaataaa

SEQ ID NO: 3869343 - DNA, 16 bp, Homo sapiens
agaccacaaaaattga

SEQ ID NO: 3869344 - DNA, 12 bp, Homo sapiens
agaccacctctc

SEQ ID NO: 3869345 - DNA, 15 bp, Homo sapiens
agaccacctgccagc

SEQ ID NO: 3869346 - DNA, 14 bp, Homo sapiens
agaccagactgtgg

SEQ ID NO: 3869347 - DNA, 13 bp, Homo sapiens
agaccagcctggc

SEQ ID NO: 3869348 - DNA, 13 bp, Homo sapiens
agaccagtactgg

SEQ ID NO: 3869349 - DNA, 13 bp, Homo sapiens
agaccatcctggc

SEQ ID NO: 3869350 - DNA, 14 bp, Homo sapiens
agaccatcctggcc

SEQ ID NO: 3869351 - DNA, 15 bp, Homo sapiens
agaccatcctggccc

SEQ ID NO: 3869352 - DNA, 17 bp, Homo sapiens
agaccatcctggcccct

SEQ ID NO: 3869353 - DNA, 19 bp, Homo sapiens
agaccatcctggcccctcc

SEQ ID NO: 3869354 - DNA, 23 bp, Homo sapiens
agaccatctccagcatcctgctt

SEQ ID NO: 3869355 - DNA, 22 bp, Homo sapiens
agacccagtgtaaagaataaat

SEQ ID NO: 3869356 - DNA, 23 bp, Homo sapiens
agacccccccccccaacagaaca

SEQ ID NO: 3869357 - DNA, 21 bp, Homo sapiens
agacccctggcttttcactgc

SEQ ID NO: 3869358 - DNA, 15 bp, Homo sapiens
agacccctgtggcag

SEQ ID NO: 3869359 - DNA, 11 bp, Homo sapiens
agaccctgaga

SEQ ID NO: 3869360 - DNA, 14 bp, Homo sapiens
agaccctgagactc

SEQ ID NO: 3869361 - DNA, 19 bp, Homo sapiens
actggaagcatgtaggaga

SEQ ID NO: 3869362 - DNA, 21 bp, Homo sapiens
actggaccactgggcaatgat

SEQ ID NO: 3869363 - DNA, 21 bp, Homo sapiens
actggaccccgcctcccagcc

SEQ ID NO: 3869364 - DNA, 21 bp, Homo sapiens
actggactgggttttgtctct

SEQ ID NO: 3869365 - DNA, 21 bp, Homo sapiens
actggagacttggaagagttg

SEQ ID NO: 3869366 - DNA, 17 bp, Homo sapiens
actggagaggctagaac

SEQ ID NO: 3869367 - DNA, 16 bp, Homo sapiens
actggagcatctgact

SEQ ID NO: 3869368 - DNA, 22 bp, Homo sapiens
actggagcccgagggcctgaca

SEQ ID NO: 3869369 - DNA, 21 bp, Homo sapiens
actggaggtcacattcaggaa

SEQ ID NO: 3869370 - DNA, 16 bp, Homo sapiens
actggagtagttgcta

SEQ ID NO: 3869371 - DNA, 13 bp, Homo sapiens
actggagtgcagg

SEQ ID NO: 3869372 - DNA, 15 bp, Homo sapiens
actggagttacatta

SEQ ID NO: 3869373 - DNA, 14 bp, Homo sapiens
actggatatgttgt

SEQ ID NO: 3869374 - DNA, 19 bp, Homo sapiens
actggatcttcagaaggct

SEQ ID NO: 3869375 - DNA, 13 bp, Homo sapiens
actggatgaagat

SEQ ID NO: 3869376 - DNA, 22 bp, Homo sapiens
actggcacagttttctgagaaa

SEQ ID NO: 3869377 - DNA, 11 bp, Homo sapiens
actggcagctc

SEQ ID NO: 3869378 - DNA, 14 bp, Homo sapiens
actggcaggtgcag

SEQ ID NO: 3869379 - DNA, 17 bp, Homo sapiens
actggcattaattatta

SEQ ID NO: 3869380 - DNA, 21 bp, Homo sapiens
actggccagagagggcccagc

SEQ ID NO: 3869381 - DNA, 23 bp, Homo sapiens
actggccagagagggcccagctg

SEQ ID NO: 3869382 - DNA, 13 bp, Homo sapiens
actggccccaccc

SEQ ID NO: 3869383 - DNA, 21 bp, Homo sapiens
actggctcacccctctccccc

SEQ ID NO: 3869384 - DNA, 15 bp, Homo sapiens
actggctggggcaga

SEQ ID NO: 3869385 - DNA, 22 bp, Homo sapiens
actggcttctgtgcactagcct

SEQ ID NO: 3869386 - DNA, 21 bp, Homo sapiens
actggggcttgcaagaggagg

SEQ ID NO: 3869387 - DNA, 22 bp, Homo sapiens
actggggcttgcaagaggaggt

SEQ ID NO: 3869388 - DNA, 22 bp, Homo sapiens
actgggttatttttgtccctgc

SEQ ID NO: 3869389 - DNA, 20 bp, Homo sapiens
actgggtttctctgtatagt

SEQ ID NO: 3869390 - DNA, 22 bp, Homo sapiens
actgggttttgtctctgcatct

SEQ ID NO: 3869391 - DNA, 17 bp, Homo sapiens
actggtccactcagggc

SEQ ID NO: 3869392 - DNA, 15 bp, Homo sapiens
actggtcctgtgtgc

SEQ ID NO: 3869393 - DNA, 12 bp, Homo sapiens
actggtgactgc

SEQ ID NO: 3869394 - DNA, 21 bp, Homo sapiens
actggtgactgcgatcttcag

SEQ ID NO: 3869395 - DNA, 23 bp, Homo sapiens
actggtggcccgacagcctggca

SEQ ID NO: 3869396 - DNA, 16 bp, Homo sapiens
actgtaaatatccaca

SEQ ID NO: 3869397 - DNA, 20 bp, Homo sapiens
actgtaaatatccacagact

SEQ ID NO: 3869398 - DNA, 13 bp, Homo sapiens
actgtaaatcact

SEQ ID NO: 3869399 - DNA, 15 bp, Homo sapiens
actgtaaatcacttg

SEQ ID NO: 3869400 - DNA, 16 bp, Homo sapiens
actgtaaatcacttgt

SEQ ID NO: 3869401 - DNA, 20 bp, Homo sapiens
actgtaaatcacttgtaaat

SEQ ID NO: 3869402 - DNA, 14 bp, Homo sapiens
actgtaagtttatt

SEQ ID NO: 3869403 - DNA, 13 bp, Homo sapiens
actgtaattttgt

SEQ ID NO: 3869404 - DNA, 12 bp, Homo sapiens
actgtacatgtg

SEQ ID NO: 3869405 - DNA, 14 bp, Homo sapiens
actgtactcctccc

SEQ ID NO: 3869406 - DNA, 15 bp, Homo sapiens
actgtactcctccca

SEQ ID NO: 3869407 - DNA, 18 bp, Homo sapiens
actgtagaatgatttcat

SEQ ID NO: 3869408 - DNA, 19 bp, Homo sapiens
actgtagaatgatttcatg

SEQ ID NO: 3869409 - DNA, 20 bp, Homo sapiens
actgtagaatgatttcatgc

SEQ ID NO: 3869410 - DNA, 21 bp, Homo sapiens
actgtaggcagggaaccttaa

SEQ ID NO: 3869411 - DNA, 17 bp, Homo sapiens
actgtatcaaatctgta

SEQ ID NO: 3869412 - DNA, 22 bp, Homo sapiens
actgtatcaaatctgtatatgt

SEQ ID NO: 3869413 - DNA, 15 bp, Homo sapiens
actgtcaccctccac

SEQ ID NO: 3869414 - DNA, 15 bp, Homo sapiens
actgtcactgttcct

SEQ ID NO: 3869415 - DNA, 13 bp, Homo sapiens
actgtcatagaaa

SEQ ID NO: 3869416 - DNA, 17 bp, Homo sapiens
actgtcatctagcccct

SEQ ID NO: 3869417 - DNA, 14 bp, Homo sapiens
actgtccctcaaat

SEQ ID NO: 3869418 - DNA, 14 bp, Homo sapiens
actgtcgctgcttc

SEQ ID NO: 3869419 - DNA, 18 bp, Homo sapiens
actgtcgtgtttacaaaa

SEQ ID NO: 3869420 - DNA, 19 bp, Homo sapiens
actgtctcaactactcagc

SEQ ID NO: 3869421 - DNA, 15 bp, Homo sapiens
actgtctctcctgat

SEQ ID NO: 3869422 - DNA, 13 bp, Homo sapiens
actgtctggtttt

SEQ ID NO: 3869423 - DNA, 18 bp, Homo sapiens
actgtctggttttaacaa

SEQ ID NO: 3869424 - DNA, 19 bp, Homo sapiens
actgtctggttttaacaat

SEQ ID NO: 3869425 - DNA, 10 bp, Homo sapiens
actgtgaaag

SEQ ID NO: 3869426 - DNA, 18 bp, Homo sapiens
actgtgaacctggagggc

SEQ ID NO: 3869427 - DNA, 23 bp, Homo sapiens
actgtgatcaggctatgtatgga

SEQ ID NO: 3869428 - DNA, 17 bp, Homo sapiens
actgtgcatacatgttc

SEQ ID NO: 3869429 - DNA, 15 bp, Homo sapiens
actgtgccctgcctt

SEQ ID NO: 3869430 - DNA, 16 bp, Homo sapiens
actgtgcctagttcct

SEQ ID NO: 3869431 - DNA, 14 bp, Homo sapiens
actgtgcttacagt

SEQ ID NO: 3869432 - DNA, 17 bp, Homo sapiens
actgtgcttacagtgac

SEQ ID NO: 3869433 - DNA, 23 bp, Homo sapiens
actgtgcttacagtgactgtcgt

SEQ ID NO: 3869434 - DNA, 22 bp, Homo sapiens
actgtggccagagctggaaggc

SEQ ID NO: 3869435 - DNA, 22 bp, Homo sapiens
actgtggggaaccaattgcttt

SEQ ID NO: 3869436 - DNA, 12 bp, Homo sapiens
actgtgtgaaga

SEQ ID NO: 3869437 - DNA, 20 bp, Homo sapiens
actgttctgtgtgggtctgg

SEQ ID NO: 3869438 - DNA, 21 bp, Homo sapiens
actgttgctcaaatctattca

SEQ ID NO: 3869439 - DNA, 13 bp, Homo sapiens
acttaaaatattt

SEQ ID NO: 3869440 - DNA, 14 bp, Homo sapiens
acttaaattttaag

SEQ ID NO: 3869441 - DNA, 13 bp, Homo sapiens
acttaactgtgtg

SEQ ID NO: 3869442 - DNA, 17 bp, Homo sapiens
acttaactgtgtgaaga

SEQ ID NO: 3869443 - DNA, 19 bp, Homo sapiens
acttaactgtgtgaagaaa

SEQ ID NO: 3869444 - DNA, 14 bp, Homo sapiens
acttaagagaaatg

SEQ ID NO: 3869445 - DNA, 17 bp, Homo sapiens
acttaataaattcagat

SEQ ID NO: 3869446 - DNA, 15 bp, Homo sapiens
acttacacttggagc

SEQ ID NO: 3869447 - DNA, 18 bp, Homo sapiens
acttagatctccaggaga

SEQ ID NO: 3869448 - DNA, 23 bp, Homo sapiens
acttagcccaagaggtctgagcc

SEQ ID NO: 3869449 - DNA, 14 bp, Homo sapiens
acttataccaaagg

SEQ ID NO: 3869450 - DNA, 20 bp, Homo sapiens
acttatcagctacttaagag

SEQ ID NO: 3869451 - DNA, 22 bp, Homo sapiens
acttatttgagtgattatttgt

SEQ ID NO: 3869452 - DNA, 14 bp, Homo sapiens
acttatttttgaca

SEQ ID NO: 3869453 - DNA, 17 bp, Homo sapiens
acttcaaatatagagat

SEQ ID NO: 3869454 - DNA, 15 bp, Homo sapiens
acttcacactgcaag

SEQ ID NO: 3869455 - DNA, 23 bp, Homo sapiens
acttcacactgcaagagccttgg

SEQ ID NO: 3869456 - DNA, 14 bp, Homo sapiens
acttcactgtgagg

SEQ ID NO: 3869457 - DNA, 17 bp, Homo sapiens
acttcactgtgagggga

SEQ ID NO: 3869458 - DNA, 21 bp, Homo sapiens
acttcactgtgaggggaaggc

SEQ ID NO: 3869459 - DNA, 10 bp, Homo sapiens
acttcagcac

SEQ ID NO: 3869460 - DNA, 16 bp, Homo sapiens
acttcaggctcttctc

SEQ ID NO: 3869461 - DNA, 17 bp, Homo sapiens
acttcaggtgcttttga

SEQ ID NO: 3869462 - DNA, 16 bp, Homo sapiens
acttccaggagcccag

SEQ ID NO: 3869463 - DNA, 19 bp, Homo sapiens
acttccaggagcccagagg

SEQ ID NO: 3869464 - DNA, 16 bp, Homo sapiens
acttcccagaggcaga

SEQ ID NO: 3869465 - DNA, 17 bp, Homo sapiens
acttcctcgcctctccc

SEQ ID NO: 3869466 - DNA, 18 bp, Homo sapiens
acttcctcgcctctccca

SEQ ID NO: 3869467 - DNA, 23 bp, Homo sapiens
acttcctggtgaggcccagcctg

SEQ ID NO: 3869468 - DNA, 11 bp, Homo sapiens
acttcctgtgt

SEQ ID NO: 3869469 - DNA, 16 bp, Homo sapiens
acttcctgtgtactct

SEQ ID NO: 3869470 - DNA, 19 bp, Homo sapiens
acttcgactcaggatccag

SEQ ID NO: 3869471 - DNA, 22 bp, Homo sapiens
acttctcatcatattgtatgta

SEQ ID NO: 3869472 - DNA, 16 bp, Homo sapiens
acttctggaaggctgg

SEQ ID NO: 3869473 - DNA, 19 bp, Homo sapiens
acttctggaaggctggctg

SEQ ID NO: 3869474 - DNA, 17 bp, Homo sapiens
acttcttaaaggcctgg

SEQ ID NO: 3869475 - DNA, 23 bp, Homo sapiens
acttcttaaaggcctggaaccag

SEQ ID NO: 3869476 - DNA, 23 bp, Homo sapiens
acttcttggaaaaaaattacaaa

SEQ ID NO: 3869477 - DNA, 19 bp, Homo sapiens
acttcttggtttggggaga

SEQ ID NO: 3869478 - DNA, 23 bp, Homo sapiens
acttctttcctctccaattgtaa

SEQ ID NO: 3869479 - DNA, 19 bp, Homo sapiens
acttgaaataccagtgaac

SEQ ID NO: 3869480 - DNA, 15 bp, Homo sapiens
acttgaactttccaa

SEQ ID NO: 3869481 - DNA, 19 bp, Homo sapiens
acttgaatactctcacaag

SEQ ID NO: 3869482 - DNA, 13 bp, Homo sapiens
acttgaatctgtt

SEQ ID NO: 3869483 - DNA, 20 bp, Homo sapiens
acttgaatctgttactgaaa

SEQ ID NO: 3869484 - DNA, 14 bp, Homo sapiens
acttgacattcctt

SEQ ID NO: 3869485 - DNA, 11 bp, Homo sapiens
acttgaggaca

SEQ ID NO: 3869486 - DNA, 12 bp, Homo sapiens
acttgaggacac

SEQ ID NO: 3869487 - DNA, 17 bp, Homo sapiens
acttgaggacacatgtc

SEQ ID NO: 3869488 - DNA, 15 bp, Homo sapiens
acttgagggtaataa

SEQ ID NO: 3869489 - DNA, 17 bp, Homo sapiens
acttgagggtaataaac

SEQ ID NO: 3869490 - DNA, 18 bp, Homo sapiens
acttgagggtaataaact

SEQ ID NO: 3869491 - DNA, 19 bp, Homo sapiens
acttgagggtaataaactt

SEQ ID NO: 3869492 - DNA, 21 bp, Homo sapiens
acttgagttacaccagacctg

SEQ ID NO: 3869493 - DNA, 17 bp, Homo sapiens
acttgcacaagcttgta

SEQ ID NO: 3869494 - DNA, 14 bp, Homo sapiens
acttgcacatctct

SEQ ID NO: 3869495 - DNA, 17 bp, Homo sapiens
acttgcacatctctgca

SEQ ID NO: 3869496 - DNA, 19 bp, Homo sapiens
acttgcattgaatatatta

SEQ ID NO: 3869497 - DNA, 16 bp, Homo sapiens
acttgcgtcctgcaga

SEQ ID NO: 3869498 - DNA, 20 bp, Homo sapiens
acttgcgtcctgcagaggac

SEQ ID NO: 3869499 - DNA, 17 bp, Homo sapiens
acttgctgcctgaagaa

SEQ ID NO: 3869500 - DNA, 23 bp, Homo sapiens
acttggaaaaagaaagaaacact

SEQ ID NO: 3869501 - DNA, 19 bp, Homo sapiens
acttggaaaggtttcaaga

SEQ ID NO: 3869502 - DNA, 15 bp, Homo sapiens
acttggagcccgtgc

SEQ ID NO: 3869503 - DNA, 11 bp, Homo sapiens
acttggctttc

SEQ ID NO: 3869504 - DNA, 15 bp, Homo sapiens
acttgtaaataaata

SEQ ID NO: 3869505 - DNA, 16 bp, Homo sapiens
acttgtaaataaatag

SEQ ID NO: 3869506 - DNA, 13 bp, Homo sapiens
acttgtaaataca

SEQ ID NO: 3869507 - DNA, 14 bp, Homo sapiens
acttgtaaatgctg

SEQ ID NO: 3869508 - DNA, 18 bp, Homo sapiens
acttgtacaaaataaaca

SEQ ID NO: 3869509 - DNA, 22 bp, Homo sapiens
acttgtactatgttaataactt

SEQ ID NO: 3869510 - DNA, 14 bp, Homo sapiens
acttgtagaaatct

SEQ ID NO: 3869511 - DNA, 15 bp, Homo sapiens
acttgtagaaatctg

SEQ ID NO: 3869512 - DNA, 23 bp, Homo sapiens
acttgtagaaatctgtaattcta

SEQ ID NO: 3869513 - DNA, 14 bp, Homo sapiens
acttgtatgaaaga

SEQ ID NO: 3869514 - DNA, 13 bp, Homo sapiens
acttgtcatgtga

SEQ ID NO: 3869515 - DNA, 12 bp, Homo sapiens
acttgtctgagg

SEQ ID NO: 3869516 - DNA, 16 bp, Homo sapiens
acttgtctgaggcctc

SEQ ID NO: 3869517 - DNA, 22 bp, Homo sapiens
acttgtctgaggcctcatccct

SEQ ID NO: 3869518 - DNA, 17 bp, Homo sapiens
acttgtgtatgatccaa

SEQ ID NO: 3869519 - DNA, 14 bp, Homo sapiens
acttgtgtctctgt

SEQ ID NO: 3869520 - DNA, 16 bp, Homo sapiens
acttgtgtctctgtgc

SEQ ID NO: 3869521 - DNA, 21 bp, Homo sapiens
acttgtgtctctgtgctttta

SEQ ID NO: 3869522 - DNA, 20 bp, Homo sapiens
acttgttccttctgcttctc

SEQ ID NO: 3869523 - DNA, 16 bp, Homo sapiens
acttgtttgtaagatt

SEQ ID NO: 3869524 - DNA, 14 bp, Homo sapiens
actttaaagtcttt

SEQ ID NO: 3869525 - DNA, 19 bp, Homo sapiens
actttaaccctctcttccc

SEQ ID NO: 3869526 - DNA, 14 bp, Homo sapiens
actttaagagagaa

SEQ ID NO: 3869527 - DNA, 23 bp, Homo sapiens
actttaattctcatgtgatcctt

SEQ ID NO: 3869528 - DNA, 13 bp, Homo sapiens
actttactctaag

SEQ ID NO: 3869529 - DNA, 12 bp, Homo sapiens
actttcattttt

SEQ ID NO: 3869530 - DNA, 14 bp, Homo sapiens
actttctgtaaact

SEQ ID NO: 3869531 - DNA, 14 bp, Homo sapiens
actttgggaggcca

SEQ ID NO: 3869532 - DNA, 19 bp, Homo sapiens
actttgggaggccaaggtg

SEQ ID NO: 3869533 - DNA, 16 bp, Homo sapiens
actgaaaaattttatt

SEQ ID NO: 3869534 - DNA, 16 bp, Homo sapiens
actgaaaactgtaaat

SEQ ID NO: 3869535 - DNA, 20 bp, Homo sapiens
actgaaaactgtaaatacaa

SEQ ID NO: 3869536 - DNA, 19 bp, Homo sapiens
actgaaagcagcagctagg

SEQ ID NO: 3869537 - DNA, 13 bp, Homo sapiens
actgaacttcagg

SEQ ID NO: 3869538 - DNA, 21 bp, Homo sapiens
actgaacttcaggataataaa

SEQ ID NO: 3869539 - DNA, 18 bp, Homo sapiens
actgaagagaccacagca

SEQ ID NO: 3869540 - DNA, 11 bp, Homo sapiens
actgaaggaga

SEQ ID NO: 3869541 - DNA, 16 bp, Homo sapiens
actgaaggggcacacc

SEQ ID NO: 3869542 - DNA, 20 bp, Homo sapiens
actgaaggggcacaccactg

SEQ ID NO: 3869543 - DNA, 21 bp, Homo sapiens
actgaatgcctcaatgtgacc

SEQ ID NO: 3869544 - DNA, 17 bp, Homo sapiens
actgaattgtccccagt

SEQ ID NO: 3869545 - DNA, 21 bp, Homo sapiens
actgaattttaaatgttcaca

SEQ ID NO: 3869546 - DNA, 20 bp, Homo sapiens
actgaccagcctccatgctg

SEQ ID NO: 3869547 - DNA, 20 bp, Homo sapiens
actgacccacagcctctgcc

SEQ ID NO: 3869548 - DNA, 18 bp, Homo sapiens
actgaccccctcccctga

SEQ ID NO: 3869549 - DNA, 19 bp, Homo sapiens
actgacccttccagacata

SEQ ID NO: 3869550 - DNA, 22 bp, Homo sapiens
actgaccttggagagacacagc

SEQ ID NO: 3869551 - DNA, 15 bp, Homo sapiens
actgacttctaagta

SEQ ID NO: 3869552 - DNA, 22 bp, Homo sapiens
actgacttctaagtaaaaccac

SEQ ID NO: 3869553 - DNA, 15 bp, Homo sapiens
actgagaaatgaatg

SEQ ID NO: 3869554 - DNA, 13 bp, Homo sapiens
actgagaattttc

SEQ ID NO: 3869555 - DNA, 22 bp, Homo sapiens
actgagacagccacttggtttt

SEQ ID NO: 3869556 - DNA, 15 bp, Homo sapiens
actgaggaccagcca

SEQ ID NO: 3869557 - DNA, 16 bp, Homo sapiens
actgaggatgtgagcc

SEQ ID NO: 3869558 - DNA, 22 bp, Homo sapiens
actgaggccaaaagaggcctga

SEQ ID NO: 3869559 - DNA, 21 bp, Homo sapiens
actgaggcctaaaagtaaaca

SEQ ID NO: 3869560 - DNA, 13 bp, Homo sapiens
actgagggagaga

SEQ ID NO: 3869561 - DNA, 19 bp, Homo sapiens
actgaggtcactgggttct

SEQ ID NO: 3869562 - DNA, 14 bp, Homo sapiens
actgagtaaattgg

SEQ ID NO: 3869563 - DNA, 18 bp, Homo sapiens
actgagtaaattggaaac

SEQ ID NO: 3869564 - DNA, 20 bp, Homo sapiens
actgagtaaattggaaacat

SEQ ID NO: 3869565 - DNA, 15 bp, Homo sapiens
actgataaagaaaga

SEQ ID NO: 3869566 - DNA, 16 bp, Homo sapiens
actgatagtgtccaaa

SEQ ID NO: 3869567 - DNA, 17 bp, Homo sapiens
actgatcaaaaataaac

SEQ ID NO: 3869568 - DNA, 18 bp, Homo sapiens
actgatcaaaaataaact

SEQ ID NO: 3869569 - DNA, 19 bp, Homo sapiens
actgatcaatccttcttat

SEQ ID NO: 3869570 - DNA, 23 bp, Homo sapiens
actgatgcgaaaacttgaatctg

SEQ ID NO: 3869571 - DNA, 22 bp, Homo sapiens
actgatggaccgggtgggcctg

SEQ ID NO: 3869572 - DNA, 21 bp, Homo sapiens
actgatgttacatcacagtgt

SEQ ID NO: 3869573 - DNA, 22 bp, Homo sapiens
actgattttgttatttttatat

SEQ ID NO: 3869574 - DNA, 15 bp, Homo sapiens
actgatttttgtgat

SEQ ID NO: 3869575 - DNA, 20 bp, Homo sapiens
actgcaacctccacctcctg

SEQ ID NO: 3869576 - DNA, 16 bp, Homo sapiens
actgcaagagccttgg

SEQ ID NO: 3869577 - DNA, 17 bp, Homo sapiens
actgcaagagccttggt

SEQ ID NO: 3869578 - DNA, 18 bp, Homo sapiens
actgcaagagccttggtg

SEQ ID NO: 3869579 - DNA, 20 bp, Homo sapiens
actgcactccagcctgggca

SEQ ID NO: 3869580 - DNA, 21 bp, Homo sapiens
actgcagatagccagacacat

SEQ ID NO: 3869581 - DNA, 12 bp, Homo sapiens
actgcaggcccc

SEQ ID NO: 3869582 - DNA, 17 bp, Homo sapiens
actgcagggactgccag

SEQ ID NO: 3869583 - DNA, 18 bp, Homo sapiens
actgcagggactgccagt

SEQ ID NO: 3869584 - DNA, 22 bp, Homo sapiens
actgcagtccgcagtctggcct

SEQ ID NO: 3869585 - DNA, 13 bp, Homo sapiens
actgcattctttt

SEQ ID NO: 3869586 - DNA, 13 bp, Homo sapiens
actgccagcaacg

SEQ ID NO: 3869587 - DNA, 14 bp, Homo sapiens
actgccaggaggga

SEQ ID NO: 3869588 - DNA, 13 bp, Homo sapiens
actgccaggcacc

SEQ ID NO: 3869589 - DNA, 15 bp, Homo sapiens
actgccaggcacctg

SEQ ID NO: 3869590 - DNA, 19 bp, Homo sapiens
actgccaggcacctggcct

SEQ ID NO: 3869591 - DNA, 15 bp, Homo sapiens
actgccccaactcct

SEQ ID NO: 3869592 - DNA, 21 bp, Homo sapiens
actgccccaactcctggaagc

SEQ ID NO: 3869593 - DNA, 22 bp, Homo sapiens
actgccccgggtgcctcagagc

SEQ ID NO: 3869594 - DNA, 13 bp, Homo sapiens
actgccctgcctg

SEQ ID NO: 3869595 - DNA, 14 bp, Homo sapiens
actgccctgcctgc

SEQ ID NO: 3869596 - DNA, 15 bp, Homo sapiens
actgccctgcctgcc

SEQ ID NO: 3869597 - DNA, 18 bp, Homo sapiens
actgccctgcctgcccac

SEQ ID NO: 3869598 - DNA, 19 bp, Homo sapiens
actgcctagaaaatgcaaa

SEQ ID NO: 3869599 - DNA, 19 bp, Homo sapiens
actgcgatcttcagagcag

SEQ ID NO: 3869600 - DNA, 20 bp, Homo sapiens
actgctaaatactgtacata

SEQ ID NO: 3869601 - DNA, 22 bp, Homo sapiens
actgctaaatactgtacataga

SEQ ID NO: 3869602 - DNA, 19 bp, Homo sapiens
actgctaggcgagtgccag

SEQ ID NO: 3869603 - DNA, 16 bp, Homo sapiens
actgctcaagaagaca

SEQ ID NO: 3869604 - DNA, 23 bp, Homo sapiens
actgctcatcattccttgagaaa

SEQ ID NO: 3869605 - DNA, 18 bp, Homo sapiens
actgctccccagccctgg

SEQ ID NO: 3869606 - DNA, 19 bp, Homo sapiens
actgctccccagccctggc

SEQ ID NO: 3869607 - DNA, 21 bp, Homo sapiens
actgctccccagccctggctc

SEQ ID NO: 3869608 - DNA, 20 bp, Homo sapiens
actgctgatcaatgaaatgc

SEQ ID NO: 3869609 - DNA, 13 bp, Homo sapiens
actgctgcaaagt

SEQ ID NO: 3869610 - DNA, 16 bp, Homo sapiens
actgctgcaaagtgca

SEQ ID NO: 3869611 - DNA, 21 bp, Homo sapiens
actgctgcaaagtgcaaatac

SEQ ID NO: 3869612 - DNA, 12 bp, Homo sapiens
actgctgcacca

SEQ ID NO: 3869613 - DNA, 21 bp, Homo sapiens
actgctgcccagcctccaagc

SEQ ID NO: 3869614 - DNA, 12 bp, Homo sapiens
actgctggctgc

SEQ ID NO: 3869615 - DNA, 14 bp, Homo sapiens
actgctggctgcct

SEQ ID NO: 3869616 - DNA, 22 bp, Homo sapiens
actgctgtaaataaatgcttta

SEQ ID NO: 3869617 - DNA, 17 bp, Homo sapiens
actgctttccagcctgg

SEQ ID NO: 3869618 - DNA, 15 bp, Homo sapiens
actggaaccagggag

SEQ ID NO: 3869619 - DNA, 13 bp, Homo sapiens
actccccaggcca

SEQ ID NO: 3869620 - DNA, 13 bp, Homo sapiens
actcccccacctg

SEQ ID NO: 3869621 - DNA, 20 bp, Homo sapiens
actccccgcctgtcctgcct

SEQ ID NO: 3869622 - DNA, 19 bp, Homo sapiens
actccctaagaaaccccag

SEQ ID NO: 3869623 - DNA, 20 bp, Homo sapiens
actccctaagaaaccccagg

SEQ ID NO: 3869624 - DNA, 15 bp, Homo sapiens
actccctcccctgcc

SEQ ID NO: 3869625 - DNA, 18 bp, Homo sapiens
actccctcctaacctaga

SEQ ID NO: 3869626 - DNA, 17 bp, Homo sapiens
actccctggctctcaga

SEQ ID NO: 3869627 - DNA, 18 bp, Homo sapiens
actccctggctctcagaa

SEQ ID NO: 3869628 - DNA, 23 bp, Homo sapiens
actcccttaggcattatttaatg

SEQ ID NO: 3869629 - DNA, 16 bp, Homo sapiens
actccgagaacaacag

SEQ ID NO: 3869630 - DNA, 23 bp, Homo sapiens
actccggcctgatgacagagcga

SEQ ID NO: 3869631 - DNA, 20 bp, Homo sapiens
actcctcaaaagcaaatgag

SEQ ID NO: 3869632 - DNA, 14 bp, Homo sapiens
actcctctgtccag

SEQ ID NO: 3869633 - DNA, 14 bp, Homo sapiens
actcctcttatttg

SEQ ID NO: 3869634 - DNA, 17 bp, Homo sapiens
actcctgagtggggcca

SEQ ID NO: 3869635 - DNA, 21 bp, Homo sapiens
actcctgattttgtagttaat

SEQ ID NO: 3869636 - DNA, 18 bp, Homo sapiens
actcctgcctgtgtttgt

SEQ ID NO: 3869637 - DNA, 12 bp, Homo sapiens
actcctggaaat

SEQ ID NO: 3869638 - DNA, 12 bp, Homo sapiens
actcctgtcccg

SEQ ID NO: 3869639 - DNA, 20 bp, Homo sapiens
actcctgtcccgccttcctc

SEQ ID NO: 3869640 - DNA, 20 bp, Homo sapiens
actcctgtgctctggaggct

SEQ ID NO: 3869641 - DNA, 22 bp, Homo sapiens
actcctgtgctctggaggctgc

SEQ ID NO: 3869642 - DNA, 17 bp, Homo sapiens
actcctgtgggagcctc

SEQ ID NO: 3869643 - DNA, 18 bp, Homo sapiens
actcctgtgggagcctcg

SEQ ID NO: 3869644 - DNA, 20 bp, Homo sapiens
actcctgtgggagcctcgca

SEQ ID NO: 3869645 - DNA, 13 bp, Homo sapiens
actccttcctgcc

SEQ ID NO: 3869646 - DNA, 22 bp, Homo sapiens
actcctttctctatcccaagcc

SEQ ID NO: 3869647 - DNA, 20 bp, Homo sapiens
actcctttgcattccatgat

SEQ ID NO: 3869648 - DNA, 16 bp, Homo sapiens
actcgagaccatcctg

SEQ ID NO: 3869649 - DNA, 21 bp, Homo sapiens
actcgagaccatcctggcccc

SEQ ID NO: 3869650 - DNA, 20 bp, Homo sapiens
actcgggaggctgagacagg

SEQ ID NO: 3869651 - DNA, 17 bp, Homo sapiens
actcggtgtaaaaccat

SEQ ID NO: 3869652 - DNA, 20 bp, Homo sapiens
actctaagtctccaagaata

SEQ ID NO: 3869653 - DNA, 15 bp, Homo sapiens
actctacgccaaagt

SEQ ID NO: 3869654 - DNA, 17 bp, Homo sapiens
actctagaacatgcaca

SEQ ID NO: 3869655 - DNA, 18 bp, Homo sapiens
actctagaacatgcacat

SEQ ID NO: 3869656 - DNA, 13 bp, Homo sapiens
actctagcctggg

SEQ ID NO: 3869657 - DNA, 16 bp, Homo sapiens
actctagtgacttcct

SEQ ID NO: 3869658 - DNA, 20 bp, Homo sapiens
actctagtgacttcctggtg

SEQ ID NO: 3869659 - DNA, 14 bp, Homo sapiens
actctatagacttt

SEQ ID NO: 3869660 - DNA, 19 bp, Homo sapiens
actctatagttattgtttt

SEQ ID NO: 3869661 - DNA, 20 bp, Homo sapiens
actctatgccccaaatatag

SEQ ID NO: 3869662 - DNA, 21 bp, Homo sapiens
actctatgccccaaatatagc

SEQ ID NO: 3869663 - DNA, 15 bp, Homo sapiens
actctcaggaggcgc

SEQ ID NO: 3869664 - DNA, 19 bp, Homo sapiens
actctcaggatcaagaaag

SEQ ID NO: 3869665 - DNA, 14 bp, Homo sapiens
actctcattcccca

SEQ ID NO: 3869666 - DNA, 16 bp, Homo sapiens
actctcattccccagg

SEQ ID NO: 3869667 - DNA, 17 bp, Homo sapiens
actctcattccccaggt

SEQ ID NO: 3869668 - DNA, 21 bp, Homo sapiens
actctcattccccaggtggct

SEQ ID NO: 3869669 - DNA, 19 bp, Homo sapiens
actctccaacctggacaac

SEQ ID NO: 3869670 - DNA, 15 bp, Homo sapiens
actctccccctttca

SEQ ID NO: 3869671 - DNA, 12 bp, Homo sapiens
actctcccctcc

SEQ ID NO: 3869672 - DNA, 22 bp, Homo sapiens
actctcctcggccccctccatc

SEQ ID NO: 3869673 - DNA, 18 bp, Homo sapiens
actctccttcgtgtctct

SEQ ID NO: 3869674 - DNA, 14 bp, Homo sapiens
actctcggggccct

SEQ ID NO: 3869675 - DNA, 17 bp, Homo sapiens
actctcggggcccttgg

SEQ ID NO: 3869676 - DNA, 23 bp, Homo sapiens
actctcggggcccttggggcctg

SEQ ID NO: 3869677 - DNA, 17 bp, Homo sapiens
actctctgagatgtgtt

SEQ ID NO: 3869678 - DNA, 10 bp, Homo sapiens
actctgaaaa

SEQ ID NO: 3869679 - DNA, 23 bp, Homo sapiens
actctgaaaagcaattgccctgt

SEQ ID NO: 3869680 - DNA, 14 bp, Homo sapiens
actctgagcccagg

SEQ ID NO: 3869681 - DNA, 14 bp, Homo sapiens
actctgcactccat

SEQ ID NO: 3869682 - DNA, 18 bp, Homo sapiens
actctgcactccatggcc

SEQ ID NO: 3869683 - DNA, 20 bp, Homo sapiens
actctgcactccatggccac

SEQ ID NO: 3869684 - DNA, 16 bp, Homo sapiens
actctgcctcctcttc

SEQ ID NO: 3869685 - DNA, 21 bp, Homo sapiens
actctgccttttttcacagcc

SEQ ID NO: 3869686 - DNA, 21 bp, Homo sapiens
actctgcggtggtgccagagg

SEQ ID NO: 3869687 - DNA, 22 bp, Homo sapiens
actctgcggtggtgccagaggt

SEQ ID NO: 3869688 - DNA, 11 bp, Homo sapiens
actctgctctg

SEQ ID NO: 3869689 - DNA, 16 bp, Homo sapiens
actctggcagccacac

SEQ ID NO: 3869690 - DNA, 14 bp, Homo sapiens
actctggcttccag

SEQ ID NO: 3869691 - DNA, 18 bp, Homo sapiens
actctgggtccctcggag

SEQ ID NO: 3869692 - DNA, 19 bp, Homo sapiens
actctgggtttcatatcca

SEQ ID NO: 3869693 - DNA, 17 bp, Homo sapiens
actctgtcagccagccg

SEQ ID NO: 3869694 - DNA, 17 bp, Homo sapiens
actctgtccaggccact

SEQ ID NO: 3869695 - DNA, 21 bp, Homo sapiens
actctgtccaggccactgtgg

SEQ ID NO: 3869696 - DNA, 19 bp, Homo sapiens
actctgtgccagagcctgg

SEQ ID NO: 3869697 - DNA, 22 bp, Homo sapiens
actctgtgccagagcctggggc

SEQ ID NO: 3869698 - DNA, 23 bp, Homo sapiens
actctgtgccagagcctggggct

SEQ ID NO: 3869699 - DNA, 15 bp, Homo sapiens
actcttatgaaatgg

SEQ ID NO: 3869700 - DNA, 13 bp, Homo sapiens
actcttcattttg

SEQ ID NO: 3869701 - DNA, 22 bp, Homo sapiens
actctttatttctagcagagtg

SEQ ID NO: 3869702 - DNA, 20 bp, Homo sapiens
actctttgctacaataaatg

SEQ ID NO: 3869703 - DNA, 24 bp, Homo sapiens
actctttgctacaataaatgctga

SEQ ID NO: 3869704 - DNA, 19 bp, Homo sapiens
actctttttagggccaggc

SEQ ID NO: 3869705 - DNA, 21 bp, Homo sapiens
acatacacttgtataaatgta

SEQ ID NO: 3869706 - DNA, 17 bp, Homo sapiens
acatacatatatatctg

SEQ ID NO: 3869707 - DNA, 13 bp, Homo sapiens
acataccatctgt

SEQ ID NO: 3869708 - DNA, 14 bp, Homo sapiens
acataccctccccc

SEQ ID NO: 3869709 - DNA, 14 bp, Homo sapiens
acatactagaaagc

SEQ ID NO: 3869710 - DNA, 22 bp, Homo sapiens
acatagagtgactccaagaaca

SEQ ID NO: 3869711 - DNA, 19 bp, Homo sapiens
acatagattaatggcactg

SEQ ID NO: 3869712 - DNA, 22 bp, Homo sapiens
acatagctacccaaaagagaaa

SEQ ID NO: 3869713 - DNA, 17 bp, Homo sapiens
acataggcaaattggaa

SEQ ID NO: 3869714 - DNA, 20 bp, Homo sapiens
acataggcaatatctttaat

SEQ ID NO: 3869715 - DNA, 17 bp, Homo sapiens
acatagttctccagttg

SEQ ID NO: 3869716 - DNA, 23 bp, Homo sapiens
acatagttctccagttgtatgga

SEQ ID NO: 3869717 - DNA, 15 bp, Homo sapiens
acatatatatataca

SEQ ID NO: 3869718 - DNA, 22 bp, Homo sapiens
acatatatatatacacatacat

SEQ ID NO: 3869719 - DNA, 13 bp, Homo sapiens
acatatatatctg

SEQ ID NO: 3869720 - DNA, 22 bp, Homo sapiens
acatatatatgccttatgtaat

SEQ ID NO: 3869721 - DNA, 12 bp, Homo sapiens
acatatcaattc

SEQ ID NO: 3869722 - DNA, 15 bp, Homo sapiens
acatatcagaaaagt

SEQ ID NO: 3869723 - DNA, 22 bp, Homo sapiens
acatatcagaaaagtagaatta

SEQ ID NO: 3869724 - DNA, 13 bp, Homo sapiens
acatatcattttt

SEQ ID NO: 3869725 - DNA, 23 bp, Homo sapiens
acatatgtattaagccaaacatg

SEQ ID NO: 3869726 - DNA, 12 bp, Homo sapiens
acatattataaa

SEQ ID NO: 3869727 - DNA, 22 bp, Homo sapiens
acatattataaataaatgccaa

SEQ ID NO: 3869728 - DNA, 14 bp, Homo sapiens
acatcaaatgcccc

SEQ ID NO: 3869729 - DNA, 21 bp, Homo sapiens
acatcaagcatgcaataatgt

SEQ ID NO: 3869730 - DNA, 23 bp, Homo sapiens
acatcaccgacgcgtctcctgtt

SEQ ID NO: 3869731 - DNA, 18 bp, Homo sapiens
acatcactgattgggtgc

SEQ ID NO: 3869732 - DNA, 19 bp, Homo sapiens
acatcactgattgggtgcc

SEQ ID NO: 3869733 - DNA, 16 bp, Homo sapiens
acatcacttgtacaaa

SEQ ID NO: 3869734 - DNA, 14 bp, Homo sapiens
acatcatcctcctt

SEQ ID NO: 3869735 - DNA, 23 bp, Homo sapiens
acatcatcctccttataagccca

SEQ ID NO: 3869736 - DNA, 13 bp, Homo sapiens
acatccaaggaga

SEQ ID NO: 3869737 - DNA, 14 bp, Homo sapiens
acatccaaggagaa

SEQ ID NO: 3869738 - DNA, 23 bp, Homo sapiens
acatccaaggagaaacagagaca

SEQ ID NO: 3869739 - DNA, 11 bp, Homo sapiens
acatccagaag

SEQ ID NO: 3869740 - DNA, 17 bp, Homo sapiens
acatccattcccaagaa

SEQ ID NO: 3869741 - DNA, 18 bp, Homo sapiens
acatccattcccaagaaa

SEQ ID NO: 3869742 - DNA, 18 bp, Homo sapiens
acatcccaggaggggcct

SEQ ID NO: 3869743 - DNA, 16 bp, Homo sapiens
acatcccattgccctg

SEQ ID NO: 3869744 - DNA, 18 bp, Homo sapiens
acatcccattgccctggt

SEQ ID NO: 3869745 - DNA, 15 bp, Homo sapiens
acatccctgggcctg

SEQ ID NO: 3869746 - DNA, 17 bp, Homo sapiens
acatccctgggcctgct

SEQ ID NO: 3869747 - DNA, 22 bp, Homo sapiens
acatctaatgtctcttcctctg

SEQ ID NO: 3869748 - DNA, 19 bp, Homo sapiens
acatctattataaaaccat

SEQ ID NO: 3869749 - DNA, 16 bp, Homo sapiens
acatctcgagccccct

SEQ ID NO: 3869750 - DNA, 18 bp, Homo sapiens
acatctctgaaagcacag

SEQ ID NO: 3869751 - DNA, 21 bp, Homo sapiens
acatctgcagctctttcttct

SEQ ID NO: 3869752 - DNA, 13 bp, Homo sapiens
acatcttctcagt

SEQ ID NO: 3869753 - DNA, 14 bp, Homo sapiens
acatcttctcagtg

SEQ ID NO: 3869754 - DNA, 16 bp, Homo sapiens
acatcttctcagtgtt

SEQ ID NO: 3869755 - DNA, 12 bp, Homo sapiens
acatcttctctc

SEQ ID NO: 3869756 - DNA, 13 bp, Homo sapiens
acatctttaagta

SEQ ID NO: 3869757 - DNA, 15 bp, Homo sapiens
acatctttaagtatt

SEQ ID NO: 3869758 - DNA, 18 bp, Homo sapiens
acatctttttcctccctt

SEQ ID NO: 3869759 - DNA, 17 bp, Homo sapiens
acatgaacacagctgct

SEQ ID NO: 3869760 - DNA, 18 bp, Homo sapiens
acatgaattgcattttac

SEQ ID NO: 3869761 - DNA, 13 bp, Homo sapiens
acatgacaatgca

SEQ ID NO: 3869762 - DNA, 14 bp, Homo sapiens
acatgacactgacc

SEQ ID NO: 3869763 - DNA, 19 bp, Homo sapiens
acatgacttttctggaaga

SEQ ID NO: 3869764 - DNA, 12 bp, Homo sapiens
acatgaggaggg

SEQ ID NO: 3869765 - DNA, 15 bp, Homo sapiens
acatgaggagggtgc

SEQ ID NO: 3869766 - DNA, 14 bp, Homo sapiens
acatgatgtgagat

SEQ ID NO: 3869767 - DNA, 22 bp, Homo sapiens
acatgatttagggaagcaggga

SEQ ID NO: 3869768 - DNA, 18 bp, Homo sapiens
acatgcaagtgagaagct

SEQ ID NO: 3869769 - DNA, 13 bp, Homo sapiens
acatgcactgacc

SEQ ID NO: 3869770 - DNA, 17 bp, Homo sapiens
acatgccaccctctcca

SEQ ID NO: 3869771 - DNA, 21 bp, Homo sapiens
acatgccatttgtactgaccc

SEQ ID NO: 3869772 - DNA, 17 bp, Homo sapiens
acatgctaaatagttct

SEQ ID NO: 3869773 - DNA, 14 bp, Homo sapiens
acatggacacagac

SEQ ID NO: 3869774 - DNA, 15 bp, Homo sapiens
acatggagactcctg

SEQ ID NO: 3869775 - DNA, 21 bp, Homo sapiens
acatggagactcctgccctgt

SEQ ID NO: 3869776 - DNA, 13 bp, Homo sapiens
acatggagagaga

SEQ ID NO: 3869777 - DNA, 16 bp, Homo sapiens
acatggagagagactc

SEQ ID NO: 3869778 - DNA, 18 bp, Homo sapiens
acatggctatcctagaga

SEQ ID NO: 3869779 - DNA, 11 bp, Homo sapiens
acatggggcat

SEQ ID NO: 3869780 - DNA, 17 bp, Homo sapiens
acatggtttgactcccg

SEQ ID NO: 3869781 - DNA, 13 bp, Homo sapiens
acatgtactccag

SEQ ID NO: 3869782 - DNA, 18 bp, Homo sapiens
acatgtactccagaggga

SEQ ID NO: 3869783 - DNA, 23 bp, Homo sapiens
acatgtcaccgtggaccttcctg

SEQ ID NO: 3869784 - DNA, 17 bp, Homo sapiens
acatgtcggagtagaaa

SEQ ID NO: 3869785 - DNA, 13 bp, Homo sapiens
acatgtggtttat

SEQ ID NO: 3869786 - DNA, 21 bp, Homo sapiens
acatgtgtctgtgtggtatat

SEQ ID NO: 3869787 - DNA, 14 bp, Homo sapiens
acatgtgtgtatat

SEQ ID NO: 3869788 - DNA, 23 bp, Homo sapiens
acatgtttaaattgtaaatttta

SEQ ID NO: 3869789 - DNA, 21 bp, Homo sapiens
acatgtttacttttcagggca

SEQ ID NO: 3869790 - DNA, 19 bp, Homo sapiens
acattaaacactgtaatct

SEQ ID NO: 3869791 - DNA, 22 bp, Homo sapiens
accctgcccatacccctgcctg

SEQ ID NO: 3869792 - DNA, 23 bp, Homo sapiens
accctgcccatacccctgcctgg

SEQ ID NO: 3869793 - DNA, 16 bp, Homo sapiens
accctggaaaggggag

SEQ ID NO: 3869794 - DNA, 22 bp, Homo sapiens
accctggcccgcccctcgctgc

SEQ ID NO: 3869795 - DNA, 14 bp, Homo sapiens
accctgggtgccat

SEQ ID NO: 3869796 - DNA, 19 bp, Homo sapiens
accctgtttcctttcagga

SEQ ID NO: 3869797 - DNA, 19 bp, Homo sapiens
accctgttttccacaccat

SEQ ID NO: 3869798 - DNA, 21 bp, Homo sapiens
accctgttttccacaccatca

SEQ ID NO: 3869799 - DNA, 21 bp, Homo sapiens
acccttcacataccctccccc

SEQ ID NO: 3869800 - DNA, 16 bp, Homo sapiens
acccttcagggccaga

SEQ ID NO: 3869801 - DNA, 21 bp, Homo sapiens
acccttcccaatcagcactga

SEQ ID NO: 3869802 - DNA, 12 bp, Homo sapiens
acccttctgggc

SEQ ID NO: 3869803 - DNA, 15 bp, Homo sapiens
acccttctttcctct

SEQ ID NO: 3869804 - DNA, 20 bp, Homo sapiens
acccttctttcctcttcccc

SEQ ID NO: 3869805 - DNA, 18 bp, Homo sapiens
acccttggacttgaggat

SEQ ID NO: 3869806 - DNA, 15 bp, Homo sapiens
acccttgtaccccat

SEQ ID NO: 3869807 - DNA, 19 bp, Homo sapiens
acccttgtaccccatccct

SEQ ID NO: 3869808 - DNA, 15 bp, Homo sapiens
accctttccttcctt

SEQ ID NO: 3869809 - DNA, 20 bp, Homo sapiens
acccttttcctccagacaga

SEQ ID NO: 3869810 - DNA, 18 bp, Homo sapiens
accgacgcgtctcctgtt

SEQ ID NO: 3869811 - DNA, 14 bp, Homo sapiens
accgagaaaaggag

SEQ ID NO: 3869812 - DNA, 15 bp, Homo sapiens
accgagaccaaactc

SEQ ID NO: 3869813 - DNA, 23 bp, Homo sapiens
accgagagtagccgagagcctgc

SEQ ID NO: 3869814 - DNA, 18 bp, Homo sapiens
accgagcgctttctggaa

SEQ ID NO: 3869815 - DNA, 24 bp, Homo sapiens
accgagtctcttctccactggatg

SEQ ID NO: 3869816 - DNA, 14 bp, Homo sapiens
accgctacaccact

SEQ ID NO: 3869817 - DNA, 19 bp, Homo sapiens
accgctacaccactctggc

SEQ ID NO: 3869818 - DNA, 21 bp, Homo sapiens
accgctacaccactctggcag

SEQ ID NO: 3869819 - DNA, 18 bp, Homo sapiens
accgcttcacccctgcac

SEQ ID NO: 3869820 - DNA, 19 bp, Homo sapiens
accgcttcacccctgcact

SEQ ID NO: 3869821 - DNA, 14 bp, Homo sapiens
accgcttcccagag

SEQ ID NO: 3869822 - DNA, 15 bp, Homo sapiens
accgcttcccagagg

SEQ ID NO: 3869823 - DNA, 16 bp, Homo sapiens
accgcttcccagaggc

SEQ ID NO: 3869824 - DNA, 23 bp, Homo sapiens
accggagctttcaaagaaggaat

SEQ ID NO: 3869825 - DNA, 12 bp, Homo sapiens
accggcagaaaa

SEQ ID NO: 3869826 - DNA, 14 bp, Homo sapiens
accggcgctgcagg

SEQ ID NO: 3869827 - DNA, 22 bp, Homo sapiens
accggggaacccagccctgggg

SEQ ID NO: 3869828 - DNA, 19 bp, Homo sapiens
accgggggccagacacaga

SEQ ID NO: 3869829 - DNA, 15 bp, Homo sapiens
accgggtgggcctgg

SEQ ID NO: 3869830 - DNA, 18 bp, Homo sapiens
accgggtgggcctggcct

SEQ ID NO: 3869831 - DNA, 19 bp, Homo sapiens
accgggtgggcctggcctg

SEQ ID NO: 3869832 - DNA, 21 bp, Homo sapiens
accgggtgggcctggcctgag

SEQ ID NO: 3869833 - DNA, 22 bp, Homo sapiens
accgggtgggcctggcctgagc

SEQ ID NO: 3869834 - DNA, 15 bp, Homo sapiens
accggtcaccgagac

SEQ ID NO: 3869835 - DNA, 12 bp, Homo sapiens
accgtaatttta

SEQ ID NO: 3869836 - DNA, 14 bp, Homo sapiens
accgtccctcagtg

SEQ ID NO: 3869837 - DNA, 18 bp, Homo sapiens
accgtggaccttcctgcc

SEQ ID NO: 3869838 - DNA, 19 bp, Homo sapiens
accgtggcccttcctggac

SEQ ID NO: 3869839 - DNA, 20 bp, Homo sapiens
accgtggcccttcctggaca

SEQ ID NO: 3869840 - DNA, 22 bp, Homo sapiens
accgtggcccttcctggacagc

SEQ ID NO: 3869841 - DNA, 19 bp, Homo sapiens
accgtgtcccaaggagctg

SEQ ID NO: 3869842 - DNA, 20 bp, Homo sapiens
accgtgtcccaaggagctga

SEQ ID NO: 3869843 - DNA, 15 bp, Homo sapiens
acctaacccctttcc

SEQ ID NO: 3869844 - DNA, 16 bp, Homo sapiens
acctaacccctttcct

SEQ ID NO: 3869845 - DNA, 17 bp, Homo sapiens
acctaacccctttcctg

SEQ ID NO: 3869846 - DNA, 18 bp, Homo sapiens
acctaacccctttcctgc

SEQ ID NO: 3869847 - DNA, 18 bp, Homo sapiens
acctaccaccccttcctg

SEQ ID NO: 3869848 - DNA, 17 bp, Homo sapiens
acctaccagttggccat

SEQ ID NO: 3869849 - DNA, 16 bp, Homo sapiens
acctaccatgctgctt

SEQ ID NO: 3869850 - DNA, 16 bp, Homo sapiens
acctactcacacaggc

SEQ ID NO: 3869851 - DNA, 17 bp, Homo sapiens
acctactcacacaggca

SEQ ID NO: 3869852 - DNA, 20 bp, Homo sapiens
acctacttgtgactgaaggg

SEQ ID NO: 3869853 - DNA, 15 bp, Homo sapiens
acctagaacttcaaa

SEQ ID NO: 3869854 - DNA, 19 bp, Homo sapiens
acctagaacttcaaaatgt

SEQ ID NO: 3869855 - DNA, 22 bp, Homo sapiens
acctagaatagccatgtactat

SEQ ID NO: 3869856 - DNA, 14 bp, Homo sapiens
acctagcaattcca

SEQ ID NO: 3869857 - DNA, 18 bp, Homo sapiens
acctagtactctctgctc

SEQ ID NO: 3869858 - DNA, 21 bp, Homo sapiens
acctagtactctctgctctag

SEQ ID NO: 3869859 - DNA, 22 bp, Homo sapiens
acctataatgtgtgtatgtgta

SEQ ID NO: 3869860 - DNA, 20 bp, Homo sapiens
acctatcaatcctgccccca

SEQ ID NO: 3869861 - DNA, 19 bp, Homo sapiens
acctatgtcctaaggacac

SEQ ID NO: 3869862 - DNA, 14 bp, Homo sapiens
acctatttgacata

SEQ ID NO: 3869863 - DNA, 19 bp, Homo sapiens
acctcacagtgacccttcc

SEQ ID NO: 3869864 - DNA, 15 bp, Homo sapiens
acctcacgctctgga

SEQ ID NO: 3869865 - DNA, 20 bp, Homo sapiens
acctcactattcaagtatta

SEQ ID NO: 3869866 - DNA, 14 bp, Homo sapiens
acctcactcctgtt

SEQ ID NO: 3869867 - DNA, 13 bp, Homo sapiens
acctcagctgcac

SEQ ID NO: 3869868 - DNA, 23 bp, Homo sapiens
acctcagctgcacattcctggcc

SEQ ID NO: 3869869 - DNA, 12 bp, Homo sapiens
acctcagtttcc

SEQ ID NO: 3869870 - DNA, 23 bp, Homo sapiens
acctcagtttcctcatctgcaga

SEQ ID NO: 3869871 - DNA, 15 bp, Homo sapiens
acctccacctcctga

SEQ ID NO: 3869872 - DNA, 18 bp, Homo sapiens
acctccacctcctgagtt

SEQ ID NO: 3869873 - DNA, 16 bp, Homo sapiens
acctccagctttcctg

SEQ ID NO: 3869874 - DNA, 13 bp, Homo sapiens
acctcccacccca

SEQ ID NO: 3869875 - DNA, 20 bp, Homo sapiens
acctcccaccccactccagc

SEQ ID NO: 3869876 - DNA, 15 bp, Homo sapiens
acggagtacagacgt

SEQ ID NO: 3869877 - DNA, 16 bp, Homo sapiens
acggatgattggatta

SEQ ID NO: 3869878 - DNA, 15 bp, Homo sapiens
acggatgcacagaga

SEQ ID NO: 3869879 - DNA, 23 bp, Homo sapiens
acggcacctgggccctggggcct

SEQ ID NO: 3869880 - DNA, 11 bp, Homo sapiens
acggccaccct

SEQ ID NO: 3869881 - DNA, 15 bp, Homo sapiens
acggccaccctcctt

SEQ ID NO: 3869882 - DNA, 20 bp, Homo sapiens
acggccaccctccttcccgc

SEQ ID NO: 3869883 - DNA, 14 bp, Homo sapiens
acggcggcagggtg

SEQ ID NO: 3869884 - DNA, 13 bp, Homo sapiens
acggctggacctg

SEQ ID NO: 3869885 - DNA, 16 bp, Homo sapiens
acggctggacctgcac

SEQ ID NO: 3869886 - DNA, 15 bp, Homo sapiens
acgggaagcaacctc

SEQ ID NO: 3869887 - DNA, 21 bp, Homo sapiens
acgggaagcctccgtcaggag

SEQ ID NO: 3869888 - DNA, 15 bp, Homo sapiens
acgggagcctcctct

SEQ ID NO: 3869889 - DNA, 12 bp, Homo sapiens
acggggagaaaa

SEQ ID NO: 3869890 - DNA, 20 bp, Homo sapiens
acgggggtgcggcaggagca

SEQ ID NO: 3869891 - DNA, 15 bp, Homo sapiens
acggtgcgtggctgt

SEQ ID NO: 3869892 - DNA, 14 bp, Homo sapiens
acggtgttgcagag

SEQ ID NO: 3869893 - DNA, 20 bp, Homo sapiens
acggttaacttgtatattcc

SEQ ID NO: 3869894 - DNA, 15 bp, Homo sapiens
acgtaatgtatttat

SEQ ID NO: 3869895 - DNA, 16 bp, Homo sapiens
acgtaatgtatttata

SEQ ID NO: 3869896 - DNA, 16 bp, Homo sapiens
acgtacttaactgtgt

SEQ ID NO: 3869897 - DNA, 23 bp, Homo sapiens
acgtacttaactgtgtgaagaaa

SEQ ID NO: 3869898 - DNA, 16 bp, Homo sapiens
acgtcaaacatgaagt

SEQ ID NO: 3869899 - DNA, 17 bp, Homo sapiens
acgtcaaacatgaagtg

SEQ ID NO: 3869900 - DNA, 18 bp, Homo sapiens
acgtcatcggaggctggg

SEQ ID NO: 3869901 - DNA, 15 bp, Homo sapiens
acgtcctgctggcac

SEQ ID NO: 3869902 - DNA, 20 bp, Homo sapiens
acgtcctgctggcacctcag

SEQ ID NO: 3869903 - DNA, 15 bp, Homo sapiens
acgtctgccaggccc

SEQ ID NO: 3869904 - DNA, 13 bp, Homo sapiens
acgtgaaatattt

SEQ ID NO: 3869905 - DNA, 14 bp, Homo sapiens
acgtgaatgtctca

SEQ ID NO: 3869906 - DNA, 15 bp, Homo sapiens
acgtgaatgtctcag

SEQ ID NO: 3869907 - DNA, 14 bp, Homo sapiens
acgtgactgcccca

SEQ ID NO: 3869908 - DNA, 16 bp, Homo sapiens
acgtgagagaatctgc

SEQ ID NO: 3869909 - DNA, 14 bp, Homo sapiens
acgtgagccaggta

SEQ ID NO: 3869910 - DNA, 22 bp, Homo sapiens
acgtgagccaggtaatgaggga

SEQ ID NO: 3869911 - DNA, 18 bp, Homo sapiens
acgtgatggtctgagact

SEQ ID NO: 3869912 - DNA, 13 bp, Homo sapiens
acgtgctcgcagc

SEQ ID NO: 3869913 - DNA, 17 bp, Homo sapiens
acgtgctcgcagcctgg

SEQ ID NO: 3869914 - DNA, 18 bp, Homo sapiens
acgtgctcgcagcctggc

SEQ ID NO: 3869915 - DNA, 19 bp, Homo sapiens
acgtgctcgcagcctggcg

SEQ ID NO: 3869916 - DNA, 18 bp, Homo sapiens
acgtgctcttctgttctc

SEQ ID NO: 3869917 - DNA, 16 bp, Homo sapiens
acgtgggagacaagaa

SEQ ID NO: 3869918 - DNA, 21 bp, Homo sapiens
acgtgggtatttcctgctaca

SEQ ID NO: 3869919 - DNA, 23 bp, Homo sapiens
acgtgttaggaggctgcatgctc

SEQ ID NO: 3869920 - DNA, 12 bp, Homo sapiens
acgttaaaagac

SEQ ID NO: 3869921 - DNA, 16 bp, Homo sapiens
acgttccttactgcag

SEQ ID NO: 3869922 - DNA, 19 bp, Homo sapiens
acgttccttactgcagaat

SEQ ID NO: 3869923 - DNA, 15 bp, Homo sapiens
acgttctccagccca

SEQ ID NO: 3869924 - DNA, 18 bp, Homo sapiens
actaaaaaatgtctatag

SEQ ID NO: 3869925 - DNA, 21 bp, Homo sapiens
actaaaaagtggctaattcaa

SEQ ID NO: 3869926 - DNA, 13 bp, Homo sapiens
actaaaaatatta

SEQ ID NO: 3869927 - DNA, 21 bp, Homo sapiens
actaaagatatcagagctctt

SEQ ID NO: 3869928 - DNA, 18 bp, Homo sapiens
actaaagtgtctattagt

SEQ ID NO: 3869929 - DNA, 16 bp, Homo sapiens
actaaatatatgtctg

SEQ ID NO: 3869930 - DNA, 18 bp, Homo sapiens
actaaatatatgtctgtg

SEQ ID NO: 3869931 - DNA, 20 bp, Homo sapiens
actaaattgtatacattttg

SEQ ID NO: 3869932 - DNA, 21 bp, Homo sapiens
actaaccccaacgcacaggaa

SEQ ID NO: 3869933 - DNA, 15 bp, Homo sapiens
actaagccacaagaa

SEQ ID NO: 3869934 - DNA, 18 bp, Homo sapiens
actaagccacaagaaatt

SEQ ID NO: 3869935 - DNA, 18 bp, Homo sapiens
actaagctttctcctttg

SEQ ID NO: 3869936 - DNA, 18 bp, Homo sapiens
actaagttatagtatatc

SEQ ID NO: 3869937 - DNA, 19 bp, Homo sapiens
actaatcgaactatgaact

SEQ ID NO: 3869938 - DNA, 23 bp, Homo sapiens
actaatgaagatacggttgcttc

SEQ ID NO: 3869939 - DNA, 23 bp, Homo sapiens
actaatgctaagaaatgctgaaa

SEQ ID NO: 3869940 - DNA, 16 bp, Homo sapiens
actaattaaaatctgg

SEQ ID NO: 3869941 - DNA, 17 bp, Homo sapiens
actacagaataatgtgt

SEQ ID NO: 3869942 - DNA, 22 bp, Homo sapiens
actacagggtgaggtgcttgcc

SEQ ID NO: 3869943 - DNA, 15 bp, Homo sapiens
actacatgtggttta

SEQ ID NO: 3869944 - DNA, 18 bp, Homo sapiens
actacatgtggtttatag

SEQ ID NO: 3869945 - DNA, 14 bp, Homo sapiens
actaccaagtgacc

SEQ ID NO: 3869946 - DNA, 19 bp, Homo sapiens
actacctttgtccaggcct

SEQ ID NO: 3869947 - DNA, 20 bp, Homo sapiens
actacctttgtccaggcctg

SEQ ID NO: 3869948 - DNA, 20 bp, Homo sapiens
actacgggggggagaaggaa

SEQ ID NO: 3869949 - DNA, 15 bp, Homo sapiens
actacgttaagggaa

SEQ ID NO: 3869950 - DNA, 21 bp, Homo sapiens
actactcatacttaagcaaaa

SEQ ID NO: 3869951 - DNA, 18 bp, Homo sapiens
actactgctgcaaagtgc

SEQ ID NO: 3869952 - DNA, 11 bp, Homo sapiens
actactgtaat

SEQ ID NO: 3869953 - DNA, 17 bp, Homo sapiens
actacttgttacctttc

SEQ ID NO: 3869954 - DNA, 22 bp, Homo sapiens
actactttttatactccataca

SEQ ID NO: 3869955 - DNA, 15 bp, Homo sapiens
actagaacctggagg

SEQ ID NO: 3869956 - DNA, 21 bp, Homo sapiens
actagagcctgtgctaaagaa

SEQ ID NO: 3869957 - DNA, 12 bp, Homo sapiens
actagagctggg

SEQ ID NO: 3869958 - DNA, 18 bp, Homo sapiens
actagatcttacatctgc

SEQ ID NO: 3869959 - DNA, 15 bp, Homo sapiens
actagcctctccagg

SEQ ID NO: 3869960 - DNA, 15 bp, Homo sapiens
actagcctgtgatta

SEQ ID NO: 3869961 - DNA, 16 bp, Homo sapiens
actaggttcaattccc

SEQ ID NO: 3869962 - DNA, 23 bp, Homo sapiens
acctcccaccccactccagccct

SEQ ID NO: 3869963 - DNA, 13 bp, Homo sapiens
acctcccagccct

SEQ ID NO: 3869964 - DNA, 23 bp, Homo sapiens
acctccccacccccgctgggggt

SEQ ID NO: 3869965 - DNA, 13 bp, Homo sapiens
acctccccccact

SEQ ID NO: 3869966 - DNA, 14 bp, Homo sapiens
acctccccccactg

SEQ ID NO: 3869967 - DNA, 16 bp, Homo sapiens
acctccccccactgca

SEQ ID NO: 3869968 - DNA, 22 bp, Homo sapiens
acctccccccactgcaggcccc

SEQ ID NO: 3869969 - DNA, 20 bp, Homo sapiens
acctccccggcctctctctt

SEQ ID NO: 3869970 - DNA, 20 bp, Homo sapiens
acctccctgaaccatccctg

SEQ ID NO: 3869971 - DNA, 19 bp, Homo sapiens
acctccggggagagcagag

SEQ ID NO: 3869972 - DNA, 22 bp, Homo sapiens
acctccggggagagcagagggt

SEQ ID NO: 3869973 - DNA, 15 bp, Homo sapiens
acctcctagaggtgg

SEQ ID NO: 3869974 - DNA, 21 bp, Homo sapiens
acctcctatccttggagagca

SEQ ID NO: 3869975 - DNA, 13 bp, Homo sapiens
acctcctccactc

SEQ ID NO: 3869976 - DNA, 18 bp, Homo sapiens
acctcctccactcactcc

SEQ ID NO: 3869977 - DNA, 12 bp, Homo sapiens
acctcctgccca

SEQ ID NO: 3869978 - DNA, 17 bp, Homo sapiens
acctcctgcccaggaga

SEQ ID NO: 3869979 - DNA, 20 bp, Homo sapiens
acctcgtcctccccctgcca

SEQ ID NO: 3869980 - DNA, 22 bp, Homo sapiens
acctcgtcctccccctgccagt

SEQ ID NO: 3869981 - DNA, 12 bp, Homo sapiens
acctctcaatat

SEQ ID NO: 3869982 - DNA, 21 bp, Homo sapiens
acctctcaatattcaataaag

SEQ ID NO: 3869983 - DNA, 18 bp, Homo sapiens
acctctcatcagtgtcct

SEQ ID NO: 3869984 - DNA, 15 bp, Homo sapiens
acctctccttggaaa

SEQ ID NO: 3869985 - DNA, 15 bp, Homo sapiens
acctctctaagccac

SEQ ID NO: 3869986 - DNA, 20 bp, Homo sapiens
acctctctaagccacagctt

SEQ ID NO: 3869987 - DNA, 13 bp, Homo sapiens
acctctcttcagc

SEQ ID NO: 3869988 - DNA, 14 bp, Homo sapiens
acctctctttttca

SEQ ID NO: 3869989 - DNA, 12 bp, Homo sapiens
acctctgatccc

SEQ ID NO: 3869990 - DNA, 22 bp, Homo sapiens
acctctgctctgaggcttccag

SEQ ID NO: 3869991 - DNA, 13 bp, Homo sapiens
acctctgggcttc

SEQ ID NO: 3869992 - DNA, 13 bp, Homo sapiens
acctcttccttcc

SEQ ID NO: 3869993 - DNA, 14 bp, Homo sapiens
acctcttctatgca

SEQ ID NO: 3869994 - DNA, 23 bp, Homo sapiens
acctcttctatgcaagccttgct

SEQ ID NO: 3869995 - DNA, 13 bp, Homo sapiens
acctcttctgcca

SEQ ID NO: 3869996 - DNA, 19 bp, Homo sapiens
acctgaaaaaaagtttaca

SEQ ID NO: 3869997 - DNA, 18 bp, Homo sapiens
acctgaaccccatgggct

SEQ ID NO: 3869998 - DNA, 19 bp, Homo sapiens
acctgaagggtgacatccc

SEQ ID NO: 3869999 - DNA, 21 bp, Homo sapiens
acctgaagggtgacatcccag

SEQ ID NO: 3870000 - DNA, 16 bp, Homo sapiens
acctgacaagcactgc

SEQ ID NO: 3870001 - DNA, 15 bp, Homo sapiens
acctgacacatcttg

SEQ ID NO: 3870002 - DNA, 20 bp, Homo sapiens
acctgacaccgtccctcagt

SEQ ID NO: 3870003 - DNA, 22 bp, Homo sapiens
acctgacaccgtccctcagtga

SEQ ID NO: 3870004 - DNA, 17 bp, Homo sapiens
acctgaccaacatggag

SEQ ID NO: 3870005 - DNA, 17 bp, Homo sapiens
acctgacggacgtcctg

SEQ ID NO: 3870006 - DNA, 16 bp, Homo sapiens
acctgagccagcctgc

SEQ ID NO: 3870007 - DNA, 13 bp, Homo sapiens
acctgagcctgcc

SEQ ID NO: 3870008 - DNA, 14 bp, Homo sapiens
acctgagcctgccg

SEQ ID NO: 3870009 - DNA, 15 bp, Homo sapiens
acctgaggcagatga

SEQ ID NO: 3870010 - DNA, 16 bp, Homo sapiens
acctgaggctcctgtg

SEQ ID NO: 3870011 - DNA, 22 bp, Homo sapiens
acctgagtcaccctacctgtgc

SEQ ID NO: 3870012 - DNA, 21 bp, Homo sapiens
acctgagtcggccccacatgg

SEQ ID NO: 3870013 - DNA, 22 bp, Homo sapiens
acctgagtcggccccacatggg

SEQ ID NO: 3870014 - DNA, 15 bp, Homo sapiens
acctgatcacctctg

SEQ ID NO: 3870015 - DNA, 16 bp, Homo sapiens
acctgatcatggtcag

SEQ ID NO: 3870016 - DNA, 17 bp, Homo sapiens
acctgcaagccccaggg

SEQ ID NO: 3870017 - DNA, 15 bp, Homo sapiens
acctgcacctccccc

SEQ ID NO: 3870018 - DNA, 16 bp, Homo sapiens
acctgcacctcccccc

SEQ ID NO: 3870019 - DNA, 18 bp, Homo sapiens
acctgcacctccccccac

SEQ ID NO: 3870020 - DNA, 21 bp, Homo sapiens
acctgcacctccccccactgc

SEQ ID NO: 3870021 - DNA, 16 bp, Homo sapiens
acctgcacgccaccgc

SEQ ID NO: 3870022 - DNA, 16 bp, Homo sapiens
acctgcagttcctgag

SEQ ID NO: 3870023 - DNA, 22 bp, Homo sapiens
acctgcatccgtagttccctga

SEQ ID NO: 3870024 - DNA, 20 bp, Homo sapiens
acctgcatgtgttgtacaat

SEQ ID NO: 3870025 - DNA, 12 bp, Homo sapiens
acctgccccagc

SEQ ID NO: 3870026 - DNA, 19 bp, Homo sapiens
acctgccccagcgcggctt

SEQ ID NO: 3870027 - DNA, 14 bp, Homo sapiens
acctgcccctcccc

SEQ ID NO: 3870028 - DNA, 12 bp, Homo sapiens
acctgccctctc

SEQ ID NO: 3870029 - DNA, 15 bp, Homo sapiens
acctgccctctctca

SEQ ID NO: 3870030 - DNA, 13 bp, Homo sapiens
acctgccctgccc

SEQ ID NO: 3870031 - DNA, 16 bp, Homo sapiens
acctgccctgccctgc

SEQ ID NO: 3870032 - DNA, 20 bp, Homo sapiens
acctgccctgccctgccacc

SEQ ID NO: 3870033 - DNA, 13 bp, Homo sapiens
acctgccgacctc

SEQ ID NO: 3870034 - DNA, 19 bp, Homo sapiens
acctgcctctcacacacat

SEQ ID NO: 3870035 - DNA, 23 bp, Homo sapiens
acctgcctctcacacacatagat

SEQ ID NO: 3870036 - DNA, 20 bp, Homo sapiens
acctgcgagaggtccctgct

SEQ ID NO: 3870037 - DNA, 17 bp, Homo sapiens
acctgctcactgttcta

SEQ ID NO: 3870038 - DNA, 18 bp, Homo sapiens
acctgctctcctcttgcc

SEQ ID NO: 3870039 - DNA, 12 bp, Homo sapiens
acctgctgagct

SEQ ID NO: 3870040 - DNA, 20 bp, Homo sapiens
acctgctgtgcaccttacat

SEQ ID NO: 3870041 - DNA, 19 bp, Homo sapiens
acctgcttcatgctcagcc

SEQ ID NO: 3870042 - DNA, 23 bp, Homo sapiens
acctgcttcatgctcagccctga

SEQ ID NO: 3870043 - DNA, 13 bp, Homo sapiens
acctggagagcta

SEQ ID NO: 3870044 - DNA, 20 bp, Homo sapiens
acctggagagctagaacctg

SEQ ID NO: 3870045 - DNA, 14 bp, Homo sapiens
acctggagatgatg

SEQ ID NO: 3870046 - DNA, 15 bp, Homo sapiens
acctggagatgatga

SEQ ID NO: 3870047 - DNA, 20 bp, Homo sapiens
acctggagggctagaacctg

SEQ ID NO: 3870048 - DNA, 22 bp, Homo sapiens
acctggagggctagaacctgga

SEQ ID NO: 3870049 - DNA, 22 bp, Homo sapiens
acctggcaagctagaacctgga

SEQ ID NO: 3870050 - DNA, 12 bp, Homo sapiens
acctggcctgct

SEQ ID NO: 3870051 - DNA, 13 bp, Homo sapiens
acctggcctgctg

SEQ ID NO: 3870052 - DNA, 16 bp, Homo sapiens
acctggcctgctggga

SEQ ID NO: 3870053 - DNA, 17 bp, Homo sapiens
acctgggaaaacagagg

SEQ ID NO: 3870054 - DNA, 23 bp, Homo sapiens
acctgggccaaaagggcagccag

SEQ ID NO: 3870055 - DNA, 18 bp, Homo sapiens
acctgggcgccaactgct

SEQ ID NO: 3870056 - DNA, 23 bp, Homo sapiens
acctggtcacaggactctgcctc

SEQ ID NO: 3870057 - DNA, 12 bp, Homo sapiens
acctggtggcac

SEQ ID NO: 3870058 - DNA, 17 bp, Homo sapiens
acctgtatgtctccagt

SEQ ID NO: 3870059 - DNA, 19 bp, Homo sapiens
acctgtcaccgtgagcagc

SEQ ID NO: 3870060 - DNA, 19 bp, Homo sapiens
acctgttaaaatgtacact

SEQ ID NO: 3870061 - DNA, 19 bp, Homo sapiens
accttaatattattggggt

SEQ ID NO: 3870062 - DNA, 14 bp, Homo sapiens
accttacattccta

SEQ ID NO: 3870063 - DNA, 16 bp, Homo sapiens
accttacattcctaga

SEQ ID NO: 3870064 - DNA, 16 bp, Homo sapiens
accttaccaactttct

SEQ ID NO: 3870065 - DNA, 18 bp, Homo sapiens
accttagaaatcattgta

SEQ ID NO: 3870066 - DNA, 17 bp, Homo sapiens
accttagattagctctg

SEQ ID NO: 3870067 - DNA, 18 bp, Homo sapiens
accttagattagctctgg

SEQ ID NO: 3870068 - DNA, 21 bp, Homo sapiens
accttagctggcattacagct

SEQ ID NO: 3870069 - DNA, 23 bp, Homo sapiens
accttagtccgcaagttcaggga

SEQ ID NO: 3870070 - DNA, 11 bp, Homo sapiens
accttcccagc

SEQ ID NO: 3870071 - DNA, 13 bp, Homo sapiens
accttcccagctc

SEQ ID NO: 3870072 - DNA, 18 bp, Homo sapiens
accttcctgccaccagtc

SEQ ID NO: 3870073 - DNA, 16 bp, Homo sapiens
accttctctatatcat

SEQ ID NO: 3870074 - DNA, 16 bp, Homo sapiens
accttctgacctcccc

SEQ ID NO: 3870075 - DNA, 21 bp, Homo sapiens
accttctgacctccccacccc

SEQ ID NO: 3870076 - DNA, 18 bp, Homo sapiens
accttctggttgcttcag

SEQ ID NO: 3870077 - DNA, 19 bp, Homo sapiens
accttcttcagccacctct

SEQ ID NO: 3870078 - DNA, 21 bp, Homo sapiens
accttcttcgctgctagagaa

SEQ ID NO: 3870079 - DNA, 20 bp, Homo sapiens
accttcttggcttctgggac

SEQ ID NO: 3870080 - DNA, 23 bp, Homo sapiens
accttcttggcttctgggacctg

SEQ ID NO: 3870081 - DNA, 20 bp, Homo sapiens
accttgcagcatttttattt

SEQ ID NO: 3870082 - DNA, 21 bp, Homo sapiens
accttgccaagctttcttcta

SEQ ID NO: 3870083 - DNA, 16 bp, Homo sapiens
accttgccgagagagg

SEQ ID NO: 3870084 - DNA, 20 bp, Homo sapiens
accttgctcttctttctgag

SEQ ID NO: 3870085 - DNA, 13 bp, Homo sapiens
accttggactcct

SEQ ID NO: 3870086 - DNA, 15 bp, Homo sapiens
accttggactcctcc

SEQ ID NO: 3870087 - DNA, 18 bp, Homo sapiens
accttggactcctcccac

SEQ ID NO: 3870088 - DNA, 21 bp, Homo sapiens
accttgggtttgtattttaaa

SEQ ID NO: 3870089 - DNA, 16 bp, Homo sapiens
acctttaagtcctctc

SEQ ID NO: 3870090 - DNA, 15 bp, Homo sapiens
acctttacataattg

SEQ ID NO: 3870091 - DNA, 18 bp, Homo sapiens
acctttattgtgatctat

SEQ ID NO: 3870092 - DNA, 15 bp, Homo sapiens
acctttcccatgctg

SEQ ID NO: 3870093 - DNA, 17 bp, Homo sapiens
acctttcccatgctgaa

SEQ ID NO: 3870094 - DNA, 13 bp, Homo sapiens
acctttggaaaaa

SEQ ID NO: 3870095 - DNA, 17 bp, Homo sapiens
acctttgtccaggcctg

SEQ ID NO: 3870096 - DNA, 15 bp, Homo sapiens
accttttatccactt

SEQ ID NO: 3870097 - DNA, 17 bp, Homo sapiens
accttttctctcccata

SEQ ID NO: 3870098 - DNA, 16 bp, Homo sapiens
accttttctgttgtac

SEQ ID NO: 3870099 - DNA, 16 bp, Homo sapiens
accttttgtatttaaa

SEQ ID NO: 3870100 - DNA, 20 bp, Homo sapiens
accttttgtatttaaaacct

SEQ ID NO: 3870101 - DNA, 19 bp, Homo sapiens
acctttttttctctcctaa

SEQ ID NO: 3870102 - DNA, 19 bp, Homo sapiens
acgaaacacaaaccacaac

SEQ ID NO: 3870103 - DNA, 15 bp, Homo sapiens
acgaacccacctgct

SEQ ID NO: 3870104 - DNA, 12 bp, Homo sapiens
acgacactgaag

SEQ ID NO: 3870105 - DNA, 11 bp, Homo sapiens
acgactcttcc

SEQ ID NO: 3870106 - DNA, 20 bp, Homo sapiens
acgagaccctacaggagagg

SEQ ID NO: 3870107 - DNA, 15 bp, Homo sapiens
acgagcactggccag

SEQ ID NO: 3870108 - DNA, 19 bp, Homo sapiens
acgagcaggctactgtcag

SEQ ID NO: 3870109 - DNA, 18 bp, Homo sapiens
acgagtaagatattattt

SEQ ID NO: 3870110 - DNA, 12 bp, Homo sapiens
acgagtcacctg

SEQ ID NO: 3870111 - DNA, 14 bp, Homo sapiens
acgagtcacctgca

SEQ ID NO: 3870112 - DNA, 18 bp, Homo sapiens
acgatgtggccctggcct

SEQ ID NO: 3870113 - DNA, 21 bp, Homo sapiens
acgcaaagggctgaaagccat

SEQ ID NO: 3870114 - DNA, 15 bp, Homo sapiens
acgcacacatcagtg

SEQ ID NO: 3870115 - DNA, 19 bp, Homo sapiens
acgcacacatggacacaga

SEQ ID NO: 3870116 - DNA, 20 bp, Homo sapiens
acgcagaggcggaaaccttg

SEQ ID NO: 3870117 - DNA, 21 bp, Homo sapiens
acgcagaggcggaaaccttgc

SEQ ID NO: 3870118 - DNA, 23 bp, Homo sapiens
acgcagaggcggaaaccttgcag

SEQ ID NO: 3870119 - DNA, 12 bp, Homo sapiens
acgcagccctgc

SEQ ID NO: 3870120 - DNA, 20 bp, Homo sapiens
acgcagccctgggggccagc

SEQ ID NO: 3870121 - DNA, 19 bp, Homo sapiens
acgcaggcccccaggtgcc

SEQ ID NO: 3870122 - DNA, 13 bp, Homo sapiens
acgcctgagccca

SEQ ID NO: 3870123 - DNA, 15 bp, Homo sapiens
acgcctgagcccagg

SEQ ID NO: 3870124 - DNA, 16 bp, Homo sapiens
acgcctgagcccaggg

SEQ ID NO: 3870125 - DNA, 17 bp, Homo sapiens
acgcctgcttgtccctg

SEQ ID NO: 3870126 - DNA, 21 bp, Homo sapiens
acgcctgcttgtccctgccca

SEQ ID NO: 3870127 - DNA, 18 bp, Homo sapiens
acgcctgtaatcccagca

SEQ ID NO: 3870128 - DNA, 13 bp, Homo sapiens
acgcgcacacaca

SEQ ID NO: 3870129 - DNA, 15 bp, Homo sapiens
acgcgtctcctgttt

SEQ ID NO: 3870130 - DNA, 23 bp, Homo sapiens
acgctgccgctgccgctgcacca

SEQ ID NO: 3870131 - DNA, 20 bp, Homo sapiens
acgctgtcctctcgagccca

SEQ ID NO: 3870132 - DNA, 12 bp, Homo sapiens
acgcttccagac

SEQ ID NO: 3870133 - DNA, 23 bp, Homo sapiens
acgcttttgggaaaactgggtgg

SEQ ID NO: 3870134 - DNA, 20 bp, Homo sapiens
tagcctggagcacctttcct

SEQ ID NO: 3870135 - DNA, 20 bp, Homo sapiens
tagccttaaatttttgtcat

SEQ ID NO: 3870136 - DNA, 21 bp, Homo sapiens
tagccttgccttttaaaagaa

SEQ ID NO: 3870137 - DNA, 14 bp, Homo sapiens
tagccttgtgccct

SEQ ID NO: 3870138 - DNA, 15 bp, Homo sapiens
tagccttgtgccctg

SEQ ID NO: 3870139 - DNA, 15 bp, Homo sapiens
tagcctttgccctgt

SEQ ID NO: 3870140 - DNA, 17 bp, Homo sapiens
tagcctttgccctgtca

SEQ ID NO: 3870141 - DNA, 17 bp, Homo sapiens
tagcgagctgctctgct

SEQ ID NO: 3870142 - DNA, 18 bp, Homo sapiens
tagcgtgggttatcagtt

SEQ ID NO: 3870143 - DNA, 18 bp, Homo sapiens
tagcgttcccaacaacat

SEQ ID NO: 3870144 - DNA, 20 bp, Homo sapiens
tagctacccaaaagagaaaa

SEQ ID NO: 3870145 - DNA, 14 bp, Homo sapiens
tagctagaagtggg

SEQ ID NO: 3870146 - DNA, 19 bp, Homo sapiens
tagctagaagtgggccagg

SEQ ID NO: 3870147 - DNA, 14 bp, Homo sapiens
tagctatcagaaga

SEQ ID NO: 3870148 - DNA, 22 bp, Homo sapiens
tagctattgcatgtaaaatgca

SEQ ID NO: 3870149 - DNA, 23 bp, Homo sapiens
tagctattgcatgtaaaatgcag

SEQ ID NO: 3870150 - DNA, 21 bp, Homo sapiens
tagctatttgtttacatgcag

SEQ ID NO: 3870151 - DNA, 20 bp, Homo sapiens
tagctccaccctcaccagga

SEQ ID NO: 3870152 - DNA, 22 bp, Homo sapiens
tagctccaccctcaccaggatg

SEQ ID NO: 3870153 - DNA, 14 bp, Homo sapiens
tagctctgcctccc

SEQ ID NO: 3870154 - DNA, 17 bp, Homo sapiens
tagctcttctatttaaa

SEQ ID NO: 3870155 - DNA, 23 bp, Homo sapiens
tagctgacatctcctctatcaca

SEQ ID NO: 3870156 - DNA, 14 bp, Homo sapiens
tagctgagaggaag

SEQ ID NO: 3870157 - DNA, 18 bp, Homo sapiens
tagctgagaggaagatga

SEQ ID NO: 3870158 - DNA, 12 bp, Homo sapiens
tagctgcagaac

SEQ ID NO: 3870159 - DNA, 11 bp, Homo sapiens
tagctggcagg

SEQ ID NO: 3870160 - DNA, 20 bp, Homo sapiens
tagctggttggagagctaga

SEQ ID NO: 3870161 - DNA, 21 bp, Homo sapiens
tagctgtaaatacatgtgtgg

SEQ ID NO: 3870162 - DNA, 14 bp, Homo sapiens
tagctgtgacctgc

SEQ ID NO: 3870163 - DNA, 18 bp, Homo sapiens
tagctgtgacctgctgag

SEQ ID NO: 3870164 - DNA, 19 bp, Homo sapiens
tagctgtgacctgctgagc

SEQ ID NO: 3870165 - DNA, 15 bp, Homo sapiens
tagcttaaataaatt

SEQ ID NO: 3870166 - DNA, 17 bp, Homo sapiens
tagcttaaataaattca

SEQ ID NO: 3870167 - DNA, 13 bp, Homo sapiens
tagcttgtatagt

SEQ ID NO: 3870168 - DNA, 19 bp, Homo sapiens
tagctttcccaaataaact

SEQ ID NO: 3870169 - DNA, 13 bp, Homo sapiens
tagctttctcagg

SEQ ID NO: 3870170 - DNA, 13 bp, Homo sapiens
tagcttttccctt

SEQ ID NO: 3870171 - DNA, 15 bp, Homo sapiens
taggaaaagaaggct

SEQ ID NO: 3870172 - DNA, 17 bp, Homo sapiens
taggaaaagtacattta

SEQ ID NO: 3870173 - DNA, 22 bp, Homo sapiens
taggaaagcgtggttccaagaa

SEQ ID NO: 3870174 - DNA, 19 bp, Homo sapiens
taggaaataaaacctttca

SEQ ID NO: 3870175 - DNA, 22 bp, Homo sapiens
taggaacagctcttcactcagc

SEQ ID NO: 3870176 - DNA, 13 bp, Homo sapiens
taggaagaaaaat

SEQ ID NO: 3870177 - DNA, 21 bp, Homo sapiens
taggaatgaccacgggcctca

SEQ ID NO: 3870178 - DNA, 23 bp, Homo sapiens
taggaatgaccacgggcctcagt

SEQ ID NO: 3870179 - DNA, 21 bp, Homo sapiens
taggacatataccttctcaaa

SEQ ID NO: 3870180 - DNA, 12 bp, Homo sapiens
taggagacagtc

SEQ ID NO: 3870181 - DNA, 14 bp, Homo sapiens
taggaggctgcatg

SEQ ID NO: 3870182 - DNA, 22 bp, Homo sapiens
taggaggctgcatgctctggaa

SEQ ID NO: 3870183 - DNA, 12 bp, Homo sapiens
taggagggactg

SEQ ID NO: 3870184 - DNA, 17 bp, Homo sapiens
taggatataaaacacat

SEQ ID NO: 3870185 - DNA, 16 bp, Homo sapiens
taggatctatgcaatt

SEQ ID NO: 3870186 - DNA, 19 bp, Homo sapiens
taggatctatgcaattttt

SEQ ID NO: 3870187 - DNA, 20 bp, Homo sapiens
taggatctatgcaattttta

SEQ ID NO: 3870188 - DNA, 23 bp, Homo sapiens
taggatctatgcaatttttaaac

SEQ ID NO: 3870189 - DNA, 13 bp, Homo sapiens
taggcagacgtgg

SEQ ID NO: 3870190 - DNA, 17 bp, Homo sapiens
taggcagacgtggggag

SEQ ID NO: 3870191 - DNA, 12 bp, Homo sapiens
taggcagagcct

SEQ ID NO: 3870192 - DNA, 19 bp, Homo sapiens
taggcagcctctctgctat

SEQ ID NO: 3870193 - DNA, 19 bp, Homo sapiens
taggcatcccaggggacca

SEQ ID NO: 3870194 - DNA, 21 bp, Homo sapiens
taggcccttgtcctgccagct

SEQ ID NO: 3870195 - DNA, 16 bp, Homo sapiens
taggcctcctctctgc

SEQ ID NO: 3870196 - DNA, 18 bp, Homo sapiens
taggcgagtgccaggact

SEQ ID NO: 3870197 - DNA, 17 bp, Homo sapiens
taggcggtcatgtgtgc

SEQ ID NO: 3870198 - DNA, 15 bp, Homo sapiens
taggctggagaagct

SEQ ID NO: 3870199 - DNA, 17 bp, Homo sapiens
taggcttatcaaaatct

SEQ ID NO: 3870200 - DNA, 18 bp, Homo sapiens
taggcttatcaaaatctt

SEQ ID NO: 3870201 - DNA, 17 bp, Homo sapiens
tagggagaatgcagaga

SEQ ID NO: 3870202 - DNA, 22 bp, Homo sapiens
tagggccagctcacaagcccag

SEQ ID NO: 3870203 - DNA, 23 bp, Homo sapiens
tagggctggactctggcacccag

SEQ ID NO: 3870204 - DNA, 18 bp, Homo sapiens
tagggtaaggtgccttct

SEQ ID NO: 3870205 - DNA, 22 bp, Homo sapiens
tagggtctggaacaccaggctg

SEQ ID NO: 3870206 - DNA, 15 bp, Homo sapiens
taggtcctggcttct

SEQ ID NO: 3870207 - DNA, 23 bp, Homo sapiens
taggtgaaaacagcccaggtcct

SEQ ID NO: 3870208 - DNA, 23 bp, Homo sapiens
taggtgctacaaaaacacagcaa

SEQ ID NO: 3870209 - DNA, 14 bp, Homo sapiens
taggtgtgccaaac

SEQ ID NO: 3870210 - DNA, 20 bp, Homo sapiens
taggttgccaataatacact

SEQ ID NO: 3870211 - DNA, 18 bp, Homo sapiens
taggtttgagttcaaatt

SEQ ID NO: 3870212 - DNA, 19 bp, Homo sapiens
taggtttttttgtatagta

SEQ ID NO: 3870213 - DNA, 19 bp, Homo sapiens
tagtaatgggccaattaaa

SEQ ID NO: 3870214 - DNA, 16 bp, Homo sapiens
tagtacagtagcttaa

SEQ ID NO: 3870215 - DNA, 20 bp, Homo sapiens
tagtacagtagcttaaataa

SEQ ID NO: 3870216 - DNA, 17 bp, Homo sapiens
tagtactctctgctcta

SEQ ID NO: 3870217 - DNA, 11 bp, Homo sapiens
tagtagcattt

SEQ ID NO: 3870218 - DNA, 19 bp, Homo sapiens
tagtagcggatctcactca

SEQ ID NO: 3870219 - DNA, 16 bp, Homo sapiens
tagtatatctggacaa

SEQ ID NO: 3870220 - DNA, 17 bp, Homo sapiens
tactctgtgccagagcc

SEQ ID NO: 3870221 - DNA, 19 bp, Homo sapiens
tactctgtgccagagcctg

SEQ ID NO: 3870222 - DNA, 23 bp, Homo sapiens
tactgaaaacaaaatatctgaca

SEQ ID NO: 3870223 - DNA, 17 bp, Homo sapiens
tactgattctcctgtca

SEQ ID NO: 3870224 - DNA, 17 bp, Homo sapiens
tactgatttttgtgatt

SEQ ID NO: 3870225 - DNA, 20 bp, Homo sapiens
tactgcccaggcctgcctgt

SEQ ID NO: 3870226 - DNA, 19 bp, Homo sapiens
tactgccggtcacccaggc

SEQ ID NO: 3870227 - DNA, 20 bp, Homo sapiens
tactgccggtcacccaggct

SEQ ID NO: 3870228 - DNA, 12 bp, Homo sapiens
tactgcctgctt

SEQ ID NO: 3870229 - DNA, 22 bp, Homo sapiens
tactgcctttggaagaaacagg

SEQ ID NO: 3870230 - DNA, 11 bp, Homo sapiens
tactgctctga

SEQ ID NO: 3870231 - DNA, 13 bp, Homo sapiens
tactgctctgaat

SEQ ID NO: 3870232 - DNA, 14 bp, Homo sapiens
tactgctctgaata

SEQ ID NO: 3870233 - DNA, 14 bp, Homo sapiens
tactgctgcaaagt

SEQ ID NO: 3870234 - DNA, 17 bp, Homo sapiens
tactggaccccgcctcc

SEQ ID NO: 3870235 - DNA, 12 bp, Homo sapiens
tactggcattaa

SEQ ID NO: 3870236 - DNA, 13 bp, Homo sapiens
tactgggaaggct

SEQ ID NO: 3870237 - DNA, 22 bp, Homo sapiens
tactgggaatggaaggctttgc

SEQ ID NO: 3870238 - DNA, 14 bp, Homo sapiens
tactgtaattaagt

SEQ ID NO: 3870239 - DNA, 13 bp, Homo sapiens
tactgtgactgat

SEQ ID NO: 3870240 - DNA, 15 bp, Homo sapiens
tactgtgcatacatg

SEQ ID NO: 3870241 - DNA, 14 bp, Homo sapiens
tacttaactgtgtg

SEQ ID NO: 3870242 - DNA, 12 bp, Homo sapiens
tacttaagagaa

SEQ ID NO: 3870243 - DNA, 17 bp, Homo sapiens
tacttaataaattcaga

SEQ ID NO: 3870244 - DNA, 17 bp, Homo sapiens
tacttatttttgacagt

SEQ ID NO: 3870245 - DNA, 19 bp, Homo sapiens
tacttcactttaattctca

SEQ ID NO: 3870246 - DNA, 22 bp, Homo sapiens
tacttcactttaattctcatgt

SEQ ID NO: 3870247 - DNA, 23 bp, Homo sapiens
tacttcaggtgcttttgatgtga

SEQ ID NO: 3870248 - DNA, 13 bp, Homo sapiens
tacttcctcctga

SEQ ID NO: 3870249 - DNA, 13 bp, Homo sapiens
tacttcctgtgta

SEQ ID NO: 3870250 - DNA, 20 bp, Homo sapiens
tacttcggggctgggaagtc

SEQ ID NO: 3870251 - DNA, 13 bp, Homo sapiens
tacttcttggaaa

SEQ ID NO: 3870252 - DNA, 12 bp, Homo sapiens
tacttgaaagat

SEQ ID NO: 3870253 - DNA, 16 bp, Homo sapiens
tacttgaactttccaa

SEQ ID NO: 3870254 - DNA, 17 bp, Homo sapiens
tacttgaactttccaaa

SEQ ID NO: 3870255 - DNA, 13 bp, Homo sapiens
tacttgagctgta

SEQ ID NO: 3870256 - DNA, 17 bp, Homo sapiens
tacttgagctgtatata

SEQ ID NO: 3870257 - DNA, 22 bp, Homo sapiens
tacttgggaggctgaggcagga

SEQ ID NO: 3870258 - DNA, 19 bp, Homo sapiens
tacttgtagaaatctgtaa

SEQ ID NO: 3870259 - DNA, 18 bp, Homo sapiens
tacttgtctgaggcctca

SEQ ID NO: 3870260 - DNA, 15 bp, Homo sapiens
tactttattagagta

SEQ ID NO: 3870261 - DNA, 19 bp, Homo sapiens
tactttgccttttgcaaac

SEQ ID NO: 3870262 - DNA, 24 bp, Homo sapiens
tactttggaatgactataaacatt

SEQ ID NO: 3870263 - DNA, 16 bp, Homo sapiens
tactttgtatttgtat

SEQ ID NO: 3870264 - DNA, 20 bp, Homo sapiens
tacttttaattcctagaggg

SEQ ID NO: 3870265 - DNA, 19 bp, Homo sapiens
tacttttgttctgtatttt

SEQ ID NO: 3870266 - DNA, 18 bp, Homo sapiens
tagaaaaatctcattccc

SEQ ID NO: 3870267 - DNA, 16 bp, Homo sapiens
tagaaaactgaaaatc

SEQ ID NO: 3870268 - DNA, 18 bp, Homo sapiens
tagaaaagatgagaggca

SEQ ID NO: 3870269 - DNA, 14 bp, Homo sapiens
tagaaaccttaata

SEQ ID NO: 3870270 - DNA, 15 bp, Homo sapiens
tagaaaccttaatat

SEQ ID NO: 3870271 - DNA, 21 bp, Homo sapiens
tagaaactgaaaactgtaaat

SEQ ID NO: 3870272 - DNA, 19 bp, Homo sapiens
tagaaagaaaagaccctga

SEQ ID NO: 3870273 - DNA, 16 bp, Homo sapiens
tagaaagcaataaaaa

SEQ ID NO: 3870274 - DNA, 20 bp, Homo sapiens
tagaaagctgtttatttatt

SEQ ID NO: 3870275 - DNA, 22 bp, Homo sapiens
tagaaaggggcagtttaaagca

SEQ ID NO: 3870276 - DNA, 18 bp, Homo sapiens
tagaaagtgccagaaagt

SEQ ID NO: 3870277 - DNA, 19 bp, Homo sapiens
tagaaatgtaacttttgta

SEQ ID NO: 3870278 - DNA, 23 bp, Homo sapiens
tagaacaatagctattgcatgta

SEQ ID NO: 3870279 - DNA, 20 bp, Homo sapiens
tagaacacccactggccagt

SEQ ID NO: 3870280 - DNA, 17 bp, Homo sapiens
tagaacataaagcaaat

SEQ ID NO: 3870281 - DNA, 14 bp, Homo sapiens
tagaacatgcacat

SEQ ID NO: 3870282 - DNA, 19 bp, Homo sapiens
tagaacatgcacatttata

SEQ ID NO: 3870283 - DNA, 15 bp, Homo sapiens
tagaaccaagcttca

SEQ ID NO: 3870284 - DNA, 16 bp, Homo sapiens
tagaaccaagcttcag

SEQ ID NO: 3870285 - DNA, 13 bp, Homo sapiens
tagaacctagaag

SEQ ID NO: 3870286 - DNA, 14 bp, Homo sapiens
tagaacctagaagg

SEQ ID NO: 3870287 - DNA, 23 bp, Homo sapiens
tagaacctagaagggctagaacc

SEQ ID NO: 3870288 - DNA, 23 bp, Homo sapiens
tagaacctagagaagctaaaacc

SEQ ID NO: 3870289 - DNA, 20 bp, Homo sapiens
tagaactgtatgtcagacat

SEQ ID NO: 3870290 - DNA, 12 bp, Homo sapiens
tagaacttcaaa

SEQ ID NO: 3870291 - DNA, 18 bp, Homo sapiens
tagaagaacatccaagga

SEQ ID NO: 3870292 - DNA, 17 bp, Homo sapiens
tagaagctggaggacta

SEQ ID NO: 3870293 - DNA, 18 bp, Homo sapiens
tagaaggctgtggtgagg

SEQ ID NO: 3870294 - DNA, 19 bp, Homo sapiens
tagaagtgggccaggacag

SEQ ID NO: 3870295 - DNA, 15 bp, Homo sapiens
tagaataaaattgta

SEQ ID NO: 3870296 - DNA, 17 bp, Homo sapiens
tagaataataataaaaa

SEQ ID NO: 3870297 - DNA, 21 bp, Homo sapiens
tagaatacttttttctagttt

SEQ ID NO: 3870298 - DNA, 18 bp, Homo sapiens
tagaatagccatgtacta

SEQ ID NO: 3870299 - DNA, 20 bp, Homo sapiens
tagaatgaaaattgtatgtt

SEQ ID NO: 3870300 - DNA, 16 bp, Homo sapiens
tagaatggtagcacta

SEQ ID NO: 3870301 - DNA, 13 bp, Homo sapiens
tagaatgtgtttt

SEQ ID NO: 3870302 - DNA, 21 bp, Homo sapiens
tagaatgttactttggaatga

SEQ ID NO: 3870303 - DNA, 21 bp, Homo sapiens
tagaattatatctaatttata

SEQ ID NO: 3870304 - DNA, 23 bp, Homo sapiens
tagaattatatctaatttataca

SEQ ID NO: 3870305 - DNA, 24 bp, Homo sapiens
tagaattatatctaatttatacaa

SEQ ID NO: 3870306 - DNA, 22 bp, Homo sapiens
tagaattgggaagctgggggaa

SEQ ID NO: 3870307 - DNA, 16 bp, Homo sapiens
tagaatttgtattttg

SEQ ID NO: 3870308 - DNA, 14 bp, Homo sapiens
tagacagtgctgcc

SEQ ID NO: 3870309 - DNA, 18 bp, Homo sapiens
tagacagtgctgccctgc

SEQ ID NO: 3870310 - DNA, 23 bp, Homo sapiens
tagacatagttcagccacaaagt

SEQ ID NO: 3870311 - DNA, 19 bp, Homo sapiens
tagacatttgtaaatgtaa

SEQ ID NO: 3870312 - DNA, 14 bp, Homo sapiens
tagaccaaaataaa

SEQ ID NO: 3870313 - DNA, 13 bp, Homo sapiens
tagactaaatgaa

SEQ ID NO: 3870314 - DNA, 13 bp, Homo sapiens
tagactatataca

SEQ ID NO: 3870315 - DNA, 23 bp, Homo sapiens
tagactatatacatgtgtgtata

SEQ ID NO: 3870316 - DNA, 22 bp, Homo sapiens
tagactggagtgaggcttccag

SEQ ID NO: 3870317 - DNA, 15 bp, Homo sapiens
tagactttctcagtg

SEQ ID NO: 3870318 - DNA, 12 bp, Homo sapiens
tagactttctgt

SEQ ID NO: 3870319 - DNA, 15 bp, Homo sapiens
tagagacacagagat

SEQ ID NO: 3870320 - DNA, 11 bp, Homo sapiens
tagagagcaga

SEQ ID NO: 3870321 - DNA, 16 bp, Homo sapiens
tagagagcagaaataa

SEQ ID NO: 3870322 - DNA, 18 bp, Homo sapiens
tagagagcagaaataaaa

SEQ ID NO: 3870323 - DNA, 14 bp, Homo sapiens
tagagaggctggca

SEQ ID NO: 3870324 - DNA, 15 bp, Homo sapiens
tagagagggggctct

SEQ ID NO: 3870325 - DNA, 18 bp, Homo sapiens
tagagaggtagcgagctg

SEQ ID NO: 3870326 - DNA, 19 bp, Homo sapiens
tagagatatgcagaaggaa

SEQ ID NO: 3870327 - DNA, 20 bp, Homo sapiens
tagagatatgcagaaggaag

SEQ ID NO: 3870328 - DNA, 17 bp, Homo sapiens
tagagatatttttgtac

SEQ ID NO: 3870329 - DNA, 11 bp, Homo sapiens
tagagatgtgt

SEQ ID NO: 3870330 - DNA, 22 bp, Homo sapiens
tagagccccccgtgtggcttac

SEQ ID NO: 3870331 - DNA, 15 bp, Homo sapiens
tagagctcctgtccc

SEQ ID NO: 3870332 - DNA, 20 bp, Homo sapiens
tagagctgggaaacagggag

SEQ ID NO: 3870333 - DNA, 21 bp, Homo sapiens
tagagctgggaaacagggagc

SEQ ID NO: 3870334 - DNA, 12 bp, Homo sapiens
tagagctttctt

SEQ ID NO: 3870335 - DNA, 22 bp, Homo sapiens
tagaggagggcatgggagggag

SEQ ID NO: 3870336 - DNA, 19 bp, Homo sapiens
tagaggcagggaggggact

SEQ ID NO: 3870337 - DNA, 20 bp, Homo sapiens
tagaggtgggcagctgggcc

SEQ ID NO: 3870338 - DNA, 16 bp, Homo sapiens
tagaggttttgttgtt

SEQ ID NO: 3870339 - DNA, 16 bp, Homo sapiens
tagataggtaaatacc

SEQ ID NO: 3870340 - DNA, 14 bp, Homo sapiens
tagatagttaaaag

SEQ ID NO: 3870341 - DNA, 19 bp, Homo sapiens
tagatagttaaaagactgc

SEQ ID NO: 3870342 - DNA, 23 bp, Homo sapiens
tagatatataactttagaaataa

SEQ ID NO: 3870343 - DNA, 14 bp, Homo sapiens
tagatattattcat

SEQ ID NO: 3870344 - DNA, 22 bp, Homo sapiens
tagatcccatgtcacctcagct

SEQ ID NO: 3870345 - DNA, 20 bp, Homo sapiens
tagatcctaggtgctggatg

SEQ ID NO: 3870346 - DNA, 21 bp, Homo sapiens
tagatctgatggtgagctggg

SEQ ID NO: 3870347 - DNA, 15 bp, Homo sapiens
tagatcttacatctg

SEQ ID NO: 3870348 - DNA, 16 bp, Homo sapiens
tagatgagggtgactg

SEQ ID NO: 3870349 - DNA, 14 bp, Homo sapiens
tagatggtgaaatt

SEQ ID NO: 3870350 - DNA, 16 bp, Homo sapiens
tagatgtgcaagtctt

SEQ ID NO: 3870351 - DNA, 16 bp, Homo sapiens
tagattaatggcactg

SEQ ID NO: 3870352 - DNA, 21 bp, Homo sapiens
tagattaccccctcattgttt

SEQ ID NO: 3870353 - DNA, 14 bp, Homo sapiens
tagattagctctgg

SEQ ID NO: 3870354 - DNA, 15 bp, Homo sapiens
tagattagctctgga

SEQ ID NO: 3870355 - DNA, 16 bp, Homo sapiens
tagattagctctggac

SEQ ID NO: 3870356 - DNA, 12 bp, Homo sapiens
tagattccagga

SEQ ID NO: 3870357 - DNA, 15 bp, Homo sapiens
tagattctccaaatg

SEQ ID NO: 3870358 - DNA, 18 bp, Homo sapiens
tagcaagttctagagaag

SEQ ID NO: 3870359 - DNA, 21 bp, Homo sapiens
tagcaatccatgttagttttt

SEQ ID NO: 3870360 - DNA, 16 bp, Homo sapiens
tagcacttgacctttt

SEQ ID NO: 3870361 - DNA, 23 bp, Homo sapiens
tagcagaaaccaagtctacttca

SEQ ID NO: 3870362 - DNA, 22 bp, Homo sapiens
tagcagagtgaggatgtgtttt

SEQ ID NO: 3870363 - DNA, 12 bp, Homo sapiens
tagcagataaag

SEQ ID NO: 3870364 - DNA, 19 bp, Homo sapiens
tagcagataaagacagctg

SEQ ID NO: 3870365 - DNA, 14 bp, Homo sapiens
tagcagatggagta

SEQ ID NO: 3870366 - DNA, 18 bp, Homo sapiens
tagcagcaaaaatataaa

SEQ ID NO: 3870367 - DNA, 20 bp, Homo sapiens
tagcagcaaaaatataaaat

SEQ ID NO: 3870368 - DNA, 22 bp, Homo sapiens
tagcaggactgaattgtcccca

SEQ ID NO: 3870369 - DNA, 23 bp, Homo sapiens
tagcaggtggtcctgagacctga

SEQ ID NO: 3870370 - DNA, 12 bp, Homo sapiens
tagcatatcaat

SEQ ID NO: 3870371 - DNA, 22 bp, Homo sapiens
tagcatgcctccaaaaattcac

SEQ ID NO: 3870372 - DNA, 18 bp, Homo sapiens
tagcattgaacatttctt

SEQ ID NO: 3870373 - DNA, 19 bp, Homo sapiens
tagcattttcttgaaccaa

SEQ ID NO: 3870374 - DNA, 14 bp, Homo sapiens
tagccacctcccac

SEQ ID NO: 3870375 - DNA, 17 bp, Homo sapiens
tagccacctcccacccc

SEQ ID NO: 3870376 - DNA, 13 bp, Homo sapiens
tagccagacacat

SEQ ID NO: 3870377 - DNA, 18 bp, Homo sapiens
tagccagagaggagcacc

SEQ ID NO: 3870378 - DNA, 20 bp, Homo sapiens
tagccagagaggagcacctg

SEQ ID NO: 3870379 - DNA, 17 bp, Homo sapiens
tagccagagggtgggag

SEQ ID NO: 3870380 - DNA, 21 bp, Homo sapiens
tagccagagggtgggagccta

SEQ ID NO: 3870381 - DNA, 23 bp, Homo sapiens
tagccagccggggcgagtggcac

SEQ ID NO: 3870382 - DNA, 19 bp, Homo sapiens
tagccaggagtctgtgctc

SEQ ID NO: 3870383 - DNA, 14 bp, Homo sapiens
tagccagtgacttt

SEQ ID NO: 3870384 - DNA, 16 bp, Homo sapiens
tagccatggctcaggc

SEQ ID NO: 3870385 - DNA, 20 bp, Homo sapiens
tagccatggctcaggcaagc

SEQ ID NO: 3870386 - DNA, 23 bp, Homo sapiens
tagccatggctcaggcaagcccc

SEQ ID NO: 3870387 - DNA, 18 bp, Homo sapiens
tagcccggccagggcctg

SEQ ID NO: 3870388 - DNA, 13 bp, Homo sapiens
tagccctttctgt

SEQ ID NO: 3870389 - DNA, 16 bp, Homo sapiens
tagccggccactttgg

SEQ ID NO: 3870390 - DNA, 17 bp, Homo sapiens
tagccgtccatggcacc

SEQ ID NO: 3870391 - DNA, 21 bp, Homo sapiens
tagcctccgtttatgggcctt

SEQ ID NO: 3870392 - DNA, 19 bp, Homo sapiens
tagtatatctggacaagcc

SEQ ID NO: 3870393 - DNA, 21 bp, Homo sapiens
tagtatgtggcgtatcatgca

SEQ ID NO: 3870394 - DNA, 14 bp, Homo sapiens
tagtattgaaagtg

SEQ ID NO: 3870395 - DNA, 21 bp, Homo sapiens
tagtatttttactattataat

SEQ ID NO: 3870396 - DNA, 18 bp, Homo sapiens
tagtcaaaccataaactt

SEQ ID NO: 3870397 - DNA, 23 bp, Homo sapiens
tagtcaagaaaaattattgtata

SEQ ID NO: 3870398 - DNA, 17 bp, Homo sapiens
tagtcacaaaaatggtg

SEQ ID NO: 3870399 - DNA, 18 bp, Homo sapiens
tagtcacaaaaatggtgg

SEQ ID NO: 3870400 - DNA, 13 bp, Homo sapiens
tagtccaatattt

SEQ ID NO: 3870401 - DNA, 23 bp, Homo sapiens
tagtccatggacaatataaactg

SEQ ID NO: 3870402 - DNA, 21 bp, Homo sapiens
tagtccgcaagttcagggaag

SEQ ID NO: 3870403 - DNA, 19 bp, Homo sapiens
tagtctcctttgcactgag

SEQ ID NO: 3870404 - DNA, 20 bp, Homo sapiens
tagtctcctttgcactgagg

SEQ ID NO: 3870405 - DNA, 20 bp, Homo sapiens
tagtctgaggccccttaact

SEQ ID NO: 3870406 - DNA, 21 bp, Homo sapiens
tagtcttttactcctttgcat

SEQ ID NO: 3870407 - DNA, 12 bp, Homo sapiens
tagtgaagatgt

SEQ ID NO: 3870408 - DNA, 13 bp, Homo sapiens
tagtgaagatgtt

SEQ ID NO: 3870409 - DNA, 14 bp, Homo sapiens
tagtgacttcctgg

SEQ ID NO: 3870410 - DNA, 14 bp, Homo sapiens
tagtgctatatata

SEQ ID NO: 3870411 - DNA, 21 bp, Homo sapiens
tagtgctatatatataaatat

SEQ ID NO: 3870412 - DNA, 16 bp, Homo sapiens
tagtgctattctgtgt

SEQ ID NO: 3870413 - DNA, 18 bp, Homo sapiens
tagtgctattctgtgttg

SEQ ID NO: 3870414 - DNA, 23 bp, Homo sapiens
tagtggaaatgagcgaaatcatg

SEQ ID NO: 3870415 - DNA, 18 bp, Homo sapiens
tagtggaagagcagcctg

SEQ ID NO: 3870416 - DNA, 21 bp, Homo sapiens
tagtggggtaattctgcttct

SEQ ID NO: 3870417 - DNA, 21 bp, Homo sapiens
tagtggggtctccctctcctg

SEQ ID NO: 3870418 - DNA, 11 bp, Homo sapiens
tagtgtaaaat

SEQ ID NO: 3870419 - DNA, 13 bp, Homo sapiens
tagtgtaaaataa

SEQ ID NO: 3870420 - DNA, 20 bp, Homo sapiens
tagtgtgagtggcagccatg

SEQ ID NO: 3870421 - DNA, 22 bp, Homo sapiens
tagtgtgagtggcagccatgcc

SEQ ID NO: 3870422 - DNA, 16 bp, Homo sapiens
tagtgtgtgtgcatgt

SEQ ID NO: 3870423 - DNA, 17 bp, Homo sapiens
tagtgtgtgtgcatgtg

SEQ ID NO: 3870424 - DNA, 22 bp, Homo sapiens
tagttaaaagactgcagctgct

SEQ ID NO: 3870425 - DNA, 21 bp, Homo sapiens
tagttaagtatttacagatgt

SEQ ID NO: 3870426 - DNA, 13 bp, Homo sapiens
tagttaatttatt

SEQ ID NO: 3870427 - DNA, 21 bp, Homo sapiens
tagttaggaaataaaaccttt

SEQ ID NO: 3870428 - DNA, 16 bp, Homo sapiens
tagttaggtgtgccaa

SEQ ID NO: 3870429 - DNA, 16 bp, Homo sapiens
tagttatttacttgaa

SEQ ID NO: 3870430 - DNA, 18 bp, Homo sapiens
tagttatttacttgaaag

SEQ ID NO: 3870431 - DNA, 16 bp, Homo sapiens
tagttcctgtggccag

SEQ ID NO: 3870432 - DNA, 15 bp, Homo sapiens
tagttcgtagctttc

SEQ ID NO: 3870433 - DNA, 19 bp, Homo sapiens
tagttcttgtgcatgttta

SEQ ID NO: 3870434 - DNA, 21 bp, Homo sapiens
tagttcttgtgcatgtttact

SEQ ID NO: 3870435 - DNA, 21 bp, Homo sapiens
tagttgtccatattttcacag

SEQ ID NO: 3870436 - DNA, 15 bp, Homo sapiens
tagtttattggaagt

SEQ ID NO: 3870437 - DNA, 13 bp, Homo sapiens
tagtttctttctg

SEQ ID NO: 3870438 - DNA, 21 bp, Homo sapiens
tagtttgacctcacagtgacc

SEQ ID NO: 3870439 - DNA, 14 bp, Homo sapiens
tagtttgtataact

SEQ ID NO: 3870440 - DNA, 14 bp, Homo sapiens
tagttttaacagaa

SEQ ID NO: 3870441 - DNA, 15 bp, Homo sapiens
tagttttaacagaac

SEQ ID NO: 3870442 - DNA, 23 bp, Homo sapiens
tagttttaacagaaccagagggt

SEQ ID NO: 3870443 - DNA, 15 bp, Homo sapiens
tagttttcagccttg

SEQ ID NO: 3870444 - DNA, 21 bp, Homo sapiens
tagttttttttgtaaactgta

SEQ ID NO: 3870445 - DNA, 13 bp, Homo sapiens
tataaaaatatat

SEQ ID NO: 3870446 - DNA, 13 bp, Homo sapiens
tataaaactcagt

SEQ ID NO: 3870447 - DNA, 23 bp, Homo sapiens
tataaaatgcaaaataaatgttt

SEQ ID NO: 3870448 - DNA, 18 bp, Homo sapiens
tataaaattagaaagcaa

SEQ ID NO: 3870449 - DNA, 23 bp, Homo sapiens
tataaacattaaaagaagactgg

SEQ ID NO: 3870450 - DNA, 16 bp, Homo sapiens
tataaacattaaatgt

SEQ ID NO: 3870451 - DNA, 19 bp, Homo sapiens
tataaacattaaatgtctt

SEQ ID NO: 3870452 - DNA, 15 bp, Homo sapiens
tataaactactgtaa

SEQ ID NO: 3870453 - DNA, 19 bp, Homo sapiens
tataaactatcagtttgtc

SEQ ID NO: 3870454 - DNA, 11 bp, Homo sapiens
tataaactgaa

SEQ ID NO: 3870455 - DNA, 14 bp, Homo sapiens
tataaacttgtgta

SEQ ID NO: 3870456 - DNA, 15 bp, Homo sapiens
tataaactttagagt

SEQ ID NO: 3870457 - DNA, 17 bp, Homo sapiens
tataaagatggctgact

SEQ ID NO: 3870458 - DNA, 15 bp, Homo sapiens
tataaagcagtagac

SEQ ID NO: 3870459 - DNA, 15 bp, Homo sapiens
tataaagtcacttcc

SEQ ID NO: 3870460 - DNA, 15 bp, Homo sapiens
tataaatatatattt

SEQ ID NO: 3870461 - DNA, 16 bp, Homo sapiens
tataaatatgaaatga

SEQ ID NO: 3870462 - DNA, 12 bp, Homo sapiens
tataaatgcatg

SEQ ID NO: 3870463 - DNA, 14 bp, Homo sapiens
tataaatgcatgat

SEQ ID NO: 3870464 - DNA, 18 bp, Homo sapiens
tataaatgcatgatttta

SEQ ID NO: 3870465 - DNA, 23 bp, Homo sapiens
tataaatgcatgattttatacat

SEQ ID NO: 3870466 - DNA, 19 bp, Homo sapiens
tataaatgtatatacacat

SEQ ID NO: 3870467 - DNA, 14 bp, Homo sapiens
tataaatgtgtggt

SEQ ID NO: 3870468 - DNA, 16 bp, Homo sapiens
tataaattaagacttt

SEQ ID NO: 3870469 - DNA, 22 bp, Homo sapiens
tataacaaggttcttctaaaat

SEQ ID NO: 3870470 - DNA, 22 bp, Homo sapiens
tataacatgtctttcagcatta

SEQ ID NO: 3870471 - DNA, 23 bp, Homo sapiens
tataaccccaccttgccaagctt

SEQ ID NO: 3870472 - DNA, 16 bp, Homo sapiens
tataactagctagaag

SEQ ID NO: 3870473 - DNA, 18 bp, Homo sapiens
tataacttaaaaaaatga

SEQ ID NO: 3870474 - DNA, 22 bp, Homo sapiens
tataacttaaaaaaatgacaga

SEQ ID NO: 3870475 - DNA, 18 bp, Homo sapiens
tataacttaaaatatttt

SEQ ID NO: 3870476 - DNA, 15 bp, Homo sapiens
tataactttagaaat

SEQ ID NO: 3870477 - DNA, 11 bp, Homo sapiens
tataagatgtc

SEQ ID NO: 3870478 - DNA, 16 bp, Homo sapiens
tataagattagaatga

SEQ ID NO: 3870479 - DNA, 22 bp, Homo sapiens
tataagcaaatttcaaaagaca

SEQ ID NO: 3870480 - DNA, 14 bp, Homo sapiens
tataagctgggaaa

SEQ ID NO: 3870481 - DNA, 15 bp, Homo sapiens
tataaggaggaaaac

SEQ ID NO: 3870482 - DNA, 17 bp, Homo sapiens
tataagtgcacacagaa

SEQ ID NO: 3870483 - DNA, 22 bp, Homo sapiens
tataagtgcacacagaaatata

SEQ ID NO: 3870484 - DNA, 16 bp, Homo sapiens
tataatactaaagtgt

SEQ ID NO: 3870485 - DNA, 13 bp, Homo sapiens
tataatctattta

SEQ ID NO: 3870486 - DNA, 15 bp, Homo sapiens
tataatggttgactg

SEQ ID NO: 3870487 - DNA, 13 bp, Homo sapiens
tataatgtgtgta

SEQ ID NO: 3870488 - DNA, 15 bp, Homo sapiens
tataatttaacagtg

SEQ ID NO: 3870489 - DNA, 11 bp, Homo sapiens
tataatttaat

SEQ ID NO: 3870490 - DNA, 19 bp, Homo sapiens
tatacaaaataatttaact

SEQ ID NO: 3870491 - DNA, 14 bp, Homo sapiens
tatacaatatataa

SEQ ID NO: 3870492 - DNA, 19 bp, Homo sapiens
tatacacaacatttatttc

SEQ ID NO: 3870493 - DNA, 21 bp, Homo sapiens
tatacacacaaaaattaacaa

SEQ ID NO: 3870494 - DNA, 12 bp, Homo sapiens
tatacacacata

SEQ ID NO: 3870495 - DNA, 14 bp, Homo sapiens
tatacacacatata

SEQ ID NO: 3870496 - DNA, 15 bp, Homo sapiens
tatacacatatacct

SEQ ID NO: 3870497 - DNA, 20 bp, Homo sapiens
tatacatacacttgtataaa

SEQ ID NO: 3870498 - DNA, 16 bp, Homo sapiens
tatacatagtcacaaa

SEQ ID NO: 3870499 - DNA, 19 bp, Homo sapiens
tatacatagtcacaaaaat

SEQ ID NO: 3870500 - DNA, 14 bp, Homo sapiens
tatacatatatata

SEQ ID NO: 3870501 - DNA, 14 bp, Homo sapiens
tatacatatcagaa

SEQ ID NO: 3870502 - DNA, 17 bp, Homo sapiens
tatacatatcagaaaag

SEQ ID NO: 3870503 - DNA, 13 bp, Homo sapiens
tatacatatgtag

SEQ ID NO: 3870504 - DNA, 15 bp, Homo sapiens
tatacatatgtagac

SEQ ID NO: 3870505 - DNA, 20 bp, Homo sapiens
tatacatattataaataaat

SEQ ID NO: 3870506 - DNA, 14 bp, Homo sapiens
tatacatcaccttt

SEQ ID NO: 3870507 - DNA, 21 bp, Homo sapiens
tatacattttgttatagaata

SEQ ID NO: 3870508 - DNA, 17 bp, Homo sapiens
tatacctataatgtgtg

SEQ ID NO: 3870509 - DNA, 16 bp, Homo sapiens
tatactatacaacaat

SEQ ID NO: 3870510 - DNA, 22 bp, Homo sapiens
tatagaatacttttttctagtt

SEQ ID NO: 3870511 - DNA, 23 bp, Homo sapiens
tatagagagggggctctccaaag

SEQ ID NO: 3870512 - DNA, 21 bp, Homo sapiens
tatagagatatttttgtacgt

SEQ ID NO: 3870513 - DNA, 22 bp, Homo sapiens
tatagatgcaagatatttatat

SEQ ID NO: 3870514 - DNA, 18 bp, Homo sapiens
tatagcagcaaaaatata

SEQ ID NO: 3870515 - DNA, 21 bp, Homo sapiens
tatagcagcaaaaatataaaa

SEQ ID NO: 3870516 - DNA, 11 bp, Homo sapiens
tatagctatta

SEQ ID NO: 3870517 - DNA, 17 bp, Homo sapiens
tatagctcttctattta

SEQ ID NO: 3870518 - DNA, 21 bp, Homo sapiens
tataggttactcataaggcat

SEQ ID NO: 3870519 - DNA, 22 bp, Homo sapiens
tatagtaactactttttatact

SEQ ID NO: 3870520 - DNA, 17 bp, Homo sapiens
tatagtagtcaattagt

SEQ ID NO: 3870521 - DNA, 18 bp, Homo sapiens
tatagtagtcaattagta

SEQ ID NO: 3870522 - DNA, 20 bp, Homo sapiens
tatagtagtcaattagtaca

SEQ ID NO: 3870523 - DNA, 13 bp, Homo sapiens
tatagtatatctg

SEQ ID NO: 3870524 - DNA, 18 bp, Homo sapiens
tatagtatatctggacaa

SEQ ID NO: 3870525 - DNA, 15 bp, Homo sapiens
tatagtatatttata

SEQ ID NO: 3870526 - DNA, 22 bp, Homo sapiens
tatagtcatttattttaaaaaa

SEQ ID NO: 3870527 - DNA, 20 bp, Homo sapiens
tatagtgctatatatataaa

SEQ ID NO: 3870528 - DNA, 19 bp, Homo sapiens
tatagttaggatagcattt

SEQ ID NO: 3870529 - DNA, 13 bp, Homo sapiens
tatagtttcagat

SEQ ID NO: 3870530 - DNA, 20 bp, Homo sapiens
tatagtttgctttgcttttt

SEQ ID NO: 3870531 - DNA, 18 bp, Homo sapiens
tatagtttgtacatgcat

SEQ ID NO: 3870532 - DNA, 12 bp, Homo sapiens
tatataaaaaga

SEQ ID NO: 3870533 - DNA, 19 bp, Homo sapiens
tatataaaaagaaaagata

SEQ ID NO: 3870534 - DNA, 20 bp, Homo sapiens
tatataaaaagaaaagataa

SEQ ID NO: 3870535 - DNA, 21 bp, Homo sapiens
tatataaaaatatatatagtg

SEQ ID NO: 3870536 - DNA, 11 bp, Homo sapiens
tatataaatat

SEQ ID NO: 3870537 - DNA, 14 bp, Homo sapiens
tatatacacataca

SEQ ID NO: 3870538 - DNA, 18 bp, Homo sapiens
tatatacacatacataca

SEQ ID NO: 3870539 - DNA, 13 bp, Homo sapiens
tatatacacatat

SEQ ID NO: 3870540 - DNA, 14 bp, Homo sapiens
tatatacacatata

SEQ ID NO: 3870541 - DNA, 15 bp, Homo sapiens
tatatacatatgtag

SEQ ID NO: 3870542 - DNA, 18 bp, Homo sapiens
tatatacatattataaat

SEQ ID NO: 3870543 - DNA, 13 bp, Homo sapiens
tatatacatgtgt

SEQ ID NO: 3870544 - DNA, 16 bp, Homo sapiens
tatatacatgtgtgta

SEQ ID NO: 3870545 - DNA, 18 bp, Homo sapiens
tatatacatgtgtgtata

SEQ ID NO: 3870546 - DNA, 18 bp, Homo sapiens
tatatagcagcaaaaata

SEQ ID NO: 3870547 - DNA, 22 bp, Homo sapiens
tatatagcagcaaaaatataaa

SEQ ID NO: 3870548 - DNA, 17 bp, Homo sapiens
tatataggttgtgcaaa

SEQ ID NO: 3870549 - DNA, 13 bp, Homo sapiens
tatatagtatatt

SEQ ID NO: 3870550 - DNA, 18 bp, Homo sapiens
tatatagtatatttatac

SEQ ID NO: 3870551 - DNA, 14 bp, Homo sapiens
tatatagtgctata

SEQ ID NO: 3870552 - DNA, 17 bp, Homo sapiens
tatatagtgctatatat

SEQ ID NO: 3870553 - DNA, 22 bp, Homo sapiens
tatatagtttattgacaataat

SEQ ID NO: 3870554 - DNA, 12 bp, Homo sapiens
tatatataaata

SEQ ID NO: 3870555 - DNA, 13 bp, Homo sapiens
tatatataaatat

SEQ ID NO: 3870556 - DNA, 13 bp, Homo sapiens
tatatatacacat

SEQ ID NO: 3870557 - DNA, 15 bp, Homo sapiens
tatatatacacatac

SEQ ID NO: 3870558 - DNA, 11 bp, Homo sapiens
tatatatacat

SEQ ID NO: 3870559 - DNA, 18 bp, Homo sapiens
tatatatacatatgtaga

SEQ ID NO: 3870560 - DNA, 12 bp, Homo sapiens
tatatatagtaa

SEQ ID NO: 3870561 - DNA, 19 bp, Homo sapiens
tatatatagtgctatatat

SEQ ID NO: 3870562 - DNA, 15 bp, Homo sapiens
tatatatatatgtgt

SEQ ID NO: 3870563 - DNA, 16 bp, Homo sapiens
tatatatatgtgtgtg

SEQ ID NO: 3870564 - DNA, 20 bp, Homo sapiens
tatatatctgataaaattgt

SEQ ID NO: 3870565 - DNA, 15 bp, Homo sapiens
tatatatgtatatgt

SEQ ID NO: 3870566 - DNA, 12 bp, Homo sapiens
tatatatgtgtg

SEQ ID NO: 3870567 - DNA, 18 bp, Homo sapiens
tatatatgtgtgtttaaa

SEQ ID NO: 3870568 - DNA, 22 bp, Homo sapiens
tatatattggtaacatcctttc

SEQ ID NO: 3870569 - DNA, 16 bp, Homo sapiens
tatatattgtattaag

SEQ ID NO: 3870570 - DNA, 20 bp, Homo sapiens
tatatatttgaatatcatta

SEQ ID NO: 3870571 - DNA, 17 bp, Homo sapiens
tatatcaaggatgttct

SEQ ID NO: 3870572 - DNA, 18 bp, Homo sapiens
tatatcaatgtaacaaaa

SEQ ID NO: 3870573 - DNA, 16 bp, Homo sapiens
tatatcagaatctgtg

SEQ ID NO: 3870574 - DNA, 22 bp, Homo sapiens
tatatcagttataattattcca

SEQ ID NO: 3870575 - DNA, 20 bp, Homo sapiens
tatatcatgctttaaagtgt

SEQ ID NO: 3870576 - DNA, 13 bp, Homo sapiens
tatatctaattta

SEQ ID NO: 3870577 - DNA, 19 bp, Homo sapiens
tatatctaatttatacaaa

SEQ ID NO: 3870578 - DNA, 13 bp, Homo sapiens
tatatctgataaa

SEQ ID NO: 3870579 - DNA, 15 bp, Homo sapiens
tatatctgataaaat

SEQ ID NO: 3870580 - DNA, 21 bp, Homo sapiens
tatatctgataaaattgtgat

SEQ ID NO: 3870581 - DNA, 16 bp, Homo sapiens
tatatgagagaatcac

SEQ ID NO: 3870582 - DNA, 19 bp, Homo sapiens
tatatgagagaatcacaca

SEQ ID NO: 3870583 - DNA, 13 bp, Homo sapiens
tatatgatctaat

SEQ ID NO: 3870584 - DNA, 16 bp, Homo sapiens
tatatgatttatagtt

SEQ ID NO: 3870585 - DNA, 21 bp, Homo sapiens
tatatgatttatagtttgtac

SEQ ID NO: 3870586 - DNA, 17 bp, Homo sapiens
tatatgccttatgtaat

SEQ ID NO: 3870587 - DNA, 17 bp, Homo sapiens
tatatgctcaaccagaa

SEQ ID NO: 3870588 - DNA, 12 bp, Homo sapiens
tatatgtatatg

SEQ ID NO: 3870589 - DNA, 17 bp, Homo sapiens
tatatgtatttattgtc

SEQ ID NO: 3870590 - DNA, 20 bp, Homo sapiens
tatatgtgcagtattttatt

SEQ ID NO: 3870591 - DNA, 19 bp, Homo sapiens
tatatgtgtatatatacat

SEQ ID NO: 3870592 - DNA, 16 bp, Homo sapiens
tatatgtgtgtttaaa

SEQ ID NO: 3870593 - DNA, 23 bp, Homo sapiens
tatatgtgtgtttaaataaagta

SEQ ID NO: 3870594 - DNA, 13 bp, Homo sapiens
tatattacctcaa

SEQ ID NO: 3870595 - DNA, 20 bp, Homo sapiens
tatattcatgtaataaatct

SEQ ID NO: 3870596 - DNA, 19 bp, Homo sapiens
tatattccaccattcacat

SEQ ID NO: 3870597 - DNA, 13 bp, Homo sapiens
tatattctggaaa

SEQ ID NO: 3870598 - DNA, 14 bp, Homo sapiens
tatattctggaaaa

SEQ ID NO: 3870599 - DNA, 22 bp, Homo sapiens
tatattctggaaaaaaaatata

SEQ ID NO: 3870600 - DNA, 13 bp, Homo sapiens
tatattctttaaa

SEQ ID NO: 3870601 - DNA, 19 bp, Homo sapiens
tatattggtaacatccttt

SEQ ID NO: 3870602 - DNA, 16 bp, Homo sapiens
tatattgtatattctg

SEQ ID NO: 3870603 - DNA, 15 bp, Homo sapiens
tatatttaacaagat

SEQ ID NO: 3870604 - DNA, 18 bp, Homo sapiens
tatatttactaaaagaat

SEQ ID NO: 3870605 - DNA, 17 bp, Homo sapiens
tatatttgaatatcatt

SEQ ID NO: 3870606 - DNA, 14 bp, Homo sapiens
tatatttggaaaga

SEQ ID NO: 3870607 - DNA, 17 bp, Homo sapiens
tatatttgtgtatgtgt

SEQ ID NO: 3870608 - DNA, 18 bp, Homo sapiens
tatatttgtgtatgtgta

SEQ ID NO: 3870609 - DNA, 20 bp, Homo sapiens
tatatttttatatttagtta

SEQ ID NO: 3870610 - DNA, 18 bp, Homo sapiens
tatatttttggttgtcaa

SEQ ID NO: 3870611 - DNA, 19 bp, Homo sapiens
tatatttttggttgtcaat

SEQ ID NO: 3870612 - DNA, 14 bp, Homo sapiens
tatcaaaacatatc

SEQ ID NO: 3870613 - DNA, 21 bp, Homo sapiens
tatcaaaacatatcaattcaa

SEQ ID NO: 3870614 - DNA, 15 bp, Homo sapiens
tatcaaaagacagca

SEQ ID NO: 3870615 - DNA, 16 bp, Homo sapiens
tatcaaacttgtgctg

SEQ ID NO: 3870616 - DNA, 21 bp, Homo sapiens
tatcaacatctttttcctccc

SEQ ID NO: 3870617 - DNA, 22 bp, Homo sapiens
tatcaacatctttttcctccct

SEQ ID NO: 3870618 - DNA, 20 bp, Homo sapiens
tatcaatagtcaagaaaaat

SEQ ID NO: 3870619 - DNA, 16 bp, Homo sapiens
tatcaatgaagatttt

SEQ ID NO: 3870620 - DNA, 11 bp, Homo sapiens
tatcaattcaa

SEQ ID NO: 3870621 - DNA, 12 bp, Homo sapiens
tatcacatacaa

SEQ ID NO: 3870622 - DNA, 15 bp, Homo sapiens
tatcacatacaattt

SEQ ID NO: 3870623 - DNA, 23 bp, Homo sapiens
tatcacattacatcatcctcctt

SEQ ID NO: 3870624 - DNA, 18 bp, Homo sapiens
tatcacctctcttcagcc

SEQ ID NO: 3870625 - DNA, 14 bp, Homo sapiens
tatcagaaaagtag

SEQ ID NO: 3870626 - DNA, 15 bp, Homo sapiens
tatcagaaaagtaga

SEQ ID NO: 3870627 - DNA, 20 bp, Homo sapiens
tatcagaaaagtagaattat

SEQ ID NO: 3870628 - DNA, 23 bp, Homo sapiens
tatcagaaaagtagaattatatc

SEQ ID NO: 3870629 - DNA, 23 bp, Homo sapiens
tatcagaagaccacaaaaattga

SEQ ID NO: 3870630 - DNA, 13 bp, Homo sapiens
tatcagacctctg

SEQ ID NO: 3870631 - DNA, 19 bp, Homo sapiens
tatcagcctgagtctcctg

SEQ ID NO: 3870632 - DNA, 15 bp, Homo sapiens
tatcaggtctcccac

SEQ ID NO: 3870633 - DNA, 19 bp, Homo sapiens
tatcagtgatggtctcaca

SEQ ID NO: 3870634 - DNA, 16 bp, Homo sapiens
tatcagtgcttaatgt

SEQ ID NO: 3870635 - DNA, 17 bp, Homo sapiens
tatcagttactcagccc

SEQ ID NO: 3870636 - DNA, 19 bp, Homo sapiens
tatcagttactcagccctg

SEQ ID NO: 3870637 - DNA, 20 bp, Homo sapiens
tatcagttactcagccctgg

SEQ ID NO: 3870638 - DNA, 21 bp, Homo sapiens
tatcagttactcagccctggg

SEQ ID NO: 3870639 - DNA, 15 bp, Homo sapiens
tatcatattggtatt

SEQ ID NO: 3870640 - DNA, 20 bp, Homo sapiens
tatcatgaaacacttctcat

SEQ ID NO: 3870641 - DNA, 14 bp, Homo sapiens
tatcatgacatgtt

SEQ ID NO: 3870642 - DNA, 22 bp, Homo sapiens
tatcatgctttaaagtgtaata

SEQ ID NO: 3870643 - DNA, 15 bp, Homo sapiens
tatcatggagtgacg

SEQ ID NO: 3870644 - DNA, 18 bp, Homo sapiens
tatccaattaaaattaag

SEQ ID NO: 3870645 - DNA, 13 bp, Homo sapiens
tatccacccagcc

SEQ ID NO: 3870646 - DNA, 15 bp, Homo sapiens
tatccacccagccca

SEQ ID NO: 3870647 - DNA, 11 bp, Homo sapiens
tatccagtcta

SEQ ID NO: 3870648 - DNA, 21 bp, Homo sapiens
tatccagtgatgtgctggagc

SEQ ID NO: 3870649 - DNA, 21 bp, Homo sapiens
tatcccacccaacagctcaga

SEQ ID NO: 3870650 - DNA, 21 bp, Homo sapiens
tatcccccccctgtatagtta

SEQ ID NO: 3870651 - DNA, 23 bp, Homo sapiens
tatccttaggaaaatgcttctgt

SEQ ID NO: 3870652 - DNA, 20 bp, Homo sapiens
tatccttggagagcagctgg

SEQ ID NO: 3870653 - DNA, 19 bp, Homo sapiens
tatcggaggtggtggagga

SEQ ID NO: 3870654 - DNA, 17 bp, Homo sapiens
tatctaatttatacaaa

SEQ ID NO: 3870655 - DNA, 21 bp, Homo sapiens
tatctaatttatacaaaataa

SEQ ID NO: 3870656 - DNA, 14 bp, Homo sapiens
tatctacctgccct

SEQ ID NO: 3870657 - DNA, 12 bp, Homo sapiens
tatctagaaaga

SEQ ID NO: 3870658 - DNA, 18 bp, Homo sapiens
tatctatggccctgcaaa

SEQ ID NO: 3870659 - DNA, 16 bp, Homo sapiens
tatctccttcccctac

SEQ ID NO: 3870660 - DNA, 22 bp, Homo sapiens
tatctctaggctgttttctcca

SEQ ID NO: 3870661 - DNA, 17 bp, Homo sapiens
tatctctatttaatatt

SEQ ID NO: 3870662 - DNA, 20 bp, Homo sapiens
tatctctatttaatatttat

SEQ ID NO: 3870663 - DNA, 16 bp, Homo sapiens
tatctctgtgtgcaca

SEQ ID NO: 3870664 - DNA, 17 bp, Homo sapiens
tatctctgtgtgcacaa

SEQ ID NO: 3870665 - DNA, 13 bp, Homo sapiens
tatctgaggtcac

SEQ ID NO: 3870666 - DNA, 15 bp, Homo sapiens
tatctgataaaattg

SEQ ID NO: 3870667 - DNA, 22 bp, Homo sapiens
tatctgcatttataaatgtgtg

SEQ ID NO: 3870668 - DNA, 16 bp, Homo sapiens
tatctgcctggcctgg

SEQ ID NO: 3870669 - DNA, 16 bp, Homo sapiens
tatctgtcacacaagg

SEQ ID NO: 3870670 - DNA, 21 bp, Homo sapiens
tatctgtcatctctctggggc

SEQ ID NO: 3870671 - DNA, 20 bp, Homo sapiens
tatcttacctgtaaagtcta

SEQ ID NO: 3870672 - DNA, 23 bp, Homo sapiens
tatcttctccattctagatgctt

SEQ ID NO: 3870673 - DNA, 22 bp, Homo sapiens
tatctttttgcttacagtttta

SEQ ID NO: 3870674 - DNA, 22 bp, Homo sapiens
tatgaaatgataaagatgtcaa

SEQ ID NO: 3870675 - DNA, 19 bp, Homo sapiens
tatgaacttgaggacacat

SEQ ID NO: 3870676 - DNA, 23 bp, Homo sapiens
tatgaacttgaggacacatgtcc

SEQ ID NO: 3870677 - DNA, 13 bp, Homo sapiens
tatgacaagcaag

SEQ ID NO: 3870678 - DNA, 19 bp, Homo sapiens
tatgacaatcctgaagaaa

SEQ ID NO: 3870679 - DNA, 20 bp, Homo sapiens
tatgacatcacttgtacaaa

SEQ ID NO: 3870680 - DNA, 13 bp, Homo sapiens
tatgacatgccac

SEQ ID NO: 3870681 - DNA, 22 bp, Homo sapiens
tatgactgctccccagccctgg

SEQ ID NO: 3870682 - DNA, 22 bp, Homo sapiens
tatgagaacaagtcacagctgc

SEQ ID NO: 3870683 - DNA, 14 bp, Homo sapiens
tatgagagaatcac

SEQ ID NO: 3870684 - DNA, 23 bp, Homo sapiens
tatgaggacttgtgtctctgtgc

SEQ ID NO: 3870685 - DNA, 20 bp, Homo sapiens
tatgagtatacaatatataa

SEQ ID NO: 3870686 - DNA, 17 bp, Homo sapiens
tatgagtcagtctctct

SEQ ID NO: 3870687 - DNA, 22 bp, Homo sapiens
tatgagttgttttcagactcag

SEQ ID NO: 3870688 - DNA, 13 bp, Homo sapiens
tatgatatccctg

SEQ ID NO: 3870689 - DNA, 15 bp, Homo sapiens
tatgatctaatacaa

SEQ ID NO: 3870690 - DNA, 15 bp, Homo sapiens
tatgatttatagttt

SEQ ID NO: 3870691 - DNA, 16 bp, Homo sapiens
tatgattttatttgac

SEQ ID NO: 3870692 - DNA, 21 bp, Homo sapiens
tatgcaaacagttcttggacc

SEQ ID NO: 3870693 - DNA, 14 bp, Homo sapiens
tatgcaaagcactg

SEQ ID NO: 3870694 - DNA, 20 bp, Homo sapiens
tatgcaaatgcctccaagcc

SEQ ID NO: 3870695 - DNA, 16 bp, Homo sapiens
tatgcaatttcctttt

SEQ ID NO: 3870696 - DNA, 21 bp, Homo sapiens
tatgcaatttttaaactagta

SEQ ID NO: 3870697 - DNA, 23 bp, Homo sapiens
tatgcaatttttaaactagtaat

SEQ ID NO: 3870698 - DNA, 19 bp, Homo sapiens
tatgcagtattgagcactg

SEQ ID NO: 3870699 - DNA, 22 bp, Homo sapiens
tatgcataatcagcgccctgga

SEQ ID NO: 3870700 - DNA, 22 bp, Homo sapiens
tatgcatatattttagggctgt

SEQ ID NO: 3870701 - DNA, 20 bp, Homo sapiens
tatgcatggaaacctgaaaa

SEQ ID NO: 3870702 - DNA, 22 bp, Homo sapiens
tatgcatggtgtagatgccctg

SEQ ID NO: 3870703 - DNA, 20 bp, Homo sapiens
tatgccctcagatggagaca

SEQ ID NO: 3870704 - DNA, 20 bp, Homo sapiens
tatgctatttctggcctcag

SEQ ID NO: 3870705 - DNA, 18 bp, Homo sapiens
tatgctggccagcaccct

SEQ ID NO: 3870706 - DNA, 15 bp, Homo sapiens
tatgcttaaaatatg

SEQ ID NO: 3870707 - DNA, 15 bp, Homo sapiens
tatggaacttctaat

SEQ ID NO: 3870708 - DNA, 17 bp, Homo sapiens
tatggaagggaggggtc

SEQ ID NO: 3870709 - DNA, 23 bp, Homo sapiens
tatggaatacagtgttattttct

SEQ ID NO: 3870710 - DNA, 13 bp, Homo sapiens
tatggagcctggc

SEQ ID NO: 3870711 - DNA, 19 bp, Homo sapiens
tatggatcccaattcattt

SEQ ID NO: 3870712 - DNA, 11 bp, Homo sapiens
tatggcaaggg

SEQ ID NO: 3870713 - DNA, 23 bp, Homo sapiens
tatggcaagtgatatcacctctc

SEQ ID NO: 3870714 - DNA, 21 bp, Homo sapiens
tatggcacttattatgaggct

SEQ ID NO: 3870715 - DNA, 17 bp, Homo sapiens
tatggcatatttatatt

SEQ ID NO: 3870716 - DNA, 16 bp, Homo sapiens
tatggctataggtgct

SEQ ID NO: 3870717 - DNA, 16 bp, Homo sapiens
tatggctcttcacctg

SEQ ID NO: 3870718 - DNA, 16 bp, Homo sapiens
tatggcttataaatgt

SEQ ID NO: 3870719 - DNA, 12 bp, Homo sapiens
tatgggtgctgg

SEQ ID NO: 3870720 - DNA, 13 bp, Homo sapiens
tatgggtgctggc

SEQ ID NO: 3870721 - DNA, 18 bp, Homo sapiens
tatggtatgctggccagc

SEQ ID NO: 3870722 - DNA, 19 bp, Homo sapiens
tatggtatgctggccagca

SEQ ID NO: 3870723 - DNA, 21 bp, Homo sapiens
tatggtcaatcccaaaagtca

SEQ ID NO: 3870724 - DNA, 13 bp, Homo sapiens
tatggtgaaatta

SEQ ID NO: 3870725 - DNA, 17 bp, Homo sapiens
tatggtgtaatgcacaa

SEQ ID NO: 3870726 - DNA, 19 bp, Homo sapiens
tatggttcccaataaaagt

SEQ ID NO: 3870727 - DNA, 19 bp, Homo sapiens
tatggttgattcccagcat

SEQ ID NO: 3870728 - DNA, 19 bp, Homo sapiens
tatgtaaaataaaattatg

SEQ ID NO: 3870729 - DNA, 21 bp, Homo sapiens
tatgtactctacgccaaagtg

SEQ ID NO: 3870730 - DNA, 17 bp, Homo sapiens
tatgtatacacacatat

SEQ ID NO: 3870731 - DNA, 17 bp, Homo sapiens
tatgtatatagatgtgc

SEQ ID NO: 3870732 - DNA, 13 bp, Homo sapiens
tatgtatgtttac

SEQ ID NO: 3870733 - DNA, 20 bp, Homo sapiens
tatgtattaagccaaacatg

SEQ ID NO: 3870734 - DNA, 22 bp, Homo sapiens
tatgtattattttctatagctc

SEQ ID NO: 3870735 - DNA, 16 bp, Homo sapiens
tatgtcaatttgtata

SEQ ID NO: 3870736 - DNA, 17 bp, Homo sapiens
taccatagaacagaact

SEQ ID NO: 3870737 - DNA, 20 bp, Homo sapiens
taccatgagaagagggcctg

SEQ ID NO: 3870738 - DNA, 22 bp, Homo sapiens
taccatgagaagagggcctgtg

SEQ ID NO: 3870739 - DNA, 23 bp, Homo sapiens
taccatgctgctttttggcacag

SEQ ID NO: 3870740 - DNA, 13 bp, Homo sapiens
tacccactctttg

SEQ ID NO: 3870741 - DNA, 18 bp, Homo sapiens
tacccactctttgctaca

SEQ ID NO: 3870742 - DNA, 21 bp, Homo sapiens
taccccacctcatgcctggcc

SEQ ID NO: 3870743 - DNA, 20 bp, Homo sapiens
taccccagggcctactgcca

SEQ ID NO: 3870744 - DNA, 16 bp, Homo sapiens
taccccatcccttcct

SEQ ID NO: 3870745 - DNA, 12 bp, Homo sapiens
tacccctgcctg

SEQ ID NO: 3870746 - DNA, 15 bp, Homo sapiens
tacccctgcctgggt

SEQ ID NO: 3870747 - DNA, 16 bp, Homo sapiens
tacccctgcctgggtt

SEQ ID NO: 3870748 - DNA, 21 bp, Homo sapiens
tacccgagcccagctacattc

SEQ ID NO: 3870749 - DNA, 13 bp, Homo sapiens
tacccggcccaga

SEQ ID NO: 3870750 - DNA, 22 bp, Homo sapiens
tacccggcccagagaccccttc

SEQ ID NO: 3870751 - DNA, 20 bp, Homo sapiens
taccctgcgattttgcctgt

SEQ ID NO: 3870752 - DNA, 20 bp, Homo sapiens
tacccttcacctttggtgca

SEQ ID NO: 3870753 - DNA, 14 bp, Homo sapiens
tacccttccacctc

SEQ ID NO: 3870754 - DNA, 20 bp, Homo sapiens
tacccttccacctcctagag

SEQ ID NO: 3870755 - DNA, 16 bp, Homo sapiens
taccctttatctctgt

SEQ ID NO: 3870756 - DNA, 17 bp, Homo sapiens
taccgagtctcttctcc

SEQ ID NO: 3870757 - DNA, 13 bp, Homo sapiens
taccgctggggaa

SEQ ID NO: 3870758 - DNA, 16 bp, Homo sapiens
taccgctggggaacag

SEQ ID NO: 3870759 - DNA, 19 bp, Homo sapiens
tacctaaacagatataaat

SEQ ID NO: 3870760 - DNA, 20 bp, Homo sapiens
tacctaggatgcatgacaat

SEQ ID NO: 3870761 - DNA, 23 bp, Homo sapiens
tacctaggatgcatgacaattgt

SEQ ID NO: 3870762 - DNA, 17 bp, Homo sapiens
tacctataatgtgtgta

SEQ ID NO: 3870763 - DNA, 19 bp, Homo sapiens
tacctataatgtgtgtatg

SEQ ID NO: 3870764 - DNA, 16 bp, Homo sapiens
tacctatgtgacagac

SEQ ID NO: 3870765 - DNA, 20 bp, Homo sapiens
tacctatgtgacagacattt

SEQ ID NO: 3870766 - DNA, 15 bp, Homo sapiens
tacctcctgcccagg

SEQ ID NO: 3870767 - DNA, 17 bp, Homo sapiens
tacctctgaccaacagg

SEQ ID NO: 3870768 - DNA, 13 bp, Homo sapiens
tacctgacacaag

SEQ ID NO: 3870769 - DNA, 13 bp, Homo sapiens
tacctgagaccag

SEQ ID NO: 3870770 - DNA, 17 bp, Homo sapiens
tacctgatcatggtcag

SEQ ID NO: 3870771 - DNA, 20 bp, Homo sapiens
tacctgcatgtgttgtacaa

SEQ ID NO: 3870772 - DNA, 14 bp, Homo sapiens
tacctgggaagggg

SEQ ID NO: 3870773 - DNA, 18 bp, Homo sapiens
tacctgtggtgactgaac

SEQ ID NO: 3870774 - DNA, 17 bp, Homo sapiens
taccttctggttgcttc

SEQ ID NO: 3870775 - DNA, 15 bp, Homo sapiens
tacctttggaaaaat

SEQ ID NO: 3870776 - DNA, 18 bp, Homo sapiens
tacctttttttctctcct

SEQ ID NO: 3870777 - DNA, 16 bp, Homo sapiens
tacggttgtctagagg

SEQ ID NO: 3870778 - DNA, 22 bp, Homo sapiens
tacgtgttaggaggctgcatgc

SEQ ID NO: 3870779 - DNA, 21 bp, Homo sapiens
tacgttctccagcccacaccc

SEQ ID NO: 3870780 - DNA, 11 bp, Homo sapiens
tactaaaagaa

SEQ ID NO: 3870781 - DNA, 12 bp, Homo sapiens
tactaaaagaat

SEQ ID NO: 3870782 - DNA, 18 bp, Homo sapiens
tactaaagatatcagagc

SEQ ID NO: 3870783 - DNA, 20 bp, Homo sapiens
tactaaagatatcagagctc

SEQ ID NO: 3870784 - DNA, 14 bp, Homo sapiens
tactaaagtgtcta

SEQ ID NO: 3870785 - DNA, 20 bp, Homo sapiens
tactactgctgcaaagtgca

SEQ ID NO: 3870786 - DNA, 22 bp, Homo sapiens
tactactgctgcaaagtgcaaa

SEQ ID NO: 3870787 - DNA, 21 bp, Homo sapiens
tactagaaagctctgcatgtg

SEQ ID NO: 3870788 - DNA, 23 bp, Homo sapiens
tactagaaagctctgcatgtgtg

SEQ ID NO: 3870789 - DNA, 16 bp, Homo sapiens
tactatacaacaatgt

SEQ ID NO: 3870790 - DNA, 20 bp, Homo sapiens
tactatgaaatgaaagaact

SEQ ID NO: 3870791 - DNA, 18 bp, Homo sapiens
tactatgttaataacttg

SEQ ID NO: 3870792 - DNA, 14 bp, Homo sapiens
tactcacacaggca

SEQ ID NO: 3870793 - DNA, 21 bp, Homo sapiens
tactcacacaggcatttcctg

SEQ ID NO: 3870794 - DNA, 13 bp, Homo sapiens
tactcacctctct

SEQ ID NO: 3870795 - DNA, 12 bp, Homo sapiens
tactcagagcag

SEQ ID NO: 3870796 - DNA, 13 bp, Homo sapiens
tactcagagcaga

SEQ ID NO: 3870797 - DNA, 14 bp, Homo sapiens
tactcagagcagag

SEQ ID NO: 3870798 - DNA, 15 bp, Homo sapiens
tactcagagcagagc

SEQ ID NO: 3870799 - DNA, 21 bp, Homo sapiens
tactcagagcagagcaaatga

SEQ ID NO: 3870800 - DNA, 17 bp, Homo sapiens
tactcagcagccctcct

SEQ ID NO: 3870801 - DNA, 12 bp, Homo sapiens
tactcaggaggc

SEQ ID NO: 3870802 - DNA, 15 bp, Homo sapiens
tactcagtatagcat

SEQ ID NO: 3870803 - DNA, 22 bp, Homo sapiens
tactcataaggcatatacaaat

SEQ ID NO: 3870804 - DNA, 20 bp, Homo sapiens
tactcattcatttattcatt

SEQ ID NO: 3870805 - DNA, 14 bp, Homo sapiens
tactccagtggtga

SEQ ID NO: 3870806 - DNA, 18 bp, Homo sapiens
tactccatacataacttg

SEQ ID NO: 3870807 - DNA, 16 bp, Homo sapiens
tactcccttcctggcc

SEQ ID NO: 3870808 - DNA, 18 bp, Homo sapiens
tactcctgtgggagcctc

SEQ ID NO: 3870809 - DNA, 20 bp, Homo sapiens
tactcctgtgggagcctcgc

SEQ ID NO: 3870810 - DNA, 21 bp, Homo sapiens
tactcctgtgggagcctcgca

SEQ ID NO: 3870811 - DNA, 22 bp, Homo sapiens
tactcgggaggctgaggcagga

SEQ ID NO: 3870812 - DNA, 14 bp, Homo sapiens
tactctagaacatg

SEQ ID NO: 3870813 - DNA, 20 bp, Homo sapiens
tactctagaacatgcacatt

SEQ ID NO: 3870814 - DNA, 22 bp, Homo sapiens
tactctagaacatgcacattta

SEQ ID NO: 3870815 - DNA, 16 bp, Homo sapiens
tactctcttgccagca

SEQ ID NO: 3870816 - DNA, 16 bp, Homo sapiens
tactctgagcccaggc

SEQ ID NO: 3870817 - DNA, 18 bp, Homo sapiens
tactctgagcccaggccg

SEQ ID NO: 3870818 - DNA, 11 bp, Homo sapiens
tactctgtcca

SEQ ID NO: 3870819 - DNA, 14 bp, Homo sapiens
tactctgtgccaga

SEQ ID NO: 3870820 - DNA, 15 bp, Homo sapiens
tactctgtgccagag

SEQ ID NO: 3870821 - DNA, 16 bp, Homo sapiens
tactctgtgccagagc

SEQ ID NO: 3870822 - DNA, 20 bp, Homo sapiens
tacagctttacacacacaga

SEQ ID NO: 3870823 - DNA, 21 bp, Homo sapiens
tacagctttacacacacagat

SEQ ID NO: 3870824 - DNA, 22 bp, Homo sapiens
tacaggcaaaacacgcaagggc

SEQ ID NO: 3870825 - DNA, 13 bp, Homo sapiens
tacaggcaattcc

SEQ ID NO: 3870826 - DNA, 14 bp, Homo sapiens
tacaggcaattccg

SEQ ID NO: 3870827 - DNA, 15 bp, Homo sapiens
tacagggcccaggtg

SEQ ID NO: 3870828 - DNA, 17 bp, Homo sapiens
tacaggtatcaggcaca

SEQ ID NO: 3870829 - DNA, 18 bp, Homo sapiens
tacaggtatcaggcacag

SEQ ID NO: 3870830 - DNA, 11 bp, Homo sapiens
tacagtaaagt

SEQ ID NO: 3870831 - DNA, 19 bp, Homo sapiens
tacagtaaagtttaaaaaa

SEQ ID NO: 3870832 - DNA, 20 bp, Homo sapiens
tacagtaaagtttaaaaaat

SEQ ID NO: 3870833 - DNA, 13 bp, Homo sapiens
tacagtaaataaa

SEQ ID NO: 3870834 - DNA, 17 bp, Homo sapiens
tacagtagcttaaataa

SEQ ID NO: 3870835 - DNA, 19 bp, Homo sapiens
tacagtagcttaaataaat

SEQ ID NO: 3870836 - DNA, 22 bp, Homo sapiens
tacagtagcttaaataaattca

SEQ ID NO: 3870837 - DNA, 23 bp, Homo sapiens
tacagtagcttaaataaattcaa

SEQ ID NO: 3870838 - DNA, 19 bp, Homo sapiens
tacagtcttcttacttgga

SEQ ID NO: 3870839 - DNA, 16 bp, Homo sapiens
tacagtgttattttct

SEQ ID NO: 3870840 - DNA, 16 bp, Homo sapiens
tacagttaactctccc

SEQ ID NO: 3870841 - DNA, 15 bp, Homo sapiens
tacataattgcaata

SEQ ID NO: 3870842 - DNA, 22 bp, Homo sapiens
tacataattttttattcaagtt

SEQ ID NO: 3870843 - DNA, 21 bp, Homo sapiens
tacatacagaggtaactatca

SEQ ID NO: 3870844 - DNA, 12 bp, Homo sapiens
tacatacataca

SEQ ID NO: 3870845 - DNA, 15 bp, Homo sapiens
tacatacatacatat

SEQ ID NO: 3870846 - DNA, 15 bp, Homo sapiens
tacatacatatatat

SEQ ID NO: 3870847 - DNA, 16 bp, Homo sapiens
tacatacatatatatc

SEQ ID NO: 3870848 - DNA, 22 bp, Homo sapiens
tacatacatatatatctgataa

SEQ ID NO: 3870849 - DNA, 13 bp, Homo sapiens
tacatagatggac

SEQ ID NO: 3870850 - DNA, 19 bp, Homo sapiens
tacatagatgtatcattaa

SEQ ID NO: 3870851 - DNA, 23 bp, Homo sapiens
tacatagatgtatcattaatgta

SEQ ID NO: 3870852 - DNA, 11 bp, Homo sapiens
tacatatatat

SEQ ID NO: 3870853 - DNA, 16 bp, Homo sapiens
tacatatatatataca

SEQ ID NO: 3870854 - DNA, 14 bp, Homo sapiens
tacatatatatctg

SEQ ID NO: 3870855 - DNA, 18 bp, Homo sapiens
tacatatcacctcatggc

SEQ ID NO: 3870856 - DNA, 15 bp, Homo sapiens
tacatatcagaaaag

SEQ ID NO: 3870857 - DNA, 18 bp, Homo sapiens
tacatatcagaaaagtag

SEQ ID NO: 3870858 - DNA, 20 bp, Homo sapiens
tacatatgtaaaataaaatt

SEQ ID NO: 3870859 - DNA, 13 bp, Homo sapiens
tacatattataaa

SEQ ID NO: 3870860 - DNA, 15 bp, Homo sapiens
tacatattataaata

SEQ ID NO: 3870861 - DNA, 17 bp, Homo sapiens
tacatattataaataaa

SEQ ID NO: 3870862 - DNA, 19 bp, Homo sapiens
tacatattataaataaatg

SEQ ID NO: 3870863 - DNA, 14 bp, Homo sapiens
tacatattggaaag

SEQ ID NO: 3870864 - DNA, 22 bp, Homo sapiens
tacatcctgctttccctcccca

SEQ ID NO: 3870865 - DNA, 22 bp, Homo sapiens
tacatctgcagctctttcttct

SEQ ID NO: 3870866 - DNA, 23 bp, Homo sapiens
tacatctgcagctctttcttctt

SEQ ID NO: 3870867 - DNA, 13 bp, Homo sapiens
tacatgaaacaga

SEQ ID NO: 3870868 - DNA, 15 bp, Homo sapiens
tacatgaaacagaaa

SEQ ID NO: 3870869 - DNA, 21 bp, Homo sapiens
tacatgaagagcagctggtca

SEQ ID NO: 3870870 - DNA, 17 bp, Homo sapiens
tacatgaccagaaaaca

SEQ ID NO: 3870871 - DNA, 22 bp, Homo sapiens
tacatgcaatttattaaaatga

SEQ ID NO: 3870872 - DNA, 14 bp, Homo sapiens
tacatgtggtttat

SEQ ID NO: 3870873 - DNA, 19 bp, Homo sapiens
tacatgtgtagggaaagtt

SEQ ID NO: 3870874 - DNA, 12 bp, Homo sapiens
tacatgtgtgta

SEQ ID NO: 3870875 - DNA, 13 bp, Homo sapiens
tacatgtgtgtat

SEQ ID NO: 3870876 - DNA, 19 bp, Homo sapiens
tacatgtgtgtatatatgt

SEQ ID NO: 3870877 - DNA, 20 bp, Homo sapiens
tacatgtttaaattgtaaat

SEQ ID NO: 3870878 - DNA, 20 bp, Homo sapiens
tacattaatgttaattcagc

SEQ ID NO: 3870879 - DNA, 19 bp, Homo sapiens
tacattagcagtttgcttt

SEQ ID NO: 3870880 - DNA, 20 bp, Homo sapiens
tacattagcagtttgctttg

SEQ ID NO: 3870881 - DNA, 18 bp, Homo sapiens
tacattagtatcccacta

SEQ ID NO: 3870882 - DNA, 12 bp, Homo sapiens
tacattccctat

SEQ ID NO: 3870883 - DNA, 18 bp, Homo sapiens
tacattccctatcaaaac

SEQ ID NO: 3870884 - DNA, 19 bp, Homo sapiens
tacattccctatcaaaaca

SEQ ID NO: 3870885 - DNA, 21 bp, Homo sapiens
tacattccctatcaaaacata

SEQ ID NO: 3870886 - DNA, 10 bp, Homo sapiens
tacattcctc

SEQ ID NO: 3870887 - DNA, 17 bp, Homo sapiens
tacattcctcagctgcc

SEQ ID NO: 3870888 - DNA, 16 bp, Homo sapiens
tacattgtgaaacttc

SEQ ID NO: 3870889 - DNA, 15 bp, Homo sapiens
tacatttccaaatga

SEQ ID NO: 3870890 - DNA, 16 bp, Homo sapiens
tacatttctctgagca

SEQ ID NO: 3870891 - DNA, 18 bp, Homo sapiens
tacattttatttattagc

SEQ ID NO: 3870892 - DNA, 21 bp, Homo sapiens
tacatttttacaataaataat

SEQ ID NO: 3870893 - DNA, 13 bp, Homo sapiens
taccaaatatttt

SEQ ID NO: 3870894 - DNA, 15 bp, Homo sapiens
taccaaatattttag

SEQ ID NO: 3870895 - DNA, 15 bp, Homo sapiens
taccaactttctgta

SEQ ID NO: 3870896 - DNA, 17 bp, Homo sapiens
taccaccccttcctgtc

SEQ ID NO: 3870897 - DNA, 18 bp, Homo sapiens
taccaccccttcctgtcc

SEQ ID NO: 3870898 - DNA, 12 bp, Homo sapiens
taccaccttccc

SEQ ID NO: 3870899 - DNA, 16 bp, Homo sapiens
taccaccttccctctt

SEQ ID NO: 3870900 - DNA, 19 bp, Homo sapiens
taccaccttccctctttct

SEQ ID NO: 3870901 - DNA, 12 bp, Homo sapiens
taccactggtta

SEQ ID NO: 3870902 - DNA, 15 bp, Homo sapiens
taccagaaagtgagg

SEQ ID NO: 3870903 - DNA, 14 bp, Homo sapiens
taccagagacctga

SEQ ID NO: 3870904 - DNA, 11 bp, Homo sapiens
taccagccagg

SEQ ID NO: 3870905 - DNA, 18 bp, Homo sapiens
taccagtgaaccaaagag

SEQ ID NO: 3870906 - DNA, 11 bp, Homo sapiens
taccagtgtgg

SEQ ID NO: 3870907 - DNA, 17 bp, Homo sapiens
taccataagggactgtg

SEQ ID NO: 3870908 - DNA, 21 bp, Homo sapiens
taaaccaaaggacattatgtg

SEQ ID NO: 3870909 - DNA, 23 bp, Homo sapiens
taaaccaaaggacattatgtgtg

SEQ ID NO: 3870910 - DNA, 22 bp, Homo sapiens
taaaccaccagtgcccaaagtc

SEQ ID NO: 3870911 - DNA, 15 bp, Homo sapiens
taaaccagcagaaaa

SEQ ID NO: 3870912 - DNA, 21 bp, Homo sapiens
taaaccagcagaaaagtgctt

SEQ ID NO: 3870913 - DNA, 18 bp, Homo sapiens
taaacccccgctccagat

SEQ ID NO: 3870914 - DNA, 17 bp, Homo sapiens
taaacctggagatgatg

SEQ ID NO: 3870915 - DNA, 13 bp, Homo sapiens
taaactactgtaa

SEQ ID NO: 3870916 - DNA, 14 bp, Homo sapiens
taaactagatctcc

SEQ ID NO: 3870917 - DNA, 14 bp, Homo sapiens
taaactagtttcca

SEQ ID NO: 3870918 - DNA, 17 bp, Homo sapiens
taaactagtttccagtg

SEQ ID NO: 3870919 - DNA, 16 bp, Homo sapiens
taaactataaactact

SEQ ID NO: 3870920 - DNA, 17 bp, Homo sapiens
taaactataaactactg

SEQ ID NO: 3870921 - DNA, 18 bp, Homo sapiens
taaactataaactactgt

SEQ ID NO: 3870922 - DNA, 20 bp, Homo sapiens
taaactatcttggtgaattt

SEQ ID NO: 3870923 - DNA, 21 bp, Homo sapiens
taaactatcttggtgaatttt

SEQ ID NO: 3870924 - DNA, 14 bp, Homo sapiens
taaactcaaaatat

SEQ ID NO: 3870925 - DNA, 23 bp, Homo sapiens
taaactcaaaatatttgtacata

SEQ ID NO: 3870926 - DNA, 14 bp, Homo sapiens
taaactctaaacat

SEQ ID NO: 3870927 - DNA, 15 bp, Homo sapiens
taaactctaaacatt

SEQ ID NO: 3870928 - DNA, 19 bp, Homo sapiens
taaacttagaataaaattg

SEQ ID NO: 3870929 - DNA, 20 bp, Homo sapiens
taaacttgtgtatgatccaa

SEQ ID NO: 3870930 - DNA, 18 bp, Homo sapiens
taaactttagagtagcat

SEQ ID NO: 3870931 - DNA, 19 bp, Homo sapiens
taaagaactccttattttg

SEQ ID NO: 3870932 - DNA, 21 bp, Homo sapiens
taaagaactccttattttgta

SEQ ID NO: 3870933 - DNA, 16 bp, Homo sapiens
taaagaagtaaatttg

SEQ ID NO: 3870934 - DNA, 15 bp, Homo sapiens
taaagacacctactg

SEQ ID NO: 3870935 - DNA, 19 bp, Homo sapiens
taaagacagggtttcacca

SEQ ID NO: 3870936 - DNA, 15 bp, Homo sapiens
taaagacttaagatt

SEQ ID NO: 3870937 - DNA, 20 bp, Homo sapiens
taaagaggaaaagtgcaatg

SEQ ID NO: 3870938 - DNA, 20 bp, Homo sapiens
taaagagtatttacaataaa

SEQ ID NO: 3870939 - DNA, 21 bp, Homo sapiens
taaagataaaatatcctcagg

SEQ ID NO: 3870940 - DNA, 11 bp, Homo sapiens
taaagatgatc

SEQ ID NO: 3870941 - DNA, 21 bp, Homo sapiens
taaagatgatctactcagaaa

SEQ ID NO: 3870942 - DNA, 12 bp, Homo sapiens
taaagcaacatt

SEQ ID NO: 3870943 - DNA, 18 bp, Homo sapiens
taaagcaacattttattt

SEQ ID NO: 3870944 - DNA, 22 bp, Homo sapiens
taaagcacagtctgatgacaca

SEQ ID NO: 3870945 - DNA, 14 bp, Homo sapiens
taaagcatcagaga

SEQ ID NO: 3870946 - DNA, 18 bp, Homo sapiens
taaagcccataaggccag

SEQ ID NO: 3870947 - DNA, 21 bp, Homo sapiens
taaagcctgctttttaagtgt

SEQ ID NO: 3870948 - DNA, 21 bp, Homo sapiens
taaagctgcctgtagttagga

SEQ ID NO: 3870949 - DNA, 23 bp, Homo sapiens
taaagctgcctgtagttaggaaa

SEQ ID NO: 3870950 - DNA, 13 bp, Homo sapiens
taaagcttaaatt

SEQ ID NO: 3870951 - DNA, 20 bp, Homo sapiens
taaaggagttaagagtagca

SEQ ID NO: 3870952 - DNA, 21 bp, Homo sapiens
taaaggattgatcactttgtt

SEQ ID NO: 3870953 - DNA, 11 bp, Homo sapiens
taaaggcctgg

SEQ ID NO: 3870954 - DNA, 23 bp, Homo sapiens
taaaggcctggaaccagggagga

SEQ ID NO: 3870955 - DNA, 21 bp, Homo sapiens
taaagggcagaaggggaagat

SEQ ID NO: 3870956 - DNA, 20 bp, Homo sapiens
taaaggttgacaataaatgt

SEQ ID NO: 3870957 - DNA, 21 bp, Homo sapiens
taaagtacctgtagtgagaaa

SEQ ID NO: 3870958 - DNA, 17 bp, Homo sapiens
taaagtatatatttatt

SEQ ID NO: 3870959 - DNA, 18 bp, Homo sapiens
taaagtcacttccagtgt

SEQ ID NO: 3870960 - DNA, 23 bp, Homo sapiens
taaagtcatggtcattgcaggaa

SEQ ID NO: 3870961 - DNA, 18 bp, Homo sapiens
taaagtctattgtttgtt

SEQ ID NO: 3870962 - DNA, 17 bp, Homo sapiens
taaagttctgagtgttt

SEQ ID NO: 3870963 - DNA, 22 bp, Homo sapiens
taaagttgttcgccgcgtggaa

SEQ ID NO: 3870964 - DNA, 13 bp, Homo sapiens
taaagtttaaaaa

SEQ ID NO: 3870965 - DNA, 17 bp, Homo sapiens
taaagtttacagtaaat

SEQ ID NO: 3870966 - DNA, 11 bp, Homo sapiens
taaataaatgc

SEQ ID NO: 3870967 - DNA, 13 bp, Homo sapiens
taaataaatgcca

SEQ ID NO: 3870968 - DNA, 13 bp, Homo sapiens
taaataaattgtt

SEQ ID NO: 3870969 - DNA, 13 bp, Homo sapiens
taaataatgaaaa

SEQ ID NO: 3870970 - DNA, 18 bp, Homo sapiens
taaatacaaaataaaatt

SEQ ID NO: 3870971 - DNA, 19 bp, Homo sapiens
taaatacagacactaagtt

SEQ ID NO: 3870972 - DNA, 22 bp, Homo sapiens
taaatacagacactaagttata

SEQ ID NO: 3870973 - DNA, 15 bp, Homo sapiens
taaatacatgtgtgg

SEQ ID NO: 3870974 - DNA, 17 bp, Homo sapiens
taaatactgtacataga

SEQ ID NO: 3870975 - DNA, 18 bp, Homo sapiens
taaatagtaggaccaatg

SEQ ID NO: 3870976 - DNA, 11 bp, Homo sapiens
taaatatatat

SEQ ID NO: 3870977 - DNA, 21 bp, Homo sapiens
taaatatatctatattattgt

SEQ ID NO: 3870978 - DNA, 13 bp, Homo sapiens
taaatatccacag

SEQ ID NO: 3870979 - DNA, 14 bp, Homo sapiens
taaatatttatgct

SEQ ID NO: 3870980 - DNA, 19 bp, Homo sapiens
taaatatttggtctctatt

SEQ ID NO: 3870981 - DNA, 13 bp, Homo sapiens
taaatcacttgta

SEQ ID NO: 3870982 - DNA, 14 bp, Homo sapiens
taaatcacttgtaa

SEQ ID NO: 3870983 - DNA, 16 bp, Homo sapiens
taaatcacttgtaaat

SEQ ID NO: 3870984 - DNA, 11 bp, Homo sapiens
taaatccacag

SEQ ID NO: 3870985 - DNA, 13 bp, Homo sapiens
taaatccttattt

SEQ ID NO: 3870986 - DNA, 19 bp, Homo sapiens
taaatcctttttctttata

SEQ ID NO: 3870987 - DNA, 14 bp, Homo sapiens
taaatctaatcagg

SEQ ID NO: 3870988 - DNA, 18 bp, Homo sapiens
taaatctctaatatggca

SEQ ID NO: 3870989 - DNA, 20 bp, Homo sapiens
taaatctgagcctaaatcta

SEQ ID NO: 3870990 - DNA, 14 bp, Homo sapiens
taaatgcatgattt

SEQ ID NO: 3870991 - DNA, 20 bp, Homo sapiens
taaatgcatgattttataca

SEQ ID NO: 3870992 - DNA, 22 bp, Homo sapiens
taaatgcatgattttatacata

SEQ ID NO: 3870993 - DNA, 23 bp, Homo sapiens
taaatgcatgattttatacatag

SEQ ID NO: 3870994 - DNA, 15 bp, Homo sapiens
taatttaaaaaataa

SEQ ID NO: 3870995 - DNA, 12 bp, Homo sapiens
taatttaaacca

SEQ ID NO: 3870996 - DNA, 18 bp, Homo sapiens
taatttaaaccagcagaa

SEQ ID NO: 3870997 - DNA, 12 bp, Homo sapiens
taatttaaagcc

SEQ ID NO: 3870998 - DNA, 16 bp, Homo sapiens
taatttaactaattta

SEQ ID NO: 3870999 - DNA, 17 bp, Homo sapiens
taatttaactaatttaa

SEQ ID NO: 3871000 - DNA, 13 bp, Homo sapiens
taatttataaaat

SEQ ID NO: 3871001 - DNA, 13 bp, Homo sapiens
taatttatacaaa

SEQ ID NO: 3871002 - DNA, 19 bp, Homo sapiens
taatttatacaaaataatt

SEQ ID NO: 3871003 - DNA, 16 bp, Homo sapiens
taatttatatttgaaa

SEQ ID NO: 3871004 - DNA, 22 bp, Homo sapiens
taatttgaaaacataatctgca

SEQ ID NO: 3871005 - DNA, 18 bp, Homo sapiens
taatttgaggacaaccat

SEQ ID NO: 3871006 - DNA, 22 bp, Homo sapiens
taatttgaggacaaccattcca

SEQ ID NO: 3871007 - DNA, 13 bp, Homo sapiens
taatttgtatctg

SEQ ID NO: 3871008 - DNA, 18 bp, Homo sapiens
taattttatgaatgtctt

SEQ ID NO: 3871009 - DNA, 12 bp, Homo sapiens
taattttattat

SEQ ID NO: 3871010 - DNA, 16 bp, Homo sapiens
taattttattattaga

SEQ ID NO: 3871011 - DNA, 19 bp, Homo sapiens
taattttcaagagaagaaa

SEQ ID NO: 3871012 - DNA, 14 bp, Homo sapiens
taattttgtttgta

SEQ ID NO: 3871013 - DNA, 20 bp, Homo sapiens
taattttgtttgtaatcctg

SEQ ID NO: 3871014 - DNA, 22 bp, Homo sapiens
taatttttgaaacccattaggc

SEQ ID NO: 3871015 - DNA, 17 bp, Homo sapiens
taattttttattcaagt

SEQ ID NO: 3871016 - DNA, 18 bp, Homo sapiens
tacaaaaacaaaacaaaa

SEQ ID NO: 3871017 - DNA, 22 bp, Homo sapiens
tacaaaaattagccgggggtgg

SEQ ID NO: 3871018 - DNA, 17 bp, Homo sapiens
tacaaaagtaccataga

SEQ ID NO: 3871019 - DNA, 13 bp, Homo sapiens
tacaaaataattt

SEQ ID NO: 3871020 - DNA, 14 bp, Homo sapiens
tacaaaataattta

SEQ ID NO: 3871021 - DNA, 12 bp, Homo sapiens
tacaaaatggag

SEQ ID NO: 3871022 - DNA, 18 bp, Homo sapiens
tacaaagctgaagaaaat

SEQ ID NO: 3871023 - DNA, 18 bp, Homo sapiens
tacaaatttttcctgcaa

SEQ ID NO: 3871024 - DNA, 18 bp, Homo sapiens
tacaacaagaacaacaac

SEQ ID NO: 3871025 - DNA, 22 bp, Homo sapiens
tacaacaagagtttatttccaa

SEQ ID NO: 3871026 - DNA, 15 bp, Homo sapiens
tacaacacaaagaga

SEQ ID NO: 3871027 - DNA, 17 bp, Homo sapiens
tacaacacaaagagaaa

SEQ ID NO: 3871028 - DNA, 22 bp, Homo sapiens
tacaagaattgtccatgtgctt

SEQ ID NO: 3871029 - DNA, 16 bp, Homo sapiens
tacaagcatatttgag

SEQ ID NO: 3871030 - DNA, 22 bp, Homo sapiens
tacaagccactaccttctgacc

SEQ ID NO: 3871031 - DNA, 14 bp, Homo sapiens
tacaagtgtatatc

SEQ ID NO: 3871032 - DNA, 15 bp, Homo sapiens
tacaagtgtatatca

SEQ ID NO: 3871033 - DNA, 13 bp, Homo sapiens
tacaagttttgta

SEQ ID NO: 3871034 - DNA, 15 bp, Homo sapiens
tacaagttttgtata

SEQ ID NO: 3871035 - DNA, 20 bp, Homo sapiens
tacaataaaatcttgaaaat

SEQ ID NO: 3871036 - DNA, 13 bp, Homo sapiens
tacaataaataat

SEQ ID NO: 3871037 - DNA, 12 bp, Homo sapiens
tacaataaatgc

SEQ ID NO: 3871038 - DNA, 13 bp, Homo sapiens
tacaataaatgct

SEQ ID NO: 3871039 - DNA, 13 bp, Homo sapiens
tacaataatgagt

SEQ ID NO: 3871040 - DNA, 20 bp, Homo sapiens
tacaataattaatgtgtgtc

SEQ ID NO: 3871041 - DNA, 19 bp, Homo sapiens
tacaataccagatcactca

SEQ ID NO: 3871042 - DNA, 20 bp, Homo sapiens
tacaatatataaaaatatat

SEQ ID NO: 3871043 - DNA, 14 bp, Homo sapiens
tacaatggaaacaa

SEQ ID NO: 3871044 - DNA, 13 bp, Homo sapiens
tacaatttgcact

SEQ ID NO: 3871045 - DNA, 14 bp, Homo sapiens
tacacaagtaaaca

SEQ ID NO: 3871046 - DNA, 14 bp, Homo sapiens
tacacacacagatg

SEQ ID NO: 3871047 - DNA, 15 bp, Homo sapiens
tacacacacagatgt

SEQ ID NO: 3871048 - DNA, 15 bp, Homo sapiens
tacacacatatacat

SEQ ID NO: 3871049 - DNA, 17 bp, Homo sapiens
tacacacatatacatat

SEQ ID NO: 3871050 - DNA, 18 bp, Homo sapiens
tacacacatatacatata

SEQ ID NO: 3871051 - DNA, 20 bp, Homo sapiens
tacacacatatacatatata

SEQ ID NO: 3871052 - DNA, 23 bp, Homo sapiens
tacacaggatcctattctcacca

SEQ ID NO: 3871053 - DNA, 13 bp, Homo sapiens
tacacatacatac

SEQ ID NO: 3871054 - DNA, 14 bp, Homo sapiens
tacacatacataca

SEQ ID NO: 3871055 - DNA, 16 bp, Homo sapiens
tacacatacatacaca

SEQ ID NO: 3871056 - DNA, 16 bp, Homo sapiens
tacaccactctggcag

SEQ ID NO: 3871057 - DNA, 17 bp, Homo sapiens
tacaccactctggcagc

SEQ ID NO: 3871058 - DNA, 19 bp, Homo sapiens
tacaccactctggcagcca

SEQ ID NO: 3871059 - DNA, 11 bp, Homo sapiens
tacactcctgc

SEQ ID NO: 3871060 - DNA, 22 bp, Homo sapiens
tacactctctgtacaaaaacaa

SEQ ID NO: 3871061 - DNA, 12 bp, Homo sapiens
tacactcttata

SEQ ID NO: 3871062 - DNA, 13 bp, Homo sapiens
tacactcttatag

SEQ ID NO: 3871063 - DNA, 16 bp, Homo sapiens
tacacttgtataaatg

SEQ ID NO: 3871064 - DNA, 18 bp, Homo sapiens
tacacttgtataaatgta

SEQ ID NO: 3871065 - DNA, 20 bp, Homo sapiens
tacacttgtataaatgtata

SEQ ID NO: 3871066 - DNA, 21 bp, Homo sapiens
tacacttgtataaatgtatat

SEQ ID NO: 3871067 - DNA, 12 bp, Homo sapiens
tacagaattttt

SEQ ID NO: 3871068 - DNA, 17 bp, Homo sapiens
tacagaatttttaatga

SEQ ID NO: 3871069 - DNA, 11 bp, Homo sapiens
tacagacacta

SEQ ID NO: 3871070 - DNA, 22 bp, Homo sapiens
tacagacgtctcaagactgaaa

SEQ ID NO: 3871071 - DNA, 15 bp, Homo sapiens
tacagacttctccag

SEQ ID NO: 3871072 - DNA, 23 bp, Homo sapiens
tacagagaagtgaataactgcaa

SEQ ID NO: 3871073 - DNA, 14 bp, Homo sapiens
tacagagcaggcca

SEQ ID NO: 3871074 - DNA, 20 bp, Homo sapiens
tacagagtggcccctcacct

SEQ ID NO: 3871075 - DNA, 23 bp, Homo sapiens
tacagcactccaccttgggacct

SEQ ID NO: 3871076 - DNA, 11 bp, Homo sapiens
tacagcagggt

SEQ ID NO: 3871077 - DNA, 18 bp, Homo sapiens
tacagcagggtcttgctg

SEQ ID NO: 3871078 - DNA, 22 bp, Homo sapiens
tacagccaaaaaggaccaactg

SEQ ID NO: 3871079 - DNA, 18 bp, Homo sapiens
tacagctaatcagcattc

SEQ ID NO: 3871080 - DNA, 13 bp, Homo sapiens
tacagctgcctgc

SEQ ID NO: 3871081 - DNA, 18 bp, Homo sapiens
taacttttgtaagacaaa

SEQ ID NO: 3871082 - DNA, 20 bp, Homo sapiens
taagaaaacaatcacactca

SEQ ID NO: 3871083 - DNA, 19 bp, Homo sapiens
taagaaacatgatgtgaga

SEQ ID NO: 3871084 - DNA, 20 bp, Homo sapiens
taagaaatgctgaaaatcaa

SEQ ID NO: 3871085 - DNA, 17 bp, Homo sapiens
taagaagacatgacaat

SEQ ID NO: 3871086 - DNA, 23 bp, Homo sapiens
taagaatgcagattcctgggcct

SEQ ID NO: 3871087 - DNA, 19 bp, Homo sapiens
taagaccataacagccaac

SEQ ID NO: 3871088 - DNA, 13 bp, Homo sapiens
taagacctcccca

SEQ ID NO: 3871089 - DNA, 14 bp, Homo sapiens
taagacgtgaatgt

SEQ ID NO: 3871090 - DNA, 18 bp, Homo sapiens
taagactcattccctaga

SEQ ID NO: 3871091 - DNA, 12 bp, Homo sapiens
taagagaaatgg

SEQ ID NO: 3871092 - DNA, 19 bp, Homo sapiens
taagataaatagagttcca

SEQ ID NO: 3871093 - DNA, 16 bp, Homo sapiens
taagatacactcctgc

SEQ ID NO: 3871094 - DNA, 19 bp, Homo sapiens
taagatgagatttgccagc

SEQ ID NO: 3871095 - DNA, 20 bp, Homo sapiens
taagatgagatttgccagca

SEQ ID NO: 3871096 - DNA, 15 bp, Homo sapiens
taagattaaaggaag

SEQ ID NO: 3871097 - DNA, 17 bp, Homo sapiens
taagattaaaggaagga

SEQ ID NO: 3871098 - DNA, 15 bp, Homo sapiens
taagatttctcctga

SEQ ID NO: 3871099 - DNA, 20 bp, Homo sapiens
taagatttctcctgactcca

SEQ ID NO: 3871100 - DNA, 18 bp, Homo sapiens
taagcaaatttcaaaaga

SEQ ID NO: 3871101 - DNA, 20 bp, Homo sapiens
taagcaaatttcaaaagaca

SEQ ID NO: 3871102 - DNA, 23 bp, Homo sapiens
taagcaaatttcaaaagacatgt

SEQ ID NO: 3871103 - DNA, 21 bp, Homo sapiens
taagcagatttaacaattcca

SEQ ID NO: 3871104 - DNA, 21 bp, Homo sapiens
taagcaggaaggatggcaagc

SEQ ID NO: 3871105 - DNA, 22 bp, Homo sapiens
taagccacaagaaatttgattt

SEQ ID NO: 3871106 - DNA, 13 bp, Homo sapiens
taagccagagcct

SEQ ID NO: 3871107 - DNA, 18 bp, Homo sapiens
taagccctcgaaccaagg

SEQ ID NO: 3871108 - DNA, 20 bp, Homo sapiens
taagccctcgaaccaaggca

SEQ ID NO: 3871109 - DNA, 16 bp, Homo sapiens
taagccctgtcgagac

SEQ ID NO: 3871110 - DNA, 22 bp, Homo sapiens
taagccctgtcgagacacttgc

SEQ ID NO: 3871111 - DNA, 17 bp, Homo sapiens
taagcctcatatttaaa

SEQ ID NO: 3871112 - DNA, 20 bp, Homo sapiens
taagcctcatatttaaagac

SEQ ID NO: 3871113 - DNA, 16 bp, Homo sapiens
taagcctccctcctcg

SEQ ID NO: 3871114 - DNA, 13 bp, Homo sapiens
taagctctggctt

SEQ ID NO: 3871115 - DNA, 12 bp, Homo sapiens
taagctggagct

SEQ ID NO: 3871116 - DNA, 18 bp, Homo sapiens
taagctggagctcttgga

SEQ ID NO: 3871117 - DNA, 11 bp, Homo sapiens
taagctttatt

SEQ ID NO: 3871118 - DNA, 22 bp, Homo sapiens
taaggaatctgaaagtatattt

SEQ ID NO: 3871119 - DNA, 15 bp, Homo sapiens
taaggacacactaat

SEQ ID NO: 3871120 - DNA, 12 bp, Homo sapiens
taaggaggaaaa

SEQ ID NO: 3871121 - DNA, 13 bp, Homo sapiens
taaggaggaaaac

SEQ ID NO: 3871122 - DNA, 19 bp, Homo sapiens
taaggatggagccagctct

SEQ ID NO: 3871123 - DNA, 20 bp, Homo sapiens
taaggatggagccagctctg

SEQ ID NO: 3871124 - DNA, 20 bp, Homo sapiens
taaggccagaaactcctttt

SEQ ID NO: 3871125 - DNA, 12 bp, Homo sapiens
taaggcctgccc

SEQ ID NO: 3871126 - DNA, 14 bp, Homo sapiens
taaggcctgccctc

SEQ ID NO: 3871127 - DNA, 17 bp, Homo sapiens
taaggctccttcatgtg

SEQ ID NO: 3871128 - DNA, 19 bp, Homo sapiens
taagggagagggagggagc

SEQ ID NO: 3871129 - DNA, 16 bp, Homo sapiens
taagggccgccggacc

SEQ ID NO: 3871130 - DNA, 17 bp, Homo sapiens
taaggggcacctgggaa

SEQ ID NO: 3871131 - DNA, 20 bp, Homo sapiens
taagggtctgttgtaaatga

SEQ ID NO: 3871132 - DNA, 18 bp, Homo sapiens
taagggttgaaggcagtc

SEQ ID NO: 3871133 - DNA, 17 bp, Homo sapiens
taaggtcttcttgtgtc

SEQ ID NO: 3871134 - DNA, 13 bp, Homo sapiens
taaggtgccttct

SEQ ID NO: 3871135 - DNA, 18 bp, Homo sapiens
taaggttacctttgttcc

SEQ ID NO: 3871136 - DNA, 17 bp, Homo sapiens
taagtaaaaccacagca

SEQ ID NO: 3871137 - DNA, 21 bp, Homo sapiens
taagtaattgcatttctgctc

SEQ ID NO: 3871138 - DNA, 21 bp, Homo sapiens
taagtagatagaaagcaataa

SEQ ID NO: 3871139 - DNA, 17 bp, Homo sapiens
taagtataattaataga

SEQ ID NO: 3871140 - DNA, 14 bp, Homo sapiens
taagtatatagtat

SEQ ID NO: 3871141 - DNA, 17 bp, Homo sapiens
taagtatttacagatgt

SEQ ID NO: 3871142 - DNA, 12 bp, Homo sapiens
taagtatttcca

SEQ ID NO: 3871143 - DNA, 18 bp, Homo sapiens
taagtccacatcttctca

SEQ ID NO: 3871144 - DNA, 22 bp, Homo sapiens
taagtctccaagaatacagaaa

SEQ ID NO: 3871145 - DNA, 15 bp, Homo sapiens
taagtgcacacagaa

SEQ ID NO: 3871146 - DNA, 19 bp, Homo sapiens
taagtgcacacagaaatat

SEQ ID NO: 3871147 - DNA, 22 bp, Homo sapiens
taagtgcacacagaaatatata

SEQ ID NO: 3871148 - DNA, 16 bp, Homo sapiens
taagtggaaaaaagag

SEQ ID NO: 3871149 - DNA, 21 bp, Homo sapiens
taagtggggttgcaaccactg

SEQ ID NO: 3871150 - DNA, 14 bp, Homo sapiens
taagttacttcact

SEQ ID NO: 3871151 - DNA, 19 bp, Homo sapiens
taagttagagaatatattt

SEQ ID NO: 3871152 - DNA, 22 bp, Homo sapiens
taagttattgatttttgtaata

SEQ ID NO: 3871153 - DNA, 17 bp, Homo sapiens
taagttcatgtttgtaa

SEQ ID NO: 3871154 - DNA, 20 bp, Homo sapiens
taagtttatgtctaaagagc

SEQ ID NO: 3871155 - DNA, 12 bp, Homo sapiens
taagtttgatca

SEQ ID NO: 3871156 - DNA, 13 bp, Homo sapiens
taagtttgatcaa

SEQ ID NO: 3871157 - DNA, 19 bp, Homo sapiens
taataaaaaatggaaagaa

SEQ ID NO: 3871158 - DNA, 15 bp, Homo sapiens
taataaaaacttcag

SEQ ID NO: 3871159 - DNA, 12 bp, Homo sapiens
taataaaattga

SEQ ID NO: 3871160 - DNA, 23 bp, Homo sapiens
taataaacttagaataaaattgt

SEQ ID NO: 3871161 - DNA, 15 bp, Homo sapiens
taataaattcagata

SEQ ID NO: 3871162 - DNA, 23 bp, Homo sapiens
taataaattttaacattttccaa

SEQ ID NO: 3871163 - DNA, 12 bp, Homo sapiens
taataagaaagt

SEQ ID NO: 3871164 - DNA, 19 bp, Homo sapiens
taataagaatggttgcctt

SEQ ID NO: 3871165 - DNA, 21 bp, Homo sapiens
taataagtccacatcttctca

SEQ ID NO: 3871166 - DNA, 16 bp, Homo sapiens
taataatgttctctgg

SEQ ID NO: 3871167 - DNA, 18 bp, Homo sapiens
taatacctttggaaaaat

SEQ ID NO: 3871168 - DNA, 21 bp, Homo sapiens
taatacctttggaaaaatctt

SEQ ID NO: 3871169 - DNA, 17 bp, Homo sapiens
taatacttcatttggtg

SEQ ID NO: 3871170 - DNA, 18 bp, Homo sapiens
taatagaaaactgaaaat

SEQ ID NO: 3871171 - DNA, 14 bp, Homo sapiens
taatagagacacag

SEQ ID NO: 3871172 - DNA, 21 bp, Homo sapiens
taatagcttttattgtataaa

SEQ ID NO: 3871173 - DNA, 15 bp, Homo sapiens
taatagttagccctc

SEQ ID NO: 3871174 - DNA, 12 bp, Homo sapiens
taatatcttgct

SEQ ID NO: 3871175 - DNA, 13 bp, Homo sapiens
taatatggaacct

SEQ ID NO: 3871176 - DNA, 22 bp, Homo sapiens
taatatggaaccttccctccaa

SEQ ID NO: 3871177 - DNA, 14 bp, Homo sapiens
taatatgtttgagg

SEQ ID NO: 3871178 - DNA, 18 bp, Homo sapiens
taatattaaaaatatgga

SEQ ID NO: 3871179 - DNA, 13 bp, Homo sapiens
taatattattggg

SEQ ID NO: 3871180 - DNA, 14 bp, Homo sapiens
taatattattgggg

SEQ ID NO: 3871181 - DNA, 17 bp, Homo sapiens
taatattcctatatgta

SEQ ID NO: 3871182 - DNA, 21 bp, Homo sapiens
taatatttaaacagcagtgtt

SEQ ID NO: 3871183 - DNA, 12 bp, Homo sapiens
taatatttaggc

SEQ ID NO: 3871184 - DNA, 15 bp, Homo sapiens
taatatttaggcaag

SEQ ID NO: 3871185 - DNA, 16 bp, Homo sapiens
taatatttaggcaaga

SEQ ID NO: 3871186 - DNA, 12 bp, Homo sapiens
taatattttgta

SEQ ID NO: 3871187 - DNA, 13 bp, Homo sapiens
taatcaattatta

SEQ ID NO: 3871188 - DNA, 13 bp, Homo sapiens
taatcagcctctt

SEQ ID NO: 3871189 - DNA, 15 bp, Homo sapiens
taatcagcctcttaa

SEQ ID NO: 3871190 - DNA, 14 bp, Homo sapiens
taatcaggcagcct

SEQ ID NO: 3871191 - DNA, 22 bp, Homo sapiens
taatcaggtcctcagagaattt

SEQ ID NO: 3871192 - DNA, 18 bp, Homo sapiens
taatcaggttgttaatgt

SEQ ID NO: 3871193 - DNA, 22 bp, Homo sapiens
taatcctcaacaacaaaccaaa

SEQ ID NO: 3871194 - DNA, 16 bp, Homo sapiens
taatcctgtatattat

SEQ ID NO: 3871195 - DNA, 16 bp, Homo sapiens
taatcggcccacagct

SEQ ID NO: 3871196 - DNA, 22 bp, Homo sapiens
taatctagaacacaggcaaaat

SEQ ID NO: 3871197 - DNA, 17 bp, Homo sapiens
taatctcatacctctga

SEQ ID NO: 3871198 - DNA, 20 bp, Homo sapiens
taatctggactcctctgtcc

SEQ ID NO: 3871199 - DNA, 21 bp, Homo sapiens
taatctggactcctctgtcca

SEQ ID NO: 3871200 - DNA, 20 bp, Homo sapiens
taatctgtagggctggacct

SEQ ID NO: 3871201 - DNA, 21 bp, Homo sapiens
taatctttctttacctgagac

SEQ ID NO: 3871202 - DNA, 16 bp, Homo sapiens
taatctttgtgacagg

SEQ ID NO: 3871203 - DNA, 16 bp, Homo sapiens
taatgaaattgagaag

SEQ ID NO: 3871204 - DNA, 19 bp, Homo sapiens
taatgaacagcagaaagac

SEQ ID NO: 3871205 - DNA, 17 bp, Homo sapiens
taatgaagacccagtgt

SEQ ID NO: 3871206 - DNA, 14 bp, Homo sapiens
taatgacacggtag

SEQ ID NO: 3871207 - DNA, 11 bp, Homo sapiens
taatgcacaat

SEQ ID NO: 3871208 - DNA, 12 bp, Homo sapiens
taatgcacaatt

SEQ ID NO: 3871209 - DNA, 17 bp, Homo sapiens
taatgcacaatttagaa

SEQ ID NO: 3871210 - DNA, 20 bp, Homo sapiens
taatgcacaatttagaaaac

SEQ ID NO: 3871211 - DNA, 16 bp, Homo sapiens
taatgcttcaagtgtt

SEQ ID NO: 3871212 - DNA, 23 bp, Homo sapiens
taatgcttcaagtgttgctcttg

SEQ ID NO: 3871213 - DNA, 19 bp, Homo sapiens
taatggaactgaccccctc

SEQ ID NO: 3871214 - DNA, 13 bp, Homo sapiens
taatggagaagac

SEQ ID NO: 3871215 - DNA, 13 bp, Homo sapiens
taatggcactgat

SEQ ID NO: 3871216 - DNA, 14 bp, Homo sapiens
taatgtaagaaaat

SEQ ID NO: 3871217 - DNA, 22 bp, Homo sapiens
taatgtcaccaccttcccagct

SEQ ID NO: 3871218 - DNA, 16 bp, Homo sapiens
taatgtctcttcctct

SEQ ID NO: 3871219 - DNA, 16 bp, Homo sapiens
taatgtgcaaattttg

SEQ ID NO: 3871220 - DNA, 18 bp, Homo sapiens
taatgtgcaaattttgca

SEQ ID NO: 3871221 - DNA, 21 bp, Homo sapiens
taatgtgcaaattttgcattt

SEQ ID NO: 3871222 - DNA, 16 bp, Homo sapiens
taatgtggatttccta

SEQ ID NO: 3871223 - DNA, 18 bp, Homo sapiens
taatgtggatttcctatt

SEQ ID NO: 3871224 - DNA, 23 bp, Homo sapiens
taatgtggatttcctattttaaa

SEQ ID NO: 3871225 - DNA, 14 bp, Homo sapiens
taatgtgtgtatgt

SEQ ID NO: 3871226 - DNA, 18 bp, Homo sapiens
taatgtgtgtatgtgtat

SEQ ID NO: 3871227 - DNA, 15 bp, Homo sapiens
taatgttaattcagc

SEQ ID NO: 3871228 - DNA, 22 bp, Homo sapiens
taatgttgggatttatatctat

SEQ ID NO: 3871229 - DNA, 13 bp, Homo sapiens
taatgttgtccag

SEQ ID NO: 3871230 - DNA, 23 bp, Homo sapiens
taatgttgttccttttgaaagaa

SEQ ID NO: 3871231 - DNA, 12 bp, Homo sapiens
taatgttttctg

SEQ ID NO: 3871232 - DNA, 20 bp, Homo sapiens
taattaaaagaatattttaa

SEQ ID NO: 3871233 - DNA, 14 bp, Homo sapiens
taattaaaatctgg

SEQ ID NO: 3871234 - DNA, 18 bp, Homo sapiens
taattaaaatctggaaat

SEQ ID NO: 3871235 - DNA, 22 bp, Homo sapiens
taattaaaatctggaaatctgt

SEQ ID NO: 3871236 - DNA, 14 bp, Homo sapiens
taattagaacaata

SEQ ID NO: 3871237 - DNA, 22 bp, Homo sapiens
taattaggatctatgcaatttt

SEQ ID NO: 3871238 - DNA, 20 bp, Homo sapiens
taattagggcatcctgcccc

SEQ ID NO: 3871239 - DNA, 18 bp, Homo sapiens
taattcagcactgatttc

SEQ ID NO: 3871240 - DNA, 22 bp, Homo sapiens
taattcagcactgatttcacaa

SEQ ID NO: 3871241 - DNA, 12 bp, Homo sapiens
taattcataatt

SEQ ID NO: 3871242 - DNA, 14 bp, Homo sapiens
taattcataattag

SEQ ID NO: 3871243 - DNA, 15 bp, Homo sapiens
taattcataattaga

SEQ ID NO: 3871244 - DNA, 18 bp, Homo sapiens
taattcataattagaaca

SEQ ID NO: 3871245 - DNA, 19 bp, Homo sapiens
taattcataattagaacaa

SEQ ID NO: 3871246 - DNA, 15 bp, Homo sapiens
taattcctggcatga

SEQ ID NO: 3871247 - DNA, 15 bp, Homo sapiens
taattcttgtatatt

SEQ ID NO: 3871248 - DNA, 14 bp, Homo sapiens
taattgatttcaag

SEQ ID NO: 3871249 - DNA, 17 bp, Homo sapiens
taattgcatttctgctc

SEQ ID NO: 3871250 - DNA, 15 bp, Homo sapiens
taattgcttacattt

SEQ ID NO: 3871251 - DNA, 23 bp, Homo sapiens
taattgcttacatttttacaata

SEQ ID NO: 3871252 - DNA, 20 bp, Homo sapiens
taattggaagaaattcctgt

SEQ ID NO: 3871253 - DNA, 18 bp, Homo sapiens
taaatgccaactggtcac

SEQ ID NO: 3871254 - DNA, 14 bp, Homo sapiens
taaatgctgaatga

SEQ ID NO: 3871255 - DNA, 15 bp, Homo sapiens
taaatggagcttgta

SEQ ID NO: 3871256 - DNA, 19 bp, Homo sapiens
taaatgggcagtgcctcct

SEQ ID NO: 3871257 - DNA, 20 bp, Homo sapiens
taaatgggcagtgcctcctg

SEQ ID NO: 3871258 - DNA, 17 bp, Homo sapiens
taaatgtatatacacat

SEQ ID NO: 3871259 - DNA, 14 bp, Homo sapiens
taaatgtgtaaatg

SEQ ID NO: 3871260 - DNA, 22 bp, Homo sapiens
taaatgtgtggtgctaactgta

SEQ ID NO: 3871261 - DNA, 11 bp, Homo sapiens
taaatgttcaa

SEQ ID NO: 3871262 - DNA, 16 bp, Homo sapiens
taaatgttgaaatctt

SEQ ID NO: 3871263 - DNA, 17 bp, Homo sapiens
taaattataacttaaaa

SEQ ID NO: 3871264 - DNA, 22 bp, Homo sapiens
taaattataacttaaaatattt

SEQ ID NO: 3871265 - DNA, 17 bp, Homo sapiens
taaattataagatgtca

SEQ ID NO: 3871266 - DNA, 21 bp, Homo sapiens
taaattcaaaccatttaattc

SEQ ID NO: 3871267 - DNA, 20 bp, Homo sapiens
taaattcagatatatttttc

SEQ ID NO: 3871268 - DNA, 23 bp, Homo sapiens
taaattcagatatatttttcaca

SEQ ID NO: 3871269 - DNA, 13 bp, Homo sapiens
taaattgaaatat

SEQ ID NO: 3871270 - DNA, 14 bp, Homo sapiens
taaattggaaacat

SEQ ID NO: 3871271 - DNA, 15 bp, Homo sapiens
taaattggaaacatt

SEQ ID NO: 3871272 - DNA, 19 bp, Homo sapiens
taaattgtatacattttgt

SEQ ID NO: 3871273 - DNA, 15 bp, Homo sapiens
taaatttatttcaaa

SEQ ID NO: 3871274 - DNA, 23 bp, Homo sapiens
taaatttgtccaatggctgtaaa

SEQ ID NO: 3871275 - DNA, 15 bp, Homo sapiens
taaatttttgtcatt

SEQ ID NO: 3871276 - DNA, 17 bp, Homo sapiens
taacaaaacaagaaaga

SEQ ID NO: 3871277 - DNA, 12 bp, Homo sapiens
taacaaatgaac

SEQ ID NO: 3871278 - DNA, 12 bp, Homo sapiens
taacaaattatg

SEQ ID NO: 3871279 - DNA, 14 bp, Homo sapiens
taacaacctggaga

SEQ ID NO: 3871280 - DNA, 18 bp, Homo sapiens
taacaagatctttcagga

SEQ ID NO: 3871281 - DNA, 22 bp, Homo sapiens
taacaatgtatgtgaaagtgta

SEQ ID NO: 3871282 - DNA, 18 bp, Homo sapiens
taacacataactagaaac

SEQ ID NO: 3871283 - DNA, 16 bp, Homo sapiens
taacactataaaggtt

SEQ ID NO: 3871284 - DNA, 20 bp, Homo sapiens
taacactcagaagcctgggg

SEQ ID NO: 3871285 - DNA, 13 bp, Homo sapiens
taacagaaccaga

SEQ ID NO: 3871286 - DNA, 14 bp, Homo sapiens
taacagaaccagag

SEQ ID NO: 3871287 - DNA, 14 bp, Homo sapiens
taacaggcttctgg

SEQ ID NO: 3871288 - DNA, 14 bp, Homo sapiens
taacagggaaggca

SEQ ID NO: 3871289 - DNA, 20 bp, Homo sapiens
taacagggaaggcaggcagg

SEQ ID NO: 3871290 - DNA, 15 bp, Homo sapiens
taacagtcatttaaa

SEQ ID NO: 3871291 - DNA, 21 bp, Homo sapiens
taacagtcctaactggtatag

SEQ ID NO: 3871292 - DNA, 21 bp, Homo sapiens
taacataaaatctgtgaatta

SEQ ID NO: 3871293 - DNA, 23 bp, Homo sapiens
taacatcctttctattgaaaaat

SEQ ID NO: 3871294 - DNA, 15 bp, Homo sapiens
taacattaacatcta

SEQ ID NO: 3871295 - DNA, 15 bp, Homo sapiens
taaccattaagaaat

SEQ ID NO: 3871296 - DNA, 17 bp, Homo sapiens
taaccattacatgttta

SEQ ID NO: 3871297 - DNA, 17 bp, Homo sapiens
taaccccaggcatccca

SEQ ID NO: 3871298 - DNA, 18 bp, Homo sapiens
taaccccaggcatcccat

SEQ ID NO: 3871299 - DNA, 21 bp, Homo sapiens
taaccccaggcatcccatccc

SEQ ID NO: 3871300 - DNA, 20 bp, Homo sapiens
taacccccagtgccacagag

SEQ ID NO: 3871301 - DNA, 21 bp, Homo sapiens
taacccccagtgccacagaga

SEQ ID NO: 3871302 - DNA, 23 bp, Homo sapiens
taacccccagtgccacagagaag

SEQ ID NO: 3871303 - DNA, 14 bp, Homo sapiens
taaccctctcttcc

SEQ ID NO: 3871304 - DNA, 20 bp, Homo sapiens
taacctatatgatttatagt

SEQ ID NO: 3871305 - DNA, 18 bp, Homo sapiens
taacctctctaagccaca

SEQ ID NO: 3871306 - DNA, 16 bp, Homo sapiens
taacctgtagaacacc

SEQ ID NO: 3871307 - DNA, 13 bp, Homo sapiens
taaccttagagct

SEQ ID NO: 3871308 - DNA, 18 bp, Homo sapiens
taacggctccaggatttt

SEQ ID NO: 3871309 - DNA, 19 bp, Homo sapiens
taacgggggtgcggcagga

SEQ ID NO: 3871310 - DNA, 19 bp, Homo sapiens
taactaatgctaagaaatg

SEQ ID NO: 3871311 - DNA, 16 bp, Homo sapiens
taactaatttaaacca

SEQ ID NO: 3871312 - DNA, 18 bp, Homo sapiens
taactaatttaaaccagc

SEQ ID NO: 3871313 - DNA, 23 bp, Homo sapiens
taactaatttaaaccagcagaaa

SEQ ID NO: 3871314 - DNA, 22 bp, Homo sapiens
taactagtcctgcagaggattt

SEQ ID NO: 3871315 - DNA, 16 bp, Homo sapiens
taactatcaatattta

SEQ ID NO: 3871316 - DNA, 14 bp, Homo sapiens
taactattgaattg

SEQ ID NO: 3871317 - DNA, 14 bp, Homo sapiens
taactcatctgtta

SEQ ID NO: 3871318 - DNA, 16 bp, Homo sapiens
taactccaccaaccca

SEQ ID NO: 3871319 - DNA, 22 bp, Homo sapiens
taactccaccaacccatcagaa

SEQ ID NO: 3871320 - DNA, 19 bp, Homo sapiens
taactccagtctcctgaca

SEQ ID NO: 3871321 - DNA, 22 bp, Homo sapiens
taactctatagttattgtttta

SEQ ID NO: 3871322 - DNA, 15 bp, Homo sapiens
taactctcgggacct

SEQ ID NO: 3871323 - DNA, 18 bp, Homo sapiens
taactctcgggacctcgt

SEQ ID NO: 3871324 - DNA, 11 bp, Homo sapiens
taactctggca

SEQ ID NO: 3871325 - DNA, 14 bp, Homo sapiens
taactgagaatttt

SEQ ID NO: 3871326 - DNA, 23 bp, Homo sapiens
taactgccatcaagatgagagaa

SEQ ID NO: 3871327 - DNA, 17 bp, Homo sapiens
taactgctgagccactc

SEQ ID NO: 3871328 - DNA, 12 bp, Homo sapiens
taactgtaaatc

SEQ ID NO: 3871329 - DNA, 17 bp, Homo sapiens
taactgtaaatcacttg

SEQ ID NO: 3871330 - DNA, 21 bp, Homo sapiens
taactgtaaatcacttgtaaa

SEQ ID NO: 3871331 - DNA, 23 bp, Homo sapiens
taactgtaaatcacttgtaaata

SEQ ID NO: 3871332 - DNA, 22 bp, Homo sapiens
taacttatctagaaagaaaaga

SEQ ID NO: 3871333 - DNA, 22 bp, Homo sapiens
taacttgagggtaataaactta

SEQ ID NO: 3871334 - DNA, 21 bp, Homo sapiens
taacttgctgaatttcaggca

SEQ ID NO: 3871335 - DNA, 23 bp, Homo sapiens
taacttggagagggacgaagaaa

SEQ ID NO: 3871336 - DNA, 20 bp, Homo sapiens
taacttgtatattccaccat

SEQ ID NO: 3871337 - DNA, 19 bp, Homo sapiens
taactttataaataaacat

SEQ ID NO: 3871338 - DNA, 16 bp, Homo sapiens
taactttgggcccaga

SEQ ID NO: 3871339 - DNA, 21 bp, Homo sapiens
gtctagaaaccagtatggaag

SEQ ID NO: 3871340 - DNA, 21 bp, Homo sapiens
gtctaggagctgggaggaaaa

SEQ ID NO: 3871341 - DNA, 14 bp, Homo sapiens
gtctagggagagac

SEQ ID NO: 3871342 - DNA, 21 bp, Homo sapiens
gtctagtgaagatgttgtcat

SEQ ID NO: 3871343 - DNA, 19 bp, Homo sapiens
gtctataatggaaacattt

SEQ ID NO: 3871344 - DNA, 20 bp, Homo sapiens
gtctataatggaaacattta

SEQ ID NO: 3871345 - DNA, 19 bp, Homo sapiens
gtctattagttttctttgt

SEQ ID NO: 3871346 - DNA, 17 bp, Homo sapiens
gtctattctgagccttg

SEQ ID NO: 3871347 - DNA, 16 bp, Homo sapiens
gtctatttaagcctca

SEQ ID NO: 3871348 - DNA, 15 bp, Homo sapiens
gtctcaagactgaaa

SEQ ID NO: 3871349 - DNA, 15 bp, Homo sapiens
gtctcaagagggcac

SEQ ID NO: 3871350 - DNA, 19 bp, Homo sapiens
gtctcaagcactaaaaagt

SEQ ID NO: 3871351 - DNA, 12 bp, Homo sapiens
gtctcactatgt

SEQ ID NO: 3871352 - DNA, 20 bp, Homo sapiens
gtctcactatgttgcccagg

SEQ ID NO: 3871353 - DNA, 22 bp, Homo sapiens
gtctcactatgttgcccaggct

SEQ ID NO: 3871354 - DNA, 17 bp, Homo sapiens
gtctcactcctgagtgg

SEQ ID NO: 3871355 - DNA, 16 bp, Homo sapiens
gtctcagcccgggaca

SEQ ID NO: 3871356 - DNA, 15 bp, Homo sapiens
gtctcaggtccctgc

SEQ ID NO: 3871357 - DNA, 16 bp, Homo sapiens
gtctcagtccagatgc

SEQ ID NO: 3871358 - DNA, 19 bp, Homo sapiens
gtctcattctgttgcccag

SEQ ID NO: 3871359 - DNA, 17 bp, Homo sapiens
gtctccactgaggatgt

SEQ ID NO: 3871360 - DNA, 19 bp, Homo sapiens
gtctccactgaggatgtga

SEQ ID NO: 3871361 - DNA, 14 bp, Homo sapiens
gtctccataatgcc

SEQ ID NO: 3871362 - DNA, 18 bp, Homo sapiens
gtctccataatgccactg

SEQ ID NO: 3871363 - DNA, 18 bp, Homo sapiens
gtctccctaaaataaaaa

SEQ ID NO: 3871364 - DNA, 15 bp, Homo sapiens
gtctccctctcctgc

SEQ ID NO: 3871365 - DNA, 18 bp, Homo sapiens
gtctccctctcctgccta

SEQ ID NO: 3871366 - DNA, 20 bp, Homo sapiens
gtctccctctcctgcctact

SEQ ID NO: 3871367 - DNA, 21 bp, Homo sapiens
gtctccctctcctgcctactc

SEQ ID NO: 3871368 - DNA, 22 bp, Homo sapiens
gtctccctctcctgcctactca

SEQ ID NO: 3871369 - DNA, 22 bp, Homo sapiens
gtctcctgtgcccacatcccag

SEQ ID NO: 3871370 - DNA, 22 bp, Homo sapiens
gtctccttactctgagcccagg

SEQ ID NO: 3871371 - DNA, 13 bp, Homo sapiens
gtctcgagcgccc

SEQ ID NO: 3871372 - DNA, 17 bp, Homo sapiens
gtctcgagcgccctgca

SEQ ID NO: 3871373 - DNA, 18 bp, Homo sapiens
gtctcgagcgccctgcag

SEQ ID NO: 3871374 - DNA, 20 bp, Homo sapiens
gtctcgagcgccctgcagac

SEQ ID NO: 3871375 - DNA, 21 bp, Homo sapiens
gtctcgagcgccctgcagacc

SEQ ID NO: 3871376 - DNA, 23 bp, Homo sapiens
gtctcgagcgccctgcagaccct

SEQ ID NO: 3871377 - DNA, 16 bp, Homo sapiens
gtctctagccactttg

SEQ ID NO: 3871378 - DNA, 14 bp, Homo sapiens
gtctctcccacccc

SEQ ID NO: 3871379 - DNA, 12 bp, Homo sapiens
gtctctgagaac

SEQ ID NO: 3871380 - DNA, 14 bp, Homo sapiens
gtctctgctgcatt

SEQ ID NO: 3871381 - DNA, 17 bp, Homo sapiens
gtctctgtataatctat

SEQ ID NO: 3871382 - DNA, 23 bp, Homo sapiens
gtctctgtcccggttcaccttgc

SEQ ID NO: 3871383 - DNA, 23 bp, Homo sapiens
gtctcttcctctgttctatccca

SEQ ID NO: 3871384 - DNA, 17 bp, Homo sapiens
gtctcttctccactgga

SEQ ID NO: 3871385 - DNA, 14 bp, Homo sapiens
gtctcttttgttcc

SEQ ID NO: 3871386 - DNA, 15 bp, Homo sapiens
gtctgaaagacagaa

SEQ ID NO: 3871387 - DNA, 20 bp, Homo sapiens
gtctgaaggaatagccagag

SEQ ID NO: 3871388 - DNA, 16 bp, Homo sapiens
gtctgaagtcactgca

SEQ ID NO: 3871389 - DNA, 17 bp, Homo sapiens
gtctgaagtcactgcac

SEQ ID NO: 3871390 - DNA, 13 bp, Homo sapiens
gtctgactccaga

SEQ ID NO: 3871391 - DNA, 15 bp, Homo sapiens
gtctgactccagagt

SEQ ID NO: 3871392 - DNA, 18 bp, Homo sapiens
gtctgactccagagtctg

SEQ ID NO: 3871393 - DNA, 20 bp, Homo sapiens
gtctgagaatgcccaactct

SEQ ID NO: 3871394 - DNA, 13 bp, Homo sapiens
gtctgagccctgg

SEQ ID NO: 3871395 - DNA, 15 bp, Homo sapiens
gtctgagccctggtg

SEQ ID NO: 3871396 - DNA, 15 bp, Homo sapiens
gtctgaggccccagg

SEQ ID NO: 3871397 - DNA, 13 bp, Homo sapiens
gtctgaggcctca

SEQ ID NO: 3871398 - DNA, 15 bp, Homo sapiens
gtctgaggtcctgag

SEQ ID NO: 3871399 - DNA, 17 bp, Homo sapiens
gtctgagtcctgtctct

SEQ ID NO: 3871400 - DNA, 23 bp, Homo sapiens
gtctgagtcctgtctctgcctgc

SEQ ID NO: 3871401 - DNA, 16 bp, Homo sapiens
gtctgatttgtgatga

SEQ ID NO: 3871402 - DNA, 13 bp, Homo sapiens
gtctgcacccagg

SEQ ID NO: 3871403 - DNA, 19 bp, Homo sapiens
gtctgcagcccggcgccac

SEQ ID NO: 3871404 - DNA, 22 bp, Homo sapiens
gtctgcattgttattgtggaag

SEQ ID NO: 3871405 - DNA, 18 bp, Homo sapiens
gtctgccaccatcctgct

SEQ ID NO: 3871406 - DNA, 11 bp, Homo sapiens
gtctgccaggc

SEQ ID NO: 3871407 - DNA, 14 bp, Homo sapiens
gtctgccaggccca

SEQ ID NO: 3871408 - DNA, 20 bp, Homo sapiens
gtctgctggtgtcattgctg

SEQ ID NO: 3871409 - DNA, 11 bp, Homo sapiens
gtctgcttctg

SEQ ID NO: 3871410 - DNA, 17 bp, Homo sapiens
gtctgggatgtagaact

SEQ ID NO: 3871411 - DNA, 14 bp, Homo sapiens
gtctggggagggag

SEQ ID NO: 3871412 - DNA, 18 bp, Homo sapiens
gtctggggttcagcccct

SEQ ID NO: 3871413 - DNA, 19 bp, Homo sapiens
gtctggtgtagctcctctg

SEQ ID NO: 3871414 - DNA, 23 bp, Homo sapiens
gtctggtgtagctcctctgctgc

SEQ ID NO: 3871415 - DNA, 15 bp, Homo sapiens
gtctgtatatacatt

SEQ ID NO: 3871416 - DNA, 14 bp, Homo sapiens
gtctgtcctggagg

SEQ ID NO: 3871417 - DNA, 18 bp, Homo sapiens
gtctgtcctggaggtggg

SEQ ID NO: 3871418 - DNA, 14 bp, Homo sapiens
gtctgtctgtctgt

SEQ ID NO: 3871419 - DNA, 15 bp, Homo sapiens
gtctgtctttgtggg

SEQ ID NO: 3871420 - DNA, 21 bp, Homo sapiens
gtctgtgaattggaccatcct

SEQ ID NO: 3871421 - DNA, 14 bp, Homo sapiens
gtctgtgctgccct

SEQ ID NO: 3871422 - DNA, 14 bp, Homo sapiens
gtctgtgctgtgcc

SEQ ID NO: 3871423 - DNA, 18 bp, Homo sapiens
gtctgtgctgtgcctgct

SEQ ID NO: 3871424 - DNA, 20 bp, Homo sapiens
gtctgtgtgatgaactttct

SEQ ID NO: 3871425 - DNA, 15 bp, Homo sapiens
gttggttctgcacta

SEQ ID NO: 3871426 - DNA, 16 bp, Homo sapiens
gttggttggggtgggg

SEQ ID NO: 3871427 - DNA, 16 bp, Homo sapiens
gttgtaaataaaagta

SEQ ID NO: 3871428 - DNA, 17 bp, Homo sapiens
gttgtaaatgaccaaga

SEQ ID NO: 3871429 - DNA, 21 bp, Homo sapiens
gttgtaaatgaccaagaaaaa

SEQ ID NO: 3871430 - DNA, 18 bp, Homo sapiens
gttgtaaatgctcgtgtg

SEQ ID NO: 3871431 - DNA, 19 bp, Homo sapiens
gttgtaaatgctcgtgtga

SEQ ID NO: 3871432 - DNA, 20 bp, Homo sapiens
gttgtaaatgctcgtgtgat

SEQ ID NO: 3871433 - DNA, 18 bp, Homo sapiens
gttgtacaagctcaggag

SEQ ID NO: 3871434 - DNA, 21 bp, Homo sapiens
gttgtcaatattaaatacaga

SEQ ID NO: 3871435 - DNA, 12 bp, Homo sapiens
gttgtccaggaa

SEQ ID NO: 3871436 - DNA, 16 bp, Homo sapiens
gttgtgattttgtaca

SEQ ID NO: 3871437 - DNA, 19 bp, Homo sapiens
gttgtgattttgtacagaa

SEQ ID NO: 3871438 - DNA, 22 bp, Homo sapiens
gttgtgattttgtacagaattt

SEQ ID NO: 3871439 - DNA, 14 bp, Homo sapiens
gttgtgtatagatg

SEQ ID NO: 3871440 - DNA, 15 bp, Homo sapiens
gttgttcccacacac

SEQ ID NO: 3871441 - DNA, 19 bp, Homo sapiens
gttgtttttaagtcctgta

SEQ ID NO: 3871442 - DNA, 19 bp, Homo sapiens
gttgttttttgaaaacatg

SEQ ID NO: 3871443 - DNA, 13 bp, Homo sapiens
gtttaaataaagt

SEQ ID NO: 3871444 - DNA, 12 bp, Homo sapiens
gtttaaattgta

SEQ ID NO: 3871445 - DNA, 23 bp, Homo sapiens
gtttaactttgggcccagaaact

SEQ ID NO: 3871446 - DNA, 12 bp, Homo sapiens
gtttaagtgttg

SEQ ID NO: 3871447 - DNA, 16 bp, Homo sapiens
gtttacaaaaggcagc

SEQ ID NO: 3871448 - DNA, 19 bp, Homo sapiens
gtttacagtaaataaattg

SEQ ID NO: 3871449 - DNA, 22 bp, Homo sapiens
gtttacatgaacacagctgctg

SEQ ID NO: 3871450 - DNA, 16 bp, Homo sapiens
gtttactaaagagaca

SEQ ID NO: 3871451 - DNA, 14 bp, Homo sapiens
gtttagatttcaag

SEQ ID NO: 3871452 - DNA, 20 bp, Homo sapiens
gtttagtttctagaggcctc

SEQ ID NO: 3871453 - DNA, 20 bp, Homo sapiens
gtttatagagggccaagact

SEQ ID NO: 3871454 - DNA, 21 bp, Homo sapiens
gtttatagagggccaagactt

SEQ ID NO: 3871455 - DNA, 16 bp, Homo sapiens
gtttatataaggcagt

SEQ ID NO: 3871456 - DNA, 13 bp, Homo sapiens
gtttatgtctaaa

SEQ ID NO: 3871457 - DNA, 14 bp, Homo sapiens
gtttattggaagtg

SEQ ID NO: 3871458 - DNA, 23 bp, Homo sapiens
gtttcaaatggactcatggctta

SEQ ID NO: 3871459 - DNA, 19 bp, Homo sapiens
gtttcactgtgttggccag

SEQ ID NO: 3871460 - DNA, 23 bp, Homo sapiens
gtttcagggggcctttaaagact

SEQ ID NO: 3871461 - DNA, 15 bp, Homo sapiens
gtttcattctcctgc

SEQ ID NO: 3871462 - DNA, 19 bp, Homo sapiens
gtttcattctcctgcctgt

SEQ ID NO: 3871463 - DNA, 23 bp, Homo sapiens
gtttccaagttcctgcactccag

SEQ ID NO: 3871464 - DNA, 22 bp, Homo sapiens
gtttccatttctcaatcagtgc

SEQ ID NO: 3871465 - DNA, 14 bp, Homo sapiens
gtttcccaccacct

SEQ ID NO: 3871466 - DNA, 23 bp, Homo sapiens
gtttccctcaaatgcgcgtgtgc

SEQ ID NO: 3871467 - DNA, 14 bp, Homo sapiens
gtttccttcagtgc

SEQ ID NO: 3871468 - DNA, 16 bp, Homo sapiens
gtttctagaggcctca

SEQ ID NO: 3871469 - DNA, 14 bp, Homo sapiens
gtttctcagctccc

SEQ ID NO: 3871470 - DNA, 22 bp, Homo sapiens
gtttctgattcactattagaga

SEQ ID NO: 3871471 - DNA, 20 bp, Homo sapiens
gtttctgcagtagtctctgt

SEQ ID NO: 3871472 - DNA, 22 bp, Homo sapiens
gtttctgcagtagtctctgtgc

SEQ ID NO: 3871473 - DNA, 17 bp, Homo sapiens
gtttctttaagaaagta

SEQ ID NO: 3871474 - DNA, 17 bp, Homo sapiens
gtttgaaggaggtgagg

SEQ ID NO: 3871475 - DNA, 20 bp, Homo sapiens
gtttgagacaagccctggca

SEQ ID NO: 3871476 - DNA, 13 bp, Homo sapiens
gtttgagctcaga

SEQ ID NO: 3871477 - DNA, 16 bp, Homo sapiens
gtttgagttttcaaag

SEQ ID NO: 3871478 - DNA, 17 bp, Homo sapiens
gtttggcaatagtttgc

SEQ ID NO: 3871479 - DNA, 19 bp, Homo sapiens
gtttggcaatagtttgcat

SEQ ID NO: 3871480 - DNA, 14 bp, Homo sapiens
gtttggggagaaat

SEQ ID NO: 3871481 - DNA, 16 bp, Homo sapiens
gtttggtccagcctgg

SEQ ID NO: 3871482 - DNA, 14 bp, Homo sapiens
gtttggttgtaaat

SEQ ID NO: 3871483 - DNA, 13 bp, Homo sapiens
gtttgtaaaacta

SEQ ID NO: 3871484 - DNA, 22 bp, Homo sapiens
gtttgtaccttccttaagccag

SEQ ID NO: 3871485 - DNA, 13 bp, Homo sapiens
gtttgtatattgt

SEQ ID NO: 3871486 - DNA, 20 bp, Homo sapiens
gtttgtattttaaatgtttt

SEQ ID NO: 3871487 - DNA, 15 bp, Homo sapiens
gtttgtcatatattc

SEQ ID NO: 3871488 - DNA, 18 bp, Homo sapiens
gtttgtcatatattcatg

SEQ ID NO: 3871489 - DNA, 14 bp, Homo sapiens
gtttgtggctgttg

SEQ ID NO: 3871490 - DNA, 14 bp, Homo sapiens
gtttgtgtgcatga

SEQ ID NO: 3871491 - DNA, 15 bp, Homo sapiens
gtttgtgtggatacc

SEQ ID NO: 3871492 - DNA, 15 bp, Homo sapiens
gttttaacagaacca

SEQ ID NO: 3871493 - DNA, 17 bp, Homo sapiens
gttttaacagaaccaga

SEQ ID NO: 3871494 - DNA, 18 bp, Homo sapiens
gttttaacagaaccagag

SEQ ID NO: 3871495 - DNA, 22 bp, Homo sapiens
gttttacaaatttttcctgcaa

SEQ ID NO: 3871496 - DNA, 20 bp, Homo sapiens
gttttagctccttgactcct

SEQ ID NO: 3871497 - DNA, 17 bp, Homo sapiens
gttttatggcatgattt

SEQ ID NO: 3871498 - DNA, 20 bp, Homo sapiens
gttttattctgacttcctct

SEQ ID NO: 3871499 - DNA, 21 bp, Homo sapiens
gttttattttttattgttttc

SEQ ID NO: 3871500 - DNA, 16 bp, Homo sapiens
gttttcagcaactcag

SEQ ID NO: 3871501 - DNA, 19 bp, Homo sapiens
gttttcataacttgctgaa

SEQ ID NO: 3871502 - DNA, 24 bp, Homo sapiens
gttttcataacttgctgaatttca

SEQ ID NO: 3871503 - DNA, 22 bp, Homo sapiens
gttttcccgagcaaagtctaaa

SEQ ID NO: 3871504 - DNA, 13 bp, Homo sapiens
gttttctaactgt

SEQ ID NO: 3871505 - DNA, 17 bp, Homo sapiens
gttttctaactgtaaat

SEQ ID NO: 3871506 - DNA, 21 bp, Homo sapiens
gttttctaactgtaaatcact

SEQ ID NO: 3871507 - DNA, 22 bp, Homo sapiens
gttttctgagaaagactattca

SEQ ID NO: 3871508 - DNA, 23 bp, Homo sapiens
gttttctgagaaagactattcaa

SEQ ID NO: 3871509 - DNA, 15 bp, Homo sapiens
gttttcttcccatca

SEQ ID NO: 3871510 - DNA, 18 bp, Homo sapiens
gttttgaaagaaaaatac

SEQ ID NO: 3871511 - DNA, 22 bp, Homo sapiens
gttttgaactaataaaagcata

SEQ ID NO: 3871512 - DNA, 14 bp, Homo sapiens
gttttgatatgagt

SEQ ID NO: 3871513 - DNA, 15 bp, Homo sapiens
gttttgatatgagta

SEQ ID NO: 3871514 - DNA, 16 bp, Homo sapiens
gttttgctgtttcctt

SEQ ID NO: 3871515 - DNA, 19 bp, Homo sapiens
gttttgtataaataataaa

SEQ ID NO: 3871516 - DNA, 21 bp, Homo sapiens
gttttgtataaataataaaga

SEQ ID NO: 3871517 - DNA, 21 bp, Homo sapiens
gtttttaacaactaatcaaga

SEQ ID NO: 3871518 - DNA, 20 bp, Homo sapiens
gtttttaatctttgtgacag

SEQ ID NO: 3871519 - DNA, 17 bp, Homo sapiens
gtttttcggtgggacag

SEQ ID NO: 3871520 - DNA, 19 bp, Homo sapiens
gtttttctacttttaaaga

SEQ ID NO: 3871521 - DNA, 13 bp, Homo sapiens
gtttttggctctt

SEQ ID NO: 3871522 - DNA, 21 bp, Homo sapiens
gtttttgtagtattggggccc

SEQ ID NO: 3871523 - DNA, 17 bp, Homo sapiens
gtttttgtgctgtgggc

SEQ ID NO: 3871524 - DNA, 18 bp, Homo sapiens
gtttttttacaacattca

SEQ ID NO: 3871525 - DNA, 12 bp, Homo sapiens
taaaaaaataca

SEQ ID NO: 3871526 - DNA, 14 bp, Homo sapiens
taaaaaaatacagt

SEQ ID NO: 3871527 - DNA, 18 bp, Homo sapiens
taaaaaaatacagtaaag

SEQ ID NO: 3871528 - DNA, 13 bp, Homo sapiens
taaaaaataaaaa

SEQ ID NO: 3871529 - DNA, 22 bp, Homo sapiens
taaaaaatacaccacgaatttg

SEQ ID NO: 3871530 - DNA, 18 bp, Homo sapiens
taaaaacaaagaaataaa

SEQ ID NO: 3871531 - DNA, 19 bp, Homo sapiens
taaaaaccagaatcataat

SEQ ID NO: 3871532 - DNA, 17 bp, Homo sapiens
taaaaacttgtactatg

SEQ ID NO: 3871533 - DNA, 19 bp, Homo sapiens
taaaaagagagaaaactta

SEQ ID NO: 3871534 - DNA, 17 bp, Homo sapiens
taaaaataaaatgatgt

SEQ ID NO: 3871535 - DNA, 16 bp, Homo sapiens
taaaaatattttctga

SEQ ID NO: 3871536 - DNA, 18 bp, Homo sapiens
taaaaatgaaattattta

SEQ ID NO: 3871537 - DNA, 23 bp, Homo sapiens
taaaacacagatttttgggctcc

SEQ ID NO: 3871538 - DNA, 13 bp, Homo sapiens
taaaacatgcacg

SEQ ID NO: 3871539 - DNA, 13 bp, Homo sapiens
taaaaccacagca

SEQ ID NO: 3871540 - DNA, 12 bp, Homo sapiens
taaaaccatgca

SEQ ID NO: 3871541 - DNA, 15 bp, Homo sapiens
taaaaccatgcagct

SEQ ID NO: 3871542 - DNA, 16 bp, Homo sapiens
taaaaccatgcagctt

SEQ ID NO: 3871543 - DNA, 21 bp, Homo sapiens
taaaaccatgcagcttcatca

SEQ ID NO: 3871544 - DNA, 18 bp, Homo sapiens
taaaacctgagctagaag

SEQ ID NO: 3871545 - DNA, 16 bp, Homo sapiens
taaaaccttgatttaa

SEQ ID NO: 3871546 - DNA, 20 bp, Homo sapiens
taaaacctttcaaatttcac

SEQ ID NO: 3871547 - DNA, 12 bp, Homo sapiens
taaaactaaata

SEQ ID NO: 3871548 - DNA, 18 bp, Homo sapiens
taaaacttatgctagttt

SEQ ID NO: 3871549 - DNA, 15 bp, Homo sapiens
taaaagaaatttatt

SEQ ID NO: 3871550 - DNA, 18 bp, Homo sapiens
taaaagaacagtaaacat

SEQ ID NO: 3871551 - DNA, 12 bp, Homo sapiens
taaaagacagtg

SEQ ID NO: 3871552 - DNA, 23 bp, Homo sapiens
taaaagataacaagatctttcag

SEQ ID NO: 3871553 - DNA, 14 bp, Homo sapiens
taaaagatgaaaat

SEQ ID NO: 3871554 - DNA, 20 bp, Homo sapiens
taaaagattcactaaagcag

SEQ ID NO: 3871555 - DNA, 12 bp, Homo sapiens
taaaagctaatt

SEQ ID NO: 3871556 - DNA, 19 bp, Homo sapiens
taaaaggagagaagaaagt

SEQ ID NO: 3871557 - DNA, 12 bp, Homo sapiens
taaaagttactt

SEQ ID NO: 3871558 - DNA, 22 bp, Homo sapiens
taaaataaagcctatttttcaa

SEQ ID NO: 3871559 - DNA, 21 bp, Homo sapiens
taaaataactagtgttgcttg

SEQ ID NO: 3871560 - DNA, 24 bp, Homo sapiens
taaaataactagtgttgcttggac

SEQ ID NO: 3871561 - DNA, 22 bp, Homo sapiens
taaaatactctagcctgggcca

SEQ ID NO: 3871562 - DNA, 22 bp, Homo sapiens
taaaatagatcctaggtgctgg

SEQ ID NO: 3871563 - DNA, 16 bp, Homo sapiens
taaaatagtattgaaa

SEQ ID NO: 3871564 - DNA, 16 bp, Homo sapiens
taaaatataaattaag

SEQ ID NO: 3871565 - DNA, 14 bp, Homo sapiens
taaaatatacaaac

SEQ ID NO: 3871566 - DNA, 15 bp, Homo sapiens
taaaatatacaaaca

SEQ ID NO: 3871567 - DNA, 15 bp, Homo sapiens
taaaatatctacctg

SEQ ID NO: 3871568 - DNA, 13 bp, Homo sapiens
taaaatattcctg

SEQ ID NO: 3871569 - DNA, 22 bp, Homo sapiens
taaaatattcctgcatttgtga

SEQ ID NO: 3871570 - DNA, 13 bp, Homo sapiens
taaaatatttatt

SEQ ID NO: 3871571 - DNA, 10 bp, Homo sapiens
taaaatcatt

SEQ ID NO: 3871572 - DNA, 22 bp, Homo sapiens
taaaatcatttctgcatcagct

SEQ ID NO: 3871573 - DNA, 15 bp, Homo sapiens
taaaatctgatttaa

SEQ ID NO: 3871574 - DNA, 23 bp, Homo sapiens
taaaatctgatttaatgttttct

SEQ ID NO: 3871575 - DNA, 16 bp, Homo sapiens
taaaatcttgaaaatg

SEQ ID NO: 3871576 - DNA, 19 bp, Homo sapiens
taaaatcttggcacagaaa

SEQ ID NO: 3871577 - DNA, 15 bp, Homo sapiens
taaaatgaaatgtct

SEQ ID NO: 3871578 - DNA, 12 bp, Homo sapiens
taaaatgacagc

SEQ ID NO: 3871579 - DNA, 17 bp, Homo sapiens
taaaatgattgtaaaat

SEQ ID NO: 3871580 - DNA, 19 bp, Homo sapiens
taaaatgcaaaataaatgt

SEQ ID NO: 3871581 - DNA, 18 bp, Homo sapiens
taaaattatggtgaaatt

SEQ ID NO: 3871582 - DNA, 17 bp, Homo sapiens
taaaattcttgggagtg

SEQ ID NO: 3871583 - DNA, 14 bp, Homo sapiens
taaaattgtaaaat

SEQ ID NO: 3871584 - DNA, 22 bp, Homo sapiens
taaaattgtaaaattgtataga

SEQ ID NO: 3871585 - DNA, 19 bp, Homo sapiens
taaaattgtgatgttttgt

SEQ ID NO: 3871586 - DNA, 23 bp, Homo sapiens
taaaattgtgatgttttgttcaa

SEQ ID NO: 3871587 - DNA, 13 bp, Homo sapiens
taaaatttcaaca

SEQ ID NO: 3871588 - DNA, 23 bp, Homo sapiens
taaaattttttgatgtcagcctt

SEQ ID NO: 3871589 - DNA, 18 bp, Homo sapiens
taaacaaaatagaagctg

SEQ ID NO: 3871590 - DNA, 18 bp, Homo sapiens
taaacacccttcacatac

SEQ ID NO: 3871591 - DNA, 15 bp, Homo sapiens
taaacacctgacaca

SEQ ID NO: 3871592 - DNA, 22 bp, Homo sapiens
taaacagcagtgttccccatct

SEQ ID NO: 3871593 - DNA, 20 bp, Homo sapiens
taaacagtgagcctgaattt

SEQ ID NO: 3871594 - DNA, 20 bp, Homo sapiens
taaacataattcttgtatat

SEQ ID NO: 3871595 - DNA, 21 bp, Homo sapiens
taaacattaaaagaagactgg

SEQ ID NO: 3871596 - DNA, 19 bp, Homo sapiens
taaacattaaacactgtaa

SEQ ID NO: 3871597 - DNA, 15 bp, Homo sapiens
gttccatgcctgagg

SEQ ID NO: 3871598 - DNA, 17 bp, Homo sapiens
gttccatgcctgagggt

SEQ ID NO: 3871599 - DNA, 15 bp, Homo sapiens
gttcccaataaaagt

SEQ ID NO: 3871600 - DNA, 23 bp, Homo sapiens
gttccccatctgggtccttgcac

SEQ ID NO: 3871601 - DNA, 18 bp, Homo sapiens
gttcccctgttcactcta

SEQ ID NO: 3871602 - DNA, 19 bp, Homo sapiens
gttccccttggcttcctcc

SEQ ID NO: 3871603 - DNA, 17 bp, Homo sapiens
gttcccggagcacagcc

SEQ ID NO: 3871604 - DNA, 21 bp, Homo sapiens
gttccctgaaaacccagagag

SEQ ID NO: 3871605 - DNA, 13 bp, Homo sapiens
gttccctgcaccc

SEQ ID NO: 3871606 - DNA, 15 bp, Homo sapiens
gttccctgcaccctg

SEQ ID NO: 3871607 - DNA, 15 bp, Homo sapiens
gttcctcgccctggg

SEQ ID NO: 3871608 - DNA, 15 bp, Homo sapiens
gttcctgcactccag

SEQ ID NO: 3871609 - DNA, 13 bp, Homo sapiens
gttcctggctttg

SEQ ID NO: 3871610 - DNA, 19 bp, Homo sapiens
gttcctggctttgacatga

SEQ ID NO: 3871611 - DNA, 21 bp, Homo sapiens
gttcctttttcaacttggaaa

SEQ ID NO: 3871612 - DNA, 16 bp, Homo sapiens
gttcgcagccaccctg

SEQ ID NO: 3871613 - DNA, 14 bp, Homo sapiens
gttctacaagcata

SEQ ID NO: 3871614 - DNA, 16 bp, Homo sapiens
gttctacaagcatatt

SEQ ID NO: 3871615 - DNA, 17 bp, Homo sapiens
gttctacaagcatattt

SEQ ID NO: 3871616 - DNA, 23 bp, Homo sapiens
gttctagtccttggtctgctggt

SEQ ID NO: 3871617 - DNA, 14 bp, Homo sapiens
gttctcaaatgcta

SEQ ID NO: 3871618 - DNA, 17 bp, Homo sapiens
gttctcagatcttgaca

SEQ ID NO: 3871619 - DNA, 20 bp, Homo sapiens
gttctccagcccacacccct

SEQ ID NO: 3871620 - DNA, 20 bp, Homo sapiens
gttctccgggtgtggcctca

SEQ ID NO: 3871621 - DNA, 16 bp, Homo sapiens
gttctgacacacgtat

SEQ ID NO: 3871622 - DNA, 14 bp, Homo sapiens
gttctgacattcat

SEQ ID NO: 3871623 - DNA, 14 bp, Homo sapiens
gttctgagtgtttt

SEQ ID NO: 3871624 - DNA, 13 bp, Homo sapiens
gttctgcactgaa

SEQ ID NO: 3871625 - DNA, 13 bp, Homo sapiens
gttctgctcctct

SEQ ID NO: 3871626 - DNA, 19 bp, Homo sapiens
gttctgctcctctccaggc

SEQ ID NO: 3871627 - DNA, 22 bp, Homo sapiens
gttctgctcctctccaggcacc

SEQ ID NO: 3871628 - DNA, 13 bp, Homo sapiens
gttctgctggcct

SEQ ID NO: 3871629 - DNA, 14 bp, Homo sapiens
gttctgctggcctg

SEQ ID NO: 3871630 - DNA, 16 bp, Homo sapiens
gttctggcctcagacc

SEQ ID NO: 3871631 - DNA, 21 bp, Homo sapiens
gttctggctttacattttatt

SEQ ID NO: 3871632 - DNA, 22 bp, Homo sapiens
gttctggggaggaagggccagg

SEQ ID NO: 3871633 - DNA, 16 bp, Homo sapiens
gttctgtataaaatgc

SEQ ID NO: 3871634 - DNA, 16 bp, Homo sapiens
gttctgttgatcccac

SEQ ID NO: 3871635 - DNA, 18 bp, Homo sapiens
gttctgttgatcccactt

SEQ ID NO: 3871636 - DNA, 23 bp, Homo sapiens
gttctgtttcccattactttaat

SEQ ID NO: 3871637 - DNA, 22 bp, Homo sapiens
gttcttagctgaacaatgaatg

SEQ ID NO: 3871638 - DNA, 15 bp, Homo sapiens
gttcttgctgagcac

SEQ ID NO: 3871639 - DNA, 21 bp, Homo sapiens
gttcttgctgagcaccctctc

SEQ ID NO: 3871640 - DNA, 18 bp, Homo sapiens
gttctttggaaggagtga

SEQ ID NO: 3871641 - DNA, 13 bp, Homo sapiens
gttcttttaaagg

SEQ ID NO: 3871642 - DNA, 16 bp, Homo sapiens
gttgaaaaatctagtt

SEQ ID NO: 3871643 - DNA, 23 bp, Homo sapiens
gttgaaaagactccaaagaaatg

SEQ ID NO: 3871644 - DNA, 17 bp, Homo sapiens
gttgaaaatgagcctgt

SEQ ID NO: 3871645 - DNA, 22 bp, Homo sapiens
gttgaaaatgagcctgtaatcc

SEQ ID NO: 3871646 - DNA, 19 bp, Homo sapiens
gttgaatgacaacagaagc

SEQ ID NO: 3871647 - DNA, 12 bp, Homo sapiens
gttgacagcagg

SEQ ID NO: 3871648 - DNA, 22 bp, Homo sapiens
gttgagaggggagggcaggagg

SEQ ID NO: 3871649 - DNA, 23 bp, Homo sapiens
gttgaggtggaagccctccttcc

SEQ ID NO: 3871650 - DNA, 16 bp, Homo sapiens
gttgagttggacacac

SEQ ID NO: 3871651 - DNA, 14 bp, Homo sapiens
gttgattcccagca

SEQ ID NO: 3871652 - DNA, 14 bp, Homo sapiens
gttgcaaccactgc

SEQ ID NO: 3871653 - DNA, 16 bp, Homo sapiens
gttgcaaggccgctgt

SEQ ID NO: 3871654 - DNA, 23 bp, Homo sapiens
gttgcaaggccgctgttcaccca

SEQ ID NO: 3871655 - DNA, 13 bp, Homo sapiens
gttgcaataaaat

SEQ ID NO: 3871656 - DNA, 15 bp, Homo sapiens
gttgcagtctcagaa

SEQ ID NO: 3871657 - DNA, 17 bp, Homo sapiens
gttgcagtctcagaaag

SEQ ID NO: 3871658 - DNA, 18 bp, Homo sapiens
gttgccacctgttaaaat

SEQ ID NO: 3871659 - DNA, 18 bp, Homo sapiens
gttgccatttctctgctt

SEQ ID NO: 3871660 - DNA, 21 bp, Homo sapiens
gttgccccttccccatctcca

SEQ ID NO: 3871661 - DNA, 18 bp, Homo sapiens
gttgccttaaagaaagtc

SEQ ID NO: 3871662 - DNA, 18 bp, Homo sapiens
gttgcgggggagctggaa

SEQ ID NO: 3871663 - DNA, 21 bp, Homo sapiens
gttgcgggggagctggaaata

SEQ ID NO: 3871664 - DNA, 19 bp, Homo sapiens
gttgctcttggaaagctga

SEQ ID NO: 3871665 - DNA, 23 bp, Homo sapiens
gttgcttagatgagggtgactgt

SEQ ID NO: 3871666 - DNA, 17 bp, Homo sapiens
gttgcttatttccctca

SEQ ID NO: 3871667 - DNA, 21 bp, Homo sapiens
gttggaatcacctggagggct

SEQ ID NO: 3871668 - DNA, 17 bp, Homo sapiens
gttggacacactgtaaa

SEQ ID NO: 3871669 - DNA, 16 bp, Homo sapiens
gttggacagctgcttg

SEQ ID NO: 3871670 - DNA, 15 bp, Homo sapiens
gttggacccgctctg

SEQ ID NO: 3871671 - DNA, 17 bp, Homo sapiens
gttggacccgctctgga

SEQ ID NO: 3871672 - DNA, 20 bp, Homo sapiens
gttggacccgctctggacca

SEQ ID NO: 3871673 - DNA, 19 bp, Homo sapiens
gttggagagctagaacctg

SEQ ID NO: 3871674 - DNA, 20 bp, Homo sapiens
gttggagccactcctgtccc

SEQ ID NO: 3871675 - DNA, 16 bp, Homo sapiens
gttggatgggaagatg

SEQ ID NO: 3871676 - DNA, 23 bp, Homo sapiens
gttggatgggaagatggtagcag

SEQ ID NO: 3871677 - DNA, 18 bp, Homo sapiens
gttggcctcgcctgggcc

SEQ ID NO: 3871678 - DNA, 14 bp, Homo sapiens
gttggctcaggcag

SEQ ID NO: 3871679 - DNA, 14 bp, Homo sapiens
gttggctggatgaa

SEQ ID NO: 3871680 - DNA, 15 bp, Homo sapiens
gttgggagcactgga

SEQ ID NO: 3871681 - DNA, 12 bp, Homo sapiens
gttggtgactga

SEQ ID NO: 3871682 - DNA, 14 bp, Homo sapiens
gttggtgactgaaa

SEQ ID NO: 3871683 - DNA, 14 bp, Homo sapiens
gtggcacctcctga

SEQ ID NO: 3871684 - DNA, 20 bp, Homo sapiens
gtggcagataatcagcctct

SEQ ID NO: 3871685 - DNA, 21 bp, Homo sapiens
gtggcagataatcagcctctt

SEQ ID NO: 3871686 - DNA, 23 bp, Homo sapiens
gtggcagataatcagcctcttaa

SEQ ID NO: 3871687 - DNA, 22 bp, Homo sapiens
gtggcagccatgcctcatgcca

SEQ ID NO: 3871688 - DNA, 22 bp, Homo sapiens
gtggcagctgtcccctctccct

SEQ ID NO: 3871689 - DNA, 21 bp, Homo sapiens
gtggcaggcacacagcagccc

SEQ ID NO: 3871690 - DNA, 22 bp, Homo sapiens
gtggcaggcacacagcagcccc

SEQ ID NO: 3871691 - DNA, 21 bp, Homo sapiens
gtggcattggggggccgggca

SEQ ID NO: 3871692 - DNA, 19 bp, Homo sapiens
gtggccaaattatttgtgt

SEQ ID NO: 3871693 - DNA, 17 bp, Homo sapiens
gtggccaatccaggtgg

SEQ ID NO: 3871694 - DNA, 22 bp, Homo sapiens
gtggccaatccaggtgggagag

SEQ ID NO: 3871695 - DNA, 16 bp, Homo sapiens
gtggccacaccacagc

SEQ ID NO: 3871696 - DNA, 16 bp, Homo sapiens
gtggccactttaagag

SEQ ID NO: 3871697 - DNA, 13 bp, Homo sapiens
gtggccagagctg

SEQ ID NO: 3871698 - DNA, 17 bp, Homo sapiens
gtggccagagctgggag

SEQ ID NO: 3871699 - DNA, 18 bp, Homo sapiens
gtggccatcagggtgggc

SEQ ID NO: 3871700 - DNA, 15 bp, Homo sapiens
gtggccatccctggg

SEQ ID NO: 3871701 - DNA, 20 bp, Homo sapiens
gtggccatccctgggcccct

SEQ ID NO: 3871702 - DNA, 21 bp, Homo sapiens
gtggccatccctgggcccctc

SEQ ID NO: 3871703 - DNA, 22 bp, Homo sapiens
gtggcccaagcctggtctcctc

SEQ ID NO: 3871704 - DNA, 14 bp, Homo sapiens
gtggccccaggtgc

SEQ ID NO: 3871705 - DNA, 16 bp, Homo sapiens
gtggccccaggtgcca

SEQ ID NO: 3871706 - DNA, 19 bp, Homo sapiens
gtggcccgacagcctggca

SEQ ID NO: 3871707 - DNA, 13 bp, Homo sapiens
gtggcccttcctg

SEQ ID NO: 3871708 - DNA, 14 bp, Homo sapiens
gtggcccttcctgg

SEQ ID NO: 3871709 - DNA, 18 bp, Homo sapiens
gtggcccttcctggacag

SEQ ID NO: 3871710 - DNA, 22 bp, Homo sapiens
gtggccgcaagcgcagggagga

SEQ ID NO: 3871711 - DNA, 16 bp, Homo sapiens
gtggcctcacttccct

SEQ ID NO: 3871712 - DNA, 19 bp, Homo sapiens
gtggcctcacttccctggg

SEQ ID NO: 3871713 - DNA, 12 bp, Homo sapiens
gtggcctcagcc

SEQ ID NO: 3871714 - DNA, 14 bp, Homo sapiens
gtggcctcagccct

SEQ ID NO: 3871715 - DNA, 16 bp, Homo sapiens
gtggcctcagccctca

SEQ ID NO: 3871716 - DNA, 20 bp, Homo sapiens
gtggcctgcggccgggctgc

SEQ ID NO: 3871717 - DNA, 22 bp, Homo sapiens
gtggcctgcggccgggctgccc

SEQ ID NO: 3871718 - DNA, 16 bp, Homo sapiens
gtggcctgtgtccagc

SEQ ID NO: 3871719 - DNA, 20 bp, Homo sapiens
gtggcctgtgtccagcagct

SEQ ID NO: 3871720 - DNA, 21 bp, Homo sapiens
gtggcctgtgtccagcagctg

SEQ ID NO: 3871721 - DNA, 20 bp, Homo sapiens
gtggccttgttctgtcacca

SEQ ID NO: 3871722 - DNA, 15 bp, Homo sapiens
gtggctactctgtgc

SEQ ID NO: 3871723 - DNA, 16 bp, Homo sapiens
gtggctactctgtgcc

SEQ ID NO: 3871724 - DNA, 18 bp, Homo sapiens
gtggctactctgtgccag

SEQ ID NO: 3871725 - DNA, 20 bp, Homo sapiens
gtggctactctgtgccagag

SEQ ID NO: 3871726 - DNA, 22 bp, Homo sapiens
gtggctactctgtgccagagcc

SEQ ID NO: 3871727 - DNA, 22 bp, Homo sapiens
gtggctcacgcctgtaatccca

SEQ ID NO: 3871728 - DNA, 15 bp, Homo sapiens
gtggctcgctccctg

SEQ ID NO: 3871729 - DNA, 17 bp, Homo sapiens
gtggctgacccagtccc

SEQ ID NO: 3871730 - DNA, 12 bp, Homo sapiens
gtggctgtggca

SEQ ID NO: 3871731 - DNA, 15 bp, Homo sapiens
gtggctgtggcacag

SEQ ID NO: 3871732 - DNA, 22 bp, Homo sapiens
gtggcttacaaattctacagca

SEQ ID NO: 3871733 - DNA, 21 bp, Homo sapiens
gtggcttgtgattctgggatg

SEQ ID NO: 3871734 - DNA, 16 bp, Homo sapiens
gtgggaaagggacccg

SEQ ID NO: 3871735 - DNA, 12 bp, Homo sapiens
gtgggaacattc

SEQ ID NO: 3871736 - DNA, 17 bp, Homo sapiens
gtgggaacgtgactgcc

SEQ ID NO: 3871737 - DNA, 12 bp, Homo sapiens
gtgggaagagaa

SEQ ID NO: 3871738 - DNA, 17 bp, Homo sapiens
gtgggaagcgtctgtcc

SEQ ID NO: 3871739 - DNA, 15 bp, Homo sapiens
gtgggaagcttgctg

SEQ ID NO: 3871740 - DNA, 14 bp, Homo sapiens
gtgggaagggagag

SEQ ID NO: 3871741 - DNA, 17 bp, Homo sapiens
gtgggaagtgaagcccc

SEQ ID NO: 3871742 - DNA, 20 bp, Homo sapiens
gtgggacaaaccagagcaga

SEQ ID NO: 3871743 - DNA, 14 bp, Homo sapiens
gtgggacagcccca

SEQ ID NO: 3871744 - DNA, 19 bp, Homo sapiens
gtgggacagccccagggcc

SEQ ID NO: 3871745 - DNA, 21 bp, Homo sapiens
gtgggacagccccagggccct

SEQ ID NO: 3871746 - DNA, 14 bp, Homo sapiens
gtgggagacaagga

SEQ ID NO: 3871747 - DNA, 12 bp, Homo sapiens
gtgggaggaaga

SEQ ID NO: 3871748 - DNA, 14 bp, Homo sapiens
gtgggagggagcag

SEQ ID NO: 3871749 - DNA, 13 bp, Homo sapiens
gtgggagggggag

SEQ ID NO: 3871750 - DNA, 17 bp, Homo sapiens
gtgggaggtgagaccac

SEQ ID NO: 3871751 - DNA, 16 bp, Homo sapiens
gtgggatggaggagaa

SEQ ID NO: 3871752 - DNA, 17 bp, Homo sapiens
gtgggatggaggagaag

SEQ ID NO: 3871753 - DNA, 16 bp, Homo sapiens
gtgggcagcaccctcc

SEQ ID NO: 3871754 - DNA, 17 bp, Homo sapiens
gtgggcagcaccctccc

SEQ ID NO: 3871755 - DNA, 12 bp, Homo sapiens
gtgggcagctgg

SEQ ID NO: 3871756 - DNA, 15 bp, Homo sapiens
gtgggcagctgggcc

SEQ ID NO: 3871757 - DNA, 17 bp, Homo sapiens
gtgggcagctgggcccc

SEQ ID NO: 3871758 - DNA, 14 bp, Homo sapiens
gtgggccaggacag

SEQ ID NO: 3871759 - DNA, 13 bp, Homo sapiens
gtgggcctggcct

SEQ ID NO: 3871760 - DNA, 20 bp, Homo sapiens
gtgggcctggcctgagctgg

SEQ ID NO: 3871761 - DNA, 13 bp, Homo sapiens
gtgggctggccca

SEQ ID NO: 3871762 - DNA, 14 bp, Homo sapiens
gtgggctggcccag

SEQ ID NO: 3871763 - DNA, 15 bp, Homo sapiens
gtgggcttggccttg

SEQ ID NO: 3871764 - DNA, 17 bp, Homo sapiens
gtggggcagctcctctg

SEQ ID NO: 3871765 - DNA, 14 bp, Homo sapiens
gtggggcctgatgg

SEQ ID NO: 3871766 - DNA, 14 bp, Homo sapiens
gtggggctgctcct

SEQ ID NO: 3871767 - DNA, 16 bp, Homo sapiens
gtggggctgctcctcc

SEQ ID NO: 3871768 - DNA, 17 bp, Homo sapiens
gtggggctgctcctcca

SEQ ID NO: 3871769 - DNA, 17 bp, Homo sapiens
gtgagcccctggtcctg

SEQ ID NO: 3871770 - DNA, 16 bp, Homo sapiens
gtgagctgggaagctg

SEQ ID NO: 3871771 - DNA, 13 bp, Homo sapiens
gtgaggcctggcc

SEQ ID NO: 3871772 - DNA, 15 bp, Homo sapiens
gtgaggctgggccag

SEQ ID NO: 3871773 - DNA, 17 bp, Homo sapiens
gtgagtggcagccatgc

SEQ ID NO: 3871774 - DNA, 13 bp, Homo sapiens
gtgataagtggaa

SEQ ID NO: 3871775 - DNA, 15 bp, Homo sapiens
gtgataagtggaaaa

SEQ ID NO: 3871776 - DNA, 16 bp, Homo sapiens
gtgataagtggaaaaa

SEQ ID NO: 3871777 - DNA, 19 bp, Homo sapiens
gtgatatcacctctcttca

SEQ ID NO: 3871778 - DNA, 21 bp, Homo sapiens
gtgatcagaaggctggggcca

SEQ ID NO: 3871779 - DNA, 15 bp, Homo sapiens
gtgatgaactttctc

SEQ ID NO: 3871780 - DNA, 22 bp, Homo sapiens
gtgatgagggcagcagccagcc

SEQ ID NO: 3871781 - DNA, 21 bp, Homo sapiens
gtgatgctggtaccactggaa

SEQ ID NO: 3871782 - DNA, 22 bp, Homo sapiens
gtgattagagggaggagaatga

SEQ ID NO: 3871783 - DNA, 13 bp, Homo sapiens
gtgattctgggat

SEQ ID NO: 3871784 - DNA, 13 bp, Homo sapiens
gtgattttgtaca

SEQ ID NO: 3871785 - DNA, 20 bp, Homo sapiens
gtgattttgtacagaatttt

SEQ ID NO: 3871786 - DNA, 22 bp, Homo sapiens
gtgcaaagttccctacttcctg

SEQ ID NO: 3871787 - DNA, 22 bp, Homo sapiens
gtgcaaatactccaagcttcaa

SEQ ID NO: 3871788 - DNA, 17 bp, Homo sapiens
gtgcaaatggaagacaa

SEQ ID NO: 3871789 - DNA, 13 bp, Homo sapiens
gtgcaaattttgc

SEQ ID NO: 3871790 - DNA, 13 bp, Homo sapiens
gtgcaagagacag

SEQ ID NO: 3871791 - DNA, 17 bp, Homo sapiens
gtgcaagagacagagcc

SEQ ID NO: 3871792 - DNA, 19 bp, Homo sapiens
gtgcaagagacagagcccc

SEQ ID NO: 3871793 - DNA, 22 bp, Homo sapiens
gtgcaagagactctggcctcca

SEQ ID NO: 3871794 - DNA, 15 bp, Homo sapiens
gtgcaaggggctcag

SEQ ID NO: 3871795 - DNA, 15 bp, Homo sapiens
gtgcaatgagccaga

SEQ ID NO: 3871796 - DNA, 15 bp, Homo sapiens
gtgcacaaatattta

SEQ ID NO: 3871797 - DNA, 14 bp, Homo sapiens
gtgcacaatgggca

SEQ ID NO: 3871798 - DNA, 21 bp, Homo sapiens
gtgcacacagaaatatatata

SEQ ID NO: 3871799 - DNA, 13 bp, Homo sapiens
gtgcacaggaggg

SEQ ID NO: 3871800 - DNA, 14 bp, Homo sapiens
gtgcacaggagggg

SEQ ID NO: 3871801 - DNA, 15 bp, Homo sapiens
gtgcacatgtgtctg

SEQ ID NO: 3871802 - DNA, 18 bp, Homo sapiens
gtgcacatgtgtctgtgt

SEQ ID NO: 3871803 - DNA, 22 bp, Homo sapiens
gtgcaccaccatgccaggctaa

SEQ ID NO: 3871804 - DNA, 19 bp, Homo sapiens
gtgcacccactcaccaggg

SEQ ID NO: 3871805 - DNA, 20 bp, Homo sapiens
gtgcacccactcaccagggt

SEQ ID NO: 3871806 - DNA, 19 bp, Homo sapiens
gtgcaccttacattcctag

SEQ ID NO: 3871807 - DNA, 20 bp, Homo sapiens
gtgcaccttacattcctaga

SEQ ID NO: 3871808 - DNA, 21 bp, Homo sapiens
gtgcaccttaccaactttctg

SEQ ID NO: 3871809 - DNA, 15 bp, Homo sapiens
gtgcacggccagctg

SEQ ID NO: 3871810 - DNA, 13 bp, Homo sapiens
gtgcactggcccc

SEQ ID NO: 3871811 - DNA, 17 bp, Homo sapiens
gtgcactggccccaccc

SEQ ID NO: 3871812 - DNA, 17 bp, Homo sapiens
gtgcagaggtttcttga

SEQ ID NO: 3871813 - DNA, 19 bp, Homo sapiens
gtgcagcccttcctcctga

SEQ ID NO: 3871814 - DNA, 18 bp, Homo sapiens
gtgcaggcctgctcaggg

SEQ ID NO: 3871815 - DNA, 17 bp, Homo sapiens
gtgcagggacaaagagg

SEQ ID NO: 3871816 - DNA, 15 bp, Homo sapiens
gtgcagtcccgtgga

SEQ ID NO: 3871817 - DNA, 17 bp, Homo sapiens
gtgcagtgatacatgta

SEQ ID NO: 3871818 - DNA, 13 bp, Homo sapiens
gtgcatctcagcc

SEQ ID NO: 3871819 - DNA, 15 bp, Homo sapiens
gtgcatgaaagagaa

SEQ ID NO: 3871820 - DNA, 21 bp, Homo sapiens
gtgcatgctctctgcagccag

SEQ ID NO: 3871821 - DNA, 19 bp, Homo sapiens
gtgcatggcttggggagca

SEQ ID NO: 3871822 - DNA, 22 bp, Homo sapiens
gtgcatgtatgtgcacatgtgt

SEQ ID NO: 3871823 - DNA, 14 bp, Homo sapiens
gtgcatgtatgtgt

SEQ ID NO: 3871824 - DNA, 10 bp, Homo sapiens
gtgccacaga

SEQ ID NO: 3871825 - DNA, 15 bp, Homo sapiens
gtgccacagagaaga

SEQ ID NO: 3871826 - DNA, 14 bp, Homo sapiens
gtgccaccaataaa

SEQ ID NO: 3871827 - DNA, 15 bp, Homo sapiens
gtgccaccaataaaa

SEQ ID NO: 3871828 - DNA, 21 bp, Homo sapiens
gtgccacttcttaaaggcctg

SEQ ID NO: 3871829 - DNA, 15 bp, Homo sapiens
gtgccagagcctggg

SEQ ID NO: 3871830 - DNA, 13 bp, Homo sapiens
gtgccagctcagg

SEQ ID NO: 3871831 - DNA, 15 bp, Homo sapiens
gtgccagctctagtt

SEQ ID NO: 3871832 - DNA, 21 bp, Homo sapiens
gtgccaggactccccaggcca

SEQ ID NO: 3871833 - DNA, 12 bp, Homo sapiens
gtgccaggcccg

SEQ ID NO: 3871834 - DNA, 17 bp, Homo sapiens
gtgccaggcccggggct

SEQ ID NO: 3871835 - DNA, 19 bp, Homo sapiens
gtgccaggcccggggctgg

SEQ ID NO: 3871836 - DNA, 17 bp, Homo sapiens
gtgccaggctgtaagca

SEQ ID NO: 3871837 - DNA, 18 bp, Homo sapiens
gtgccatgtggagtggac

SEQ ID NO: 3871838 - DNA, 16 bp, Homo sapiens
gtgccattcccagcgt

SEQ ID NO: 3871839 - DNA, 20 bp, Homo sapiens
gtgcccaagaatagatgctg

SEQ ID NO: 3871840 - DNA, 15 bp, Homo sapiens
gtgcccacatcccag

SEQ ID NO: 3871841 - DNA, 14 bp, Homo sapiens
gtgcccagctaatt

SEQ ID NO: 3871842 - DNA, 16 bp, Homo sapiens
gtgcccccacccagtc

SEQ ID NO: 3871843 - DNA, 22 bp, Homo sapiens
gtgccctctggatcctgctgtg

SEQ ID NO: 3871844 - DNA, 18 bp, Homo sapiens
gtgccctgacccctgcac

SEQ ID NO: 3871845 - DNA, 18 bp, Homo sapiens
gtgccgttactctccaac

SEQ ID NO: 3871846 - DNA, 21 bp, Homo sapiens
gtgccgttactctccaacctg

SEQ ID NO: 3871847 - DNA, 17 bp, Homo sapiens
gtgcctaatggagaaga

SEQ ID NO: 3871848 - DNA, 20 bp, Homo sapiens
gtgcctaatggagaagaccc

SEQ ID NO: 3871849 - DNA, 16 bp, Homo sapiens
gtgcctatttattggg

SEQ ID NO: 3871850 - DNA, 16 bp, Homo sapiens
gtgcctcagagcaggc

SEQ ID NO: 3871851 - DNA, 19 bp, Homo sapiens
gtgcctcagcctcctaagc

SEQ ID NO: 3871852 - DNA, 14 bp, Homo sapiens
gtgcctcgaggcac

SEQ ID NO: 3871853 - DNA, 16 bp, Homo sapiens
gtgcctcgaggcaccg

SEQ ID NO: 3871854 - DNA, 22 bp, Homo sapiens
gtgcctcgaggcaccggcgctg

SEQ ID NO: 3871855 - DNA, 12 bp, Homo sapiens
gtgcctctgcct

SEQ ID NO: 3871856 - DNA, 15 bp, Homo sapiens
gtgcctctgcctgtc

SEQ ID NO: 3871857 - DNA, 23 bp, Homo sapiens
gtgcctgagctggggcctggaga

SEQ ID NO: 3871858 - DNA, 14 bp, Homo sapiens
gtgcctgccctgga

SEQ ID NO: 3871859 - DNA, 16 bp, Homo sapiens
gtgcctgctagagcaa

SEQ ID NO: 3871860 - DNA, 22 bp, Homo sapiens
gtgcctggacatttgccttgct

SEQ ID NO: 3871861 - DNA, 18 bp, Homo sapiens
gtgcctggcgcccctgcc

SEQ ID NO: 3871862 - DNA, 17 bp, Homo sapiens
gtgcctgtgaggcaggg

SEQ ID NO: 3871863 - DNA, 14 bp, Homo sapiens
gtgcctgtggcaga

SEQ ID NO: 3871864 - DNA, 15 bp, Homo sapiens
gtgccttcagctcta

SEQ ID NO: 3871865 - DNA, 14 bp, Homo sapiens
gtgccttttatagc

SEQ ID NO: 3871866 - DNA, 17 bp, Homo sapiens
gtgcgacttcacaaaat

SEQ ID NO: 3871867 - DNA, 18 bp, Homo sapiens
gtgcgctcttggtccctg

SEQ ID NO: 3871868 - DNA, 20 bp, Homo sapiens
gtgcggcaggagcaggaaca

SEQ ID NO: 3871869 - DNA, 16 bp, Homo sapiens
gtgcgtggctgtggca

SEQ ID NO: 3871870 - DNA, 17 bp, Homo sapiens
gtgcgtgttagtgtgtg

SEQ ID NO: 3871871 - DNA, 15 bp, Homo sapiens
gtgcgttggaatcac

SEQ ID NO: 3871872 - DNA, 22 bp, Homo sapiens
gtgcgttggaatcacctggagg

SEQ ID NO: 3871873 - DNA, 21 bp, Homo sapiens
gtgctacaaaaacacagcaag

SEQ ID NO: 3871874 - DNA, 16 bp, Homo sapiens
gtgctataggctggag

SEQ ID NO: 3871875 - DNA, 17 bp, Homo sapiens
gtgctattgaactgagc

SEQ ID NO: 3871876 - DNA, 18 bp, Homo sapiens
gtgctcgcccacaaactg

SEQ ID NO: 3871877 - DNA, 18 bp, Homo sapiens
gtgctcgcttctcctcca

SEQ ID NO: 3871878 - DNA, 14 bp, Homo sapiens
gtgctctggcggct

SEQ ID NO: 3871879 - DNA, 19 bp, Homo sapiens
gtgctctggcggcttcctg

SEQ ID NO: 3871880 - DNA, 22 bp, Homo sapiens
gtgctctggcggcttcctgtcc

SEQ ID NO: 3871881 - DNA, 13 bp, Homo sapiens
gtgctctttgaag

SEQ ID NO: 3871882 - DNA, 15 bp, Homo sapiens
gtgctgattcagcct

SEQ ID NO: 3871883 - DNA, 12 bp, Homo sapiens
gtgctgccacac

SEQ ID NO: 3871884 - DNA, 12 bp, Homo sapiens
gtgctgccatgc

SEQ ID NO: 3871885 - DNA, 14 bp, Homo sapiens
gtgctgccatgcca

SEQ ID NO: 3871886 - DNA, 16 bp, Homo sapiens
gtgctgccatgccact

SEQ ID NO: 3871887 - DNA, 21 bp, Homo sapiens
gtgctgccatgccactgccag

SEQ ID NO: 3871888 - DNA, 11 bp, Homo sapiens
gtgctgccctg

SEQ ID NO: 3871889 - DNA, 17 bp, Homo sapiens
gtgctgccctgctctgg

SEQ ID NO: 3871890 - DNA, 13 bp, Homo sapiens
gtgctggagctgg

SEQ ID NO: 3871891 - DNA, 16 bp, Homo sapiens
gtgctggagctggctt

SEQ ID NO: 3871892 - DNA, 21 bp, Homo sapiens
gtgctggatattttactacca

SEQ ID NO: 3871893 - DNA, 20 bp, Homo sapiens
gtgctgtacccttccacctc

SEQ ID NO: 3871894 - DNA, 17 bp, Homo sapiens
gtgctgtggccagggtg

SEQ ID NO: 3871895 - DNA, 17 bp, Homo sapiens
gtgctgtgggcagcacc

SEQ ID NO: 3871896 - DNA, 19 bp, Homo sapiens
gtgctgtgggcagcaccct

SEQ ID NO: 3871897 - DNA, 13 bp, Homo sapiens
gtgctgtttgaga

SEQ ID NO: 3871898 - DNA, 15 bp, Homo sapiens
gtgcttacagtgact

SEQ ID NO: 3871899 - DNA, 16 bp, Homo sapiens
gtgcttcaacattctt

SEQ ID NO: 3871900 - DNA, 20 bp, Homo sapiens
gtgcttccctaggctgagct

SEQ ID NO: 3871901 - DNA, 21 bp, Homo sapiens
gtgcttgggtggtgggtgctg

SEQ ID NO: 3871902 - DNA, 23 bp, Homo sapiens
gtgcttggtggggctcgtggcct

SEQ ID NO: 3871903 - DNA, 15 bp, Homo sapiens
gtgcttttaaatgca

SEQ ID NO: 3871904 - DNA, 20 bp, Homo sapiens
gtggaaatgagcgaaatcat

SEQ ID NO: 3871905 - DNA, 15 bp, Homo sapiens
gtggaagagcagcct

SEQ ID NO: 3871906 - DNA, 16 bp, Homo sapiens
gtggaagggggtgtgc

SEQ ID NO: 3871907 - DNA, 18 bp, Homo sapiens
gtggaagggggtgtgcgt

SEQ ID NO: 3871908 - DNA, 12 bp, Homo sapiens
gtggacacctgc

SEQ ID NO: 3871909 - DNA, 14 bp, Homo sapiens
gtggacacctgccc

SEQ ID NO: 3871910 - DNA, 16 bp, Homo sapiens
gtggacacctgccctg

SEQ ID NO: 3871911 - DNA, 14 bp, Homo sapiens
gtggaccaggacag

SEQ ID NO: 3871912 - DNA, 14 bp, Homo sapiens
gtggaccttcctgc

SEQ ID NO: 3871913 - DNA, 20 bp, Homo sapiens
gtggacgcaattgtgggatg

SEQ ID NO: 3871914 - DNA, 22 bp, Homo sapiens
gtggagaaattccttgattcac

SEQ ID NO: 3871915 - DNA, 22 bp, Homo sapiens
gtggagagaaagccaaggctgc

SEQ ID NO: 3871916 - DNA, 14 bp, Homo sapiens
gtggagagtgttcc

SEQ ID NO: 3871917 - DNA, 14 bp, Homo sapiens
gtggaggaggcctg

SEQ ID NO: 3871918 - DNA, 12 bp, Homo sapiens
gtggaggcctga

SEQ ID NO: 3871919 - DNA, 16 bp, Homo sapiens
gtggaggcctgatgct

SEQ ID NO: 3871920 - DNA, 12 bp, Homo sapiens
gtggaggctgct

SEQ ID NO: 3871921 - DNA, 13 bp, Homo sapiens
gtggaggctgctc

SEQ ID NO: 3871922 - DNA, 14 bp, Homo sapiens
gtggaggctgctcg

SEQ ID NO: 3871923 - DNA, 16 bp, Homo sapiens
gtggaggttgcagtga

SEQ ID NO: 3871924 - DNA, 13 bp, Homo sapiens
gtggagtctgagt

SEQ ID NO: 3871925 - DNA, 15 bp, Homo sapiens
gtggataagggagag

SEQ ID NO: 3871926 - DNA, 14 bp, Homo sapiens
gtggatcacagagg

SEQ ID NO: 3871927 - DNA, 16 bp, Homo sapiens
gtggatcacagaggct

SEQ ID NO: 3871928 - DNA, 15 bp, Homo sapiens
gtggatcacctgagg

SEQ ID NO: 3871929 - DNA, 16 bp, Homo sapiens
gtggatcatgaaaagt

SEQ ID NO: 3871930 - DNA, 19 bp, Homo sapiens
gtggatcatgaggtcagga

SEQ ID NO: 3871931 - DNA, 18 bp, Homo sapiens
gtggatctccaaggacca

SEQ ID NO: 3871932 - DNA, 19 bp, Homo sapiens
gtggatggaggagaaataa

SEQ ID NO: 3871933 - DNA, 20 bp, Homo sapiens
gtggatggaggagaaataaa

SEQ ID NO: 3871934 - DNA, 16 bp, Homo sapiens
gtggatggatggacag

SEQ ID NO: 3871935 - DNA, 17 bp, Homo sapiens
gtggatgtgtaaatgga

SEQ ID NO: 3871936 - DNA, 19 bp, Homo sapiens
gtggattcctgggcaagaa

SEQ ID NO: 3871937 - DNA, 19 bp, Homo sapiens
gtggatttcctattttaaa

SEQ ID NO: 3871938 - DNA, 23 bp, Homo sapiens
gtggatttcctattttaaaacca

SEQ ID NO: 3871939 - DNA, 16 bp, Homo sapiens
gtggcaagggggcggg

SEQ ID NO: 3871940 - DNA, 14 bp, Homo sapiens
gtggcaccagatgc

SEQ ID NO: 3871941 - DNA, 13 bp, Homo sapiens
gtggcacctcctg

SEQ ID NO: 3871942 - DNA, 14 bp, Homo sapiens
gtgggggagggagg

SEQ ID NO: 3871943 - DNA, 12 bp, Homo sapiens
gtgggggtggcc

SEQ ID NO: 3871944 - DNA, 22 bp, Homo sapiens
gtggggtacatttctctgagca

SEQ ID NO: 3871945 - DNA, 19 bp, Homo sapiens
gtggggtctccctctcctg

SEQ ID NO: 3871946 - DNA, 19 bp, Homo sapiens
gtgggtatttcctgctaca

SEQ ID NO: 3871947 - DNA, 12 bp, Homo sapiens
gtgggtccagga

SEQ ID NO: 3871948 - DNA, 18 bp, Homo sapiens
gtgggtccaggaaggcag

SEQ ID NO: 3871949 - DNA, 20 bp, Homo sapiens
gtgggtccaggaaggcagct

SEQ ID NO: 3871950 - DNA, 14 bp, Homo sapiens
gtgggtctggggag

SEQ ID NO: 3871951 - DNA, 19 bp, Homo sapiens
gtgggtctggggagggaga

SEQ ID NO: 3871952 - DNA, 24 bp, Homo sapiens
gtgggtgatcagaaggctggggcc

SEQ ID NO: 3871953 - DNA, 17 bp, Homo sapiens
gtgggtggcacctcctg

SEQ ID NO: 3871954 - DNA, 19 bp, Homo sapiens
gtggtagaaccacttggct

SEQ ID NO: 3871955 - DNA, 19 bp, Homo sapiens
gtggtatatttgtgtatgt

SEQ ID NO: 3871956 - DNA, 23 bp, Homo sapiens
gtggtctccttgcactttctcag

SEQ ID NO: 3871957 - DNA, 24 bp, Homo sapiens
gtggtcttggaagtgtgtggaagg

SEQ ID NO: 3871958 - DNA, 19 bp, Homo sapiens
gtggtgactgaacgaggga

SEQ ID NO: 3871959 - DNA, 14 bp, Homo sapiens
gtggtgccagaggt

SEQ ID NO: 3871960 - DNA, 20 bp, Homo sapiens
gtggttctaatatttttagc

SEQ ID NO: 3871961 - DNA, 21 bp, Homo sapiens
gtggtttgatggtgacttcct

SEQ ID NO: 3871962 - DNA, 23 bp, Homo sapiens
gtgtaaaacgagaatccacccat

SEQ ID NO: 3871963 - DNA, 17 bp, Homo sapiens
gtgtaaatgtggacaca

SEQ ID NO: 3871964 - DNA, 14 bp, Homo sapiens
gtgtaagcattgta

SEQ ID NO: 3871965 - DNA, 14 bp, Homo sapiens
gtgtaatgcacaat

SEQ ID NO: 3871966 - DNA, 14 bp, Homo sapiens
gtgtagctcctctg

SEQ ID NO: 3871967 - DNA, 16 bp, Homo sapiens
gtgtagctgtgacctg

SEQ ID NO: 3871968 - DNA, 23 bp, Homo sapiens
gtgtagctgtgacctgctgagct

SEQ ID NO: 3871969 - DNA, 22 bp, Homo sapiens
gtgtagtggaagagcagcctga

SEQ ID NO: 3871970 - DNA, 23 bp, Homo sapiens
gtgtagtggaagagcagcctgat

SEQ ID NO: 3871971 - DNA, 14 bp, Homo sapiens
gtgtatatatacat

SEQ ID NO: 3871972 - DNA, 16 bp, Homo sapiens
gtgtatatatacatac

SEQ ID NO: 3871973 - DNA, 20 bp, Homo sapiens
gtgtatttattgaagaaaca

SEQ ID NO: 3871974 - DNA, 17 bp, Homo sapiens
gtgtatttgtatgtact

SEQ ID NO: 3871975 - DNA, 13 bp, Homo sapiens
gtgtcaggcaggt

SEQ ID NO: 3871976 - DNA, 14 bp, Homo sapiens
gtgtcaggcaggtt

SEQ ID NO: 3871977 - DNA, 22 bp, Homo sapiens
gtgtccaattatgcactggcca

SEQ ID NO: 3871978 - DNA, 13 bp, Homo sapiens
gtgtccagcagct

SEQ ID NO: 3871979 - DNA, 15 bp, Homo sapiens
gtgtcccaaggagct

SEQ ID NO: 3871980 - DNA, 18 bp, Homo sapiens
gtgtcccaaggagctgat

SEQ ID NO: 3871981 - DNA, 21 bp, Homo sapiens
gtgtcccctcactctgtcagc

SEQ ID NO: 3871982 - DNA, 15 bp, Homo sapiens
gtgtcctctcccctc

SEQ ID NO: 3871983 - DNA, 17 bp, Homo sapiens
gtgtccttgcacctgca

SEQ ID NO: 3871984 - DNA, 14 bp, Homo sapiens
gtgtctctcccacc

SEQ ID NO: 3871985 - DNA, 23 bp, Homo sapiens
gtgtctgcattgttattgtggaa

SEQ ID NO: 3871986 - DNA, 15 bp, Homo sapiens
gtgtctgctcagtaa

SEQ ID NO: 3871987 - DNA, 13 bp, Homo sapiens
gtgtctgtctttg

SEQ ID NO: 3871988 - DNA, 22 bp, Homo sapiens
gtgtcttaattaaaagaatatt

SEQ ID NO: 3871989 - DNA, 13 bp, Homo sapiens
gtgtgaaaatggg

SEQ ID NO: 3871990 - DNA, 17 bp, Homo sapiens
gtgtgaattctgcaact

SEQ ID NO: 3871991 - DNA, 15 bp, Homo sapiens
gtgtgaggctgggcc

SEQ ID NO: 3871992 - DNA, 20 bp, Homo sapiens
gtgtgagtggcagccatgcc

SEQ ID NO: 3871993 - DNA, 21 bp, Homo sapiens
gtgtgagtggcagccatgcct

SEQ ID NO: 3871994 - DNA, 17 bp, Homo sapiens
gtgtgatgaactttctc

SEQ ID NO: 3871995 - DNA, 12 bp, Homo sapiens
gtgtgcatgtgt

SEQ ID NO: 3871996 - DNA, 18 bp, Homo sapiens
gtgtgctgtgctgtgtct

SEQ ID NO: 3871997 - DNA, 12 bp, Homo sapiens
gtgtggcctcag

SEQ ID NO: 3871998 - DNA, 15 bp, Homo sapiens
gtgtggcctcagccc

SEQ ID NO: 3871999 - DNA, 13 bp, Homo sapiens
gtgtggggcatgg

SEQ ID NO: 3872000 - DNA, 18 bp, Homo sapiens
gtgtgggtctggggaggg

SEQ ID NO: 3872001 - DNA, 14 bp, Homo sapiens
gtgtggtggctcat

SEQ ID NO: 3872002 - DNA, 23 bp, Homo sapiens
gtgtgtatatatgtgtatatata

SEQ ID NO: 3872003 - DNA, 18 bp, Homo sapiens
gtgtgtatgtatgtgtgt

SEQ ID NO: 3872004 - DNA, 15 bp, Homo sapiens
gtgtgtatgtgtatt

SEQ ID NO: 3872005 - DNA, 20 bp, Homo sapiens
gtgtgtccttggggcacagt

SEQ ID NO: 3872006 - DNA, 13 bp, Homo sapiens
gtgtgtctgaaga

SEQ ID NO: 3872007 - DNA, 15 bp, Homo sapiens
gtgtgtctgaagact

SEQ ID NO: 3872008 - DNA, 18 bp, Homo sapiens
gtgtgtctgtctttgtgg

SEQ ID NO: 3872009 - DNA, 22 bp, Homo sapiens
gtgtgtctgttcacttttcctc

SEQ ID NO: 3872010 - DNA, 20 bp, Homo sapiens
gtgtgtggaaggcagggaca

SEQ ID NO: 3872011 - DNA, 14 bp, Homo sapiens
gtgtgtgtctgtct

SEQ ID NO: 3872012 - DNA, 13 bp, Homo sapiens
gtgtgtgtgcatg

SEQ ID NO: 3872013 - DNA, 14 bp, Homo sapiens
gtgtgtgtgcatgt

SEQ ID NO: 3872014 - DNA, 11 bp, Homo sapiens
gtgtgtgtgtg

SEQ ID NO: 3872015 - DNA, 21 bp, Homo sapiens
gtgtgttctgtaatggaactg

SEQ ID NO: 3872016 - DNA, 15 bp, Homo sapiens
gtgtgtttaaataaa

SEQ ID NO: 3872017 - DNA, 16 bp, Homo sapiens
gtgttacaaggcactt

SEQ ID NO: 3872018 - DNA, 21 bp, Homo sapiens
gtgttacacagcccaagagga

SEQ ID NO: 3872019 - DNA, 20 bp, Homo sapiens
gtgttcacactgtaaacatt

SEQ ID NO: 3872020 - DNA, 18 bp, Homo sapiens
gtgttccagctgcctggg

SEQ ID NO: 3872021 - DNA, 14 bp, Homo sapiens
gtgttctctcttat

SEQ ID NO: 3872022 - DNA, 14 bp, Homo sapiens
gtgttctgtttccc

SEQ ID NO: 3872023 - DNA, 12 bp, Homo sapiens
gtgttgtacaat

SEQ ID NO: 3872024 - DNA, 16 bp, Homo sapiens
gtgtttaaataaagta

SEQ ID NO: 3872025 - DNA, 18 bp, Homo sapiens
gtgttttctgaataacat

SEQ ID NO: 3872026 - DNA, 19 bp, Homo sapiens
gtgttttctgaataacatt

SEQ ID NO: 3872027 - DNA, 17 bp, Homo sapiens
gttaaaaatcagctggg

SEQ ID NO: 3872028 - DNA, 22 bp, Homo sapiens
gttaaaagactgcagctgctga

SEQ ID NO: 3872029 - DNA, 16 bp, Homo sapiens
gttaaaagatgaaaat

SEQ ID NO: 3872030 - DNA, 20 bp, Homo sapiens
gttaaaagatgaaaatattt

SEQ ID NO: 3872031 - DNA, 15 bp, Homo sapiens
gttaaaataaagcct

SEQ ID NO: 3872032 - DNA, 22 bp, Homo sapiens
gttaaaataaagcctatttttc

SEQ ID NO: 3872033 - DNA, 21 bp, Homo sapiens
gttaaaataactagtgttgct

SEQ ID NO: 3872034 - DNA, 21 bp, Homo sapiens
gttaaaatataaattaagact

SEQ ID NO: 3872035 - DNA, 23 bp, Homo sapiens
gttaaaatataaattaagacttt

SEQ ID NO: 3872036 - DNA, 14 bp, Homo sapiens
gttaaaatgtacac

SEQ ID NO: 3872037 - DNA, 20 bp, Homo sapiens
gttaaagggcagaaggggaa

SEQ ID NO: 3872038 - DNA, 18 bp, Homo sapiens
gttaaatgcaggtatttt

SEQ ID NO: 3872039 - DNA, 23 bp, Homo sapiens
gttaacagagacagataactctc

SEQ ID NO: 3872040 - DNA, 15 bp, Homo sapiens
gttaacattaacatc

SEQ ID NO: 3872041 - DNA, 13 bp, Homo sapiens
gttaacattgttg

SEQ ID NO: 3872042 - DNA, 15 bp, Homo sapiens
gttaactctcccagg

SEQ ID NO: 3872043 - DNA, 17 bp, Homo sapiens
gttaactttaagactga

SEQ ID NO: 3872044 - DNA, 18 bp, Homo sapiens
gttaagaatggaagaaaa

SEQ ID NO: 3872045 - DNA, 14 bp, Homo sapiens
gttaagcaaaggaa

SEQ ID NO: 3872046 - DNA, 22 bp, Homo sapiens
gttaagggaaggaactctggct

SEQ ID NO: 3872047 - DNA, 21 bp, Homo sapiens
gttaatatatcccagaaatta

SEQ ID NO: 3872048 - DNA, 23 bp, Homo sapiens
gttaatgttgggatttatatcta

SEQ ID NO: 3872049 - DNA, 13 bp, Homo sapiens
gttacagaagctg

SEQ ID NO: 3872050 - DNA, 21 bp, Homo sapiens
gttacagcgagaggcagagaa

SEQ ID NO: 3872051 - DNA, 14 bp, Homo sapiens
gttacattaatgtt

SEQ ID NO: 3872052 - DNA, 13 bp, Homo sapiens
gttacccagagaa

SEQ ID NO: 3872053 - DNA, 13 bp, Homo sapiens
gttaccgaggacc

SEQ ID NO: 3872054 - DNA, 23 bp, Homo sapiens
gttacctttcccatgctgaatta

SEQ ID NO: 3872055 - DNA, 22 bp, Homo sapiens
gttacggagggaggacatcata

SEQ ID NO: 3872056 - DNA, 18 bp, Homo sapiens
gttactctccaacctgga

SEQ ID NO: 3872057 - DNA, 22 bp, Homo sapiens
gttactctccaacctggacaac

SEQ ID NO: 3872058 - DNA, 14 bp, Homo sapiens
gttactgattctcc

SEQ ID NO: 3872059 - DNA, 15 bp, Homo sapiens
gttactgttgcactg

SEQ ID NO: 3872060 - DNA, 18 bp, Homo sapiens
gttacttgtctgaggcct

SEQ ID NO: 3872061 - DNA, 20 bp, Homo sapiens
gttagaattttcctaaaaat

SEQ ID NO: 3872062 - DNA, 21 bp, Homo sapiens
gttagagaggtagcgagctgc

SEQ ID NO: 3872063 - DNA, 23 bp, Homo sapiens
gttagattcctcttgcctctctc

SEQ ID NO: 3872064 - DNA, 11 bp, Homo sapiens
gttagctggag

SEQ ID NO: 3872065 - DNA, 19 bp, Homo sapiens
gttaggaaataaaaccttt

SEQ ID NO: 3872066 - DNA, 21 bp, Homo sapiens
gttaggaaataaaacctttca

SEQ ID NO: 3872067 - DNA, 18 bp, Homo sapiens
gttaggaggctgcatgct

SEQ ID NO: 3872068 - DNA, 19 bp, Homo sapiens
gttaggaggctgcatgctc

SEQ ID NO: 3872069 - DNA, 22 bp, Homo sapiens
gttaggaggctgcatgctctgg

SEQ ID NO: 3872070 - DNA, 23 bp, Homo sapiens
gttaggaggctgcatgctctgga

SEQ ID NO: 3872071 - DNA, 15 bp, Homo sapiens
gttaggatttaacag

SEQ ID NO: 3872072 - DNA, 23 bp, Homo sapiens
gttagggtgctctggaagagagg

SEQ ID NO: 3872073 - DNA, 23 bp, Homo sapiens
gttagtgtgtgtgcatgtgtgtg

SEQ ID NO: 3872074 - DNA, 15 bp, Homo sapiens
gttatagtatatctg

SEQ ID NO: 3872075 - DNA, 21 bp, Homo sapiens
gttatatattgtattaagggc

SEQ ID NO: 3872076 - DNA, 23 bp, Homo sapiens
gttatatattgtattaagggcat

SEQ ID NO: 3872077 - DNA, 17 bp, Homo sapiens
gttatatattttttgta

SEQ ID NO: 3872078 - DNA, 13 bp, Homo sapiens
gttatcctgctag

SEQ ID NO: 3872079 - DNA, 20 bp, Homo sapiens
gttatctgcctggcctggct

SEQ ID NO: 3872080 - DNA, 17 bp, Homo sapiens
gttatgtatatagatgt

SEQ ID NO: 3872081 - DNA, 19 bp, Homo sapiens
gttatgtatatagatgtgc

SEQ ID NO: 3872082 - DNA, 14 bp, Homo sapiens
gttattaatattgt

SEQ ID NO: 3872083 - DNA, 15 bp, Homo sapiens
gttattgaaaatata

SEQ ID NO: 3872084 - DNA, 16 bp, Homo sapiens
gttattgatttttgta

SEQ ID NO: 3872085 - DNA, 20 bp, Homo sapiens
gttatttgtacagttcagtt

SEQ ID NO: 3872086 - DNA, 18 bp, Homo sapiens
gttatttgttattttcag

SEQ ID NO: 3872087 - DNA, 19 bp, Homo sapiens
gttattttaggagacagtc

SEQ ID NO: 3872088 - DNA, 20 bp, Homo sapiens
gttatttttgtccctgctcc

SEQ ID NO: 3872089 - DNA, 21 bp, Homo sapiens
gttatttttgtccctgctcct

SEQ ID NO: 3872090 - DNA, 14 bp, Homo sapiens
gttcaaaaagtcta

SEQ ID NO: 3872091 - DNA, 14 bp, Homo sapiens
gttcaaatcctcac

SEQ ID NO: 3872092 - DNA, 20 bp, Homo sapiens
gttcaacctggtggcaccag

SEQ ID NO: 3872093 - DNA, 18 bp, Homo sapiens
gttcaagaccagcctggc

SEQ ID NO: 3872094 - DNA, 14 bp, Homo sapiens
gttcaagcctgtgg

SEQ ID NO: 3872095 - DNA, 16 bp, Homo sapiens
gttcaagcctgtggga

SEQ ID NO: 3872096 - DNA, 18 bp, Homo sapiens
gttcacaacataaggaga

SEQ ID NO: 3872097 - DNA, 24 bp, Homo sapiens
gttcactctacttagcatgtccct

SEQ ID NO: 3872098 - DNA, 14 bp, Homo sapiens
gttcagaagaaatt

SEQ ID NO: 3872099 - DNA, 19 bp, Homo sapiens
gttcagccacaaagtagtt

SEQ ID NO: 3872100 - DNA, 23 bp, Homo sapiens
gttcagccaccctgaggcctctg

SEQ ID NO: 3872101 - DNA, 16 bp, Homo sapiens
gttcagcccctcctct

SEQ ID NO: 3872102 - DNA, 22 bp, Homo sapiens
gttcagctaagctaggaatgaa

SEQ ID NO: 3872103 - DNA, 16 bp, Homo sapiens
gttcagggaagcaggc

SEQ ID NO: 3872104 - DNA, 17 bp, Homo sapiens
gttcagggaagcaggca

SEQ ID NO: 3872105 - DNA, 20 bp, Homo sapiens
gttcagttcctctttgcatg

SEQ ID NO: 3872106 - DNA, 19 bp, Homo sapiens
gttcatgagaatctatatt

SEQ ID NO: 3872107 - DNA, 15 bp, Homo sapiens
gttcatgagtggatg

SEQ ID NO: 3872108 - DNA, 15 bp, Homo sapiens
gttcatgtttgtaaa

SEQ ID NO: 3872109 - DNA, 19 bp, Homo sapiens
gttcattccccggccctcc

SEQ ID NO: 3872110 - DNA, 21 bp, Homo sapiens
gttccaagaaagatccaccct

SEQ ID NO: 3872111 - DNA, 20 bp, Homo sapiens
gttccacgtccccctggggc

SEQ ID NO: 3872112 - DNA, 18 bp, Homo sapiens
gttccagctgcctgggag

SEQ ID NO: 3872113 - DNA, 15 bp, Homo sapiens
gtctgttgtaaatga

SEQ ID NO: 3872114 - DNA, 20 bp, Homo sapiens
gtctgtttcaatgacctgta

SEQ ID NO: 3872115 - DNA, 12 bp, Homo sapiens
gtcttaaaataa

SEQ ID NO: 3872116 - DNA, 22 bp, Homo sapiens
gtcttaattaaaagaatatttt

SEQ ID NO: 3872117 - DNA, 23 bp, Homo sapiens
gtcttagaagtggaccaggacag

SEQ ID NO: 3872118 - DNA, 17 bp, Homo sapiens
gtcttcactgccatgcc

SEQ ID NO: 3872119 - DNA, 14 bp, Homo sapiens
gtcttccaacccca

SEQ ID NO: 3872120 - DNA, 16 bp, Homo sapiens
gtcttccaaccccagc

SEQ ID NO: 3872121 - DNA, 17 bp, Homo sapiens
gtcttccaaccccagct

SEQ ID NO: 3872122 - DNA, 21 bp, Homo sapiens
gtcttccaaccccagctggcc

SEQ ID NO: 3872123 - DNA, 20 bp, Homo sapiens
gtcttctccaacaccacctc

SEQ ID NO: 3872124 - DNA, 16 bp, Homo sapiens
gtcttgggctactggc

SEQ ID NO: 3872125 - DNA, 17 bp, Homo sapiens
gtcttgggctactggca

SEQ ID NO: 3872126 - DNA, 20 bp, Homo sapiens
gtcttgggctactggcagct

SEQ ID NO: 3872127 - DNA, 15 bp, Homo sapiens
gtcttggtattctta

SEQ ID NO: 3872128 - DNA, 22 bp, Homo sapiens
gtcttgttttttttttccactt

SEQ ID NO: 3872129 - DNA, 15 bp, Homo sapiens
gtctttaatcccagt

SEQ ID NO: 3872130 - DNA, 21 bp, Homo sapiens
gtctttcaggaccttttgaag

SEQ ID NO: 3872131 - DNA, 18 bp, Homo sapiens
gtctttctctaaatatga

SEQ ID NO: 3872132 - DNA, 19 bp, Homo sapiens
gtctttgcacatgtgacca

SEQ ID NO: 3872133 - DNA, 15 bp, Homo sapiens
gtctttggttcagct

SEQ ID NO: 3872134 - DNA, 16 bp, Homo sapiens
gtctttgtaatgtcac

SEQ ID NO: 3872135 - DNA, 16 bp, Homo sapiens
gtctttgttgcaccat

SEQ ID NO: 3872136 - DNA, 20 bp, Homo sapiens
gtcttttccactcctatgga

SEQ ID NO: 3872137 - DNA, 23 bp, Homo sapiens
gtgaaaccacaggcccttggggt

SEQ ID NO: 3872138 - DNA, 17 bp, Homo sapiens
gtgaaactggggcttgc

SEQ ID NO: 3872139 - DNA, 12 bp, Homo sapiens
gtgaaagggcta

SEQ ID NO: 3872140 - DNA, 13 bp, Homo sapiens
gtgaaagtgtaaa

SEQ ID NO: 3872141 - DNA, 20 bp, Homo sapiens
gtgaaagtgtaaaatagaat

SEQ ID NO: 3872142 - DNA, 17 bp, Homo sapiens
gtgaaataccagtgtgg

SEQ ID NO: 3872143 - DNA, 11 bp, Homo sapiens
gtgaaattatg

SEQ ID NO: 3872144 - DNA, 12 bp, Homo sapiens
gtgaaccaaaga

SEQ ID NO: 3872145 - DNA, 12 bp, Homo sapiens
gtgaacctggag

SEQ ID NO: 3872146 - DNA, 22 bp, Homo sapiens
gtgaactcagagcccctccctg

SEQ ID NO: 3872147 - DNA, 18 bp, Homo sapiens
gtgaacttcttgaatcta

SEQ ID NO: 3872148 - DNA, 23 bp, Homo sapiens
gtgaagaatgaagtggaggaagt

SEQ ID NO: 3872149 - DNA, 15 bp, Homo sapiens
gtgaagacttcttgg

SEQ ID NO: 3872150 - DNA, 16 bp, Homo sapiens
gtgaagcagtgcctcg

SEQ ID NO: 3872151 - DNA, 22 bp, Homo sapiens
gtgaagccccttgtcctctccc

SEQ ID NO: 3872152 - DNA, 19 bp, Homo sapiens
gtgaaggagaaaggagccg

SEQ ID NO: 3872153 - DNA, 20 bp, Homo sapiens
gtgaaggagaaaggagccgg

SEQ ID NO: 3872154 - DNA, 21 bp, Homo sapiens
gtgaaggagaaaggagccgga

SEQ ID NO: 3872155 - DNA, 17 bp, Homo sapiens
gtgaagttacacaatta

SEQ ID NO: 3872156 - DNA, 13 bp, Homo sapiens
gtgaataaaaacc

SEQ ID NO: 3872157 - DNA, 19 bp, Homo sapiens
gtgaatggccctagaactg

SEQ ID NO: 3872158 - DNA, 12 bp, Homo sapiens
gtgaattaaaaa

SEQ ID NO: 3872159 - DNA, 20 bp, Homo sapiens
gtgaattgcctgcagagaga

SEQ ID NO: 3872160 - DNA, 23 bp, Homo sapiens
gtgaattgcctgcagagagaagc

SEQ ID NO: 3872161 - DNA, 17 bp, Homo sapiens
gtgacaagtggaggggg

SEQ ID NO: 3872162 - DNA, 17 bp, Homo sapiens
gtgacaggaaagccctc

SEQ ID NO: 3872163 - DNA, 14 bp, Homo sapiens
gtgaccaggggtga

SEQ ID NO: 3872164 - DNA, 19 bp, Homo sapiens
gtgaccccagggcacagga

SEQ ID NO: 3872165 - DNA, 21 bp, Homo sapiens
gtgaccccagggcacaggagc

SEQ ID NO: 3872166 - DNA, 17 bp, Homo sapiens
gtgacccggcaccccct

SEQ ID NO: 3872167 - DNA, 18 bp, Homo sapiens
gtgacccttcagggccag

SEQ ID NO: 3872168 - DNA, 12 bp, Homo sapiens
gtgacccttccc

SEQ ID NO: 3872169 - DNA, 19 bp, Homo sapiens
gtgacctgaccggcacctg

SEQ ID NO: 3872170 - DNA, 12 bp, Homo sapiens
gtgacctgctga

SEQ ID NO: 3872171 - DNA, 16 bp, Homo sapiens
gtgacgggagcctcct

SEQ ID NO: 3872172 - DNA, 15 bp, Homo sapiens
gtgacggtcccacac

SEQ ID NO: 3872173 - DNA, 20 bp, Homo sapiens
gtgacggtcctttaggcagc

SEQ ID NO: 3872174 - DNA, 21 bp, Homo sapiens
gtgacggtcctttaggcagcc

SEQ ID NO: 3872175 - DNA, 20 bp, Homo sapiens
gtgactcggtgtaaaaccat

SEQ ID NO: 3872176 - DNA, 16 bp, Homo sapiens
gtgactctttttaggg

SEQ ID NO: 3872177 - DNA, 22 bp, Homo sapiens
gtgactctttttagggccaggc

SEQ ID NO: 3872178 - DNA, 18 bp, Homo sapiens
gtgactgaaggggcacac

SEQ ID NO: 3872179 - DNA, 22 bp, Homo sapiens
gtgactgaaggggcacaccact

SEQ ID NO: 3872180 - DNA, 22 bp, Homo sapiens
gtgactgaatttgggcctcttg

SEQ ID NO: 3872181 - DNA, 21 bp, Homo sapiens
gtgactgatgttacatcacag

SEQ ID NO: 3872182 - DNA, 24 bp, Homo sapiens
gtgactggcaggtgcagatgggct

SEQ ID NO: 3872183 - DNA, 16 bp, Homo sapiens
gtgacttcagctctgt

SEQ ID NO: 3872184 - DNA, 16 bp, Homo sapiens
gtgactttacaggagg

SEQ ID NO: 3872185 - DNA, 20 bp, Homo sapiens
gtgactttttagccagtgac

SEQ ID NO: 3872186 - DNA, 22 bp, Homo sapiens
gtgagaaaaagctcctgtcctc

SEQ ID NO: 3872187 - DNA, 14 bp, Homo sapiens
gtgagaatcctgcc

SEQ ID NO: 3872188 - DNA, 19 bp, Homo sapiens
gtgagaatctggctcctgt

SEQ ID NO: 3872189 - DNA, 21 bp, Homo sapiens
gtgagacacagagtggagccc

SEQ ID NO: 3872190 - DNA, 13 bp, Homo sapiens
gtgagaccacctc

SEQ ID NO: 3872191 - DNA, 16 bp, Homo sapiens
gtgagagaatctgcct

SEQ ID NO: 3872192 - DNA, 17 bp, Homo sapiens
gtgagagaatctgcctg

SEQ ID NO: 3872193 - DNA, 12 bp, Homo sapiens
gtgagagctggt

SEQ ID NO: 3872194 - DNA, 13 bp, Homo sapiens
gtgagagtgagct

SEQ ID NO: 3872195 - DNA, 21 bp, Homo sapiens
gtgagcaagaagtcaaagtaa

SEQ ID NO: 3872196 - DNA, 16 bp, Homo sapiens
gtgagcatgggtgtgc

SEQ ID NO: 3872197 - DNA, 19 bp, Homo sapiens
gtgagcatgggtgtgccct

SEQ ID NO: 3872198 - DNA, 14 bp, Homo sapiens
gtgagcccctggtc

SEQ ID NO: 3872199 - DNA, 19 bp, Homo sapiens
gtcagaggctaagatgaga

SEQ ID NO: 3872200 - DNA, 23 bp, Homo sapiens
gtcagagtaacatgccagcttcc

SEQ ID NO: 3872201 - DNA, 12 bp, Homo sapiens
gtcagccagggc

SEQ ID NO: 3872202 - DNA, 13 bp, Homo sapiens
gtcagctcacacc

SEQ ID NO: 3872203 - DNA, 15 bp, Homo sapiens
gtcagctcacaccct

SEQ ID NO: 3872204 - DNA, 14 bp, Homo sapiens
gtcagctttcagag

SEQ ID NO: 3872205 - DNA, 21 bp, Homo sapiens
gtcagctttcagagccagtga

SEQ ID NO: 3872206 - DNA, 18 bp, Homo sapiens
gtcaggacaccagcctgg

SEQ ID NO: 3872207 - DNA, 14 bp, Homo sapiens
gtcaggacccaggc

SEQ ID NO: 3872208 - DNA, 19 bp, Homo sapiens
gtcaggacccaggccgcct

SEQ ID NO: 3872209 - DNA, 13 bp, Homo sapiens
gtcaggcaggttt

SEQ ID NO: 3872210 - DNA, 22 bp, Homo sapiens
gtcaggcccttattttcaagaa

SEQ ID NO: 3872211 - DNA, 12 bp, Homo sapiens
gtcaggctccat

SEQ ID NO: 3872212 - DNA, 19 bp, Homo sapiens
gtcagtaggtccaagggcc

SEQ ID NO: 3872213 - DNA, 21 bp, Homo sapiens
gtcagtaggtccaagggccat

SEQ ID NO: 3872214 - DNA, 20 bp, Homo sapiens
gtcagttcccggagcacagc

SEQ ID NO: 3872215 - DNA, 22 bp, Homo sapiens
gtcagttcccggagcacagccc

SEQ ID NO: 3872216 - DNA, 15 bp, Homo sapiens
gtcagttgataaaag

SEQ ID NO: 3872217 - DNA, 17 bp, Homo sapiens
gtcatatattcatgtaa

SEQ ID NO: 3872218 - DNA, 23 bp, Homo sapiens
gtcatatattcatgtaataaatc

SEQ ID NO: 3872219 - DNA, 14 bp, Homo sapiens
gtcatattcttatg

SEQ ID NO: 3872220 - DNA, 14 bp, Homo sapiens
gtcatcactccctg

SEQ ID NO: 3872221 - DNA, 16 bp, Homo sapiens
gtcatcactccctgga

SEQ ID NO: 3872222 - DNA, 16 bp, Homo sapiens
gtcatcacttttcagt

SEQ ID NO: 3872223 - DNA, 17 bp, Homo sapiens
gtcatcacttttcagtg

SEQ ID NO: 3872224 - DNA, 13 bp, Homo sapiens
gtcatcatacatg

SEQ ID NO: 3872225 - DNA, 22 bp, Homo sapiens
gtcatcggaggctgggcccctg

SEQ ID NO: 3872226 - DNA, 23 bp, Homo sapiens
gtcatctctctggggccctgggc

SEQ ID NO: 3872227 - DNA, 15 bp, Homo sapiens
gtcatgaatgccttc

SEQ ID NO: 3872228 - DNA, 15 bp, Homo sapiens
gtcatgatctccctg

SEQ ID NO: 3872229 - DNA, 17 bp, Homo sapiens
gtcatgatctccctgcc

SEQ ID NO: 3872230 - DNA, 20 bp, Homo sapiens
gtcatgctgctgttgctgga

SEQ ID NO: 3872231 - DNA, 13 bp, Homo sapiens
gtcatgcttttgc

SEQ ID NO: 3872232 - DNA, 17 bp, Homo sapiens
gtcatgtacttcctgtg

SEQ ID NO: 3872233 - DNA, 12 bp, Homo sapiens
gtcatgtgtgca

SEQ ID NO: 3872234 - DNA, 13 bp, Homo sapiens
gtcatgtgtgcat

SEQ ID NO: 3872235 - DNA, 14 bp, Homo sapiens
gtcatgtgtgcatg

SEQ ID NO: 3872236 - DNA, 13 bp, Homo sapiens
gtcattaatgtgt

SEQ ID NO: 3872237 - DNA, 15 bp, Homo sapiens
gtcattatgtagaaa

SEQ ID NO: 3872238 - DNA, 16 bp, Homo sapiens
gtcattttaaaatctg

SEQ ID NO: 3872239 - DNA, 14 bp, Homo sapiens
gtccaacctaaccc

SEQ ID NO: 3872240 - DNA, 20 bp, Homo sapiens
gtccaacctaacccctttcc

SEQ ID NO: 3872241 - DNA, 22 bp, Homo sapiens
gtccaaggaaacttgaatcaaa

SEQ ID NO: 3872242 - DNA, 21 bp, Homo sapiens
gtccaagggccatacttttga

SEQ ID NO: 3872243 - DNA, 12 bp, Homo sapiens
gtccaatatttg

SEQ ID NO: 3872244 - DNA, 17 bp, Homo sapiens
gtccaatggctgtaaac

SEQ ID NO: 3872245 - DNA, 18 bp, Homo sapiens
gtccaatggctgtaaact

SEQ ID NO: 3872246 - DNA, 20 bp, Homo sapiens
gtccaattatgcactggcca

SEQ ID NO: 3872247 - DNA, 16 bp, Homo sapiens
gtccacaggggcaggc

SEQ ID NO: 3872248 - DNA, 19 bp, Homo sapiens
gtccacaggggcaggcctg

SEQ ID NO: 3872249 - DNA, 21 bp, Homo sapiens
gtccacaggggcaggcctggg

SEQ ID NO: 3872250 - DNA, 23 bp, Homo sapiens
gtccacaggggcaggcctgggac

SEQ ID NO: 3872251 - DNA, 18 bp, Homo sapiens
gtccacagtctcccattc

SEQ ID NO: 3872252 - DNA, 21 bp, Homo sapiens
gtccactctcggggcccttgg

SEQ ID NO: 3872253 - DNA, 22 bp, Homo sapiens
gtccagaagaatattcaggact

SEQ ID NO: 3872254 - DNA, 18 bp, Homo sapiens
gtccagaccattgtcttc

SEQ ID NO: 3872255 - DNA, 21 bp, Homo sapiens
gtccagaccattgtcttccaa

SEQ ID NO: 3872256 - DNA, 19 bp, Homo sapiens
gtccaggaaggcagctgct

SEQ ID NO: 3872257 - DNA, 11 bp, Homo sapiens
gtccaggccac

SEQ ID NO: 3872258 - DNA, 13 bp, Homo sapiens
gtccaggccactg

SEQ ID NO: 3872259 - DNA, 18 bp, Homo sapiens
gtccaggccactgtggcc

SEQ ID NO: 3872260 - DNA, 20 bp, Homo sapiens
gtccaggccactgtggccag

SEQ ID NO: 3872261 - DNA, 17 bp, Homo sapiens
gtccaggtcctggtggg

SEQ ID NO: 3872262 - DNA, 22 bp, Homo sapiens
gtccaggtcctggtggggcagc

SEQ ID NO: 3872263 - DNA, 20 bp, Homo sapiens
gtccagtgcaaccacacacc

SEQ ID NO: 3872264 - DNA, 24 bp, Homo sapiens
gtccagtgggaggtgagaccacct

SEQ ID NO: 3872265 - DNA, 18 bp, Homo sapiens
gtccatatcagacctctg

SEQ ID NO: 3872266 - DNA, 20 bp, Homo sapiens
gtccatatcagacctctgat

SEQ ID NO: 3872267 - DNA, 17 bp, Homo sapiens
gtccatggcaccagccc

SEQ ID NO: 3872268 - DNA, 19 bp, Homo sapiens
gtccatggcaccagccccc

SEQ ID NO: 3872269 - DNA, 20 bp, Homo sapiens
gtccatggcaccagccccct

SEQ ID NO: 3872270 - DNA, 21 bp, Homo sapiens
gtccatggcaccagccccctg

SEQ ID NO: 3872271 - DNA, 22 bp, Homo sapiens
gtccatggcaccagccccctgg

SEQ ID NO: 3872272 - DNA, 16 bp, Homo sapiens
gtcccaaggagctgat

SEQ ID NO: 3872273 - DNA, 18 bp, Homo sapiens
gtcccacatccctgggcc

SEQ ID NO: 3872274 - DNA, 19 bp, Homo sapiens
gtcccaccaactctgcact

SEQ ID NO: 3872275 - DNA, 19 bp, Homo sapiens
gtcccacctcttctcttcc

SEQ ID NO: 3872276 - DNA, 20 bp, Homo sapiens
gtcccagaaccacactgttg

SEQ ID NO: 3872277 - DNA, 19 bp, Homo sapiens
gtcccagaggttatctgcc

SEQ ID NO: 3872278 - DNA, 24 bp, Homo sapiens
gtcccagaggttatctgcctggcc

SEQ ID NO: 3872279 - DNA, 14 bp, Homo sapiens
gtccccacctggga

SEQ ID NO: 3872280 - DNA, 15 bp, Homo sapiens
gtccccacctgggac

SEQ ID NO: 3872281 - DNA, 13 bp, Homo sapiens
gtccccagccctt

SEQ ID NO: 3872282 - DNA, 12 bp, Homo sapiens
gtccccagggcc

SEQ ID NO: 3872283 - DNA, 12 bp, Homo sapiens
gtccccatcagc

SEQ ID NO: 3872284 - DNA, 17 bp, Homo sapiens
gtccccatcatcccagc

SEQ ID NO: 3872285 - DNA, 15 bp, Homo sapiens
gtcccccagaacctc

SEQ ID NO: 3872286 - DNA, 15 bp, Homo sapiens
gtcccccccagtgca

SEQ ID NO: 3872287 - DNA, 21 bp, Homo sapiens
gtccccgtcccccagaacctc

SEQ ID NO: 3872288 - DNA, 13 bp, Homo sapiens
gtcccctcactct

SEQ ID NO: 3872289 - DNA, 15 bp, Homo sapiens
gtcccctcactctgt

SEQ ID NO: 3872290 - DNA, 18 bp, Homo sapiens
gtcccctcactctgtcag

SEQ ID NO: 3872291 - DNA, 13 bp, Homo sapiens
gtcccctctcccc

SEQ ID NO: 3872292 - DNA, 17 bp, Homo sapiens
gtcccctctcccctcat

SEQ ID NO: 3872293 - DNA, 21 bp, Homo sapiens
gtcccctctgtcatcactccc

SEQ ID NO: 3872294 - DNA, 22 bp, Homo sapiens
gtcccctctgtcatcactccct

SEQ ID NO: 3872295 - DNA, 23 bp, Homo sapiens
gtcccctctgtcatcactccctg

SEQ ID NO: 3872296 - DNA, 19 bp, Homo sapiens
gtcccctgtcccaccaact

SEQ ID NO: 3872297 - DNA, 21 bp, Homo sapiens
gtcccgccttcctcctccaca

SEQ ID NO: 3872298 - DNA, 17 bp, Homo sapiens
gtcccggttcaccttgc

SEQ ID NO: 3872299 - DNA, 13 bp, Homo sapiens
gtcccgtggaggg

SEQ ID NO: 3872300 - DNA, 22 bp, Homo sapiens
gtccctaccgagtctcttctcc

SEQ ID NO: 3872301 - DNA, 23 bp, Homo sapiens
gtccctcaaatgacccaaagacc

SEQ ID NO: 3872302 - DNA, 21 bp, Homo sapiens
gtccctcccatctctacccca

SEQ ID NO: 3872303 - DNA, 14 bp, Homo sapiens
gtccctcggagctg

SEQ ID NO: 3872304 - DNA, 16 bp, Homo sapiens
gtccctcgtccacagg

SEQ ID NO: 3872305 - DNA, 10 bp, Homo sapiens
gtccctgctc

SEQ ID NO: 3872306 - DNA, 16 bp, Homo sapiens
gtccctgctcctccca

SEQ ID NO: 3872307 - DNA, 23 bp, Homo sapiens
gtccctgggggaagccctggatt

SEQ ID NO: 3872308 - DNA, 18 bp, Homo sapiens
gtccctgtttcaaactga

SEQ ID NO: 3872309 - DNA, 14 bp, Homo sapiens
gtcccttgagacct

SEQ ID NO: 3872310 - DNA, 16 bp, Homo sapiens
gtcccttgagacctca

SEQ ID NO: 3872311 - DNA, 17 bp, Homo sapiens
gtcccttgagacctcag

SEQ ID NO: 3872312 - DNA, 18 bp, Homo sapiens
gtcccttgagacctcagc

SEQ ID NO: 3872313 - DNA, 19 bp, Homo sapiens
gtcccttgagacctcagcc

SEQ ID NO: 3872314 - DNA, 15 bp, Homo sapiens
gtcccttgctgacat

SEQ ID NO: 3872315 - DNA, 13 bp, Homo sapiens
gtccgcaccagct

SEQ ID NO: 3872316 - DNA, 20 bp, Homo sapiens
gtccgcaccagctgctctgc

SEQ ID NO: 3872317 - DNA, 17 bp, Homo sapiens
gtccgccaaacactcca

SEQ ID NO: 3872318 - DNA, 21 bp, Homo sapiens
gtccgcctctgcccgcagagc

SEQ ID NO: 3872319 - DNA, 15 bp, Homo sapiens
gtccgtccaccacct

SEQ ID NO: 3872320 - DNA, 16 bp, Homo sapiens
gtcctcacagcctctc

SEQ ID NO: 3872321 - DNA, 20 bp, Homo sapiens
gtcctcacagcctctccctt

SEQ ID NO: 3872322 - DNA, 23 bp, Homo sapiens
gtcctccaacaataaagagctca

SEQ ID NO: 3872323 - DNA, 20 bp, Homo sapiens
gtcctccatttcaactccag

SEQ ID NO: 3872324 - DNA, 20 bp, Homo sapiens
gtcctcccatcccctggact

SEQ ID NO: 3872325 - DNA, 21 bp, Homo sapiens
gtcctcccatcccctggactg

SEQ ID NO: 3872326 - DNA, 15 bp, Homo sapiens
gtcctccccctgcca

SEQ ID NO: 3872327 - DNA, 15 bp, Homo sapiens
gtcctcccctatttt

SEQ ID NO: 3872328 - DNA, 18 bp, Homo sapiens
gtcctcccctattttaag

SEQ ID NO: 3872329 - DNA, 22 bp, Homo sapiens
gtcctcctcggatcaccgagag

SEQ ID NO: 3872330 - DNA, 15 bp, Homo sapiens
gtcctcctctctcta

SEQ ID NO: 3872331 - DNA, 16 bp, Homo sapiens
gtcctctcgagcccag

SEQ ID NO: 3872332 - DNA, 20 bp, Homo sapiens
gtcctctcttctctattcct

SEQ ID NO: 3872333 - DNA, 19 bp, Homo sapiens
gtcctctgatacccagagc

SEQ ID NO: 3872334 - DNA, 15 bp, Homo sapiens
gtcctgacgccctgc

SEQ ID NO: 3872335 - DNA, 16 bp, Homo sapiens
gtcctgacgccctgcg

SEQ ID NO: 3872336 - DNA, 13 bp, Homo sapiens
gtcctgagacctg

SEQ ID NO: 3872337 - DNA, 18 bp, Homo sapiens
gtcctgcaatctccaggg

SEQ ID NO: 3872338 - DNA, 16 bp, Homo sapiens
gtcctgcagaggacca

SEQ ID NO: 3872339 - DNA, 16 bp, Homo sapiens
gtcctgccagctgcct

SEQ ID NO: 3872340 - DNA, 16 bp, Homo sapiens
gtcctgcccatgtgtc

SEQ ID NO: 3872341 - DNA, 23 bp, Homo sapiens
gtcctgcccatgtgtcccctcac

SEQ ID NO: 3872342 - DNA, 21 bp, Homo sapiens
gtcctgcctctctgctccaga

SEQ ID NO: 3872343 - DNA, 20 bp, Homo sapiens
gtcctgctctcttcaggagg

SEQ ID NO: 3872344 - DNA, 20 bp, Homo sapiens
gtcctggcttctagatctgg

SEQ ID NO: 3872345 - DNA, 15 bp, Homo sapiens
gtcctgtgaatttct

SEQ ID NO: 3872346 - DNA, 16 bp, Homo sapiens
gtcctgttccctaccc

SEQ ID NO: 3872347 - DNA, 15 bp, Homo sapiens
gtccttactcctgtg

SEQ ID NO: 3872348 - DNA, 18 bp, Homo sapiens
gtccttactcctgtggga

SEQ ID NO: 3872349 - DNA, 13 bp, Homo sapiens
gtccttcagagct

SEQ ID NO: 3872350 - DNA, 15 bp, Homo sapiens
gtccttgcacctgca

SEQ ID NO: 3872351 - DNA, 16 bp, Homo sapiens
gtccttgcacctgcat

SEQ ID NO: 3872352 - DNA, 17 bp, Homo sapiens
gtccttgcacctgcatc

SEQ ID NO: 3872353 - DNA, 15 bp, Homo sapiens
gtccttggggcacag

SEQ ID NO: 3872354 - DNA, 22 bp, Homo sapiens
gtccttggtgtgaccctctgaa

SEQ ID NO: 3872355 - DNA, 19 bp, Homo sapiens
gtcctttaggcagcctgcc

SEQ ID NO: 3872356 - DNA, 16 bp, Homo sapiens
gtcctttgagaaagaa

SEQ ID NO: 3872357 - DNA, 15 bp, Homo sapiens
gtccttttcactaca

SEQ ID NO: 3872358 - DNA, 18 bp, Homo sapiens
gtccttttcactacacca

SEQ ID NO: 3872359 - DNA, 16 bp, Homo sapiens
gtcgactttgagctgg

SEQ ID NO: 3872360 - DNA, 12 bp, Homo sapiens
gtcgagacactt

SEQ ID NO: 3872361 - DNA, 15 bp, Homo sapiens
gtcgagtcaaaatgt

SEQ ID NO: 3872362 - DNA, 20 bp, Homo sapiens
gtcgcaggatccgctgccac

SEQ ID NO: 3872363 - DNA, 14 bp, Homo sapiens
gtcgccccaggccc

SEQ ID NO: 3872364 - DNA, 23 bp, Homo sapiens
gtcgcgcgcagcgcgtgcacagc

SEQ ID NO: 3872365 - DNA, 19 bp, Homo sapiens
gtcgctgggctgtgggtgc

SEQ ID NO: 3872366 - DNA, 17 bp, Homo sapiens
gtcggcacgtcccatgt

SEQ ID NO: 3872367 - DNA, 14 bp, Homo sapiens
gtcgggacagagag

SEQ ID NO: 3872368 - DNA, 22 bp, Homo sapiens
gtcgtggaattaaatcacggat

SEQ ID NO: 3872369 - DNA, 24 bp, Homo sapiens
gtcgtggagagctaggagcaaagc

SEQ ID NO: 3872370 - DNA, 11 bp, Homo sapiens
gtctaaagttt

SEQ ID NO: 3872371 - DNA, 13 bp, Homo sapiens
gtatcaggcacag

SEQ ID NO: 3872372 - DNA, 15 bp, Homo sapiens
gtatcaggtctccca

SEQ ID NO: 3872373 - DNA, 15 bp, Homo sapiens
gtatcatagaaatgt

SEQ ID NO: 3872374 - DNA, 11 bp, Homo sapiens
gtatcatgcat

SEQ ID NO: 3872375 - DNA, 14 bp, Homo sapiens
gtatccactttgca

SEQ ID NO: 3872376 - DNA, 18 bp, Homo sapiens
gtatcccagacccctctc

SEQ ID NO: 3872377 - DNA, 18 bp, Homo sapiens
gtatcgctgccttgccat

SEQ ID NO: 3872378 - DNA, 13 bp, Homo sapiens
gtatctccaggat

SEQ ID NO: 3872379 - DNA, 14 bp, Homo sapiens
gtatctccaggatt

SEQ ID NO: 3872380 - DNA, 20 bp, Homo sapiens
gtatctcggacctttcagct

SEQ ID NO: 3872381 - DNA, 20 bp, Homo sapiens
gtatgaacttgaggacacat

SEQ ID NO: 3872382 - DNA, 13 bp, Homo sapiens
gtatgaatgatgt

SEQ ID NO: 3872383 - DNA, 14 bp, Homo sapiens
gtatgctggccagc

SEQ ID NO: 3872384 - DNA, 15 bp, Homo sapiens
gtatgctggccagca

SEQ ID NO: 3872385 - DNA, 18 bp, Homo sapiens
gtatgctggccagcaccc

SEQ ID NO: 3872386 - DNA, 13 bp, Homo sapiens
gtatggaaataaa

SEQ ID NO: 3872387 - DNA, 18 bp, Homo sapiens
gtatggaagggaggggtc

SEQ ID NO: 3872388 - DNA, 17 bp, Homo sapiens
gtatggaatacagtgtt

SEQ ID NO: 3872389 - DNA, 18 bp, Homo sapiens
gtatggaatacagtgtta

SEQ ID NO: 3872390 - DNA, 14 bp, Homo sapiens
gtatgggaagccat

SEQ ID NO: 3872391 - DNA, 19 bp, Homo sapiens
gtatgtagcccggccaggg

SEQ ID NO: 3872392 - DNA, 18 bp, Homo sapiens
gtatgtgaaagtgtaaaa

SEQ ID NO: 3872393 - DNA, 17 bp, Homo sapiens
gtattaaacttgtcaga

SEQ ID NO: 3872394 - DNA, 14 bp, Homo sapiens
gtattaaagatgtg

SEQ ID NO: 3872395 - DNA, 16 bp, Homo sapiens
gtattaaagatgtgtt

SEQ ID NO: 3872396 - DNA, 18 bp, Homo sapiens
gtattaagccaaacatga

SEQ ID NO: 3872397 - DNA, 22 bp, Homo sapiens
gtattaatactaaaatatgtct

SEQ ID NO: 3872398 - DNA, 16 bp, Homo sapiens
gtattaattatctgat

SEQ ID NO: 3872399 - DNA, 18 bp, Homo sapiens
gtattacatctaatgctt

SEQ ID NO: 3872400 - DNA, 23 bp, Homo sapiens
gtattagcacctctttttgaaca

SEQ ID NO: 3872401 - DNA, 22 bp, Homo sapiens
gtattaggggtaatatattgct

SEQ ID NO: 3872402 - DNA, 23 bp, Homo sapiens
gtattatcacatcaagcatgcaa

SEQ ID NO: 3872403 - DNA, 20 bp, Homo sapiens
gtattcaacagaaggactgt

SEQ ID NO: 3872404 - DNA, 23 bp, Homo sapiens
gtattccttttgtgtacagtgtg

SEQ ID NO: 3872405 - DNA, 18 bp, Homo sapiens
gtattctaaagctttctg

SEQ ID NO: 3872406 - DNA, 23 bp, Homo sapiens
gtattgcgaaacaacttgtgttc

SEQ ID NO: 3872407 - DNA, 21 bp, Homo sapiens
gtatttaaaaccttgatttaa

SEQ ID NO: 3872408 - DNA, 16 bp, Homo sapiens
gtatttatatttggaa

SEQ ID NO: 3872409 - DNA, 23 bp, Homo sapiens
gtatttatatttggaaagagacc

SEQ ID NO: 3872410 - DNA, 12 bp, Homo sapiens
gtatttcctgct

SEQ ID NO: 3872411 - DNA, 12 bp, Homo sapiens
gtatttctgccc

SEQ ID NO: 3872412 - DNA, 16 bp, Homo sapiens
gtatttgttcccaaga

SEQ ID NO: 3872413 - DNA, 19 bp, Homo sapiens
gtattttaggcagggattt

SEQ ID NO: 3872414 - DNA, 17 bp, Homo sapiens
gtattttattaaagcaa

SEQ ID NO: 3872415 - DNA, 13 bp, Homo sapiens
gtcaaaagcctgg

SEQ ID NO: 3872416 - DNA, 16 bp, Homo sapiens
gtcaaaaggtgcctgt

SEQ ID NO: 3872417 - DNA, 16 bp, Homo sapiens
gtcaaacatgaagtgt

SEQ ID NO: 3872418 - DNA, 21 bp, Homo sapiens
gtcaaaccgcactcacccatg

SEQ ID NO: 3872419 - DNA, 18 bp, Homo sapiens
gtcaacagagaaggcagg

SEQ ID NO: 3872420 - DNA, 11 bp, Homo sapiens
gtcaacatctt

SEQ ID NO: 3872421 - DNA, 14 bp, Homo sapiens
gtcaacatcttctc

SEQ ID NO: 3872422 - DNA, 14 bp, Homo sapiens
gtcaaccaggaaca

SEQ ID NO: 3872423 - DNA, 17 bp, Homo sapiens
gtcaactggagcaagaa

SEQ ID NO: 3872424 - DNA, 13 bp, Homo sapiens
gtcaagtcaacca

SEQ ID NO: 3872425 - DNA, 16 bp, Homo sapiens
gtcaatattaaataca

SEQ ID NO: 3872426 - DNA, 20 bp, Homo sapiens
gtcaatattaaatacagaca

SEQ ID NO: 3872427 - DNA, 22 bp, Homo sapiens
gtcaatattaaatacagacact

SEQ ID NO: 3872428 - DNA, 23 bp, Homo sapiens
gtcaatattaaatacagacacta

SEQ ID NO: 3872429 - DNA, 20 bp, Homo sapiens
gtcaatcccaaaagtcacca

SEQ ID NO: 3872430 - DNA, 16 bp, Homo sapiens
gtcaatcccctcattc

SEQ ID NO: 3872431 - DNA, 17 bp, Homo sapiens
gtcaatcccctcattca

SEQ ID NO: 3872432 - DNA, 12 bp, Homo sapiens
gtcacagctctg

SEQ ID NO: 3872433 - DNA, 18 bp, Homo sapiens
gtcacagctgcagctggg

SEQ ID NO: 3872434 - DNA, 17 bp, Homo sapiens
gtcacaggactctgcct

SEQ ID NO: 3872435 - DNA, 18 bp, Homo sapiens
gtcacagggcctggggag

SEQ ID NO: 3872436 - DNA, 21 bp, Homo sapiens
gtcacatatacaaaagcaaga

SEQ ID NO: 3872437 - DNA, 16 bp, Homo sapiens
gtcacattcaggaaga

SEQ ID NO: 3872438 - DNA, 11 bp, Homo sapiens
gtcaccacctt

SEQ ID NO: 3872439 - DNA, 14 bp, Homo sapiens
gtcaccaccttccc

SEQ ID NO: 3872440 - DNA, 15 bp, Homo sapiens
gtcaccaccttccca

SEQ ID NO: 3872441 - DNA, 16 bp, Homo sapiens
gtcaccaccttcccag

SEQ ID NO: 3872442 - DNA, 18 bp, Homo sapiens
gtcaccactccattccca

SEQ ID NO: 3872443 - DNA, 23 bp, Homo sapiens
gtcaccagctatctgtcatctct

SEQ ID NO: 3872444 - DNA, 16 bp, Homo sapiens
gtcaccctgcagagct

SEQ ID NO: 3872445 - DNA, 20 bp, Homo sapiens
gtcaccgtggaccttcctgc

SEQ ID NO: 3872446 - DNA, 21 bp, Homo sapiens
gtcaccgtggaccttcctgcc

SEQ ID NO: 3872447 - DNA, 14 bp, Homo sapiens
gtcacctcagctga

SEQ ID NO: 3872448 - DNA, 14 bp, Homo sapiens
gtcacctcctccac

SEQ ID NO: 3872449 - DNA, 19 bp, Homo sapiens
gtcactatgctatttctgg

SEQ ID NO: 3872450 - DNA, 16 bp, Homo sapiens
gtcacttccagtgttg

SEQ ID NO: 3872451 - DNA, 12 bp, Homo sapiens
gtcagagacaga

SEQ ID NO: 3872452 - DNA, 23 bp, Homo sapiens
gtcagagacagaccccttggctt

SEQ ID NO: 3872453 - DNA, 17 bp, Homo sapiens
gtcagagccaggctctg

SEQ ID NO: 3872454 - DNA, 13 bp, Homo sapiens
gtcagagctatgt

SEQ ID NO: 3872455 - DNA, 15 bp, Homo sapiens
gtcagagctgggagt

SEQ ID NO: 3872456 - DNA, 19 bp, Homo sapiens
gtcagagctgttggcctcg

SEQ ID NO: 3872457 - DNA, 12 bp, Homo sapiens
gtaacacatctt

SEQ ID NO: 3872458 - DNA, 14 bp, Homo sapiens
gtaacatccagaag

SEQ ID NO: 3872459 - DNA, 13 bp, Homo sapiens
gtaacatcctttc

SEQ ID NO: 3872460 - DNA, 12 bp, Homo sapiens
gtaacatgttta

SEQ ID NO: 3872461 - DNA, 17 bp, Homo sapiens
gtaactacactaataaa

SEQ ID NO: 3872462 - DNA, 18 bp, Homo sapiens
gtaactactttttatact

SEQ ID NO: 3872463 - DNA, 23 bp, Homo sapiens
gtaactactttttatactccata

SEQ ID NO: 3872464 - DNA, 17 bp, Homo sapiens
gtaactccaccaaccca

SEQ ID NO: 3872465 - DNA, 12 bp, Homo sapiens
gtaactgctgag

SEQ ID NO: 3872466 - DNA, 16 bp, Homo sapiens
gtaagcactgactggg

SEQ ID NO: 3872467 - DNA, 15 bp, Homo sapiens
gtaagcattctgagc

SEQ ID NO: 3872468 - DNA, 16 bp, Homo sapiens
gtaagccagagcctgg

SEQ ID NO: 3872469 - DNA, 17 bp, Homo sapiens
gtaagctctggctttct

SEQ ID NO: 3872470 - DNA, 18 bp, Homo sapiens
gtaagggaaactgccagc

SEQ ID NO: 3872471 - DNA, 21 bp, Homo sapiens
gtaagtggggttgcaaccact

SEQ ID NO: 3872472 - DNA, 19 bp, Homo sapiens
gtaagtttatgtctaaaga

SEQ ID NO: 3872473 - DNA, 12 bp, Homo sapiens
gtaataagaaag

SEQ ID NO: 3872474 - DNA, 18 bp, Homo sapiens
gtaatagtccaatatttg

SEQ ID NO: 3872475 - DNA, 19 bp, Homo sapiens
gtaatagtccaatatttgg

SEQ ID NO: 3872476 - DNA, 18 bp, Homo sapiens
gtaatatattgctgctgg

SEQ ID NO: 3872477 - DNA, 20 bp, Homo sapiens
gtaatatattgctgctggta

SEQ ID NO: 3872478 - DNA, 22 bp, Homo sapiens
gtaatcagcattattcttcaga

SEQ ID NO: 3872479 - DNA, 15 bp, Homo sapiens
gtaatcaggcagcct

SEQ ID NO: 3872480 - DNA, 14 bp, Homo sapiens
gtaatcccagcact

SEQ ID NO: 3872481 - DNA, 17 bp, Homo sapiens
gtaatcccagctactca

SEQ ID NO: 3872482 - DNA, 14 bp, Homo sapiens
gtaatgagggactg

SEQ ID NO: 3872483 - DNA, 12 bp, Homo sapiens
gtaatgcacaat

SEQ ID NO: 3872484 - DNA, 19 bp, Homo sapiens
gtaatgcacaatttagaaa

SEQ ID NO: 3872485 - DNA, 22 bp, Homo sapiens
gtaatgcacaatttagaaaaca

SEQ ID NO: 3872486 - DNA, 18 bp, Homo sapiens
gtaatgggccaattaaaa

SEQ ID NO: 3872487 - DNA, 22 bp, Homo sapiens
gtaatgggccaattaaaatata

SEQ ID NO: 3872488 - DNA, 12 bp, Homo sapiens
gtaatgggcctg

SEQ ID NO: 3872489 - DNA, 19 bp, Homo sapiens
gtaattaaaagaattttcc

SEQ ID NO: 3872490 - DNA, 19 bp, Homo sapiens
gtaattaagtgcaatttcc

SEQ ID NO: 3872491 - DNA, 23 bp, Homo sapiens
gtaattctccctaaggaatctga

SEQ ID NO: 3872492 - DNA, 16 bp, Homo sapiens
gtaatttgaggacaac

SEQ ID NO: 3872493 - DNA, 16 bp, Homo sapiens
gtacaaaagtaccata

SEQ ID NO: 3872494 - DNA, 14 bp, Homo sapiens
gtacaaaataaaca

SEQ ID NO: 3872495 - DNA, 16 bp, Homo sapiens
gtacaagttttgtata

SEQ ID NO: 3872496 - DNA, 14 bp, Homo sapiens
gtacaatctcaaat

SEQ ID NO: 3872497 - DNA, 14 bp, Homo sapiens
gtacaatgtttcag

SEQ ID NO: 3872498 - DNA, 17 bp, Homo sapiens
gtacaatgtttcagaag

SEQ ID NO: 3872499 - DNA, 19 bp, Homo sapiens
gtacacacggaccatgtgg

SEQ ID NO: 3872500 - DNA, 14 bp, Homo sapiens
gtacagaattttta

SEQ ID NO: 3872501 - DNA, 22 bp, Homo sapiens
gtacagaatttttaatgacttt

SEQ ID NO: 3872502 - DNA, 23 bp, Homo sapiens
gtacagaatttttaatgactttt

SEQ ID NO: 3872503 - DNA, 18 bp, Homo sapiens
gtacagctgtttaagatg

SEQ ID NO: 3872504 - DNA, 18 bp, Homo sapiens
gtacagtagcttaaataa

SEQ ID NO: 3872505 - DNA, 23 bp, Homo sapiens
gtacagtagcttaaataaattca

SEQ ID NO: 3872506 - DNA, 16 bp, Homo sapiens
gtacagtgtgtaaagt

SEQ ID NO: 3872507 - DNA, 21 bp, Homo sapiens
gtacagttatttatgcctctg

SEQ ID NO: 3872508 - DNA, 22 bp, Homo sapiens
gtacagttcagttcctctttgc

SEQ ID NO: 3872509 - DNA, 21 bp, Homo sapiens
gtacatagatgtatcattaat

SEQ ID NO: 3872510 - DNA, 18 bp, Homo sapiens
gtacatagttatttattt

SEQ ID NO: 3872511 - DNA, 10 bp, Homo sapiens
gtacatgtat

SEQ ID NO: 3872512 - DNA, 18 bp, Homo sapiens
gtacatttccctgtgctg

SEQ ID NO: 3872513 - DNA, 12 bp, Homo sapiens
gtaccagccagg

SEQ ID NO: 3872514 - DNA, 24 bp, Homo sapiens
gtaccagccaggatcccaagcgtc

SEQ ID NO: 3872515 - DNA, 17 bp, Homo sapiens
gtaccatacacattgga

SEQ ID NO: 3872516 - DNA, 21 bp, Homo sapiens
gtaccatgctggcggcgcaga

SEQ ID NO: 3872517 - DNA, 19 bp, Homo sapiens
gtacccaccgggccactcc

SEQ ID NO: 3872518 - DNA, 12 bp, Homo sapiens
gtacccagctcc

SEQ ID NO: 3872519 - DNA, 24 bp, Homo sapiens
gtacccagctccttttgtccccag

SEQ ID NO: 3872520 - DNA, 12 bp, Homo sapiens
gtaccccatccc

SEQ ID NO: 3872521 - DNA, 20 bp, Homo sapiens
gtaccccatcccttcctccc

SEQ ID NO: 3872522 - DNA, 21 bp, Homo sapiens
gtaccccatcccttcctcccc

SEQ ID NO: 3872523 - DNA, 14 bp, Homo sapiens
gtacccttccacct

SEQ ID NO: 3872524 - DNA, 18 bp, Homo sapiens
gtacctatgtgacagaca

SEQ ID NO: 3872525 - DNA, 21 bp, Homo sapiens
gtacctgtagtgagaaactga

SEQ ID NO: 3872526 - DNA, 13 bp, Homo sapiens
gtactactgctgc

SEQ ID NO: 3872527 - DNA, 20 bp, Homo sapiens
gtactactgctgcaaagtgc

SEQ ID NO: 3872528 - DNA, 13 bp, Homo sapiens
gtactatgttaat

SEQ ID NO: 3872529 - DNA, 16 bp, Homo sapiens
gtactcagagcagagc

SEQ ID NO: 3872530 - DNA, 17 bp, Homo sapiens
gtactctacgccaaagt

SEQ ID NO: 3872531 - DNA, 15 bp, Homo sapiens
gtactctctgctcta

SEQ ID NO: 3872532 - DNA, 17 bp, Homo sapiens
gtactctctgctctagc

SEQ ID NO: 3872533 - DNA, 23 bp, Homo sapiens
gtactctttatttctagcagagt

SEQ ID NO: 3872534 - DNA, 19 bp, Homo sapiens
gtactgaccccatcaccta

SEQ ID NO: 3872535 - DNA, 14 bp, Homo sapiens
gtactggcatggta

SEQ ID NO: 3872536 - DNA, 19 bp, Homo sapiens
gtactggggagaaataatt

SEQ ID NO: 3872537 - DNA, 15 bp, Homo sapiens
gtacttcctcctgat

SEQ ID NO: 3872538 - DNA, 20 bp, Homo sapiens
gtacttcctcctgatggcca

SEQ ID NO: 3872539 - DNA, 13 bp, Homo sapiens
gtacttctaagag

SEQ ID NO: 3872540 - DNA, 18 bp, Homo sapiens
gtagaaacacagttttga

SEQ ID NO: 3872541 - DNA, 22 bp, Homo sapiens
gtagaaccacttggctgctcat

SEQ ID NO: 3872542 - DNA, 16 bp, Homo sapiens
gtagaattatatctaa

SEQ ID NO: 3872543 - DNA, 19 bp, Homo sapiens
gtagaattatatctaattt

SEQ ID NO: 3872544 - DNA, 15 bp, Homo sapiens
gtagaccactgtcct

SEQ ID NO: 3872545 - DNA, 14 bp, Homo sapiens
gtagagatgtgtgt

SEQ ID NO: 3872546 - DNA, 20 bp, Homo sapiens
gtagagtttgaaggaggtga

SEQ ID NO: 3872547 - DNA, 17 bp, Homo sapiens
gtagatagaaagcaata

SEQ ID NO: 3872548 - DNA, 17 bp, Homo sapiens
gtagatcgcttgagccc

SEQ ID NO: 3872549 - DNA, 18 bp, Homo sapiens
gtagatcgcttgagccca

SEQ ID NO: 3872550 - DNA, 20 bp, Homo sapiens
gtagatcgcttgagcccagg

SEQ ID NO: 3872551 - DNA, 16 bp, Homo sapiens
gtagattacctgccac

SEQ ID NO: 3872552 - DNA, 21 bp, Homo sapiens
gtagcaagttctagagaagag

SEQ ID NO: 3872553 - DNA, 17 bp, Homo sapiens
gtagcaggtaccactga

SEQ ID NO: 3872554 - DNA, 11 bp, Homo sapiens
gtagccagccg

SEQ ID NO: 3872555 - DNA, 18 bp, Homo sapiens
gtagccatggctcaggca

SEQ ID NO: 3872556 - DNA, 22 bp, Homo sapiens
gtagccatggctcaggcaagcc

SEQ ID NO: 3872557 - DNA, 23 bp, Homo sapiens
gtagccatggctcaggcaagccc

SEQ ID NO: 3872558 - DNA, 15 bp, Homo sapiens
gtagcccggccaggg

SEQ ID NO: 3872559 - DNA, 14 bp, Homo sapiens
gtagccctttctgt

SEQ ID NO: 3872560 - DNA, 19 bp, Homo sapiens
gtagccgagagcctgctcc

SEQ ID NO: 3872561 - DNA, 21 bp, Homo sapiens
gtagcctccgtttatgggcct

SEQ ID NO: 3872562 - DNA, 22 bp, Homo sapiens
gtagcctccgtttatgggcctt

SEQ ID NO: 3872563 - DNA, 18 bp, Homo sapiens
gtagctctgcctccctct

SEQ ID NO: 3872564 - DNA, 14 bp, Homo sapiens
gtagctgagaggaa

SEQ ID NO: 3872565 - DNA, 17 bp, Homo sapiens
gtagctgagaggaagat

SEQ ID NO: 3872566 - DNA, 13 bp, Homo sapiens
gtagctgagctca

SEQ ID NO: 3872567 - DNA, 13 bp, Homo sapiens
gtagctgtgacct

SEQ ID NO: 3872568 - DNA, 21 bp, Homo sapiens
gtagctgtgacctgctgagct

SEQ ID NO: 3872569 - DNA, 21 bp, Homo sapiens
gtaggaatcctttgagaatgt

SEQ ID NO: 3872570 - DNA, 23 bp, Homo sapiens
gtaggaatgaccacgggcctcag

SEQ ID NO: 3872571 - DNA, 14 bp, Homo sapiens
gtaggcagagcctt

SEQ ID NO: 3872572 - DNA, 15 bp, Homo sapiens
gtaggcagagccttt

SEQ ID NO: 3872573 - DNA, 13 bp, Homo sapiens
gtaggcagcctct

SEQ ID NO: 3872574 - DNA, 18 bp, Homo sapiens
gtaggcagggaaccttaa

SEQ ID NO: 3872575 - DNA, 22 bp, Homo sapiens
gtaggcatgagggatcacaggg

SEQ ID NO: 3872576 - DNA, 19 bp, Homo sapiens
gtaggcccttgtcctgcca

SEQ ID NO: 3872577 - DNA, 16 bp, Homo sapiens
gtaggctttatgctgt

SEQ ID NO: 3872578 - DNA, 17 bp, Homo sapiens
gtaggggagtgtgggtg

SEQ ID NO: 3872579 - DNA, 19 bp, Homo sapiens
gtaggtattaaagatgtgt

SEQ ID NO: 3872580 - DNA, 15 bp, Homo sapiens
gtaggtccaagggcc

SEQ ID NO: 3872581 - DNA, 21 bp, Homo sapiens
gtagtagccctttctgtgtgc

SEQ ID NO: 3872582 - DNA, 19 bp, Homo sapiens
gtagtgatgttgtttggga

SEQ ID NO: 3872583 - DNA, 14 bp, Homo sapiens
gtagtggaagagca

SEQ ID NO: 3872584 - DNA, 13 bp, Homo sapiens
gtagttaggaaat

SEQ ID NO: 3872585 - DNA, 14 bp, Homo sapiens
gtagttaggaaata

SEQ ID NO: 3872586 - DNA, 16 bp, Homo sapiens
gtagttaggaaataaa

SEQ ID NO: 3872587 - DNA, 22 bp, Homo sapiens
gtagttaggaaataaaaccttt

SEQ ID NO: 3872588 - DNA, 23 bp, Homo sapiens
gtagttccctgaaaacccagaga

SEQ ID NO: 3872589 - DNA, 13 bp, Homo sapiens
gtagttttaacag

SEQ ID NO: 3872590 - DNA, 15 bp, Homo sapiens
gtagttttaacagaa

SEQ ID NO: 3872591 - DNA, 21 bp, Homo sapiens
gtagttttaacagaaccagag

SEQ ID NO: 3872592 - DNA, 14 bp, Homo sapiens
gtataaaagacaaa

SEQ ID NO: 3872593 - DNA, 11 bp, Homo sapiens
gtataaacatt

SEQ ID NO: 3872594 - DNA, 13 bp, Homo sapiens
gtataaacattaa

SEQ ID NO: 3872595 - DNA, 14 bp, Homo sapiens
gtataaacattaaa

SEQ ID NO: 3872596 - DNA, 19 bp, Homo sapiens
gtataaacattaaatgtct

SEQ ID NO: 3872597 - DNA, 17 bp, Homo sapiens
gtataaatggttgtctg

SEQ ID NO: 3872598 - DNA, 21 bp, Homo sapiens
gtataaatgtatatacacata

SEQ ID NO: 3872599 - DNA, 20 bp, Homo sapiens
gtataaccccaccttgccaa

SEQ ID NO: 3872600 - DNA, 19 bp, Homo sapiens
gtataatggttgactgggt

SEQ ID NO: 3872601 - DNA, 14 bp, Homo sapiens
gtatacaatatata

SEQ ID NO: 3872602 - DNA, 15 bp, Homo sapiens
gtatacaatatataa

SEQ ID NO: 3872603 - DNA, 18 bp, Homo sapiens
gtatacaatatataaaaa

SEQ ID NO: 3872604 - DNA, 14 bp, Homo sapiens
gtatacacacatat

SEQ ID NO: 3872605 - DNA, 21 bp, Homo sapiens
gtatacattttgttatagaat

SEQ ID NO: 3872606 - DNA, 14 bp, Homo sapiens
gtatagacagcact

SEQ ID NO: 3872607 - DNA, 14 bp, Homo sapiens
gtatagatgcaaga

SEQ ID NO: 3872608 - DNA, 15 bp, Homo sapiens
gtataggatgtcaga

SEQ ID NO: 3872609 - DNA, 16 bp, Homo sapiens
gtatagtgtaaaataa

SEQ ID NO: 3872610 - DNA, 20 bp, Homo sapiens
gtatagttttataaaactca

SEQ ID NO: 3872611 - DNA, 11 bp, Homo sapiens
gtatatacatt

SEQ ID NO: 3872612 - DNA, 14 bp, Homo sapiens
gtatatagatgtgc

SEQ ID NO: 3872613 - DNA, 22 bp, Homo sapiens
gtatatagtatatttatactct

SEQ ID NO: 3872614 - DNA, 14 bp, Homo sapiens
gtatatatatatgt

SEQ ID NO: 3872615 - DNA, 12 bp, Homo sapiens
gtatatatgtgt

SEQ ID NO: 3872616 - DNA, 18 bp, Homo sapiens
gtatatatgtgtgtttaa

SEQ ID NO: 3872617 - DNA, 12 bp, Homo sapiens
gtatatgtatat

SEQ ID NO: 3872618 - DNA, 21 bp, Homo sapiens
gtatatgtctcaggtccctgc

SEQ ID NO: 3872619 - DNA, 16 bp, Homo sapiens
gtatatgttgggtgca

SEQ ID NO: 3872620 - DNA, 13 bp, Homo sapiens
gtatatgttgtaa

SEQ ID NO: 3872621 - DNA, 15 bp, Homo sapiens
gtatatgttgtaata

SEQ ID NO: 3872622 - DNA, 18 bp, Homo sapiens
gtatatgttgtaataaaa

SEQ ID NO: 3872623 - DNA, 21 bp, Homo sapiens
gtatattatggtgtaatgcac

SEQ ID NO: 3872624 - DNA, 22 bp, Homo sapiens
gtatattgtaggaatcctttga

SEQ ID NO: 3872625 - DNA, 22 bp, Homo sapiens
gtatatttatagtcacaagagc

SEQ ID NO: 3872626 - DNA, 17 bp, Homo sapiens
gtatatttgtgtatgtg

SEQ ID NO: 3872627 - DNA, 18 bp, Homo sapiens
gtatatttgtgtatgtgt

SEQ ID NO: 3872628 - DNA, 19 bp, Homo sapiens
gtatcaataccaaatagct

SEQ ID NO: 3872629 - DNA, 22 bp, Homo sapiens
gggtggccccctgtgccagctc

SEQ ID NO: 3872630 - DNA, 23 bp, Homo sapiens
gggtggccccctgtgccagctca

SEQ ID NO: 3872631 - DNA, 11 bp, Homo sapiens
gggtggcctcg

SEQ ID NO: 3872632 - DNA, 18 bp, Homo sapiens
gggtggctactctgtgcc

SEQ ID NO: 3872633 - DNA, 19 bp, Homo sapiens
gggtggctactctgtgcca

SEQ ID NO: 3872634 - DNA, 23 bp, Homo sapiens
gggtggctactctgtgccagagc

SEQ ID NO: 3872635 - DNA, 16 bp, Homo sapiens
gggtgggagagccagc

SEQ ID NO: 3872636 - DNA, 13 bp, Homo sapiens
gggtgggcctggc

SEQ ID NO: 3872637 - DNA, 13 bp, Homo sapiens
gggtggggcagga

SEQ ID NO: 3872638 - DNA, 17 bp, Homo sapiens
gggtgtcatctgaggag

SEQ ID NO: 3872639 - DNA, 13 bp, Homo sapiens
gggtgtgcccttg

SEQ ID NO: 3872640 - DNA, 11 bp, Homo sapiens
gggtgtggcct

SEQ ID NO: 3872641 - DNA, 19 bp, Homo sapiens
gggttatttttgtccctgc

SEQ ID NO: 3872642 - DNA, 19 bp, Homo sapiens
gggttcagcccctcctctg

SEQ ID NO: 3872643 - DNA, 18 bp, Homo sapiens
gggttcatctagggacac

SEQ ID NO: 3872644 - DNA, 21 bp, Homo sapiens
gggttcattccccggccctcc

SEQ ID NO: 3872645 - DNA, 15 bp, Homo sapiens
gggttgcgggggagc

SEQ ID NO: 3872646 - DNA, 23 bp, Homo sapiens
gggttgcgggggagctggaaata

SEQ ID NO: 3872647 - DNA, 20 bp, Homo sapiens
gggttggtgggctggcccag

SEQ ID NO: 3872648 - DNA, 20 bp, Homo sapiens
gggttttattgtttaaaatc

SEQ ID NO: 3872649 - DNA, 18 bp, Homo sapiens
ggtacatttccctgtgct

SEQ ID NO: 3872650 - DNA, 18 bp, Homo sapiens
ggtaccaatcctggcagg

SEQ ID NO: 3872651 - DNA, 14 bp, Homo sapiens
ggtaccactgattt

SEQ ID NO: 3872652 - DNA, 22 bp, Homo sapiens
ggtactactgctgcaaagtgca

SEQ ID NO: 3872653 - DNA, 23 bp, Homo sapiens
ggtactactgctgcaaagtgcaa

SEQ ID NO: 3872654 - DNA, 22 bp, Homo sapiens
ggtagatcgcttgagcccagga

SEQ ID NO: 3872655 - DNA, 14 bp, Homo sapiens
ggtaggcagagcct

SEQ ID NO: 3872656 - DNA, 16 bp, Homo sapiens
ggtaggccaagctgaa

SEQ ID NO: 3872657 - DNA, 22 bp, Homo sapiens
ggtaggccaagctgaagtgaag

SEQ ID NO: 3872658 - DNA, 21 bp, Homo sapiens
ggtaggcccttgtcctgccag

SEQ ID NO: 3872659 - DNA, 14 bp, Homo sapiens
ggtagtactgggaa

SEQ ID NO: 3872660 - DNA, 18 bp, Homo sapiens
ggtatatttagaccctgt

SEQ ID NO: 3872661 - DNA, 19 bp, Homo sapiens
ggtatcaggcacaggcagg

SEQ ID NO: 3872662 - DNA, 14 bp, Homo sapiens
ggtatgagctgagg

SEQ ID NO: 3872663 - DNA, 15 bp, Homo sapiens
ggtatgagctgaggg

SEQ ID NO: 3872664 - DNA, 16 bp, Homo sapiens
ggtatgagctgagggg

SEQ ID NO: 3872665 - DNA, 17 bp, Homo sapiens
ggtatgctggccagcac

SEQ ID NO: 3872666 - DNA, 13 bp, Homo sapiens
ggtatgggaagcc

SEQ ID NO: 3872667 - DNA, 17 bp, Homo sapiens
ggtattaaagatgtgtt

SEQ ID NO: 3872668 - DNA, 16 bp, Homo sapiens
ggtcacaggactctgc

SEQ ID NO: 3872669 - DNA, 19 bp, Homo sapiens
ggtcacccttaatatttat

SEQ ID NO: 3872670 - DNA, 21 bp, Homo sapiens
ggtcactcttcctgcaaggac

SEQ ID NO: 3872671 - DNA, 22 bp, Homo sapiens
ggtcactcttcctgcaaggact

SEQ ID NO: 3872672 - DNA, 15 bp, Homo sapiens
ggtcagccagggcca

SEQ ID NO: 3872673 - DNA, 19 bp, Homo sapiens
ggtcagtgtggagaggggt

SEQ ID NO: 3872674 - DNA, 14 bp, Homo sapiens
ggtccaagggccat

SEQ ID NO: 3872675 - DNA, 16 bp, Homo sapiens
ggtccactcagggctg

SEQ ID NO: 3872676 - DNA, 17 bp, Homo sapiens
ggtccagcttgctcttc

SEQ ID NO: 3872677 - DNA, 15 bp, Homo sapiens
ggtccaggaaggcag

SEQ ID NO: 3872678 - DNA, 17 bp, Homo sapiens
ggtccaggaaggcagct

SEQ ID NO: 3872679 - DNA, 20 bp, Homo sapiens
ggtccaggaaggcagctgct

SEQ ID NO: 3872680 - DNA, 13 bp, Homo sapiens
ggtccagggttga

SEQ ID NO: 3872681 - DNA, 17 bp, Homo sapiens
ggtcccacatccctggg

SEQ ID NO: 3872682 - DNA, 21 bp, Homo sapiens
ggtcccacatccctgggcctg

SEQ ID NO: 3872683 - DNA, 22 bp, Homo sapiens
ggtcccacatccctgggcctgc

SEQ ID NO: 3872684 - DNA, 16 bp, Homo sapiens
ggtccccatcatccca

SEQ ID NO: 3872685 - DNA, 21 bp, Homo sapiens
ggtccccatcatcccagctgc

SEQ ID NO: 3872686 - DNA, 21 bp, Homo sapiens
ggtcccgtgcagcttctgtcc

SEQ ID NO: 3872687 - DNA, 21 bp, Homo sapiens
ggtccctcctttggaccctgt

SEQ ID NO: 3872688 - DNA, 17 bp, Homo sapiens
ggtccctcggagctgcc

SEQ ID NO: 3872689 - DNA, 20 bp, Homo sapiens
ggtccctgataacaacctgg

SEQ ID NO: 3872690 - DNA, 22 bp, Homo sapiens
ggtccctgataacaacctggag

SEQ ID NO: 3872691 - DNA, 22 bp, Homo sapiens
ggtccgattaatttatggtttc

SEQ ID NO: 3872692 - DNA, 15 bp, Homo sapiens
ggtccgcaccagctg

SEQ ID NO: 3872693 - DNA, 17 bp, Homo sapiens
ggtccggtgtccttttc

SEQ ID NO: 3872694 - DNA, 23 bp, Homo sapiens
ggtcctccatttcaactccagaa

SEQ ID NO: 3872695 - DNA, 15 bp, Homo sapiens
ggtcctgagcactgc

SEQ ID NO: 3872696 - DNA, 18 bp, Homo sapiens
ggtcctgagcactgccag

SEQ ID NO: 3872697 - DNA, 23 bp, Homo sapiens
ggtcctgagcactgccaggaggg

SEQ ID NO: 3872698 - DNA, 19 bp, Homo sapiens
ggtcctgcaatctccaggg

SEQ ID NO: 3872699 - DNA, 13 bp, Homo sapiens
ggtcctggcttct

SEQ ID NO: 3872700 - DNA, 16 bp, Homo sapiens
ggtccttgcacccctc

SEQ ID NO: 3872701 - DNA, 15 bp, Homo sapiens
ggtccttgctgcagg

SEQ ID NO: 3872702 - DNA, 20 bp, Homo sapiens
ggtccttggtgtgaccctct

SEQ ID NO: 3872703 - DNA, 16 bp, Homo sapiens
ggtcctttaggcagcc

SEQ ID NO: 3872704 - DNA, 18 bp, Homo sapiens
ggtcgccctaccctcact

SEQ ID NO: 3872705 - DNA, 19 bp, Homo sapiens
ggtcgtggagagctaggag

SEQ ID NO: 3872706 - DNA, 20 bp, Homo sapiens
ggtctcacttataccaaagg

SEQ ID NO: 3872707 - DNA, 18 bp, Homo sapiens
ggtctcagcccgggacag

SEQ ID NO: 3872708 - DNA, 15 bp, Homo sapiens
ggtctccctctcctg

SEQ ID NO: 3872709 - DNA, 17 bp, Homo sapiens
ggtctccctctcctgcc

SEQ ID NO: 3872710 - DNA, 18 bp, Homo sapiens
ggtctccttactctgagc

SEQ ID NO: 3872711 - DNA, 16 bp, Homo sapiens
ggtctgagcaccccct

SEQ ID NO: 3872712 - DNA, 13 bp, Homo sapiens
ggtctgagccctg

SEQ ID NO: 3872713 - DNA, 14 bp, Homo sapiens
ggtctgagccctgg

SEQ ID NO: 3872714 - DNA, 22 bp, Homo sapiens
ggtctggagaagcagtgagccg

SEQ ID NO: 3872715 - DNA, 18 bp, Homo sapiens
ggtggtcctgagacctga

SEQ ID NO: 3872716 - DNA, 13 bp, Homo sapiens
ggtggtgccagag

SEQ ID NO: 3872717 - DNA, 21 bp, Homo sapiens
ggtggtggatctgtccaagga

SEQ ID NO: 3872718 - DNA, 14 bp, Homo sapiens
ggtgtaaaaccatg

SEQ ID NO: 3872719 - DNA, 15 bp, Homo sapiens
ggtgtaaaaccatgt

SEQ ID NO: 3872720 - DNA, 18 bp, Homo sapiens
ggtgtagctcctctgctg

SEQ ID NO: 3872721 - DNA, 12 bp, Homo sapiens
ggtgtcccaagc

SEQ ID NO: 3872722 - DNA, 14 bp, Homo sapiens
ggtgtctggaagct

SEQ ID NO: 3872723 - DNA, 13 bp, Homo sapiens
ggtgtgaggctgg

SEQ ID NO: 3872724 - DNA, 15 bp, Homo sapiens
ggtgtgcctgccctg

SEQ ID NO: 3872725 - DNA, 18 bp, Homo sapiens
ggtgtggcctcagccctc

SEQ ID NO: 3872726 - DNA, 20 bp, Homo sapiens
ggtgttacacagcccaagag

SEQ ID NO: 3872727 - DNA, 22 bp, Homo sapiens
ggtgttgccatttctctgctta

SEQ ID NO: 3872728 - DNA, 17 bp, Homo sapiens
ggtgtttcaaaagtgga

SEQ ID NO: 3872729 - DNA, 21 bp, Homo sapiens
ggttatctgcctggcctggct

SEQ ID NO: 3872730 - DNA, 19 bp, Homo sapiens
ggttcaagagacactgctt

SEQ ID NO: 3872731 - DNA, 18 bp, Homo sapiens
ggttcaattccctgaagg

SEQ ID NO: 3872732 - DNA, 13 bp, Homo sapiens
ggttcactagagc

SEQ ID NO: 3872733 - DNA, 17 bp, Homo sapiens
ggttcagcccctcctct

SEQ ID NO: 3872734 - DNA, 16 bp, Homo sapiens
ggttccatgcctgagg

SEQ ID NO: 3872735 - DNA, 17 bp, Homo sapiens
ggttcccaataaaagtg

SEQ ID NO: 3872736 - DNA, 20 bp, Homo sapiens
ggttcccaataaaagtgact

SEQ ID NO: 3872737 - DNA, 13 bp, Homo sapiens
ggttcccagcagc

SEQ ID NO: 3872738 - DNA, 22 bp, Homo sapiens
ggttcccagcagctgggccggc

SEQ ID NO: 3872739 - DNA, 23 bp, Homo sapiens
ggttcccattttcgctttcctct

SEQ ID NO: 3872740 - DNA, 19 bp, Homo sapiens
ggttcccccagacagagcc

SEQ ID NO: 3872741 - DNA, 15 bp, Homo sapiens
ggttcccctgttcac

SEQ ID NO: 3872742 - DNA, 23 bp, Homo sapiens
ggttctagtctcctttgcactga

SEQ ID NO: 3872743 - DNA, 14 bp, Homo sapiens
ggttctttcttcct

SEQ ID NO: 3872744 - DNA, 17 bp, Homo sapiens
ggttctttcttcctctg

SEQ ID NO: 3872745 - DNA, 18 bp, Homo sapiens
ggttctttcttcctctgc

SEQ ID NO: 3872746 - DNA, 17 bp, Homo sapiens
ggttctttggaaggagt

SEQ ID NO: 3872747 - DNA, 14 bp, Homo sapiens
ggttgatcacactc

SEQ ID NO: 3872748 - DNA, 17 bp, Homo sapiens
ggttgccccttccccat

SEQ ID NO: 3872749 - DNA, 22 bp, Homo sapiens
ggttgccccttccccatctcca

SEQ ID NO: 3872750 - DNA, 19 bp, Homo sapiens
ggttgcttaaaagggacag

SEQ ID NO: 3872751 - DNA, 15 bp, Homo sapiens
ggttggagagctaga

SEQ ID NO: 3872752 - DNA, 19 bp, Homo sapiens
ggttgtaaatgctcgtgtg

SEQ ID NO: 3872753 - DNA, 13 bp, Homo sapiens
ggttgtgaggcct

SEQ ID NO: 3872754 - DNA, 14 bp, Homo sapiens
ggttgtgaggcctg

SEQ ID NO: 3872755 - DNA, 15 bp, Homo sapiens
ggtttacccagtggg

SEQ ID NO: 3872756 - DNA, 12 bp, Homo sapiens
ggtttgaaagcc

SEQ ID NO: 3872757 - DNA, 21 bp, Homo sapiens
ggtttgaaagtgaataaactt

SEQ ID NO: 3872758 - DNA, 16 bp, Homo sapiens
ggtttgccagtgaaga

SEQ ID NO: 3872759 - DNA, 17 bp, Homo sapiens
ggtttggggagaaataa

SEQ ID NO: 3872760 - DNA, 15 bp, Homo sapiens
ggtttgttgtaaata

SEQ ID NO: 3872761 - DNA, 16 bp, Homo sapiens
ggttttctaactgtaa

SEQ ID NO: 3872762 - DNA, 17 bp, Homo sapiens
ggttttctaactgtaaa

SEQ ID NO: 3872763 - DNA, 21 bp, Homo sapiens
ggttttctaactgtaaatcac

SEQ ID NO: 3872764 - DNA, 22 bp, Homo sapiens
ggttttctaactgtaaatcact

SEQ ID NO: 3872765 - DNA, 15 bp, Homo sapiens
ggttttctgttactt

SEQ ID NO: 3872766 - DNA, 16 bp, Homo sapiens
ggtttttggctctttc

SEQ ID NO: 3872767 - DNA, 23 bp, Homo sapiens
ggtttttgtttgtttcctttgtt

SEQ ID NO: 3872768 - DNA, 17 bp, Homo sapiens
gtaaaaaattaaagccc

SEQ ID NO: 3872769 - DNA, 13 bp, Homo sapiens
gtaaaaacaaaaa

SEQ ID NO: 3872770 - DNA, 19 bp, Homo sapiens
gtaaaaacaaaaagacagt

SEQ ID NO: 3872771 - DNA, 23 bp, Homo sapiens
gtaaaaccacagcagttgaaaag

SEQ ID NO: 3872772 - DNA, 15 bp, Homo sapiens
gtaaaattgtataga

SEQ ID NO: 3872773 - DNA, 14 bp, Homo sapiens
gtaaacagtgcctg

SEQ ID NO: 3872774 - DNA, 22 bp, Homo sapiens
gtaaacagtgcctgctgaatga

SEQ ID NO: 3872775 - DNA, 23 bp, Homo sapiens
gtaaactataaactactgtaatt

SEQ ID NO: 3872776 - DNA, 23 bp, Homo sapiens
gtaaactcaaaatatttgtacat

SEQ ID NO: 3872777 - DNA, 18 bp, Homo sapiens
gtaaagaataaatgaatc

SEQ ID NO: 3872778 - DNA, 15 bp, Homo sapiens
gtaaagtcaaggaga

SEQ ID NO: 3872779 - DNA, 14 bp, Homo sapiens
gtaaagtttaaaaa

SEQ ID NO: 3872780 - DNA, 15 bp, Homo sapiens
gtaaatacaaaataa

SEQ ID NO: 3872781 - DNA, 21 bp, Homo sapiens
gtaaatacaaaataaaattat

SEQ ID NO: 3872782 - DNA, 16 bp, Homo sapiens
gtaaatacatgtgtgg

SEQ ID NO: 3872783 - DNA, 13 bp, Homo sapiens
gtaaatatagtag

SEQ ID NO: 3872784 - DNA, 11 bp, Homo sapiens
gtaaatcactt

SEQ ID NO: 3872785 - DNA, 13 bp, Homo sapiens
gtaaatcacttgt

SEQ ID NO: 3872786 - DNA, 17 bp, Homo sapiens
gtaaatcacttgtaaat

SEQ ID NO: 3872787 - DNA, 22 bp, Homo sapiens
gtaaatccttatttatatatca

SEQ ID NO: 3872788 - DNA, 16 bp, Homo sapiens
gtaaatcctttttctt

SEQ ID NO: 3872789 - DNA, 21 bp, Homo sapiens
gtaaatctaactacaaggaca

SEQ ID NO: 3872790 - DNA, 22 bp, Homo sapiens
gtaaatctaactacaaggacaa

SEQ ID NO: 3872791 - DNA, 22 bp, Homo sapiens
gtaaatgaccaagaaaaagaaa

SEQ ID NO: 3872792 - DNA, 23 bp, Homo sapiens
gtaaatgcagccttcttttcaaa

SEQ ID NO: 3872793 - DNA, 19 bp, Homo sapiens
gtaaatgctcgtgtgattt

SEQ ID NO: 3872794 - DNA, 21 bp, Homo sapiens
gtaaatgctcgtgtgatttcc

SEQ ID NO: 3872795 - DNA, 15 bp, Homo sapiens
gtaaattggaaacat

SEQ ID NO: 3872796 - DNA, 16 bp, Homo sapiens
gtaaattggaaacatt

SEQ ID NO: 3872797 - DNA, 12 bp, Homo sapiens
gtaaattttaga

SEQ ID NO: 3872798 - DNA, 15 bp, Homo sapiens
gtaacaaggtgtctt

SEQ ID NO: 3872799 - DNA, 19 bp, Homo sapiens
gtaacaattttaatgctat

SEQ ID NO: 3872800 - DNA, 17 bp, Homo sapiens
gtaacacaagccacaga

SEQ ID NO: 3872801 - DNA, 15 bp, Homo sapiens
ggtctggctgagctg

SEQ ID NO: 3872802 - DNA, 24 bp, Homo sapiens
ggtctggttgttgcaccatctgct

SEQ ID NO: 3872803 - DNA, 15 bp, Homo sapiens
ggtctgtcccaccag

SEQ ID NO: 3872804 - DNA, 14 bp, Homo sapiens
ggtctgtgctgccc

SEQ ID NO: 3872805 - DNA, 19 bp, Homo sapiens
ggtctgtgctgtgcctgct

SEQ ID NO: 3872806 - DNA, 21 bp, Homo sapiens
ggtctgtgctgtgcctgctag

SEQ ID NO: 3872807 - DNA, 17 bp, Homo sapiens
ggtctttgcacatgtga

SEQ ID NO: 3872808 - DNA, 12 bp, Homo sapiens
ggtgaaattatg

SEQ ID NO: 3872809 - DNA, 17 bp, Homo sapiens
ggtgacatgtgcctgta

SEQ ID NO: 3872810 - DNA, 16 bp, Homo sapiens
ggtgaccccagggcac

SEQ ID NO: 3872811 - DNA, 23 bp, Homo sapiens
ggtgaccccagggcacaggagct

SEQ ID NO: 3872812 - DNA, 23 bp, Homo sapiens
ggtgacccggcaccccctgcagc

SEQ ID NO: 3872813 - DNA, 13 bp, Homo sapiens
ggtgactggagcc

SEQ ID NO: 3872814 - DNA, 12 bp, Homo sapiens
ggtgactgtccc

SEQ ID NO: 3872815 - DNA, 15 bp, Homo sapiens
ggtgaggcccagcct

SEQ ID NO: 3872816 - DNA, 14 bp, Homo sapiens
ggtgatcagaaggc

SEQ ID NO: 3872817 - DNA, 23 bp, Homo sapiens
ggtgatcagaaggctggggccag

SEQ ID NO: 3872818 - DNA, 12 bp, Homo sapiens
ggtgatcagtgc

SEQ ID NO: 3872819 - DNA, 16 bp, Homo sapiens
ggtgatgagggcagca

SEQ ID NO: 3872820 - DNA, 17 bp, Homo sapiens
ggtgatgagggcagcag

SEQ ID NO: 3872821 - DNA, 22 bp, Homo sapiens
ggtgatgagggcagcagccagc

SEQ ID NO: 3872822 - DNA, 15 bp, Homo sapiens
ggtgcaagagacaga

SEQ ID NO: 3872823 - DNA, 22 bp, Homo sapiens
ggtgcaagagacagagccccca

SEQ ID NO: 3872824 - DNA, 20 bp, Homo sapiens
ggtgcacccactcaccaggg

SEQ ID NO: 3872825 - DNA, 18 bp, Homo sapiens
ggtgcagttgacagcagg

SEQ ID NO: 3872826 - DNA, 21 bp, Homo sapiens
ggtgcatggcttggggagcag

SEQ ID NO: 3872827 - DNA, 23 bp, Homo sapiens
ggtgcatggcttggggagcagag

SEQ ID NO: 3872828 - DNA, 14 bp, Homo sapiens
ggtgccaccaataa

SEQ ID NO: 3872829 - DNA, 16 bp, Homo sapiens
ggtgccaccaataaaa

SEQ ID NO: 3872830 - DNA, 23 bp, Homo sapiens
ggtgccaccaataaaaatcctac

SEQ ID NO: 3872831 - DNA, 15 bp, Homo sapiens
ggtgccactccctga

SEQ ID NO: 3872832 - DNA, 11 bp, Homo sapiens
ggtgccagagg

SEQ ID NO: 3872833 - DNA, 12 bp, Homo sapiens
ggtgccagaggt

SEQ ID NO: 3872834 - DNA, 23 bp, Homo sapiens
ggtgccctctggatcctgctgtg

SEQ ID NO: 3872835 - DNA, 17 bp, Homo sapiens
ggtgcctatttattggg

SEQ ID NO: 3872836 - DNA, 14 bp, Homo sapiens
ggtgcctgagctgg

SEQ ID NO: 3872837 - DNA, 10 bp, Homo sapiens
ggtgcctggc

SEQ ID NO: 3872838 - DNA, 22 bp, Homo sapiens
ggtgcctgggtggggctgctcc

SEQ ID NO: 3872839 - DNA, 18 bp, Homo sapiens
ggtgcctgtgaggcaggg

SEQ ID NO: 3872840 - DNA, 15 bp, Homo sapiens
ggtgcggcaggagca

SEQ ID NO: 3872841 - DNA, 12 bp, Homo sapiens
ggtgcgtggctg

SEQ ID NO: 3872842 - DNA, 17 bp, Homo sapiens
ggtgcgtggctgtggca

SEQ ID NO: 3872843 - DNA, 18 bp, Homo sapiens
ggtgcgtggctgtggcac

SEQ ID NO: 3872844 - DNA, 21 bp, Homo sapiens
ggtgcgtggctgtggcacaga

SEQ ID NO: 3872845 - DNA, 18 bp, Homo sapiens
ggtgctcgcttctcctcc

SEQ ID NO: 3872846 - DNA, 12 bp, Homo sapiens
ggtgctctggcg

SEQ ID NO: 3872847 - DNA, 14 bp, Homo sapiens
ggtgctctggcggc

SEQ ID NO: 3872848 - DNA, 20 bp, Homo sapiens
ggtgctctggcggcttcctg

SEQ ID NO: 3872849 - DNA, 22 bp, Homo sapiens
ggtgctgtcctgttttactgga

SEQ ID NO: 3872850 - DNA, 14 bp, Homo sapiens
ggtgcttctcctct

SEQ ID NO: 3872851 - DNA, 21 bp, Homo sapiens
ggtgctttcaggtctggggct

SEQ ID NO: 3872852 - DNA, 18 bp, Homo sapiens
ggtgcttttgatgtgaaa

SEQ ID NO: 3872853 - DNA, 13 bp, Homo sapiens
ggtggaagccctc

SEQ ID NO: 3872854 - DNA, 16 bp, Homo sapiens
ggtggaaggcccgagg

SEQ ID NO: 3872855 - DNA, 18 bp, Homo sapiens
ggtggattcctgggcaag

SEQ ID NO: 3872856 - DNA, 20 bp, Homo sapiens
ggtggcaccagatgcaacct

SEQ ID NO: 3872857 - DNA, 14 bp, Homo sapiens
ggtggcaggaccag

SEQ ID NO: 3872858 - DNA, 18 bp, Homo sapiens
ggtggcaggaccaggact

SEQ ID NO: 3872859 - DNA, 22 bp, Homo sapiens
ggtggccaatccaggtgggaga

SEQ ID NO: 3872860 - DNA, 20 bp, Homo sapiens
ggtggccactccagacccct

SEQ ID NO: 3872861 - DNA, 14 bp, Homo sapiens
ggtggccatccctg

SEQ ID NO: 3872862 - DNA, 22 bp, Homo sapiens
ggtggccatccctgggcccctc

SEQ ID NO: 3872863 - DNA, 23 bp, Homo sapiens
ggtggccccctgtgccagctcag

SEQ ID NO: 3872864 - DNA, 18 bp, Homo sapiens
ggtggcccgacagcctgg

SEQ ID NO: 3872865 - DNA, 19 bp, Homo sapiens
ggtggcccgacagcctggc

SEQ ID NO: 3872866 - DNA, 20 bp, Homo sapiens
ggtggcccgacagcctggca

SEQ ID NO: 3872867 - DNA, 23 bp, Homo sapiens
ggtggctactctgtgccagagcc

SEQ ID NO: 3872868 - DNA, 17 bp, Homo sapiens
ggtggctagtcagagag

SEQ ID NO: 3872869 - DNA, 17 bp, Homo sapiens
ggtggctcttgcctgta

SEQ ID NO: 3872870 - DNA, 15 bp, Homo sapiens
ggtggctgacccagt

SEQ ID NO: 3872871 - DNA, 18 bp, Homo sapiens
ggtggctgacccagtccc

SEQ ID NO: 3872872 - DNA, 16 bp, Homo sapiens
ggtgggacagccccag

SEQ ID NO: 3872873 - DNA, 18 bp, Homo sapiens
ggtgggacagccccaggg

SEQ ID NO: 3872874 - DNA, 19 bp, Homo sapiens
ggtgggacagccccagggc

SEQ ID NO: 3872875 - DNA, 20 bp, Homo sapiens
ggtgggacagccccagggcc

SEQ ID NO: 3872876 - DNA, 16 bp, Homo sapiens
ggtgggcctggcctga

SEQ ID NO: 3872877 - DNA, 16 bp, Homo sapiens
ggtgggctggcccagc

SEQ ID NO: 3872878 - DNA, 17 bp, Homo sapiens
ggtgggctggcccagcc

SEQ ID NO: 3872879 - DNA, 12 bp, Homo sapiens
ggtggggaccaa

SEQ ID NO: 3872880 - DNA, 19 bp, Homo sapiens
ggtggggaccaaaaccatg

SEQ ID NO: 3872881 - DNA, 12 bp, Homo sapiens
ggtggggcagct

SEQ ID NO: 3872882 - DNA, 13 bp, Homo sapiens
ggtggggcagctc

SEQ ID NO: 3872883 - DNA, 13 bp, Homo sapiens
ggtggggctgctc

SEQ ID NO: 3872884 - DNA, 17 bp, Homo sapiens
ggtggggctgctcctcc

SEQ ID NO: 3872885 - DNA, 20 bp, Homo sapiens
ggtgggtccaggaaggcagc

SEQ ID NO: 3872886 - DNA, 17 bp, Homo sapiens
ggtgggttttcttccca

SEQ ID NO: 3872887 - DNA, 21 bp, Homo sapiens
gggacagtattctcagtgctc

SEQ ID NO: 3872888 - DNA, 15 bp, Homo sapiens
gggacagttggcaga

SEQ ID NO: 3872889 - DNA, 20 bp, Homo sapiens
gggacattccaaagaacagc

SEQ ID NO: 3872890 - DNA, 20 bp, Homo sapiens
gggaccattgacctcagctg

SEQ ID NO: 3872891 - DNA, 21 bp, Homo sapiens
gggacccagctactctgtcca

SEQ ID NO: 3872892 - DNA, 14 bp, Homo sapiens
gggacccctcccaa

SEQ ID NO: 3872893 - DNA, 19 bp, Homo sapiens
gggacccctcccaacctca

SEQ ID NO: 3872894 - DNA, 20 bp, Homo sapiens
gggacgcgcacacacaccgg

SEQ ID NO: 3872895 - DNA, 13 bp, Homo sapiens
gggacgcgggctg

SEQ ID NO: 3872896 - DNA, 13 bp, Homo sapiens
gggacgcttccag

SEQ ID NO: 3872897 - DNA, 14 bp, Homo sapiens
gggacgcttccaga

SEQ ID NO: 3872898 - DNA, 21 bp, Homo sapiens
gggacgcttccagaccacctg

SEQ ID NO: 3872899 - DNA, 23 bp, Homo sapiens
gggacgcttccagaccacctgcc

SEQ ID NO: 3872900 - DNA, 20 bp, Homo sapiens
gggactcaagggtccagaag

SEQ ID NO: 3872901 - DNA, 19 bp, Homo sapiens
gggactggaaccagggaga

SEQ ID NO: 3872902 - DNA, 20 bp, Homo sapiens
gggactggggatgtgggagg

SEQ ID NO: 3872903 - DNA, 17 bp, Homo sapiens
gggactgtcgctgcttc

SEQ ID NO: 3872904 - DNA, 13 bp, Homo sapiens
gggacttgtgcca

SEQ ID NO: 3872905 - DNA, 14 bp, Homo sapiens
gggacttgtgccag

SEQ ID NO: 3872906 - DNA, 10 bp, Homo sapiens
gggagaaaac

SEQ ID NO: 3872907 - DNA, 13 bp, Homo sapiens
gggagagaccctt

SEQ ID NO: 3872908 - DNA, 14 bp, Homo sapiens
gggagagccagctc

SEQ ID NO: 3872909 - DNA, 14 bp, Homo sapiens
gggagatggtcagt

SEQ ID NO: 3872910 - DNA, 21 bp, Homo sapiens
gggagcagagtataggatgga

SEQ ID NO: 3872911 - DNA, 17 bp, Homo sapiens
gggagcccctaggaaag

SEQ ID NO: 3872912 - DNA, 12 bp, Homo sapiens
gggagctctgca

SEQ ID NO: 3872913 - DNA, 12 bp, Homo sapiens
gggagctggaaa

SEQ ID NO: 3872914 - DNA, 13 bp, Homo sapiens
gggagctggaaat

SEQ ID NO: 3872915 - DNA, 14 bp, Homo sapiens
gggagctggaaata

SEQ ID NO: 3872916 - DNA, 14 bp, Homo sapiens
gggagctgggcttc

SEQ ID NO: 3872917 - DNA, 11 bp, Homo sapiens
gggaggaaggg

SEQ ID NO: 3872918 - DNA, 21 bp, Homo sapiens
gggaggaagggccaggagaga

SEQ ID NO: 3872919 - DNA, 12 bp, Homo sapiens
gggaggactccg

SEQ ID NO: 3872920 - DNA, 19 bp, Homo sapiens
gggaggatgccacagcccc

SEQ ID NO: 3872921 - DNA, 12 bp, Homo sapiens
gggaggcaccag

SEQ ID NO: 3872922 - DNA, 14 bp, Homo sapiens
gggaggcaccagct

SEQ ID NO: 3872923 - DNA, 19 bp, Homo sapiens
gggaggccaaggcaggtag

SEQ ID NO: 3872924 - DNA, 13 bp, Homo sapiens
gggaggcctcagt

SEQ ID NO: 3872925 - DNA, 21 bp, Homo sapiens
gggaggcctcgtaccagccag

SEQ ID NO: 3872926 - DNA, 23 bp, Homo sapiens
gggaggcctcgtaccagccagga

SEQ ID NO: 3872927 - DNA, 18 bp, Homo sapiens
gggaggcggagagtacag

SEQ ID NO: 3872928 - DNA, 15 bp, Homo sapiens
gggaggctgagacag

SEQ ID NO: 3872929 - DNA, 17 bp, Homo sapiens
gggaggctgagacagga

SEQ ID NO: 3872930 - DNA, 17 bp, Homo sapiens
gggaggctgaggcagga

SEQ ID NO: 3872931 - DNA, 14 bp, Homo sapiens
gggagggctctgag

SEQ ID NO: 3872932 - DNA, 20 bp, Homo sapiens
gggagggctctgaggcgccc

SEQ ID NO: 3872933 - DNA, 14 bp, Homo sapiens
gggagggggctcca

SEQ ID NO: 3872934 - DNA, 15 bp, Homo sapiens
gggaggtcgaggtag

SEQ ID NO: 3872935 - DNA, 18 bp, Homo sapiens
gggaggtgagaccacctc

SEQ ID NO: 3872936 - DNA, 20 bp, Homo sapiens
gggagttcgagaccaacctg

SEQ ID NO: 3872937 - DNA, 23 bp, Homo sapiens
gggagttcgagaccaacctgacc

SEQ ID NO: 3872938 - DNA, 21 bp, Homo sapiens
gggatcgcaccttttatacca

SEQ ID NO: 3872939 - DNA, 18 bp, Homo sapiens
gggatcttgcattcccag

SEQ ID NO: 3872940 - DNA, 17 bp, Homo sapiens
gggatgactagaggcag

SEQ ID NO: 3872941 - DNA, 15 bp, Homo sapiens
gggatgagccgctgt

SEQ ID NO: 3872942 - DNA, 14 bp, Homo sapiens
gggatggaggagaa

SEQ ID NO: 3872943 - DNA, 12 bp, Homo sapiens
gggatgtcctct

SEQ ID NO: 3872944 - DNA, 19 bp, Homo sapiens
gggatttcttcgctgctct

SEQ ID NO: 3872945 - DNA, 17 bp, Homo sapiens
gggcaaaccatttcaaa

SEQ ID NO: 3872946 - DNA, 21 bp, Homo sapiens
gggcaaacccttctcttctcc

SEQ ID NO: 3872947 - DNA, 21 bp, Homo sapiens
gggcaaatgacatgcactgac

SEQ ID NO: 3872948 - DNA, 16 bp, Homo sapiens
gggcaatgaaaccaaa

SEQ ID NO: 3872949 - DNA, 14 bp, Homo sapiens
gggcacaccactgc

SEQ ID NO: 3872950 - DNA, 22 bp, Homo sapiens
gggcacaccactgccctgcctg

SEQ ID NO: 3872951 - DNA, 12 bp, Homo sapiens
gggcacaggagc

SEQ ID NO: 3872952 - DNA, 14 bp, Homo sapiens
gggcacaggagcta

SEQ ID NO: 3872953 - DNA, 18 bp, Homo sapiens
gggcacaggagctacctg

SEQ ID NO: 3872954 - DNA, 16 bp, Homo sapiens
gggcacatgaggaggg

SEQ ID NO: 3872955 - DNA, 16 bp, Homo sapiens
gggcactggtggcccg

SEQ ID NO: 3872956 - DNA, 16 bp, Homo sapiens
gggcagaagggagaag

SEQ ID NO: 3872957 - DNA, 18 bp, Homo sapiens
gggcagaagggagaagga

SEQ ID NO: 3872958 - DNA, 19 bp, Homo sapiens
gggcagaagggagaaggat

SEQ ID NO: 3872959 - DNA, 14 bp, Homo sapiens
gggcagaggctgga

SEQ ID NO: 3872960 - DNA, 15 bp, Homo sapiens
gggcagaggctggag

SEQ ID NO: 3872961 - DNA, 12 bp, Homo sapiens
gggcagagggaa

SEQ ID NO: 3872962 - DNA, 15 bp, Homo sapiens
gggcagagggcagag

SEQ ID NO: 3872963 - DNA, 13 bp, Homo sapiens
gggcagaggggca

SEQ ID NO: 3872964 - DNA, 14 bp, Homo sapiens
gggcagaggggcag

SEQ ID NO: 3872965 - DNA, 17 bp, Homo sapiens
gggcagcaccctccccc

SEQ ID NO: 3872966 - DNA, 12 bp, Homo sapiens
gggcagcagcca

SEQ ID NO: 3872967 - DNA, 19 bp, Homo sapiens
gggcagcagccagccctgc

SEQ ID NO: 3872968 - DNA, 14 bp, Homo sapiens
gggcagccaggggc

SEQ ID NO: 3872969 - DNA, 19 bp, Homo sapiens
gggcagccgctaggagaga

SEQ ID NO: 3872970 - DNA, 22 bp, Homo sapiens
gggcagccgctaggagagactg

SEQ ID NO: 3872971 - DNA, 22 bp, Homo sapiens
gggcagcctccaccttgctctt

SEQ ID NO: 3872972 - DNA, 21 bp, Homo sapiens
gggcagctcctctgtctcgag

SEQ ID NO: 3872973 - DNA, 17 bp, Homo sapiens
gggcagctgggccccac

SEQ ID NO: 3872974 - DNA, 19 bp, Homo sapiens
gggcctttaaagacttaag

SEQ ID NO: 3872975 - DNA, 22 bp, Homo sapiens
gggcctttcctgtgccaacctg

SEQ ID NO: 3872976 - DNA, 23 bp, Homo sapiens
gggcgcacatgttatccacaagc

SEQ ID NO: 3872977 - DNA, 23 bp, Homo sapiens
gggcgcccattcgtctgtcccag

SEQ ID NO: 3872978 - DNA, 21 bp, Homo sapiens
gggcgggagtgggggctgtgc

SEQ ID NO: 3872979 - DNA, 12 bp, Homo sapiens
gggcggggcagg

SEQ ID NO: 3872980 - DNA, 20 bp, Homo sapiens
gggcgggggagccaacagca

SEQ ID NO: 3872981 - DNA, 20 bp, Homo sapiens
gggctaagagctagcgctgc

SEQ ID NO: 3872982 - DNA, 16 bp, Homo sapiens
gggctactggcagctc

SEQ ID NO: 3872983 - DNA, 17 bp, Homo sapiens
gggctactggcagctcc

SEQ ID NO: 3872984 - DNA, 15 bp, Homo sapiens
gggctagaacctgga

SEQ ID NO: 3872985 - DNA, 16 bp, Homo sapiens
gggctagaacctggca

SEQ ID NO: 3872986 - DNA, 21 bp, Homo sapiens
gggctagtgtgagtggcagcc

SEQ ID NO: 3872987 - DNA, 21 bp, Homo sapiens
gggctatgtgtcacagctctg

SEQ ID NO: 3872988 - DNA, 22 bp, Homo sapiens
gggctatttctctccccactga

SEQ ID NO: 3872989 - DNA, 15 bp, Homo sapiens
gggctcagggctgga

SEQ ID NO: 3872990 - DNA, 19 bp, Homo sapiens
gggctccatggaggaggtg

SEQ ID NO: 3872991 - DNA, 12 bp, Homo sapiens
gggctccctcct

SEQ ID NO: 3872992 - DNA, 14 bp, Homo sapiens
gggctcctggctgc

SEQ ID NO: 3872993 - DNA, 18 bp, Homo sapiens
gggctcctggctgccagg

SEQ ID NO: 3872994 - DNA, 20 bp, Homo sapiens
gggctcctggctgccaggcg

SEQ ID NO: 3872995 - DNA, 20 bp, Homo sapiens
gggctcctttctccagccag

SEQ ID NO: 3872996 - DNA, 18 bp, Homo sapiens
gggctcgccccacccagg

SEQ ID NO: 3872997 - DNA, 17 bp, Homo sapiens
gggctcgtggccttccc

SEQ ID NO: 3872998 - DNA, 17 bp, Homo sapiens
gggctctaacgcctgag

SEQ ID NO: 3872999 - DNA, 21 bp, Homo sapiens
gggctctaacgcctgagccca

SEQ ID NO: 3873000 - DNA, 23 bp, Homo sapiens
gggctctaacgcctgagcccagg

SEQ ID NO: 3873001 - DNA, 13 bp, Homo sapiens
gggctctccaaag

SEQ ID NO: 3873002 - DNA, 19 bp, Homo sapiens
gggctctccaaaggggctg

SEQ ID NO: 3873003 - DNA, 21 bp, Homo sapiens
gggctctccaaaggggctgct

SEQ ID NO: 3873004 - DNA, 22 bp, Homo sapiens
gggctctccaaaggggctgctg

SEQ ID NO: 3873005 - DNA, 17 bp, Homo sapiens
gggctctccacctcagc

SEQ ID NO: 3873006 - DNA, 14 bp, Homo sapiens
gggctctggccacc

SEQ ID NO: 3873007 - DNA, 16 bp, Homo sapiens
gggctctggccaccct

SEQ ID NO: 3873008 - DNA, 20 bp, Homo sapiens
gggctgacacctaccatgct

SEQ ID NO: 3873009 - DNA, 22 bp, Homo sapiens
gggctgcccctgtaggttgctt

SEQ ID NO: 3873010 - DNA, 21 bp, Homo sapiens
gggctgccctggtgctgccac

SEQ ID NO: 3873011 - DNA, 22 bp, Homo sapiens
gggctgcccttcgctgccagga

SEQ ID NO: 3873012 - DNA, 14 bp, Homo sapiens
gggctgctcatcac

SEQ ID NO: 3873013 - DNA, 18 bp, Homo sapiens
gggctgctcatcacccag

SEQ ID NO: 3873014 - DNA, 18 bp, Homo sapiens
gggctgctcctccagggc

SEQ ID NO: 3873015 - DNA, 14 bp, Homo sapiens
gggctgctggggca

SEQ ID NO: 3873016 - DNA, 16 bp, Homo sapiens
gggctgctggggcatg

SEQ ID NO: 3873017 - DNA, 21 bp, Homo sapiens
gggctggaatctggagagcta

SEQ ID NO: 3873018 - DNA, 21 bp, Homo sapiens
gggctggagtgcgctcttggt

SEQ ID NO: 3873019 - DNA, 13 bp, Homo sapiens
gggctggcaagca

SEQ ID NO: 3873020 - DNA, 15 bp, Homo sapiens
gggctggcaagcagg

SEQ ID NO: 3873021 - DNA, 12 bp, Homo sapiens
gggctgggccca

SEQ ID NO: 3873022 - DNA, 14 bp, Homo sapiens
gggctgggcccaca

SEQ ID NO: 3873023 - DNA, 15 bp, Homo sapiens
gggctgggcccacag

SEQ ID NO: 3873024 - DNA, 22 bp, Homo sapiens
gggctgggcccacagagatgca

SEQ ID NO: 3873025 - DNA, 17 bp, Homo sapiens
gggctggggtttattta

SEQ ID NO: 3873026 - DNA, 17 bp, Homo sapiens
gggctgttggacagctg

SEQ ID NO: 3873027 - DNA, 15 bp, Homo sapiens
gggcttcctgggtcc

SEQ ID NO: 3873028 - DNA, 16 bp, Homo sapiens
gggcttctcctgaccc

SEQ ID NO: 3873029 - DNA, 18 bp, Homo sapiens
gggcttggacttcctggg

SEQ ID NO: 3873030 - DNA, 20 bp, Homo sapiens
gggcttgtagaccactgtcc

SEQ ID NO: 3873031 - DNA, 24 bp, Homo sapiens
gggcttgttgtttttaagtcctgt

SEQ ID NO: 3873032 - DNA, 15 bp, Homo sapiens
gggctttgcaggctc

SEQ ID NO: 3873033 - DNA, 20 bp, Homo sapiens
gggctttgcaggctctgggc

SEQ ID NO: 3873034 - DNA, 14 bp, Homo sapiens
ggggaacccagccc

SEQ ID NO: 3873035 - DNA, 12 bp, Homo sapiens
ggggaacgcaga

SEQ ID NO: 3873036 - DNA, 19 bp, Homo sapiens
ggggaacgcagaggcggaa

SEQ ID NO: 3873037 - DNA, 13 bp, Homo sapiens
ggggaactggcca

SEQ ID NO: 3873038 - DNA, 23 bp, Homo sapiens
ggggaagggccagtctgggctgc

SEQ ID NO: 3873039 - DNA, 20 bp, Homo sapiens
ggggacagttggcagagaag

SEQ ID NO: 3873040 - DNA, 20 bp, Homo sapiens
ggggaccatgaagagactct

SEQ ID NO: 3873041 - DNA, 17 bp, Homo sapiens
ggggacgcgcacacaca

SEQ ID NO: 3873042 - DNA, 10 bp, Homo sapiens
ggggagaaat

SEQ ID NO: 3873043 - DNA, 16 bp, Homo sapiens
ggggagaagggccagc

SEQ ID NO: 3873044 - DNA, 17 bp, Homo sapiens
ggggagccaacagcagc

SEQ ID NO: 3873045 - DNA, 12 bp, Homo sapiens
ggggaggaaggg

SEQ ID NO: 3873046 - DNA, 22 bp, Homo sapiens
ggggaggaagggccaggagaga

SEQ ID NO: 3873047 - DNA, 20 bp, Homo sapiens
ggggaggcagctccaacagc

SEQ ID NO: 3873048 - DNA, 14 bp, Homo sapiens
ggggagggagagca

SEQ ID NO: 3873049 - DNA, 12 bp, Homo sapiens
ggggagggaggt

SEQ ID NO: 3873050 - DNA, 16 bp, Homo sapiens
ggggagggggacgcgc

SEQ ID NO: 3873051 - DNA, 13 bp, Homo sapiens
ggggaggtgcctg

SEQ ID NO: 3873052 - DNA, 14 bp, Homo sapiens
ggggatgtgggagg

SEQ ID NO: 3873053 - DNA, 18 bp, Homo sapiens
ggggatgtgggagggagc

SEQ ID NO: 3873054 - DNA, 20 bp, Homo sapiens
ggggattggagggaagacag

SEQ ID NO: 3873055 - DNA, 17 bp, Homo sapiens
ggggcaggagtagctga

SEQ ID NO: 3873056 - DNA, 19 bp, Homo sapiens
ggggcaggagtagctgagc

SEQ ID NO: 3873057 - DNA, 13 bp, Homo sapiens
ggggcaggcctgg

SEQ ID NO: 3873058 - DNA, 16 bp, Homo sapiens
ggggcaggcctgggac

SEQ ID NO: 3873059 - DNA, 20 bp, Homo sapiens
ggggcatagaaactgaggag

SEQ ID NO: 3873060 - DNA, 17 bp, Homo sapiens
ggggcatggttccttcc

SEQ ID NO: 3873061 - DNA, 20 bp, Homo sapiens
ggggcatgtgtgcctgtggc

SEQ ID NO: 3873062 - DNA, 15 bp, Homo sapiens
ggggccagacacaga

SEQ ID NO: 3873063 - DNA, 17 bp, Homo sapiens
ggggccagctggtgctg

SEQ ID NO: 3873064 - DNA, 18 bp, Homo sapiens
ggggccagtgagggctgg

SEQ ID NO: 3873065 - DNA, 23 bp, Homo sapiens
ggggccccagatctgcctgggcc

SEQ ID NO: 3873066 - DNA, 11 bp, Homo sapiens
ggggccctggg

SEQ ID NO: 3873067 - DNA, 18 bp, Homo sapiens
ggggccctgggcctcagt

SEQ ID NO: 3873068 - DNA, 11 bp, Homo sapiens
ggggccctgtg

SEQ ID NO: 3873069 - DNA, 21 bp, Homo sapiens
ggggccgggcaggtcctgccc

SEQ ID NO: 3873070 - DNA, 11 bp, Homo sapiens
ggggcctggca

SEQ ID NO: 3873071 - DNA, 12 bp, Homo sapiens
ggggcctggcag

SEQ ID NO: 3873072 - DNA, 11 bp, Homo sapiens
ggggcctggct

SEQ ID NO: 3873073 - DNA, 22 bp, Homo sapiens
ggggcctggctggctgagggca

SEQ ID NO: 3873074 - DNA, 21 bp, Homo sapiens
ggggcctggcttgctccaggg

SEQ ID NO: 3873075 - DNA, 16 bp, Homo sapiens
ggggcctgggaaagga

SEQ ID NO: 3873076 - DNA, 17 bp, Homo sapiens
ggggcctgggaaaggaa

SEQ ID NO: 3873077 - DNA, 14 bp, Homo sapiens
ggggcctgtactgc

SEQ ID NO: 3873078 - DNA, 15 bp, Homo sapiens
ggggcctgtactgcc

SEQ ID NO: 3873079 - DNA, 17 bp, Homo sapiens
ggggcctgtactgcctg

SEQ ID NO: 3873080 - DNA, 19 bp, Homo sapiens
ggggcgatcaagtccagag

SEQ ID NO: 3873081 - DNA, 20 bp, Homo sapiens
ggggcgatcaagtccagagc

SEQ ID NO: 3873082 - DNA, 12 bp, Homo sapiens
ggggcgctcagg

SEQ ID NO: 3873083 - DNA, 22 bp, Homo sapiens
ggggcgctcaggacccaggccc

SEQ ID NO: 3873084 - DNA, 15 bp, Homo sapiens
ggggctcagcaaggt

SEQ ID NO: 3873085 - DNA, 16 bp, Homo sapiens
ggggctcagcaaggtg

SEQ ID NO: 3873086 - DNA, 17 bp, Homo sapiens
ggggctctaacgcctga

SEQ ID NO: 3873087 - DNA, 24 bp, Homo sapiens
ggggctctccaaaggggctgctgg

SEQ ID NO: 3873088 - DNA, 23 bp, Homo sapiens
ggggctgctcatcacccagtcct

SEQ ID NO: 3873089 - DNA, 15 bp, Homo sapiens
ggggctgctcctcca

SEQ ID NO: 3873090 - DNA, 12 bp, Homo sapiens
ggggctgctggg

SEQ ID NO: 3873091 - DNA, 18 bp, Homo sapiens
ggggctggcaagcaggga

SEQ ID NO: 3873092 - DNA, 18 bp, Homo sapiens
gggggccagctggtgctg

SEQ ID NO: 3873093 - DNA, 18 bp, Homo sapiens
gggggccgggcaggtcct

SEQ ID NO: 3873094 - DNA, 20 bp, Homo sapiens
gggggccgggcaggtcctgc

SEQ ID NO: 3873095 - DNA, 14 bp, Homo sapiens
gggggcctggctgg

SEQ ID NO: 3873096 - DNA, 12 bp, Homo sapiens
gggggctctcca

SEQ ID NO: 3873097 - DNA, 22 bp, Homo sapiens
gggggtgatgagggcagcagcc

SEQ ID NO: 3873098 - DNA, 14 bp, Homo sapiens
gggggtgcggcagg

SEQ ID NO: 3873099 - DNA, 15 bp, Homo sapiens
ggggtaagccagagc

SEQ ID NO: 3873100 - DNA, 20 bp, Homo sapiens
ggggtacatttctctgagca

SEQ ID NO: 3873101 - DNA, 17 bp, Homo sapiens
ggggtaggcagagcctt

SEQ ID NO: 3873102 - DNA, 19 bp, Homo sapiens
ggggtctccctctcctgcc

SEQ ID NO: 3873103 - DNA, 14 bp, Homo sapiens
ggggtgcacaggag

SEQ ID NO: 3873104 - DNA, 16 bp, Homo sapiens
ggggtgcacaggaggg

SEQ ID NO: 3873105 - DNA, 16 bp, Homo sapiens
ggggttcagcccctcc

SEQ ID NO: 3873106 - DNA, 22 bp, Homo sapiens
ggggttctttcttcctctgctg

SEQ ID NO: 3873107 - DNA, 21 bp, Homo sapiens
gggtaaaccctcacatcagag

SEQ ID NO: 3873108 - DNA, 19 bp, Homo sapiens
gggtaagccagagcctggg

SEQ ID NO: 3873109 - DNA, 19 bp, Homo sapiens
gggtacatttccctgtgct

SEQ ID NO: 3873110 - DNA, 19 bp, Homo sapiens
gggtacatttctctgagca

SEQ ID NO: 3873111 - DNA, 16 bp, Homo sapiens
gggtaggggagtgtgg

SEQ ID NO: 3873112 - DNA, 13 bp, Homo sapiens
gggtcagccaggg

SEQ ID NO: 3873113 - DNA, 14 bp, Homo sapiens
gggtcagggcagta

SEQ ID NO: 3873114 - DNA, 17 bp, Homo sapiens
gggtccccatcatccca

SEQ ID NO: 3873115 - DNA, 16 bp, Homo sapiens
gggtccgcaccagctg

SEQ ID NO: 3873116 - DNA, 20 bp, Homo sapiens
gggtcctgcaatctccaggg

SEQ ID NO: 3873117 - DNA, 18 bp, Homo sapiens
gggtcgtggagagctagg

SEQ ID NO: 3873118 - DNA, 17 bp, Homo sapiens
gggtctcacttatacca

SEQ ID NO: 3873119 - DNA, 15 bp, Homo sapiens
gggtctccctctcct

SEQ ID NO: 3873120 - DNA, 18 bp, Homo sapiens
gggtctccctctcctgcc

SEQ ID NO: 3873121 - DNA, 20 bp, Homo sapiens
gggtctccctctcctgccta

SEQ ID NO: 3873122 - DNA, 15 bp, Homo sapiens
gggtctgtgctgtgc

SEQ ID NO: 3873123 - DNA, 17 bp, Homo sapiens
gggtctgtgctgtgcct

SEQ ID NO: 3873124 - DNA, 20 bp, Homo sapiens
gggtctgtgctgtgcctgct

SEQ ID NO: 3873125 - DNA, 22 bp, Homo sapiens
gggtctgtgctgtgcctgctag

SEQ ID NO: 3873126 - DNA, 16 bp, Homo sapiens
gggtctgttgtaaatg

SEQ ID NO: 3873127 - DNA, 20 bp, Homo sapiens
gggtgacccggcaccccctg

SEQ ID NO: 3873128 - DNA, 19 bp, Homo sapiens
gggtgatcagaaggctggg

SEQ ID NO: 3873129 - DNA, 18 bp, Homo sapiens
gggtgatgagggcagcag

SEQ ID NO: 3873130 - DNA, 19 bp, Homo sapiens
gggtgatgagggcagcagc

SEQ ID NO: 3873131 - DNA, 21 bp, Homo sapiens
gggtgatgagggcagcagcca

SEQ ID NO: 3873132 - DNA, 23 bp, Homo sapiens
gggtgatgagggcagcagccagc

SEQ ID NO: 3873133 - DNA, 16 bp, Homo sapiens
gggtgcacaggagggg

SEQ ID NO: 3873134 - DNA, 19 bp, Homo sapiens
gggtgcacaggagggggtc

SEQ ID NO: 3873135 - DNA, 19 bp, Homo sapiens
gggtgcacccactcaccag

SEQ ID NO: 3873136 - DNA, 23 bp, Homo sapiens
gggtgcacccactcaccagggtc

SEQ ID NO: 3873137 - DNA, 15 bp, Homo sapiens
gggtgcatggcttgg

SEQ ID NO: 3873138 - DNA, 19 bp, Homo sapiens
gggtgcatggcttggggag

SEQ ID NO: 3873139 - DNA, 20 bp, Homo sapiens
gggtgcatttgagagaagcc

SEQ ID NO: 3873140 - DNA, 19 bp, Homo sapiens
gggtgccatgtggagtgga

SEQ ID NO: 3873141 - DNA, 21 bp, Homo sapiens
gggtgccatgtggagtggaca

SEQ ID NO: 3873142 - DNA, 13 bp, Homo sapiens
gggtgccctctgg

SEQ ID NO: 3873143 - DNA, 15 bp, Homo sapiens
gggtgcggcaggagc

SEQ ID NO: 3873144 - DNA, 16 bp, Homo sapiens
gggtgcggcaggagca

SEQ ID NO: 3873145 - DNA, 15 bp, Homo sapiens
gggtggcaagggggc

SEQ ID NO: 3873146 - DNA, 13 bp, Homo sapiens
gggcaggaggcct

SEQ ID NO: 3873147 - DNA, 15 bp, Homo sapiens
gggcaggagtagctg

SEQ ID NO: 3873148 - DNA, 14 bp, Homo sapiens
gggcagtacctggg

SEQ ID NO: 3873149 - DNA, 22 bp, Homo sapiens
gggcagtacctgggaaaggacc

SEQ ID NO: 3873150 - DNA, 12 bp, Homo sapiens
gggcagtgacaa

SEQ ID NO: 3873151 - DNA, 15 bp, Homo sapiens
gggcagtgactggca

SEQ ID NO: 3873152 - DNA, 18 bp, Homo sapiens
gggcagtgactggcaggt

SEQ ID NO: 3873153 - DNA, 13 bp, Homo sapiens
gggcagtgcctcc

SEQ ID NO: 3873154 - DNA, 17 bp, Homo sapiens
gggcagtgcctcctggg

SEQ ID NO: 3873155 - DNA, 22 bp, Homo sapiens
gggcagtggtaagctctggctt

SEQ ID NO: 3873156 - DNA, 15 bp, Homo sapiens
gggcatagaaactga

SEQ ID NO: 3873157 - DNA, 16 bp, Homo sapiens
gggcatagaaactgag

SEQ ID NO: 3873158 - DNA, 17 bp, Homo sapiens
gggcatccacccagtgc

SEQ ID NO: 3873159 - DNA, 23 bp, Homo sapiens
gggcatccacccagtgctgccat

SEQ ID NO: 3873160 - DNA, 17 bp, Homo sapiens
gggcatccgcagcccag

SEQ ID NO: 3873161 - DNA, 21 bp, Homo sapiens
gggcatctcgtgccagggcag

SEQ ID NO: 3873162 - DNA, 24 bp, Homo sapiens
gggcatctcgtgccagggcaggct

SEQ ID NO: 3873163 - DNA, 15 bp, Homo sapiens
gggcatcttctggct

SEQ ID NO: 3873164 - DNA, 22 bp, Homo sapiens
gggcatggttccttccctggga

SEQ ID NO: 3873165 - DNA, 15 bp, Homo sapiens
gggcatgtgtgcctg

SEQ ID NO: 3873166 - DNA, 19 bp, Homo sapiens
gggccaaaagggcagccag

SEQ ID NO: 3873167 - DNA, 23 bp, Homo sapiens
gggccaaaagggcagccaggggc

SEQ ID NO: 3873168 - DNA, 17 bp, Homo sapiens
gggccaagacttggcaa

SEQ ID NO: 3873169 - DNA, 14 bp, Homo sapiens
gggccacgtgccag

SEQ ID NO: 3873170 - DNA, 19 bp, Homo sapiens
gggccacgtgccaggcccg

SEQ ID NO: 3873171 - DNA, 22 bp, Homo sapiens
gggccagaaggagggcagagcc

SEQ ID NO: 3873172 - DNA, 15 bp, Homo sapiens
gggccagctggtgct

SEQ ID NO: 3873173 - DNA, 21 bp, Homo sapiens
gggccagctggtgctgcaagg

SEQ ID NO: 3873174 - DNA, 22 bp, Homo sapiens
gggccagctggtgctgcaagga

SEQ ID NO: 3873175 - DNA, 16 bp, Homo sapiens
gggccaggacaggccc

SEQ ID NO: 3873176 - DNA, 15 bp, Homo sapiens
gggccaggagagaga

SEQ ID NO: 3873177 - DNA, 16 bp, Homo sapiens
gggccaggagctcagc

SEQ ID NO: 3873178 - DNA, 20 bp, Homo sapiens
gggccaggcaggtgcctgga

SEQ ID NO: 3873179 - DNA, 16 bp, Homo sapiens
gggccagtctgggctg

SEQ ID NO: 3873180 - DNA, 19 bp, Homo sapiens
gggccagtgtaaggcatag

SEQ ID NO: 3873181 - DNA, 20 bp, Homo sapiens
gggccagtgtaaggcatagg

SEQ ID NO: 3873182 - DNA, 14 bp, Homo sapiens
gggccatgctgaag

SEQ ID NO: 3873183 - DNA, 12 bp, Homo sapiens
gggcccacaaag

SEQ ID NO: 3873184 - DNA, 16 bp, Homo sapiens
gggcccacaaagggga

SEQ ID NO: 3873185 - DNA, 24 bp, Homo sapiens
gggcccacaatggagtgggagatc

SEQ ID NO: 3873186 - DNA, 20 bp, Homo sapiens
gggcccagctgtagccatgg

SEQ ID NO: 3873187 - DNA, 11 bp, Homo sapiens
gggcccaggct

SEQ ID NO: 3873188 - DNA, 13 bp, Homo sapiens
gggcccaggctct

SEQ ID NO: 3873189 - DNA, 17 bp, Homo sapiens
gggcccaggctctggga

SEQ ID NO: 3873190 - DNA, 13 bp, Homo sapiens
gggccccacctac

SEQ ID NO: 3873191 - DNA, 13 bp, Homo sapiens
gggccccagatct

SEQ ID NO: 3873192 - DNA, 14 bp, Homo sapiens
gggccccagatctg

SEQ ID NO: 3873193 - DNA, 23 bp, Homo sapiens
gggccccagatctgcctgggcct

SEQ ID NO: 3873194 - DNA, 24 bp, Homo sapiens
gggccccagatctgcctgggcctg

SEQ ID NO: 3873195 - DNA, 12 bp, Homo sapiens
gggccccatgct

SEQ ID NO: 3873196 - DNA, 17 bp, Homo sapiens
gggcccccctccttgct

SEQ ID NO: 3873197 - DNA, 17 bp, Homo sapiens
gggccccggggctggca

SEQ ID NO: 3873198 - DNA, 21 bp, Homo sapiens
gggccccggggctggcaagca

SEQ ID NO: 3873199 - DNA, 15 bp, Homo sapiens
gggcccctccctctg

SEQ ID NO: 3873200 - DNA, 17 bp, Homo sapiens
gggcccctccctctgcc

SEQ ID NO: 3873201 - DNA, 19 bp, Homo sapiens
gggcccctccctctgcccc

SEQ ID NO: 3873202 - DNA, 12 bp, Homo sapiens
gggcccctggga

SEQ ID NO: 3873203 - DNA, 15 bp, Homo sapiens
gggccctgggcctca

SEQ ID NO: 3873204 - DNA, 18 bp, Homo sapiens
gggccctgggcctcagtt

SEQ ID NO: 3873205 - DNA, 20 bp, Homo sapiens
gggccctggggcctgtactg

SEQ ID NO: 3873206 - DNA, 16 bp, Homo sapiens
gggcccttggggcctg

SEQ ID NO: 3873207 - DNA, 19 bp, Homo sapiens
gggcccttggggcctggct

SEQ ID NO: 3873208 - DNA, 20 bp, Homo sapiens
gggcccttggggcctggctt

SEQ ID NO: 3873209 - DNA, 21 bp, Homo sapiens
gggccgggcaggtcctgccca

SEQ ID NO: 3873210 - DNA, 16 bp, Homo sapiens
gggccggggaactggc

SEQ ID NO: 3873211 - DNA, 17 bp, Homo sapiens
gggccggggaactggcc

SEQ ID NO: 3873212 - DNA, 19 bp, Homo sapiens
gggccggggaactggccaa

SEQ ID NO: 3873213 - DNA, 14 bp, Homo sapiens
gggccgtgcccagg

SEQ ID NO: 3873214 - DNA, 20 bp, Homo sapiens
gggcctagatccacacacag

SEQ ID NO: 3873215 - DNA, 22 bp, Homo sapiens
gggcctagatccacacacagag

SEQ ID NO: 3873216 - DNA, 23 bp, Homo sapiens
gggcctagatccacacacagagg

SEQ ID NO: 3873217 - DNA, 14 bp, Homo sapiens
gggcctcagtttcc

SEQ ID NO: 3873218 - DNA, 16 bp, Homo sapiens
gggcctcttccctcag

SEQ ID NO: 3873219 - DNA, 22 bp, Homo sapiens
gggcctgacaggttcccagcag

SEQ ID NO: 3873220 - DNA, 12 bp, Homo sapiens
gggcctgcccaa

SEQ ID NO: 3873221 - DNA, 17 bp, Homo sapiens
gggcctgctgcgtcaga

SEQ ID NO: 3873222 - DNA, 22 bp, Homo sapiens
gggcctggcagccgtgccttca

SEQ ID NO: 3873223 - DNA, 15 bp, Homo sapiens
gggcctggcctgagc

SEQ ID NO: 3873224 - DNA, 18 bp, Homo sapiens
gggcctggcctgagctgg

SEQ ID NO: 3873225 - DNA, 16 bp, Homo sapiens
gggcctggctggctga

SEQ ID NO: 3873226 - DNA, 22 bp, Homo sapiens
gggcctggctggctgagggcag

SEQ ID NO: 3873227 - DNA, 23 bp, Homo sapiens
gggcctggcttgctccagggtct

SEQ ID NO: 3873228 - DNA, 17 bp, Homo sapiens
gggcctgggaaaggaaa

SEQ ID NO: 3873229 - DNA, 18 bp, Homo sapiens
gggcctgtgcagcagccc

SEQ ID NO: 3873230 - DNA, 20 bp, Homo sapiens
gggcctgtgcagcagcccag

SEQ ID NO: 3873231 - DNA, 22 bp, Homo sapiens
gggccttgcccagagatgcctc

SEQ ID NO: 3873232 - DNA, 17 bp, Homo sapiens
ggctgggcccctgggat

SEQ ID NO: 3873233 - DNA, 21 bp, Homo sapiens
ggctgggcccctgggatggga

SEQ ID NO: 3873234 - DNA, 13 bp, Homo sapiens
ggctggggcagag

SEQ ID NO: 3873235 - DNA, 14 bp, Homo sapiens
ggctggggcagagg

SEQ ID NO: 3873236 - DNA, 13 bp, Homo sapiens
ggctggggccagt

SEQ ID NO: 3873237 - DNA, 14 bp, Homo sapiens
ggctggggccagtg

SEQ ID NO: 3873238 - DNA, 18 bp, Homo sapiens
ggctgggggcgggggagc

SEQ ID NO: 3873239 - DNA, 19 bp, Homo sapiens
ggctggtgctgtggccagg

SEQ ID NO: 3873240 - DNA, 21 bp, Homo sapiens
ggctgtaagcattctgagctg

SEQ ID NO: 3873241 - DNA, 16 bp, Homo sapiens
ggctgtgcctctgcct

SEQ ID NO: 3873242 - DNA, 12 bp, Homo sapiens
ggctgtgcctta

SEQ ID NO: 3873243 - DNA, 21 bp, Homo sapiens
ggctgtggaggcctgatgctg

SEQ ID NO: 3873244 - DNA, 14 bp, Homo sapiens
ggctgtggcacaga

SEQ ID NO: 3873245 - DNA, 13 bp, Homo sapiens
ggctgttctgcac

SEQ ID NO: 3873246 - DNA, 15 bp, Homo sapiens
ggctgttctgcactg

SEQ ID NO: 3873247 - DNA, 17 bp, Homo sapiens
ggctgttctgcactgaa

SEQ ID NO: 3873248 - DNA, 18 bp, Homo sapiens
ggctgttctgcactgaaa

SEQ ID NO: 3873249 - DNA, 21 bp, Homo sapiens
ggctgttctgcactgaaaagg

SEQ ID NO: 3873250 - DNA, 18 bp, Homo sapiens
ggctgttggacagctgct

SEQ ID NO: 3873251 - DNA, 21 bp, Homo sapiens
ggctgttggacagctgcttgt

SEQ ID NO: 3873252 - DNA, 18 bp, Homo sapiens
ggctgtttcgtgtagtgg

SEQ ID NO: 3873253 - DNA, 18 bp, Homo sapiens
ggctgtttgatagcagaa

SEQ ID NO: 3873254 - DNA, 21 bp, Homo sapiens
ggcttagacttcgactcagga

SEQ ID NO: 3873255 - DNA, 23 bp, Homo sapiens
ggcttattcccaactgctctgcc

SEQ ID NO: 3873256 - DNA, 13 bp, Homo sapiens
ggcttccagagag

SEQ ID NO: 3873257 - DNA, 17 bp, Homo sapiens
ggcttccaggctcttcc

SEQ ID NO: 3873258 - DNA, 21 bp, Homo sapiens
ggcttccaggtatctccagga

SEQ ID NO: 3873259 - DNA, 14 bp, Homo sapiens
ggcttcccgctcag

SEQ ID NO: 3873260 - DNA, 17 bp, Homo sapiens
ggcttcccgctcagccc

SEQ ID NO: 3873261 - DNA, 18 bp, Homo sapiens
ggcttcccgctcagccct

SEQ ID NO: 3873262 - DNA, 19 bp, Homo sapiens
ggcttcctccgtccaccca

SEQ ID NO: 3873263 - DNA, 13 bp, Homo sapiens
ggcttcctcctga

SEQ ID NO: 3873264 - DNA, 13 bp, Homo sapiens
ggcttcctgtcca

SEQ ID NO: 3873265 - DNA, 14 bp, Homo sapiens
ggcttctcctgtga

SEQ ID NO: 3873266 - DNA, 17 bp, Homo sapiens
ggcttctgggacctgtg

SEQ ID NO: 3873267 - DNA, 13 bp, Homo sapiens
ggcttctgtgcac

SEQ ID NO: 3873268 - DNA, 23 bp, Homo sapiens
ggcttctgtgcactagcctgtga

SEQ ID NO: 3873269 - DNA, 14 bp, Homo sapiens
ggcttgactggatg

SEQ ID NO: 3873270 - DNA, 14 bp, Homo sapiens
ggcttgcatgccaa

SEQ ID NO: 3873271 - DNA, 18 bp, Homo sapiens
ggcttgcttgccgagcct

SEQ ID NO: 3873272 - DNA, 12 bp, Homo sapiens
ggcttggccttg

SEQ ID NO: 3873273 - DNA, 21 bp, Homo sapiens
ggctttaaactaccctccaga

SEQ ID NO: 3873274 - DNA, 22 bp, Homo sapiens
ggctttctccggggtctgtgct

SEQ ID NO: 3873275 - DNA, 15 bp, Homo sapiens
ggctttgcaggctct

SEQ ID NO: 3873276 - DNA, 20 bp, Homo sapiens
ggctttggcagaccatctcc

SEQ ID NO: 3873277 - DNA, 14 bp, Homo sapiens
ggcttttcactgct

SEQ ID NO: 3873278 - DNA, 19 bp, Homo sapiens
ggcttttcgcttgcttctg

SEQ ID NO: 3873279 - DNA, 21 bp, Homo sapiens
gggaaaaaagttttgatgaaa

SEQ ID NO: 3873280 - DNA, 13 bp, Homo sapiens
gggaaaacagagg

SEQ ID NO: 3873281 - DNA, 13 bp, Homo sapiens
gggaaacagggag

SEQ ID NO: 3873282 - DNA, 12 bp, Homo sapiens
gggaaaggaaaa

SEQ ID NO: 3873283 - DNA, 16 bp, Homo sapiens
gggaaaggacccaccc

SEQ ID NO: 3873284 - DNA, 22 bp, Homo sapiens
gggaaagggacccgaagcccag

SEQ ID NO: 3873285 - DNA, 14 bp, Homo sapiens
gggaaataagagag

SEQ ID NO: 3873286 - DNA, 17 bp, Homo sapiens
gggaaatggagggtggg

SEQ ID NO: 3873287 - DNA, 14 bp, Homo sapiens
gggaacagacagga

SEQ ID NO: 3873288 - DNA, 18 bp, Homo sapiens
gggaacagacaggagaaa

SEQ ID NO: 3873289 - DNA, 20 bp, Homo sapiens
gggaacccagccctggggta

SEQ ID NO: 3873290 - DNA, 16 bp, Homo sapiens
gggaaccccgcagccc

SEQ ID NO: 3873291 - DNA, 17 bp, Homo sapiens
gggaaccccgcagcccg

SEQ ID NO: 3873292 - DNA, 19 bp, Homo sapiens
gggaaccctgcccactccc

SEQ ID NO: 3873293 - DNA, 21 bp, Homo sapiens
gggaacgcagaggcggaaacc

SEQ ID NO: 3873294 - DNA, 14 bp, Homo sapiens
gggaacgtgactgc

SEQ ID NO: 3873295 - DNA, 14 bp, Homo sapiens
gggaactccactct

SEQ ID NO: 3873296 - DNA, 15 bp, Homo sapiens
gggaactccactctc

SEQ ID NO: 3873297 - DNA, 13 bp, Homo sapiens
gggaactctgaca

SEQ ID NO: 3873298 - DNA, 21 bp, Homo sapiens
gggaactctgacaagggctga

SEQ ID NO: 3873299 - DNA, 21 bp, Homo sapiens
gggaactgcatatcggaggtg

SEQ ID NO: 3873300 - DNA, 22 bp, Homo sapiens
gggaactgcatatcggaggtgg

SEQ ID NO: 3873301 - DNA, 19 bp, Homo sapiens
gggaactggccaagctgag

SEQ ID NO: 3873302 - DNA, 20 bp, Homo sapiens
gggaactggccaagctgagg

SEQ ID NO: 3873303 - DNA, 16 bp, Homo sapiens
gggaagatcatttctt

SEQ ID NO: 3873304 - DNA, 12 bp, Homo sapiens
gggaagcaggca

SEQ ID NO: 3873305 - DNA, 13 bp, Homo sapiens
gggaagcaggcag

SEQ ID NO: 3873306 - DNA, 12 bp, Homo sapiens
gggaagccctgg

SEQ ID NO: 3873307 - DNA, 18 bp, Homo sapiens
gggaagctgggggaaggg

SEQ ID NO: 3873308 - DNA, 21 bp, Homo sapiens
gggaagctgggggaagggtgg

SEQ ID NO: 3873309 - DNA, 22 bp, Homo sapiens
gggaagctgtactcagagcaga

SEQ ID NO: 3873310 - DNA, 14 bp, Homo sapiens
gggaaggcaggcag

SEQ ID NO: 3873311 - DNA, 21 bp, Homo sapiens
gggaaggcaggcagggctctc

SEQ ID NO: 3873312 - DNA, 20 bp, Homo sapiens
gggaagtgctccccacacgt

SEQ ID NO: 3873313 - DNA, 22 bp, Homo sapiens
gggaagtgctccccacacgtgc

SEQ ID NO: 3873314 - DNA, 18 bp, Homo sapiens
gggaatggatggggagaa

SEQ ID NO: 3873315 - DNA, 15 bp, Homo sapiens
gggacaaaggagcct

SEQ ID NO: 3873316 - DNA, 12 bp, Homo sapiens
gggacacacaca

SEQ ID NO: 3873317 - DNA, 16 bp, Homo sapiens
gggacacctgccctgc

SEQ ID NO: 3873318 - DNA, 13 bp, Homo sapiens
ggcctcttccctc

SEQ ID NO: 3873319 - DNA, 22 bp, Homo sapiens
ggcctcttggacctctgctctg

SEQ ID NO: 3873320 - DNA, 21 bp, Homo sapiens
ggcctgaaccacagcggagga

SEQ ID NO: 3873321 - DNA, 16 bp, Homo sapiens
ggcctgagctggggcc

SEQ ID NO: 3873322 - DNA, 19 bp, Homo sapiens
ggcctgagctggggccaca

SEQ ID NO: 3873323 - DNA, 14 bp, Homo sapiens
ggcctgatgacaga

SEQ ID NO: 3873324 - DNA, 16 bp, Homo sapiens
ggcctgatgctgcccc

SEQ ID NO: 3873325 - DNA, 20 bp, Homo sapiens
ggcctgcactgggttgtcca

SEQ ID NO: 3873326 - DNA, 11 bp, Homo sapiens
ggcctgccctc

SEQ ID NO: 3873327 - DNA, 16 bp, Homo sapiens
ggcctgccctcaggga

SEQ ID NO: 3873328 - DNA, 13 bp, Homo sapiens
ggcctgccctccc

SEQ ID NO: 3873329 - DNA, 20 bp, Homo sapiens
ggcctgcctcccagccctgc

SEQ ID NO: 3873330 - DNA, 23 bp, Homo sapiens
ggcctgcctcccagccctgccag

SEQ ID NO: 3873331 - DNA, 18 bp, Homo sapiens
ggcctgctgctgagaacc

SEQ ID NO: 3873332 - DNA, 22 bp, Homo sapiens
ggcctgctgctgagaacctggc

SEQ ID NO: 3873333 - DNA, 19 bp, Homo sapiens
ggcctgcttttccaggatc

SEQ ID NO: 3873334 - DNA, 13 bp, Homo sapiens
ggcctggagaggg

SEQ ID NO: 3873335 - DNA, 21 bp, Homo sapiens
ggcctggagaggggcctggga

SEQ ID NO: 3873336 - DNA, 14 bp, Homo sapiens
ggcctggccaggca

SEQ ID NO: 3873337 - DNA, 15 bp, Homo sapiens
ggcctggcctgagct

SEQ ID NO: 3873338 - DNA, 17 bp, Homo sapiens
ggcctggcctgagctgg

SEQ ID NO: 3873339 - DNA, 20 bp, Homo sapiens
ggcctggccttgtcaggacc

SEQ ID NO: 3873340 - DNA, 14 bp, Homo sapiens
ggcctggctcccca

SEQ ID NO: 3873341 - DNA, 11 bp, Homo sapiens
ggcctggctgg

SEQ ID NO: 3873342 - DNA, 16 bp, Homo sapiens
ggcctggcttgctcca

SEQ ID NO: 3873343 - DNA, 21 bp, Homo sapiens
ggcctggcttgctccagggtc

SEQ ID NO: 3873344 - DNA, 23 bp, Homo sapiens
ggcctggggctcctttctccagc

SEQ ID NO: 3873345 - DNA, 18 bp, Homo sapiens
ggcctgggggcagggaga

SEQ ID NO: 3873346 - DNA, 15 bp, Homo sapiens
ggcctgggggcagtg

SEQ ID NO: 3873347 - DNA, 18 bp, Homo sapiens
ggcctggggtgacccggc

SEQ ID NO: 3873348 - DNA, 21 bp, Homo sapiens
ggcctggggtgacccggcacc

SEQ ID NO: 3873349 - DNA, 14 bp, Homo sapiens
ggcctgtgcagcag

SEQ ID NO: 3873350 - DNA, 16 bp, Homo sapiens
ggcctgtgcagcagcc

SEQ ID NO: 3873351 - DNA, 17 bp, Homo sapiens
ggcctgtgcagcagccc

SEQ ID NO: 3873352 - DNA, 20 bp, Homo sapiens
ggcctgtgcagcagcccagc

SEQ ID NO: 3873353 - DNA, 19 bp, Homo sapiens
ggcctgtgtagctgtgacc

SEQ ID NO: 3873354 - DNA, 20 bp, Homo sapiens
ggcctgtgtagctgtgacct

SEQ ID NO: 3873355 - DNA, 23 bp, Homo sapiens
ggcctgtgtagctgtgacctgct

SEQ ID NO: 3873356 - DNA, 22 bp, Homo sapiens
ggcctgtgtccagcagctgcgg

SEQ ID NO: 3873357 - DNA, 14 bp, Homo sapiens
ggccttgcccagag

SEQ ID NO: 3873358 - DNA, 16 bp, Homo sapiens
ggccttgttctgtcac

SEQ ID NO: 3873359 - DNA, 13 bp, Homo sapiens
ggcctttcctgtg

SEQ ID NO: 3873360 - DNA, 22 bp, Homo sapiens
ggcctttcctgtgccaacctga

SEQ ID NO: 3873361 - DNA, 11 bp, Homo sapiens
ggcgaataaat

SEQ ID NO: 3873362 - DNA, 12 bp, Homo sapiens
ggcgaataaatg

SEQ ID NO: 3873363 - DNA, 15 bp, Homo sapiens
ggcgaataaatgttc

SEQ ID NO: 3873364 - DNA, 17 bp, Homo sapiens
ggcgaatctacagaaca

SEQ ID NO: 3873365 - DNA, 18 bp, Homo sapiens
ggcgatcaagtccagagc

SEQ ID NO: 3873366 - DNA, 19 bp, Homo sapiens
ggcgatcaagtccagagcc

SEQ ID NO: 3873367 - DNA, 19 bp, Homo sapiens
ggcgcagcccgaagcccag

SEQ ID NO: 3873368 - DNA, 21 bp, Homo sapiens
ggcgcagtggctcacgcctgt

SEQ ID NO: 3873369 - DNA, 15 bp, Homo sapiens
ggcgccaactgctga

SEQ ID NO: 3873370 - DNA, 16 bp, Homo sapiens
ggcgccccaacccgtg

SEQ ID NO: 3873371 - DNA, 19 bp, Homo sapiens
ggcgcgggaggcaccagct

SEQ ID NO: 3873372 - DNA, 14 bp, Homo sapiens
ggcgctcaggaccc

SEQ ID NO: 3873373 - DNA, 20 bp, Homo sapiens
ggcgctcaggacccaggccc

SEQ ID NO: 3873374 - DNA, 15 bp, Homo sapiens
ggcggaaaccttgca

SEQ ID NO: 3873375 - DNA, 15 bp, Homo sapiens
ggcggaaggggacgc

SEQ ID NO: 3873376 - DNA, 20 bp, Homo sapiens
ggcggagagtacagtgagcc

SEQ ID NO: 3873377 - DNA, 21 bp, Homo sapiens
ggcggagagtacagtgagcca

SEQ ID NO: 3873378 - DNA, 11 bp, Homo sapiens
ggcggaggcgg

SEQ ID NO: 3873379 - DNA, 19 bp, Homo sapiens
ggcggaggttgcagtgagc

SEQ ID NO: 3873380 - DNA, 21 bp, Homo sapiens
ggcggcacgccaacagccccc

SEQ ID NO: 3873381 - DNA, 13 bp, Homo sapiens
ggcggcggccctc

SEQ ID NO: 3873382 - DNA, 21 bp, Homo sapiens
ggcggctactcagcagccctc

SEQ ID NO: 3873383 - DNA, 21 bp, Homo sapiens
ggcggcttcctgtccactctc

SEQ ID NO: 3873384 - DNA, 13 bp, Homo sapiens
ggcgggcacctgt

SEQ ID NO: 3873385 - DNA, 14 bp, Homo sapiens
ggcggggcaggagg

SEQ ID NO: 3873386 - DNA, 15 bp, Homo sapiens
ggcggggcaggaggc

SEQ ID NO: 3873387 - DNA, 22 bp, Homo sapiens
ggcggggcaggaggcctggcct

SEQ ID NO: 3873388 - DNA, 20 bp, Homo sapiens
ggcgggtggatcatgaggtc

SEQ ID NO: 3873389 - DNA, 22 bp, Homo sapiens
ggcgggtggatcatgaggtcag

SEQ ID NO: 3873390 - DNA, 17 bp, Homo sapiens
ggcgtaatgggcctgcc

SEQ ID NO: 3873391 - DNA, 18 bp, Homo sapiens
ggcgtaatgggcctgccc

SEQ ID NO: 3873392 - DNA, 19 bp, Homo sapiens
ggcgtaatgggcctgccca

SEQ ID NO: 3873393 - DNA, 22 bp, Homo sapiens
ggcgtcgctggacaacccagaa

SEQ ID NO: 3873394 - DNA, 17 bp, Homo sapiens
ggcgtgactcacccaag

SEQ ID NO: 3873395 - DNA, 15 bp, Homo sapiens
ggcgtgcaaggggct

SEQ ID NO: 3873396 - DNA, 17 bp, Homo sapiens
ggcgtgcaaggggctca

SEQ ID NO: 3873397 - DNA, 16 bp, Homo sapiens
ggcgtggcaaatataa

SEQ ID NO: 3873398 - DNA, 14 bp, Homo sapiens
ggctaactggaagc

SEQ ID NO: 3873399 - DNA, 15 bp, Homo sapiens
ggctaagatgagatt

SEQ ID NO: 3873400 - DNA, 17 bp, Homo sapiens
ggctactcagcagccct

SEQ ID NO: 3873401 - DNA, 20 bp, Homo sapiens
ggctactcagcagccctcct

SEQ ID NO: 3873402 - DNA, 20 bp, Homo sapiens
ggctactctgtgccagagcc

SEQ ID NO: 3873403 - DNA, 23 bp, Homo sapiens
ggctactctgtgccagagcctgg

SEQ ID NO: 3873404 - DNA, 14 bp, Homo sapiens
gctcctgtccctac

SEQ ID NO: 3873405 - DNA, 16 bp, Homo sapiens
gctcctgtccctaccc

SEQ ID NO: 3873406 - DNA, 17 bp, Homo sapiens
gctcctgtccctaccca

SEQ ID NO: 3873407 - DNA, 15 bp, Homo sapiens
gctcctgtcctccca

SEQ ID NO: 3873408 - DNA, 17 bp, Homo sapiens
gctcctttacctaccac

SEQ ID NO: 3873409 - DNA, 18 bp, Homo sapiens
gctcctttacctaccacc

SEQ ID NO: 3873410 - DNA, 20 bp, Homo sapiens
gctcctttctccagccagca

SEQ ID NO: 3873411 - DNA, 20 bp, Homo sapiens
gctccttttgtccccagggc

SEQ ID NO: 3873412 - DNA, 14 bp, Homo sapiens
gctcgcagcctggc

SEQ ID NO: 3873413 - DNA, 17 bp, Homo sapiens
gctcgccccacccaggg

SEQ ID NO: 3873414 - DNA, 16 bp, Homo sapiens
gctcgctccctgtagc

SEQ ID NO: 3873415 - DNA, 18 bp, Homo sapiens
gctcggggtgcacaggag

SEQ ID NO: 3873416 - DNA, 13 bp, Homo sapiens
gctcgtggccttc

SEQ ID NO: 3873417 - DNA, 13 bp, Homo sapiens
gctctaacgcctg

SEQ ID NO: 3873418 - DNA, 15 bp, Homo sapiens
gctctaacgcctgag

SEQ ID NO: 3873419 - DNA, 17 bp, Homo sapiens
gctctaacgcctgagcc

SEQ ID NO: 3873420 - DNA, 21 bp, Homo sapiens
gctctaacgcctgagcccagg

SEQ ID NO: 3873421 - DNA, 16 bp, Homo sapiens
gctctagccaggagtc

SEQ ID NO: 3873422 - DNA, 22 bp, Homo sapiens
gctctagccaggagtctgtgct

SEQ ID NO: 3873423 - DNA, 14 bp, Homo sapiens
gctctagctggcag

SEQ ID NO: 3873424 - DNA, 16 bp, Homo sapiens
gctctagctggcagga

SEQ ID NO: 3873425 - DNA, 23 bp, Homo sapiens
gctctagtcttgctttgctgtct

SEQ ID NO: 3873426 - DNA, 16 bp, Homo sapiens
gctctatttccccacc

SEQ ID NO: 3873427 - DNA, 19 bp, Homo sapiens
gctctatttccccacccca

SEQ ID NO: 3873428 - DNA, 11 bp, Homo sapiens
gctctcagaag

SEQ ID NO: 3873429 - DNA, 12 bp, Homo sapiens
gctctcagaagg

SEQ ID NO: 3873430 - DNA, 13 bp, Homo sapiens
gctctccacctca

SEQ ID NO: 3873431 - DNA, 21 bp, Homo sapiens
gctctccacctcagccttgga

SEQ ID NO: 3873432 - DNA, 14 bp, Homo sapiens
gctctccctctggc

SEQ ID NO: 3873433 - DNA, 19 bp, Homo sapiens
gctctcctcagaagaaaga

SEQ ID NO: 3873434 - DNA, 19 bp, Homo sapiens
gctctcctcttgccactgc

SEQ ID NO: 3873435 - DNA, 14 bp, Homo sapiens
gctctcctgctgca

SEQ ID NO: 3873436 - DNA, 13 bp, Homo sapiens
gctctcctggctt

SEQ ID NO: 3873437 - DNA, 17 bp, Homo sapiens
gctctcctggcttccca

SEQ ID NO: 3873438 - DNA, 15 bp, Homo sapiens
gctctctgcagccag

SEQ ID NO: 3873439 - DNA, 18 bp, Homo sapiens
gctctctgcagccagccc

SEQ ID NO: 3873440 - DNA, 20 bp, Homo sapiens
gctctctgcagccagcccag

SEQ ID NO: 3873441 - DNA, 11 bp, Homo sapiens
gctctctgtat

SEQ ID NO: 3873442 - DNA, 23 bp, Homo sapiens
gctctctgtataaacattaaatg

SEQ ID NO: 3873443 - DNA, 17 bp, Homo sapiens
gctctgaaatcttgggc

SEQ ID NO: 3873444 - DNA, 19 bp, Homo sapiens
gctctgaatattttgtaat

SEQ ID NO: 3873445 - DNA, 16 bp, Homo sapiens
gctctgacagccctgc

SEQ ID NO: 3873446 - DNA, 20 bp, Homo sapiens
gctctgagaggccctggatc

SEQ ID NO: 3873447 - DNA, 20 bp, Homo sapiens
gctctgaggcgccccaaccc

SEQ ID NO: 3873448 - DNA, 18 bp, Homo sapiens
gctctgaggcttccagag

SEQ ID NO: 3873449 - DNA, 21 bp, Homo sapiens
gctctgaggcttccagagagt

SEQ ID NO: 3873450 - DNA, 16 bp, Homo sapiens
gctctgcaggcacctt

SEQ ID NO: 3873451 - DNA, 18 bp, Homo sapiens
gctctgcaggcaccttag

SEQ ID NO: 3873452 - DNA, 19 bp, Homo sapiens
gctctgccccaagccccca

SEQ ID NO: 3873453 - DNA, 13 bp, Homo sapiens
gctctgctggcct

SEQ ID NO: 3873454 - DNA, 19 bp, Homo sapiens
gctctgctggcctggccgg

SEQ ID NO: 3873455 - DNA, 21 bp, Homo sapiens
gctctgctggcctggccggca

SEQ ID NO: 3873456 - DNA, 14 bp, Homo sapiens
gctctggaagagag

SEQ ID NO: 3873457 - DNA, 15 bp, Homo sapiens
gctctggaagagagg

SEQ ID NO: 3873458 - DNA, 11 bp, Homo sapiens
gctctggacca

SEQ ID NO: 3873459 - DNA, 16 bp, Homo sapiens
gctctggaccagcctg

SEQ ID NO: 3873460 - DNA, 13 bp, Homo sapiens
gctctggccaccc

SEQ ID NO: 3873461 - DNA, 21 bp, Homo sapiens
gctctgggaaggggtgccctc

SEQ ID NO: 3873462 - DNA, 12 bp, Homo sapiens
gctctgggctca

SEQ ID NO: 3873463 - DNA, 14 bp, Homo sapiens
gctctgggctcagg

SEQ ID NO: 3873464 - DNA, 20 bp, Homo sapiens
gctctgggctcagggctgga

SEQ ID NO: 3873465 - DNA, 21 bp, Homo sapiens
gctctgggctcagggctggag

SEQ ID NO: 3873466 - DNA, 23 bp, Homo sapiens
gctctgggctcagggctggagtg

SEQ ID NO: 3873467 - DNA, 11 bp, Homo sapiens
gctctgtggcc

SEQ ID NO: 3873468 - DNA, 16 bp, Homo sapiens
gctctgtggcctgtgt

SEQ ID NO: 3873469 - DNA, 19 bp, Homo sapiens
gctctgtggcctgtgtcca

SEQ ID NO: 3873470 - DNA, 14 bp, Homo sapiens
gctcttcactcagc

SEQ ID NO: 3873471 - DNA, 19 bp, Homo sapiens
gctcttcagtgggagaaaa

SEQ ID NO: 3873472 - DNA, 15 bp, Homo sapiens
gctcttccttactcc

SEQ ID NO: 3873473 - DNA, 17 bp, Homo sapiens
gctcttctaacctcagc

SEQ ID NO: 3873474 - DNA, 23 bp, Homo sapiens
gctcttctacgtataaatatgaa

SEQ ID NO: 3873475 - DNA, 13 bp, Homo sapiens
gctcttctccttt

SEQ ID NO: 3873476 - DNA, 20 bp, Homo sapiens
gctcttctgttctcaaatgc

SEQ ID NO: 3873477 - DNA, 15 bp, Homo sapiens
gctcttctttctgag

SEQ ID NO: 3873478 - DNA, 16 bp, Homo sapiens
gctcttctttctgaga

SEQ ID NO: 3873479 - DNA, 22 bp, Homo sapiens
gctcttggaaagctgatgatgt

SEQ ID NO: 3873480 - DNA, 12 bp, Homo sapiens
gctcttggaaga

SEQ ID NO: 3873481 - DNA, 21 bp, Homo sapiens
gctcttggcattttcctcgcc

SEQ ID NO: 3873482 - DNA, 22 bp, Homo sapiens
gctcttggcattttcctcgcct

SEQ ID NO: 3873483 - DNA, 14 bp, Homo sapiens
gctcttggtccctg

SEQ ID NO: 3873484 - DNA, 15 bp, Homo sapiens
gctcttggtccctgg

SEQ ID NO: 3873485 - DNA, 21 bp, Homo sapiens
gctcttggtccctggtccctc

SEQ ID NO: 3873486 - DNA, 14 bp, Homo sapiens
gctctttcagagag

SEQ ID NO: 3873487 - DNA, 23 bp, Homo sapiens
gctctttggggtcagccagggcc

SEQ ID NO: 3873488 - DNA, 18 bp, Homo sapiens
gctctttggtagaaaagg

SEQ ID NO: 3873489 - DNA, 16 bp, Homo sapiens
gctgaacggggagaaa

SEQ ID NO: 3873490 - DNA, 18 bp, Homo sapiens
ggctactgcagctttaca

SEQ ID NO: 3873491 - DNA, 15 bp, Homo sapiens
ggctactggcagctc

SEQ ID NO: 3873492 - DNA, 17 bp, Homo sapiens
ggctactggcagctcct

SEQ ID NO: 3873493 - DNA, 21 bp, Homo sapiens
ggctagaaccaagaagggcta

SEQ ID NO: 3873494 - DNA, 22 bp, Homo sapiens
ggctagaacctggagagctaga

SEQ ID NO: 3873495 - DNA, 14 bp, Homo sapiens
ggctagaacctggc

SEQ ID NO: 3873496 - DNA, 22 bp, Homo sapiens
ggctagaacctgtagagctaga

SEQ ID NO: 3873497 - DNA, 13 bp, Homo sapiens
ggctagaatctgg

SEQ ID NO: 3873498 - DNA, 14 bp, Homo sapiens
ggctagaatctgga

SEQ ID NO: 3873499 - DNA, 17 bp, Homo sapiens
ggctaggggctggtcct

SEQ ID NO: 3873500 - DNA, 13 bp, Homo sapiens
ggctagtcagaga

SEQ ID NO: 3873501 - DNA, 18 bp, Homo sapiens
ggctagtcagagagagtg

SEQ ID NO: 3873502 - DNA, 18 bp, Homo sapiens
ggctagttctaattccct

SEQ ID NO: 3873503 - DNA, 13 bp, Homo sapiens
ggctatcctagag

SEQ ID NO: 3873504 - DNA, 19 bp, Homo sapiens
ggctatgggggcactgagg

SEQ ID NO: 3873505 - DNA, 13 bp, Homo sapiens
ggctatttaaaag

SEQ ID NO: 3873506 - DNA, 13 bp, Homo sapiens
ggctcaagaggcc

SEQ ID NO: 3873507 - DNA, 18 bp, Homo sapiens
ggctcaagcagtcctccc

SEQ ID NO: 3873508 - DNA, 19 bp, Homo sapiens
ggctcacccctctcccccg

SEQ ID NO: 3873509 - DNA, 21 bp, Homo sapiens
ggctcaggaagaaaccccaag

SEQ ID NO: 3873510 - DNA, 12 bp, Homo sapiens
ggctcaggcaga

SEQ ID NO: 3873511 - DNA, 12 bp, Homo sapiens
ggctcagggctg

SEQ ID NO: 3873512 - DNA, 14 bp, Homo sapiens
ggctcagggctgga

SEQ ID NO: 3873513 - DNA, 17 bp, Homo sapiens
ggctccactccaagggt

SEQ ID NO: 3873514 - DNA, 21 bp, Homo sapiens
ggctccagcatccagcctgtg

SEQ ID NO: 3873515 - DNA, 19 bp, Homo sapiens
ggctccaggtccggagggg

SEQ ID NO: 3873516 - DNA, 20 bp, Homo sapiens
ggctccaggtccggaggggt

SEQ ID NO: 3873517 - DNA, 23 bp, Homo sapiens
ggctccatggggaagtgctcccc

SEQ ID NO: 3873518 - DNA, 17 bp, Homo sapiens
ggctcccacaggccctt

SEQ ID NO: 3873519 - DNA, 20 bp, Homo sapiens
ggctcccacaggcccttcct

SEQ ID NO: 3873520 - DNA, 21 bp, Homo sapiens
ggctcccacaggcccttcctc

SEQ ID NO: 3873521 - DNA, 13 bp, Homo sapiens
ggctccccacgag

SEQ ID NO: 3873522 - DNA, 14 bp, Homo sapiens
ggctcctggctgcc

SEQ ID NO: 3873523 - DNA, 19 bp, Homo sapiens
ggctcctggctgccaggcg

SEQ ID NO: 3873524 - DNA, 11 bp, Homo sapiens
ggctcctgtcc

SEQ ID NO: 3873525 - DNA, 13 bp, Homo sapiens
ggctcctgtgcta

SEQ ID NO: 3873526 - DNA, 20 bp, Homo sapiens
ggctcgccccacccagggct

SEQ ID NO: 3873527 - DNA, 23 bp, Homo sapiens
ggctcgctccctgtagctctgcc

SEQ ID NO: 3873528 - DNA, 18 bp, Homo sapiens
ggctctaacgcctgagcc

SEQ ID NO: 3873529 - DNA, 23 bp, Homo sapiens
ggctctccaaaggggctgctggg

SEQ ID NO: 3873530 - DNA, 15 bp, Homo sapiens
ggctctccacctcag

SEQ ID NO: 3873531 - DNA, 16 bp, Homo sapiens
ggctctccacctcagc

SEQ ID NO: 3873532 - DNA, 13 bp, Homo sapiens
ggctctccagtta

SEQ ID NO: 3873533 - DNA, 12 bp, Homo sapiens
ggctctcctggc

SEQ ID NO: 3873534 - DNA, 14 bp, Homo sapiens
ggctctgaaagcca

SEQ ID NO: 3873535 - DNA, 17 bp, Homo sapiens
ggctctgccccagaggc

SEQ ID NO: 3873536 - DNA, 15 bp, Homo sapiens
ggctctggccaccct

SEQ ID NO: 3873537 - DNA, 18 bp, Homo sapiens
ggctctggccaccctggc

SEQ ID NO: 3873538 - DNA, 21 bp, Homo sapiens
ggctctggccaccctggcccg

SEQ ID NO: 3873539 - DNA, 15 bp, Homo sapiens
ggctctgggctcagg

SEQ ID NO: 3873540 - DNA, 18 bp, Homo sapiens
ggctctgggctcagggct

SEQ ID NO: 3873541 - DNA, 14 bp, Homo sapiens
ggctcttcaaagac

SEQ ID NO: 3873542 - DNA, 17 bp, Homo sapiens
ggctcttcctggacctg

SEQ ID NO: 3873543 - DNA, 15 bp, Homo sapiens
ggctcttctcctttc

SEQ ID NO: 3873544 - DNA, 22 bp, Homo sapiens
ggctctttggggtcagccaggg

SEQ ID NO: 3873545 - DNA, 20 bp, Homo sapiens
ggctgaacggggagaaaagg

SEQ ID NO: 3873546 - DNA, 22 bp, Homo sapiens
ggctgacacctaccatgctgct

SEQ ID NO: 3873547 - DNA, 18 bp, Homo sapiens
ggctgaccccaaagagcc

SEQ ID NO: 3873548 - DNA, 20 bp, Homo sapiens
ggctgaccccaaagagcctg

SEQ ID NO: 3873549 - DNA, 22 bp, Homo sapiens
ggctgaccccaaagagcctgga

SEQ ID NO: 3873550 - DNA, 15 bp, Homo sapiens
ggctgagacaggaga

SEQ ID NO: 3873551 - DNA, 15 bp, Homo sapiens
ggctgagcttggccc

SEQ ID NO: 3873552 - DNA, 21 bp, Homo sapiens
ggctgaggatttcaagcctgc

SEQ ID NO: 3873553 - DNA, 14 bp, Homo sapiens
ggctgaggcagaag

SEQ ID NO: 3873554 - DNA, 13 bp, Homo sapiens
ggctgagggcagt

SEQ ID NO: 3873555 - DNA, 19 bp, Homo sapiens
ggctgagtggaatgcaggg

SEQ ID NO: 3873556 - DNA, 18 bp, Homo sapiens
ggctgcaagggccagagt

SEQ ID NO: 3873557 - DNA, 14 bp, Homo sapiens
ggctgcatgctctg

SEQ ID NO: 3873558 - DNA, 11 bp, Homo sapiens
ggctgccaggc

SEQ ID NO: 3873559 - DNA, 13 bp, Homo sapiens
ggctgccctggtg

SEQ ID NO: 3873560 - DNA, 14 bp, Homo sapiens
ggctgccctggtgc

SEQ ID NO: 3873561 - DNA, 19 bp, Homo sapiens
ggctgccctggtgctgcca

SEQ ID NO: 3873562 - DNA, 16 bp, Homo sapiens
ggctgcctgccgccca

SEQ ID NO: 3873563 - DNA, 16 bp, Homo sapiens
ggctgccttagaacct

SEQ ID NO: 3873564 - DNA, 12 bp, Homo sapiens
ggctgctcatca

SEQ ID NO: 3873565 - DNA, 16 bp, Homo sapiens
ggctgctcatcaccca

SEQ ID NO: 3873566 - DNA, 22 bp, Homo sapiens
ggctgctcggggtgcacaggag

SEQ ID NO: 3873567 - DNA, 24 bp, Homo sapiens
ggctgctggggcatgtgtgcctgt

SEQ ID NO: 3873568 - DNA, 15 bp, Homo sapiens
ggctgctgtgtgcct

SEQ ID NO: 3873569 - DNA, 20 bp, Homo sapiens
ggctggagtgcagtggtgcg

SEQ ID NO: 3873570 - DNA, 20 bp, Homo sapiens
ggctggagttcagtggtgtg

SEQ ID NO: 3873571 - DNA, 15 bp, Homo sapiens
ggctggcaagcaggg

SEQ ID NO: 3873572 - DNA, 17 bp, Homo sapiens
ggctggcagctgagagc

SEQ ID NO: 3873573 - DNA, 17 bp, Homo sapiens
ggctggctaactggaag

SEQ ID NO: 3873574 - DNA, 15 bp, Homo sapiens
ggctggctgagggca

SEQ ID NO: 3873575 - DNA, 15 bp, Homo sapiens
ggctgggagctctgc

SEQ ID NO: 3873576 - DNA, 12 bp, Homo sapiens
ggccccatgctc

SEQ ID NO: 3873577 - DNA, 15 bp, Homo sapiens
ggccccatgctctgc

SEQ ID NO: 3873578 - DNA, 18 bp, Homo sapiens
ggccccatgctctgcccc

SEQ ID NO: 3873579 - DNA, 19 bp, Homo sapiens
ggccccatgctctgcccca

SEQ ID NO: 3873580 - DNA, 23 bp, Homo sapiens
ggccccccacacgcgtgtgtaca

SEQ ID NO: 3873581 - DNA, 21 bp, Homo sapiens
ggccccccctcttttggcctt

SEQ ID NO: 3873582 - DNA, 22 bp, Homo sapiens
ggccccccctcttttggccttg

SEQ ID NO: 3873583 - DNA, 14 bp, Homo sapiens
ggcccccctccagg

SEQ ID NO: 3873584 - DNA, 16 bp, Homo sapiens
ggcccccctccaggca

SEQ ID NO: 3873585 - DNA, 18 bp, Homo sapiens
ggcccccctccaggcatg

SEQ ID NO: 3873586 - DNA, 20 bp, Homo sapiens
ggcccccctccttgctctgc

SEQ ID NO: 3873587 - DNA, 18 bp, Homo sapiens
ggccccctgtgccagctc

SEQ ID NO: 3873588 - DNA, 19 bp, Homo sapiens
ggccccgggctctggccac

SEQ ID NO: 3873589 - DNA, 16 bp, Homo sapiens
ggccccggggctggca

SEQ ID NO: 3873590 - DNA, 18 bp, Homo sapiens
ggccccggggctggcaag

SEQ ID NO: 3873591 - DNA, 19 bp, Homo sapiens
ggccccggggctggcaagc

SEQ ID NO: 3873592 - DNA, 12 bp, Homo sapiens
ggcccctccacg

SEQ ID NO: 3873593 - DNA, 23 bp, Homo sapiens
ggcccctccacgcctcctggcca

SEQ ID NO: 3873594 - DNA, 16 bp, Homo sapiens
ggcccctccctctgcc

SEQ ID NO: 3873595 - DNA, 17 bp, Homo sapiens
ggcccctccctctgccc

SEQ ID NO: 3873596 - DNA, 21 bp, Homo sapiens
ggcccctccctctgccccaag

SEQ ID NO: 3873597 - DNA, 15 bp, Homo sapiens
ggcccctgaggactg

SEQ ID NO: 3873598 - DNA, 13 bp, Homo sapiens
ggcccctgggatg

SEQ ID NO: 3873599 - DNA, 22 bp, Homo sapiens
ggcccgagcagctgagcagggc

SEQ ID NO: 3873600 - DNA, 21 bp, Homo sapiens
ggcccgcccctcgctgctgct

SEQ ID NO: 3873601 - DNA, 21 bp, Homo sapiens
ggccctaggattcctccccca

SEQ ID NO: 3873602 - DNA, 22 bp, Homo sapiens
ggccctaggattcctcccccag

SEQ ID NO: 3873603 - DNA, 11 bp, Homo sapiens
ggccctccctg

SEQ ID NO: 3873604 - DNA, 13 bp, Homo sapiens
ggccctccctgac

SEQ ID NO: 3873605 - DNA, 23 bp, Homo sapiens
ggccctccctgactccctgtggg

SEQ ID NO: 3873606 - DNA, 14 bp, Homo sapiens
ggccctgccttctt

SEQ ID NO: 3873607 - DNA, 18 bp, Homo sapiens
ggccctggatcagcgtgg

SEQ ID NO: 3873608 - DNA, 22 bp, Homo sapiens
ggccctggatcagcgtggcctt

SEQ ID NO: 3873609 - DNA, 15 bp, Homo sapiens
ggccctggcctgctg

SEQ ID NO: 3873610 - DNA, 16 bp, Homo sapiens
ggccctggcctgctgg

SEQ ID NO: 3873611 - DNA, 17 bp, Homo sapiens
ggccctggcctgctggg

SEQ ID NO: 3873612 - DNA, 22 bp, Homo sapiens
ggccctggctcccacaggccct

SEQ ID NO: 3873613 - DNA, 13 bp, Homo sapiens
ggccctggggcct

SEQ ID NO: 3873614 - DNA, 18 bp, Homo sapiens
ggccctggggcctgtact

SEQ ID NO: 3873615 - DNA, 18 bp, Homo sapiens
ggccctggtgtcaggcag

SEQ ID NO: 3873616 - DNA, 22 bp, Homo sapiens
ggcccttcctctccactgcctt

SEQ ID NO: 3873617 - DNA, 12 bp, Homo sapiens
ggcccttcctgg

SEQ ID NO: 3873618 - DNA, 13 bp, Homo sapiens
ggcccttcctgga

SEQ ID NO: 3873619 - DNA, 20 bp, Homo sapiens
ggcccttcctggacagctgt

SEQ ID NO: 3873620 - DNA, 22 bp, Homo sapiens
ggcccttcctggacagctgtgc

SEQ ID NO: 3873621 - DNA, 15 bp, Homo sapiens
ggcccttggggcctg

SEQ ID NO: 3873622 - DNA, 17 bp, Homo sapiens
ggcccttggggcctggc

SEQ ID NO: 3873623 - DNA, 19 bp, Homo sapiens
ggcccttggggcctggctt

SEQ ID NO: 3873624 - DNA, 21 bp, Homo sapiens
ggcccttggggcctggcttgc

SEQ ID NO: 3873625 - DNA, 16 bp, Homo sapiens
ggcccttgtcctgcca

SEQ ID NO: 3873626 - DNA, 19 bp, Homo sapiens
ggcccttgtcctgccagct

SEQ ID NO: 3873627 - DNA, 20 bp, Homo sapiens
ggcccttgtcctgccagctg

SEQ ID NO: 3873628 - DNA, 20 bp, Homo sapiens
ggccgaagctaacagggaag

SEQ ID NO: 3873629 - DNA, 16 bp, Homo sapiens
ggccgaaggcagtgca

SEQ ID NO: 3873630 - DNA, 20 bp, Homo sapiens
ggccgacggcggcggccctc

SEQ ID NO: 3873631 - DNA, 19 bp, Homo sapiens
ggccgatcggggcactgca

SEQ ID NO: 3873632 - DNA, 16 bp, Homo sapiens
ggccgctgttcaccca

SEQ ID NO: 3873633 - DNA, 19 bp, Homo sapiens
ggccgctgttcacccacag

SEQ ID NO: 3873634 - DNA, 17 bp, Homo sapiens
ggccggcccaggcctcc

SEQ ID NO: 3873635 - DNA, 18 bp, Homo sapiens
ggccggggaactggccaa

SEQ ID NO: 3873636 - DNA, 15 bp, Homo sapiens
ggccggggcccctca

SEQ ID NO: 3873637 - DNA, 22 bp, Homo sapiens
ggccgttccccttggcttcctc

SEQ ID NO: 3873638 - DNA, 17 bp, Homo sapiens
ggcctatggagagccct

SEQ ID NO: 3873639 - DNA, 22 bp, Homo sapiens
ggcctatggagagccctgggac

SEQ ID NO: 3873640 - DNA, 19 bp, Homo sapiens
ggcctattatattaaaata

SEQ ID NO: 3873641 - DNA, 14 bp, Homo sapiens
ggcctcacacccag

SEQ ID NO: 3873642 - DNA, 19 bp, Homo sapiens
ggcctcacacccagagggt

SEQ ID NO: 3873643 - DNA, 13 bp, Homo sapiens
ggcctcactggct

SEQ ID NO: 3873644 - DNA, 15 bp, Homo sapiens
ggcctcactggctgg

SEQ ID NO: 3873645 - DNA, 19 bp, Homo sapiens
ggcctcactggctggggca

SEQ ID NO: 3873646 - DNA, 17 bp, Homo sapiens
ggcctcagcacccctgt

SEQ ID NO: 3873647 - DNA, 10 bp, Homo sapiens
ggcctcagcc

SEQ ID NO: 3873648 - DNA, 12 bp, Homo sapiens
ggcctcagccct

SEQ ID NO: 3873649 - DNA, 13 bp, Homo sapiens
ggcctcagccctc

SEQ ID NO: 3873650 - DNA, 21 bp, Homo sapiens
ggcctcagtttctccatcagc

SEQ ID NO: 3873651 - DNA, 15 bp, Homo sapiens
ggcctcatccctcgg

SEQ ID NO: 3873652 - DNA, 16 bp, Homo sapiens
ggcctccagcctctcc

SEQ ID NO: 3873653 - DNA, 17 bp, Homo sapiens
ggcctcccaataaagct

SEQ ID NO: 3873654 - DNA, 13 bp, Homo sapiens
ggcctcctgcctc

SEQ ID NO: 3873655 - DNA, 24 bp, Homo sapiens
ggcctcgcctgggcccaggctctg

SEQ ID NO: 3873656 - DNA, 22 bp, Homo sapiens
ggcctcgggacacctgccctgc

SEQ ID NO: 3873657 - DNA, 19 bp, Homo sapiens
ggcctcgtaccagccagga

SEQ ID NO: 3873658 - DNA, 13 bp, Homo sapiens
ggcctctagaaca

SEQ ID NO: 3873659 - DNA, 20 bp, Homo sapiens
ggcctctagaacacccactg

SEQ ID NO: 3873660 - DNA, 17 bp, Homo sapiens
ggcctctgaaatttccc

SEQ ID NO: 3873661 - DNA, 14 bp, Homo sapiens
ggcctctgtgtcct

SEQ ID NO: 3873662 - DNA, 15 bp, Homo sapiens
ggcatcaggcactgg

SEQ ID NO: 3873663 - DNA, 15 bp, Homo sapiens
ggcatcccaggggac

SEQ ID NO: 3873664 - DNA, 14 bp, Homo sapiens
ggcatcccatccct

SEQ ID NO: 3873665 - DNA, 13 bp, Homo sapiens
ggcatcctgcccc

SEQ ID NO: 3873666 - DNA, 16 bp, Homo sapiens
ggcatccttctgcctt

SEQ ID NO: 3873667 - DNA, 16 bp, Homo sapiens
ggcatcgtagaagaga

SEQ ID NO: 3873668 - DNA, 15 bp, Homo sapiens
ggcatgacactctag

SEQ ID NO: 3873669 - DNA, 23 bp, Homo sapiens
ggcatgacactctagtgacttcc

SEQ ID NO: 3873670 - DNA, 12 bp, Homo sapiens
ggcatggccctg

SEQ ID NO: 3873671 - DNA, 16 bp, Homo sapiens
ggcatggccctggggt

SEQ ID NO: 3873672 - DNA, 21 bp, Homo sapiens
ggcatggtggcgcaagcctgt

SEQ ID NO: 3873673 - DNA, 23 bp, Homo sapiens
ggcatggttccttccctgggaag

SEQ ID NO: 3873674 - DNA, 19 bp, Homo sapiens
ggcatgtcagagccaggct

SEQ ID NO: 3873675 - DNA, 21 bp, Homo sapiens
ggcattttcctcgcctaggcc

SEQ ID NO: 3873676 - DNA, 19 bp, Homo sapiens
ggccaaaagggcagccagg

SEQ ID NO: 3873677 - DNA, 22 bp, Homo sapiens
ggccaaaagggcagccaggggc

SEQ ID NO: 3873678 - DNA, 22 bp, Homo sapiens
ggccaaatgcacaagctcagaa

SEQ ID NO: 3873679 - DNA, 16 bp, Homo sapiens
ggccaagctgaagtga

SEQ ID NO: 3873680 - DNA, 24 bp, Homo sapiens
ggccacccgttctgctggcctgga

SEQ ID NO: 3873681 - DNA, 10 bp, Homo sapiens
ggccaccctc

SEQ ID NO: 3873682 - DNA, 15 bp, Homo sapiens
ggccaccctccttcc

SEQ ID NO: 3873683 - DNA, 15 bp, Homo sapiens
ggccaccctggcccg

SEQ ID NO: 3873684 - DNA, 17 bp, Homo sapiens
ggccacgtgccaggccc

SEQ ID NO: 3873685 - DNA, 14 bp, Homo sapiens
ggccactccttcct

SEQ ID NO: 3873686 - DNA, 17 bp, Homo sapiens
ggccactccttcctgcc

SEQ ID NO: 3873687 - DNA, 20 bp, Homo sapiens
ggccactccttcctgcccca

SEQ ID NO: 3873688 - DNA, 18 bp, Homo sapiens
ggccactgtggccagagc

SEQ ID NO: 3873689 - DNA, 19 bp, Homo sapiens
ggccactgtggccagagct

SEQ ID NO: 3873690 - DNA, 14 bp, Homo sapiens
ggccagaaggaggg

SEQ ID NO: 3873691 - DNA, 24 bp, Homo sapiens
ggccagaaggagggcagagccatg

SEQ ID NO: 3873692 - DNA, 13 bp, Homo sapiens
ggccagacacaga

SEQ ID NO: 3873693 - DNA, 23 bp, Homo sapiens
ggccagacacagatacatgggga

SEQ ID NO: 3873694 - DNA, 16 bp, Homo sapiens
ggccagacgctgccgc

SEQ ID NO: 3873695 - DNA, 12 bp, Homo sapiens
ggccagagaggg

SEQ ID NO: 3873696 - DNA, 17 bp, Homo sapiens
ggccagagctggaaggc

SEQ ID NO: 3873697 - DNA, 18 bp, Homo sapiens
ggccagagctggaaggca

SEQ ID NO: 3873698 - DNA, 12 bp, Homo sapiens
ggccagcaccct

SEQ ID NO: 3873699 - DNA, 13 bp, Homo sapiens
ggccagcaccctc

SEQ ID NO: 3873700 - DNA, 17 bp, Homo sapiens
ggccagcaccctctcct

SEQ ID NO: 3873701 - DNA, 19 bp, Homo sapiens
ggccagcaccctctcctgg

SEQ ID NO: 3873702 - DNA, 20 bp, Homo sapiens
ggccagcaccctctcctggg

SEQ ID NO: 3873703 - DNA, 15 bp, Homo sapiens
ggccagcctcagctc

SEQ ID NO: 3873704 - DNA, 20 bp, Homo sapiens
ggccagcctcagctcagcct

SEQ ID NO: 3873705 - DNA, 13 bp, Homo sapiens
ggccagcctggcc

SEQ ID NO: 3873706 - DNA, 16 bp, Homo sapiens
ggccagcctggcctcc

SEQ ID NO: 3873707 - DNA, 18 bp, Homo sapiens
ggccagcctggcctcctg

SEQ ID NO: 3873708 - DNA, 18 bp, Homo sapiens
ggccagccttgcactgtg

SEQ ID NO: 3873709 - DNA, 23 bp, Homo sapiens
ggccagctgcatctactcaggcc

SEQ ID NO: 3873710 - DNA, 15 bp, Homo sapiens
ggccaggacaggccc

SEQ ID NO: 3873711 - DNA, 17 bp, Homo sapiens
ggccaggagagagatct

SEQ ID NO: 3873712 - DNA, 15 bp, Homo sapiens
ggccaggagctcagc

SEQ ID NO: 3873713 - DNA, 19 bp, Homo sapiens
ggccaggcaggggtgggag

SEQ ID NO: 3873714 - DNA, 13 bp, Homo sapiens
ggccagggcctgg

SEQ ID NO: 3873715 - DNA, 20 bp, Homo sapiens
ggccagtcctagagctcctg

SEQ ID NO: 3873716 - DNA, 16 bp, Homo sapiens
ggccagtctgggctgc

SEQ ID NO: 3873717 - DNA, 18 bp, Homo sapiens
ggccagtgagggctgggc

SEQ ID NO: 3873718 - DNA, 19 bp, Homo sapiens
ggccatacttttgagaggg

SEQ ID NO: 3873719 - DNA, 16 bp, Homo sapiens
ggccatccctgggccc

SEQ ID NO: 3873720 - DNA, 19 bp, Homo sapiens
ggccatccctgggcccctc

SEQ ID NO: 3873721 - DNA, 16 bp, Homo sapiens
ggccatgctgaaggga

SEQ ID NO: 3873722 - DNA, 20 bp, Homo sapiens
ggccattttcttgcctgagg

SEQ ID NO: 3873723 - DNA, 23 bp, Homo sapiens
ggccattttcttgcctgaggctc

SEQ ID NO: 3873724 - DNA, 19 bp, Homo sapiens
ggcccaagagatgaagagt

SEQ ID NO: 3873725 - DNA, 19 bp, Homo sapiens
ggcccacaaaggggagaag

SEQ ID NO: 3873726 - DNA, 13 bp, Homo sapiens
ggcccacagctcc

SEQ ID NO: 3873727 - DNA, 15 bp, Homo sapiens
ggcccacagctccca

SEQ ID NO: 3873728 - DNA, 19 bp, Homo sapiens
ggcccacagctcccacccc

SEQ ID NO: 3873729 - DNA, 20 bp, Homo sapiens
ggcccacagctcccacccca

SEQ ID NO: 3873730 - DNA, 12 bp, Homo sapiens
ggcccagaaact

SEQ ID NO: 3873731 - DNA, 12 bp, Homo sapiens
ggcccagcctgt

SEQ ID NO: 3873732 - DNA, 16 bp, Homo sapiens
ggcccagcctgtcctg

SEQ ID NO: 3873733 - DNA, 17 bp, Homo sapiens
ggcccagcctgtcctgg

SEQ ID NO: 3873734 - DNA, 22 bp, Homo sapiens
ggcccagcctgtcctggtacag

SEQ ID NO: 3873735 - DNA, 16 bp, Homo sapiens
ggcccagctgtagcca

SEQ ID NO: 3873736 - DNA, 22 bp, Homo sapiens
ggcccagctgtagccatggctc

SEQ ID NO: 3873737 - DNA, 14 bp, Homo sapiens
ggcccaggctctgg

SEQ ID NO: 3873738 - DNA, 17 bp, Homo sapiens
ggcccaggctctgggaa

SEQ ID NO: 3873739 - DNA, 22 bp, Homo sapiens
ggcccagggagcaatgggaggg

SEQ ID NO: 3873740 - DNA, 21 bp, Homo sapiens
ggcccataatagttagccctc

SEQ ID NO: 3873741 - DNA, 23 bp, Homo sapiens
ggcccataatagttagccctcag

SEQ ID NO: 3873742 - DNA, 14 bp, Homo sapiens
ggccccaccaccta

SEQ ID NO: 3873743 - DNA, 18 bp, Homo sapiens
ggccccagatctgcctgg

SEQ ID NO: 3873744 - DNA, 21 bp, Homo sapiens
ggccccagatctgcctgggcc

SEQ ID NO: 3873745 - DNA, 22 bp, Homo sapiens
ggccccagatctgcctgggcct

SEQ ID NO: 3873746 - DNA, 20 bp, Homo sapiens
ggccccaggtgccaccaata

SEQ ID NO: 3873747 - DNA, 14 bp, Homo sapiens
ggccccatgacctc

SEQ ID NO: 3873748 - DNA, 19 bp, Homo sapiens
ggagtgagaggtctctctt

SEQ ID NO: 3873749 - DNA, 21 bp, Homo sapiens
ggagtgaggcttccaggctct

SEQ ID NO: 3873750 - DNA, 15 bp, Homo sapiens
ggagtgcagggagga

SEQ ID NO: 3873751 - DNA, 21 bp, Homo sapiens
ggagtgcgctcttggtccctg

SEQ ID NO: 3873752 - DNA, 22 bp, Homo sapiens
ggagtgcttatcccttcttttt

SEQ ID NO: 3873753 - DNA, 21 bp, Homo sapiens
ggagtgggggctgtgccgtga

SEQ ID NO: 3873754 - DNA, 17 bp, Homo sapiens
ggagtgtgggtgatcag

SEQ ID NO: 3873755 - DNA, 13 bp, Homo sapiens
ggagttgagtcac

SEQ ID NO: 3873756 - DNA, 18 bp, Homo sapiens
ggagtttgagacaagccc

SEQ ID NO: 3873757 - DNA, 16 bp, Homo sapiens
ggataacaaaatcaca

SEQ ID NO: 3873758 - DNA, 23 bp, Homo sapiens
ggataacaaaatcacaagcaata

SEQ ID NO: 3873759 - DNA, 14 bp, Homo sapiens
ggataacctatatg

SEQ ID NO: 3873760 - DNA, 18 bp, Homo sapiens
ggatactctgtcagatgg

SEQ ID NO: 3873761 - DNA, 13 bp, Homo sapiens
ggatagcattttt

SEQ ID NO: 3873762 - DNA, 15 bp, Homo sapiens
ggatataaaacacat

SEQ ID NO: 3873763 - DNA, 17 bp, Homo sapiens
ggatcacagggccccag

SEQ ID NO: 3873764 - DNA, 16 bp, Homo sapiens
ggatcagaacaggagc

SEQ ID NO: 3873765 - DNA, 16 bp, Homo sapiens
ggatcagcgtggcctt

SEQ ID NO: 3873766 - DNA, 15 bp, Homo sapiens
ggatccacacctggt

SEQ ID NO: 3873767 - DNA, 14 bp, Homo sapiens
ggatccctggaggg

SEQ ID NO: 3873768 - DNA, 15 bp, Homo sapiens
ggatccgctgccacc

SEQ ID NO: 3873769 - DNA, 15 bp, Homo sapiens
ggatcctcacaggag

SEQ ID NO: 3873770 - DNA, 17 bp, Homo sapiens
ggatcctcacaggagca

SEQ ID NO: 3873771 - DNA, 18 bp, Homo sapiens
ggatcctcacaggagcag

SEQ ID NO: 3873772 - DNA, 19 bp, Homo sapiens
ggatcctcacaggagcaga

SEQ ID NO: 3873773 - DNA, 22 bp, Homo sapiens
ggatctagcttcatgcctcagt

SEQ ID NO: 3873774 - DNA, 16 bp, Homo sapiens
ggatctctcaggagca

SEQ ID NO: 3873775 - DNA, 14 bp, Homo sapiens
ggatgaccagaaca

SEQ ID NO: 3873776 - DNA, 14 bp, Homo sapiens
ggatgagagtggct

SEQ ID NO: 3873777 - DNA, 16 bp, Homo sapiens
ggatgagagtggctta

SEQ ID NO: 3873778 - DNA, 20 bp, Homo sapiens
ggatgaggggcttcctgggt

SEQ ID NO: 3873779 - DNA, 13 bp, Homo sapiens
ggatgccacagcc

SEQ ID NO: 3873780 - DNA, 15 bp, Homo sapiens
ggatgccacagcccc

SEQ ID NO: 3873781 - DNA, 13 bp, Homo sapiens
ggatgctccaggg

SEQ ID NO: 3873782 - DNA, 17 bp, Homo sapiens
ggatgctccagggcagc

SEQ ID NO: 3873783 - DNA, 14 bp, Homo sapiens
ggatgctggggaga

SEQ ID NO: 3873784 - DNA, 14 bp, Homo sapiens
ggatggaagtgtct

SEQ ID NO: 3873785 - DNA, 16 bp, Homo sapiens
ggatggagaggcggcc

SEQ ID NO: 3873786 - DNA, 17 bp, Homo sapiens
ggatggagaggcggcct

SEQ ID NO: 3873787 - DNA, 18 bp, Homo sapiens
ggatggagaggcggcctc

SEQ ID NO: 3873788 - DNA, 14 bp, Homo sapiens
ggatggaggagaaa

SEQ ID NO: 3873789 - DNA, 12 bp, Homo sapiens
ggatggcaagat

SEQ ID NO: 3873790 - DNA, 15 bp, Homo sapiens
ggatggcaccagagg

SEQ ID NO: 3873791 - DNA, 13 bp, Homo sapiens
ggatgggaagatg

SEQ ID NO: 3873792 - DNA, 17 bp, Homo sapiens
ggatgggccagggttta

SEQ ID NO: 3873793 - DNA, 13 bp, Homo sapiens
ggatgtagaactt

SEQ ID NO: 3873794 - DNA, 14 bp, Homo sapiens
ggatgtcagacaat

SEQ ID NO: 3873795 - DNA, 15 bp, Homo sapiens
ggatgtcaggcccag

SEQ ID NO: 3873796 - DNA, 23 bp, Homo sapiens
ggatgtgggagggagcagacagg

SEQ ID NO: 3873797 - DNA, 13 bp, Homo sapiens
ggatgtgtaaatg

SEQ ID NO: 3873798 - DNA, 23 bp, Homo sapiens
ggatgttctagccctccctggca

SEQ ID NO: 3873799 - DNA, 18 bp, Homo sapiens
ggattaagatacactcct

SEQ ID NO: 3873800 - DNA, 22 bp, Homo sapiens
ggattaatggtcctgtgatgct

SEQ ID NO: 3873801 - DNA, 22 bp, Homo sapiens
ggattattcatttaaaatgatt

SEQ ID NO: 3873802 - DNA, 22 bp, Homo sapiens
ggattcccaccaaggtcttcag

SEQ ID NO: 3873803 - DNA, 17 bp, Homo sapiens
ggattgcagtccccagt

SEQ ID NO: 3873804 - DNA, 18 bp, Homo sapiens
ggatttcctattttaaaa

SEQ ID NO: 3873805 - DNA, 23 bp, Homo sapiens
ggatttcctattttaaaaccatg

SEQ ID NO: 3873806 - DNA, 13 bp, Homo sapiens
ggatttgaagcaa

SEQ ID NO: 3873807 - DNA, 14 bp, Homo sapiens
ggatttgccccttc

SEQ ID NO: 3873808 - DNA, 13 bp, Homo sapiens
ggatttgttcaca

SEQ ID NO: 3873809 - DNA, 12 bp, Homo sapiens
ggattttgagta

SEQ ID NO: 3873810 - DNA, 17 bp, Homo sapiens
ggattttgtgttttttc

SEQ ID NO: 3873811 - DNA, 15 bp, Homo sapiens
ggcaaaaaaattaaa

SEQ ID NO: 3873812 - DNA, 16 bp, Homo sapiens
ggcaaagaactgcccc

SEQ ID NO: 3873813 - DNA, 16 bp, Homo sapiens
ggcaaagcccctggaa

SEQ ID NO: 3873814 - DNA, 17 bp, Homo sapiens
ggcaaccccagttctgc

SEQ ID NO: 3873815 - DNA, 21 bp, Homo sapiens
ggcaaccccagttctgctcct

SEQ ID NO: 3873816 - DNA, 18 bp, Homo sapiens
ggcaactaagcagtccct

SEQ ID NO: 3873817 - DNA, 12 bp, Homo sapiens
ggcaagcaggga

SEQ ID NO: 3873818 - DNA, 14 bp, Homo sapiens
ggcaagcccctcag

SEQ ID NO: 3873819 - DNA, 16 bp, Homo sapiens
ggcaagcccctcagcc

SEQ ID NO: 3873820 - DNA, 19 bp, Homo sapiens
ggcaagcccctcagccctt

SEQ ID NO: 3873821 - DNA, 20 bp, Homo sapiens
ggcaagtcgagagggctgtt

SEQ ID NO: 3873822 - DNA, 19 bp, Homo sapiens
ggcaattctgacttctccc

SEQ ID NO: 3873823 - DNA, 24 bp, Homo sapiens
ggcacaactgtctaatgacacggt

SEQ ID NO: 3873824 - DNA, 16 bp, Homo sapiens
ggcacacagcagcccc

SEQ ID NO: 3873825 - DNA, 14 bp, Homo sapiens
ggcacaccactgcc

SEQ ID NO: 3873826 - DNA, 18 bp, Homo sapiens
ggcacagcggggccccag

SEQ ID NO: 3873827 - DNA, 16 bp, Homo sapiens
ggcacaggagctacct

SEQ ID NO: 3873828 - DNA, 17 bp, Homo sapiens
ggcacaggagctacctg

SEQ ID NO: 3873829 - DNA, 19 bp, Homo sapiens
ggcacaggagctacctgtg

SEQ ID NO: 3873830 - DNA, 20 bp, Homo sapiens
ggcacaggagctacctgtgt

SEQ ID NO: 3873831 - DNA, 22 bp, Homo sapiens
ggcacaggcaggaagagagaga

SEQ ID NO: 3873832 - DNA, 12 bp, Homo sapiens
ggcaccagaggc

SEQ ID NO: 3873833 - DNA, 19 bp, Homo sapiens
ggcaccagaggctgcagaa

SEQ ID NO: 3873834 - DNA, 15 bp, Homo sapiens
ggcaccagccccctg

SEQ ID NO: 3873835 - DNA, 18 bp, Homo sapiens
ggcaccagctctgtggcc

SEQ ID NO: 3873836 - DNA, 19 bp, Homo sapiens
ggcaccagctctgtggcct

SEQ ID NO: 3873837 - DNA, 14 bp, Homo sapiens
ggcacccccagcct

SEQ ID NO: 3873838 - DNA, 16 bp, Homo sapiens
ggcacccccagcctgg

SEQ ID NO: 3873839 - DNA, 19 bp, Homo sapiens
ggcacccccagcctgggcc

SEQ ID NO: 3873840 - DNA, 15 bp, Homo sapiens
ggcaccccctgcagc

SEQ ID NO: 3873841 - DNA, 19 bp, Homo sapiens
ggcaccccctggagagaag

SEQ ID NO: 3873842 - DNA, 20 bp, Homo sapiens
ggcaccccctggagagaagt

SEQ ID NO: 3873843 - DNA, 23 bp, Homo sapiens
ggcacctcagacaatccactctc

SEQ ID NO: 3873844 - DNA, 14 bp, Homo sapiens
ggcacctcctgaga

SEQ ID NO: 3873845 - DNA, 13 bp, Homo sapiens
ggcacctgctgga

SEQ ID NO: 3873846 - DNA, 15 bp, Homo sapiens
ggcacctggcctgct

SEQ ID NO: 3873847 - DNA, 19 bp, Homo sapiens
ggcacctggcctgctggga

SEQ ID NO: 3873848 - DNA, 19 bp, Homo sapiens
ggcacctgggaaaacagag

SEQ ID NO: 3873849 - DNA, 13 bp, Homo sapiens
ggcacctgggccc

SEQ ID NO: 3873850 - DNA, 19 bp, Homo sapiens
ggcacctgggccctggggc

SEQ ID NO: 3873851 - DNA, 18 bp, Homo sapiens
ggcacgaacccacctgct

SEQ ID NO: 3873852 - DNA, 21 bp, Homo sapiens
ggcactgggatgagccgctgt

SEQ ID NO: 3873853 - DNA, 14 bp, Homo sapiens
ggcacttgtcacta

SEQ ID NO: 3873854 - DNA, 22 bp, Homo sapiens
ggcagaagaattgaacccagga

SEQ ID NO: 3873855 - DNA, 13 bp, Homo sapiens
ggcagaaggggaa

SEQ ID NO: 3873856 - DNA, 18 bp, Homo sapiens
ggcagaataagaaaacaa

SEQ ID NO: 3873857 - DNA, 15 bp, Homo sapiens
ggcagacaagagctg

SEQ ID NO: 3873858 - DNA, 19 bp, Homo sapiens
ggcagacaagagctgctgt

SEQ ID NO: 3873859 - DNA, 17 bp, Homo sapiens
ggcagaccatctccagc

SEQ ID NO: 3873860 - DNA, 23 bp, Homo sapiens
ggcagaccgggggccagacacag

SEQ ID NO: 3873861 - DNA, 14 bp, Homo sapiens
ggcagagaaagaag

SEQ ID NO: 3873862 - DNA, 21 bp, Homo sapiens
ggcagagaaagaagagacagg

SEQ ID NO: 3873863 - DNA, 17 bp, Homo sapiens
ggcagagaccccaggat

SEQ ID NO: 3873864 - DNA, 20 bp, Homo sapiens
ggcagagatcaggtgggcag

SEQ ID NO: 3873865 - DNA, 22 bp, Homo sapiens
ggcagaggctggaggcagggcc

SEQ ID NO: 3873866 - DNA, 22 bp, Homo sapiens
ggcagagggaatgttccctgca

SEQ ID NO: 3873867 - DNA, 14 bp, Homo sapiens
ggcagagggcagag

SEQ ID NO: 3873868 - DNA, 18 bp, Homo sapiens
ggcagaggggcagccgct

SEQ ID NO: 3873869 - DNA, 23 bp, Homo sapiens
ggcagagtgagactcgtctcaaa

SEQ ID NO: 3873870 - DNA, 19 bp, Homo sapiens
ggcagataatcagcctctt

SEQ ID NO: 3873871 - DNA, 16 bp, Homo sapiens
ggcagatcacaaggtc

SEQ ID NO: 3873872 - DNA, 14 bp, Homo sapiens
ggcagatgtaggag

SEQ ID NO: 3873873 - DNA, 16 bp, Homo sapiens
ggcagatgtaggaggg

SEQ ID NO: 3873874 - DNA, 17 bp, Homo sapiens
ggcagatgtaggaggga

SEQ ID NO: 3873875 - DNA, 13 bp, Homo sapiens
ggcagcaccctcc

SEQ ID NO: 3873876 - DNA, 19 bp, Homo sapiens
ggcagcaccctcccccgca

SEQ ID NO: 3873877 - DNA, 11 bp, Homo sapiens
ggcagcagcca

SEQ ID NO: 3873878 - DNA, 17 bp, Homo sapiens
ggcagcatggagagcct

SEQ ID NO: 3873879 - DNA, 20 bp, Homo sapiens
ggcagccacacttctcagga

SEQ ID NO: 3873880 - DNA, 14 bp, Homo sapiens
ggcagccatgcctc

SEQ ID NO: 3873881 - DNA, 16 bp, Homo sapiens
ggcagccatgcctcat

SEQ ID NO: 3873882 - DNA, 21 bp, Homo sapiens
ggcagccgtgccttcagctct

SEQ ID NO: 3873883 - DNA, 13 bp, Homo sapiens
ggcagcctccaga

SEQ ID NO: 3873884 - DNA, 15 bp, Homo sapiens
ggcagcctccagagc

SEQ ID NO: 3873885 - DNA, 17 bp, Homo sapiens
ggcagcctccagagcca

SEQ ID NO: 3873886 - DNA, 22 bp, Homo sapiens
ggcagcctccagagccagcctg

SEQ ID NO: 3873887 - DNA, 24 bp, Homo sapiens
ggcagcctccagagccagcctggg

SEQ ID NO: 3873888 - DNA, 18 bp, Homo sapiens
ggcagctccaacagcttg

SEQ ID NO: 3873889 - DNA, 12 bp, Homo sapiens
ggcagctgctct

SEQ ID NO: 3873890 - DNA, 13 bp, Homo sapiens
ggcagctgctctt

SEQ ID NO: 3873891 - DNA, 18 bp, Homo sapiens
ggcagctgggccccacct

SEQ ID NO: 3873892 - DNA, 20 bp, Homo sapiens
ggcagctgggccccacctac

SEQ ID NO: 3873893 - DNA, 13 bp, Homo sapiens
ggcagctgtagct

SEQ ID NO: 3873894 - DNA, 12 bp, Homo sapiens
ggcaggaagaga

SEQ ID NO: 3873895 - DNA, 21 bp, Homo sapiens
ggcaggacacatcccggcctc

SEQ ID NO: 3873896 - DNA, 13 bp, Homo sapiens
ggcaggagcagga

SEQ ID NO: 3873897 - DNA, 22 bp, Homo sapiens
ggcaggagcaggaacagagact

SEQ ID NO: 3873898 - DNA, 23 bp, Homo sapiens
ggcaggagcaggaacagagactc

SEQ ID NO: 3873899 - DNA, 14 bp, Homo sapiens
ggcaggaggcctgg

SEQ ID NO: 3873900 - DNA, 18 bp, Homo sapiens
ggcaggaggcctggcctt

SEQ ID NO: 3873901 - DNA, 22 bp, Homo sapiens
ggcaggcacacagcagcccccc

SEQ ID NO: 3873902 - DNA, 23 bp, Homo sapiens
ggcaggcagggctctcctggctt

SEQ ID NO: 3873903 - DNA, 21 bp, Homo sapiens
ggcagggccttgcccagagat

SEQ ID NO: 3873904 - DNA, 20 bp, Homo sapiens
ggcagggctctcctggcttc

SEQ ID NO: 3873905 - DNA, 17 bp, Homo sapiens
ggcaggggtgggagagc

SEQ ID NO: 3873906 - DNA, 21 bp, Homo sapiens
ggcaggtagatcgcttgagcc

SEQ ID NO: 3873907 - DNA, 24 bp, Homo sapiens
ggcaggtagatcgcttgagcccag

SEQ ID NO: 3873908 - DNA, 16 bp, Homo sapiens
ggcaggtttgccagtg

SEQ ID NO: 3873909 - DNA, 14 bp, Homo sapiens
ggcagtacctggga

SEQ ID NO: 3873910 - DNA, 22 bp, Homo sapiens
ggcagtcattcagcaccagagc

SEQ ID NO: 3873911 - DNA, 15 bp, Homo sapiens
ggcagtctgaaccct

SEQ ID NO: 3873912 - DNA, 20 bp, Homo sapiens
ggcagtggtaagctctggct

SEQ ID NO: 3873913 - DNA, 16 bp, Homo sapiens
ggcagttcgcagccac

SEQ ID NO: 3873914 - DNA, 18 bp, Homo sapiens
ggcagttcgcagccaccc

SEQ ID NO: 3873915 - DNA, 22 bp, Homo sapiens
ggcagttcgcagccaccctgag

SEQ ID NO: 3873916 - DNA, 23 bp, Homo sapiens
ggcagttcgcagccaccctgagg

SEQ ID NO: 3873917 - DNA, 21 bp, Homo sapiens
ggcatagaaactgaggagtag

SEQ ID NO: 3873918 - DNA, 11 bp, Homo sapiens
ggcatatttat

SEQ ID NO: 3873919 - DNA, 12 bp, Homo sapiens
ggcatcaggcac

SEQ ID NO: 3873920 - DNA, 15 bp, Homo sapiens
ggacggttgtaagca

SEQ ID NO: 3873921 - DNA, 17 bp, Homo sapiens
ggacgttgcctggccct

SEQ ID NO: 3873922 - DNA, 23 bp, Homo sapiens
ggactaacactcagaagcctggg

SEQ ID NO: 3873923 - DNA, 21 bp, Homo sapiens
ggactacgttaagggaaggaa

SEQ ID NO: 3873924 - DNA, 22 bp, Homo sapiens
ggactagaaaaacttgggtctc

SEQ ID NO: 3873925 - DNA, 18 bp, Homo sapiens
ggactcaagggtccagaa

SEQ ID NO: 3873926 - DNA, 19 bp, Homo sapiens
ggactcaagggtccagaag

SEQ ID NO: 3873927 - DNA, 14 bp, Homo sapiens
ggactcatggctta

SEQ ID NO: 3873928 - DNA, 22 bp, Homo sapiens
ggactcattttaaaaaatggaa

SEQ ID NO: 3873929 - DNA, 17 bp, Homo sapiens
ggactccccaggccagg

SEQ ID NO: 3873930 - DNA, 12 bp, Homo sapiens
ggactcctccca

SEQ ID NO: 3873931 - DNA, 13 bp, Homo sapiens
ggactcctcccac

SEQ ID NO: 3873932 - DNA, 15 bp, Homo sapiens
ggactcctctgtcca

SEQ ID NO: 3873933 - DNA, 21 bp, Homo sapiens
ggactctgccccttctgtttc

SEQ ID NO: 3873934 - DNA, 23 bp, Homo sapiens
ggactctgccccttctgtttcca

SEQ ID NO: 3873935 - DNA, 14 bp, Homo sapiens
ggactctggcctct

SEQ ID NO: 3873936 - DNA, 15 bp, Homo sapiens
ggactctggcctctc

SEQ ID NO: 3873937 - DNA, 23 bp, Homo sapiens
ggactgagactggcacttagccc

SEQ ID NO: 3873938 - DNA, 13 bp, Homo sapiens
ggactgaggagtg

SEQ ID NO: 3873939 - DNA, 16 bp, Homo sapiens
ggactgcgctggacga

SEQ ID NO: 3873940 - DNA, 14 bp, Homo sapiens
ggactggaaccagg

SEQ ID NO: 3873941 - DNA, 17 bp, Homo sapiens
ggactggaaccagggag

SEQ ID NO: 3873942 - DNA, 22 bp, Homo sapiens
ggactggaaccagggagaccga

SEQ ID NO: 3873943 - DNA, 18 bp, Homo sapiens
ggactgggttttgtctct

SEQ ID NO: 3873944 - DNA, 15 bp, Homo sapiens
ggacttaacggctcc

SEQ ID NO: 3873945 - DNA, 14 bp, Homo sapiens
ggacttcctggggc

SEQ ID NO: 3873946 - DNA, 18 bp, Homo sapiens
ggacttctgcagctatgc

SEQ ID NO: 3873947 - DNA, 15 bp, Homo sapiens
ggagaaacagagaca

SEQ ID NO: 3873948 - DNA, 16 bp, Homo sapiens
ggagaaacagagacag

SEQ ID NO: 3873949 - DNA, 16 bp, Homo sapiens
ggagaaagggcaaatt

SEQ ID NO: 3873950 - DNA, 23 bp, Homo sapiens
ggagaagaaagaggtgaccccag

SEQ ID NO: 3873951 - DNA, 23 bp, Homo sapiens
ggagaagagctgttcacagccag

SEQ ID NO: 3873952 - DNA, 16 bp, Homo sapiens
ggagaagcagtgagcc

SEQ ID NO: 3873953 - DNA, 13 bp, Homo sapiens
ggagaagctgatg

SEQ ID NO: 3873954 - DNA, 12 bp, Homo sapiens
ggagaaggaagg

SEQ ID NO: 3873955 - DNA, 12 bp, Homo sapiens
ggagaaggatct

SEQ ID NO: 3873956 - DNA, 17 bp, Homo sapiens
ggagaagggccagccct

SEQ ID NO: 3873957 - DNA, 22 bp, Homo sapiens
ggagaagggccagccctacatc

SEQ ID NO: 3873958 - DNA, 18 bp, Homo sapiens
ggagacaagaaatccctg

SEQ ID NO: 3873959 - DNA, 14 bp, Homo sapiens
ggagacagtagagg

SEQ ID NO: 3873960 - DNA, 16 bp, Homo sapiens
ggagactcacctctgc

SEQ ID NO: 3873961 - DNA, 17 bp, Homo sapiens
ggagactcacctctgcc

SEQ ID NO: 3873962 - DNA, 18 bp, Homo sapiens
ggagactcacctctgcct

SEQ ID NO: 3873963 - DNA, 12 bp, Homo sapiens
ggagactcctgc

SEQ ID NO: 3873964 - DNA, 21 bp, Homo sapiens
ggagactgggtgaaagtgact

SEQ ID NO: 3873965 - DNA, 19 bp, Homo sapiens
ggagagactgaaagcagca

SEQ ID NO: 3873966 - DNA, 21 bp, Homo sapiens
ggagagactgaaagcagcagc

SEQ ID NO: 3873967 - DNA, 20 bp, Homo sapiens
ggagagagatctagaaagtg

SEQ ID NO: 3873968 - DNA, 15 bp, Homo sapiens
ggagagcagctggct

SEQ ID NO: 3873969 - DNA, 17 bp, Homo sapiens
ggagagcagctggctct

SEQ ID NO: 3873970 - DNA, 16 bp, Homo sapiens
ggagagccagaacctg

SEQ ID NO: 3873971 - DNA, 19 bp, Homo sapiens
ggagagccagaacctggag

SEQ ID NO: 3873972 - DNA, 11 bp, Homo sapiens
ggagagccagc

SEQ ID NO: 3873973 - DNA, 18 bp, Homo sapiens
ggagagccagccctccct

SEQ ID NO: 3873974 - DNA, 19 bp, Homo sapiens
ggagagccagctctctcta

SEQ ID NO: 3873975 - DNA, 11 bp, Homo sapiens
ggagagccctg

SEQ ID NO: 3873976 - DNA, 13 bp, Homo sapiens
ggagagccctggg

SEQ ID NO: 3873977 - DNA, 14 bp, Homo sapiens
ggagagccctggga

SEQ ID NO: 3873978 - DNA, 13 bp, Homo sapiens
ggagagctaggag

SEQ ID NO: 3873979 - DNA, 15 bp, Homo sapiens
ggagagctaggagca

SEQ ID NO: 3873980 - DNA, 21 bp, Homo sapiens
ggagagctaggagcaaagcct

SEQ ID NO: 3873981 - DNA, 14 bp, Homo sapiens
ggagaggactctgc

SEQ ID NO: 3873982 - DNA, 20 bp, Homo sapiens
ggagaggagtgactgagctt

SEQ ID NO: 3873983 - DNA, 17 bp, Homo sapiens
ggagaggggtgcaccca

SEQ ID NO: 3873984 - DNA, 17 bp, Homo sapiens
ggagagggtctggagaa

SEQ ID NO: 3873985 - DNA, 18 bp, Homo sapiens
ggagagggtctggagaag

SEQ ID NO: 3873986 - DNA, 23 bp, Homo sapiens
ggagagggtctggagaagcagtg

SEQ ID NO: 3873987 - DNA, 17 bp, Homo sapiens
ggagagtacagtgagcc

SEQ ID NO: 3873988 - DNA, 14 bp, Homo sapiens
ggagatgatgatga

SEQ ID NO: 3873989 - DNA, 15 bp, Homo sapiens
ggagatggtcagtgt

SEQ ID NO: 3873990 - DNA, 22 bp, Homo sapiens
ggagatggtcagtgtggagagg

SEQ ID NO: 3873991 - DNA, 15 bp, Homo sapiens
ggagcaaagcctgtt

SEQ ID NO: 3873992 - DNA, 22 bp, Homo sapiens
ggagcaatgggagggggctcca

SEQ ID NO: 3873993 - DNA, 15 bp, Homo sapiens
ggagcacagaggggc

SEQ ID NO: 3873994 - DNA, 13 bp, Homo sapiens
ggagcacagccct

SEQ ID NO: 3873995 - DNA, 13 bp, Homo sapiens
ggagcacctgaac

SEQ ID NO: 3873996 - DNA, 19 bp, Homo sapiens
ggagcacctgaaccccatg

SEQ ID NO: 3873997 - DNA, 22 bp, Homo sapiens
ggagcacctgaaccccatgggc

SEQ ID NO: 3873998 - DNA, 15 bp, Homo sapiens
ggagcactggagtgc

SEQ ID NO: 3873999 - DNA, 18 bp, Homo sapiens
ggagcacttgcgtcctgc

SEQ ID NO: 3874000 - DNA, 20 bp, Homo sapiens
ggagcacttgcgtcctgcag

SEQ ID NO: 3874001 - DNA, 12 bp, Homo sapiens
ggagcagacaga

SEQ ID NO: 3874002 - DNA, 13 bp, Homo sapiens
ggagcagacagag

SEQ ID NO: 3874003 - DNA, 18 bp, Homo sapiens
ggagcagacagagaaatg

SEQ ID NO: 3874004 - DNA, 22 bp, Homo sapiens
ggagcagcacgattttgcacaa

SEQ ID NO: 3874005 - DNA, 19 bp, Homo sapiens
ggagcaggggtctgagcca

SEQ ID NO: 3874006 - DNA, 16 bp, Homo sapiens
ggagcatctgactcac

SEQ ID NO: 3874007 - DNA, 17 bp, Homo sapiens
ggagcatggctgtgagg

SEQ ID NO: 3874008 - DNA, 14 bp, Homo sapiens
ggagccaacagcag

SEQ ID NO: 3874009 - DNA, 16 bp, Homo sapiens
ggagccaatggagact

SEQ ID NO: 3874010 - DNA, 17 bp, Homo sapiens
ggagccactcctgtccc

SEQ ID NO: 3874011 - DNA, 13 bp, Homo sapiens
ggagccccaggcc

SEQ ID NO: 3874012 - DNA, 16 bp, Homo sapiens
ggagcccctaggaaag

SEQ ID NO: 3874013 - DNA, 18 bp, Homo sapiens
ggagcccctaggaaagca

SEQ ID NO: 3874014 - DNA, 14 bp, Homo sapiens
ggagcctccccctc

SEQ ID NO: 3874015 - DNA, 16 bp, Homo sapiens
ggagcctccccctcag

SEQ ID NO: 3874016 - DNA, 19 bp, Homo sapiens
ggagcctccccctcagatg

SEQ ID NO: 3874017 - DNA, 18 bp, Homo sapiens
ggagcctcgcaacccgtg

SEQ ID NO: 3874018 - DNA, 13 bp, Homo sapiens
ggagcctggcaca

SEQ ID NO: 3874019 - DNA, 17 bp, Homo sapiens
ggagcctgtgaacccag

SEQ ID NO: 3874020 - DNA, 19 bp, Homo sapiens
ggagcctgtgaacccagga

SEQ ID NO: 3874021 - DNA, 13 bp, Homo sapiens
ggagctcttggaa

SEQ ID NO: 3874022 - DNA, 14 bp, Homo sapiens
ggagctcttggaag

SEQ ID NO: 3874023 - DNA, 18 bp, Homo sapiens
ggagctggttagaaatgc

SEQ ID NO: 3874024 - DNA, 23 bp, Homo sapiens
ggagctggttagaaatgcagaat

SEQ ID NO: 3874025 - DNA, 14 bp, Homo sapiens
ggagcttgcagtga

SEQ ID NO: 3874026 - DNA, 20 bp, Homo sapiens
ggaggaaaaccaagccgtgg

SEQ ID NO: 3874027 - DNA, 10 bp, Homo sapiens
ggaggaaggg

SEQ ID NO: 3874028 - DNA, 14 bp, Homo sapiens
ggaggaagggccag

SEQ ID NO: 3874029 - DNA, 15 bp, Homo sapiens
ggaggaagggccagg

SEQ ID NO: 3874030 - DNA, 15 bp, Homo sapiens
ggaggaaggtgctga

SEQ ID NO: 3874031 - DNA, 18 bp, Homo sapiens
ggaggaaggtgctgagct

SEQ ID NO: 3874032 - DNA, 22 bp, Homo sapiens
ggaggacggttgtaagcagttg

SEQ ID NO: 3874033 - DNA, 16 bp, Homo sapiens
ggaggactagaacctg

SEQ ID NO: 3874034 - DNA, 19 bp, Homo sapiens
ggaggactagaacctggag

SEQ ID NO: 3874035 - DNA, 12 bp, Homo sapiens
ggaggaggaagg

SEQ ID NO: 3874036 - DNA, 14 bp, Homo sapiens
ggaggaggaggaag

SEQ ID NO: 3874037 - DNA, 22 bp, Homo sapiens
ggaggaggcctgggggcaggga

SEQ ID NO: 3874038 - DNA, 16 bp, Homo sapiens
ggaggatgccacagcc

SEQ ID NO: 3874039 - DNA, 17 bp, Homo sapiens
ggaggatgccacagccc

SEQ ID NO: 3874040 - DNA, 18 bp, Homo sapiens
ggaggatgccacagcccc

SEQ ID NO: 3874041 - DNA, 13 bp, Homo sapiens
ggaggatggagag

SEQ ID NO: 3874042 - DNA, 12 bp, Homo sapiens
ggaggcaagaac

SEQ ID NO: 3874043 - DNA, 12 bp, Homo sapiens
ggaggcaccagc

SEQ ID NO: 3874044 - DNA, 14 bp, Homo sapiens
ggaggcaccagctc

SEQ ID NO: 3874045 - DNA, 14 bp, Homo sapiens
ggaggcagagaaga

SEQ ID NO: 3874046 - DNA, 19 bp, Homo sapiens
ggaggcagagaagaaagaa

SEQ ID NO: 3874047 - DNA, 19 bp, Homo sapiens
ggaggcagctccaacagct

SEQ ID NO: 3874048 - DNA, 13 bp, Homo sapiens
ggaggcagggcct

SEQ ID NO: 3874049 - DNA, 17 bp, Homo sapiens
ggaggcatggccctggg

SEQ ID NO: 3874050 - DNA, 11 bp, Homo sapiens
ggaggcctcag

SEQ ID NO: 3874051 - DNA, 19 bp, Homo sapiens
ggaggcctcgtaccagcca

SEQ ID NO: 3874052 - DNA, 20 bp, Homo sapiens
ggaggcctcgtaccagccag

SEQ ID NO: 3874053 - DNA, 21 bp, Homo sapiens
ggaggcctcgtaccagccagg

SEQ ID NO: 3874054 - DNA, 22 bp, Homo sapiens
ggaggcctcgtaccagccagga

SEQ ID NO: 3874055 - DNA, 14 bp, Homo sapiens
ggaggcctgatgct

SEQ ID NO: 3874056 - DNA, 18 bp, Homo sapiens
ggaggcctgggggcaggg

SEQ ID NO: 3874057 - DNA, 18 bp, Homo sapiens
ggaggcgaataaatgttc

SEQ ID NO: 3874058 - DNA, 14 bp, Homo sapiens
ggaggcgcagcccg

SEQ ID NO: 3874059 - DNA, 20 bp, Homo sapiens
ggaggcggagagtacagtga

SEQ ID NO: 3874060 - DNA, 17 bp, Homo sapiens
ggaggcggctccaggtc

SEQ ID NO: 3874061 - DNA, 14 bp, Homo sapiens
ggaggctgaggcag

SEQ ID NO: 3874062 - DNA, 16 bp, Homo sapiens
ggaggctgaggcagga

SEQ ID NO: 3874063 - DNA, 13 bp, Homo sapiens
ggaggctgcagag

SEQ ID NO: 3874064 - DNA, 14 bp, Homo sapiens
ggaggctgcagagc

SEQ ID NO: 3874065 - DNA, 18 bp, Homo sapiens
ggaggctgcatgctctgg

SEQ ID NO: 3874066 - DNA, 23 bp, Homo sapiens
ggaggctgcatgctctggaagcc

SEQ ID NO: 3874067 - DNA, 16 bp, Homo sapiens
ggaggctgggcccctg

SEQ ID NO: 3874068 - DNA, 19 bp, Homo sapiens
ggagggacaaaggagcctg

SEQ ID NO: 3874069 - DNA, 12 bp, Homo sapiens
ggagggcagagc

SEQ ID NO: 3874070 - DNA, 20 bp, Homo sapiens
ggagggctagaacctagaag

SEQ ID NO: 3874071 - DNA, 16 bp, Homo sapiens
ggagggctagaacctg

SEQ ID NO: 3874072 - DNA, 20 bp, Homo sapiens
ggagggctagaacctggcag

SEQ ID NO: 3874073 - DNA, 14 bp, Homo sapiens
ggagggctctgagg

SEQ ID NO: 3874074 - DNA, 20 bp, Homo sapiens
ggaggggactatttatgaag

SEQ ID NO: 3874075 - DNA, 15 bp, Homo sapiens
ggaggggcctctgaa

SEQ ID NO: 3874076 - DNA, 13 bp, Homo sapiens
ggaggggcctggc

SEQ ID NO: 3874077 - DNA, 21 bp, Homo sapiens
ggaggggcctggcagccgtgc

SEQ ID NO: 3874078 - DNA, 22 bp, Homo sapiens
ggagggggtcgtggagagctag

SEQ ID NO: 3874079 - DNA, 20 bp, Homo sapiens
ggagggtgccctcctagctc

SEQ ID NO: 3874080 - DNA, 19 bp, Homo sapiens
ggagggtggggccgggtga

SEQ ID NO: 3874081 - DNA, 18 bp, Homo sapiens
ggaggtctccactgagga

SEQ ID NO: 3874082 - DNA, 21 bp, Homo sapiens
ggaggtctccactgaggatgt

SEQ ID NO: 3874083 - DNA, 18 bp, Homo sapiens
ggaggtggctatggccac

SEQ ID NO: 3874084 - DNA, 16 bp, Homo sapiens
ggaggtggtggaggag

SEQ ID NO: 3874085 - DNA, 18 bp, Homo sapiens
ggaggtggtggaggagga

SEQ ID NO: 3874086 - DNA, 20 bp, Homo sapiens
ggaggtggtggaggaggagg

SEQ ID NO: 3874087 - DNA, 15 bp, Homo sapiens
ggaggtgtcccaagc

SEQ ID NO: 3874088 - DNA, 18 bp, Homo sapiens
ggagtaatcaggcagcct

SEQ ID NO: 3874089 - DNA, 13 bp, Homo sapiens
ggagtcaggacct

SEQ ID NO: 3874090 - DNA, 20 bp, Homo sapiens
ggagtctgaggtcctgagca

SEQ ID NO: 3874091 - DNA, 22 bp, Homo sapiens
ggagtctgagtctgagtcctgt

SEQ ID NO: 3874092 - DNA, 23 bp, Homo sapiens
ggagtcttcggtgtttaaagtca

SEQ ID NO: 3874093 - DNA, 20 bp, Homo sapiens
ggacaagcagaggtggccag

SEQ ID NO: 3874094 - DNA, 13 bp, Homo sapiens
ggacaagcatggt

SEQ ID NO: 3874095 - DNA, 21 bp, Homo sapiens
ggacaagccaacttgtaaata

SEQ ID NO: 3874096 - DNA, 11 bp, Homo sapiens
ggacacacaca

SEQ ID NO: 3874097 - DNA, 13 bp, Homo sapiens
ggacacacacaca

SEQ ID NO: 3874098 - DNA, 21 bp, Homo sapiens
ggacacactgtaaacccctgg

SEQ ID NO: 3874099 - DNA, 11 bp, Homo sapiens
ggacacaggcc

SEQ ID NO: 3874100 - DNA, 13 bp, Homo sapiens
ggacacaggcctg

SEQ ID NO: 3874101 - DNA, 14 bp, Homo sapiens
ggacacaggcctgt

SEQ ID NO: 3874102 - DNA, 19 bp, Homo sapiens
ggacacatcccggcctctt

SEQ ID NO: 3874103 - DNA, 19 bp, Homo sapiens
ggacacatgtccagtggga

SEQ ID NO: 3874104 - DNA, 21 bp, Homo sapiens
ggacacattttctcctaggag

SEQ ID NO: 3874105 - DNA, 12 bp, Homo sapiens
ggacacctgccc

SEQ ID NO: 3874106 - DNA, 15 bp, Homo sapiens
ggacacctgccccag

SEQ ID NO: 3874107 - DNA, 17 bp, Homo sapiens
ggacacctgccccagcg

SEQ ID NO: 3874108 - DNA, 14 bp, Homo sapiens
ggacacctgccctg

SEQ ID NO: 3874109 - DNA, 16 bp, Homo sapiens
ggacacttatggggac

SEQ ID NO: 3874110 - DNA, 16 bp, Homo sapiens
ggacagaatgatggac

SEQ ID NO: 3874111 - DNA, 17 bp, Homo sapiens
ggacagagacacctgca

SEQ ID NO: 3874112 - DNA, 18 bp, Homo sapiens
ggacagagacacctgcac

SEQ ID NO: 3874113 - DNA, 15 bp, Homo sapiens
ggacagagatggagg

SEQ ID NO: 3874114 - DNA, 21 bp, Homo sapiens
ggacagcagaagggggagacc

SEQ ID NO: 3874115 - DNA, 13 bp, Homo sapiens
ggacagccccagg

SEQ ID NO: 3874116 - DNA, 14 bp, Homo sapiens
ggacagccccaggg

SEQ ID NO: 3874117 - DNA, 15 bp, Homo sapiens
ggacagccccagggc

SEQ ID NO: 3874118 - DNA, 16 bp, Homo sapiens
ggacagccccagggcc

SEQ ID NO: 3874119 - DNA, 16 bp, Homo sapiens
ggacagccgcctggag

SEQ ID NO: 3874120 - DNA, 12 bp, Homo sapiens
ggacagctgctt

SEQ ID NO: 3874121 - DNA, 13 bp, Homo sapiens
ggacagctgcttg

SEQ ID NO: 3874122 - DNA, 11 bp, Homo sapiens
ggacagctgtg

SEQ ID NO: 3874123 - DNA, 14 bp, Homo sapiens
ggacagctgtgcct

SEQ ID NO: 3874124 - DNA, 19 bp, Homo sapiens
ggacaggactaacactcag

SEQ ID NO: 3874125 - DNA, 18 bp, Homo sapiens
ggacaggaggggcccaca

SEQ ID NO: 3874126 - DNA, 23 bp, Homo sapiens
ggacaggaggggcccacaatgga

SEQ ID NO: 3874127 - DNA, 22 bp, Homo sapiens
ggacagggcatggccaggtggc

SEQ ID NO: 3874128 - DNA, 22 bp, Homo sapiens
ggacagttgcttttcagcatgg

SEQ ID NO: 3874129 - DNA, 16 bp, Homo sapiens
ggacagttggcagaga

SEQ ID NO: 3874130 - DNA, 23 bp, Homo sapiens
ggacagttggcagagaaggcctc

SEQ ID NO: 3874131 - DNA, 20 bp, Homo sapiens
ggacatgatttagggaagca

SEQ ID NO: 3874132 - DNA, 15 bp, Homo sapiens
ggacatggagagaga

SEQ ID NO: 3874133 - DNA, 22 bp, Homo sapiens
ggacatggggcatagaaactga

SEQ ID NO: 3874134 - DNA, 17 bp, Homo sapiens
ggaccaaccctgtttcc

SEQ ID NO: 3874135 - DNA, 14 bp, Homo sapiens
ggaccaactggctt

SEQ ID NO: 3874136 - DNA, 18 bp, Homo sapiens
ggaccaactggcttctgt

SEQ ID NO: 3874137 - DNA, 19 bp, Homo sapiens
ggaccaactggcttctgtg

SEQ ID NO: 3874138 - DNA, 14 bp, Homo sapiens
ggaccaagatgggc

SEQ ID NO: 3874139 - DNA, 18 bp, Homo sapiens
ggaccaagatgggcacat

SEQ ID NO: 3874140 - DNA, 21 bp, Homo sapiens
ggaccacagtgggtggcacct

SEQ ID NO: 3874141 - DNA, 11 bp, Homo sapiens
ggaccaggact

SEQ ID NO: 3874142 - DNA, 18 bp, Homo sapiens
ggaccaggcaccaggcag

SEQ ID NO: 3874143 - DNA, 17 bp, Homo sapiens
ggaccagtcccagagca

SEQ ID NO: 3874144 - DNA, 18 bp, Homo sapiens
ggaccagtcccagagcag

SEQ ID NO: 3874145 - DNA, 15 bp, Homo sapiens
ggaccatgaagagac

SEQ ID NO: 3874146 - DNA, 17 bp, Homo sapiens
ggaccatgaagagactc

SEQ ID NO: 3874147 - DNA, 14 bp, Homo sapiens
ggaccatggacaca

SEQ ID NO: 3874148 - DNA, 20 bp, Homo sapiens
ggaccattgacctcagctgc

SEQ ID NO: 3874149 - DNA, 21 bp, Homo sapiens
ggaccattgacctcagctgca

SEQ ID NO: 3874150 - DNA, 22 bp, Homo sapiens
ggaccattgacctcagctgcac

SEQ ID NO: 3874151 - DNA, 23 bp, Homo sapiens
ggacccacccatcttcctgctgc

SEQ ID NO: 3874152 - DNA, 14 bp, Homo sapiens
ggacccagctactc

SEQ ID NO: 3874153 - DNA, 22 bp, Homo sapiens
ggacccagctactctgtccagg

SEQ ID NO: 3874154 - DNA, 11 bp, Homo sapiens
ggacccaggcc

SEQ ID NO: 3874155 - DNA, 12 bp, Homo sapiens
ggacccaggccc

SEQ ID NO: 3874156 - DNA, 13 bp, Homo sapiens
ggacccaggccct

SEQ ID NO: 3874157 - DNA, 14 bp, Homo sapiens
ggacccctcccttg

SEQ ID NO: 3874158 - DNA, 23 bp, Homo sapiens
ggacccgaagcccaggctgaaga

SEQ ID NO: 3874159 - DNA, 14 bp, Homo sapiens
ggacccgctctgga

SEQ ID NO: 3874160 - DNA, 18 bp, Homo sapiens
ggaccctcgcagcaggtg

SEQ ID NO: 3874161 - DNA, 23 bp, Homo sapiens
ggacccttgagagtatcaggtct

SEQ ID NO: 3874162 - DNA, 17 bp, Homo sapiens
ggaccctttccttcctt

SEQ ID NO: 3874163 - DNA, 23 bp, Homo sapiens
ggaccctttccttccttccctgg

SEQ ID NO: 3874164 - DNA, 16 bp, Homo sapiens
ggaccgcgtagagagc

SEQ ID NO: 3874165 - DNA, 19 bp, Homo sapiens
ggaccgctacaccactctg

SEQ ID NO: 3874166 - DNA, 22 bp, Homo sapiens
ggaccgctacaccactctggca

SEQ ID NO: 3874167 - DNA, 19 bp, Homo sapiens
ggacctccggggagagcag

SEQ ID NO: 3874168 - DNA, 13 bp, Homo sapiens
ggacctctgctct

SEQ ID NO: 3874169 - DNA, 16 bp, Homo sapiens
ggacctctgctctgag

SEQ ID NO: 3874170 - DNA, 14 bp, Homo sapiens
ggacctgagcctgc

SEQ ID NO: 3874171 - DNA, 15 bp, Homo sapiens
ggacctgagcctgcc

SEQ ID NO: 3874172 - DNA, 16 bp, Homo sapiens
ggacctgagcctgccg

SEQ ID NO: 3874173 - DNA, 17 bp, Homo sapiens
ggacctgagcctgccga

SEQ ID NO: 3874174 - DNA, 12 bp, Homo sapiens
ggaccttcctgc

SEQ ID NO: 3874175 - DNA, 13 bp, Homo sapiens
ggaccttcctgcc

SEQ ID NO: 3874176 - DNA, 23 bp, Homo sapiens
ggacgatagcttggagggatgga

SEQ ID NO: 3874177 - DNA, 15 bp, Homo sapiens
ggacgcgcacacaca

SEQ ID NO: 3874178 - DNA, 16 bp, Homo sapiens
ggacgcgcacacacac

SEQ ID NO: 3874179 - DNA, 17 bp, Homo sapiens
gcttcagcctccccacc

SEQ ID NO: 3874180 - DNA, 18 bp, Homo sapiens
gcttcagttgttttcccg

SEQ ID NO: 3874181 - DNA, 14 bp, Homo sapiens
gcttcatcaatttt

SEQ ID NO: 3874182 - DNA, 16 bp, Homo sapiens
gcttcatcaattttta

SEQ ID NO: 3874183 - DNA, 19 bp, Homo sapiens
gcttcatcaatttttatac

SEQ ID NO: 3874184 - DNA, 23 bp, Homo sapiens
gcttcatcaatttttatacatat

SEQ ID NO: 3874185 - DNA, 13 bp, Homo sapiens
gcttccagaccac

SEQ ID NO: 3874186 - DNA, 18 bp, Homo sapiens
gcttccagaccacctgcc

SEQ ID NO: 3874187 - DNA, 21 bp, Homo sapiens
gcttccagaccacctgccagc

SEQ ID NO: 3874188 - DNA, 13 bp, Homo sapiens
gcttccagagagt

SEQ ID NO: 3874189 - DNA, 21 bp, Homo sapiens
gcttccagagagtcctctgga

SEQ ID NO: 3874190 - DNA, 22 bp, Homo sapiens
gcttccagagagtcctctggat

SEQ ID NO: 3874191 - DNA, 12 bp, Homo sapiens
gcttccaggctc

SEQ ID NO: 3874192 - DNA, 18 bp, Homo sapiens
gcttccaggctcttcctg

SEQ ID NO: 3874193 - DNA, 12 bp, Homo sapiens
gcttcccaggat

SEQ ID NO: 3874194 - DNA, 18 bp, Homo sapiens
gcttcccatccccagcga

SEQ ID NO: 3874195 - DNA, 18 bp, Homo sapiens
gcttcctaggccccagag

SEQ ID NO: 3874196 - DNA, 19 bp, Homo sapiens
gcttcctccgtccacccag

SEQ ID NO: 3874197 - DNA, 23 bp, Homo sapiens
gcttcctgtccactctcggggcc

SEQ ID NO: 3874198 - DNA, 17 bp, Homo sapiens
gcttccttagccttgct

SEQ ID NO: 3874199 - DNA, 17 bp, Homo sapiens
gcttccttctgcaccca

SEQ ID NO: 3874200 - DNA, 22 bp, Homo sapiens
gcttcgcttccttagccttgct

SEQ ID NO: 3874201 - DNA, 12 bp, Homo sapiens
gcttctatccca

SEQ ID NO: 3874202 - DNA, 14 bp, Homo sapiens
gcttctatcccagg

SEQ ID NO: 3874203 - DNA, 18 bp, Homo sapiens
gcttctatcccaggaggt

SEQ ID NO: 3874204 - DNA, 13 bp, Homo sapiens
gcttctccctggc

SEQ ID NO: 3874205 - DNA, 16 bp, Homo sapiens
gcttctccctggctga

SEQ ID NO: 3874206 - DNA, 13 bp, Homo sapiens
gcttctcctccag

SEQ ID NO: 3874207 - DNA, 13 bp, Homo sapiens
gcttctcctctcc

SEQ ID NO: 3874208 - DNA, 13 bp, Homo sapiens
gcttctcctgtga

SEQ ID NO: 3874209 - DNA, 16 bp, Homo sapiens
gcttctcctgtgaccc

SEQ ID NO: 3874210 - DNA, 23 bp, Homo sapiens
gcttctcttgggaactccactct

SEQ ID NO: 3874211 - DNA, 20 bp, Homo sapiens
gcttctgcagcaactcccac

SEQ ID NO: 3874212 - DNA, 23 bp, Homo sapiens
gcttctgcagcaactcccacgac

SEQ ID NO: 3874213 - DNA, 15 bp, Homo sapiens
gcttctggctcctcc

SEQ ID NO: 3874214 - DNA, 20 bp, Homo sapiens
gcttctgtgcactagcctgt

SEQ ID NO: 3874215 - DNA, 13 bp, Homo sapiens
gcttctgttgtaa

SEQ ID NO: 3874216 - DNA, 19 bp, Homo sapiens
gcttcttcaagcacctgca

SEQ ID NO: 3874217 - DNA, 16 bp, Homo sapiens
gcttcttcagatcagt

SEQ ID NO: 3874218 - DNA, 19 bp, Homo sapiens
gcttcttcagatcagtgct

SEQ ID NO: 3874219 - DNA, 16 bp, Homo sapiens
gcttctttcaaagtgt

SEQ ID NO: 3874220 - DNA, 17 bp, Homo sapiens
gcttgaagtaaccttat

SEQ ID NO: 3874221 - DNA, 19 bp, Homo sapiens
gcttgaccagacctagacc

SEQ ID NO: 3874222 - DNA, 14 bp, Homo sapiens
gcttgactatcaca

SEQ ID NO: 3874223 - DNA, 19 bp, Homo sapiens
gcttgactatcacatacaa

SEQ ID NO: 3874224 - DNA, 20 bp, Homo sapiens
gcttgactatcacatacaat

SEQ ID NO: 3874225 - DNA, 21 bp, Homo sapiens
gcttgactatcacatacaatt

SEQ ID NO: 3874226 - DNA, 22 bp, Homo sapiens
gcttgactatcacatacaattt

SEQ ID NO: 3874227 - DNA, 13 bp, Homo sapiens
gcttgagcccagg

SEQ ID NO: 3874228 - DNA, 16 bp, Homo sapiens
gcttgagcccaggagt

SEQ ID NO: 3874229 - DNA, 19 bp, Homo sapiens
gcttgcactttgtaacatg

SEQ ID NO: 3874230 - DNA, 18 bp, Homo sapiens
gcttgccctgttaaaaga

SEQ ID NO: 3874231 - DNA, 14 bp, Homo sapiens
gcttgctcattttt

SEQ ID NO: 3874232 - DNA, 23 bp, Homo sapiens
gcttgctcttcagtgggagaaaa

SEQ ID NO: 3874233 - DNA, 12 bp, Homo sapiens
gcttgcttctgc

SEQ ID NO: 3874234 - DNA, 16 bp, Homo sapiens
gcttgcttctgcagca

SEQ ID NO: 3874235 - DNA, 12 bp, Homo sapiens
gcttgcttgccg

SEQ ID NO: 3874236 - DNA, 17 bp, Homo sapiens
gcttgcttgccgagcct

SEQ ID NO: 3874237 - DNA, 15 bp, Homo sapiens
gcttggcagagagga

SEQ ID NO: 3874238 - DNA, 11 bp, Homo sapiens
gcttggccttg

SEQ ID NO: 3874239 - DNA, 18 bp, Homo sapiens
gcttggtggggctcgtgg

SEQ ID NO: 3874240 - DNA, 21 bp, Homo sapiens
gcttggtggggctcgtggcct

SEQ ID NO: 3874241 - DNA, 18 bp, Homo sapiens
gcttgtacatattggaaa

SEQ ID NO: 3874242 - DNA, 13 bp, Homo sapiens
gcttgtagccagc

SEQ ID NO: 3874243 - DNA, 22 bp, Homo sapiens
gcttgtagccagccggggcgag

SEQ ID NO: 3874244 - DNA, 15 bp, Homo sapiens
gcttgtatatacata

SEQ ID NO: 3874245 - DNA, 16 bp, Homo sapiens
gcttgtccctgcccag

SEQ ID NO: 3874246 - DNA, 15 bp, Homo sapiens
gcttgtgagagctgg

SEQ ID NO: 3874247 - DNA, 16 bp, Homo sapiens
gcttgtgagagctggt

SEQ ID NO: 3874248 - DNA, 23 bp, Homo sapiens
gcttgtggattgagggtaggagg

SEQ ID NO: 3874249 - DNA, 13 bp, Homo sapiens
gcttgttaatgct

SEQ ID NO: 3874250 - DNA, 21 bp, Homo sapiens
gcttgttaatgctttctgaag

SEQ ID NO: 3874251 - DNA, 23 bp, Homo sapiens
gcttgttaatgctttctgaagct

SEQ ID NO: 3874252 - DNA, 16 bp, Homo sapiens
gctttaaacacccttc

SEQ ID NO: 3874253 - DNA, 18 bp, Homo sapiens
gctttaaactaccctcca

SEQ ID NO: 3874254 - DNA, 22 bp, Homo sapiens
gctttaaactaccctccagagt

SEQ ID NO: 3874255 - DNA, 16 bp, Homo sapiens
gctttaaagtgtaata

SEQ ID NO: 3874256 - DNA, 19 bp, Homo sapiens
gctttaacaaaacaagaaa

SEQ ID NO: 3874257 - DNA, 13 bp, Homo sapiens
gctttatttatgg

SEQ ID NO: 3874258 - DNA, 15 bp, Homo sapiens
gctttcagagccagt

SEQ ID NO: 3874259 - DNA, 21 bp, Homo sapiens
gctttccccgggggaggaagg

SEQ ID NO: 3874260 - DNA, 12 bp, Homo sapiens
gctttctccttt

SEQ ID NO: 3874261 - DNA, 22 bp, Homo sapiens
gctttctggaaaagaggagttt

SEQ ID NO: 3874262 - DNA, 20 bp, Homo sapiens
gctttcttctacaaccagag

SEQ ID NO: 3874263 - DNA, 18 bp, Homo sapiens
gctttgaatacccccaga

SEQ ID NO: 3874264 - DNA, 23 bp, Homo sapiens
gctttgaatacccccagagacct

SEQ ID NO: 3874265 - DNA, 14 bp, Homo sapiens
gctttgactcacct

SEQ ID NO: 3874266 - DNA, 20 bp, Homo sapiens
gctttgactcacctgttact

SEQ ID NO: 3874267 - DNA, 18 bp, Homo sapiens
gctttgaggacaaagaga

SEQ ID NO: 3874268 - DNA, 22 bp, Homo sapiens
gctttgcattcctacaaagatg

SEQ ID NO: 3874269 - DNA, 20 bp, Homo sapiens
gctttgccatgggcctgctg

SEQ ID NO: 3874270 - DNA, 17 bp, Homo sapiens
gctttgcttttcctgga

SEQ ID NO: 3874271 - DNA, 19 bp, Homo sapiens
gctttgggaggccaaggca

SEQ ID NO: 3874272 - DNA, 18 bp, Homo sapiens
gctttgtctctagccggg

SEQ ID NO: 3874273 - DNA, 13 bp, Homo sapiens
gcttttaataaaa

SEQ ID NO: 3874274 - DNA, 18 bp, Homo sapiens
gcttttcaaacaagaatg

SEQ ID NO: 3874275 - DNA, 18 bp, Homo sapiens
gcttttcactgctggctg

SEQ ID NO: 3874276 - DNA, 15 bp, Homo sapiens
gcttttccaggatcc

SEQ ID NO: 3874277 - DNA, 20 bp, Homo sapiens
gcttttcgcttgcttctgca

SEQ ID NO: 3874278 - DNA, 19 bp, Homo sapiens
gcttttgaggctatttcta

SEQ ID NO: 3874279 - DNA, 22 bp, Homo sapiens
gcttttgccactttggcttctc

SEQ ID NO: 3874280 - DNA, 14 bp, Homo sapiens
gcttttgcttggca

SEQ ID NO: 3874281 - DNA, 21 bp, Homo sapiens
gcttttggtggtccccacagc

SEQ ID NO: 3874282 - DNA, 18 bp, Homo sapiens
gcttttttttgagaatac

SEQ ID NO: 3874283 - DNA, 16 bp, Homo sapiens
ggaaaaaaaataatgt

SEQ ID NO: 3874284 - DNA, 14 bp, Homo sapiens
ggaaaaaaatgact

SEQ ID NO: 3874285 - DNA, 21 bp, Homo sapiens
ggaaaaacatctgaaagccac

SEQ ID NO: 3874286 - DNA, 15 bp, Homo sapiens
ggaaaacagaggaat

SEQ ID NO: 3874287 - DNA, 21 bp, Homo sapiens
ggaaaaccaagccgtggcttc

SEQ ID NO: 3874288 - DNA, 16 bp, Homo sapiens
ggaaaaccagggatag

SEQ ID NO: 3874289 - DNA, 23 bp, Homo sapiens
ggaaaagaatccctgcagcctgg

SEQ ID NO: 3874290 - DNA, 13 bp, Homo sapiens
ggaaaagcccagt

SEQ ID NO: 3874291 - DNA, 21 bp, Homo sapiens
ggaaaagcccagtgacctgac

SEQ ID NO: 3874292 - DNA, 14 bp, Homo sapiens
ggaaaaggcctggg

SEQ ID NO: 3874293 - DNA, 22 bp, Homo sapiens
ggaaaaggcctggggtgacccg

SEQ ID NO: 3874294 - DNA, 16 bp, Homo sapiens
ggaaaatgtcctgtgg

SEQ ID NO: 3874295 - DNA, 16 bp, Homo sapiens
ggaaacccaaggaaca

SEQ ID NO: 3874296 - DNA, 13 bp, Homo sapiens
ggaaaccttgcag

SEQ ID NO: 3874297 - DNA, 15 bp, Homo sapiens
ggaaaccttgcagca

SEQ ID NO: 3874298 - DNA, 16 bp, Homo sapiens
ggaaaccttgcagcat

SEQ ID NO: 3874299 - DNA, 22 bp, Homo sapiens
ggaaagaaagcacctgttttta

SEQ ID NO: 3874300 - DNA, 16 bp, Homo sapiens
ggaaagaatataaagt

SEQ ID NO: 3874301 - DNA, 15 bp, Homo sapiens
ggaaagcagtgtgtc

SEQ ID NO: 3874302 - DNA, 21 bp, Homo sapiens
ggaaaggaaaaccagggatag

SEQ ID NO: 3874303 - DNA, 15 bp, Homo sapiens
ggaaaggacccaccc

SEQ ID NO: 3874304 - DNA, 19 bp, Homo sapiens
ggaaaggacccacccatct

SEQ ID NO: 3874305 - DNA, 15 bp, Homo sapiens
ggaaaggctctgaaa

SEQ ID NO: 3874306 - DNA, 15 bp, Homo sapiens
ggaaaggggcgagca

SEQ ID NO: 3874307 - DNA, 16 bp, Homo sapiens
ggaaagttcagccaga

SEQ ID NO: 3874308 - DNA, 16 bp, Homo sapiens
ggaaataaaacctttc

SEQ ID NO: 3874309 - DNA, 20 bp, Homo sapiens
ggaaataaaacctttcaaat

SEQ ID NO: 3874310 - DNA, 22 bp, Homo sapiens
ggaaataaaacctttcaaattt

SEQ ID NO: 3874311 - DNA, 23 bp, Homo sapiens
ggaaataaacctggagatgatga

SEQ ID NO: 3874312 - DNA, 22 bp, Homo sapiens
ggaaatatcagttactcagccc

SEQ ID NO: 3874313 - DNA, 15 bp, Homo sapiens
ggaaatggagggtgg

SEQ ID NO: 3874314 - DNA, 16 bp, Homo sapiens
ggaaatggagggtggg

SEQ ID NO: 3874315 - DNA, 17 bp, Homo sapiens
ggaaatggagggtgggg

SEQ ID NO: 3874316 - DNA, 19 bp, Homo sapiens
ggaaatggtatgagctgag

SEQ ID NO: 3874317 - DNA, 23 bp, Homo sapiens
ggaaattcaggtgaaaatgttca

SEQ ID NO: 3874318 - DNA, 18 bp, Homo sapiens
ggaaattgctattttatt

SEQ ID NO: 3874319 - DNA, 17 bp, Homo sapiens
ggaacagacaggagaaa

SEQ ID NO: 3874320 - DNA, 21 bp, Homo sapiens
ggaacagagactctggaagcc

SEQ ID NO: 3874321 - DNA, 23 bp, Homo sapiens
ggaacagagcgggcctcttccct

SEQ ID NO: 3874322 - DNA, 21 bp, Homo sapiens
ggaacagctcttcactcagcc

SEQ ID NO: 3874323 - DNA, 20 bp, Homo sapiens
ggaaccaccgaagaggaagc

SEQ ID NO: 3874324 - DNA, 14 bp, Homo sapiens
ggaacccagccctg

SEQ ID NO: 3874325 - DNA, 23 bp, Homo sapiens
ggaaccctgcccactcccaggac

SEQ ID NO: 3874326 - DNA, 15 bp, Homo sapiens
ggaacctcaaactgg

SEQ ID NO: 3874327 - DNA, 19 bp, Homo sapiens
ggaacctgaggcctgaagg

SEQ ID NO: 3874328 - DNA, 16 bp, Homo sapiens
ggaaccttccctccaa

SEQ ID NO: 3874329 - DNA, 13 bp, Homo sapiens
ggaacgagcactg

SEQ ID NO: 3874330 - DNA, 16 bp, Homo sapiens
ggaacgagcactggcc

SEQ ID NO: 3874331 - DNA, 19 bp, Homo sapiens
ggaacgagcactggccaga

SEQ ID NO: 3874332 - DNA, 16 bp, Homo sapiens
ggaacgtgactgcccc

SEQ ID NO: 3874333 - DNA, 21 bp, Homo sapiens
ggaactagagggatacactga

SEQ ID NO: 3874334 - DNA, 13 bp, Homo sapiens
ggaactccactct

SEQ ID NO: 3874335 - DNA, 13 bp, Homo sapiens
ggaactctgacaa

SEQ ID NO: 3874336 - DNA, 20 bp, Homo sapiens
ggaactctggcttccaggta

SEQ ID NO: 3874337 - DNA, 19 bp, Homo sapiens
ggaactgaagacctccaca

SEQ ID NO: 3874338 - DNA, 20 bp, Homo sapiens
ggaactgaagggggcggcct

SEQ ID NO: 3874339 - DNA, 20 bp, Homo sapiens
ggaactgaccccctcccctg

SEQ ID NO: 3874340 - DNA, 23 bp, Homo sapiens
ggaactgcatatcggaggtggtg

SEQ ID NO: 3874341 - DNA, 16 bp, Homo sapiens
ggaactggccaagctg

SEQ ID NO: 3874342 - DNA, 17 bp, Homo sapiens
ggaactggccaagctga

SEQ ID NO: 3874343 - DNA, 22 bp, Homo sapiens
ggaactggccaagctgaggtgc

SEQ ID NO: 3874344 - DNA, 14 bp, Homo sapiens
ggaactgtggcttt

SEQ ID NO: 3874345 - DNA, 15 bp, Homo sapiens
ggaacttctaatata

SEQ ID NO: 3874346 - DNA, 16 bp, Homo sapiens
ggaagaaaactatcct

SEQ ID NO: 3874347 - DNA, 18 bp, Homo sapiens
ggaagaaacactcttatt

SEQ ID NO: 3874348 - DNA, 18 bp, Homo sapiens
ggaagaaaccccaagcag

SEQ ID NO: 3874349 - DNA, 19 bp, Homo sapiens
ggaagaaaccccaagcagc

SEQ ID NO: 3874350 - DNA, 18 bp, Homo sapiens
gctggttggagagctaga

SEQ ID NO: 3874351 - DNA, 21 bp, Homo sapiens
gctgtaaactataaactactg

SEQ ID NO: 3874352 - DNA, 15 bp, Homo sapiens
gctgtaaataaatgc

SEQ ID NO: 3874353 - DNA, 17 bp, Homo sapiens
gctgtaaatacatgtgt

SEQ ID NO: 3874354 - DNA, 18 bp, Homo sapiens
gctgtaactcagacattc

SEQ ID NO: 3874355 - DNA, 15 bp, Homo sapiens
gctgtaactgctgag

SEQ ID NO: 3874356 - DNA, 16 bp, Homo sapiens
gctgtaactgctgagc

SEQ ID NO: 3874357 - DNA, 22 bp, Homo sapiens
gctgtaactgctgagccactcg

SEQ ID NO: 3874358 - DNA, 22 bp, Homo sapiens
gctgtaagcattctgagctggg

SEQ ID NO: 3874359 - DNA, 15 bp, Homo sapiens
gctgtacccttccac

SEQ ID NO: 3874360 - DNA, 18 bp, Homo sapiens
gctgtacccttccacctc

SEQ ID NO: 3874361 - DNA, 19 bp, Homo sapiens
gctgtactcagagcagagc

SEQ ID NO: 3874362 - DNA, 13 bp, Homo sapiens
gctgtagccatgg

SEQ ID NO: 3874363 - DNA, 15 bp, Homo sapiens
gctgtagccatggct

SEQ ID NO: 3874364 - DNA, 17 bp, Homo sapiens
gctgtagccatggctca

SEQ ID NO: 3874365 - DNA, 21 bp, Homo sapiens
gctgtagccatggctcaggca

SEQ ID NO: 3874366 - DNA, 20 bp, Homo sapiens
gctgtagtagccctttctgt

SEQ ID NO: 3874367 - DNA, 17 bp, Homo sapiens
gctgtatatatatatgt

SEQ ID NO: 3874368 - DNA, 18 bp, Homo sapiens
gctgtatatatatatgtg

SEQ ID NO: 3874369 - DNA, 13 bp, Homo sapiens
gctgtatctgtaa

SEQ ID NO: 3874370 - DNA, 20 bp, Homo sapiens
gctgtcatggaaaagcccag

SEQ ID NO: 3874371 - DNA, 12 bp, Homo sapiens
gctgtcccctct

SEQ ID NO: 3874372 - DNA, 14 bp, Homo sapiens
gctgtcccctctcc

SEQ ID NO: 3874373 - DNA, 18 bp, Homo sapiens
gctgtcccctctccctgg

SEQ ID NO: 3874374 - DNA, 15 bp, Homo sapiens
gctgtcccctctgtc

SEQ ID NO: 3874375 - DNA, 16 bp, Homo sapiens
gctgtcccctctgtca

SEQ ID NO: 3874376 - DNA, 14 bp, Homo sapiens
gctgtccctgtcac

SEQ ID NO: 3874377 - DNA, 18 bp, Homo sapiens
gctgtccctgtcaccaag

SEQ ID NO: 3874378 - DNA, 19 bp, Homo sapiens
gctgtcctctcgagcccag

SEQ ID NO: 3874379 - DNA, 15 bp, Homo sapiens
gctgtcctctgaagg

SEQ ID NO: 3874380 - DNA, 19 bp, Homo sapiens
gctgtctccataatgccac

SEQ ID NO: 3874381 - DNA, 19 bp, Homo sapiens
gctgtgaaaatgaggagga

SEQ ID NO: 3874382 - DNA, 13 bp, Homo sapiens
gctgtgaactcag

SEQ ID NO: 3874383 - DNA, 20 bp, Homo sapiens
gctgtgaactcagagcccct

SEQ ID NO: 3874384 - DNA, 16 bp, Homo sapiens
gctgtgacctgctgag

SEQ ID NO: 3874385 - DNA, 20 bp, Homo sapiens
gctgtgacctgctgagctct

SEQ ID NO: 3874386 - DNA, 15 bp, Homo sapiens
gctgtgagcccctgg

SEQ ID NO: 3874387 - DNA, 21 bp, Homo sapiens
gctgtgcaccttacattccta

SEQ ID NO: 3874388 - DNA, 12 bp, Homo sapiens
gctgtgcctctg

SEQ ID NO: 3874389 - DNA, 16 bp, Homo sapiens
gctgtgcctgctagag

SEQ ID NO: 3874390 - DNA, 18 bp, Homo sapiens
gctgtgcctgctagagca

SEQ ID NO: 3874391 - DNA, 12 bp, Homo sapiens
gctgtggcacag

SEQ ID NO: 3874392 - DNA, 13 bp, Homo sapiens
gctgtggcacaga

SEQ ID NO: 3874393 - DNA, 16 bp, Homo sapiens
gctgtggccagggtga

SEQ ID NO: 3874394 - DNA, 19 bp, Homo sapiens
gctgtggccagggtgagag

SEQ ID NO: 3874395 - DNA, 21 bp, Homo sapiens
gctgtggccagggtgagagct

SEQ ID NO: 3874396 - DNA, 13 bp, Homo sapiens
gctgtggcctcac

SEQ ID NO: 3874397 - DNA, 21 bp, Homo sapiens
gctgtggcctcacttccctgg

SEQ ID NO: 3874398 - DNA, 13 bp, Homo sapiens
gctgtgggcagca

SEQ ID NO: 3874399 - DNA, 19 bp, Homo sapiens
gctgtgtccttgcacctgc

SEQ ID NO: 3874400 - DNA, 20 bp, Homo sapiens
gctgtgtccttgcacctgca

SEQ ID NO: 3874401 - DNA, 20 bp, Homo sapiens
gctgtgtgacagaatcttgt

SEQ ID NO: 3874402 - DNA, 22 bp, Homo sapiens
gctgtgtgacagaatcttgtat

SEQ ID NO: 3874403 - DNA, 20 bp, Homo sapiens
gctgtgtttatgcccccaat

SEQ ID NO: 3874404 - DNA, 18 bp, Homo sapiens
gctgttccacttctctag

SEQ ID NO: 3874405 - DNA, 16 bp, Homo sapiens
gctgttctgcactgaa

SEQ ID NO: 3874406 - DNA, 13 bp, Homo sapiens
gctgttgcctcat

SEQ ID NO: 3874407 - DNA, 18 bp, Homo sapiens
gctgttggacagctgctt

SEQ ID NO: 3874408 - DNA, 21 bp, Homo sapiens
gctgttggacagctgcttgtg

SEQ ID NO: 3874409 - DNA, 16 bp, Homo sapiens
gctgttggcctcgcct

SEQ ID NO: 3874410 - DNA, 18 bp, Homo sapiens
gctgttggcctcgcctgg

SEQ ID NO: 3874411 - DNA, 19 bp, Homo sapiens
gctgttggcctcgcctggg

SEQ ID NO: 3874412 - DNA, 17 bp, Homo sapiens
gctgtttatttattcac

SEQ ID NO: 3874413 - DNA, 13 bp, Homo sapiens
gctgtttgagatg

SEQ ID NO: 3874414 - DNA, 20 bp, Homo sapiens
gctgtttgagatgtgatgct

SEQ ID NO: 3874415 - DNA, 18 bp, Homo sapiens
gcttaaataaattcaaac

SEQ ID NO: 3874416 - DNA, 22 bp, Homo sapiens
gcttaaattgcttttgttgtga

SEQ ID NO: 3874417 - DNA, 14 bp, Homo sapiens
gcttaactggctgt

SEQ ID NO: 3874418 - DNA, 17 bp, Homo sapiens
gcttaatgtttattcct

SEQ ID NO: 3874419 - DNA, 11 bp, Homo sapiens
gcttacatttt

SEQ ID NO: 3874420 - DNA, 16 bp, Homo sapiens
gcttagagaatgttct

SEQ ID NO: 3874421 - DNA, 20 bp, Homo sapiens
gcttagatgagggtgactgt

SEQ ID NO: 3874422 - DNA, 22 bp, Homo sapiens
gcttagcctcctgacctgaggc

SEQ ID NO: 3874423 - DNA, 17 bp, Homo sapiens
gcttagccttgtgccct

SEQ ID NO: 3874424 - DNA, 17 bp, Homo sapiens
gcttaggtgccaggctg

SEQ ID NO: 3874425 - DNA, 18 bp, Homo sapiens
gcttaggtgccaggctgt

SEQ ID NO: 3874426 - DNA, 15 bp, Homo sapiens
gcttataaatgtgta

SEQ ID NO: 3874427 - DNA, 22 bp, Homo sapiens
gcttatgacatcacttgtacaa

SEQ ID NO: 3874428 - DNA, 14 bp, Homo sapiens
gcttatttccctca

SEQ ID NO: 3874429 - DNA, 12 bp, Homo sapiens
gcttcaagtgat

SEQ ID NO: 3874430 - DNA, 22 bp, Homo sapiens
gcttcaagtgatatatgtattt

SEQ ID NO: 3874431 - DNA, 21 bp, Homo sapiens
gcttcaagtgttgctcttgga

SEQ ID NO: 3874432 - DNA, 15 bp, Homo sapiens
gcttcagagcctagc

SEQ ID NO: 3874433 - DNA, 18 bp, Homo sapiens
gcttcagagcctagccac

SEQ ID NO: 3874434 - DNA, 23 bp, Homo sapiens
gcttcagagcctagccacctccc

SEQ ID NO: 3874435 - DNA, 17 bp, Homo sapiens
gcttcagcatatttata

SEQ ID NO: 3874436 - DNA, 21 bp, Homo sapiens
gctgcgtcagaccagtactgg

SEQ ID NO: 3874437 - DNA, 12 bp, Homo sapiens
gctgctcctcca

SEQ ID NO: 3874438 - DNA, 15 bp, Homo sapiens
gctgctcctccaggg

SEQ ID NO: 3874439 - DNA, 18 bp, Homo sapiens
gctgctcctccagggcca

SEQ ID NO: 3874440 - DNA, 18 bp, Homo sapiens
gctgctcggggtgcacag

SEQ ID NO: 3874441 - DNA, 22 bp, Homo sapiens
gctgctcggggtgcacaggagg

SEQ ID NO: 3874442 - DNA, 16 bp, Homo sapiens
gctgctctagctggca

SEQ ID NO: 3874443 - DNA, 17 bp, Homo sapiens
gctgctctagctggcag

SEQ ID NO: 3874444 - DNA, 17 bp, Homo sapiens
gctgctctcatgcctgc

SEQ ID NO: 3874445 - DNA, 13 bp, Homo sapiens
gctgctctgcccc

SEQ ID NO: 3874446 - DNA, 21 bp, Homo sapiens
gctgctctgctatatgcctta

SEQ ID NO: 3874447 - DNA, 19 bp, Homo sapiens
gctgctgaagttctgagcc

SEQ ID NO: 3874448 - DNA, 16 bp, Homo sapiens
gctgctgactgatgtt

SEQ ID NO: 3874449 - DNA, 15 bp, Homo sapiens
gctgctgagaacctg

SEQ ID NO: 3874450 - DNA, 12 bp, Homo sapiens
gctgctgctctg

SEQ ID NO: 3874451 - DNA, 15 bp, Homo sapiens
gctgctggggcatgt

SEQ ID NO: 3874452 - DNA, 17 bp, Homo sapiens
gctgctggggcatgtgt

SEQ ID NO: 3874453 - DNA, 18 bp, Homo sapiens
gctgctttttggcacagt

SEQ ID NO: 3874454 - DNA, 11 bp, Homo sapiens
gctggaaataa

SEQ ID NO: 3874455 - DNA, 15 bp, Homo sapiens
gctggaaggcagggc

SEQ ID NO: 3874456 - DNA, 16 bp, Homo sapiens
gctggaaggcagggca

SEQ ID NO: 3874457 - DNA, 17 bp, Homo sapiens
gctggaaggcagggcag

SEQ ID NO: 3874458 - DNA, 18 bp, Homo sapiens
gctggaaggcagggcaga

SEQ ID NO: 3874459 - DNA, 22 bp, Homo sapiens
gctggaatcaatttcccagaag

SEQ ID NO: 3874460 - DNA, 21 bp, Homo sapiens
gctggaatctggagagctaga

SEQ ID NO: 3874461 - DNA, 22 bp, Homo sapiens
gctggaattctaaatgctggtc

SEQ ID NO: 3874462 - DNA, 13 bp, Homo sapiens
gctggacaaccca

SEQ ID NO: 3874463 - DNA, 19 bp, Homo sapiens
gctggacaagaagctgcta

SEQ ID NO: 3874464 - DNA, 17 bp, Homo sapiens
gctggacagaggggcag

SEQ ID NO: 3874465 - DNA, 13 bp, Homo sapiens
gctggactgagga

SEQ ID NO: 3874466 - DNA, 14 bp, Homo sapiens
gctggactgaggac

SEQ ID NO: 3874467 - DNA, 16 bp, Homo sapiens
gctggagaagctcacc

SEQ ID NO: 3874468 - DNA, 20 bp, Homo sapiens
gctggagatcctaactgaga

SEQ ID NO: 3874469 - DNA, 21 bp, Homo sapiens
gctggagatcctaactgagaa

SEQ ID NO: 3874470 - DNA, 14 bp, Homo sapiens
gctggagctcttgg

SEQ ID NO: 3874471 - DNA, 15 bp, Homo sapiens
gctggagctcttgga

SEQ ID NO: 3874472 - DNA, 13 bp, Homo sapiens
gctggagctggct

SEQ ID NO: 3874473 - DNA, 15 bp, Homo sapiens
gctggaggcagggcc

SEQ ID NO: 3874474 - DNA, 20 bp, Homo sapiens
gctggagttcagtggtgtga

SEQ ID NO: 3874475 - DNA, 20 bp, Homo sapiens
gctggatgagacttccaaac

SEQ ID NO: 3874476 - DNA, 18 bp, Homo sapiens
gctggattaatgttttgt

SEQ ID NO: 3874477 - DNA, 18 bp, Homo sapiens
gctggcagagcccccaag

SEQ ID NO: 3874478 - DNA, 15 bp, Homo sapiens
gctggcagctgagag

SEQ ID NO: 3874479 - DNA, 20 bp, Homo sapiens
gctggcagctgagagccctg

SEQ ID NO: 3874480 - DNA, 13 bp, Homo sapiens
gctggccagcacc

SEQ ID NO: 3874481 - DNA, 14 bp, Homo sapiens
gctggccagcaccc

SEQ ID NO: 3874482 - DNA, 17 bp, Homo sapiens
gctggccagcaccctct

SEQ ID NO: 3874483 - DNA, 18 bp, Homo sapiens
gctggccagcaccctctc

SEQ ID NO: 3874484 - DNA, 23 bp, Homo sapiens
gctggccagcaccctctcctggg

SEQ ID NO: 3874485 - DNA, 12 bp, Homo sapiens
gctggcccagcc

SEQ ID NO: 3874486 - DNA, 23 bp, Homo sapiens
gctggcctcccaataaagctgga

SEQ ID NO: 3874487 - DNA, 13 bp, Homo sapiens
gctggcctctaga

SEQ ID NO: 3874488 - DNA, 22 bp, Homo sapiens
gctggcctctagaacacccact

SEQ ID NO: 3874489 - DNA, 20 bp, Homo sapiens
gctggcctgatcttggctca

SEQ ID NO: 3874490 - DNA, 16 bp, Homo sapiens
gctggcggcgcagagg

SEQ ID NO: 3874491 - DNA, 20 bp, Homo sapiens
gctggcggctactcagcagc

SEQ ID NO: 3874492 - DNA, 12 bp, Homo sapiens
gctggctcagga

SEQ ID NO: 3874493 - DNA, 14 bp, Homo sapiens
gctggctcaggaag

SEQ ID NO: 3874494 - DNA, 20 bp, Homo sapiens
gctggctcaggaagaaaccc

SEQ ID NO: 3874495 - DNA, 15 bp, Homo sapiens
gctggctgagggcag

SEQ ID NO: 3874496 - DNA, 16 bp, Homo sapiens
gctggctgagggcagt

SEQ ID NO: 3874497 - DNA, 21 bp, Homo sapiens
gctggcttctgttgcgccact

SEQ ID NO: 3874498 - DNA, 18 bp, Homo sapiens
gctgggaaacagggagcc

SEQ ID NO: 3874499 - DNA, 18 bp, Homo sapiens
gctgggaaccccgcagcc

SEQ ID NO: 3874500 - DNA, 19 bp, Homo sapiens
gctgggaaccccgcagccc

SEQ ID NO: 3874501 - DNA, 20 bp, Homo sapiens
gctgggatttcttcgctgct

SEQ ID NO: 3874502 - DNA, 23 bp, Homo sapiens
gctgggatttcttcgctgctcta

SEQ ID NO: 3874503 - DNA, 24 bp, Homo sapiens
gctgggatttcttcgctgctctag

SEQ ID NO: 3874504 - DNA, 23 bp, Homo sapiens
gctgggccagcctcagctcagcc

SEQ ID NO: 3874505 - DNA, 19 bp, Homo sapiens
gctgggccccatgctctgc

SEQ ID NO: 3874506 - DNA, 14 bp, Homo sapiens
gctgggcccctggg

SEQ ID NO: 3874507 - DNA, 18 bp, Homo sapiens
gctgggcccctgggatgg

SEQ ID NO: 3874508 - DNA, 23 bp, Homo sapiens
gctgggcccctgggatgggacca

SEQ ID NO: 3874509 - DNA, 13 bp, Homo sapiens
gctgggctctcca

SEQ ID NO: 3874510 - DNA, 20 bp, Homo sapiens
gctgggctctccacctcagc

SEQ ID NO: 3874511 - DNA, 13 bp, Homo sapiens
gctggggaacaga

SEQ ID NO: 3874512 - DNA, 15 bp, Homo sapiens
gctggggaacagagc

SEQ ID NO: 3874513 - DNA, 23 bp, Homo sapiens
gctggggaacagagcgggcctct

SEQ ID NO: 3874514 - DNA, 13 bp, Homo sapiens
gctggggcagagg

SEQ ID NO: 3874515 - DNA, 15 bp, Homo sapiens
gctggggcctggaga

SEQ ID NO: 3874516 - DNA, 20 bp, Homo sapiens
gctgggggcgggggagccaa

SEQ ID NO: 3874517 - DNA, 14 bp, Homo sapiens
gctgggggtggggg

SEQ ID NO: 3874518 - DNA, 17 bp, Homo sapiens
gctgggtgccgggctgc

SEQ ID NO: 3874519 - DNA, 20 bp, Homo sapiens
gctggtcgtgaactcctgag

SEQ ID NO: 3874520 - DNA, 21 bp, Homo sapiens
gctggtcgtgaactcctgagc

SEQ ID NO: 3874521 - DNA, 15 bp, Homo sapiens
gctggtgctgcaagg

SEQ ID NO: 3874522 - DNA, 22 bp, Homo sapiens
gctgaagacaaaccactgtaca

SEQ ID NO: 3874523 - DNA, 17 bp, Homo sapiens
gctgaagcctatttatt

SEQ ID NO: 3874524 - DNA, 16 bp, Homo sapiens
gctgaatagcttctcc

SEQ ID NO: 3874525 - DNA, 19 bp, Homo sapiens
gctgacacataatttgaat

SEQ ID NO: 3874526 - DNA, 14 bp, Homo sapiens
gctgacacctacca

SEQ ID NO: 3874527 - DNA, 19 bp, Homo sapiens
gctgacacctaccatgctg

SEQ ID NO: 3874528 - DNA, 21 bp, Homo sapiens
gctgacagatacatagatgga

SEQ ID NO: 3874529 - DNA, 20 bp, Homo sapiens
gctgaccaagagagaaagaa

SEQ ID NO: 3874530 - DNA, 13 bp, Homo sapiens
gctgacccagtcc

SEQ ID NO: 3874531 - DNA, 16 bp, Homo sapiens
gctgacccagtccctg

SEQ ID NO: 3874532 - DNA, 16 bp, Homo sapiens
gctgacctgcctctca

SEQ ID NO: 3874533 - DNA, 16 bp, Homo sapiens
gctgacctgtttttgt

SEQ ID NO: 3874534 - DNA, 18 bp, Homo sapiens
gctgactgatgttgaggg

SEQ ID NO: 3874535 - DNA, 21 bp, Homo sapiens
gctgagaacctggccttcagt

SEQ ID NO: 3874536 - DNA, 20 bp, Homo sapiens
gctgagaagaagctgaggat

SEQ ID NO: 3874537 - DNA, 21 bp, Homo sapiens
gctgagaagaagctgaggatc

SEQ ID NO: 3874538 - DNA, 23 bp, Homo sapiens
gctgagaagaagctgaggatcct

SEQ ID NO: 3874539 - DNA, 14 bp, Homo sapiens
gctgagagacccaa

SEQ ID NO: 3874540 - DNA, 15 bp, Homo sapiens
gctgagaggaagatg

SEQ ID NO: 3874541 - DNA, 16 bp, Homo sapiens
gctgagaggaagatga

SEQ ID NO: 3874542 - DNA, 22 bp, Homo sapiens
gctgagaggcagacttccctga

SEQ ID NO: 3874543 - DNA, 13 bp, Homo sapiens
gctgagcagggcc

SEQ ID NO: 3874544 - DNA, 16 bp, Homo sapiens
gctgagcagggccggg

SEQ ID NO: 3874545 - DNA, 16 bp, Homo sapiens
gctgagccactcgcag

SEQ ID NO: 3874546 - DNA, 14 bp, Homo sapiens
gctgagctctgaga

SEQ ID NO: 3874547 - DNA, 18 bp, Homo sapiens
gctgagctctgagaggcc

SEQ ID NO: 3874548 - DNA, 19 bp, Homo sapiens
gctgagctctgagaggccc

SEQ ID NO: 3874549 - DNA, 11 bp, Homo sapiens
gctgagctgga

SEQ ID NO: 3874550 - DNA, 16 bp, Homo sapiens
gctgagcttagccttg

SEQ ID NO: 3874551 - DNA, 18 bp, Homo sapiens
gctgaggatcctcacagg

SEQ ID NO: 3874552 - DNA, 19 bp, Homo sapiens
gctgaggatttcaagcctg

SEQ ID NO: 3874553 - DNA, 13 bp, Homo sapiens
gctgaggcagaag

SEQ ID NO: 3874554 - DNA, 15 bp, Homo sapiens
gctgaggcagaagaa

SEQ ID NO: 3874555 - DNA, 12 bp, Homo sapiens
gctgagggcagt

SEQ ID NO: 3874556 - DNA, 22 bp, Homo sapiens
gctgagggcagttcgcagccac

SEQ ID NO: 3874557 - DNA, 21 bp, Homo sapiens
gctgaggggggccgtgcccag

SEQ ID NO: 3874558 - DNA, 18 bp, Homo sapiens
gctgaggtgcccaggaga

SEQ ID NO: 3874559 - DNA, 20 bp, Homo sapiens
gctgaggtgcccaggagaag

SEQ ID NO: 3874560 - DNA, 21 bp, Homo sapiens
gctgaggtgtcttaagccttt

SEQ ID NO: 3874561 - DNA, 15 bp, Homo sapiens
gctgagtcacctcct

SEQ ID NO: 3874562 - DNA, 17 bp, Homo sapiens
gctgagtcacctcctcc

SEQ ID NO: 3874563 - DNA, 22 bp, Homo sapiens
gctgagtcacctcctccactca

SEQ ID NO: 3874564 - DNA, 18 bp, Homo sapiens
gctgagtggaatgcaggg

SEQ ID NO: 3874565 - DNA, 23 bp, Homo sapiens
gctgatgaaactcctgattttgt

SEQ ID NO: 3874566 - DNA, 22 bp, Homo sapiens
gctgatgatgtctcttgtagaa

SEQ ID NO: 3874567 - DNA, 16 bp, Homo sapiens
gctgatggagaaggaa

SEQ ID NO: 3874568 - DNA, 16 bp, Homo sapiens
gctgattcaagaaaca

SEQ ID NO: 3874569 - DNA, 17 bp, Homo sapiens
gctgatttccaggcccc

SEQ ID NO: 3874570 - DNA, 21 bp, Homo sapiens
gctgatttccaggcccctgag

SEQ ID NO: 3874571 - DNA, 23 bp, Homo sapiens
gctgatttccaggcccctgagga

SEQ ID NO: 3874572 - DNA, 13 bp, Homo sapiens
gctgcaaagtgca

SEQ ID NO: 3874573 - DNA, 17 bp, Homo sapiens
gctgcaaggaagggtgg

SEQ ID NO: 3874574 - DNA, 20 bp, Homo sapiens
gctgcaccacggcgtttttt

SEQ ID NO: 3874575 - DNA, 15 bp, Homo sapiens
gctgcaccagagtga

SEQ ID NO: 3874576 - DNA, 16 bp, Homo sapiens
gctgcaccagagtgaa

SEQ ID NO: 3874577 - DNA, 14 bp, Homo sapiens
gctgcactgcagtg

SEQ ID NO: 3874578 - DNA, 15 bp, Homo sapiens
gctgcactgcagtga

SEQ ID NO: 3874579 - DNA, 13 bp, Homo sapiens
gctgcagctgggc

SEQ ID NO: 3874580 - DNA, 14 bp, Homo sapiens
gctgcatgcctggt

SEQ ID NO: 3874581 - DNA, 14 bp, Homo sapiens
gctgcatgctctgg

SEQ ID NO: 3874582 - DNA, 15 bp, Homo sapiens
gctgccacacttcag

SEQ ID NO: 3874583 - DNA, 22 bp, Homo sapiens
gctgccacacttcaggctcttc

SEQ ID NO: 3874584 - DNA, 21 bp, Homo sapiens
gctgccaccacgtctgccagg

SEQ ID NO: 3874585 - DNA, 15 bp, Homo sapiens
gctgccaggacacct

SEQ ID NO: 3874586 - DNA, 16 bp, Homo sapiens
gctgccaggacacctg

SEQ ID NO: 3874587 - DNA, 17 bp, Homo sapiens
gctgccaggacacctgc

SEQ ID NO: 3874588 - DNA, 19 bp, Homo sapiens
gctgccaggacacctgccc

SEQ ID NO: 3874589 - DNA, 21 bp, Homo sapiens
gctgccaggacacctgcccca

SEQ ID NO: 3874590 - DNA, 23 bp, Homo sapiens
gctgccaggacacctgccccagc

SEQ ID NO: 3874591 - DNA, 10 bp, Homo sapiens
gctgccaggc

SEQ ID NO: 3874592 - DNA, 20 bp, Homo sapiens
gctgccatgccactgccagg

SEQ ID NO: 3874593 - DNA, 23 bp, Homo sapiens
gctgccatgccactgccaggcac

SEQ ID NO: 3874594 - DNA, 15 bp, Homo sapiens
gctgcccccacctct

SEQ ID NO: 3874595 - DNA, 20 bp, Homo sapiens
gctgcccctggtgcactggc

SEQ ID NO: 3874596 - DNA, 14 bp, Homo sapiens
gctgccctggtgct

SEQ ID NO: 3874597 - DNA, 17 bp, Homo sapiens
gctgccctggtgctgcc

SEQ ID NO: 3874598 - DNA, 22 bp, Homo sapiens
gctgccctggtgctgccacact

SEQ ID NO: 3874599 - DNA, 23 bp, Homo sapiens
gctgcccttcgctgccaggacac

SEQ ID NO: 3874600 - DNA, 14 bp, Homo sapiens
gctgccgcacccca

SEQ ID NO: 3874601 - DNA, 17 bp, Homo sapiens
gctgccgctgccgctgc

SEQ ID NO: 3874602 - DNA, 12 bp, Homo sapiens
gctgcctgtagt

SEQ ID NO: 3874603 - DNA, 13 bp, Homo sapiens
gctgcctgtagtt

SEQ ID NO: 3874604 - DNA, 16 bp, Homo sapiens
gctgcctgtagttagg

SEQ ID NO: 3874605 - DNA, 14 bp, Homo sapiens
gctgccttgccatg

SEQ ID NO: 3874606 - DNA, 20 bp, Homo sapiens
gctgcggcctaggggtccac

SEQ ID NO: 3874607 - DNA, 17 bp, Homo sapiens
gctgcgggtctgaagga

SEQ ID NO: 3874608 - DNA, 20 bp, Homo sapiens
gctcaaatcatttaagaagg

SEQ ID NO: 3874609 - DNA, 18 bp, Homo sapiens
gctcaaatctattcagac

SEQ ID NO: 3874610 - DNA, 16 bp, Homo sapiens
gctcaacaataaaaca

SEQ ID NO: 3874611 - DNA, 13 bp, Homo sapiens
gctcaagaggccc

SEQ ID NO: 3874612 - DNA, 20 bp, Homo sapiens
gctcaagaggcccagggagc

SEQ ID NO: 3874613 - DNA, 23 bp, Homo sapiens
gctcaatgcattgtcttgtggag

SEQ ID NO: 3874614 - DNA, 15 bp, Homo sapiens
gctcacaagcccagg

SEQ ID NO: 3874615 - DNA, 19 bp, Homo sapiens
gctcacaaggcagcaaggc

SEQ ID NO: 3874616 - DNA, 21 bp, Homo sapiens
gctcacaaggcagcaaggccc

SEQ ID NO: 3874617 - DNA, 22 bp, Homo sapiens
gctcacaaggcagcaaggcccg

SEQ ID NO: 3874618 - DNA, 21 bp, Homo sapiens
gctcacacggggtattttagg

SEQ ID NO: 3874619 - DNA, 17 bp, Homo sapiens
gctcacagttcctcgcc

SEQ ID NO: 3874620 - DNA, 20 bp, Homo sapiens
gctcacccaataaacattaa

SEQ ID NO: 3874621 - DNA, 16 bp, Homo sapiens
gctcacgactcttcct

SEQ ID NO: 3874622 - DNA, 23 bp, Homo sapiens
gctcacgctcccccgcagtcccc

SEQ ID NO: 3874623 - DNA, 13 bp, Homo sapiens
gctcactcaggac

SEQ ID NO: 3874624 - DNA, 17 bp, Homo sapiens
gctcagaatagatctga

SEQ ID NO: 3874625 - DNA, 15 bp, Homo sapiens
gctcagcaggcccta

SEQ ID NO: 3874626 - DNA, 20 bp, Homo sapiens
gctcagccctgactggtgct

SEQ ID NO: 3874627 - DNA, 13 bp, Homo sapiens
gctcagcctcccc

SEQ ID NO: 3874628 - DNA, 19 bp, Homo sapiens
gctcagcctccccctgctg

SEQ ID NO: 3874629 - DNA, 20 bp, Homo sapiens
gctcagctactgatttttgt

SEQ ID NO: 3874630 - DNA, 19 bp, Homo sapiens
gctcaggaagaaaccccaa

SEQ ID NO: 3874631 - DNA, 22 bp, Homo sapiens
gctcaggaagaaaccccaagca

SEQ ID NO: 3874632 - DNA, 15 bp, Homo sapiens
gctcaggacccaggc

SEQ ID NO: 3874633 - DNA, 17 bp, Homo sapiens
gctcaggacccaggccc

SEQ ID NO: 3874634 - DNA, 19 bp, Homo sapiens
gctcaggacccaggccctc

SEQ ID NO: 3874635 - DNA, 21 bp, Homo sapiens
gctcaggacccaggccctcca

SEQ ID NO: 3874636 - DNA, 19 bp, Homo sapiens
gctcaggaggcgaataaat

SEQ ID NO: 3874637 - DNA, 12 bp, Homo sapiens
gctcaggcaagc

SEQ ID NO: 3874638 - DNA, 14 bp, Homo sapiens
gctcaggcaagccc

SEQ ID NO: 3874639 - DNA, 11 bp, Homo sapiens
gctcaggcaga

SEQ ID NO: 3874640 - DNA, 17 bp, Homo sapiens
gctcaggtgactggagc

SEQ ID NO: 3874641 - DNA, 18 bp, Homo sapiens
gctcaggtgactggagcc

SEQ ID NO: 3874642 - DNA, 19 bp, Homo sapiens
gctcaggtgactggagccc

SEQ ID NO: 3874643 - DNA, 22 bp, Homo sapiens
gctcaggtgactggagcccgag

SEQ ID NO: 3874644 - DNA, 16 bp, Homo sapiens
gctcagtgcctcctgg

SEQ ID NO: 3874645 - DNA, 17 bp, Homo sapiens
gctcagtgcctcctggc

SEQ ID NO: 3874646 - DNA, 18 bp, Homo sapiens
gctcataacatctttgaa

SEQ ID NO: 3874647 - DNA, 13 bp, Homo sapiens
gctcatcacccag

SEQ ID NO: 3874648 - DNA, 15 bp, Homo sapiens
gctcattttttctta

SEQ ID NO: 3874649 - DNA, 22 bp, Homo sapiens
gctccaacagcttgaccagacc

SEQ ID NO: 3874650 - DNA, 13 bp, Homo sapiens
gctccagcatcca

SEQ ID NO: 3874651 - DNA, 18 bp, Homo sapiens
gctccagcatccagcctg

SEQ ID NO: 3874652 - DNA, 16 bp, Homo sapiens
gctccagggcagcctc

SEQ ID NO: 3874653 - DNA, 23 bp, Homo sapiens
gctccagggcagcctccaccttg

SEQ ID NO: 3874654 - DNA, 16 bp, Homo sapiens
gctccaggtccggagg

SEQ ID NO: 3874655 - DNA, 13 bp, Homo sapiens
gctccatggagga

SEQ ID NO: 3874656 - DNA, 14 bp, Homo sapiens
gctccatggaggag

SEQ ID NO: 3874657 - DNA, 17 bp, Homo sapiens
gctccatggaggaggtg

SEQ ID NO: 3874658 - DNA, 12 bp, Homo sapiens
gctccatgggga

SEQ ID NO: 3874659 - DNA, 14 bp, Homo sapiens
gctccatggggaag

SEQ ID NO: 3874660 - DNA, 22 bp, Homo sapiens
gctccatggggaagtgctcccc

SEQ ID NO: 3874661 - DNA, 23 bp, Homo sapiens
gctccatggggaagtgctcccca

SEQ ID NO: 3874662 - DNA, 15 bp, Homo sapiens
gctcccacaggccct

SEQ ID NO: 3874663 - DNA, 22 bp, Homo sapiens
gctcccacaggcccttcctctc

SEQ ID NO: 3874664 - DNA, 17 bp, Homo sapiens
gctcccagatgctgggg

SEQ ID NO: 3874665 - DNA, 12 bp, Homo sapiens
gctcccagcagc

SEQ ID NO: 3874666 - DNA, 19 bp, Homo sapiens
gctcccatagcgctggctc

SEQ ID NO: 3874667 - DNA, 23 bp, Homo sapiens
gctcccatagcgctggctcagga

SEQ ID NO: 3874668 - DNA, 16 bp, Homo sapiens
gctccccactctgctc

SEQ ID NO: 3874669 - DNA, 15 bp, Homo sapiens
gctccccagccctgg

SEQ ID NO: 3874670 - DNA, 18 bp, Homo sapiens
gctccccagccctggctc

SEQ ID NO: 3874671 - DNA, 15 bp, Homo sapiens
gctcccccaccccct

SEQ ID NO: 3874672 - DNA, 21 bp, Homo sapiens
gctccccccagccccctaaga

SEQ ID NO: 3874673 - DNA, 19 bp, Homo sapiens
gctcccccgcagtccccag

SEQ ID NO: 3874674 - DNA, 16 bp, Homo sapiens
gctccctgtagctctg

SEQ ID NO: 3874675 - DNA, 17 bp, Homo sapiens
gctccctgtagctctgc

SEQ ID NO: 3874676 - DNA, 23 bp, Homo sapiens
gctccgtccaggagcctgtgcct

SEQ ID NO: 3874677 - DNA, 20 bp, Homo sapiens
gctcctaaacccccgctcca

SEQ ID NO: 3874678 - DNA, 21 bp, Homo sapiens
gctcctaaacccccgctccag

SEQ ID NO: 3874679 - DNA, 22 bp, Homo sapiens
gctcctaaacccccgctccaga

SEQ ID NO: 3874680 - DNA, 23 bp, Homo sapiens
gctcctaaacccccgctccagat

SEQ ID NO: 3874681 - DNA, 15 bp, Homo sapiens
gctcctaagcttcaa

SEQ ID NO: 3874682 - DNA, 14 bp, Homo sapiens
gctcctcacatagc

SEQ ID NO: 3874683 - DNA, 16 bp, Homo sapiens
gctcctcccctcttga

SEQ ID NO: 3874684 - DNA, 16 bp, Homo sapiens
gctcctcccggtgccc

SEQ ID NO: 3874685 - DNA, 13 bp, Homo sapiens
gctcctctccagg

SEQ ID NO: 3874686 - DNA, 15 bp, Homo sapiens
gctcctctccaggca

SEQ ID NO: 3874687 - DNA, 17 bp, Homo sapiens
gctcctctccagtctga

SEQ ID NO: 3874688 - DNA, 17 bp, Homo sapiens
gctcctctccttgggct

SEQ ID NO: 3874689 - DNA, 18 bp, Homo sapiens
gctcctctccttgggctc

SEQ ID NO: 3874690 - DNA, 19 bp, Homo sapiens
gctcctctccttgggctcc

SEQ ID NO: 3874691 - DNA, 13 bp, Homo sapiens
gctcctctgtctc

SEQ ID NO: 3874692 - DNA, 21 bp, Homo sapiens
gctcctggagggggcaagcct

SEQ ID NO: 3874693 - DNA, 12 bp, Homo sapiens
gctcctggctgc

SEQ ID NO: 3874694 - DNA, 21 bp, Homo sapiens
gccccaaggggtttctgtttc

SEQ ID NO: 3874695 - DNA, 20 bp, Homo sapiens
gccccacacggaggcatctg

SEQ ID NO: 3874696 - DNA, 13 bp, Homo sapiens
gccccaccaccta

SEQ ID NO: 3874697 - DNA, 15 bp, Homo sapiens
gccccacccagggct

SEQ ID NO: 3874698 - DNA, 17 bp, Homo sapiens
gccccacccccatgcag

SEQ ID NO: 3874699 - DNA, 21 bp, Homo sapiens
gccccaccctcaaaccctgtg

SEQ ID NO: 3874700 - DNA, 22 bp, Homo sapiens
gccccaccctcgtggacacctg

SEQ ID NO: 3874701 - DNA, 20 bp, Homo sapiens
gccccacctacttgtgactg

SEQ ID NO: 3874702 - DNA, 18 bp, Homo sapiens
gccccacctttaagtcct

SEQ ID NO: 3874703 - DNA, 15 bp, Homo sapiens
gccccagaaggcagg

SEQ ID NO: 3874704 - DNA, 12 bp, Homo sapiens
gccccagaggcc

SEQ ID NO: 3874705 - DNA, 17 bp, Homo sapiens
gccccagatctgcctgg

SEQ ID NO: 3874706 - DNA, 20 bp, Homo sapiens
gccccagatctgcctgggcc

SEQ ID NO: 3874707 - DNA, 17 bp, Homo sapiens
gccccaggccctccctg

SEQ ID NO: 3874708 - DNA, 12 bp, Homo sapiens
gccccagggccc

SEQ ID NO: 3874709 - DNA, 14 bp, Homo sapiens
gccccagggcctgg

SEQ ID NO: 3874710 - DNA, 16 bp, Homo sapiens
gccccagggctaccct

SEQ ID NO: 3874711 - DNA, 18 bp, Homo sapiens
gccccagggctaccctcc

SEQ ID NO: 3874712 - DNA, 20 bp, Homo sapiens
gccccaggggtgcctgtggg

SEQ ID NO: 3874713 - DNA, 21 bp, Homo sapiens
gccccaggggtgcctgtgggg

SEQ ID NO: 3874714 - DNA, 13 bp, Homo sapiens
gccccaggtgcca

SEQ ID NO: 3874715 - DNA, 21 bp, Homo sapiens
gccccaggtgccaccaataaa

SEQ ID NO: 3874716 - DNA, 22 bp, Homo sapiens
gccccaggtgccaccaataaaa

SEQ ID NO: 3874717 - DNA, 13 bp, Homo sapiens
gccccatctcctc

SEQ ID NO: 3874718 - DNA, 22 bp, Homo sapiens
gccccatctcctcccatggcct

SEQ ID NO: 3874719 - DNA, 17 bp, Homo sapiens
gccccatgctctgcccc

SEQ ID NO: 3874720 - DNA, 21 bp, Homo sapiens
gccccatgctctgccccaagc

SEQ ID NO: 3874721 - DNA, 15 bp, Homo sapiens
gccccatgtctctca

SEQ ID NO: 3874722 - DNA, 16 bp, Homo sapiens
gccccatgtctctcag

SEQ ID NO: 3874723 - DNA, 23 bp, Homo sapiens
gcccccaaccccgcggtgctctg

SEQ ID NO: 3874724 - DNA, 13 bp, Homo sapiens
gcccccaagcctc

SEQ ID NO: 3874725 - DNA, 21 bp, Homo sapiens
gcccccactttcctacaaaat

SEQ ID NO: 3874726 - DNA, 23 bp, Homo sapiens
gcccccactttcctacaaaatgg

SEQ ID NO: 3874727 - DNA, 22 bp, Homo sapiens
gcccccagccatggtgaggaag

SEQ ID NO: 3874728 - DNA, 16 bp, Homo sapiens
gccccccacctttctc

SEQ ID NO: 3874729 - DNA, 23 bp, Homo sapiens
gccccccacctttgggatcagcc

SEQ ID NO: 3874730 - DNA, 22 bp, Homo sapiens
gccccccctcttttggccttgt

SEQ ID NO: 3874731 - DNA, 12 bp, Homo sapiens
gcccccctccag

SEQ ID NO: 3874732 - DNA, 14 bp, Homo sapiens
gcccccctccaggc

SEQ ID NO: 3874733 - DNA, 20 bp, Homo sapiens
gcccccgacagcccagccta

SEQ ID NO: 3874734 - DNA, 12 bp, Homo sapiens
gccccctggatg

SEQ ID NO: 3874735 - DNA, 17 bp, Homo sapiens
gccccgggctctggcca

SEQ ID NO: 3874736 - DNA, 22 bp, Homo sapiens
gccccgggctctggccaccctg

SEQ ID NO: 3874737 - DNA, 16 bp, Homo sapiens
gccccggggctggcaa

SEQ ID NO: 3874738 - DNA, 15 bp, Homo sapiens
gccccgttccctgtc

SEQ ID NO: 3874739 - DNA, 13 bp, Homo sapiens
gcccctcagccct

SEQ ID NO: 3874740 - DNA, 21 bp, Homo sapiens
gcccctccacgcctcctggcc

SEQ ID NO: 3874741 - DNA, 20 bp, Homo sapiens
gcccctccagaccctgcctg

SEQ ID NO: 3874742 - DNA, 17 bp, Homo sapiens
gcccctccccagccctt

SEQ ID NO: 3874743 - DNA, 20 bp, Homo sapiens
gcccctccctcctctggccc

SEQ ID NO: 3874744 - DNA, 14 bp, Homo sapiens
gcccctccctctgc

SEQ ID NO: 3874745 - DNA, 18 bp, Homo sapiens
gcccctccctctgcccca

SEQ ID NO: 3874746 - DNA, 14 bp, Homo sapiens
gcccctcccttcaa

SEQ ID NO: 3874747 - DNA, 15 bp, Homo sapiens
gcccctcctctgcca

SEQ ID NO: 3874748 - DNA, 20 bp, Homo sapiens
gcccctcctctgccacctcc

SEQ ID NO: 3874749 - DNA, 21 bp, Homo sapiens
gcccctcctctgccacctccc

SEQ ID NO: 3874750 - DNA, 18 bp, Homo sapiens
gcccctgaggactggaga

SEQ ID NO: 3874751 - DNA, 23 bp, Homo sapiens
gcccctgcatccccttggctgtg

SEQ ID NO: 3874752 - DNA, 19 bp, Homo sapiens
gcccctggacaagcagagg

SEQ ID NO: 3874753 - DNA, 23 bp, Homo sapiens
gccccttaagggttgaaggcagt

SEQ ID NO: 3874754 - DNA, 15 bp, Homo sapiens
gccccttcccatctc

SEQ ID NO: 3874755 - DNA, 20 bp, Homo sapiens
gccccttccccatctccatt

SEQ ID NO: 3874756 - DNA, 12 bp, Homo sapiens
gccccttccccc

SEQ ID NO: 3874757 - DNA, 18 bp, Homo sapiens
gccccttctgtttccata

SEQ ID NO: 3874758 - DNA, 12 bp, Homo sapiens
gcccgaagccca

SEQ ID NO: 3874759 - DNA, 13 bp, Homo sapiens
gcccgaagcccag

SEQ ID NO: 3874760 - DNA, 14 bp, Homo sapiens
gcccgacagagaga

SEQ ID NO: 3874761 - DNA, 18 bp, Homo sapiens
gcccgacagagagatgaa

SEQ ID NO: 3874762 - DNA, 12 bp, Homo sapiens
gcccgacagcct

SEQ ID NO: 3874763 - DNA, 14 bp, Homo sapiens
gcccgaccccatct

SEQ ID NO: 3874764 - DNA, 12 bp, Homo sapiens
gcccgagcagct

SEQ ID NO: 3874765 - DNA, 18 bp, Homo sapiens
gcccgagcagctgagcag

SEQ ID NO: 3874766 - DNA, 13 bp, Homo sapiens
gcccgaggaccgg

SEQ ID NO: 3874767 - DNA, 21 bp, Homo sapiens
gcccgaggaccgggctggggt

SEQ ID NO: 3874768 - DNA, 17 bp, Homo sapiens
gcccgagggcctgacag

SEQ ID NO: 3874769 - DNA, 18 bp, Homo sapiens
gcccgagggcctgacagg

SEQ ID NO: 3874770 - DNA, 13 bp, Homo sapiens
gcccgcagagccc

SEQ ID NO: 3874771 - DNA, 16 bp, Homo sapiens
gcccgccagcctcagt

SEQ ID NO: 3874772 - DNA, 17 bp, Homo sapiens
gcccgccagcctcagtg

SEQ ID NO: 3874773 - DNA, 18 bp, Homo sapiens
gcccgccagcctcagtgc

SEQ ID NO: 3874774 - DNA, 19 bp, Homo sapiens
gcccggagtaatcaggcag

SEQ ID NO: 3874775 - DNA, 20 bp, Homo sapiens
gcccggagtaatcaggcagc

SEQ ID NO: 3874776 - DNA, 15 bp, Homo sapiens
gcccggccagggcct

SEQ ID NO: 3874777 - DNA, 15 bp, Homo sapiens
gcccggcctgctccc

SEQ ID NO: 3874778 - DNA, 20 bp, Homo sapiens
gcccgggtgtgcctgccctg

SEQ ID NO: 3874779 - DNA, 23 bp, Homo sapiens
gcccgggtgtgcctgccctggag

SEQ ID NO: 3874780 - DNA, 15 bp, Homo sapiens
gcgttggtgccactt

SEQ ID NO: 3874781 - DNA, 20 bp, Homo sapiens
gctaaatgcaaacactgtgt

SEQ ID NO: 3874782 - DNA, 22 bp, Homo sapiens
gctaaatttttcttaatcaaga

SEQ ID NO: 3874783 - DNA, 15 bp, Homo sapiens
gctaacagggaaggc

SEQ ID NO: 3874784 - DNA, 20 bp, Homo sapiens
gctaacagggaaggcaggca

SEQ ID NO: 3874785 - DNA, 22 bp, Homo sapiens
gctaacagggaaggcaggcagg

SEQ ID NO: 3874786 - DNA, 23 bp, Homo sapiens
gctaactccagtctcctgacatt

SEQ ID NO: 3874787 - DNA, 21 bp, Homo sapiens
gctaagatgagatttgccagc

SEQ ID NO: 3874788 - DNA, 21 bp, Homo sapiens
gctaagccccctactgagaaa

SEQ ID NO: 3874789 - DNA, 22 bp, Homo sapiens
gctaagttctaagttcatgttt

SEQ ID NO: 3874790 - DNA, 22 bp, Homo sapiens
gctaatcagcattctcactcct

SEQ ID NO: 3874791 - DNA, 17 bp, Homo sapiens
gctaatctgtagggctg

SEQ ID NO: 3874792 - DNA, 18 bp, Homo sapiens
gctaatctgtagggctgg

SEQ ID NO: 3874793 - DNA, 18 bp, Homo sapiens
gctacaataaatgctgaa

SEQ ID NO: 3874794 - DNA, 20 bp, Homo sapiens
gctacaccactctggcagcc

SEQ ID NO: 3874795 - DNA, 20 bp, Homo sapiens
gctacagttttgtgaatctt

SEQ ID NO: 3874796 - DNA, 18 bp, Homo sapiens
gctacattcctcagctgc

SEQ ID NO: 3874797 - DNA, 19 bp, Homo sapiens
gctacctgtgtggacagga

SEQ ID NO: 3874798 - DNA, 22 bp, Homo sapiens
gctacctgtgtggacaggacta

SEQ ID NO: 3874799 - DNA, 18 bp, Homo sapiens
gctacgtacatgtgaggc

SEQ ID NO: 3874800 - DNA, 15 bp, Homo sapiens
gctactaattatata

SEQ ID NO: 3874801 - DNA, 18 bp, Homo sapiens
gctactcagcagccctcc

SEQ ID NO: 3874802 - DNA, 19 bp, Homo sapiens
gctactcagcagccctcct

SEQ ID NO: 3874803 - DNA, 23 bp, Homo sapiens
gctactcaggaggctgaggcaga

SEQ ID NO: 3874804 - DNA, 16 bp, Homo sapiens
gctactcctgtgctct

SEQ ID NO: 3874805 - DNA, 20 bp, Homo sapiens
gctactcgggaggctgaggc

SEQ ID NO: 3874806 - DNA, 13 bp, Homo sapiens
gctactctgtcca

SEQ ID NO: 3874807 - DNA, 19 bp, Homo sapiens
gctactctgtgccagagcc

SEQ ID NO: 3874808 - DNA, 20 bp, Homo sapiens
gctactctgtgccagagcct

SEQ ID NO: 3874809 - DNA, 14 bp, Homo sapiens
gctactggcagctc

SEQ ID NO: 3874810 - DNA, 20 bp, Homo sapiens
gctactggcagctcctctcc

SEQ ID NO: 3874811 - DNA, 19 bp, Homo sapiens
gctactggcattaattatt

SEQ ID NO: 3874812 - DNA, 18 bp, Homo sapiens
gctagaaatatgatttta

SEQ ID NO: 3874813 - DNA, 19 bp, Homo sapiens
gctagaaccaagaagggct

SEQ ID NO: 3874814 - DNA, 19 bp, Homo sapiens
gctagaacctagaagggct

SEQ ID NO: 3874815 - DNA, 18 bp, Homo sapiens
gctagaacctggaagggc

SEQ ID NO: 3874816 - DNA, 20 bp, Homo sapiens
gctagaacctggagagctag

SEQ ID NO: 3874817 - DNA, 15 bp, Homo sapiens
gctagaagctggagg

SEQ ID NO: 3874818 - DNA, 15 bp, Homo sapiens
gctagacacccattt

SEQ ID NO: 3874819 - DNA, 16 bp, Homo sapiens
gctagactggagtgag

SEQ ID NO: 3874820 - DNA, 23 bp, Homo sapiens
gctagatatcacttactcagtta

SEQ ID NO: 3874821 - DNA, 15 bp, Homo sapiens
gctagcgctgccgca

SEQ ID NO: 3874822 - DNA, 20 bp, Homo sapiens
gctagcgctgccgcacccca

SEQ ID NO: 3874823 - DNA, 17 bp, Homo sapiens
gctagctgtagaaatgt

SEQ ID NO: 3874824 - DNA, 11 bp, Homo sapiens
gctaggactga

SEQ ID NO: 3874825 - DNA, 15 bp, Homo sapiens
gctaggactgaggag

SEQ ID NO: 3874826 - DNA, 19 bp, Homo sapiens
gctaggagagactgaaagc

SEQ ID NO: 3874827 - DNA, 19 bp, Homo sapiens
gctaggagcaaagcctgtt

SEQ ID NO: 3874828 - DNA, 18 bp, Homo sapiens
gctaggattacaggcctt

SEQ ID NO: 3874829 - DNA, 19 bp, Homo sapiens
gctagggagaatgcagaga

SEQ ID NO: 3874830 - DNA, 13 bp, Homo sapiens
gctagggctggac

SEQ ID NO: 3874831 - DNA, 21 bp, Homo sapiens
gctagtaccctatagagaggg

SEQ ID NO: 3874832 - DNA, 18 bp, Homo sapiens
gctagtcagagagagtgt

SEQ ID NO: 3874833 - DNA, 17 bp, Homo sapiens
gctagtgtgagtggcag

SEQ ID NO: 3874834 - DNA, 22 bp, Homo sapiens
gctagtgtgagtggcagccatg

SEQ ID NO: 3874835 - DNA, 19 bp, Homo sapiens
gctataggtgctacaaaaa

SEQ ID NO: 3874836 - DNA, 15 bp, Homo sapiens
gctatatatataaat

SEQ ID NO: 3874837 - DNA, 19 bp, Homo sapiens
gctatatatataaatattt

SEQ ID NO: 3874838 - DNA, 20 bp, Homo sapiens
gctatcaaaataaattgaaa

SEQ ID NO: 3874839 - DNA, 22 bp, Homo sapiens
gctatcaaaataaattgaaata

SEQ ID NO: 3874840 - DNA, 17 bp, Homo sapiens
gctatcctagagaggct

SEQ ID NO: 3874841 - DNA, 20 bp, Homo sapiens
gctatctactgagacatgac

SEQ ID NO: 3874842 - DNA, 13 bp, Homo sapiens
gctatctctgtgt

SEQ ID NO: 3874843 - DNA, 16 bp, Homo sapiens
gctatctgtcatctct

SEQ ID NO: 3874844 - DNA, 21 bp, Homo sapiens
gctatggcaagggggtgtcat

SEQ ID NO: 3874845 - DNA, 19 bp, Homo sapiens
gctatggccccagggttga

SEQ ID NO: 3874846 - DNA, 18 bp, Homo sapiens
gctattaaaagaatccaa

SEQ ID NO: 3874847 - DNA, 15 bp, Homo sapiens
gctattactgtctgg

SEQ ID NO: 3874848 - DNA, 21 bp, Homo sapiens
gctattatgtaacatccagaa

SEQ ID NO: 3874849 - DNA, 21 bp, Homo sapiens
gctattattttcactgtagaa

SEQ ID NO: 3874850 - DNA, 16 bp, Homo sapiens
gctattgaaattactg

SEQ ID NO: 3874851 - DNA, 18 bp, Homo sapiens
gctattgatgtttccaga

SEQ ID NO: 3874852 - DNA, 21 bp, Homo sapiens
gctattgatgtttccagaaaa

SEQ ID NO: 3874853 - DNA, 12 bp, Homo sapiens
gctattgcatgt

SEQ ID NO: 3874854 - DNA, 18 bp, Homo sapiens
gctattgcatgtaaaatg

SEQ ID NO: 3874855 - DNA, 22 bp, Homo sapiens
gctattgcatgtaaaatgcagt

SEQ ID NO: 3874856 - DNA, 16 bp, Homo sapiens
gctattgttgtgggct

SEQ ID NO: 3874857 - DNA, 13 bp, Homo sapiens
gctatttctctcc

SEQ ID NO: 3874858 - DNA, 15 bp, Homo sapiens
gctatttctctcccc

SEQ ID NO: 3874859 - DNA, 14 bp, Homo sapiens
gctatttctggcct

SEQ ID NO: 3874860 - DNA, 15 bp, Homo sapiens
gctatttctggcctc

SEQ ID NO: 3874861 - DNA, 17 bp, Homo sapiens
gctatttctggcctcag

SEQ ID NO: 3874862 - DNA, 20 bp, Homo sapiens
gctatttctggcctcagcag

SEQ ID NO: 3874863 - DNA, 19 bp, Homo sapiens
gctattttatttgtattca

SEQ ID NO: 3874864 - DNA, 14 bp, Homo sapiens
gctcaaatcattta

SEQ ID NO: 3874865 - DNA, 18 bp, Homo sapiens
gcccgtcatgttcctcaa

SEQ ID NO: 3874866 - DNA, 21 bp, Homo sapiens
gccctaacgggggtgcggcag

SEQ ID NO: 3874867 - DNA, 22 bp, Homo sapiens
gccctaacgggggtgcggcagg

SEQ ID NO: 3874868 - DNA, 23 bp, Homo sapiens
gccctaacgggggtgcggcagga

SEQ ID NO: 3874869 - DNA, 16 bp, Homo sapiens
gccctaagatgccttg

SEQ ID NO: 3874870 - DNA, 13 bp, Homo sapiens
gccctatggatgt

SEQ ID NO: 3874871 - DNA, 16 bp, Homo sapiens
gccctcaaaagcactt

SEQ ID NO: 3874872 - DNA, 18 bp, Homo sapiens
gccctcaataagccagca

SEQ ID NO: 3874873 - DNA, 23 bp, Homo sapiens
gccctcaatccccaagctggcag

SEQ ID NO: 3874874 - DNA, 20 bp, Homo sapiens
gccctcatgataatctgggc

SEQ ID NO: 3874875 - DNA, 21 bp, Homo sapiens
gccctcatgataatctgggca

SEQ ID NO: 3874876 - DNA, 23 bp, Homo sapiens
gccctcccatgttgcatgcctat

SEQ ID NO: 3874877 - DNA, 23 bp, Homo sapiens
gccctcccccttccccttctgtg

SEQ ID NO: 3874878 - DNA, 19 bp, Homo sapiens
gccctccctccccagctcc

SEQ ID NO: 3874879 - DNA, 17 bp, Homo sapiens
gccctccctgactccct

SEQ ID NO: 3874880 - DNA, 22 bp, Homo sapiens
gccctccctgactccctgtggg

SEQ ID NO: 3874881 - DNA, 15 bp, Homo sapiens
gccctccctgcccct

SEQ ID NO: 3874882 - DNA, 17 bp, Homo sapiens
gccctccctggcatgtc

SEQ ID NO: 3874883 - DNA, 18 bp, Homo sapiens
gccctccctggcatgtca

SEQ ID NO: 3874884 - DNA, 20 bp, Homo sapiens
gccctccctggcatgtcaga

SEQ ID NO: 3874885 - DNA, 18 bp, Homo sapiens
gccctccctgtcctcctc

SEQ ID NO: 3874886 - DNA, 13 bp, Homo sapiens
gccctcctcaccc

SEQ ID NO: 3874887 - DNA, 21 bp, Homo sapiens
gccctcctcaccccgtctggg

SEQ ID NO: 3874888 - DNA, 16 bp, Homo sapiens
gccctcgaaccaaggc

SEQ ID NO: 3874889 - DNA, 17 bp, Homo sapiens
gccctcgaaccaaggca

SEQ ID NO: 3874890 - DNA, 20 bp, Homo sapiens
gccctcgaaccaaggcagcc

SEQ ID NO: 3874891 - DNA, 11 bp, Homo sapiens
gccctctctca

SEQ ID NO: 3874892 - DNA, 20 bp, Homo sapiens
gccctctggatcctgctgtg

SEQ ID NO: 3874893 - DNA, 17 bp, Homo sapiens
gccctgacccctgcacc

SEQ ID NO: 3874894 - DNA, 16 bp, Homo sapiens
gccctgacctcccagc

SEQ ID NO: 3874895 - DNA, 14 bp, Homo sapiens
gccctgcagaccct

SEQ ID NO: 3874896 - DNA, 17 bp, Homo sapiens
gccctgcagaccctgcc

SEQ ID NO: 3874897 - DNA, 18 bp, Homo sapiens
gccctgcagaccctgccc

SEQ ID NO: 3874898 - DNA, 20 bp, Homo sapiens
gccctgcagaccctgccctt

SEQ ID NO: 3874899 - DNA, 12 bp, Homo sapiens
gccctgccagga

SEQ ID NO: 3874900 - DNA, 22 bp, Homo sapiens
gccctgccaggaggctgcggcc

SEQ ID NO: 3874901 - DNA, 12 bp, Homo sapiens
gccctgcctccc

SEQ ID NO: 3874902 - DNA, 15 bp, Homo sapiens
gccctgcctgcccac

SEQ ID NO: 3874903 - DNA, 12 bp, Homo sapiens
gccctgcctgga

SEQ ID NO: 3874904 - DNA, 18 bp, Homo sapiens
gccctgcctggaggacct

SEQ ID NO: 3874905 - DNA, 19 bp, Homo sapiens
gccctgcgttggagccact

SEQ ID NO: 3874906 - DNA, 22 bp, Homo sapiens
gccctgcgttggagccactcct

SEQ ID NO: 3874907 - DNA, 15 bp, Homo sapiens
gccctgctctgggga

SEQ ID NO: 3874908 - DNA, 22 bp, Homo sapiens
gccctgctgccgcctcccagcc

SEQ ID NO: 3874909 - DNA, 19 bp, Homo sapiens
gccctgctttgggctgccc

SEQ ID NO: 3874910 - DNA, 20 bp, Homo sapiens
gccctggagtcccctgggcc

SEQ ID NO: 3874911 - DNA, 17 bp, Homo sapiens
gccctggatcagcgtgg

SEQ ID NO: 3874912 - DNA, 19 bp, Homo sapiens
gccctggcaacatagtgag

SEQ ID NO: 3874913 - DNA, 19 bp, Homo sapiens
gccctggcccagagctgga

SEQ ID NO: 3874914 - DNA, 15 bp, Homo sapiens
gccctggcctgctgg

SEQ ID NO: 3874915 - DNA, 15 bp, Homo sapiens
gccctggctcccaca

SEQ ID NO: 3874916 - DNA, 19 bp, Homo sapiens
gccctggctcccacaggcc

SEQ ID NO: 3874917 - DNA, 20 bp, Homo sapiens
gccctggctcccacaggccc

SEQ ID NO: 3874918 - DNA, 14 bp, Homo sapiens
gccctggctctgca

SEQ ID NO: 3874919 - DNA, 22 bp, Homo sapiens
gccctgggaccgctacaccact

SEQ ID NO: 3874920 - DNA, 16 bp, Homo sapiens
gccctgggagggggct

SEQ ID NO: 3874921 - DNA, 19 bp, Homo sapiens
gccctgggcacccacctcc

SEQ ID NO: 3874922 - DNA, 20 bp, Homo sapiens
gccctgggcacccacctcca

SEQ ID NO: 3874923 - DNA, 15 bp, Homo sapiens
gccctgggccccacc

SEQ ID NO: 3874924 - DNA, 19 bp, Homo sapiens
gccctgggccccaccacct

SEQ ID NO: 3874925 - DNA, 20 bp, Homo sapiens
gccctgggccccaccaccta

SEQ ID NO: 3874926 - DNA, 20 bp, Homo sapiens
gccctgggctgtctgtcacc

SEQ ID NO: 3874927 - DNA, 12 bp, Homo sapiens
gccctggggcct

SEQ ID NO: 3874928 - DNA, 13 bp, Homo sapiens
gccctggggcctg

SEQ ID NO: 3874929 - DNA, 21 bp, Homo sapiens
gccctggggcctgtactgcct

SEQ ID NO: 3874930 - DNA, 23 bp, Homo sapiens
gccctggggcctgtactgcctgc

SEQ ID NO: 3874931 - DNA, 19 bp, Homo sapiens
gccctgggggccagctggt

SEQ ID NO: 3874932 - DNA, 21 bp, Homo sapiens
gccctggtgctgccacacttc

SEQ ID NO: 3874933 - DNA, 18 bp, Homo sapiens
gccctggtgtcaggcagg

SEQ ID NO: 3874934 - DNA, 21 bp, Homo sapiens
gccctgtcgagacacttgcct

SEQ ID NO: 3874935 - DNA, 19 bp, Homo sapiens
gccctgtgaggctgggtcc

SEQ ID NO: 3874936 - DNA, 18 bp, Homo sapiens
gcccttattttcaagaaa

SEQ ID NO: 3874937 - DNA, 20 bp, Homo sapiens
gcccttattttcaagaaact

SEQ ID NO: 3874938 - DNA, 12 bp, Homo sapiens
gcccttcccact

SEQ ID NO: 3874939 - DNA, 16 bp, Homo sapiens
gcccttcccactggag

SEQ ID NO: 3874940 - DNA, 21 bp, Homo sapiens
gcccttcctcctgaagcctct

SEQ ID NO: 3874941 - DNA, 23 bp, Homo sapiens
gcccttcctcctgaagcctctgc

SEQ ID NO: 3874942 - DNA, 12 bp, Homo sapiens
gcccttcctctc

SEQ ID NO: 3874943 - DNA, 17 bp, Homo sapiens
gcccttcctctccactg

SEQ ID NO: 3874944 - DNA, 19 bp, Homo sapiens
gcccttcctctccactgcc

SEQ ID NO: 3874945 - DNA, 14 bp, Homo sapiens
gcccttcctggaca

SEQ ID NO: 3874946 - DNA, 15 bp, Homo sapiens
gcccttcctggacag

SEQ ID NO: 3874947 - DNA, 16 bp, Homo sapiens
gcccttcctggacagc

SEQ ID NO: 3874948 - DNA, 18 bp, Homo sapiens
gcccttcctggacagctg

SEQ ID NO: 3874949 - DNA, 20 bp, Homo sapiens
gcccttcctggacagctgtg

SEQ ID NO: 3874950 - DNA, 20 bp, Homo sapiens
gccaagctgaagtgaaggag

SEQ ID NO: 3874951 - DNA, 21 bp, Homo sapiens
gccaagctgaggtgcccagga

SEQ ID NO: 3874952 - DNA, 20 bp, Homo sapiens
gccaaggtgtggcctgcact

SEQ ID NO: 3874953 - DNA, 15 bp, Homo sapiens
gccaaggttgtcctg

SEQ ID NO: 3874954 - DNA, 18 bp, Homo sapiens
gccaaggttgtcctggag

SEQ ID NO: 3874955 - DNA, 21 bp, Homo sapiens
gccaagtccaggtcctggtgg

SEQ ID NO: 3874956 - DNA, 18 bp, Homo sapiens
gccaatccaggtgggaga

SEQ ID NO: 3874957 - DNA, 22 bp, Homo sapiens
gccaatccaggtgggagagaca

SEQ ID NO: 3874958 - DNA, 16 bp, Homo sapiens
gccaatggagactgtc

SEQ ID NO: 3874959 - DNA, 18 bp, Homo sapiens
gccaattaaaatatatat

SEQ ID NO: 3874960 - DNA, 23 bp, Homo sapiens
gccacaaatcaaagcaagggctc

SEQ ID NO: 3874961 - DNA, 17 bp, Homo sapiens
gccacaatgcctctccc

SEQ ID NO: 3874962 - DNA, 18 bp, Homo sapiens
gccacaatgcctctccca

SEQ ID NO: 3874963 - DNA, 14 bp, Homo sapiens
gccacacctgagcc

SEQ ID NO: 3874964 - DNA, 18 bp, Homo sapiens
gccacactattaccatga

SEQ ID NO: 3874965 - DNA, 21 bp, Homo sapiens
gccacactattaccatgagaa

SEQ ID NO: 3874966 - DNA, 20 bp, Homo sapiens
gccacacttcaggctcttct

SEQ ID NO: 3874967 - DNA, 22 bp, Homo sapiens
gccacacttcaggctcttctcc

SEQ ID NO: 3874968 - DNA, 16 bp, Homo sapiens
gccacacttctcagga

SEQ ID NO: 3874969 - DNA, 23 bp, Homo sapiens
gccacacttctcaggacacaggc

SEQ ID NO: 3874970 - DNA, 14 bp, Homo sapiens
gccacagaagccag

SEQ ID NO: 3874971 - DNA, 12 bp, Homo sapiens
gccacagagaag

SEQ ID NO: 3874972 - DNA, 15 bp, Homo sapiens
gccacagccccacag

SEQ ID NO: 3874973 - DNA, 12 bp, Homo sapiens
gccaccaataaa

SEQ ID NO: 3874974 - DNA, 18 bp, Homo sapiens
gccaccaataaaaatcct

SEQ ID NO: 3874975 - DNA, 20 bp, Homo sapiens
gccaccacgtctgccaggcc

SEQ ID NO: 3874976 - DNA, 21 bp, Homo sapiens
gccaccacgtctgccaggccc

SEQ ID NO: 3874977 - DNA, 17 bp, Homo sapiens
gccaccaggatggccct

SEQ ID NO: 3874978 - DNA, 16 bp, Homo sapiens
gccaccagtcactgtc

SEQ ID NO: 3874979 - DNA, 14 bp, Homo sapiens
gccaccatcctgct

SEQ ID NO: 3874980 - DNA, 22 bp, Homo sapiens
gccacccaggcaggccctgcct

SEQ ID NO: 3874981 - DNA, 20 bp, Homo sapiens
gccacccgtaggcagcctct

SEQ ID NO: 3874982 - DNA, 22 bp, Homo sapiens
gccacccgttctgctggcctgg

SEQ ID NO: 3874983 - DNA, 13 bp, Homo sapiens
gccaccctctcca

SEQ ID NO: 3874984 - DNA, 16 bp, Homo sapiens
gccaccctctccatgc

SEQ ID NO: 3874985 - DNA, 14 bp, Homo sapiens
gccaccctgaggag

SEQ ID NO: 3874986 - DNA, 19 bp, Homo sapiens
gccaccctgaggagtctga

SEQ ID NO: 3874987 - DNA, 20 bp, Homo sapiens
gccaccctgaggagtctgag

SEQ ID NO: 3874988 - DNA, 15 bp, Homo sapiens
gccaccgctgccttt

SEQ ID NO: 3874989 - DNA, 23 bp, Homo sapiens
gccaccgctgccttttgctgctg

SEQ ID NO: 3874990 - DNA, 16 bp, Homo sapiens
gccacctcccacccca

SEQ ID NO: 3874991 - DNA, 19 bp, Homo sapiens
gccacctcccaccccactc

SEQ ID NO: 3874992 - DNA, 21 bp, Homo sapiens
gccacctcccaccccactcca

SEQ ID NO: 3874993 - DNA, 12 bp, Homo sapiens
gccacctcccct

SEQ ID NO: 3874994 - DNA, 13 bp, Homo sapiens
gccacctccccta

SEQ ID NO: 3874995 - DNA, 20 bp, Homo sapiens
gccacctcccctatccaccc

SEQ ID NO: 3874996 - DNA, 21 bp, Homo sapiens
gccacctcccctatccaccca

SEQ ID NO: 3874997 - DNA, 13 bp, Homo sapiens
gccacctgtctgt

SEQ ID NO: 3874998 - DNA, 14 bp, Homo sapiens
gccacctgtctgtc

SEQ ID NO: 3874999 - DNA, 13 bp, Homo sapiens
gccacgctcaggc

SEQ ID NO: 3875000 - DNA, 19 bp, Homo sapiens
gccacgctgtcctctcgag

SEQ ID NO: 3875001 - DNA, 14 bp, Homo sapiens
gccacgtgaatggc

SEQ ID NO: 3875002 - DNA, 13 bp, Homo sapiens
gccacgtgccagg

SEQ ID NO: 3875003 - DNA, 14 bp, Homo sapiens
gccacgtgccaggc

SEQ ID NO: 3875004 - DNA, 21 bp, Homo sapiens
gccacgttccttactgcagaa

SEQ ID NO: 3875005 - DNA, 15 bp, Homo sapiens
gccactacctttgtc

SEQ ID NO: 3875006 - DNA, 22 bp, Homo sapiens
gccactacctttgtccaggcct

SEQ ID NO: 3875007 - DNA, 21 bp, Homo sapiens
gccactccagacccctggctt

SEQ ID NO: 3875008 - DNA, 14 bp, Homo sapiens
gccactccctgagc

SEQ ID NO: 3875009 - DNA, 14 bp, Homo sapiens
gccactcctgtccc

SEQ ID NO: 3875010 - DNA, 13 bp, Homo sapiens
gccactccttcct

SEQ ID NO: 3875011 - DNA, 20 bp, Homo sapiens
gccactgcactccagcctgg

SEQ ID NO: 3875012 - DNA, 17 bp, Homo sapiens
gccactgccagcagctg

SEQ ID NO: 3875013 - DNA, 12 bp, Homo sapiens
gccactgccagg

SEQ ID NO: 3875014 - DNA, 15 bp, Homo sapiens
gccactgccaggcac

SEQ ID NO: 3875015 - DNA, 18 bp, Homo sapiens
gccactgccaggcacctg

SEQ ID NO: 3875016 - DNA, 24 bp, Homo sapiens
gccactgccaggcacctggcctgc

SEQ ID NO: 3875017 - DNA, 18 bp, Homo sapiens
gccactgggtctcactcc

SEQ ID NO: 3875018 - DNA, 13 bp, Homo sapiens
gccactgtggcca

SEQ ID NO: 3875019 - DNA, 14 bp, Homo sapiens
gccactgtggccag

SEQ ID NO: 3875020 - DNA, 14 bp, Homo sapiens
gccacttccaggag

SEQ ID NO: 3875021 - DNA, 19 bp, Homo sapiens
gccacttcttaaaggcctg

SEQ ID NO: 3875022 - DNA, 15 bp, Homo sapiens
gccacttgacattcc

SEQ ID NO: 3875023 - DNA, 19 bp, Homo sapiens
gccactttaagagagaaat

SEQ ID NO: 3875024 - DNA, 15 bp, Homo sapiens
gccactttggcttct

SEQ ID NO: 3875025 - DNA, 21 bp, Homo sapiens
gccagaaggagggcagagcca

SEQ ID NO: 3875026 - DNA, 20 bp, Homo sapiens
gccagaatcttcgtcctgcc

SEQ ID NO: 3875027 - DNA, 18 bp, Homo sapiens
gccagacgctgccgctgc

SEQ ID NO: 3875028 - DNA, 12 bp, Homo sapiens
gccagagaggag

SEQ ID NO: 3875029 - DNA, 15 bp, Homo sapiens
gccagagaggagcac

SEQ ID NO: 3875030 - DNA, 17 bp, Homo sapiens
gccagagcccaagtgcc

SEQ ID NO: 3875031 - DNA, 18 bp, Homo sapiens
gccagagcccaagtgcca

SEQ ID NO: 3875032 - DNA, 12 bp, Homo sapiens
gccagagcctgg

SEQ ID NO: 3875033 - DNA, 18 bp, Homo sapiens
gccagagcctggggctct

SEQ ID NO: 3875034 - DNA, 16 bp, Homo sapiens
gccagagcctggggtg

SEQ ID NO: 3875035 - DNA, 15 bp, Homo sapiens
gccagagctggaagg

SEQ ID NO: 3875036 - DNA, 14 bp, Homo sapiens
gcccttcgctgcca

SEQ ID NO: 3875037 - DNA, 15 bp, Homo sapiens
gcccttcgctgccag

SEQ ID NO: 3875038 - DNA, 18 bp, Homo sapiens
gcccttcgctgccaggac

SEQ ID NO: 3875039 - DNA, 19 bp, Homo sapiens
gcccttcgctgccaggaca

SEQ ID NO: 3875040 - DNA, 21 bp, Homo sapiens
gcccttcgctgccaggacacc

SEQ ID NO: 3875041 - DNA, 13 bp, Homo sapiens
gcccttgccctga

SEQ ID NO: 3875042 - DNA, 15 bp, Homo sapiens
gcccttgccctgacc

SEQ ID NO: 3875043 - DNA, 14 bp, Homo sapiens
gcccttggggcctg

SEQ ID NO: 3875044 - DNA, 17 bp, Homo sapiens
gcccttggggcctggct

SEQ ID NO: 3875045 - DNA, 18 bp, Homo sapiens
gcccttggggcctggctt

SEQ ID NO: 3875046 - DNA, 13 bp, Homo sapiens
gcccttggggttc

SEQ ID NO: 3875047 - DNA, 15 bp, Homo sapiens
gcccttgtcctgcca

SEQ ID NO: 3875048 - DNA, 21 bp, Homo sapiens
gcccttgtcctgccagctgcc

SEQ ID NO: 3875049 - DNA, 17 bp, Homo sapiens
gcccttgtttggggcag

SEQ ID NO: 3875050 - DNA, 19 bp, Homo sapiens
gcccttgtttggggcagga

SEQ ID NO: 3875051 - DNA, 13 bp, Homo sapiens
gccctttctgtgt

SEQ ID NO: 3875052 - DNA, 23 bp, Homo sapiens
gccctttgcaggcccagcagact

SEQ ID NO: 3875053 - DNA, 20 bp, Homo sapiens
gcccttttacagctcttggc

SEQ ID NO: 3875054 - DNA, 15 bp, Homo sapiens
gccgaagctaacagg

SEQ ID NO: 3875055 - DNA, 21 bp, Homo sapiens
gccgacctcgtcctccccctg

SEQ ID NO: 3875056 - DNA, 13 bp, Homo sapiens
gccgagagaggcg

SEQ ID NO: 3875057 - DNA, 16 bp, Homo sapiens
gccgagagcctgctcc

SEQ ID NO: 3875058 - DNA, 17 bp, Homo sapiens
gccgagagcctgctccc

SEQ ID NO: 3875059 - DNA, 20 bp, Homo sapiens
gccgagcaaccgtggccctt

SEQ ID NO: 3875060 - DNA, 16 bp, Homo sapiens
gccgagccgggcctgg

SEQ ID NO: 3875061 - DNA, 17 bp, Homo sapiens
gccgagccgggcctggg

SEQ ID NO: 3875062 - DNA, 13 bp, Homo sapiens
gccgcaaatcaac

SEQ ID NO: 3875063 - DNA, 19 bp, Homo sapiens
gccgcaaatcaaccccaga

SEQ ID NO: 3875064 - DNA, 14 bp, Homo sapiens
gccgcaagcgcagg

SEQ ID NO: 3875065 - DNA, 18 bp, Homo sapiens
gccgcatcttctccatct

SEQ ID NO: 3875066 - DNA, 14 bp, Homo sapiens
gccgcattccctga

SEQ ID NO: 3875067 - DNA, 16 bp, Homo sapiens
gccgccatccgggacg

SEQ ID NO: 3875068 - DNA, 24 bp, Homo sapiens
gccgccctgggctgtctgtcacca

SEQ ID NO: 3875069 - DNA, 13 bp, Homo sapiens
gccgcctcccagc

SEQ ID NO: 3875070 - DNA, 15 bp, Homo sapiens
gccgcctcccagcct

SEQ ID NO: 3875071 - DNA, 21 bp, Homo sapiens
gccgcctgccataccgctggg

SEQ ID NO: 3875072 - DNA, 13 bp, Homo sapiens
gccgctaggagag

SEQ ID NO: 3875073 - DNA, 22 bp, Homo sapiens
gccgctaggagagactgaaagc

SEQ ID NO: 3875074 - DNA, 15 bp, Homo sapiens
gccgctgccgctgca

SEQ ID NO: 3875075 - DNA, 20 bp, Homo sapiens
gccggaccaagatgggcaca

SEQ ID NO: 3875076 - DNA, 20 bp, Homo sapiens
gccggaccgcgtagagagcc

SEQ ID NO: 3875077 - DNA, 18 bp, Homo sapiens
gccggcaaccccagttct

SEQ ID NO: 3875078 - DNA, 21 bp, Homo sapiens
gccggcaaccccagttctgct

SEQ ID NO: 3875079 - DNA, 13 bp, Homo sapiens
gccggccagcctt

SEQ ID NO: 3875080 - DNA, 23 bp, Homo sapiens
gccggcgtggcaaatataaaact

SEQ ID NO: 3875081 - DNA, 14 bp, Homo sapiens
gccgggcaggcctg

SEQ ID NO: 3875082 - DNA, 23 bp, Homo sapiens
gccgggcatggtggcgcaagcct

SEQ ID NO: 3875083 - DNA, 24 bp, Homo sapiens
gccgggctgcccttcgctgccagg

SEQ ID NO: 3875084 - DNA, 17 bp, Homo sapiens
gccggggaactggccaa

SEQ ID NO: 3875085 - DNA, 20 bp, Homo sapiens
gccggggaactggccaagct

SEQ ID NO: 3875086 - DNA, 22 bp, Homo sapiens
gccggggaactggccaagctga

SEQ ID NO: 3875087 - DNA, 13 bp, Homo sapiens
gccgggtgcggtg

SEQ ID NO: 3875088 - DNA, 13 bp, Homo sapiens
gccggtgcctggc

SEQ ID NO: 3875089 - DNA, 20 bp, Homo sapiens
gccggttgcagagaatctgt

SEQ ID NO: 3875090 - DNA, 23 bp, Homo sapiens
gccgtccatggcaccagccccct

SEQ ID NO: 3875091 - DNA, 19 bp, Homo sapiens
gccgtcgtggaattaaatc

SEQ ID NO: 3875092 - DNA, 14 bp, Homo sapiens
gccgtctgactcca

SEQ ID NO: 3875093 - DNA, 23 bp, Homo sapiens
gccgtgcactccctaagaaaccc

SEQ ID NO: 3875094 - DNA, 14 bp, Homo sapiens
gccgtgccttcagc

SEQ ID NO: 3875095 - DNA, 23 bp, Homo sapiens
gccgtgcctttctctggctccag

SEQ ID NO: 3875096 - DNA, 23 bp, Homo sapiens
gccgtgctcgcccacaaactgat

SEQ ID NO: 3875097 - DNA, 20 bp, Homo sapiens
gccgtggccatcagggtggg

SEQ ID NO: 3875098 - DNA, 12 bp, Homo sapiens
gccgtggcttcc

SEQ ID NO: 3875099 - DNA, 15 bp, Homo sapiens
gccgtgtctctgagg

SEQ ID NO: 3875100 - DNA, 14 bp, Homo sapiens
gccgttactctcca

SEQ ID NO: 3875101 - DNA, 18 bp, Homo sapiens
gccgttactctccaacct

SEQ ID NO: 3875102 - DNA, 17 bp, Homo sapiens
gcctaaaaatgcaactt

SEQ ID NO: 3875103 - DNA, 19 bp, Homo sapiens
gcctaagaaaatcatcttg

SEQ ID NO: 3875104 - DNA, 17 bp, Homo sapiens
gcctaagtggctgctga

SEQ ID NO: 3875105 - DNA, 23 bp, Homo sapiens
gcctaatatttaggcaagagaaa

SEQ ID NO: 3875106 - DNA, 19 bp, Homo sapiens
gcctacccttgtaccccat

SEQ ID NO: 3875107 - DNA, 23 bp, Homo sapiens
gcctacccttgtaccccatccct

SEQ ID NO: 3875108 - DNA, 17 bp, Homo sapiens
gcctagatccacacaca

SEQ ID NO: 3875109 - DNA, 23 bp, Homo sapiens
gcctagatccacacacagaggaa

SEQ ID NO: 3875110 - DNA, 12 bp, Homo sapiens
gcctagccacct

SEQ ID NO: 3875111 - DNA, 23 bp, Homo sapiens
gcctagccacctcccaccccact

SEQ ID NO: 3875112 - DNA, 22 bp, Homo sapiens
gcctagttcctgtggccaggag

SEQ ID NO: 3875113 - DNA, 19 bp, Homo sapiens
gcctatccatcctgcgagc

SEQ ID NO: 3875114 - DNA, 18 bp, Homo sapiens
gcctatgacttgggcacc

SEQ ID NO: 3875115 - DNA, 18 bp, Homo sapiens
gcctatttattcattcag

SEQ ID NO: 3875116 - DNA, 13 bp, Homo sapiens
gcctatttattgg

SEQ ID NO: 3875117 - DNA, 16 bp, Homo sapiens
gcctatttattggggt

SEQ ID NO: 3875118 - DNA, 16 bp, Homo sapiens
gcctatttatttgaaa

SEQ ID NO: 3875119 - DNA, 12 bp, Homo sapiens
gcctcaagaaca

SEQ ID NO: 3875120 - DNA, 21 bp, Homo sapiens
gcctcaatgtgaatcagaccc

SEQ ID NO: 3875121 - DNA, 17 bp, Homo sapiens
gcctcaatgtgaccagg

SEQ ID NO: 3875122 - DNA, 16 bp, Homo sapiens
gcctcactgagctaat

SEQ ID NO: 3875123 - DNA, 15 bp, Homo sapiens
gcctcacttccctgg

SEQ ID NO: 3875124 - DNA, 16 bp, Homo sapiens
gcctcacttccctggg

SEQ ID NO: 3875125 - DNA, 14 bp, Homo sapiens
gcctcagtgccact

SEQ ID NO: 3875126 - DNA, 15 bp, Homo sapiens
gcctcagtgccactt

SEQ ID NO: 3875127 - DNA, 18 bp, Homo sapiens
gcctcagtgtagttaaag

SEQ ID NO: 3875128 - DNA, 16 bp, Homo sapiens
gcctcagttcaacctg

SEQ ID NO: 3875129 - DNA, 12 bp, Homo sapiens
gcctcagtttcc

SEQ ID NO: 3875130 - DNA, 14 bp, Homo sapiens
gcctcagtttcccc

SEQ ID NO: 3875131 - DNA, 15 bp, Homo sapiens
gcctcagtttcccca

SEQ ID NO: 3875132 - DNA, 17 bp, Homo sapiens
gcctcagtttccccatt

SEQ ID NO: 3875133 - DNA, 13 bp, Homo sapiens
gcctcatatttaa

SEQ ID NO: 3875134 - DNA, 13 bp, Homo sapiens
gcctcatccctcg

SEQ ID NO: 3875135 - DNA, 12 bp, Homo sapiens
gcctcatctcct

SEQ ID NO: 3875136 - DNA, 16 bp, Homo sapiens
gcctcatgccacacct

SEQ ID NO: 3875137 - DNA, 18 bp, Homo sapiens
gcctccacctctccttgg

SEQ ID NO: 3875138 - DNA, 15 bp, Homo sapiens
gcctccactccccca

SEQ ID NO: 3875139 - DNA, 21 bp, Homo sapiens
gcctccactcccccacctgac

SEQ ID NO: 3875140 - DNA, 23 bp, Homo sapiens
gcctccactcccccacctgacaa

SEQ ID NO: 3875141 - DNA, 15 bp, Homo sapiens
gcctccagagccagc

SEQ ID NO: 3875142 - DNA, 19 bp, Homo sapiens
gcctccagagccagcctgg

SEQ ID NO: 3875143 - DNA, 23 bp, Homo sapiens
gcctccagagccagcctgggact

SEQ ID NO: 3875144 - DNA, 24 bp, Homo sapiens
gcctccagagccagcctgggactc

SEQ ID NO: 3875145 - DNA, 19 bp, Homo sapiens
gcctccagcctctcccggc

SEQ ID NO: 3875146 - DNA, 17 bp, Homo sapiens
gcctcccaataaagctg

SEQ ID NO: 3875147 - DNA, 20 bp, Homo sapiens
gcctcccaataaagctggac

SEQ ID NO: 3875148 - DNA, 19 bp, Homo sapiens
gcctcccagccccaggggt

SEQ ID NO: 3875149 - DNA, 20 bp, Homo sapiens
gcctcccagccccaggggtg

SEQ ID NO: 3875150 - DNA, 21 bp, Homo sapiens
gcctcccagccccaggggtgc

SEQ ID NO: 3875151 - DNA, 20 bp, Homo sapiens
gcctcccagccctgccagga

SEQ ID NO: 3875152 - DNA, 14 bp, Homo sapiens
gcctccctcaaccc

SEQ ID NO: 3875153 - DNA, 21 bp, Homo sapiens
gcctccctctccatatctcct

SEQ ID NO: 3875154 - DNA, 15 bp, Homo sapiens
gcctccgtcaggaga

SEQ ID NO: 3875155 - DNA, 16 bp, Homo sapiens
gcctccgtcaggagag

SEQ ID NO: 3875156 - DNA, 20 bp, Homo sapiens
gcctccgtcaggagagacgc

SEQ ID NO: 3875157 - DNA, 19 bp, Homo sapiens
gcctcctaagcagctggga

SEQ ID NO: 3875158 - DNA, 14 bp, Homo sapiens
gcctcctcaccccc

SEQ ID NO: 3875159 - DNA, 16 bp, Homo sapiens
gcctcctcacccccag

SEQ ID NO: 3875160 - DNA, 17 bp, Homo sapiens
gcctcctgacctgaggc

SEQ ID NO: 3875161 - DNA, 21 bp, Homo sapiens
gcctcctgacctgaggctcct

SEQ ID NO: 3875162 - DNA, 12 bp, Homo sapiens
gcctcctggcca

SEQ ID NO: 3875163 - DNA, 15 bp, Homo sapiens
gcctcctggccagac

SEQ ID NO: 3875164 - DNA, 20 bp, Homo sapiens
gcctcctgggaccatggaca

SEQ ID NO: 3875165 - DNA, 17 bp, Homo sapiens
gcctccttatttatcaa

SEQ ID NO: 3875166 - DNA, 21 bp, Homo sapiens
gcctccttttgctgtttggat

SEQ ID NO: 3875167 - DNA, 13 bp, Homo sapiens
gcctcgaggcacc

SEQ ID NO: 3875168 - DNA, 16 bp, Homo sapiens
gcctcgaggcaccggc

SEQ ID NO: 3875169 - DNA, 23 bp, Homo sapiens
gcctcgaggcaccggcgctgcag

SEQ ID NO: 3875170 - DNA, 19 bp, Homo sapiens
gcctcgctccccactctgc

SEQ ID NO: 3875171 - DNA, 23 bp, Homo sapiens
gcctcgctccccactctgctctg

SEQ ID NO: 3875172 - DNA, 21 bp, Homo sapiens
gcctcgggacacctgccctgc

SEQ ID NO: 3875173 - DNA, 18 bp, Homo sapiens
gcctcgtaccagccagga

SEQ ID NO: 3875174 - DNA, 13 bp, Homo sapiens
gcctcgtgccatg

SEQ ID NO: 3875175 - DNA, 14 bp, Homo sapiens
gcctcgtgccatga

SEQ ID NO: 3875176 - DNA, 17 bp, Homo sapiens
gcctctactgggaaggc

SEQ ID NO: 3875177 - DNA, 19 bp, Homo sapiens
gcctctagaacacccactg

SEQ ID NO: 3875178 - DNA, 20 bp, Homo sapiens
gcctctagaacacccactgg

SEQ ID NO: 3875179 - DNA, 12 bp, Homo sapiens
gcctctccctta

SEQ ID NO: 3875180 - DNA, 13 bp, Homo sapiens
gcctctctgctcc

SEQ ID NO: 3875181 - DNA, 17 bp, Homo sapiens
gcctctgaggccagcct

SEQ ID NO: 3875182 - DNA, 20 bp, Homo sapiens
gcctctgaggccagcctggc

SEQ ID NO: 3875183 - DNA, 22 bp, Homo sapiens
gcctctgaggccagcctggcct

SEQ ID NO: 3875184 - DNA, 13 bp, Homo sapiens
gcctctgatatgg

SEQ ID NO: 3875185 - DNA, 23 bp, Homo sapiens
gcctctgatatgggactgagcct

SEQ ID NO: 3875186 - DNA, 13 bp, Homo sapiens
gcctctgccatgc

SEQ ID NO: 3875187 - DNA, 14 bp, Homo sapiens
gcctctgccccaag

SEQ ID NO: 3875188 - DNA, 23 bp, Homo sapiens
gcctctgccccaaggggcccaca

SEQ ID NO: 3875189 - DNA, 13 bp, Homo sapiens
gcctctgcccgca

SEQ ID NO: 3875190 - DNA, 14 bp, Homo sapiens
gcctctgcccgcag

SEQ ID NO: 3875191 - DNA, 16 bp, Homo sapiens
gcctctgcccgcagag

SEQ ID NO: 3875192 - DNA, 13 bp, Homo sapiens
gcctctgccctgc

SEQ ID NO: 3875193 - DNA, 13 bp, Homo sapiens
gcctctgcctgtg

SEQ ID NO: 3875194 - DNA, 12 bp, Homo sapiens
gcctctggccag

SEQ ID NO: 3875195 - DNA, 15 bp, Homo sapiens
gcctctggccaggca

SEQ ID NO: 3875196 - DNA, 18 bp, Homo sapiens
gcctcttaaagctgcctg

SEQ ID NO: 3875197 - DNA, 20 bp, Homo sapiens
gcctcttaaagctgcctgta

SEQ ID NO: 3875198 - DNA, 14 bp, Homo sapiens
gcctcttagtgatt

SEQ ID NO: 3875199 - DNA, 16 bp, Homo sapiens
gcctcttagtgattgt

SEQ ID NO: 3875200 - DNA, 13 bp, Homo sapiens
gcctcttccaccc

SEQ ID NO: 3875201 - DNA, 14 bp, Homo sapiens
gcctcttccaccca

SEQ ID NO: 3875202 - DNA, 14 bp, Homo sapiens
gcctcttccctcag

SEQ ID NO: 3875203 - DNA, 19 bp, Homo sapiens
gcctcttggacctctgctc

SEQ ID NO: 3875204 - DNA, 20 bp, Homo sapiens
gcctcttggacctctgctct

SEQ ID NO: 3875205 - DNA, 14 bp, Homo sapiens
gcctcttgtgctca

SEQ ID NO: 3875206 - DNA, 17 bp, Homo sapiens
gcctcttgtgctcacgc

SEQ ID NO: 3875207 - DNA, 20 bp, Homo sapiens
gcctcttgtgctcacgctcc

SEQ ID NO: 3875208 - DNA, 12 bp, Homo sapiens
gcctcttttctc

SEQ ID NO: 3875209 - DNA, 18 bp, Homo sapiens
gcctgacaggttcccagc

SEQ ID NO: 3875210 - DNA, 14 bp, Homo sapiens
gcctgagcccagga

SEQ ID NO: 3875211 - DNA, 19 bp, Homo sapiens
gcctgagcccagggaggcc

SEQ ID NO: 3875212 - DNA, 13 bp, Homo sapiens
gcctgagctgggg

SEQ ID NO: 3875213 - DNA, 14 bp, Homo sapiens
gcctgagctggggc

SEQ ID NO: 3875214 - DNA, 16 bp, Homo sapiens
gcctgagctggggcca

SEQ ID NO: 3875215 - DNA, 18 bp, Homo sapiens
gcctgagctggggccaca

SEQ ID NO: 3875216 - DNA, 16 bp, Homo sapiens
gcctgagctggggcct

SEQ ID NO: 3875217 - DNA, 22 bp, Homo sapiens
gcctgagctggggcctggagag

SEQ ID NO: 3875218 - DNA, 16 bp, Homo sapiens
gcctgaggctcaagag

SEQ ID NO: 3875219 - DNA, 20 bp, Homo sapiens
gcctgaggctcaagaggccc

SEQ ID NO: 3875220 - DNA, 20 bp, Homo sapiens
gcctgataagcttcaaagct

SEQ ID NO: 3875221 - DNA, 17 bp, Homo sapiens
gcctgatgacagagcga

SEQ ID NO: 3875222 - DNA, 14 bp, Homo sapiens
gcctgatgctgccc

SEQ ID NO: 3875223 - DNA, 17 bp, Homo sapiens
gcctgatggccaagggg

SEQ ID NO: 3875224 - DNA, 18 bp, Homo sapiens
gcctgcagagagaagcct

SEQ ID NO: 3875225 - DNA, 21 bp, Homo sapiens
gcctgcagaggacagagctgg

SEQ ID NO: 3875226 - DNA, 23 bp, Homo sapiens
gcctgcagcctcccccacaaata

SEQ ID NO: 3875227 - DNA, 13 bp, Homo sapiens
gcctgccataccg

SEQ ID NO: 3875228 - DNA, 20 bp, Homo sapiens
gcctgccataccgctgggga

SEQ ID NO: 3875229 - DNA, 15 bp, Homo sapiens
gcctgccctcccatg

SEQ ID NO: 3875230 - DNA, 17 bp, Homo sapiens
gcctgccctccctgggg

SEQ ID NO: 3875231 - DNA, 14 bp, Homo sapiens
gcctgccgagcaac

SEQ ID NO: 3875232 - DNA, 20 bp, Homo sapiens
gcctgccgagcaaccgtggc

SEQ ID NO: 3875233 - DNA, 20 bp, Homo sapiens
gcctgccgccgtctctgtcc

SEQ ID NO: 3875234 - DNA, 14 bp, Homo sapiens
gcctgcctcccagc

SEQ ID NO: 3875235 - DNA, 15 bp, Homo sapiens
gcctgcctcccagcc

SEQ ID NO: 3875236 - DNA, 23 bp, Homo sapiens
gcctgcctcccagccctgccagg

SEQ ID NO: 3875237 - DNA, 14 bp, Homo sapiens
gcctgcctctgcca

SEQ ID NO: 3875238 - DNA, 17 bp, Homo sapiens
gcctgcctgttcccatt

SEQ ID NO: 3875239 - DNA, 21 bp, Homo sapiens
gcctgcggcccagaagtttcc

SEQ ID NO: 3875240 - DNA, 16 bp, Homo sapiens
gcctgcggccgggctg

SEQ ID NO: 3875241 - DNA, 18 bp, Homo sapiens
gcctgcggccgggctgcc

SEQ ID NO: 3875242 - DNA, 16 bp, Homo sapiens
gcctgctagagcaacc

SEQ ID NO: 3875243 - DNA, 13 bp, Homo sapiens
gcctgctcccagc

SEQ ID NO: 3875244 - DNA, 15 bp, Homo sapiens
gcctgctcccagcag

SEQ ID NO: 3875245 - DNA, 17 bp, Homo sapiens
gcctgctcccccacccc

SEQ ID NO: 3875246 - DNA, 19 bp, Homo sapiens
gcctgctgcgtcagaccag

SEQ ID NO: 3875247 - DNA, 12 bp, Homo sapiens
gcctgctgctga

SEQ ID NO: 3875248 - DNA, 14 bp, Homo sapiens
gcctgctgctgaga

SEQ ID NO: 3875249 - DNA, 15 bp, Homo sapiens
gcctgctgctgagaa

SEQ ID NO: 3875250 - DNA, 13 bp, Homo sapiens
gcctgctgggaac

SEQ ID NO: 3875251 - DNA, 21 bp, Homo sapiens
gcctgctgggaaccccgcagc

SEQ ID NO: 3875252 - DNA, 22 bp, Homo sapiens
gcctgctgggaaccccgcagcc

SEQ ID NO: 3875253 - DNA, 23 bp, Homo sapiens
gcctgctgggaaccccgcagccc

SEQ ID NO: 3875254 - DNA, 16 bp, Homo sapiens
gcctgctgggctctcc

SEQ ID NO: 3875255 - DNA, 17 bp, Homo sapiens
gcctgcttttccaggat

SEQ ID NO: 3875256 - DNA, 18 bp, Homo sapiens
gcctgcttttccaggatc

SEQ ID NO: 3875257 - DNA, 19 bp, Homo sapiens
gcctgcttttccaggatcc

SEQ ID NO: 3875258 - DNA, 22 bp, Homo sapiens
gcctgcttttccaggatcctgc

SEQ ID NO: 3875259 - DNA, 19 bp, Homo sapiens
gcctggaaccagggaggag

SEQ ID NO: 3875260 - DNA, 20 bp, Homo sapiens
gcctggaaccagggaggaga

SEQ ID NO: 3875261 - DNA, 19 bp, Homo sapiens
gcctggaccgcttcccaga

SEQ ID NO: 3875262 - DNA, 20 bp, Homo sapiens
gcctggaccgcttcccagag

SEQ ID NO: 3875263 - DNA, 21 bp, Homo sapiens
gcctggaccgcttcccagagg

SEQ ID NO: 3875264 - DNA, 23 bp, Homo sapiens
gcctggaccgcttcccagaggcc

SEQ ID NO: 3875265 - DNA, 15 bp, Homo sapiens
gcctggactctaagc

SEQ ID NO: 3875266 - DNA, 19 bp, Homo sapiens
gcctggactctaagctgga

SEQ ID NO: 3875267 - DNA, 20 bp, Homo sapiens
gcctggagaggggcctggga

SEQ ID NO: 3875268 - DNA, 20 bp, Homo sapiens
gcctggaggacctgagcctg

SEQ ID NO: 3875269 - DNA, 20 bp, Homo sapiens
gcctggatgttgctgtgcac

SEQ ID NO: 3875270 - DNA, 15 bp, Homo sapiens
gcctggcaaggcctc

SEQ ID NO: 3875271 - DNA, 13 bp, Homo sapiens
gcctggcacaggg

SEQ ID NO: 3875272 - DNA, 14 bp, Homo sapiens
gcctggcacagggc

SEQ ID NO: 3875273 - DNA, 15 bp, Homo sapiens
gcctggccatcccca

SEQ ID NO: 3875274 - DNA, 14 bp, Homo sapiens
gcctggcccataga

SEQ ID NO: 3875275 - DNA, 19 bp, Homo sapiens
gcctggcccccctccaggc

SEQ ID NO: 3875276 - DNA, 18 bp, Homo sapiens
gcctggccggcaacccca

SEQ ID NO: 3875277 - DNA, 14 bp, Homo sapiens
gcctggcctcctgc

SEQ ID NO: 3875278 - DNA, 15 bp, Homo sapiens
gcctggcctcctgcc

SEQ ID NO: 3875279 - DNA, 12 bp, Homo sapiens
gcctggcctgag

SEQ ID NO: 3875280 - DNA, 15 bp, Homo sapiens
gcctggcctgagctg

SEQ ID NO: 3875281 - DNA, 18 bp, Homo sapiens
gcctggcctgagctgggg

SEQ ID NO: 3875282 - DNA, 12 bp, Homo sapiens
gcctggccttgt

SEQ ID NO: 3875283 - DNA, 19 bp, Homo sapiens
gcctggccttgtcaggacc

SEQ ID NO: 3875284 - DNA, 22 bp, Homo sapiens
gcctggccttgtcaggacccag

SEQ ID NO: 3875285 - DNA, 22 bp, Homo sapiens
gcctggctccccacgagtcacc

SEQ ID NO: 3875286 - DNA, 23 bp, Homo sapiens
gcctggctccccacgagtcacct

SEQ ID NO: 3875287 - DNA, 16 bp, Homo sapiens
gcctggctccgtccag

SEQ ID NO: 3875288 - DNA, 14 bp, Homo sapiens
gcctggctggctga

SEQ ID NO: 3875289 - DNA, 16 bp, Homo sapiens
gcctggctggctgagg

SEQ ID NO: 3875290 - DNA, 20 bp, Homo sapiens
gcctggctggctgagggcag

SEQ ID NO: 3875291 - DNA, 10 bp, Homo sapiens
gcctggctgt

SEQ ID NO: 3875292 - DNA, 16 bp, Homo sapiens
gcctggctgtggaggc

SEQ ID NO: 3875293 - DNA, 21 bp, Homo sapiens
gcctggcttgctccagggtct

SEQ ID NO: 3875294 - DNA, 15 bp, Homo sapiens
gcctgggacccagct

SEQ ID NO: 3875295 - DNA, 17 bp, Homo sapiens
gcctgggactcccagtg

SEQ ID NO: 3875296 - DNA, 12 bp, Homo sapiens
gcctgggcccag

SEQ ID NO: 3875297 - DNA, 18 bp, Homo sapiens
gcctgggcccaggctctg

SEQ ID NO: 3875298 - DNA, 21 bp, Homo sapiens
gcctgggcccaggctctggga

SEQ ID NO: 3875299 - DNA, 12 bp, Homo sapiens
gcctgggcctgc

SEQ ID NO: 3875300 - DNA, 14 bp, Homo sapiens
gcctgggcctgctt

SEQ ID NO: 3875301 - DNA, 22 bp, Homo sapiens
gcctgggcctgcttttccagga

SEQ ID NO: 3875302 - DNA, 16 bp, Homo sapiens
gcctgggcctgtgcag

SEQ ID NO: 3875303 - DNA, 20 bp, Homo sapiens
gcctgggcgacagagcgaga

SEQ ID NO: 3875304 - DNA, 20 bp, Homo sapiens
gcctggggctctaacgcctg

SEQ ID NO: 3875305 - DNA, 21 bp, Homo sapiens
gcctggggctctaacgcctga

SEQ ID NO: 3875306 - DNA, 14 bp, Homo sapiens
gcctgggggcagtg

SEQ ID NO: 3875307 - DNA, 18 bp, Homo sapiens
gcctgggggcagtgactg

SEQ ID NO: 3875308 - DNA, 19 bp, Homo sapiens
gcctgggggcagtgactgg

SEQ ID NO: 3875309 - DNA, 14 bp, Homo sapiens
gcctgggggcctgg

SEQ ID NO: 3875310 - DNA, 15 bp, Homo sapiens
gcctgggggcctggc

SEQ ID NO: 3875311 - DNA, 17 bp, Homo sapiens
gcctgggggcctggctg

SEQ ID NO: 3875312 - DNA, 18 bp, Homo sapiens
gcctggggtgacccggca

SEQ ID NO: 3875313 - DNA, 21 bp, Homo sapiens
gcctgggtgagaatcctgcct

SEQ ID NO: 3875314 - DNA, 22 bp, Homo sapiens
gcctgggtgagaatcctgcctc

SEQ ID NO: 3875315 - DNA, 20 bp, Homo sapiens
gcctgggtggcagagtgaga

SEQ ID NO: 3875316 - DNA, 19 bp, Homo sapiens
gcctgggtggggctgctcc

SEQ ID NO: 3875317 - DNA, 20 bp, Homo sapiens
gcctgggtggggctgctcct

SEQ ID NO: 3875318 - DNA, 15 bp, Homo sapiens
gcctgggttttctaa

SEQ ID NO: 3875319 - DNA, 23 bp, Homo sapiens
gcctgggttttctaactgtaaat

SEQ ID NO: 3875320 - DNA, 21 bp, Homo sapiens
gcctggtagaattgggaagct

SEQ ID NO: 3875321 - DNA, 16 bp, Homo sapiens
gcctggtctcctccca

SEQ ID NO: 3875322 - DNA, 17 bp, Homo sapiens
gcctggtgtgaggctgg

SEQ ID NO: 3875323 - DNA, 18 bp, Homo sapiens
gcctggtgtgaggctggg

SEQ ID NO: 3875324 - DNA, 17 bp, Homo sapiens
gcctgtaatcccagcta

SEQ ID NO: 3875325 - DNA, 14 bp, Homo sapiens
gcctgtactgcctg

SEQ ID NO: 3875326 - DNA, 16 bp, Homo sapiens
gcctgtactgcctgct

SEQ ID NO: 3875327 - DNA, 19 bp, Homo sapiens
gcctgtactgcctgcttgg

SEQ ID NO: 3875328 - DNA, 14 bp, Homo sapiens
gcctgtagttagga

SEQ ID NO: 3875329 - DNA, 18 bp, Homo sapiens
gcctgtatagacagcact

SEQ ID NO: 3875330 - DNA, 18 bp, Homo sapiens
gcctgtcagtttcatgga

SEQ ID NO: 3875331 - DNA, 13 bp, Homo sapiens
gcctgtccccctg

SEQ ID NO: 3875332 - DNA, 12 bp, Homo sapiens
gcctgtcctggt

SEQ ID NO: 3875333 - DNA, 20 bp, Homo sapiens
gcctgtcctggtacagcagg

SEQ ID NO: 3875334 - DNA, 21 bp, Homo sapiens
gcctgtgaacccaggacaagc

SEQ ID NO: 3875335 - DNA, 19 bp, Homo sapiens
gcctgtgattaacttgctt

SEQ ID NO: 3875336 - DNA, 14 bp, Homo sapiens
gcctgtgcagcagc

SEQ ID NO: 3875337 - DNA, 16 bp, Homo sapiens
gcctgtgcagcagccc

SEQ ID NO: 3875338 - DNA, 22 bp, Homo sapiens
gcctgtgcagcagcccagcttc

SEQ ID NO: 3875339 - DNA, 19 bp, Homo sapiens
gcctgtgctgaggactccc

SEQ ID NO: 3875340 - DNA, 22 bp, Homo sapiens
gcctgtggcagaaaagaggaga

SEQ ID NO: 3875341 - DNA, 21 bp, Homo sapiens
gcctgtgtagctgtgacctgc

SEQ ID NO: 3875342 - DNA, 12 bp, Homo sapiens
gcctgtgtccag

SEQ ID NO: 3875343 - DNA, 14 bp, Homo sapiens
gcctgtgtccagca

SEQ ID NO: 3875344 - DNA, 18 bp, Homo sapiens
gcctgtgtccagcagctg

SEQ ID NO: 3875345 - DNA, 14 bp, Homo sapiens
gcctgtgtgttctg

SEQ ID NO: 3875346 - DNA, 15 bp, Homo sapiens
gcctgttcatggcag

SEQ ID NO: 3875347 - DNA, 19 bp, Homo sapiens
gcctgttggacccgctctg

SEQ ID NO: 3875348 - DNA, 19 bp, Homo sapiens
gcctgttgttcccatctgc

SEQ ID NO: 3875349 - DNA, 16 bp, Homo sapiens
gccttaaagaaagtcg

SEQ ID NO: 3875350 - DNA, 13 bp, Homo sapiens
gccttaaattttt

SEQ ID NO: 3875351 - DNA, 15 bp, Homo sapiens
gccttacctcctgcc

SEQ ID NO: 3875352 - DNA, 17 bp, Homo sapiens
gccttacctcctgccca

SEQ ID NO: 3875353 - DNA, 20 bp, Homo sapiens
gccttacctcctgcccagga

SEQ ID NO: 3875354 - DNA, 15 bp, Homo sapiens
gccttactcacctct

SEQ ID NO: 3875355 - DNA, 17 bp, Homo sapiens
gccttactcacctctct

SEQ ID NO: 3875356 - DNA, 21 bp, Homo sapiens
gccttatgtaattattttctt

SEQ ID NO: 3875357 - DNA, 13 bp, Homo sapiens
gccttcagctcta

SEQ ID NO: 3875358 - DNA, 16 bp, Homo sapiens
gccttcagctctacag

SEQ ID NO: 3875359 - DNA, 16 bp, Homo sapiens
gccttcataggcggtc

SEQ ID NO: 3875360 - DNA, 23 bp, Homo sapiens
gccttcataggcggtcatgtgtg

SEQ ID NO: 3875361 - DNA, 16 bp, Homo sapiens
gccttccccttttgcc

SEQ ID NO: 3875362 - DNA, 16 bp, Homo sapiens
gccttccctccccaca

SEQ ID NO: 3875363 - DNA, 14 bp, Homo sapiens
gccttcctcctcca

SEQ ID NO: 3875364 - DNA, 20 bp, Homo sapiens
gccttcctcctccacagtgc

SEQ ID NO: 3875365 - DNA, 18 bp, Homo sapiens
gccttcgatacaccgggc

SEQ ID NO: 3875366 - DNA, 18 bp, Homo sapiens
gccttcttattctcactc

SEQ ID NO: 3875367 - DNA, 23 bp, Homo sapiens
gccttcttattctcactccacca

SEQ ID NO: 3875368 - DNA, 22 bp, Homo sapiens
gccttcttcggggaactcctgg

SEQ ID NO: 3875369 - DNA, 23 bp, Homo sapiens
gccttcttcggggaactcctgga

SEQ ID NO: 3875370 - DNA, 23 bp, Homo sapiens
gccttgagagaaaaagtgcccct

SEQ ID NO: 3875371 - DNA, 16 bp, Homo sapiens
gccttgcccagagatg

SEQ ID NO: 3875372 - DNA, 18 bp, Homo sapiens
gccttgcccgccagcctc

SEQ ID NO: 3875373 - DNA, 17 bp, Homo sapiens
gccttgctttgggcttt

SEQ ID NO: 3875374 - DNA, 13 bp, Homo sapiens
gccttgtgccctg

SEQ ID NO: 3875375 - DNA, 14 bp, Homo sapiens
gccttgtgccctgc

SEQ ID NO: 3875376 - DNA, 16 bp, Homo sapiens
gccttgttctgtcacc

SEQ ID NO: 3875377 - DNA, 14 bp, Homo sapiens
gccttgttttattc

SEQ ID NO: 3875378 - DNA, 21 bp, Homo sapiens
gcctttcccaccgccctccct

SEQ ID NO: 3875379 - DNA, 14 bp, Homo sapiens
gcctttctcccccg

SEQ ID NO: 3875380 - DNA, 17 bp, Homo sapiens
gcctttctctggctcca

SEQ ID NO: 3875381 - DNA, 19 bp, Homo sapiens
gcctttctctggctccaga

SEQ ID NO: 3875382 - DNA, 15 bp, Homo sapiens
gccttttaaaagaaa

SEQ ID NO: 3875383 - DNA, 16 bp, Homo sapiens
gccttttgctgctgct

SEQ ID NO: 3875384 - DNA, 21 bp, Homo sapiens
gccttttgtgtaataagaaag

SEQ ID NO: 3875385 - DNA, 22 bp, Homo sapiens
gcgaaacaacttgtgttctatt

SEQ ID NO: 3875386 - DNA, 12 bp, Homo sapiens
gcgaataaatgt

SEQ ID NO: 3875387 - DNA, 17 bp, Homo sapiens
gcgacttcacaaaatgc

SEQ ID NO: 3875388 - DNA, 21 bp, Homo sapiens
gcgagacccttgcattagaaa

SEQ ID NO: 3875389 - DNA, 15 bp, Homo sapiens
gcgagaggcagagaa

SEQ ID NO: 3875390 - DNA, 13 bp, Homo sapiens
gcgagcacccacg

SEQ ID NO: 3875391 - DNA, 16 bp, Homo sapiens
gcgaggtcaacagaga

SEQ ID NO: 3875392 - DNA, 17 bp, Homo sapiens
gcgaggtcaacagagaa

SEQ ID NO: 3875393 - DNA, 18 bp, Homo sapiens
gcgaggtcaacagagaag

SEQ ID NO: 3875394 - DNA, 21 bp, Homo sapiens
gcgataaaactaaatatatgt

SEQ ID NO: 3875395 - DNA, 15 bp, Homo sapiens
gcgatggtctcagaa

SEQ ID NO: 3875396 - DNA, 16 bp, Homo sapiens
gcgattccctctcacc

SEQ ID NO: 3875397 - DNA, 22 bp, Homo sapiens
gcgattccctctcccaggcccc

SEQ ID NO: 3875398 - DNA, 19 bp, Homo sapiens
gcgattcttgtgcctcagc

SEQ ID NO: 3875399 - DNA, 12 bp, Homo sapiens
gcgcaagcctgt

SEQ ID NO: 3875400 - DNA, 21 bp, Homo sapiens
gcgcaagcctgtaatcccagc

SEQ ID NO: 3875401 - DNA, 22 bp, Homo sapiens
gcgcaagcctgtaatcccagct

SEQ ID NO: 3875402 - DNA, 20 bp, Homo sapiens
gcgcacctatcacccaggct

SEQ ID NO: 3875403 - DNA, 19 bp, Homo sapiens
gcgcagcccgaagcccagt

SEQ ID NO: 3875404 - DNA, 17 bp, Homo sapiens
gcgcatctcttcctgat

SEQ ID NO: 3875405 - DNA, 19 bp, Homo sapiens
gcgccactgagacggcaga

SEQ ID NO: 3875406 - DNA, 20 bp, Homo sapiens
gcgcccattcgtctgtccca

SEQ ID NO: 3875407 - DNA, 22 bp, Homo sapiens
gcgccccaacccgtggaggctg

SEQ ID NO: 3875408 - DNA, 14 bp, Homo sapiens
gcgccctgcagacc

SEQ ID NO: 3875409 - DNA, 16 bp, Homo sapiens
gcgccctgcagaccct

SEQ ID NO: 3875410 - DNA, 18 bp, Homo sapiens
gcgccctgcagaccctgc

SEQ ID NO: 3875411 - DNA, 21 bp, Homo sapiens
gcgcctagtggggtctccctc

SEQ ID NO: 3875412 - DNA, 20 bp, Homo sapiens
gcgcctgccctccctggggt

SEQ ID NO: 3875413 - DNA, 22 bp, Homo sapiens
gcgcctgtgctgaggactccct

SEQ ID NO: 3875414 - DNA, 22 bp, Homo sapiens
gcgcgggaggcaccagctctgt

SEQ ID NO: 3875415 - DNA, 16 bp, Homo sapiens
gcgcgtccttccctaa

SEQ ID NO: 3875416 - DNA, 13 bp, Homo sapiens
gcgcgtctgcccc

SEQ ID NO: 3875417 - DNA, 16 bp, Homo sapiens
gcgctcaggacccagg

SEQ ID NO: 3875418 - DNA, 19 bp, Homo sapiens
gcgctcattttaggcctcc

SEQ ID NO: 3875419 - DNA, 16 bp, Homo sapiens
gcgctcttggtccctg

SEQ ID NO: 3875420 - DNA, 17 bp, Homo sapiens
gcgctcttggtccctgg

SEQ ID NO: 3875421 - DNA, 18 bp, Homo sapiens
gcgctggacagaggggca

SEQ ID NO: 3875422 - DNA, 22 bp, Homo sapiens
gcgctggacgatagcttggagg

SEQ ID NO: 3875423 - DNA, 16 bp, Homo sapiens
gcgctggctcaggaag

SEQ ID NO: 3875424 - DNA, 22 bp, Homo sapiens
gcggagagtacagtgagccaag

SEQ ID NO: 3875425 - DNA, 13 bp, Homo sapiens
gcggaggagctcc

SEQ ID NO: 3875426 - DNA, 17 bp, Homo sapiens
gcggaggcggctccagg

SEQ ID NO: 3875427 - DNA, 13 bp, Homo sapiens
gcggatctcactc

SEQ ID NO: 3875428 - DNA, 17 bp, Homo sapiens
gcggcaggagcaggaac

SEQ ID NO: 3875429 - DNA, 20 bp, Homo sapiens
gcggcaggagcaggaacaga

SEQ ID NO: 3875430 - DNA, 12 bp, Homo sapiens
gcggccgggctg

SEQ ID NO: 3875431 - DNA, 23 bp, Homo sapiens
gcggcctatgacttgggcacccc

SEQ ID NO: 3875432 - DNA, 22 bp, Homo sapiens
gcggctgagtcatgatctccct

SEQ ID NO: 3875433 - DNA, 23 bp, Homo sapiens
gcggctgagtcatgatctccctg

SEQ ID NO: 3875434 - DNA, 20 bp, Homo sapiens
gcggcttcctgtccactctc

SEQ ID NO: 3875435 - DNA, 14 bp, Homo sapiens
gcggcttggccgcc

SEQ ID NO: 3875436 - DNA, 20 bp, Homo sapiens
gcgggaccggtacagaaagg

SEQ ID NO: 3875437 - DNA, 19 bp, Homo sapiens
gcgggaggcaccagctctg

SEQ ID NO: 3875438 - DNA, 19 bp, Homo sapiens
gcgggagtgggggctgtgc

SEQ ID NO: 3875439 - DNA, 16 bp, Homo sapiens
gcgggcaccagaatgc

SEQ ID NO: 3875440 - DNA, 11 bp, Homo sapiens
gcgggcctctt

SEQ ID NO: 3875441 - DNA, 18 bp, Homo sapiens
gcgggcctcttccctcag

SEQ ID NO: 3875442 - DNA, 18 bp, Homo sapiens
gcgggcggaggcggctcc

SEQ ID NO: 3875443 - DNA, 21 bp, Homo sapiens
gcgggcggaggcggctccagg

SEQ ID NO: 3875444 - DNA, 12 bp, Homo sapiens
gcggggcaggag

SEQ ID NO: 3875445 - DNA, 20 bp, Homo sapiens
gcggggcaggaggcctggcc

SEQ ID NO: 3875446 - DNA, 20 bp, Homo sapiens
gcgggggagccaacagcagc

SEQ ID NO: 3875447 - DNA, 16 bp, Homo sapiens
gcgggggagctggaaa

SEQ ID NO: 3875448 - DNA, 14 bp, Homo sapiens
gcgggtctgaagga

SEQ ID NO: 3875449 - DNA, 11 bp, Homo sapiens
gcggtacccca

SEQ ID NO: 3875450 - DNA, 15 bp, Homo sapiens
gcggtcatgtgtgca

SEQ ID NO: 3875451 - DNA, 18 bp, Homo sapiens
gcggtggactgcgctgga

SEQ ID NO: 3875452 - DNA, 13 bp, Homo sapiens
gcggttgcttctg

SEQ ID NO: 3875453 - DNA, 14 bp, Homo sapiens
gcgtaatgggcctg

SEQ ID NO: 3875454 - DNA, 17 bp, Homo sapiens
gcgtaatgggcctgccc

SEQ ID NO: 3875455 - DNA, 19 bp, Homo sapiens
gcgtccctagcagtgaact

SEQ ID NO: 3875456 - DNA, 20 bp, Homo sapiens
gcgtcctgcagaggaccaca

SEQ ID NO: 3875457 - DNA, 16 bp, Homo sapiens
gcgtctaccctgggat

SEQ ID NO: 3875458 - DNA, 20 bp, Homo sapiens
gcgtctcctgtttttctggg

SEQ ID NO: 3875459 - DNA, 13 bp, Homo sapiens
gcgtctgccccac

SEQ ID NO: 3875460 - DNA, 22 bp, Homo sapiens
gcgtgcacatatgggtgctggc

SEQ ID NO: 3875461 - DNA, 23 bp, Homo sapiens
gcgtggaccacccgccctggcag

SEQ ID NO: 3875462 - DNA, 13 bp, Homo sapiens
gcgtggctgtggc

SEQ ID NO: 3875463 - DNA, 15 bp, Homo sapiens
gcgtggctgtggcac

SEQ ID NO: 3875464 - DNA, 18 bp, Homo sapiens
gcgtggctgtggcacaga

SEQ ID NO: 3875465 - DNA, 16 bp, Homo sapiens
gcgtgtgcgtgcgtgt

SEQ ID NO: 3875466 - DNA, 20 bp, Homo sapiens
gccatgatcgagccactgca

SEQ ID NO: 3875467 - DNA, 22 bp, Homo sapiens
gccatgatctgtatttaatggt

SEQ ID NO: 3875468 - DNA, 13 bp, Homo sapiens
gccatgccactgc

SEQ ID NO: 3875469 - DNA, 15 bp, Homo sapiens
gccatgccactgcca

SEQ ID NO: 3875470 - DNA, 16 bp, Homo sapiens
gccatgccactgccag

SEQ ID NO: 3875471 - DNA, 21 bp, Homo sapiens
gccatgccactgccaggcacc

SEQ ID NO: 3875472 - DNA, 22 bp, Homo sapiens
gccatgccactgccaggcacct

SEQ ID NO: 3875473 - DNA, 16 bp, Homo sapiens
gccatgcctcatgcca

SEQ ID NO: 3875474 - DNA, 14 bp, Homo sapiens
gccatgctgaaggg

SEQ ID NO: 3875475 - DNA, 13 bp, Homo sapiens
gccatggctcagg

SEQ ID NO: 3875476 - DNA, 14 bp, Homo sapiens
gccatggctcaggc

SEQ ID NO: 3875477 - DNA, 15 bp, Homo sapiens
gccatggctcaggca

SEQ ID NO: 3875478 - DNA, 23 bp, Homo sapiens
gccatggctcaggcaagcccctc

SEQ ID NO: 3875479 - DNA, 20 bp, Homo sapiens
gccatgggcctgggcctgct

SEQ ID NO: 3875480 - DNA, 19 bp, Homo sapiens
gccatggtgacacacagca

SEQ ID NO: 3875481 - DNA, 15 bp, Homo sapiens
gccatgtcttgttca

SEQ ID NO: 3875482 - DNA, 21 bp, Homo sapiens
gccatgtttagattccaggat

SEQ ID NO: 3875483 - DNA, 14 bp, Homo sapiens
gccattccaacagc

SEQ ID NO: 3875484 - DNA, 22 bp, Homo sapiens
gccattccaagtcaacactctt

SEQ ID NO: 3875485 - DNA, 13 bp, Homo sapiens
gccattcccagcg

SEQ ID NO: 3875486 - DNA, 14 bp, Homo sapiens
gccattttcttgcc

SEQ ID NO: 3875487 - DNA, 19 bp, Homo sapiens
gcccaaccctgcccacttc

SEQ ID NO: 3875488 - DNA, 24 bp, Homo sapiens
gcccaacctgctctcctcttgcca

SEQ ID NO: 3875489 - DNA, 22 bp, Homo sapiens
gcccaagaggactgagactggc

SEQ ID NO: 3875490 - DNA, 21 bp, Homo sapiens
gcccaagaggtctgagccctg

SEQ ID NO: 3875491 - DNA, 15 bp, Homo sapiens
gcccaagcctggtct

SEQ ID NO: 3875492 - DNA, 12 bp, Homo sapiens
gcccaagtgcca

SEQ ID NO: 3875493 - DNA, 15 bp, Homo sapiens
gcccaagtgccatcc

SEQ ID NO: 3875494 - DNA, 18 bp, Homo sapiens
gcccaagtgccatcccac

SEQ ID NO: 3875495 - DNA, 19 bp, Homo sapiens
gcccaagtgccatcccaca

SEQ ID NO: 3875496 - DNA, 22 bp, Homo sapiens
gcccaagtgccatcccacattc

SEQ ID NO: 3875497 - DNA, 22 bp, Homo sapiens
gcccaatgctttgggaggccaa

SEQ ID NO: 3875498 - DNA, 21 bp, Homo sapiens
gcccacaaactgatttctcac

SEQ ID NO: 3875499 - DNA, 17 bp, Homo sapiens
gcccacaaaggggagaa

SEQ ID NO: 3875500 - DNA, 22 bp, Homo sapiens
gcccacaagccttactcacctc

SEQ ID NO: 3875501 - DNA, 17 bp, Homo sapiens
gcccacagctcccaccc

SEQ ID NO: 3875502 - DNA, 19 bp, Homo sapiens
gcccacagggaaccctgct

SEQ ID NO: 3875503 - DNA, 14 bp, Homo sapiens
gcccacatcccagg

SEQ ID NO: 3875504 - DNA, 21 bp, Homo sapiens
gcccacttagccgtccatggc

SEQ ID NO: 3875505 - DNA, 17 bp, Homo sapiens
gcccagagatgcctcca

SEQ ID NO: 3875506 - DNA, 18 bp, Homo sapiens
gcccagagatgcctccac

SEQ ID NO: 3875507 - DNA, 14 bp, Homo sapiens
gcccagcccagctg

SEQ ID NO: 3875508 - DNA, 14 bp, Homo sapiens
gcccagcctaggcc

SEQ ID NO: 3875509 - DNA, 15 bp, Homo sapiens
gcccagcctaggccc

SEQ ID NO: 3875510 - DNA, 11 bp, Homo sapiens
gcccagcctgt

SEQ ID NO: 3875511 - DNA, 21 bp, Homo sapiens
gcccagctacattcctcagct

SEQ ID NO: 3875512 - DNA, 20 bp, Homo sapiens
gcccagctatggccccaggg

SEQ ID NO: 3875513 - DNA, 21 bp, Homo sapiens
gcccagctatggccccagggt

SEQ ID NO: 3875514 - DNA, 19 bp, Homo sapiens
gcccagctgtagccatggc

SEQ ID NO: 3875515 - DNA, 20 bp, Homo sapiens
gcccaggagctgagtcacct

SEQ ID NO: 3875516 - DNA, 21 bp, Homo sapiens
gcccaggccgttccccttggc

SEQ ID NO: 3875517 - DNA, 17 bp, Homo sapiens
gcccaggcctgcctgtt

SEQ ID NO: 3875518 - DNA, 13 bp, Homo sapiens
gcccaggctctgg

SEQ ID NO: 3875519 - DNA, 17 bp, Homo sapiens
gcccaggctctgggaag

SEQ ID NO: 3875520 - DNA, 22 bp, Homo sapiens
gcccaggctctgggaaggggtg

SEQ ID NO: 3875521 - DNA, 19 bp, Homo sapiens
gcccaggctggagtgcagt

SEQ ID NO: 3875522 - DNA, 20 bp, Homo sapiens
gcccaggctggagtgcagtg

SEQ ID NO: 3875523 - DNA, 15 bp, Homo sapiens
gcccaggctggcctg

SEQ ID NO: 3875524 - DNA, 21 bp, Homo sapiens
gcccagggaggccgaagctaa

SEQ ID NO: 3875525 - DNA, 19 bp, Homo sapiens
gcccaggggcccacaggga

SEQ ID NO: 3875526 - DNA, 16 bp, Homo sapiens
gcccagtgacctgacc

SEQ ID NO: 3875527 - DNA, 20 bp, Homo sapiens
gcccataaggccagaaactc

SEQ ID NO: 3875528 - DNA, 20 bp, Homo sapiens
gcccataatagttagccctc

SEQ ID NO: 3875529 - DNA, 19 bp, Homo sapiens
gcccatacccctgcctggg

SEQ ID NO: 3875530 - DNA, 15 bp, Homo sapiens
gcccataccttctgg

SEQ ID NO: 3875531 - DNA, 14 bp, Homo sapiens
gcccatcaaaatgt

SEQ ID NO: 3875532 - DNA, 23 bp, Homo sapiens
gcccatcatacgcatggtcctgg

SEQ ID NO: 3875533 - DNA, 17 bp, Homo sapiens
gcccatctcaggtgcca

SEQ ID NO: 3875534 - DNA, 20 bp, Homo sapiens
gcccatctcaggtgccactc

SEQ ID NO: 3875535 - DNA, 23 bp, Homo sapiens
gcccatctcaggtgccactccct

SEQ ID NO: 3875536 - DNA, 22 bp, Homo sapiens
gcccatggcctctggccaggca

SEQ ID NO: 3875537 - DNA, 17 bp, Homo sapiens
gcccatgtgtcccctca

SEQ ID NO: 3875538 - DNA, 18 bp, Homo sapiens
gcccattcgtctgtccca

SEQ ID NO: 3875539 - DNA, 22 bp, Homo sapiens
gcccattcgtctgtcccagagc

SEQ ID NO: 3875540 - DNA, 19 bp, Homo sapiens
gcccattctctctcctgtc

SEQ ID NO: 3875541 - DNA, 20 bp, Homo sapiens
gcccattctctctcctgtcc

SEQ ID NO: 3875542 - DNA, 18 bp, Homo sapiens
gccccaaaccagggtgca

SEQ ID NO: 3875543 - DNA, 15 bp, Homo sapiens
gccccaacccgtgga

SEQ ID NO: 3875544 - DNA, 23 bp, Homo sapiens
gccccaacccgtggaggctgctc

SEQ ID NO: 3875545 - DNA, 14 bp, Homo sapiens
gccccaactcctgg

SEQ ID NO: 3875546 - DNA, 22 bp, Homo sapiens
gccccaactcctggaagctgtg

SEQ ID NO: 3875547 - DNA, 17 bp, Homo sapiens
gccccaactccttccag

SEQ ID NO: 3875548 - DNA, 14 bp, Homo sapiens
gccccaagcagcca

SEQ ID NO: 3875549 - DNA, 16 bp, Homo sapiens
gccccaagcagccagc

SEQ ID NO: 3875550 - DNA, 19 bp, Homo sapiens
gccccaaggggtttctgtt

SEQ ID NO: 3875551 - DNA, 17 bp, Homo sapiens
gccagagctggaaggca

SEQ ID NO: 3875552 - DNA, 21 bp, Homo sapiens
gccagagctggaaggcagggc

SEQ ID NO: 3875553 - DNA, 23 bp, Homo sapiens
gccagagctggaaggcagggcag

SEQ ID NO: 3875554 - DNA, 20 bp, Homo sapiens
gccagaggttttaggaaacc

SEQ ID NO: 3875555 - DNA, 22 bp, Homo sapiens
gccagcaatgatgtccagaaga

SEQ ID NO: 3875556 - DNA, 15 bp, Homo sapiens
gccagcacaggggcc

SEQ ID NO: 3875557 - DNA, 13 bp, Homo sapiens
gccagcaccctct

SEQ ID NO: 3875558 - DNA, 18 bp, Homo sapiens
gccagcaccctctcctgg

SEQ ID NO: 3875559 - DNA, 19 bp, Homo sapiens
gccagcaccctctcctggg

SEQ ID NO: 3875560 - DNA, 21 bp, Homo sapiens
gccagcaccctctcctggggg

SEQ ID NO: 3875561 - DNA, 19 bp, Homo sapiens
gccagccagtcttgcctag

SEQ ID NO: 3875562 - DNA, 21 bp, Homo sapiens
gccagccagtcttgcctaggc

SEQ ID NO: 3875563 - DNA, 14 bp, Homo sapiens
gccagccctacatc

SEQ ID NO: 3875564 - DNA, 18 bp, Homo sapiens
gccagccctacatcttca

SEQ ID NO: 3875565 - DNA, 21 bp, Homo sapiens
gccagccctccctgtcctcct

SEQ ID NO: 3875566 - DNA, 16 bp, Homo sapiens
gccagccctgcctgga

SEQ ID NO: 3875567 - DNA, 17 bp, Homo sapiens
gccagccctgcctggag

SEQ ID NO: 3875568 - DNA, 18 bp, Homo sapiens
gccagccctgcctggagg

SEQ ID NO: 3875569 - DNA, 19 bp, Homo sapiens
gccagccgccctgggctgt

SEQ ID NO: 3875570 - DNA, 23 bp, Homo sapiens
gccagccggggcgagtggcacgt

SEQ ID NO: 3875571 - DNA, 16 bp, Homo sapiens
gccagccggtgcctgg

SEQ ID NO: 3875572 - DNA, 18 bp, Homo sapiens
gccagcctcagctcagcc

SEQ ID NO: 3875573 - DNA, 16 bp, Homo sapiens
gccagcctggcctcct

SEQ ID NO: 3875574 - DNA, 17 bp, Homo sapiens
gccagcctggcctcctg

SEQ ID NO: 3875575 - DNA, 19 bp, Homo sapiens
gccagcctggcctcctgcc

SEQ ID NO: 3875576 - DNA, 13 bp, Homo sapiens
gccagcctgggac

SEQ ID NO: 3875577 - DNA, 17 bp, Homo sapiens
gccagccttgcactgtg

SEQ ID NO: 3875578 - DNA, 20 bp, Homo sapiens
gccagccttgcactgtgggg

SEQ ID NO: 3875579 - DNA, 18 bp, Homo sapiens
gccagctgcatctactca

SEQ ID NO: 3875580 - DNA, 20 bp, Homo sapiens
gccagctgccgaccagagcc

SEQ ID NO: 3875581 - DNA, 12 bp, Homo sapiens
gccagctggtgc

SEQ ID NO: 3875582 - DNA, 13 bp, Homo sapiens
gccagctggtgct

SEQ ID NO: 3875583 - DNA, 16 bp, Homo sapiens
gccagctggtgctgca

SEQ ID NO: 3875584 - DNA, 20 bp, Homo sapiens
gccagctggtgctgcaagga

SEQ ID NO: 3875585 - DNA, 21 bp, Homo sapiens
gccagctggtgctgcaaggaa

SEQ ID NO: 3875586 - DNA, 11 bp, Homo sapiens
gccaggacacc

SEQ ID NO: 3875587 - DNA, 15 bp, Homo sapiens
gccaggacacctgcc

SEQ ID NO: 3875588 - DNA, 16 bp, Homo sapiens
gccaggacacctgccc

SEQ ID NO: 3875589 - DNA, 17 bp, Homo sapiens
gccaggacacctgcccc

SEQ ID NO: 3875590 - DNA, 18 bp, Homo sapiens
gccaggacacctgcccca

SEQ ID NO: 3875591 - DNA, 23 bp, Homo sapiens
gccaggaccagtcccagagcagg

SEQ ID NO: 3875592 - DNA, 17 bp, Homo sapiens
gccaggactccccaggc

SEQ ID NO: 3875593 - DNA, 21 bp, Homo sapiens
gccaggactccccaggccagg

SEQ ID NO: 3875594 - DNA, 22 bp, Homo sapiens
gccaggactccccaggccaggc

SEQ ID NO: 3875595 - DNA, 13 bp, Homo sapiens
gccaggagagaga

SEQ ID NO: 3875596 - DNA, 20 bp, Homo sapiens
gccaggagcaaatgtttctg

SEQ ID NO: 3875597 - DNA, 22 bp, Homo sapiens
gccaggagcaaatgtttctgca

SEQ ID NO: 3875598 - DNA, 14 bp, Homo sapiens
gccaggagctcagc

SEQ ID NO: 3875599 - DNA, 16 bp, Homo sapiens
gccaggagctggagga

SEQ ID NO: 3875600 - DNA, 19 bp, Homo sapiens
gccaggagggacaaaggag

SEQ ID NO: 3875601 - DNA, 19 bp, Homo sapiens
gccaggaggtcctcctctc

SEQ ID NO: 3875602 - DNA, 16 bp, Homo sapiens
gccaggagtctgtgct

SEQ ID NO: 3875603 - DNA, 19 bp, Homo sapiens
gccaggagtctgtgctctt

SEQ ID NO: 3875604 - DNA, 17 bp, Homo sapiens
gccaggatcccaagcgt

SEQ ID NO: 3875605 - DNA, 17 bp, Homo sapiens
gccaggattcctctctc

SEQ ID NO: 3875606 - DNA, 19 bp, Homo sapiens
gccaggcaccccctggaga

SEQ ID NO: 3875607 - DNA, 21 bp, Homo sapiens
gccaggcaccccctggagaga

SEQ ID NO: 3875608 - DNA, 16 bp, Homo sapiens
gccaggcacctggcct

SEQ ID NO: 3875609 - DNA, 17 bp, Homo sapiens
gccaggcacctggcctg

SEQ ID NO: 3875610 - DNA, 18 bp, Homo sapiens
gccaggcacctggcctgc

SEQ ID NO: 3875611 - DNA, 22 bp, Homo sapiens
gccaggcacctggcctgctggg

SEQ ID NO: 3875612 - DNA, 14 bp, Homo sapiens
gccaggcaggggtg

SEQ ID NO: 3875613 - DNA, 17 bp, Homo sapiens
gccaggcccatctcagg

SEQ ID NO: 3875614 - DNA, 22 bp, Homo sapiens
gccaggcccatctcaggtgcca

SEQ ID NO: 3875615 - DNA, 15 bp, Homo sapiens
gccaggctctgcctg

SEQ ID NO: 3875616 - DNA, 15 bp, Homo sapiens
gccaggctgtaagca

SEQ ID NO: 3875617 - DNA, 21 bp, Homo sapiens
gccagggcaggctaccccttc

SEQ ID NO: 3875618 - DNA, 15 bp, Homo sapiens
gccagggcctggtgt

SEQ ID NO: 3875619 - DNA, 16 bp, Homo sapiens
gccaggtaatgaggga

SEQ ID NO: 3875620 - DNA, 23 bp, Homo sapiens
gccaggttagcctttgccctgtc

SEQ ID NO: 3875621 - DNA, 23 bp, Homo sapiens
gccagtacagagaaattctgtgg

SEQ ID NO: 3875622 - DNA, 14 bp, Homo sapiens
gccagtatttttta

SEQ ID NO: 3875623 - DNA, 13 bp, Homo sapiens
gccagtctgggct

SEQ ID NO: 3875624 - DNA, 14 bp, Homo sapiens
gccagtctgggctg

SEQ ID NO: 3875625 - DNA, 21 bp, Homo sapiens
gccagtgagggctgggcccac

SEQ ID NO: 3875626 - DNA, 17 bp, Homo sapiens
gccagtgccttacctcc

SEQ ID NO: 3875627 - DNA, 19 bp, Homo sapiens
gccagtgccttacctcctg

SEQ ID NO: 3875628 - DNA, 23 bp, Homo sapiens
gccagtgccttacctcctgccca

SEQ ID NO: 3875629 - DNA, 18 bp, Homo sapiens
gccagtggaaattcaggt

SEQ ID NO: 3875630 - DNA, 15 bp, Homo sapiens
gccatcacaagggga

SEQ ID NO: 3875631 - DNA, 20 bp, Homo sapiens
gccatccgggacgcttccag

SEQ ID NO: 3875632 - DNA, 23 bp, Homo sapiens
gccatccgggacgcttccagacc

SEQ ID NO: 3875633 - DNA, 14 bp, Homo sapiens
gccatctgttttca

SEQ ID NO: 3875634 - DNA, 16 bp, Homo sapiens
gccatctgttttcaac

SEQ ID NO: 3875635 - DNA, 20 bp, Homo sapiens
gccatgaccagttctggcca

SEQ ID NO: 3875636 - DNA, 19 bp, Homo sapiens
gcatccgtagttccctgaa

SEQ ID NO: 3875637 - DNA, 13 bp, Homo sapiens
gcatcctgcttcc

SEQ ID NO: 3875638 - DNA, 13 bp, Homo sapiens
gcatccttctgcc

SEQ ID NO: 3875639 - DNA, 21 bp, Homo sapiens
gcatcgtgacccttcagggcc

SEQ ID NO: 3875640 - DNA, 15 bp, Homo sapiens
gcatctcagcccaca

SEQ ID NO: 3875641 - DNA, 17 bp, Homo sapiens
gcatctgactcacaaga

SEQ ID NO: 3875642 - DNA, 20 bp, Homo sapiens
gcatcttctggagtctccag

SEQ ID NO: 3875643 - DNA, 16 bp, Homo sapiens
gcatgatattttcaga

SEQ ID NO: 3875644 - DNA, 16 bp, Homo sapiens
gcatgatttatatatg

SEQ ID NO: 3875645 - DNA, 21 bp, Homo sapiens
gcatgatttatatatggcata

SEQ ID NO: 3875646 - DNA, 13 bp, Homo sapiens
gcatgattttata

SEQ ID NO: 3875647 - DNA, 19 bp, Homo sapiens
gcatgattttatacatagt

SEQ ID NO: 3875648 - DNA, 14 bp, Homo sapiens
gcatgcaataatgt

SEQ ID NO: 3875649 - DNA, 18 bp, Homo sapiens
gcatgcaataatgtgcaa

SEQ ID NO: 3875650 - DNA, 17 bp, Homo sapiens
gcatgcacagctgcttg

SEQ ID NO: 3875651 - DNA, 11 bp, Homo sapiens
gcatgcctctg

SEQ ID NO: 3875652 - DNA, 13 bp, Homo sapiens
gcatgcgcaggct

SEQ ID NO: 3875653 - DNA, 22 bp, Homo sapiens
gcatgctctctgcagccagccc

SEQ ID NO: 3875654 - DNA, 23 bp, Homo sapiens
gcatgctctctgcagccagccca

SEQ ID NO: 3875655 - DNA, 13 bp, Homo sapiens
gcatgctctggaa

SEQ ID NO: 3875656 - DNA, 20 bp, Homo sapiens
gcatgctctggaagcctgga

SEQ ID NO: 3875657 - DNA, 24 bp, Homo sapiens
gcatgctggcctcccaataaagct

SEQ ID NO: 3875658 - DNA, 17 bp, Homo sapiens
gcatggaatttgtaagt

SEQ ID NO: 3875659 - DNA, 23 bp, Homo sapiens
gcatggacaccccttatccagga

SEQ ID NO: 3875660 - DNA, 21 bp, Homo sapiens
gcatggagagcctcttagtga

SEQ ID NO: 3875661 - DNA, 13 bp, Homo sapiens
gcatggccctggg

SEQ ID NO: 3875662 - DNA, 16 bp, Homo sapiens
gcatggccctggggtc

SEQ ID NO: 3875663 - DNA, 22 bp, Homo sapiens
gcatggccctggggtcccacga

SEQ ID NO: 3875664 - DNA, 19 bp, Homo sapiens
gcatgggagggagggagag

SEQ ID NO: 3875665 - DNA, 23 bp, Homo sapiens
gcatggtcccacatccctgggcc

SEQ ID NO: 3875666 - DNA, 13 bp, Homo sapiens
gcatggtgcagtt

SEQ ID NO: 3875667 - DNA, 19 bp, Homo sapiens
gcatggtggcgcaagcctg

SEQ ID NO: 3875668 - DNA, 17 bp, Homo sapiens
gcatggttccttccctg

SEQ ID NO: 3875669 - DNA, 18 bp, Homo sapiens
gcatggttccttccctgg

SEQ ID NO: 3875670 - DNA, 17 bp, Homo sapiens
gcatgtaaaatgcagtc

SEQ ID NO: 3875671 - DNA, 14 bp, Homo sapiens
gcatgtaggagaat

SEQ ID NO: 3875672 - DNA, 20 bp, Homo sapiens
gcatgtatgtgcacatgtgt

SEQ ID NO: 3875673 - DNA, 19 bp, Homo sapiens
gcatgtattatcacatcaa

SEQ ID NO: 3875674 - DNA, 16 bp, Homo sapiens
gcatgtgccagttggg

SEQ ID NO: 3875675 - DNA, 14 bp, Homo sapiens
gcatgtgtgcctgt

SEQ ID NO: 3875676 - DNA, 16 bp, Homo sapiens
gcatgtgtgcctgtgg

SEQ ID NO: 3875677 - DNA, 12 bp, Homo sapiens
gcatgtgtgtat

SEQ ID NO: 3875678 - DNA, 15 bp, Homo sapiens
gcatgtgtgtgtctg

SEQ ID NO: 3875679 - DNA, 12 bp, Homo sapiens
gcatgtttactt

SEQ ID NO: 3875680 - DNA, 13 bp, Homo sapiens
gcattaattatta

SEQ ID NO: 3875681 - DNA, 17 bp, Homo sapiens
gcattacgtgagccagg

SEQ ID NO: 3875682 - DNA, 21 bp, Homo sapiens
gcattagaaatagacagtata

SEQ ID NO: 3875683 - DNA, 15 bp, Homo sapiens
gcattatttaatgtt

SEQ ID NO: 3875684 - DNA, 17 bp, Homo sapiens
gcattcagcacacccca

SEQ ID NO: 3875685 - DNA, 11 bp, Homo sapiens
gcattccatga

SEQ ID NO: 3875686 - DNA, 16 bp, Homo sapiens
gcattccccgctgccc

SEQ ID NO: 3875687 - DNA, 13 bp, Homo sapiens
gcattccctgagt

SEQ ID NO: 3875688 - DNA, 21 bp, Homo sapiens
gcattccctgagtcaccagga

SEQ ID NO: 3875689 - DNA, 22 bp, Homo sapiens
gcattccctgagtcaccaggaa

SEQ ID NO: 3875690 - DNA, 16 bp, Homo sapiens
gcattctgagctgggc

SEQ ID NO: 3875691 - DNA, 13 bp, Homo sapiens
gcattggtctgct

SEQ ID NO: 3875692 - DNA, 15 bp, Homo sapiens
gcattggtctgctga

SEQ ID NO: 3875693 - DNA, 14 bp, Homo sapiens
gcattgtcttgtgg

SEQ ID NO: 3875694 - DNA, 20 bp, Homo sapiens
gcatttagttttatggcatg

SEQ ID NO: 3875695 - DNA, 16 bp, Homo sapiens
gcatttataaatgtgt

SEQ ID NO: 3875696 - DNA, 19 bp, Homo sapiens
gcatttataaatgtgtggt

SEQ ID NO: 3875697 - DNA, 13 bp, Homo sapiens
gcatttccacact

SEQ ID NO: 3875698 - DNA, 19 bp, Homo sapiens
gcatttgccctgtggattc

SEQ ID NO: 3875699 - DNA, 15 bp, Homo sapiens
gcatttgtgtcatct

SEQ ID NO: 3875700 - DNA, 16 bp, Homo sapiens
gcattttcctcgccta

SEQ ID NO: 3875701 - DNA, 17 bp, Homo sapiens
gccaaacacactgtaaa

SEQ ID NO: 3875702 - DNA, 14 bp, Homo sapiens
gccaaacactccac

SEQ ID NO: 3875703 - DNA, 15 bp, Homo sapiens
gccaaagtgcagccc

SEQ ID NO: 3875704 - DNA, 18 bp, Homo sapiens
gccaaagtgcagcccttc

SEQ ID NO: 3875705 - DNA, 22 bp, Homo sapiens
gccaaataaaacctcagggaca

SEQ ID NO: 3875706 - DNA, 14 bp, Homo sapiens
gccaaatgcacaag

SEQ ID NO: 3875707 - DNA, 19 bp, Homo sapiens
gccaaattatttgtgtaat

SEQ ID NO: 3875708 - DNA, 16 bp, Homo sapiens
gccaacaggtggcagg

SEQ ID NO: 3875709 - DNA, 19 bp, Homo sapiens
gccaacaggtggcaggacc

SEQ ID NO: 3875710 - DNA, 14 bp, Homo sapiens
gccaacctgatgcc

SEQ ID NO: 3875711 - DNA, 17 bp, Homo sapiens
gccaacctgatgcccct

SEQ ID NO: 3875712 - DNA, 20 bp, Homo sapiens
gccaactcactcttatgaaa

SEQ ID NO: 3875713 - DNA, 21 bp, Homo sapiens
gccaactcactcttatgaaat

SEQ ID NO: 3875714 - DNA, 13 bp, Homo sapiens
gccaactgccccg

SEQ ID NO: 3875715 - DNA, 20 bp, Homo sapiens
gccaacttgtaaatacacca

SEQ ID NO: 3875716 - DNA, 17 bp, Homo sapiens
gccaagaccccagcttc

SEQ ID NO: 3875717 - DNA, 12 bp, Homo sapiens
gccaagacttgg

SEQ ID NO: 3875718 - DNA, 18 bp, Homo sapiens
gccaagacttggcaacag

SEQ ID NO: 3875719 - DNA, 22 bp, Homo sapiens
gccaagcacctagcctcgctct

SEQ ID NO: 3875720 - DNA, 19 bp, Homo sapiens
gccaagcccacctgcacgt

SEQ ID NO: 3875721 - DNA, 21 bp, Homo sapiens
gccaagccctccccatcccat

SEQ ID NO: 3875722 - DNA, 18 bp, Homo sapiens
gcacccttctttcctctt

SEQ ID NO: 3875723 - DNA, 16 bp, Homo sapiens
gcaccggcgctgcagg

SEQ ID NO: 3875724 - DNA, 17 bp, Homo sapiens
gcaccggcgctgcaggt

SEQ ID NO: 3875725 - DNA, 17 bp, Homo sapiens
gcaccgtcatggcttaa

SEQ ID NO: 3875726 - DNA, 16 bp, Homo sapiens
gcacctagtccagtga

SEQ ID NO: 3875727 - DNA, 16 bp, Homo sapiens
gcacctcagacaatcc

SEQ ID NO: 3875728 - DNA, 23 bp, Homo sapiens
gcacctcccagtttgctgggttt

SEQ ID NO: 3875729 - DNA, 13 bp, Homo sapiens
gcacctcccccca

SEQ ID NO: 3875730 - DNA, 23 bp, Homo sapiens
gcacctccccccactgcaggccc

SEQ ID NO: 3875731 - DNA, 13 bp, Homo sapiens
gcacctcctgaga

SEQ ID NO: 3875732 - DNA, 16 bp, Homo sapiens
gcacctgaaccccatg

SEQ ID NO: 3875733 - DNA, 18 bp, Homo sapiens
gcacctgaaccccatggg

SEQ ID NO: 3875734 - DNA, 19 bp, Homo sapiens
gcacctgccgacctcgtcc

SEQ ID NO: 3875735 - DNA, 22 bp, Homo sapiens
gcacctgcgagaggtccctgct

SEQ ID NO: 3875736 - DNA, 23 bp, Homo sapiens
gcacctgctggaaaccacacttc

SEQ ID NO: 3875737 - DNA, 12 bp, Homo sapiens
gcacctggcctg

SEQ ID NO: 3875738 - DNA, 14 bp, Homo sapiens
gcacctggcctgct

SEQ ID NO: 3875739 - DNA, 19 bp, Homo sapiens
gcacctgggccctggggcc

SEQ ID NO: 3875740 - DNA, 21 bp, Homo sapiens
gcaccttaatattattggggt

SEQ ID NO: 3875741 - DNA, 18 bp, Homo sapiens
gcaccttaccaactttct

SEQ ID NO: 3875742 - DNA, 20 bp, Homo sapiens
gcaccttttataccagagac

SEQ ID NO: 3875743 - DNA, 16 bp, Homo sapiens
gcacgaacccacctgc

SEQ ID NO: 3875744 - DNA, 17 bp, Homo sapiens
gcacgaacccacctgct

SEQ ID NO: 3875745 - DNA, 18 bp, Homo sapiens
gcacgcaacccttgctgc

SEQ ID NO: 3875746 - DNA, 14 bp, Homo sapiens
gcacggagagaagg

SEQ ID NO: 3875747 - DNA, 14 bp, Homo sapiens
gcacggcggcaggg

SEQ ID NO: 3875748 - DNA, 14 bp, Homo sapiens
gcacgtcccatgtg

SEQ ID NO: 3875749 - DNA, 22 bp, Homo sapiens
gcactaaaaagtggctaattca

SEQ ID NO: 3875750 - DNA, 21 bp, Homo sapiens
gcactacatgtggtttataga

SEQ ID NO: 3875751 - DNA, 14 bp, Homo sapiens
gcactagcctgtga

SEQ ID NO: 3875752 - DNA, 19 bp, Homo sapiens
gcactcacccatgtgccaa

SEQ ID NO: 3875753 - DNA, 22 bp, Homo sapiens
gcactcagaaaagaaaaccatt

SEQ ID NO: 3875754 - DNA, 22 bp, Homo sapiens
gcactcagtctagtgaagatgt

SEQ ID NO: 3875755 - DNA, 13 bp, Homo sapiens
gcactccatggcc

SEQ ID NO: 3875756 - DNA, 15 bp, Homo sapiens
gcactccctaagaaa

SEQ ID NO: 3875757 - DNA, 18 bp, Homo sapiens
gcactccctaagaaaccc

SEQ ID NO: 3875758 - DNA, 19 bp, Homo sapiens
gcactcctcggtactccca

SEQ ID NO: 3875759 - DNA, 20 bp, Homo sapiens
gcactcctcggtactcccat

SEQ ID NO: 3875760 - DNA, 16 bp, Homo sapiens
gcactcgagaccatcc

SEQ ID NO: 3875761 - DNA, 17 bp, Homo sapiens
gcactcgagaccatcct

SEQ ID NO: 3875762 - DNA, 20 bp, Homo sapiens
gcactgacccacagcctctg

SEQ ID NO: 3875763 - DNA, 16 bp, Homo sapiens
gcactgacccttccag

SEQ ID NO: 3875764 - DNA, 21 bp, Homo sapiens
gcactgacccttccagacata

SEQ ID NO: 3875765 - DNA, 18 bp, Homo sapiens
gcactgacttctaagtaa

SEQ ID NO: 3875766 - DNA, 17 bp, Homo sapiens
gcactgaggaccagcca

SEQ ID NO: 3875767 - DNA, 16 bp, Homo sapiens
gcactgagggccacac

SEQ ID NO: 3875768 - DNA, 20 bp, Homo sapiens
gcactgagggccacactatt

SEQ ID NO: 3875769 - DNA, 17 bp, Homo sapiens
gcactgatcaatccttc

SEQ ID NO: 3875770 - DNA, 20 bp, Homo sapiens
gcactgatttcacaacagat

SEQ ID NO: 3875771 - DNA, 21 bp, Homo sapiens
gcactgcagatagccagacac

SEQ ID NO: 3875772 - DNA, 12 bp, Homo sapiens
gcactgctgccc

SEQ ID NO: 3875773 - DNA, 15 bp, Homo sapiens
gcactgctgcccagc

SEQ ID NO: 3875774 - DNA, 13 bp, Homo sapiens
gcactggccagag

SEQ ID NO: 3875775 - DNA, 15 bp, Homo sapiens
gcactggccagagag

SEQ ID NO: 3875776 - DNA, 19 bp, Homo sapiens
gcactggccagagagggcc

SEQ ID NO: 3875777 - DNA, 20 bp, Homo sapiens
gcactggccagagagggccc

SEQ ID NO: 3875778 - DNA, 22 bp, Homo sapiens
gcactggccagagagggcccag

SEQ ID NO: 3875779 - DNA, 23 bp, Homo sapiens
gcactgggatgagccgctgtgag

SEQ ID NO: 3875780 - DNA, 23 bp, Homo sapiens
gcactggtggcccgacagcctgg

SEQ ID NO: 3875781 - DNA, 15 bp, Homo sapiens
gcactgtcaagatga

SEQ ID NO: 3875782 - DNA, 21 bp, Homo sapiens
gcacttagcccaagaggtctg

SEQ ID NO: 3875783 - DNA, 17 bp, Homo sapiens
gcacttgcgtcctgcag

SEQ ID NO: 3875784 - DNA, 18 bp, Homo sapiens
gcacttggagacttgtat

SEQ ID NO: 3875785 - DNA, 21 bp, Homo sapiens
gcacttggggcaccttgctcc

SEQ ID NO: 3875786 - DNA, 17 bp, Homo sapiens
gcacttgtcactatgct

SEQ ID NO: 3875787 - DNA, 22 bp, Homo sapiens
gcacttgttccttctgcttctc

SEQ ID NO: 3875788 - DNA, 21 bp, Homo sapiens
gcactttaaccctctcttccc

SEQ ID NO: 3875789 - DNA, 23 bp, Homo sapiens
gcactttaaccctctcttcccta

SEQ ID NO: 3875790 - DNA, 15 bp, Homo sapiens
gcactttataaaagc

SEQ ID NO: 3875791 - DNA, 14 bp, Homo sapiens
gcacttttctgtgt

SEQ ID NO: 3875792 - DNA, 22 bp, Homo sapiens
gcagaaaacggagagtgcttgg

SEQ ID NO: 3875793 - DNA, 19 bp, Homo sapiens
gcagaaaagaggagaccct

SEQ ID NO: 3875794 - DNA, 15 bp, Homo sapiens
gcagaaaagcacctg

SEQ ID NO: 3875795 - DNA, 16 bp, Homo sapiens
gcagaaaagcacctgc

SEQ ID NO: 3875796 - DNA, 18 bp, Homo sapiens
gcagaaaagcacctgccg

SEQ ID NO: 3875797 - DNA, 16 bp, Homo sapiens
gcagaaaagtgcttag

SEQ ID NO: 3875798 - DNA, 17 bp, Homo sapiens
gcagaaacgaagccatc

SEQ ID NO: 3875799 - DNA, 23 bp, Homo sapiens
gcagaaacgaagccatctttctt

SEQ ID NO: 3875800 - DNA, 12 bp, Homo sapiens
gcagaaataaaa

SEQ ID NO: 3875801 - DNA, 24 bp, Homo sapiens
gcagaacggagccccaggcctctg

SEQ ID NO: 3875802 - DNA, 23 bp, Homo sapiens
gcagaagaattgaacccaggagg

SEQ ID NO: 3875803 - DNA, 22 bp, Homo sapiens
gcagacagagaaatgtgaaggg

SEQ ID NO: 3875804 - DNA, 20 bp, Homo sapiens
gcagaccgggggccagacac

SEQ ID NO: 3875805 - DNA, 22 bp, Homo sapiens
gcagaccgggggccagacacag

SEQ ID NO: 3875806 - DNA, 16 bp, Homo sapiens
gcagactcctcagatc

SEQ ID NO: 3875807 - DNA, 15 bp, Homo sapiens
gcaggggtctgagcc

SEQ ID NO: 3875808 - DNA, 19 bp, Homo sapiens
gcaggggtgggagagccag

SEQ ID NO: 3875809 - DNA, 20 bp, Homo sapiens
gcaggggtgggagagccagc

SEQ ID NO: 3875810 - DNA, 13 bp, Homo sapiens
gcagggtcttgct

SEQ ID NO: 3875811 - DNA, 23 bp, Homo sapiens
gcaggtacttcctcctgatggcc

SEQ ID NO: 3875812 - DNA, 15 bp, Homo sapiens
gcaggtcctgcccat

SEQ ID NO: 3875813 - DNA, 16 bp, Homo sapiens
gcaggtcctgcccatg

SEQ ID NO: 3875814 - DNA, 21 bp, Homo sapiens
gcaggtcctgcccatgtgtcc

SEQ ID NO: 3875815 - DNA, 15 bp, Homo sapiens
gcaggtgcaagagac

SEQ ID NO: 3875816 - DNA, 18 bp, Homo sapiens
gcaggtgcaagagacaga

SEQ ID NO: 3875817 - DNA, 22 bp, Homo sapiens
gcaggtgcaagagacagagccc

SEQ ID NO: 3875818 - DNA, 15 bp, Homo sapiens
gcaggtgcagatggg

SEQ ID NO: 3875819 - DNA, 16 bp, Homo sapiens
gcaggtggtcctgaga

SEQ ID NO: 3875820 - DNA, 21 bp, Homo sapiens
gcaggtggtcctgagacctga

SEQ ID NO: 3875821 - DNA, 19 bp, Homo sapiens
gcaggtgtggtggctcatg

SEQ ID NO: 3875822 - DNA, 14 bp, Homo sapiens
gcaggttcttgatg

SEQ ID NO: 3875823 - DNA, 18 bp, Homo sapiens
gcagtaagtcttttttga

SEQ ID NO: 3875824 - DNA, 18 bp, Homo sapiens
gcagtacctgggaaagga

SEQ ID NO: 3875825 - DNA, 17 bp, Homo sapiens
gcagtagtctctgtgct

SEQ ID NO: 3875826 - DNA, 13 bp, Homo sapiens
gcagtatgaatga

SEQ ID NO: 3875827 - DNA, 18 bp, Homo sapiens
gcagtatgaatgatgttt

SEQ ID NO: 3875828 - DNA, 13 bp, Homo sapiens
gcagtattgagca

SEQ ID NO: 3875829 - DNA, 16 bp, Homo sapiens
gcagtattttattaaa

SEQ ID NO: 3875830 - DNA, 18 bp, Homo sapiens
gcagtattttattaaagc

SEQ ID NO: 3875831 - DNA, 17 bp, Homo sapiens
gcagtcagggtgggaag

SEQ ID NO: 3875832 - DNA, 19 bp, Homo sapiens
gcagtccagaataagtgct

SEQ ID NO: 3875833 - DNA, 21 bp, Homo sapiens
gcagtccagaataagtgctgt

SEQ ID NO: 3875834 - DNA, 15 bp, Homo sapiens
gcagtccccagccct

SEQ ID NO: 3875835 - DNA, 19 bp, Homo sapiens
gcagtccccagcccttctg

SEQ ID NO: 3875836 - DNA, 15 bp, Homo sapiens
gcagtcccgtggagg

SEQ ID NO: 3875837 - DNA, 20 bp, Homo sapiens
gcagtcccgtggagggtagg

SEQ ID NO: 3875838 - DNA, 23 bp, Homo sapiens
gcagtcccgtggagggtagggga

SEQ ID NO: 3875839 - DNA, 12 bp, Homo sapiens
gcagtcgcagga

SEQ ID NO: 3875840 - DNA, 21 bp, Homo sapiens
gcagtcgcaggatccgctgcc

SEQ ID NO: 3875841 - DNA, 16 bp, Homo sapiens
gcagtctcagaaagcc

SEQ ID NO: 3875842 - DNA, 19 bp, Homo sapiens
gcagtctcagaaagccttc

SEQ ID NO: 3875843 - DNA, 18 bp, Homo sapiens
gcagtctggcctgggcga

SEQ ID NO: 3875844 - DNA, 17 bp, Homo sapiens
gcagtgacaagtggagg

SEQ ID NO: 3875845 - DNA, 16 bp, Homo sapiens
gcagtgactggcaggt

SEQ ID NO: 3875846 - DNA, 18 bp, Homo sapiens
gcagtgactggcaggtgc

SEQ ID NO: 3875847 - DNA, 21 bp, Homo sapiens
gcagtgagaaaaagctcctgt

SEQ ID NO: 3875848 - DNA, 14 bp, Homo sapiens
gcagtgagctgaga

SEQ ID NO: 3875849 - DNA, 20 bp, Homo sapiens
gcagtgagttacagcgagag

SEQ ID NO: 3875850 - DNA, 17 bp, Homo sapiens
gcagtgcccccacccag

SEQ ID NO: 3875851 - DNA, 12 bp, Homo sapiens
gcagtgcctcct

SEQ ID NO: 3875852 - DNA, 20 bp, Homo sapiens
gcagtgcctcgaggcaccgg

SEQ ID NO: 3875853 - DNA, 21 bp, Homo sapiens
gcagtgcctcgaggcaccggc

SEQ ID NO: 3875854 - DNA, 15 bp, Homo sapiens
gcagtgcctgataag

SEQ ID NO: 3875855 - DNA, 21 bp, Homo sapiens
gcagtgggacagggcatggcc

SEQ ID NO: 3875856 - DNA, 16 bp, Homo sapiens
gcagtgggtgggagct

SEQ ID NO: 3875857 - DNA, 21 bp, Homo sapiens
gcagtgttcctatttggggct

SEQ ID NO: 3875858 - DNA, 18 bp, Homo sapiens
gcagttcaaatcctcacc

SEQ ID NO: 3875859 - DNA, 18 bp, Homo sapiens
gcataagattaaaggaag

SEQ ID NO: 3875860 - DNA, 23 bp, Homo sapiens
gcataagattaaaggaaggaaaa

SEQ ID NO: 3875861 - DNA, 19 bp, Homo sapiens
gcataatcagcgccctgga

SEQ ID NO: 3875862 - DNA, 23 bp, Homo sapiens
gcataattcggaagggaaaacag

SEQ ID NO: 3875863 - DNA, 13 bp, Homo sapiens
gcatacatgttca

SEQ ID NO: 3875864 - DNA, 16 bp, Homo sapiens
gcatagaaactgagga

SEQ ID NO: 3875865 - DNA, 19 bp, Homo sapiens
gcatagaaactgaggagta

SEQ ID NO: 3875866 - DNA, 23 bp, Homo sapiens
gcatatttatagcaatccatgtt

SEQ ID NO: 3875867 - DNA, 20 bp, Homo sapiens
gcatatttatattgtatatt

SEQ ID NO: 3875868 - DNA, 14 bp, Homo sapiens
gcatcacttggggt

SEQ ID NO: 3875869 - DNA, 15 bp, Homo sapiens
gcatcacttggggtc

SEQ ID NO: 3875870 - DNA, 18 bp, Homo sapiens
gcatcagaaagggagggc

SEQ ID NO: 3875871 - DNA, 19 bp, Homo sapiens
gcatcagaaagggagggct

SEQ ID NO: 3875872 - DNA, 23 bp, Homo sapiens
gcatcagaaagggagggctctga

SEQ ID NO: 3875873 - DNA, 12 bp, Homo sapiens
gcatcaggcact

SEQ ID NO: 3875874 - DNA, 14 bp, Homo sapiens
gcatcaggcactgg

SEQ ID NO: 3875875 - DNA, 17 bp, Homo sapiens
gcatcaggcactggtgg

SEQ ID NO: 3875876 - DNA, 12 bp, Homo sapiens
gcatcatgcctc

SEQ ID NO: 3875877 - DNA, 13 bp, Homo sapiens
gcatcatgcctct

SEQ ID NO: 3875878 - DNA, 14 bp, Homo sapiens
gcatcatgcctctg

SEQ ID NO: 3875879 - DNA, 15 bp, Homo sapiens
gcatcatgcctctga

SEQ ID NO: 3875880 - DNA, 17 bp, Homo sapiens
gcatcatgcctctgagg

SEQ ID NO: 3875881 - DNA, 20 bp, Homo sapiens
gcatcatgcctctgaggcca

SEQ ID NO: 3875882 - DNA, 19 bp, Homo sapiens
gcatccacccagtgctgcc

SEQ ID NO: 3875883 - DNA, 20 bp, Homo sapiens
gcatccacccagtgctgcca

SEQ ID NO: 3875884 - DNA, 21 bp, Homo sapiens
gcatccacccagtgctgccat

SEQ ID NO: 3875885 - DNA, 22 bp, Homo sapiens
gcatccacccagtgctgccatg

SEQ ID NO: 3875886 - DNA, 12 bp, Homo sapiens
gcatccagcctg

SEQ ID NO: 3875887 - DNA, 12 bp, Homo sapiens
gcatccattcct

SEQ ID NO: 3875888 - DNA, 14 bp, Homo sapiens
gcatcccatccctt

SEQ ID NO: 3875889 - DNA, 15 bp, Homo sapiens
gcatcccatcccttg

SEQ ID NO: 3875890 - DNA, 19 bp, Homo sapiens
gcatcccccagcactgatg

SEQ ID NO: 3875891 - DNA, 19 bp, Homo sapiens
gcatccccttggctgtgag

SEQ ID NO: 3875892 - DNA, 16 bp, Homo sapiens
gcatccgcagcccagg

SEQ ID NO: 3875893 - DNA, 13 bp, Homo sapiens
gcagcctccagag

SEQ ID NO: 3875894 - DNA, 17 bp, Homo sapiens
gcagcctccagagccag

SEQ ID NO: 3875895 - DNA, 21 bp, Homo sapiens
gcagcctccagagccagcctg

SEQ ID NO: 3875896 - DNA, 22 bp, Homo sapiens
gcagcctccagagccagcctgg

SEQ ID NO: 3875897 - DNA, 13 bp, Homo sapiens
gcagcctccccca

SEQ ID NO: 3875898 - DNA, 14 bp, Homo sapiens
gcagcctcctcctg

SEQ ID NO: 3875899 - DNA, 15 bp, Homo sapiens
gcagcctcctcctga

SEQ ID NO: 3875900 - DNA, 18 bp, Homo sapiens
gcagcctcctcctgacca

SEQ ID NO: 3875901 - DNA, 13 bp, Homo sapiens
gcagcctcctggg

SEQ ID NO: 3875902 - DNA, 15 bp, Homo sapiens
gcagcctcctgggca

SEQ ID NO: 3875903 - DNA, 16 bp, Homo sapiens
gcagcctcctgggcag

SEQ ID NO: 3875904 - DNA, 13 bp, Homo sapiens
gcagcctgatggc

SEQ ID NO: 3875905 - DNA, 17 bp, Homo sapiens
gcagcctgatggccaag

SEQ ID NO: 3875906 - DNA, 18 bp, Homo sapiens
gcagcctgatggccaagg

SEQ ID NO: 3875907 - DNA, 19 bp, Homo sapiens
gcagcctggcggggcagga

SEQ ID NO: 3875908 - DNA, 18 bp, Homo sapiens
gcagcgcagccgccgggc

SEQ ID NO: 3875909 - DNA, 14 bp, Homo sapiens
gcagcgcgtgcaca

SEQ ID NO: 3875910 - DNA, 14 bp, Homo sapiens
gcagctagactgga

SEQ ID NO: 3875911 - DNA, 20 bp, Homo sapiens
gcagctaggactgaggagtg

SEQ ID NO: 3875912 - DNA, 19 bp, Homo sapiens
gcagctatgcgcaatgtgg

SEQ ID NO: 3875913 - DNA, 21 bp, Homo sapiens
gcagctatgcgcaatgtggca

SEQ ID NO: 3875914 - DNA, 14 bp, Homo sapiens
gcagctccaacagc

SEQ ID NO: 3875915 - DNA, 22 bp, Homo sapiens
gcagctccaacagcttgaccag

SEQ ID NO: 3875916 - DNA, 19 bp, Homo sapiens
gcagctcctctccttgggc

SEQ ID NO: 3875917 - DNA, 13 bp, Homo sapiens
gcagctcctctgt

SEQ ID NO: 3875918 - DNA, 15 bp, Homo sapiens
gcagctgagcagggc

SEQ ID NO: 3875919 - DNA, 21 bp, Homo sapiens
gcagctgagcagggccgggga

SEQ ID NO: 3875920 - DNA, 11 bp, Homo sapiens
gcagctgctct

SEQ ID NO: 3875921 - DNA, 18 bp, Homo sapiens
gcagctgctcttagtgcc

SEQ ID NO: 3875922 - DNA, 12 bp, Homo sapiens
gcagctgggact

SEQ ID NO: 3875923 - DNA, 13 bp, Homo sapiens
gcagctgggcccc

SEQ ID NO: 3875924 - DNA, 18 bp, Homo sapiens
gcagctgggccccaccta

SEQ ID NO: 3875925 - DNA, 17 bp, Homo sapiens
gcagctgggccccatgc

SEQ ID NO: 3875926 - DNA, 18 bp, Homo sapiens
gcagctgggccccatgct

SEQ ID NO: 3875927 - DNA, 12 bp, Homo sapiens
gcagctgggccg

SEQ ID NO: 3875928 - DNA, 18 bp, Homo sapiens
gcagctgggccggccagc

SEQ ID NO: 3875929 - DNA, 23 bp, Homo sapiens
gcagctgggccggccagccttgc

SEQ ID NO: 3875930 - DNA, 20 bp, Homo sapiens
gcagctgtcatggaaaagcc

SEQ ID NO: 3875931 - DNA, 22 bp, Homo sapiens
gcagctgtcatggaaaagccca

SEQ ID NO: 3875932 - DNA, 23 bp, Homo sapiens
gcagctgtcatggaaaagcccag

SEQ ID NO: 3875933 - DNA, 17 bp, Homo sapiens
gcagctgtttctggaaa

SEQ ID NO: 3875934 - DNA, 15 bp, Homo sapiens
gcagcttaacattga

SEQ ID NO: 3875935 - DNA, 18 bp, Homo sapiens
gcagcttcatcaattttt

SEQ ID NO: 3875936 - DNA, 19 bp, Homo sapiens
gcagcttcatcaattttta

SEQ ID NO: 3875937 - DNA, 14 bp, Homo sapiens
gcagcttctgtcct

SEQ ID NO: 3875938 - DNA, 19 bp, Homo sapiens
gcagcttgtagccagccgg

SEQ ID NO: 3875939 - DNA, 21 bp, Homo sapiens
gcagcttgtagccagccgggg

SEQ ID NO: 3875940 - DNA, 15 bp, Homo sapiens
gcaggaacagagact

SEQ ID NO: 3875941 - DNA, 20 bp, Homo sapiens
gcaggaacgagcactggcca

SEQ ID NO: 3875942 - DNA, 16 bp, Homo sapiens
gcaggaactcccagca

SEQ ID NO: 3875943 - DNA, 14 bp, Homo sapiens
gcaggaagagagag

SEQ ID NO: 3875944 - DNA, 21 bp, Homo sapiens
gcaggaagagagagagagagg

SEQ ID NO: 3875945 - DNA, 16 bp, Homo sapiens
gcaggaagtctctccc

SEQ ID NO: 3875946 - DNA, 17 bp, Homo sapiens
gcaggacacatcccggc

SEQ ID NO: 3875947 - DNA, 13 bp, Homo sapiens
gcaggaccaggac

SEQ ID NO: 3875948 - DNA, 14 bp, Homo sapiens
gcaggaccaggact

SEQ ID NO: 3875949 - DNA, 15 bp, Homo sapiens
gcaggaccaggacta

SEQ ID NO: 3875950 - DNA, 23 bp, Homo sapiens
gcaggactcggaattctcgggaa

SEQ ID NO: 3875951 - DNA, 16 bp, Homo sapiens
gcaggagcaggaacag

SEQ ID NO: 3875952 - DNA, 17 bp, Homo sapiens
gcaggaggcctggcctt

SEQ ID NO: 3875953 - DNA, 18 bp, Homo sapiens
gcaggagtagctgagctc

SEQ ID NO: 3875954 - DNA, 17 bp, Homo sapiens
gcaggatccgctgccac

SEQ ID NO: 3875955 - DNA, 16 bp, Homo sapiens
gcaggcacacagcagc

SEQ ID NO: 3875956 - DNA, 15 bp, Homo sapiens
gcaggcaccttagtg

SEQ ID NO: 3875957 - DNA, 20 bp, Homo sapiens
gcaggcaccttagtggcttt

SEQ ID NO: 3875958 - DNA, 24 bp, Homo sapiens
gcaggcagagcggggaggtgcctg

SEQ ID NO: 3875959 - DNA, 14 bp, Homo sapiens
gcaggcagggctct

SEQ ID NO: 3875960 - DNA, 15 bp, Homo sapiens
gcaggcccagcagac

SEQ ID NO: 3875961 - DNA, 15 bp, Homo sapiens
gcaggcccgacagag

SEQ ID NO: 3875962 - DNA, 18 bp, Homo sapiens
gcaggcccgacagagaga

SEQ ID NO: 3875963 - DNA, 23 bp, Homo sapiens
gcaggcccgacagagagatgaag

SEQ ID NO: 3875964 - DNA, 14 bp, Homo sapiens
gcaggccctgcctt

SEQ ID NO: 3875965 - DNA, 13 bp, Homo sapiens
gcaggcctgggac

SEQ ID NO: 3875966 - DNA, 16 bp, Homo sapiens
gcaggctagaacctgg

SEQ ID NO: 3875967 - DNA, 13 bp, Homo sapiens
gcaggctccccct

SEQ ID NO: 3875968 - DNA, 18 bp, Homo sapiens
gcaggctctgggctcagg

SEQ ID NO: 3875969 - DNA, 15 bp, Homo sapiens
gcagggacaaagagg

SEQ ID NO: 3875970 - DNA, 15 bp, Homo sapiens
gcagggacagagatg

SEQ ID NO: 3875971 - DNA, 17 bp, Homo sapiens
gcagggagctgggcttc

SEQ ID NO: 3875972 - DNA, 20 bp, Homo sapiens
gcagggccggggaactggcc

SEQ ID NO: 3875973 - DNA, 12 bp, Homo sapiens
gcagggctctcc

SEQ ID NO: 3875974 - DNA, 14 bp, Homo sapiens
gcagggctctcctg

SEQ ID NO: 3875975 - DNA, 19 bp, Homo sapiens
gcagggctctgccccagag

SEQ ID NO: 3875976 - DNA, 21 bp, Homo sapiens
gcagggctctgccccagaggc

SEQ ID NO: 3875977 - DNA, 13 bp, Homo sapiens
gcaggggagtgcc

SEQ ID NO: 3875978 - DNA, 14 bp, Homo sapiens
gcaggggtctgagc

SEQ ID NO: 3875979 - DNA, 17 bp, Homo sapiens
gcaataaaatagtattg

SEQ ID NO: 3875980 - DNA, 21 bp, Homo sapiens
gcaataaagtgtagcaccctg

SEQ ID NO: 3875981 - DNA, 20 bp, Homo sapiens
gcaataagttccatgttaaa

SEQ ID NO: 3875982 - DNA, 14 bp, Homo sapiens
gcaataatgtgcaa

SEQ ID NO: 3875983 - DNA, 20 bp, Homo sapiens
gcaatactaattgagaaaca

SEQ ID NO: 3875984 - DNA, 23 bp, Homo sapiens
gcaatactaattgagaaacatga

SEQ ID NO: 3875985 - DNA, 13 bp, Homo sapiens
gcaatgaaacaga

SEQ ID NO: 3875986 - DNA, 15 bp, Homo sapiens
gcaatgaaaccaaag

SEQ ID NO: 3875987 - DNA, 15 bp, Homo sapiens
gcaatgatgtccaga

SEQ ID NO: 3875988 - DNA, 18 bp, Homo sapiens
gcaatgcgtgttgtacat

SEQ ID NO: 3875989 - DNA, 21 bp, Homo sapiens
gcaatgggagggggctccatg

SEQ ID NO: 3875990 - DNA, 15 bp, Homo sapiens
gcaatgtttatttca

SEQ ID NO: 3875991 - DNA, 14 bp, Homo sapiens
gcaatgttttcctt

SEQ ID NO: 3875992 - DNA, 14 bp, Homo sapiens
gcaattgccctgta

SEQ ID NO: 3875993 - DNA, 16 bp, Homo sapiens
gcaatttttaaactag

SEQ ID NO: 3875994 - DNA, 15 bp, Homo sapiens
gcacaaaatgataat

SEQ ID NO: 3875995 - DNA, 14 bp, Homo sapiens
gcacaagctcagaa

SEQ ID NO: 3875996 - DNA, 18 bp, Homo sapiens
gcacaagctcagaataga

SEQ ID NO: 3875997 - DNA, 22 bp, Homo sapiens
gcacaagcttgtatatacatat

SEQ ID NO: 3875998 - DNA, 18 bp, Homo sapiens
gcacaagttccagctggt

SEQ ID NO: 3875999 - DNA, 21 bp, Homo sapiens
gcacaatttgagcaattcatt

SEQ ID NO: 3876000 - DNA, 22 bp, Homo sapiens
gcacaatttgagcaattcattt

SEQ ID NO: 3876001 - DNA, 13 bp, Homo sapiens
gcacacacacaga

SEQ ID NO: 3876002 - DNA, 13 bp, Homo sapiens
gcacacacagctc

SEQ ID NO: 3876003 - DNA, 16 bp, Homo sapiens
gcacacacagctcctc

SEQ ID NO: 3876004 - DNA, 21 bp, Homo sapiens
gcacacacatggatgagcaca

SEQ ID NO: 3876005 - DNA, 13 bp, Homo sapiens
gcacacagaaata

SEQ ID NO: 3876006 - DNA, 20 bp, Homo sapiens
gcacacagaaatatatatac

SEQ ID NO: 3876007 - DNA, 23 bp, Homo sapiens
gcacacagaaatatatatacata

SEQ ID NO: 3876008 - DNA, 17 bp, Homo sapiens
gcacacagcagcccccc

SEQ ID NO: 3876009 - DNA, 20 bp, Homo sapiens
gcacacagcagccccccagc

SEQ ID NO: 3876010 - DNA, 21 bp, Homo sapiens
gcacacagcagccccccagca

SEQ ID NO: 3876011 - DNA, 14 bp, Homo sapiens
gcacacagtcacct

SEQ ID NO: 3876012 - DNA, 15 bp, Homo sapiens
gcacacatggacaca

SEQ ID NO: 3876013 - DNA, 15 bp, Homo sapiens
gcacaccactgccct

SEQ ID NO: 3876014 - DNA, 13 bp, Homo sapiens
gcacacctgtggt

SEQ ID NO: 3876015 - DNA, 20 bp, Homo sapiens
gcacagaaacacaatatttt

SEQ ID NO: 3876016 - DNA, 21 bp, Homo sapiens
gcacagacttctggaaggctg

SEQ ID NO: 3876017 - DNA, 13 bp, Homo sapiens
gcacagcagcatc

SEQ ID NO: 3876018 - DNA, 16 bp, Homo sapiens
gcacagcgcgggcgga

SEQ ID NO: 3876019 - DNA, 17 bp, Homo sapiens
gcacagcgcgggcggag

SEQ ID NO: 3876020 - DNA, 21 bp, Homo sapiens
gcacagcggggccccagggct

SEQ ID NO: 3876021 - DNA, 12 bp, Homo sapiens
gcacaggagggg

SEQ ID NO: 3876022 - DNA, 21 bp, Homo sapiens
gcacaggagggggtcgtggag

SEQ ID NO: 3876023 - DNA, 22 bp, Homo sapiens
gcacaggagggggtcgtggaga

SEQ ID NO: 3876024 - DNA, 14 bp, Homo sapiens
gcacaggcagctgg

SEQ ID NO: 3876025 - DNA, 14 bp, Homo sapiens
gcacaggcaggaag

SEQ ID NO: 3876026 - DNA, 16 bp, Homo sapiens
gcacaggttttcagca

SEQ ID NO: 3876027 - DNA, 14 bp, Homo sapiens
gcacagttttctga

SEQ ID NO: 3876028 - DNA, 17 bp, Homo sapiens
gcacagttttctgagaa

SEQ ID NO: 3876029 - DNA, 22 bp, Homo sapiens
gcacagttttctgagaaagact

SEQ ID NO: 3876030 - DNA, 23 bp, Homo sapiens
gcacagttttctgagaaagacta

SEQ ID NO: 3876031 - DNA, 20 bp, Homo sapiens
gcacatatgggtgctggcag

SEQ ID NO: 3876032 - DNA, 15 bp, Homo sapiens
gcacatccctgccct

SEQ ID NO: 3876033 - DNA, 20 bp, Homo sapiens
gcacatccctgccctcctac

SEQ ID NO: 3876034 - DNA, 19 bp, Homo sapiens
gcacatgaggagggtgccc

SEQ ID NO: 3876035 - DNA, 17 bp, Homo sapiens
gcacattcctggccccg

SEQ ID NO: 3876036 - DNA, 18 bp, Homo sapiens
gcacattcctggccccgg

SEQ ID NO: 3876037 - DNA, 22 bp, Homo sapiens
gcaccaattgtacattccctgc

SEQ ID NO: 3876038 - DNA, 22 bp, Homo sapiens
gcaccagagtgaaagggctatg

SEQ ID NO: 3876039 - DNA, 19 bp, Homo sapiens
gcaccagcccttccctgct

SEQ ID NO: 3876040 - DNA, 20 bp, Homo sapiens
gcaccagcccttccctgctt

SEQ ID NO: 3876041 - DNA, 22 bp, Homo sapiens
gcaccagcccttccctgctttg

SEQ ID NO: 3876042 - DNA, 14 bp, Homo sapiens
gcaccagctctgtg

SEQ ID NO: 3876043 - DNA, 15 bp, Homo sapiens
gcaccagctctgtgg

SEQ ID NO: 3876044 - DNA, 20 bp, Homo sapiens
gcaccagctctgtggcctgt

SEQ ID NO: 3876045 - DNA, 22 bp, Homo sapiens
gcaccagctctgtggcctgtgt

SEQ ID NO: 3876046 - DNA, 23 bp, Homo sapiens
gcaccagctctgtggcctgtgtc

SEQ ID NO: 3876047 - DNA, 12 bp, Homo sapiens
gcaccagctgct

SEQ ID NO: 3876048 - DNA, 18 bp, Homo sapiens
gcaccagctgctctgccc

SEQ ID NO: 3876049 - DNA, 15 bp, Homo sapiens
gcaccatctgcttgg

SEQ ID NO: 3876050 - DNA, 15 bp, Homo sapiens
gcaccatggaggcag

SEQ ID NO: 3876051 - DNA, 14 bp, Homo sapiens
gcacccactcacca

SEQ ID NO: 3876052 - DNA, 17 bp, Homo sapiens
gcacccaggctccatgg

SEQ ID NO: 3876053 - DNA, 12 bp, Homo sapiens
gcacccccagcc

SEQ ID NO: 3876054 - DNA, 13 bp, Homo sapiens
gcacccccagcct

SEQ ID NO: 3876055 - DNA, 15 bp, Homo sapiens
gcacccccagcctgg

SEQ ID NO: 3876056 - DNA, 17 bp, Homo sapiens
gcacccccagcctgggc

SEQ ID NO: 3876057 - DNA, 20 bp, Homo sapiens
gcacccccagcctgggccta

SEQ ID NO: 3876058 - DNA, 17 bp, Homo sapiens
gcaccccctcattcccc

SEQ ID NO: 3876059 - DNA, 18 bp, Homo sapiens
gcaccccctcattcccct

SEQ ID NO: 3876060 - DNA, 13 bp, Homo sapiens
gcaccccctgcag

SEQ ID NO: 3876061 - DNA, 15 bp, Homo sapiens
gcaccccctgcagct

SEQ ID NO: 3876062 - DNA, 14 bp, Homo sapiens
gcaccccctggaga

SEQ ID NO: 3876063 - DNA, 21 bp, Homo sapiens
gcaccccggatcgaggacaag

SEQ ID NO: 3876064 - DNA, 19 bp, Homo sapiens
gcaccctcgatgaagccca

SEQ ID NO: 3876065 - DNA, 22 bp, Homo sapiens
gcagactcctcagatctgaaca

SEQ ID NO: 3876066 - DNA, 20 bp, Homo sapiens
gcagactgatgggacatcaa

SEQ ID NO: 3876067 - DNA, 22 bp, Homo sapiens
gcagagaaagaagagacaggag

SEQ ID NO: 3876068 - DNA, 14 bp, Homo sapiens
gcagagaaggcctc

SEQ ID NO: 3876069 - DNA, 16 bp, Homo sapiens
gcagagaccccaggat

SEQ ID NO: 3876070 - DNA, 17 bp, Homo sapiens
gcagagaccccaggatc

SEQ ID NO: 3876071 - DNA, 12 bp, Homo sapiens
gcagagccatgg

SEQ ID NO: 3876072 - DNA, 14 bp, Homo sapiens
gcagagccatgggc

SEQ ID NO: 3876073 - DNA, 18 bp, Homo sapiens
gcagagccatgggcctgg

SEQ ID NO: 3876074 - DNA, 20 bp, Homo sapiens
gcagagccatgggcctgggc

SEQ ID NO: 3876075 - DNA, 21 bp, Homo sapiens
gcagagccatgggcctgggcc

SEQ ID NO: 3876076 - DNA, 14 bp, Homo sapiens
gcagagcggggagg

SEQ ID NO: 3876077 - DNA, 17 bp, Homo sapiens
gcagagcggggaggtgc

SEQ ID NO: 3876078 - DNA, 20 bp, Homo sapiens
gcagagcggggaggtgcctg

SEQ ID NO: 3876079 - DNA, 19 bp, Homo sapiens
gcagagctgatggagaagg

SEQ ID NO: 3876080 - DNA, 13 bp, Homo sapiens
gcagaggaccaca

SEQ ID NO: 3876081 - DNA, 16 bp, Homo sapiens
gcagaggaccacagtg

SEQ ID NO: 3876082 - DNA, 21 bp, Homo sapiens
gcagaggaccacagtgggtgg

SEQ ID NO: 3876083 - DNA, 18 bp, Homo sapiens
gcagaggagtccagggcg

SEQ ID NO: 3876084 - DNA, 13 bp, Homo sapiens
gcagaggcggaaa

SEQ ID NO: 3876085 - DNA, 20 bp, Homo sapiens
gcagaggcggaaaccttgca

SEQ ID NO: 3876086 - DNA, 23 bp, Homo sapiens
gcagaggcggaaaccttgcagca

SEQ ID NO: 3876087 - DNA, 21 bp, Homo sapiens
gcagagggaatgttccctgca

SEQ ID NO: 3876088 - DNA, 16 bp, Homo sapiens
gcagagggcagaggct

SEQ ID NO: 3876089 - DNA, 13 bp, Homo sapiens
gcagaggggcagc

SEQ ID NO: 3876090 - DNA, 16 bp, Homo sapiens
gcagaggggcagccgc

SEQ ID NO: 3876091 - DNA, 13 bp, Homo sapiens
gcagaggtaaaag

SEQ ID NO: 3876092 - DNA, 20 bp, Homo sapiens
gcagaggtaaaagtgtgagc

SEQ ID NO: 3876093 - DNA, 16 bp, Homo sapiens
gcagaggtgagcagag

SEQ ID NO: 3876094 - DNA, 17 bp, Homo sapiens
gcagataatcagcctct

SEQ ID NO: 3876095 - DNA, 12 bp, Homo sapiens
gcagatgggctg

SEQ ID NO: 3876096 - DNA, 13 bp, Homo sapiens
gcagattcctggg

SEQ ID NO: 3876097 - DNA, 16 bp, Homo sapiens
gcagattcctgggcct

SEQ ID NO: 3876098 - DNA, 18 bp, Homo sapiens
gcagattcctgggcctgt

SEQ ID NO: 3876099 - DNA, 20 bp, Homo sapiens
gcagattgtgtaacaatttt

SEQ ID NO: 3876100 - DNA, 23 bp, Homo sapiens
gcagatttagtgaaagctagaga

SEQ ID NO: 3876101 - DNA, 14 bp, Homo sapiens
gcagcaaaaatata

SEQ ID NO: 3876102 - DNA, 15 bp, Homo sapiens
gcagcaaaaatataa

SEQ ID NO: 3876103 - DNA, 19 bp, Homo sapiens
gcagcaaaaatataaaata

SEQ ID NO: 3876104 - DNA, 12 bp, Homo sapiens
gcagcaactccc

SEQ ID NO: 3876105 - DNA, 22 bp, Homo sapiens
gcagcaaggcccgagcagctga

SEQ ID NO: 3876106 - DNA, 11 bp, Homo sapiens
gcagcagccag

SEQ ID NO: 3876107 - DNA, 14 bp, Homo sapiens
gcagcagccagccc

SEQ ID NO: 3876108 - DNA, 15 bp, Homo sapiens
gcagcagccagccct

SEQ ID NO: 3876109 - DNA, 19 bp, Homo sapiens
gcagcagccagccctgcct

SEQ ID NO: 3876110 - DNA, 15 bp, Homo sapiens
gcagcagcccagctt

SEQ ID NO: 3876111 - DNA, 19 bp, Homo sapiens
gcagcagcccagcttcctg

SEQ ID NO: 3876112 - DNA, 17 bp, Homo sapiens
gcagcagctaggactga

SEQ ID NO: 3876113 - DNA, 23 bp, Homo sapiens
gcagcagctaggactgaggagtg

SEQ ID NO: 3876114 - DNA, 21 bp, Homo sapiens
gcagcagctgggacccctccc

SEQ ID NO: 3876115 - DNA, 22 bp, Homo sapiens
gcagcagctgggacccctccca

SEQ ID NO: 3876116 - DNA, 16 bp, Homo sapiens
gcagcaggtgcaagag

SEQ ID NO: 3876117 - DNA, 15 bp, Homo sapiens
gcagcagttccatga

SEQ ID NO: 3876118 - DNA, 14 bp, Homo sapiens
gcagcattcagcac

SEQ ID NO: 3876119 - DNA, 12 bp, Homo sapiens
gcagccaccctg

SEQ ID NO: 3876120 - DNA, 21 bp, Homo sapiens
gcagccaccctgaggagtctg

SEQ ID NO: 3876121 - DNA, 17 bp, Homo sapiens
gcagccagccagtcttg

SEQ ID NO: 3876122 - DNA, 20 bp, Homo sapiens
gcagccagccagtcttgcct

SEQ ID NO: 3876123 - DNA, 23 bp, Homo sapiens
gcagccagccagtcttgcctagg

SEQ ID NO: 3876124 - DNA, 13 bp, Homo sapiens
gcagccagcccag

SEQ ID NO: 3876125 - DNA, 17 bp, Homo sapiens
gcagccagcccagccca

SEQ ID NO: 3876126 - DNA, 18 bp, Homo sapiens
gcagccagccctgcctgg

SEQ ID NO: 3876127 - DNA, 21 bp, Homo sapiens
gcagccagccctgcctggagg

SEQ ID NO: 3876128 - DNA, 19 bp, Homo sapiens
gcagccagccggtgcctgg

SEQ ID NO: 3876129 - DNA, 20 bp, Homo sapiens
gcagccagccggtgcctggc

SEQ ID NO: 3876130 - DNA, 18 bp, Homo sapiens
gcagccatgcctcatgcc

SEQ ID NO: 3876131 - DNA, 20 bp, Homo sapiens
gcagccatgcctcatgccac

SEQ ID NO: 3876132 - DNA, 23 bp, Homo sapiens
gcagccatgcctcatgccacacc

SEQ ID NO: 3876133 - DNA, 19 bp, Homo sapiens
gcagcccagcttcctggtg

SEQ ID NO: 3876134 - DNA, 22 bp, Homo sapiens
gcagcccatggcctctggccag

SEQ ID NO: 3876135 - DNA, 14 bp, Homo sapiens
gcagccccccagca

SEQ ID NO: 3876136 - DNA, 15 bp, Homo sapiens
gcagccccccagcac

SEQ ID NO: 3876137 - DNA, 16 bp, Homo sapiens
gcagccccccagcact

SEQ ID NO: 3876138 - DNA, 16 bp, Homo sapiens
gcagcccgaagcccag

SEQ ID NO: 3876139 - DNA, 18 bp, Homo sapiens
gcagcccgaagcccagtt

SEQ ID NO: 3876140 - DNA, 21 bp, Homo sapiens
gcagcccgaagcccagtttcc

SEQ ID NO: 3876141 - DNA, 21 bp, Homo sapiens
gcagcccgtgaagcagtgcct

SEQ ID NO: 3876142 - DNA, 22 bp, Homo sapiens
gcagccctaaggatctctcagg

SEQ ID NO: 3876143 - DNA, 24 bp, Homo sapiens
gcagccctgctttgggctgccctg

SEQ ID NO: 3876144 - DNA, 21 bp, Homo sapiens
gcagccctggcctgtggagag

SEQ ID NO: 3876145 - DNA, 21 bp, Homo sapiens
gcagccctgggggccagctgg

SEQ ID NO: 3876146 - DNA, 21 bp, Homo sapiens
gcagcccttcctcctgaagcc

SEQ ID NO: 3876147 - DNA, 14 bp, Homo sapiens
gcagccgccgggca

SEQ ID NO: 3876148 - DNA, 15 bp, Homo sapiens
gcagccgtgccttca

SEQ ID NO: 3876149 - DNA, 17 bp, Homo sapiens
gcagccgtgccttcagc

SEQ ID NO: 3876150 - DNA, 21 bp, Homo sapiens
gcagcctccaccttgctcttc

SEQ ID NO: 3876151 - DNA, 12 bp, Homo sapiens
gagtgccaggac

SEQ ID NO: 3876152 - DNA, 19 bp, Homo sapiens
gagtgccaggactccccag

SEQ ID NO: 3876153 - DNA, 21 bp, Homo sapiens
gagtggaatgcagggaagagg

SEQ ID NO: 3876154 - DNA, 17 bp, Homo sapiens
gagtggaggaggcctgg

SEQ ID NO: 3876155 - DNA, 18 bp, Homo sapiens
gagtggaggaggcctggg

SEQ ID NO: 3876156 - DNA, 15 bp, Homo sapiens
gagtggagtctgagt

SEQ ID NO: 3876157 - DNA, 22 bp, Homo sapiens
gagtggatctccaaggaccagg

SEQ ID NO: 3876158 - DNA, 18 bp, Homo sapiens
gagtggatggatggacag

SEQ ID NO: 3876159 - DNA, 11 bp, Homo sapiens
gagtggcagcc

SEQ ID NO: 3876160 - DNA, 18 bp, Homo sapiens
gagtggcagccatgcctc

SEQ ID NO: 3876161 - DNA, 21 bp, Homo sapiens
gagtggcccctcacctgggcc

SEQ ID NO: 3876162 - DNA, 13 bp, Homo sapiens
gagtggctcctcc

SEQ ID NO: 3876163 - DNA, 22 bp, Homo sapiens
gagtgtgtttgtgtgcatgaaa

SEQ ID NO: 3876164 - DNA, 18 bp, Homo sapiens
gagtgttctgtgggcttg

SEQ ID NO: 3876165 - DNA, 19 bp, Homo sapiens
gagtgttctgtgggcttgg

SEQ ID NO: 3876166 - DNA, 18 bp, Homo sapiens
gagttacagcgagaggca

SEQ ID NO: 3876167 - DNA, 19 bp, Homo sapiens
gagttacttgtctgaggcc

SEQ ID NO: 3876168 - DNA, 21 bp, Homo sapiens
gagttacttgtctgaggcctc

SEQ ID NO: 3876169 - DNA, 17 bp, Homo sapiens
gagttatagtttgcttt

SEQ ID NO: 3876170 - DNA, 13 bp, Homo sapiens
gagttcatcccag

SEQ ID NO: 3876171 - DNA, 21 bp, Homo sapiens
gagttccttgatctgtatata

SEQ ID NO: 3876172 - DNA, 16 bp, Homo sapiens
gagttgccagggaaga

SEQ ID NO: 3876173 - DNA, 15 bp, Homo sapiens
gagttgctcactcag

SEQ ID NO: 3876174 - DNA, 17 bp, Homo sapiens
gagttggctcaggcaga

SEQ ID NO: 3876175 - DNA, 21 bp, Homo sapiens
gagtttaactttgggcccaga

SEQ ID NO: 3876176 - DNA, 22 bp, Homo sapiens
gagtttgagacaagccctggca

SEQ ID NO: 3876177 - DNA, 19 bp, Homo sapiens
gagtttttatggggctgaa

SEQ ID NO: 3876178 - DNA, 20 bp, Homo sapiens
gataaaactaaatatatgtc

SEQ ID NO: 3876179 - DNA, 17 bp, Homo sapiens
gataaaatatcctcagg

SEQ ID NO: 3876180 - DNA, 19 bp, Homo sapiens
gataaaattgtgatgtttt

SEQ ID NO: 3876181 - DNA, 15 bp, Homo sapiens
gataaacattaaaca

SEQ ID NO: 3876182 - DNA, 21 bp, Homo sapiens
gataaagacagctgacagata

SEQ ID NO: 3876183 - DNA, 23 bp, Homo sapiens
gataaagagggatgtaactattg

SEQ ID NO: 3876184 - DNA, 11 bp, Homo sapiens
gataaagatga

SEQ ID NO: 3876185 - DNA, 13 bp, Homo sapiens
gataaatatttat

SEQ ID NO: 3876186 - DNA, 21 bp, Homo sapiens
gataactgcaattttaattga

SEQ ID NO: 3876187 - DNA, 15 bp, Homo sapiens
gataagaaccacaga

SEQ ID NO: 3876188 - DNA, 16 bp, Homo sapiens
gataagaaccacagaa

SEQ ID NO: 3876189 - DNA, 16 bp, Homo sapiens
gataagcttcaaagct

SEQ ID NO: 3876190 - DNA, 20 bp, Homo sapiens
gataatatgtttgaggttaa

SEQ ID NO: 3876191 - DNA, 13 bp, Homo sapiens
gataatcagcctc

SEQ ID NO: 3876192 - DNA, 22 bp, Homo sapiens
gataatgttctttaatgttgtc

SEQ ID NO: 3876193 - DNA, 20 bp, Homo sapiens
gatacaacttcaagtgcatg

SEQ ID NO: 3876194 - DNA, 19 bp, Homo sapiens
gatacaccgggcctggaga

SEQ ID NO: 3876195 - DNA, 19 bp, Homo sapiens
gatacagccccaaaccagg

SEQ ID NO: 3876196 - DNA, 12 bp, Homo sapiens
gatacatagatg

SEQ ID NO: 3876197 - DNA, 18 bp, Homo sapiens
gatacattccctatcaaa

SEQ ID NO: 3876198 - DNA, 22 bp, Homo sapiens
gatacattccctatcaaaacat

SEQ ID NO: 3876199 - DNA, 23 bp, Homo sapiens
gatacattccctatcaaaacata

SEQ ID NO: 3876200 - DNA, 15 bp, Homo sapiens
gatacttcaggtgct

SEQ ID NO: 3876201 - DNA, 23 bp, Homo sapiens
gatagatccatttggacaaaatg

SEQ ID NO: 3876202 - DNA, 21 bp, Homo sapiens
gatagctattttcttacagtg

SEQ ID NO: 3876203 - DNA, 13 bp, Homo sapiens
gataggaaaagaa

SEQ ID NO: 3876204 - DNA, 22 bp, Homo sapiens
gatatatatttactaaaagaat

SEQ ID NO: 3876205 - DNA, 15 bp, Homo sapiens
gatatatttttcaca

SEQ ID NO: 3876206 - DNA, 12 bp, Homo sapiens
gatatgacaagc

SEQ ID NO: 3876207 - DNA, 21 bp, Homo sapiens
gatatgagttgttttcagact

SEQ ID NO: 3876208 - DNA, 14 bp, Homo sapiens
gatatgcaaaagct

SEQ ID NO: 3876209 - DNA, 13 bp, Homo sapiens
gatatgggactga

SEQ ID NO: 3876210 - DNA, 22 bp, Homo sapiens
gatatgggactgagcctggccc

SEQ ID NO: 3876211 - DNA, 22 bp, Homo sapiens
gatattgtcagagttctgctct

SEQ ID NO: 3876212 - DNA, 23 bp, Homo sapiens
gatattttcaacgcagccctgct

SEQ ID NO: 3876213 - DNA, 20 bp, Homo sapiens
gatattttcttccaagcaaa

SEQ ID NO: 3876214 - DNA, 17 bp, Homo sapiens
gatcaaaaataaactag

SEQ ID NO: 3876215 - DNA, 12 bp, Homo sapiens
gatcaaagttcc

SEQ ID NO: 3876216 - DNA, 13 bp, Homo sapiens
gatcaactgttca

SEQ ID NO: 3876217 - DNA, 13 bp, Homo sapiens
gatcacagaggct

SEQ ID NO: 3876218 - DNA, 20 bp, Homo sapiens
gatcacagggccccagaagg

SEQ ID NO: 3876219 - DNA, 22 bp, Homo sapiens
gatcaccagcccggcctgctcc

SEQ ID NO: 3876220 - DNA, 20 bp, Homo sapiens
gatcactcaaaaaggtgtgt

SEQ ID NO: 3876221 - DNA, 15 bp, Homo sapiens
gatcagaacagcaga

SEQ ID NO: 3876222 - DNA, 15 bp, Homo sapiens
gatcagcgtggcctt

SEQ ID NO: 3876223 - DNA, 16 bp, Homo sapiens
gatcaggaagagaagg

SEQ ID NO: 3876224 - DNA, 17 bp, Homo sapiens
gatcataggtatttcaa

SEQ ID NO: 3876225 - DNA, 22 bp, Homo sapiens
gatcatcccatctaagctgcag

SEQ ID NO: 3876226 - DNA, 13 bp, Homo sapiens
gatcatgaaaagt

SEQ ID NO: 3876227 - DNA, 14 bp, Homo sapiens
gatcatgaaaagtg

SEQ ID NO: 3876228 - DNA, 15 bp, Homo sapiens
gatccacacacagag

SEQ ID NO: 3876229 - DNA, 16 bp, Homo sapiens
gatccaccctatccct

SEQ ID NO: 3876230 - DNA, 16 bp, Homo sapiens
gatccatgtagcagga

SEQ ID NO: 3876231 - DNA, 23 bp, Homo sapiens
gatcccaattcatttcatctact

SEQ ID NO: 3876232 - DNA, 20 bp, Homo sapiens
gatcccatccatcagctccc

SEQ ID NO: 3876233 - DNA, 20 bp, Homo sapiens
gatccctgttacccagagaa

SEQ ID NO: 3876234 - DNA, 22 bp, Homo sapiens
gatccctttcccatgatccaga

SEQ ID NO: 3876235 - DNA, 20 bp, Homo sapiens
gatcctgcaggaacgagcac

SEQ ID NO: 3876236 - DNA, 24 bp, Homo sapiens
gatttcttcgctgctctagctggc

SEQ ID NO: 3876237 - DNA, 18 bp, Homo sapiens
gatttgaagctgtaccca

SEQ ID NO: 3876238 - DNA, 23 bp, Homo sapiens
gatttgaggagcagcttcagttg

SEQ ID NO: 3876239 - DNA, 12 bp, Homo sapiens
gatttgccagca

SEQ ID NO: 3876240 - DNA, 13 bp, Homo sapiens
gatttggaagaga

SEQ ID NO: 3876241 - DNA, 23 bp, Homo sapiens
gatttggaagagaggcacctgct

SEQ ID NO: 3876242 - DNA, 21 bp, Homo sapiens
gattttaaattcacaatagaa

SEQ ID NO: 3876243 - DNA, 20 bp, Homo sapiens
gattttaacaaaagcaagac

SEQ ID NO: 3876244 - DNA, 21 bp, Homo sapiens
gattttacagagaatctgaag

SEQ ID NO: 3876245 - DNA, 14 bp, Homo sapiens
gattttagttcact

SEQ ID NO: 3876246 - DNA, 13 bp, Homo sapiens
gattttatacata

SEQ ID NO: 3876247 - DNA, 15 bp, Homo sapiens
gattttatttgacaa

SEQ ID NO: 3876248 - DNA, 13 bp, Homo sapiens
gattttgcctgtg

SEQ ID NO: 3876249 - DNA, 15 bp, Homo sapiens
gattttgtacagaat

SEQ ID NO: 3876250 - DNA, 14 bp, Homo sapiens
gatttttgggctcc

SEQ ID NO: 3876251 - DNA, 18 bp, Homo sapiens
gatttttgtaataaaagg

SEQ ID NO: 3876252 - DNA, 17 bp, Homo sapiens
gattttttaaaagaaat

SEQ ID NO: 3876253 - DNA, 16 bp, Homo sapiens
gcaaaaatataaaata

SEQ ID NO: 3876254 - DNA, 16 bp, Homo sapiens
gcaaaagactaattta

SEQ ID NO: 3876255 - DNA, 14 bp, Homo sapiens
gcaaacactgtgta

SEQ ID NO: 3876256 - DNA, 18 bp, Homo sapiens
gcaaaccatttcaaatgg

SEQ ID NO: 3876257 - DNA, 23 bp, Homo sapiens
gcaaaccatttcaaatggcagca

SEQ ID NO: 3876258 - DNA, 19 bp, Homo sapiens
gcaaacccttctcttctcc

SEQ ID NO: 3876259 - DNA, 21 bp, Homo sapiens
gcaaagcctgttcatggcaga

SEQ ID NO: 3876260 - DNA, 17 bp, Homo sapiens
gcaaaggaaaccaaagg

SEQ ID NO: 3876261 - DNA, 22 bp, Homo sapiens
gcaaagggctgaaagccatttg

SEQ ID NO: 3876262 - DNA, 14 bp, Homo sapiens
gcaaagtctaaagt

SEQ ID NO: 3876263 - DNA, 22 bp, Homo sapiens
gcaaagtctaaagtttacagta

SEQ ID NO: 3876264 - DNA, 16 bp, Homo sapiens
gcaaagtgcaaatact

SEQ ID NO: 3876265 - DNA, 14 bp, Homo sapiens
gcaaatataaaact

SEQ ID NO: 3876266 - DNA, 19 bp, Homo sapiens
gcaaatataagctgggaaa

SEQ ID NO: 3876267 - DNA, 14 bp, Homo sapiens
gcaaatgagggagg

SEQ ID NO: 3876268 - DNA, 14 bp, Homo sapiens
gcaaattattttaa

SEQ ID NO: 3876269 - DNA, 12 bp, Homo sapiens
gcaaatttcaaa

SEQ ID NO: 3876270 - DNA, 18 bp, Homo sapiens
gcaacacctccttgcttt

SEQ ID NO: 3876271 - DNA, 19 bp, Homo sapiens
gcaacacctccttgctttg

SEQ ID NO: 3876272 - DNA, 13 bp, Homo sapiens
gcaacaggtttta

SEQ ID NO: 3876273 - DNA, 21 bp, Homo sapiens
gcaacatctcgagccccctgg

SEQ ID NO: 3876274 - DNA, 13 bp, Homo sapiens
gcaaccacacacc

SEQ ID NO: 3876275 - DNA, 16 bp, Homo sapiens
gcaaccccagttctgc

SEQ ID NO: 3876276 - DNA, 18 bp, Homo sapiens
gcaaccccagttctgctc

SEQ ID NO: 3876277 - DNA, 19 bp, Homo sapiens
gcaaccccagttctgctcc

SEQ ID NO: 3876278 - DNA, 21 bp, Homo sapiens
gcaaccccagttctgctcctc

SEQ ID NO: 3876279 - DNA, 21 bp, Homo sapiens
gcaacccctgtacccagctcc

SEQ ID NO: 3876280 - DNA, 18 bp, Homo sapiens
gcaacccgtgccaagtcc

SEQ ID NO: 3876281 - DNA, 18 bp, Homo sapiens
gcaaccgtggcccttcct

SEQ ID NO: 3876282 - DNA, 21 bp, Homo sapiens
gcaaccgtggcccttcctgga

SEQ ID NO: 3876283 - DNA, 15 bp, Homo sapiens
gcaacctcactatgg

SEQ ID NO: 3876284 - DNA, 15 bp, Homo sapiens
gcaacctcttcctcc

SEQ ID NO: 3876285 - DNA, 17 bp, Homo sapiens
gcaacctcttcctcctg

SEQ ID NO: 3876286 - DNA, 16 bp, Homo sapiens
gcaactagccaaggct

SEQ ID NO: 3876287 - DNA, 12 bp, Homo sapiens
gcaactcagaat

SEQ ID NO: 3876288 - DNA, 16 bp, Homo sapiens
gcaactctgactcttt

SEQ ID NO: 3876289 - DNA, 18 bp, Homo sapiens
gcaactgagtctgcggga

SEQ ID NO: 3876290 - DNA, 18 bp, Homo sapiens
gcaagactgttgctcaaa

SEQ ID NO: 3876291 - DNA, 15 bp, Homo sapiens
gcaagagacagagcc

SEQ ID NO: 3876292 - DNA, 21 bp, Homo sapiens
gcaagagacagagcccccaag

SEQ ID NO: 3876293 - DNA, 23 bp, Homo sapiens
gcaagagagagctcgctcttggg

SEQ ID NO: 3876294 - DNA, 13 bp, Homo sapiens
gcaagatatttat

SEQ ID NO: 3876295 - DNA, 12 bp, Homo sapiens
gcaagcagggaa

SEQ ID NO: 3876296 - DNA, 14 bp, Homo sapiens
gcaagcagggaaag

SEQ ID NO: 3876297 - DNA, 21 bp, Homo sapiens
gcaagccactatgtccagcta

SEQ ID NO: 3876298 - DNA, 16 bp, Homo sapiens
gcaagccccagggcct

SEQ ID NO: 3876299 - DNA, 17 bp, Homo sapiens
gcaagccccagggcctg

SEQ ID NO: 3876300 - DNA, 19 bp, Homo sapiens
gcaagccccagggcctggg

SEQ ID NO: 3876301 - DNA, 23 bp, Homo sapiens
gcaagcccctcagcccttgcccc

SEQ ID NO: 3876302 - DNA, 14 bp, Homo sapiens
gcaaggaaaataat

SEQ ID NO: 3876303 - DNA, 19 bp, Homo sapiens
gcaaggacaacctgcccct

SEQ ID NO: 3876304 - DNA, 21 bp, Homo sapiens
gcaaggacaacctgcccctcc

SEQ ID NO: 3876305 - DNA, 18 bp, Homo sapiens
gcaaggcccgagcagctg

SEQ ID NO: 3876306 - DNA, 19 bp, Homo sapiens
gcaaggcccgagcagctga

SEQ ID NO: 3876307 - DNA, 21 bp, Homo sapiens
gcaaggcccgagcagctgagc

SEQ ID NO: 3876308 - DNA, 24 bp, Homo sapiens
gcaaggcccgagcagctgagcagg

SEQ ID NO: 3876309 - DNA, 15 bp, Homo sapiens
gcaagggcatcaggc

SEQ ID NO: 3876310 - DNA, 20 bp, Homo sapiens
gcaagggcatcaggcactgg

SEQ ID NO: 3876311 - DNA, 14 bp, Homo sapiens
gcaagggctccagc

SEQ ID NO: 3876312 - DNA, 19 bp, Homo sapiens
gcaagggctccagcatcca

SEQ ID NO: 3876313 - DNA, 22 bp, Homo sapiens
gcaaggggctcagcaaggtgtg

SEQ ID NO: 3876314 - DNA, 23 bp, Homo sapiens
gcaagggggtgtcatctgaggag

SEQ ID NO: 3876315 - DNA, 14 bp, Homo sapiens
gcaagggtgatggg

SEQ ID NO: 3876316 - DNA, 23 bp, Homo sapiens
gcaaggtctccttactctgagcc

SEQ ID NO: 3876317 - DNA, 17 bp, Homo sapiens
gcaagtctggatctggg

SEQ ID NO: 3876318 - DNA, 19 bp, Homo sapiens
gcaagtgttcccaaattga

SEQ ID NO: 3876319 - DNA, 19 bp, Homo sapiens
gcaagttcagggaagcagg

SEQ ID NO: 3876320 - DNA, 21 bp, Homo sapiens
gcaagttcagggaagcaggca

SEQ ID NO: 3876321 - DNA, 22 bp, Homo sapiens
gcaagtttctagctagaaatat

SEQ ID NO: 3876322 - DNA, 17 bp, Homo sapiens
gatcctgctgtggcctc

SEQ ID NO: 3876323 - DNA, 18 bp, Homo sapiens
gatcctgctgtggcctca

SEQ ID NO: 3876324 - DNA, 19 bp, Homo sapiens
gatcctgctgtggcctcac

SEQ ID NO: 3876325 - DNA, 23 bp, Homo sapiens
gatccttcatcgaacaaactgat

SEQ ID NO: 3876326 - DNA, 19 bp, Homo sapiens
gatcgagaccatcctggct

SEQ ID NO: 3876327 - DNA, 16 bp, Homo sapiens
gatcgtattaattatc

SEQ ID NO: 3876328 - DNA, 18 bp, Homo sapiens
gatctaatacaaagatga

SEQ ID NO: 3876329 - DNA, 16 bp, Homo sapiens
gatctagaatgtgttt

SEQ ID NO: 3876330 - DNA, 12 bp, Homo sapiens
gatctatgcaat

SEQ ID NO: 3876331 - DNA, 14 bp, Homo sapiens
gatctccctccagg

SEQ ID NO: 3876332 - DNA, 15 bp, Homo sapiens
gatctccctgccgcc

SEQ ID NO: 3876333 - DNA, 18 bp, Homo sapiens
gatctccctgccgcctca

SEQ ID NO: 3876334 - DNA, 22 bp, Homo sapiens
gatctctcaggagcacaggcag

SEQ ID NO: 3876335 - DNA, 19 bp, Homo sapiens
gatctgatggtgagctggg

SEQ ID NO: 3876336 - DNA, 20 bp, Homo sapiens
gatctgatggtgagctggga

SEQ ID NO: 3876337 - DNA, 22 bp, Homo sapiens
gatctgcattccccgctgccca

SEQ ID NO: 3876338 - DNA, 12 bp, Homo sapiens
gatctgcctggg

SEQ ID NO: 3876339 - DNA, 13 bp, Homo sapiens
gatctgcctgggc

SEQ ID NO: 3876340 - DNA, 14 bp, Homo sapiens
gatctgcctgggcc

SEQ ID NO: 3876341 - DNA, 22 bp, Homo sapiens
gatctgcctgggcctgtgcagc

SEQ ID NO: 3876342 - DNA, 14 bp, Homo sapiens
gatcttcagagcag

SEQ ID NO: 3876343 - DNA, 11 bp, Homo sapiens
gatctttcagg

SEQ ID NO: 3876344 - DNA, 23 bp, Homo sapiens
gatgaaagtgcaaagtgccctca

SEQ ID NO: 3876345 - DNA, 21 bp, Homo sapiens
gatgaaattgaacctggtttt

SEQ ID NO: 3876346 - DNA, 23 bp, Homo sapiens
gatgaaattttctagactttctg

SEQ ID NO: 3876347 - DNA, 13 bp, Homo sapiens
gatgaagagaagc

SEQ ID NO: 3876348 - DNA, 14 bp, Homo sapiens
gatgaagagtgaga

SEQ ID NO: 3876349 - DNA, 18 bp, Homo sapiens
gatgaccagaacaaggtt

SEQ ID NO: 3876350 - DNA, 19 bp, Homo sapiens
gatgacctaacctaagcaa

SEQ ID NO: 3876351 - DNA, 15 bp, Homo sapiens
gatgactagaggcag

SEQ ID NO: 3876352 - DNA, 16 bp, Homo sapiens
gatgagatttgccagc

SEQ ID NO: 3876353 - DNA, 21 bp, Homo sapiens
gatgagatttgccagcacagg

SEQ ID NO: 3876354 - DNA, 13 bp, Homo sapiens
gatgaggcagagg

SEQ ID NO: 3876355 - DNA, 23 bp, Homo sapiens
gatgaggcctcttggacctctgc

SEQ ID NO: 3876356 - DNA, 15 bp, Homo sapiens
gatgagggcagcagc

SEQ ID NO: 3876357 - DNA, 17 bp, Homo sapiens
gatgagggcagcagcca

SEQ ID NO: 3876358 - DNA, 20 bp, Homo sapiens
gatgagggcagcagccagcc

SEQ ID NO: 3876359 - DNA, 21 bp, Homo sapiens
gatgataaatatttatgctta

SEQ ID NO: 3876360 - DNA, 22 bp, Homo sapiens
gatgataaatatttatgcttaa

SEQ ID NO: 3876361 - DNA, 21 bp, Homo sapiens
gatgatctactcagaaatttt

SEQ ID NO: 3876362 - DNA, 13 bp, Homo sapiens
gatgatctctcca

SEQ ID NO: 3876363 - DNA, 22 bp, Homo sapiens
gatgatctctccacggtagcac

SEQ ID NO: 3876364 - DNA, 15 bp, Homo sapiens
gatgatgatgatgat

SEQ ID NO: 3876365 - DNA, 23 bp, Homo sapiens
gatgattaaacacctgacacatc

SEQ ID NO: 3876366 - DNA, 13 bp, Homo sapiens
gatgccacagccc

SEQ ID NO: 3876367 - DNA, 18 bp, Homo sapiens
gatgccacagccccacag

SEQ ID NO: 3876368 - DNA, 20 bp, Homo sapiens
gatgccacagccccacagca

SEQ ID NO: 3876369 - DNA, 21 bp, Homo sapiens
gatgccacagccccacagcac

SEQ ID NO: 3876370 - DNA, 22 bp, Homo sapiens
gatgccacccagcaacacagag

SEQ ID NO: 3876371 - DNA, 13 bp, Homo sapiens
gatgccagtggaa

SEQ ID NO: 3876372 - DNA, 12 bp, Homo sapiens
gatgccatgttt

SEQ ID NO: 3876373 - DNA, 17 bp, Homo sapiens
gatgccccttccccaag

SEQ ID NO: 3876374 - DNA, 16 bp, Homo sapiens
gatgcgaaaacttgaa

SEQ ID NO: 3876375 - DNA, 21 bp, Homo sapiens
gatgcgaaaacttgaatctgt

SEQ ID NO: 3876376 - DNA, 14 bp, Homo sapiens
gatgctcaggcttg

SEQ ID NO: 3876377 - DNA, 21 bp, Homo sapiens
gatgctcaggcttgaaatgca

SEQ ID NO: 3876378 - DNA, 19 bp, Homo sapiens
gatgctccagggcagcctc

SEQ ID NO: 3876379 - DNA, 17 bp, Homo sapiens
gatgctgactgtactcc

SEQ ID NO: 3876380 - DNA, 19 bp, Homo sapiens
gatgctgccccgttccctg

SEQ ID NO: 3876381 - DNA, 23 bp, Homo sapiens
gatgctgccccgttccctgtcag

SEQ ID NO: 3876382 - DNA, 14 bp, Homo sapiens
gatggaccagtaga

SEQ ID NO: 3876383 - DNA, 13 bp, Homo sapiens
gatggaccctcgc

SEQ ID NO: 3876384 - DNA, 23 bp, Homo sapiens
gatggaccgggtgggcctggcct

SEQ ID NO: 3876385 - DNA, 17 bp, Homo sapiens
gatggacttttgggggt

SEQ ID NO: 3876386 - DNA, 19 bp, Homo sapiens
gatggacttttgggggttg

SEQ ID NO: 3876387 - DNA, 21 bp, Homo sapiens
gatggacttttgggggttgga

SEQ ID NO: 3876388 - DNA, 16 bp, Homo sapiens
gatggagaaggaaggc

SEQ ID NO: 3876389 - DNA, 23 bp, Homo sapiens
gatggagactggtcctgtgtgca

SEQ ID NO: 3876390 - DNA, 16 bp, Homo sapiens
gatggagagaggggaa

SEQ ID NO: 3876391 - DNA, 21 bp, Homo sapiens
gatggagaggcggcctcgtgc

SEQ ID NO: 3876392 - DNA, 20 bp, Homo sapiens
gatggagccagctctgcatt

SEQ ID NO: 3876393 - DNA, 16 bp, Homo sapiens
gatggaggagaaataa

SEQ ID NO: 3876394 - DNA, 14 bp, Homo sapiens
gatggaggagaaga

SEQ ID NO: 3876395 - DNA, 17 bp, Homo sapiens
gatggaggccgagccaa

SEQ ID NO: 3876396 - DNA, 13 bp, Homo sapiens
gatggatggacag

SEQ ID NO: 3876397 - DNA, 15 bp, Homo sapiens
gatggatggacagaa

SEQ ID NO: 3876398 - DNA, 15 bp, Homo sapiens
gatggcaccagaggc

SEQ ID NO: 3876399 - DNA, 21 bp, Homo sapiens
gatggcacttagctatcagaa

SEQ ID NO: 3876400 - DNA, 15 bp, Homo sapiens
gatggccaagagcat

SEQ ID NO: 3876401 - DNA, 22 bp, Homo sapiens
gatggcccttcccactggaggt

SEQ ID NO: 3876402 - DNA, 16 bp, Homo sapiens
gatggcgcgggaggca

SEQ ID NO: 3876403 - DNA, 17 bp, Homo sapiens
gatggcgcgggaggcac

SEQ ID NO: 3876404 - DNA, 18 bp, Homo sapiens
gatggctgtgcctctgcc

SEQ ID NO: 3876405 - DNA, 19 bp, Homo sapiens
gatgggaagatggtagcag

SEQ ID NO: 3876406 - DNA, 20 bp, Homo sapiens
gatgggaagatggtagcaga

SEQ ID NO: 3876407 - DNA, 23 bp, Homo sapiens
gatgggactagagctttctttca

SEQ ID NO: 3876408 - DNA, 20 bp, Homo sapiens
gatgggatcccaggccaggg

SEQ ID NO: 3876409 - DNA, 17 bp, Homo sapiens
gatgggcacatgaggag

SEQ ID NO: 3876410 - DNA, 20 bp, Homo sapiens
gatgggcacatgaggagggt

SEQ ID NO: 3876411 - DNA, 21 bp, Homo sapiens
gatgggcattgggctgacacc

SEQ ID NO: 3876412 - DNA, 22 bp, Homo sapiens
gatgggcattgggctgacacct

SEQ ID NO: 3876413 - DNA, 15 bp, Homo sapiens
gatgggtattaaact

SEQ ID NO: 3876414 - DNA, 15 bp, Homo sapiens
gatggtctcacagag

SEQ ID NO: 3876415 - DNA, 21 bp, Homo sapiens
gatggttcccctgttcactct

SEQ ID NO: 3876416 - DNA, 20 bp, Homo sapiens
gatgtaaacagtgcctgctg

SEQ ID NO: 3876417 - DNA, 16 bp, Homo sapiens
gatgtaggagggactg

SEQ ID NO: 3876418 - DNA, 23 bp, Homo sapiens
gatgtcatccccttgtgtcagag

SEQ ID NO: 3876419 - DNA, 20 bp, Homo sapiens
gatgtcatgtacttcctgtg

SEQ ID NO: 3876420 - DNA, 12 bp, Homo sapiens
gatgtccagaag

SEQ ID NO: 3876421 - DNA, 16 bp, Homo sapiens
gatgtgaacacatcag

SEQ ID NO: 3876422 - DNA, 23 bp, Homo sapiens
gatgtgaattgcctgcagagaga

SEQ ID NO: 3876423 - DNA, 16 bp, Homo sapiens
gatgtgccagaacttc

SEQ ID NO: 3876424 - DNA, 14 bp, Homo sapiens
gatgtgctggagct

SEQ ID NO: 3876425 - DNA, 17 bp, Homo sapiens
gatgtgctggagctggc

SEQ ID NO: 3876426 - DNA, 18 bp, Homo sapiens
gatgtgctggagctggct

SEQ ID NO: 3876427 - DNA, 21 bp, Homo sapiens
gatgtgctttgcattcctaca

SEQ ID NO: 3876428 - DNA, 17 bp, Homo sapiens
gatgtggcaaagtgctg

SEQ ID NO: 3876429 - DNA, 23 bp, Homo sapiens
gatgtgggagggagcagacagga

SEQ ID NO: 3876430 - DNA, 16 bp, Homo sapiens
gatgtgtggggcatgg

SEQ ID NO: 3876431 - DNA, 14 bp, Homo sapiens
gatgttaaccagaa

SEQ ID NO: 3876432 - DNA, 23 bp, Homo sapiens
gatgttacatcacagtgtttgca

SEQ ID NO: 3876433 - DNA, 19 bp, Homo sapiens
gatgttgtcattatgtaca

SEQ ID NO: 3876434 - DNA, 19 bp, Homo sapiens
gatgttgttactgattctc

SEQ ID NO: 3876435 - DNA, 18 bp, Homo sapiens
gatgttttgttcaaagtt

SEQ ID NO: 3876436 - DNA, 16 bp, Homo sapiens
gatgtttttcatgaaa

SEQ ID NO: 3876437 - DNA, 20 bp, Homo sapiens
gattaaattatatctgaggc

SEQ ID NO: 3876438 - DNA, 20 bp, Homo sapiens
gattaagatacactcctgct

SEQ ID NO: 3876439 - DNA, 17 bp, Homo sapiens
gattaaggtgatgtgat

SEQ ID NO: 3876440 - DNA, 15 bp, Homo sapiens
gattaatgttttgta

SEQ ID NO: 3876441 - DNA, 17 bp, Homo sapiens
gattagaatgaaaattg

SEQ ID NO: 3876442 - DNA, 16 bp, Homo sapiens
gattatattataataa

SEQ ID NO: 3876443 - DNA, 15 bp, Homo sapiens
gattattcatttaaa

SEQ ID NO: 3876444 - DNA, 17 bp, Homo sapiens
gattattctgattccac

SEQ ID NO: 3876445 - DNA, 19 bp, Homo sapiens
gattattctgattccactt

SEQ ID NO: 3876446 - DNA, 14 bp, Homo sapiens
gattattcttccag

SEQ ID NO: 3876447 - DNA, 23 bp, Homo sapiens
gattatttgttatttgtacagtt

SEQ ID NO: 3876448 - DNA, 14 bp, Homo sapiens
gattattttcatta

SEQ ID NO: 3876449 - DNA, 22 bp, Homo sapiens
gattcaggaaaaggcctggggt

SEQ ID NO: 3876450 - DNA, 14 bp, Homo sapiens
gattcataacaatg

SEQ ID NO: 3876451 - DNA, 22 bp, Homo sapiens
gattccagagagtggctcctcc

SEQ ID NO: 3876452 - DNA, 13 bp, Homo sapiens
gattcccagagac

SEQ ID NO: 3876453 - DNA, 17 bp, Homo sapiens
gattccctctcccaggc

SEQ ID NO: 3876454 - DNA, 18 bp, Homo sapiens
gattccctctcccaggcc

SEQ ID NO: 3876455 - DNA, 23 bp, Homo sapiens
gattcctaagcagtgcttgtaaa

SEQ ID NO: 3876456 - DNA, 12 bp, Homo sapiens
gattcctgggcc

SEQ ID NO: 3876457 - DNA, 14 bp, Homo sapiens
gattcctgggcctg

SEQ ID NO: 3876458 - DNA, 15 bp, Homo sapiens
gattcctgggcctgt

SEQ ID NO: 3876459 - DNA, 12 bp, Homo sapiens
gattccttttga

SEQ ID NO: 3876460 - DNA, 20 bp, Homo sapiens
gattccttttgatggggaga

SEQ ID NO: 3876461 - DNA, 21 bp, Homo sapiens
gattccttttgatggggagaa

SEQ ID NO: 3876462 - DNA, 16 bp, Homo sapiens
gattctcctgtcagag

SEQ ID NO: 3876463 - DNA, 14 bp, Homo sapiens
gattctcctgtgct

SEQ ID NO: 3876464 - DNA, 17 bp, Homo sapiens
gattcttgtgcctcagc

SEQ ID NO: 3876465 - DNA, 13 bp, Homo sapiens
gattgaggcctgc

SEQ ID NO: 3876466 - DNA, 15 bp, Homo sapiens
gattgcagtccccag

SEQ ID NO: 3876467 - DNA, 22 bp, Homo sapiens
gattgcattagaaatagacagt

SEQ ID NO: 3876468 - DNA, 23 bp, Homo sapiens
gattgccccagagccccactccc

SEQ ID NO: 3876469 - DNA, 14 bp, Homo sapiens
gattgcttaaaata

SEQ ID NO: 3876470 - DNA, 11 bp, Homo sapiens
gattggattat

SEQ ID NO: 3876471 - DNA, 14 bp, Homo sapiens
gattggattattca

SEQ ID NO: 3876472 - DNA, 11 bp, Homo sapiens
gattgggtgcc

SEQ ID NO: 3876473 - DNA, 17 bp, Homo sapiens
gattgggtgccatgtgg

SEQ ID NO: 3876474 - DNA, 19 bp, Homo sapiens
gattgggtgccatgtggag

SEQ ID NO: 3876475 - DNA, 14 bp, Homo sapiens
gattgtaaaaacaa

SEQ ID NO: 3876476 - DNA, 12 bp, Homo sapiens
gattgtaaaata

SEQ ID NO: 3876477 - DNA, 20 bp, Homo sapiens
gattgtaaaatagcttgtat

SEQ ID NO: 3876478 - DNA, 13 bp, Homo sapiens
gattgttcatcat

SEQ ID NO: 3876479 - DNA, 12 bp, Homo sapiens
gattgttttatc

SEQ ID NO: 3876480 - DNA, 15 bp, Homo sapiens
gatttaactgtgaac

SEQ ID NO: 3876481 - DNA, 13 bp, Homo sapiens
gatttaatgtttt

SEQ ID NO: 3876482 - DNA, 19 bp, Homo sapiens
gatttagcacccttctgct

SEQ ID NO: 3876483 - DNA, 16 bp, Homo sapiens
gatttcatgctatctc

SEQ ID NO: 3876484 - DNA, 18 bp, Homo sapiens
gatttccaagtaatataa

SEQ ID NO: 3876485 - DNA, 20 bp, Homo sapiens
gatttccaagtaatataatg

SEQ ID NO: 3876486 - DNA, 12 bp, Homo sapiens
gatttccaggcc

SEQ ID NO: 3876487 - DNA, 13 bp, Homo sapiens
gatttccaggccc

SEQ ID NO: 3876488 - DNA, 14 bp, Homo sapiens
gatttccaggcccc

SEQ ID NO: 3876489 - DNA, 14 bp, Homo sapiens
gatttcctatttta

SEQ ID NO: 3876490 - DNA, 16 bp, Homo sapiens
gatttcctattttaaa

SEQ ID NO: 3876491 - DNA, 22 bp, Homo sapiens
gatttcctccatggtggaaggg

SEQ ID NO: 3876492 - DNA, 10 bp, Homo sapiens
gatttctctg

SEQ ID NO: 3876493 - DNA, 17 bp, Homo sapiens
gatttcttcgctgctct

SEQ ID NO: 3876494 - DNA, 15 bp, Homo sapiens
gaggcagggccttgc

SEQ ID NO: 3876495 - DNA, 14 bp, Homo sapiens
gaggcaggggcgga

SEQ ID NO: 3876496 - DNA, 14 bp, Homo sapiens
gaggcatggccctg

SEQ ID NO: 3876497 - DNA, 17 bp, Homo sapiens
gaggcatgtgatgtgca

SEQ ID NO: 3876498 - DNA, 16 bp, Homo sapiens
gaggccaaggcaggta

SEQ ID NO: 3876499 - DNA, 14 bp, Homo sapiens
gaggccagcctggc

SEQ ID NO: 3876500 - DNA, 11 bp, Homo sapiens
gaggcccagcc

SEQ ID NO: 3876501 - DNA, 15 bp, Homo sapiens
gaggcccagcctgtc

SEQ ID NO: 3876502 - DNA, 18 bp, Homo sapiens
gaggcccagcctgtcctg

SEQ ID NO: 3876503 - DNA, 12 bp, Homo sapiens
gaggcccaggga

SEQ ID NO: 3876504 - DNA, 12 bp, Homo sapiens
gaggccctggat

SEQ ID NO: 3876505 - DNA, 23 bp, Homo sapiens
gaggccctggatcagcgtggcct

SEQ ID NO: 3876506 - DNA, 16 bp, Homo sapiens
gaggccctggtgtcag

SEQ ID NO: 3876507 - DNA, 21 bp, Homo sapiens
gaggccctggtgtcaggcagg

SEQ ID NO: 3876508 - DNA, 13 bp, Homo sapiens
gaggcctcatccc

SEQ ID NO: 3876509 - DNA, 18 bp, Homo sapiens
gaggcctctggaaagcaa

SEQ ID NO: 3876510 - DNA, 18 bp, Homo sapiens
gaggcctcttggacctct

SEQ ID NO: 3876511 - DNA, 19 bp, Homo sapiens
gaggcctcttggacctctg

SEQ ID NO: 3876512 - DNA, 24 bp, Homo sapiens
gaggcctcttggacctctgctctg

SEQ ID NO: 3876513 - DNA, 13 bp, Homo sapiens
gaggcctggccag

SEQ ID NO: 3876514 - DNA, 14 bp, Homo sapiens
gaggcctggccagg

SEQ ID NO: 3876515 - DNA, 12 bp, Homo sapiens
gaggcctggcct

SEQ ID NO: 3876516 - DNA, 23 bp, Homo sapiens
gaggcctggccttgtcaggaccc

SEQ ID NO: 3876517 - DNA, 20 bp, Homo sapiens
gaggcgaataaatgttcaaa

SEQ ID NO: 3876518 - DNA, 17 bp, Homo sapiens
gaggcgcagcccgaagc

SEQ ID NO: 3876519 - DNA, 19 bp, Homo sapiens
gaggcggaaaccttgcagc

SEQ ID NO: 3876520 - DNA, 19 bp, Homo sapiens
gaggcggagagtacagtga

SEQ ID NO: 3876521 - DNA, 16 bp, Homo sapiens
gaggcggctccaggtc

SEQ ID NO: 3876522 - DNA, 19 bp, Homo sapiens
gaggctaagatgagatttg

SEQ ID NO: 3876523 - DNA, 20 bp, Homo sapiens
gaggctattattttcactgt

SEQ ID NO: 3876524 - DNA, 21 bp, Homo sapiens
gaggctcaagaggcccaggga

SEQ ID NO: 3876525 - DNA, 23 bp, Homo sapiens
gaggctcaagaggcccagggagc

SEQ ID NO: 3876526 - DNA, 18 bp, Homo sapiens
gaggctcttccatcccca

SEQ ID NO: 3876527 - DNA, 14 bp, Homo sapiens
gaggctgagacagg

SEQ ID NO: 3876528 - DNA, 16 bp, Homo sapiens
gaggctgcagagctga

SEQ ID NO: 3876529 - DNA, 15 bp, Homo sapiens
gaggctgcatgctct

SEQ ID NO: 3876530 - DNA, 17 bp, Homo sapiens
gaggctgcatgctctgg

SEQ ID NO: 3876531 - DNA, 21 bp, Homo sapiens
gaggctgctcggggtgcacag

SEQ ID NO: 3876532 - DNA, 23 bp, Homo sapiens
gaggctgggccagcctcagctca

SEQ ID NO: 3876533 - DNA, 15 bp, Homo sapiens
gaggctgggcccctg

SEQ ID NO: 3876534 - DNA, 16 bp, Homo sapiens
gaggctgggcccctgg

SEQ ID NO: 3876535 - DNA, 17 bp, Homo sapiens
gaggctgggcccctggg

SEQ ID NO: 3876536 - DNA, 16 bp, Homo sapiens
gaggcttccagagagt

SEQ ID NO: 3876537 - DNA, 20 bp, Homo sapiens
gaggcttccagagagtcctc

SEQ ID NO: 3876538 - DNA, 19 bp, Homo sapiens
gagggaacagacaggagaa

SEQ ID NO: 3876539 - DNA, 16 bp, Homo sapiens
gagggaatgaacctgg

SEQ ID NO: 3876540 - DNA, 20 bp, Homo sapiens
gagggaatgttccctgcacc

SEQ ID NO: 3876541 - DNA, 18 bp, Homo sapiens
gagggacaaaggagcctg

SEQ ID NO: 3876542 - DNA, 20 bp, Homo sapiens
gagggacaaaggagcctgtg

SEQ ID NO: 3876543 - DNA, 13 bp, Homo sapiens
gagggacagggtg

SEQ ID NO: 3876544 - DNA, 23 bp, Homo sapiens
gagggactgtcgctgcttcgtgg

SEQ ID NO: 3876545 - DNA, 14 bp, Homo sapiens
gagggagagactct

SEQ ID NO: 3876546 - DNA, 12 bp, Homo sapiens
gagggagaggtg

SEQ ID NO: 3876547 - DNA, 15 bp, Homo sapiens
gagggaggacatcat

SEQ ID NO: 3876548 - DNA, 15 bp, Homo sapiens
gagggagggagaggt

SEQ ID NO: 3876549 - DNA, 23 bp, Homo sapiens
gagggagggggcgctcaggaccc

SEQ ID NO: 3876550 - DNA, 14 bp, Homo sapiens
gagggaggttcctc

SEQ ID NO: 3876551 - DNA, 15 bp, Homo sapiens
gagggatcacagggc

SEQ ID NO: 3876552 - DNA, 17 bp, Homo sapiens
gagggatgtaactattg

SEQ ID NO: 3876553 - DNA, 23 bp, Homo sapiens
gagggatgttctagccctccctg

SEQ ID NO: 3876554 - DNA, 18 bp, Homo sapiens
gagggcaagggccatgct

SEQ ID NO: 3876555 - DNA, 20 bp, Homo sapiens
gagggcaaggggtttccaca

SEQ ID NO: 3876556 - DNA, 11 bp, Homo sapiens
gagggcagagc

SEQ ID NO: 3876557 - DNA, 13 bp, Homo sapiens
gagggcagagcca

SEQ ID NO: 3876558 - DNA, 14 bp, Homo sapiens
gagggcagaggctg

SEQ ID NO: 3876559 - DNA, 14 bp, Homo sapiens
gagggcagcagcca

SEQ ID NO: 3876560 - DNA, 21 bp, Homo sapiens
gagggcagcagccagccctgc

SEQ ID NO: 3876561 - DNA, 15 bp, Homo sapiens
gagggcagtacctgg

SEQ ID NO: 3876562 - DNA, 19 bp, Homo sapiens
gagggcagttcgcagccac

SEQ ID NO: 3876563 - DNA, 23 bp, Homo sapiens
gagggcagttcgcagccaccctg

SEQ ID NO: 3876564 - DNA, 22 bp, Homo sapiens
gagggcccagctgtagccatgg

SEQ ID NO: 3876565 - DNA, 19 bp, Homo sapiens
gagggcctgtgggagcctg

SEQ ID NO: 3876566 - DNA, 20 bp, Homo sapiens
gagggcgtgactcacccaag

SEQ ID NO: 3876567 - DNA, 17 bp, Homo sapiens
gagggctagaacctaga

SEQ ID NO: 3876568 - DNA, 19 bp, Homo sapiens
gagggctagaacctggaga

SEQ ID NO: 3876569 - DNA, 21 bp, Homo sapiens
gagggctagaacctggagagc

SEQ ID NO: 3876570 - DNA, 20 bp, Homo sapiens
gagggctagaacctggcagg

SEQ ID NO: 3876571 - DNA, 18 bp, Homo sapiens
gagggctagaactggaga

SEQ ID NO: 3876572 - DNA, 20 bp, Homo sapiens
gagggctagaatctggagag

SEQ ID NO: 3876573 - DNA, 12 bp, Homo sapiens
gagggctctgag

SEQ ID NO: 3876574 - DNA, 13 bp, Homo sapiens
gagggctggaatc

SEQ ID NO: 3876575 - DNA, 20 bp, Homo sapiens
gagggctggaatctggagag

SEQ ID NO: 3876576 - DNA, 13 bp, Homo sapiens
gagggctgggccc

SEQ ID NO: 3876577 - DNA, 14 bp, Homo sapiens
gagggctgggccca

SEQ ID NO: 3876578 - DNA, 23 bp, Homo sapiens
gagggctgttggacagctgcttg

SEQ ID NO: 3876579 - DNA, 17 bp, Homo sapiens
gaggggcctgggaaagg

SEQ ID NO: 3876580 - DNA, 16 bp, Homo sapiens
gagggggcgctcagga

SEQ ID NO: 3876581 - DNA, 17 bp, Homo sapiens
gagggggtcgtggagag

SEQ ID NO: 3876582 - DNA, 18 bp, Homo sapiens
gagggggtcgtggagagc

SEQ ID NO: 3876583 - DNA, 21 bp, Homo sapiens
gagggggtcgtggagagctag

SEQ ID NO: 3876584 - DNA, 15 bp, Homo sapiens
gaggggtgacagtgg

SEQ ID NO: 3876585 - DNA, 17 bp, Homo sapiens
gaggggttgcgggggag

SEQ ID NO: 3876586 - DNA, 16 bp, Homo sapiens
gagggtaataaactta

SEQ ID NO: 3876587 - DNA, 16 bp, Homo sapiens
gagggtagggcagcag

SEQ ID NO: 3876588 - DNA, 13 bp, Homo sapiens
gagggtaggggag

SEQ ID NO: 3876589 - DNA, 14 bp, Homo sapiens
gagggtggaggaag

SEQ ID NO: 3876590 - DNA, 18 bp, Homo sapiens
gagggtggggccgggtga

SEQ ID NO: 3876591 - DNA, 21 bp, Homo sapiens
gaggtaactatcaatatttaa

SEQ ID NO: 3876592 - DNA, 16 bp, Homo sapiens
gaggtagcgagctgct

SEQ ID NO: 3876593 - DNA, 19 bp, Homo sapiens
gaggtatttatctttactt

SEQ ID NO: 3876594 - DNA, 23 bp, Homo sapiens
gaggtcaacagagaaggcaggaa

SEQ ID NO: 3876595 - DNA, 13 bp, Homo sapiens
gaggtccagaccc

SEQ ID NO: 3876596 - DNA, 20 bp, Homo sapiens
gaggtcctgagcactgccag

SEQ ID NO: 3876597 - DNA, 22 bp, Homo sapiens
gaggtcgaccccaaagcccctt

SEQ ID NO: 3876598 - DNA, 20 bp, Homo sapiens
gaggtcgggagttcgagacc

SEQ ID NO: 3876599 - DNA, 21 bp, Homo sapiens
gaggtctcaggttctttccat

SEQ ID NO: 3876600 - DNA, 16 bp, Homo sapiens
gaggtctccactgagg

SEQ ID NO: 3876601 - DNA, 12 bp, Homo sapiens
gaggtctgagcc

SEQ ID NO: 3876602 - DNA, 16 bp, Homo sapiens
gaggtctgagccctgg

SEQ ID NO: 3876603 - DNA, 17 bp, Homo sapiens
gaggtgaccccagggca

SEQ ID NO: 3876604 - DNA, 18 bp, Homo sapiens
gaggtgaccccagggcac

SEQ ID NO: 3876605 - DNA, 19 bp, Homo sapiens
gaggtgaccccagggcaca

SEQ ID NO: 3876606 - DNA, 23 bp, Homo sapiens
gaggtgaccccagggcacaggag

SEQ ID NO: 3876607 - DNA, 21 bp, Homo sapiens
gaggtgcctgagctggggcct

SEQ ID NO: 3876608 - DNA, 15 bp, Homo sapiens
gaggtggaagccctc

SEQ ID NO: 3876609 - DNA, 20 bp, Homo sapiens
gaggtggaggttgcagtgag

SEQ ID NO: 3876610 - DNA, 19 bp, Homo sapiens
gaggtggattcctgggcaa

SEQ ID NO: 3876611 - DNA, 22 bp, Homo sapiens
gaggtggccagagctgggaggc

SEQ ID NO: 3876612 - DNA, 12 bp, Homo sapiens
gaggtgggcagc

SEQ ID NO: 3876613 - DNA, 17 bp, Homo sapiens
gaggtgggcagctgggc

SEQ ID NO: 3876614 - DNA, 19 bp, Homo sapiens
gaggtgggcagctgggccc

SEQ ID NO: 3876615 - DNA, 13 bp, Homo sapiens
gaggtggtggagg

SEQ ID NO: 3876616 - DNA, 14 bp, Homo sapiens
gaggtggtggagga

SEQ ID NO: 3876617 - DNA, 16 bp, Homo sapiens
gaggtggtggaggagg

SEQ ID NO: 3876618 - DNA, 17 bp, Homo sapiens
gaggtggtggaggagga

SEQ ID NO: 3876619 - DNA, 15 bp, Homo sapiens
gaggttaaaatataa

SEQ ID NO: 3876620 - DNA, 15 bp, Homo sapiens
gaggttatctgcctg

SEQ ID NO: 3876621 - DNA, 16 bp, Homo sapiens
gaggttatctgcctgg

SEQ ID NO: 3876622 - DNA, 19 bp, Homo sapiens
gaggttatctgcctggcct

SEQ ID NO: 3876623 - DNA, 21 bp, Homo sapiens
gaggttatctgcctggcctgg

SEQ ID NO: 3876624 - DNA, 19 bp, Homo sapiens
gaggttctggggaggaagg

SEQ ID NO: 3876625 - DNA, 13 bp, Homo sapiens
gaggttgcagtga

SEQ ID NO: 3876626 - DNA, 20 bp, Homo sapiens
gaggttgccccttccccatc

SEQ ID NO: 3876627 - DNA, 21 bp, Homo sapiens
gagtactagaatttgtatttt

SEQ ID NO: 3876628 - DNA, 19 bp, Homo sapiens
gagtagaaattgttcctga

SEQ ID NO: 3876629 - DNA, 18 bp, Homo sapiens
gagtagcatggactctgg

SEQ ID NO: 3876630 - DNA, 17 bp, Homo sapiens
gagtagccgagagcctg

SEQ ID NO: 3876631 - DNA, 14 bp, Homo sapiens
gagtagctgagagg

SEQ ID NO: 3876632 - DNA, 20 bp, Homo sapiens
gagtagctgagaggaagatg

SEQ ID NO: 3876633 - DNA, 14 bp, Homo sapiens
gagtagctgagctc

SEQ ID NO: 3876634 - DNA, 15 bp, Homo sapiens
gagtagctgagctca

SEQ ID NO: 3876635 - DNA, 17 bp, Homo sapiens
gagtagtttttcagcta

SEQ ID NO: 3876636 - DNA, 17 bp, Homo sapiens
gagtatcaggtctccca

SEQ ID NO: 3876637 - DNA, 18 bp, Homo sapiens
gagtatttacaataaaga

SEQ ID NO: 3876638 - DNA, 15 bp, Homo sapiens
gagtcaaaagcctgg

SEQ ID NO: 3876639 - DNA, 15 bp, Homo sapiens
gagtcaactggagca

SEQ ID NO: 3876640 - DNA, 12 bp, Homo sapiens
gagtcacctcct

SEQ ID NO: 3876641 - DNA, 12 bp, Homo sapiens
gagtcacctgca

SEQ ID NO: 3876642 - DNA, 17 bp, Homo sapiens
gagtcacctgcaagccc

SEQ ID NO: 3876643 - DNA, 13 bp, Homo sapiens
gagtcagaggaga

SEQ ID NO: 3876644 - DNA, 14 bp, Homo sapiens
gagtcagaggagaa

SEQ ID NO: 3876645 - DNA, 17 bp, Homo sapiens
gagtcaggacctccggg

SEQ ID NO: 3876646 - DNA, 21 bp, Homo sapiens
gagtcaggacctccggggaga

SEQ ID NO: 3876647 - DNA, 23 bp, Homo sapiens
gagtcaggacttgaacccaggtc

SEQ ID NO: 3876648 - DNA, 22 bp, Homo sapiens
gagtcccctactcccctgatcc

SEQ ID NO: 3876649 - DNA, 13 bp, Homo sapiens
gagtcctgtctct

SEQ ID NO: 3876650 - DNA, 14 bp, Homo sapiens
gagtcctgtctctg

SEQ ID NO: 3876651 - DNA, 15 bp, Homo sapiens
gagtcctgtctctgc

SEQ ID NO: 3876652 - DNA, 18 bp, Homo sapiens
gagtcctgtctctgcctg

SEQ ID NO: 3876653 - DNA, 12 bp, Homo sapiens
gagtcggcccca

SEQ ID NO: 3876654 - DNA, 20 bp, Homo sapiens
gagtctccagtggttgctgt

SEQ ID NO: 3876655 - DNA, 12 bp, Homo sapiens
gagtctcctgtg

SEQ ID NO: 3876656 - DNA, 15 bp, Homo sapiens
gagtctcttctccac

SEQ ID NO: 3876657 - DNA, 14 bp, Homo sapiens
gagtgaaagggcta

SEQ ID NO: 3876658 - DNA, 15 bp, Homo sapiens
gagtgaatagctttc

SEQ ID NO: 3876659 - DNA, 20 bp, Homo sapiens
gagtgacgggagcctcctct

SEQ ID NO: 3876660 - DNA, 20 bp, Homo sapiens
gagtgacggtcccacactgg

SEQ ID NO: 3876661 - DNA, 18 bp, Homo sapiens
gagtgactcgagggttgg

SEQ ID NO: 3876662 - DNA, 21 bp, Homo sapiens
gagtgactgtaggcagggaac

SEQ ID NO: 3876663 - DNA, 18 bp, Homo sapiens
gagtgaggcttccaggct

SEQ ID NO: 3876664 - DNA, 20 bp, Homo sapiens
gagtgaggcttccaggctct

SEQ ID NO: 3876665 - DNA, 22 bp, Homo sapiens
gagtgatacaacttcaagtgca

SEQ ID NO: 3876666 - DNA, 13 bp, Homo sapiens
gagcatgggtgtg

SEQ ID NO: 3876667 - DNA, 21 bp, Homo sapiens
gagcattacgtgagccaggta

SEQ ID NO: 3876668 - DNA, 21 bp, Homo sapiens
gagccaagatcgcgccactgc

SEQ ID NO: 3876669 - DNA, 15 bp, Homo sapiens
gagccaatagactga

SEQ ID NO: 3876670 - DNA, 15 bp, Homo sapiens
gagccactacctttg

SEQ ID NO: 3876671 - DNA, 12 bp, Homo sapiens
gagccactcctg

SEQ ID NO: 3876672 - DNA, 16 bp, Homo sapiens
gagccactcctgtccc

SEQ ID NO: 3876673 - DNA, 17 bp, Homo sapiens
gagccactcctgtcccg

SEQ ID NO: 3876674 - DNA, 16 bp, Homo sapiens
gagccagaacctggag

SEQ ID NO: 3876675 - DNA, 12 bp, Homo sapiens
gagccagccctc

SEQ ID NO: 3876676 - DNA, 13 bp, Homo sapiens
gagccagccctcc

SEQ ID NO: 3876677 - DNA, 15 bp, Homo sapiens
gagccagccctccct

SEQ ID NO: 3876678 - DNA, 13 bp, Homo sapiens
gagccagcctggg

SEQ ID NO: 3876679 - DNA, 14 bp, Homo sapiens
gagccagcctggga

SEQ ID NO: 3876680 - DNA, 15 bp, Homo sapiens
gagccaggctctgcc

SEQ ID NO: 3876681 - DNA, 22 bp, Homo sapiens
gagccaggtaatgagggactgg

SEQ ID NO: 3876682 - DNA, 23 bp, Homo sapiens
gagccattttggggggcccccct

SEQ ID NO: 3876683 - DNA, 16 bp, Homo sapiens
gagcccaagtgccatc

SEQ ID NO: 3876684 - DNA, 22 bp, Homo sapiens
gagcccaagtgccatcccacat

SEQ ID NO: 3876685 - DNA, 23 bp, Homo sapiens
gagcccacgcccgactagcaggc

SEQ ID NO: 3876686 - DNA, 17 bp, Homo sapiens
gagcccagagggccaag

SEQ ID NO: 3876687 - DNA, 12 bp, Homo sapiens
gagcccaggagt

SEQ ID NO: 3876688 - DNA, 16 bp, Homo sapiens
gagccccaggcctctg

SEQ ID NO: 3876689 - DNA, 18 bp, Homo sapiens
gagccccaggcctctgtg

SEQ ID NO: 3876690 - DNA, 16 bp, Homo sapiens
gagcccccaagcctct

SEQ ID NO: 3876691 - DNA, 13 bp, Homo sapiens
gagccccccacaa

SEQ ID NO: 3876692 - DNA, 17 bp, Homo sapiens
gagccccccgtgtggct

SEQ ID NO: 3876693 - DNA, 13 bp, Homo sapiens
gagccccctggat

SEQ ID NO: 3876694 - DNA, 14 bp, Homo sapiens
gagcccctggtcct

SEQ ID NO: 3876695 - DNA, 20 bp, Homo sapiens
gagccgagattgcgccactg

SEQ ID NO: 3876696 - DNA, 22 bp, Homo sapiens
gagccgcatcttctccatctgg

SEQ ID NO: 3876697 - DNA, 14 bp, Homo sapiens
gagccgggcctggg

SEQ ID NO: 3876698 - DNA, 16 bp, Homo sapiens
gagccgtagagggtgg

SEQ ID NO: 3876699 - DNA, 13 bp, Homo sapiens
gagcctagccacc

SEQ ID NO: 3876700 - DNA, 15 bp, Homo sapiens
gagcctagccacctc

SEQ ID NO: 3876701 - DNA, 17 bp, Homo sapiens
gagcctagccacctccc

SEQ ID NO: 3876702 - DNA, 18 bp, Homo sapiens
gagcctagccacctccca

SEQ ID NO: 3876703 - DNA, 20 bp, Homo sapiens
gagcctagccacctcccacc

SEQ ID NO: 3876704 - DNA, 13 bp, Homo sapiens
gagcctccccctc

SEQ ID NO: 3876705 - DNA, 14 bp, Homo sapiens
gagcctccccctca

SEQ ID NO: 3876706 - DNA, 16 bp, Homo sapiens
gagcctccccctcaga

SEQ ID NO: 3876707 - DNA, 17 bp, Homo sapiens
gagcctccccctcagat

SEQ ID NO: 3876708 - DNA, 22 bp, Homo sapiens
gagcctcctctctcaaactggg

SEQ ID NO: 3876709 - DNA, 21 bp, Homo sapiens
gagcctgcaaactcactgctc

SEQ ID NO: 3876710 - DNA, 13 bp, Homo sapiens
gagcctgccgagc

SEQ ID NO: 3876711 - DNA, 14 bp, Homo sapiens
gagcctgccgagca

SEQ ID NO: 3876712 - DNA, 16 bp, Homo sapiens
gagcctgccgagcaac

SEQ ID NO: 3876713 - DNA, 18 bp, Homo sapiens
gagcctgccgagcaaccg

SEQ ID NO: 3876714 - DNA, 22 bp, Homo sapiens
gagcctgccgagcaaccgtggc

SEQ ID NO: 3876715 - DNA, 13 bp, Homo sapiens
gagcctggagaag

SEQ ID NO: 3876716 - DNA, 14 bp, Homo sapiens
gagcctggagaagc

SEQ ID NO: 3876717 - DNA, 17 bp, Homo sapiens
gagcctggcacaggact

SEQ ID NO: 3876718 - DNA, 17 bp, Homo sapiens
gagcctggcccatagaa

SEQ ID NO: 3876719 - DNA, 13 bp, Homo sapiens
gagcctggggctc

SEQ ID NO: 3876720 - DNA, 15 bp, Homo sapiens
gagcctggggctcta

SEQ ID NO: 3876721 - DNA, 19 bp, Homo sapiens
gagcctgtgaacccaggac

SEQ ID NO: 3876722 - DNA, 19 bp, Homo sapiens
gagcctgtgcctcctcacc

SEQ ID NO: 3876723 - DNA, 19 bp, Homo sapiens
gagccttggtgtccacctg

SEQ ID NO: 3876724 - DNA, 20 bp, Homo sapiens
gagccttggtgtccacctgg

SEQ ID NO: 3876725 - DNA, 22 bp, Homo sapiens
gagccttggtgtccacctggcc

SEQ ID NO: 3876726 - DNA, 17 bp, Homo sapiens
gagcctttggatgacca

SEQ ID NO: 3876727 - DNA, 13 bp, Homo sapiens
gagcgccctgcag

SEQ ID NO: 3876728 - DNA, 14 bp, Homo sapiens
gagcgccctgcaga

SEQ ID NO: 3876729 - DNA, 19 bp, Homo sapiens
gagctacctgtgtggacag

SEQ ID NO: 3876730 - DNA, 21 bp, Homo sapiens
gagctactctcttgccagcat

SEQ ID NO: 3876731 - DNA, 14 bp, Homo sapiens
gagctagaacctgg

SEQ ID NO: 3876732 - DNA, 17 bp, Homo sapiens
gagctagaacctggagg

SEQ ID NO: 3876733 - DNA, 18 bp, Homo sapiens
gagctagcgctgccgcac

SEQ ID NO: 3876734 - DNA, 20 bp, Homo sapiens
gagctatgattatgccactg

SEQ ID NO: 3876735 - DNA, 16 bp, Homo sapiens
gagctatgttccctcc

SEQ ID NO: 3876736 - DNA, 14 bp, Homo sapiens
gagctcacaaggca

SEQ ID NO: 3876737 - DNA, 21 bp, Homo sapiens
gagctcacaaggcagcaaggc

SEQ ID NO: 3876738 - DNA, 15 bp, Homo sapiens
gagctcagaccccca

SEQ ID NO: 3876739 - DNA, 18 bp, Homo sapiens
gagctcagacccccactc

SEQ ID NO: 3876740 - DNA, 20 bp, Homo sapiens
gagctcagacccccactctc

SEQ ID NO: 3876741 - DNA, 21 bp, Homo sapiens
gagctcagacccccactctca

SEQ ID NO: 3876742 - DNA, 14 bp, Homo sapiens
gagctcctgtccct

SEQ ID NO: 3876743 - DNA, 19 bp, Homo sapiens
gagctcctgtccctaccca

SEQ ID NO: 3876744 - DNA, 21 bp, Homo sapiens
gagctcctgtccctacccact

SEQ ID NO: 3876745 - DNA, 12 bp, Homo sapiens
gagctctgagag

SEQ ID NO: 3876746 - DNA, 21 bp, Homo sapiens
gagctctgagaggccctggat

SEQ ID NO: 3876747 - DNA, 17 bp, Homo sapiens
gagctcttggaagagct

SEQ ID NO: 3876748 - DNA, 23 bp, Homo sapiens
gagctgaggggggccgtgcccag

SEQ ID NO: 3876749 - DNA, 14 bp, Homo sapiens
gagctgagtcacct

SEQ ID NO: 3876750 - DNA, 15 bp, Homo sapiens
gagctgagtcacctc

SEQ ID NO: 3876751 - DNA, 20 bp, Homo sapiens
gagctgagtcacctcctcca

SEQ ID NO: 3876752 - DNA, 20 bp, Homo sapiens
ctgcctggaggatccctcca

SEQ ID NO: 3876753 - DNA, 11 bp, Homo sapiens
ctgcctggcct

SEQ ID NO: 3876754 - DNA, 12 bp, Homo sapiens
ctgcctgggcct

SEQ ID NO: 3876755 - DNA, 17 bp, Homo sapiens
ctgcctgggcctgtgca

SEQ ID NO: 3876756 - DNA, 23 bp, Homo sapiens
ctgcctgggcctgtgcagcagcc

SEQ ID NO: 3876757 - DNA, 24 bp, Homo sapiens
ctgcctgggcctgtgcagcagccc

SEQ ID NO: 3876758 - DNA, 15 bp, Homo sapiens
ctgcctgggttttct

SEQ ID NO: 3876759 - DNA, 16 bp, Homo sapiens
ctgcctgtagcagtga

SEQ ID NO: 3876760 - DNA, 21 bp, Homo sapiens
ctgcctgtggccttgcccgcc

SEQ ID NO: 3876761 - DNA, 23 bp, Homo sapiens
ctgcctgtggccttgcccgccag

SEQ ID NO: 3876762 - DNA, 15 bp, Homo sapiens
ctgccttcaccttca

SEQ ID NO: 3876763 - DNA, 18 bp, Homo sapiens
ctgccttcagccctggcc

SEQ ID NO: 3876764 - DNA, 17 bp, Homo sapiens
ctgcctttctcccccga

SEQ ID NO: 3876765 - DNA, 23 bp, Homo sapiens
ctgcctttctcccccgacactgc

SEQ ID NO: 3876766 - DNA, 13 bp, Homo sapiens
ctgcctttggaag

SEQ ID NO: 3876767 - DNA, 18 bp, Homo sapiens
ctgcctttggaagaaaca

SEQ ID NO: 3876768 - DNA, 16 bp, Homo sapiens
ctgccttttgctgctg

SEQ ID NO: 3876769 - DNA, 17 bp, Homo sapiens
ctgcgatcttcagagca

SEQ ID NO: 3876770 - DNA, 18 bp, Homo sapiens
ctgcggagaccctgagtc

SEQ ID NO: 3876771 - DNA, 17 bp, Homo sapiens
ctgcggccgggctgccc

SEQ ID NO: 3876772 - DNA, 19 bp, Homo sapiens
ctgcgtcctgacgccctgc

SEQ ID NO: 3876773 - DNA, 20 bp, Homo sapiens
ctgcgtcctgacgccctgcg

SEQ ID NO: 3876774 - DNA, 14 bp, Homo sapiens
ctgcgtgctttatt

SEQ ID NO: 3876775 - DNA, 17 bp, Homo sapiens
ctgcgtgctttatttat

SEQ ID NO: 3876776 - DNA, 22 bp, Homo sapiens
ctgctacaagaatgcaaaaaat

SEQ ID NO: 3876777 - DNA, 18 bp, Homo sapiens
ctgctaccaaggcccagc

SEQ ID NO: 3876778 - DNA, 20 bp, Homo sapiens
ctgctaccaaggcccagcta

SEQ ID NO: 3876779 - DNA, 15 bp, Homo sapiens
ctgctactcctgtgc

SEQ ID NO: 3876780 - DNA, 17 bp, Homo sapiens
ctgctactcctgtgctc

SEQ ID NO: 3876781 - DNA, 15 bp, Homo sapiens
ctgctagagaagggg

SEQ ID NO: 3876782 - DNA, 13 bp, Homo sapiens
ctgctagagcaac

SEQ ID NO: 3876783 - DNA, 16 bp, Homo sapiens
ctgctagagcaacccc

SEQ ID NO: 3876784 - DNA, 23 bp, Homo sapiens
ctgctagagcaacccctgtaccc

SEQ ID NO: 3876785 - DNA, 19 bp, Homo sapiens
ctgctagctgtagaaatgt

SEQ ID NO: 3876786 - DNA, 16 bp, Homo sapiens
ctgctattatgtaaca

SEQ ID NO: 3876787 - DNA, 17 bp, Homo sapiens
ctgctattatgtaacat

SEQ ID NO: 3876788 - DNA, 23 bp, Homo sapiens
ctgctattatgtaacatccagaa

SEQ ID NO: 3876789 - DNA, 13 bp, Homo sapiens
ctgctcagacaga

SEQ ID NO: 3876790 - DNA, 16 bp, Homo sapiens
ctgctcagcaggccct

SEQ ID NO: 3876791 - DNA, 18 bp, Homo sapiens
ctgctcatcacccagtcc

SEQ ID NO: 3876792 - DNA, 21 bp, Homo sapiens
ctgctcatcacccagtcctgg

SEQ ID NO: 3876793 - DNA, 15 bp, Homo sapiens
ctgctcattccttct

SEQ ID NO: 3876794 - DNA, 11 bp, Homo sapiens
ctgctccagag

SEQ ID NO: 3876795 - DNA, 12 bp, Homo sapiens
ctgctccagaga

SEQ ID NO: 3876796 - DNA, 17 bp, Homo sapiens
ctgctcccagcagccct

SEQ ID NO: 3876797 - DNA, 12 bp, Homo sapiens
ctgctcccccac

SEQ ID NO: 3876798 - DNA, 13 bp, Homo sapiens
ctgctcccccacc

SEQ ID NO: 3876799 - DNA, 14 bp, Homo sapiens
ctgctcccccaccc

SEQ ID NO: 3876800 - DNA, 21 bp, Homo sapiens
ctgctcccccaccccctcccc

SEQ ID NO: 3876801 - DNA, 23 bp, Homo sapiens
ctgctcccccaccccctccccag

SEQ ID NO: 3876802 - DNA, 14 bp, Homo sapiens
ctgctcctcccaac

SEQ ID NO: 3876803 - DNA, 14 bp, Homo sapiens
ctgctcctctccag

SEQ ID NO: 3876804 - DNA, 17 bp, Homo sapiens
ctgctcctctccaggca

SEQ ID NO: 3876805 - DNA, 13 bp, Homo sapiens
ctgctcggggtgc

SEQ ID NO: 3876806 - DNA, 15 bp, Homo sapiens
ctgctctagccagga

SEQ ID NO: 3876807 - DNA, 18 bp, Homo sapiens
ctgctctagctggcagga

SEQ ID NO: 3876808 - DNA, 22 bp, Homo sapiens
ctgctctagctggcaggacaca

SEQ ID NO: 3876809 - DNA, 14 bp, Homo sapiens
ctgctctcatgcct

SEQ ID NO: 3876810 - DNA, 21 bp, Homo sapiens
ctgctctgaggcttccagaga

SEQ ID NO: 3876811 - DNA, 23 bp, Homo sapiens
ctgctctgagttatgttaaaatc

SEQ ID NO: 3876812 - DNA, 13 bp, Homo sapiens
ctgctctgatgca

SEQ ID NO: 3876813 - DNA, 11 bp, Homo sapiens
ctgctctgccc

SEQ ID NO: 3876814 - DNA, 14 bp, Homo sapiens
ctgctctgcccctt

SEQ ID NO: 3876815 - DNA, 13 bp, Homo sapiens
ctgctctggaaaa

SEQ ID NO: 3876816 - DNA, 13 bp, Homo sapiens
ctgctctggggat

SEQ ID NO: 3876817 - DNA, 17 bp, Homo sapiens
ctgctcttagtgcccgc

SEQ ID NO: 3876818 - DNA, 18 bp, Homo sapiens
ctgctgaaacaacaaata

SEQ ID NO: 3876819 - DNA, 11 bp, Homo sapiens
ctgctgaagag

SEQ ID NO: 3876820 - DNA, 12 bp, Homo sapiens
ctgctgagaacc

SEQ ID NO: 3876821 - DNA, 13 bp, Homo sapiens
ctgctgagaacct

SEQ ID NO: 3876822 - DNA, 17 bp, Homo sapiens
ctgctgagaacctggcc

SEQ ID NO: 3876823 - DNA, 16 bp, Homo sapiens
ctgctgagagacccaa

SEQ ID NO: 3876824 - DNA, 21 bp, Homo sapiens
ctgctgagagacccaaggagg

SEQ ID NO: 3876825 - DNA, 11 bp, Homo sapiens
ctgctgagcca

SEQ ID NO: 3876826 - DNA, 14 bp, Homo sapiens
ctgctgagccactc

SEQ ID NO: 3876827 - DNA, 17 bp, Homo sapiens
ctgctgagccactcgca

SEQ ID NO: 3876828 - DNA, 13 bp, Homo sapiens
ctgctgagctctg

SEQ ID NO: 3876829 - DNA, 15 bp, Homo sapiens
ctgctgagctctgag

SEQ ID NO: 3876830 - DNA, 22 bp, Homo sapiens
ctgctgagctctgagaggccct

SEQ ID NO: 3876831 - DNA, 12 bp, Homo sapiens
ctgctgcaaagt

SEQ ID NO: 3876832 - DNA, 21 bp, Homo sapiens
ctgctgcaccagagtgaaagg

SEQ ID NO: 3876833 - DNA, 12 bp, Homo sapiens
ctgctgcccagc

SEQ ID NO: 3876834 - DNA, 13 bp, Homo sapiens
ctgctgctaaggc

SEQ ID NO: 3876835 - DNA, 23 bp, Homo sapiens
ctgctgctaaggctctatttcct

SEQ ID NO: 3876836 - DNA, 17 bp, Homo sapiens
ctgctgctcatccaggg

SEQ ID NO: 3876837 - DNA, 11 bp, Homo sapiens
ctgctgctgag

SEQ ID NO: 3876838 - DNA, 21 bp, Homo sapiens
ctgctgctgagaacctggcct

SEQ ID NO: 3876839 - DNA, 16 bp, Homo sapiens
gagctgatggagaagg

SEQ ID NO: 3876840 - DNA, 18 bp, Homo sapiens
gagctgatggagaaggaa

SEQ ID NO: 3876841 - DNA, 17 bp, Homo sapiens
gagctgatttccaggcc

SEQ ID NO: 3876842 - DNA, 17 bp, Homo sapiens
gagctgctattaaatta

SEQ ID NO: 3876843 - DNA, 16 bp, Homo sapiens
gagctgctctggaaaa

SEQ ID NO: 3876844 - DNA, 17 bp, Homo sapiens
gagctggaaataaacct

SEQ ID NO: 3876845 - DNA, 20 bp, Homo sapiens
gagctggaaataaacctgga

SEQ ID NO: 3876846 - DNA, 18 bp, Homo sapiens
gagctggaaggcagggca

SEQ ID NO: 3876847 - DNA, 16 bp, Homo sapiens
gagctggcattggtct

SEQ ID NO: 3876848 - DNA, 20 bp, Homo sapiens
gagctggcattggtctgctg

SEQ ID NO: 3876849 - DNA, 21 bp, Homo sapiens
gagctggcgactgcagctgca

SEQ ID NO: 3876850 - DNA, 20 bp, Homo sapiens
gagctgggaaacagggagcc

SEQ ID NO: 3876851 - DNA, 23 bp, Homo sapiens
gagctgggaagctgtactcagag

SEQ ID NO: 3876852 - DNA, 16 bp, Homo sapiens
gagctgggaggaaaag

SEQ ID NO: 3876853 - DNA, 17 bp, Homo sapiens
gagctgggaggcatggc

SEQ ID NO: 3876854 - DNA, 14 bp, Homo sapiens
gagctggggccaca

SEQ ID NO: 3876855 - DNA, 14 bp, Homo sapiens
gagctggggcctgg

SEQ ID NO: 3876856 - DNA, 18 bp, Homo sapiens
gagctggggcctggagag

SEQ ID NO: 3876857 - DNA, 19 bp, Homo sapiens
gagctggggtacaggtttg

SEQ ID NO: 3876858 - DNA, 14 bp, Homo sapiens
gagctgtctccagg

SEQ ID NO: 3876859 - DNA, 20 bp, Homo sapiens
gagctgtggactttgttcac

SEQ ID NO: 3876860 - DNA, 18 bp, Homo sapiens
gagctgttggcctcgcct

SEQ ID NO: 3876861 - DNA, 22 bp, Homo sapiens
gagctgttggcctcgcctgggc

SEQ ID NO: 3876862 - DNA, 17 bp, Homo sapiens
gagcttattggccactg

SEQ ID NO: 3876863 - DNA, 18 bp, Homo sapiens
gagcttattggccactgg

SEQ ID NO: 3876864 - DNA, 23 bp, Homo sapiens
gagcttcccaggatccctcccag

SEQ ID NO: 3876865 - DNA, 14 bp, Homo sapiens
gagcttctggcact

SEQ ID NO: 3876866 - DNA, 13 bp, Homo sapiens
gagcttggacagt

SEQ ID NO: 3876867 - DNA, 13 bp, Homo sapiens
gagcttgggaatg

SEQ ID NO: 3876868 - DNA, 16 bp, Homo sapiens
gagcttgtacatattg

SEQ ID NO: 3876869 - DNA, 15 bp, Homo sapiens
gagctttcaaagaag

SEQ ID NO: 3876870 - DNA, 13 bp, Homo sapiens
gaggaaaaaaagc

SEQ ID NO: 3876871 - DNA, 20 bp, Homo sapiens
gaggaaaaccaagccgtggc

SEQ ID NO: 3876872 - DNA, 16 bp, Homo sapiens
gaggaaaagtgcaatg

SEQ ID NO: 3876873 - DNA, 17 bp, Homo sapiens
gaggaacctcaaactgg

SEQ ID NO: 3876874 - DNA, 12 bp, Homo sapiens
gaggaagcaaga

SEQ ID NO: 3876875 - DNA, 14 bp, Homo sapiens
gaggaagggccagg

SEQ ID NO: 3876876 - DNA, 18 bp, Homo sapiens
gaggaagggccaggagag

SEQ ID NO: 3876877 - DNA, 19 bp, Homo sapiens
gaggaattatcatgggaaa

SEQ ID NO: 3876878 - DNA, 15 bp, Homo sapiens
gaggacaaccattcc

SEQ ID NO: 3876879 - DNA, 14 bp, Homo sapiens
gaggacagagctgg

SEQ ID NO: 3876880 - DNA, 21 bp, Homo sapiens
gaggacatgtttttgttttct

SEQ ID NO: 3876881 - DNA, 23 bp, Homo sapiens
gaggaccacagtgggtggcacct

SEQ ID NO: 3876882 - DNA, 17 bp, Homo sapiens
gaggaccctggttactc

SEQ ID NO: 3876883 - DNA, 15 bp, Homo sapiens
gaggacctgagcctg

SEQ ID NO: 3876884 - DNA, 22 bp, Homo sapiens
gaggacgtcatcggaggctggg

SEQ ID NO: 3876885 - DNA, 21 bp, Homo sapiens
gaggactactatttgaagcaa

SEQ ID NO: 3876886 - DNA, 11 bp, Homo sapiens
gaggactgaga

SEQ ID NO: 3876887 - DNA, 15 bp, Homo sapiens
gaggactgagactgg

SEQ ID NO: 3876888 - DNA, 18 bp, Homo sapiens
gaggacttgtgtctctgt

SEQ ID NO: 3876889 - DNA, 9 bp, Homo sapiens
gaggagaaa

SEQ ID NO: 3876890 - DNA, 15 bp, Homo sapiens
gaggagaaataaact

SEQ ID NO: 3876891 - DNA, 17 bp, Homo sapiens
gaggagcacctgaaccc

SEQ ID NO: 3876892 - DNA, 21 bp, Homo sapiens
gaggagcttgggggatgacta

SEQ ID NO: 3876893 - DNA, 16 bp, Homo sapiens
gaggaggcagagaaga

SEQ ID NO: 3876894 - DNA, 20 bp, Homo sapiens
gaggagggcgtgactcaccc

SEQ ID NO: 3876895 - DNA, 20 bp, Homo sapiens
gaggaggtttggggtctgcc

SEQ ID NO: 3876896 - DNA, 21 bp, Homo sapiens
gaggagtagctgagaggaaga

SEQ ID NO: 3876897 - DNA, 18 bp, Homo sapiens
gaggagtccagggcggga

SEQ ID NO: 3876898 - DNA, 14 bp, Homo sapiens
gaggagtctgaggt

SEQ ID NO: 3876899 - DNA, 18 bp, Homo sapiens
gaggagtctgaggtcctg

SEQ ID NO: 3876900 - DNA, 16 bp, Homo sapiens
gaggatcctcacagga

SEQ ID NO: 3876901 - DNA, 18 bp, Homo sapiens
gaggatcctcacaggagc

SEQ ID NO: 3876902 - DNA, 20 bp, Homo sapiens
gaggatcctcacaggagcag

SEQ ID NO: 3876903 - DNA, 18 bp, Homo sapiens
gaggatgaatagatgtga

SEQ ID NO: 3876904 - DNA, 17 bp, Homo sapiens
gaggatgccacagcccc

SEQ ID NO: 3876905 - DNA, 18 bp, Homo sapiens
gaggatgccacagcccca

SEQ ID NO: 3876906 - DNA, 19 bp, Homo sapiens
gaggatgccacagccccac

SEQ ID NO: 3876907 - DNA, 20 bp, Homo sapiens
gaggatgccacagccccaca

SEQ ID NO: 3876908 - DNA, 22 bp, Homo sapiens
gaggatgtgttttgcacgtctt

SEQ ID NO: 3876909 - DNA, 13 bp, Homo sapiens
gaggcaccagctc

SEQ ID NO: 3876910 - DNA, 20 bp, Homo sapiens
gaggcaccagctctgtggcc

SEQ ID NO: 3876911 - DNA, 21 bp, Homo sapiens
gaggcaccagctctgtggcct

SEQ ID NO: 3876912 - DNA, 22 bp, Homo sapiens
gaggcaccagctctgtggcctg

SEQ ID NO: 3876913 - DNA, 16 bp, Homo sapiens
gaggcaccggcgctgc

SEQ ID NO: 3876914 - DNA, 18 bp, Homo sapiens
gaggcaccggcgctgcag

SEQ ID NO: 3876915 - DNA, 19 bp, Homo sapiens
gaggcaccggcgctgcagg

SEQ ID NO: 3876916 - DNA, 14 bp, Homo sapiens
gaggcacctgctgg

SEQ ID NO: 3876917 - DNA, 16 bp, Homo sapiens
gaggcagagaaagaag

SEQ ID NO: 3876918 - DNA, 16 bp, Homo sapiens
gaggcagagaagaaag

SEQ ID NO: 3876919 - DNA, 18 bp, Homo sapiens
gaggcagagaagaaagaa

SEQ ID NO: 3876920 - DNA, 12 bp, Homo sapiens
gaggcagctcca

SEQ ID NO: 3876921 - DNA, 15 bp, Homo sapiens
gaggcagctccaaca

SEQ ID NO: 3876922 - DNA, 19 bp, Homo sapiens
gaggcagctccaacagctt

SEQ ID NO: 3876923 - DNA, 16 bp, Homo sapiens
gaggcaggctccccct

SEQ ID NO: 3876924 - DNA, 17 bp, Homo sapiens
gaggcaggctccccctg

SEQ ID NO: 3876925 - DNA, 19 bp, Homo sapiens
gagaagttttgtacagaga

SEQ ID NO: 3876926 - DNA, 14 bp, Homo sapiens
gagaatatatacat

SEQ ID NO: 3876927 - DNA, 14 bp, Homo sapiens
gagaatcagggcag

SEQ ID NO: 3876928 - DNA, 14 bp, Homo sapiens
gagaatcctgcctc

SEQ ID NO: 3876929 - DNA, 13 bp, Homo sapiens
gagaatgagcctc

SEQ ID NO: 3876930 - DNA, 17 bp, Homo sapiens
gagaatgcccaactctt

SEQ ID NO: 3876931 - DNA, 17 bp, Homo sapiens
gagaattgggattacat

SEQ ID NO: 3876932 - DNA, 22 bp, Homo sapiens
gagacaaacacctcccaggaga

SEQ ID NO: 3876933 - DNA, 15 bp, Homo sapiens
gagacaaggaaccac

SEQ ID NO: 3876934 - DNA, 14 bp, Homo sapiens
gagacacagagatg

SEQ ID NO: 3876935 - DNA, 16 bp, Homo sapiens
gagacacagagatgga

SEQ ID NO: 3876936 - DNA, 22 bp, Homo sapiens
gagacacagagtggagccctca

SEQ ID NO: 3876937 - DNA, 16 bp, Homo sapiens
gagacacagcgtccct

SEQ ID NO: 3876938 - DNA, 13 bp, Homo sapiens
gagacacctgcac

SEQ ID NO: 3876939 - DNA, 15 bp, Homo sapiens
gagacacctgcacct

SEQ ID NO: 3876940 - DNA, 18 bp, Homo sapiens
gagacacctgcacctccc

SEQ ID NO: 3876941 - DNA, 19 bp, Homo sapiens
gagacacctgcacctcccc

SEQ ID NO: 3876942 - DNA, 15 bp, Homo sapiens
gagacactcccaggg

SEQ ID NO: 3876943 - DNA, 17 bp, Homo sapiens
gagacactcccagggac

SEQ ID NO: 3876944 - DNA, 18 bp, Homo sapiens
gagacagaaacagagaga

SEQ ID NO: 3876945 - DNA, 21 bp, Homo sapiens
gagacagaaacagagagagac

SEQ ID NO: 3876946 - DNA, 18 bp, Homo sapiens
gagacagagagagactga

SEQ ID NO: 3876947 - DNA, 15 bp, Homo sapiens
gagacagagccccca

SEQ ID NO: 3876948 - DNA, 16 bp, Homo sapiens
gagacagagcccccaa

SEQ ID NO: 3876949 - DNA, 17 bp, Homo sapiens
gagacagagcccccaag

SEQ ID NO: 3876950 - DNA, 19 bp, Homo sapiens
gagacagagcccccaagcc

SEQ ID NO: 3876951 - DNA, 15 bp, Homo sapiens
gagacaggaaagaat

SEQ ID NO: 3876952 - DNA, 12 bp, Homo sapiens
gagacaggaagg

SEQ ID NO: 3876953 - DNA, 19 bp, Homo sapiens
gagacagggcaatcttgtc

SEQ ID NO: 3876954 - DNA, 18 bp, Homo sapiens
gagacatgtaccttgacc

SEQ ID NO: 3876955 - DNA, 15 bp, Homo sapiens
gagacattgcctcca

SEQ ID NO: 3876956 - DNA, 15 bp, Homo sapiens
gagaccaacctgacc

SEQ ID NO: 3876957 - DNA, 23 bp, Homo sapiens
gagaccacagcaattggctcctc

SEQ ID NO: 3876958 - DNA, 11 bp, Homo sapiens
gagaccagcac

SEQ ID NO: 3876959 - DNA, 23 bp, Homo sapiens
gagaccatcctggcccctccaga

SEQ ID NO: 3876960 - DNA, 12 bp, Homo sapiens
gagaccccttcc

SEQ ID NO: 3876961 - DNA, 14 bp, Homo sapiens
gagaccccttcctt

SEQ ID NO: 3876962 - DNA, 15 bp, Homo sapiens
gagaccccttccttt

SEQ ID NO: 3876963 - DNA, 17 bp, Homo sapiens
gagaccctcgccacggg

SEQ ID NO: 3876964 - DNA, 19 bp, Homo sapiens
gagacccttgcattagaaa

SEQ ID NO: 3876965 - DNA, 23 bp, Homo sapiens
gagaccttttctctcccatacca

SEQ ID NO: 3876966 - DNA, 22 bp, Homo sapiens
gagacgcagccctgggggccag

SEQ ID NO: 3876967 - DNA, 14 bp, Homo sapiens
gagacggctggacc

SEQ ID NO: 3876968 - DNA, 15 bp, Homo sapiens
gagacggctggacct

SEQ ID NO: 3876969 - DNA, 16 bp, Homo sapiens
gagacggctggacctg

SEQ ID NO: 3876970 - DNA, 14 bp, Homo sapiens
gagactaagccctg

SEQ ID NO: 3876971 - DNA, 22 bp, Homo sapiens
gagactatggagcctggcacag

SEQ ID NO: 3876972 - DNA, 15 bp, Homo sapiens
gagactcacctctgc

SEQ ID NO: 3876973 - DNA, 17 bp, Homo sapiens
gagactcacctctgcct

SEQ ID NO: 3876974 - DNA, 19 bp, Homo sapiens
gagactcacctctgcctca

SEQ ID NO: 3876975 - DNA, 20 bp, Homo sapiens
gagactcacctctgcctcaa

SEQ ID NO: 3876976 - DNA, 23 bp, Homo sapiens
gagactcacctctgcctcaatgt

SEQ ID NO: 3876977 - DNA, 20 bp, Homo sapiens
gagactccagaatctgctgt

SEQ ID NO: 3876978 - DNA, 17 bp, Homo sapiens
gagactcctgccctgtt

SEQ ID NO: 3876979 - DNA, 13 bp, Homo sapiens
gagactctggcct

SEQ ID NO: 3876980 - DNA, 17 bp, Homo sapiens
gagactgaaagcagcag

SEQ ID NO: 3876981 - DNA, 21 bp, Homo sapiens
gagactgaaagcagcagctag

SEQ ID NO: 3876982 - DNA, 15 bp, Homo sapiens
gagactgagggagag

SEQ ID NO: 3876983 - DNA, 18 bp, Homo sapiens
gagactgagggagagact

SEQ ID NO: 3876984 - DNA, 22 bp, Homo sapiens
gagacttttaatcagacaaagt

SEQ ID NO: 3876985 - DNA, 13 bp, Homo sapiens
gagagaaaactta

SEQ ID NO: 3876986 - DNA, 11 bp, Homo sapiens
gagagaaagaa

SEQ ID NO: 3876987 - DNA, 18 bp, Homo sapiens
gagagacacagcgtccct

SEQ ID NO: 3876988 - DNA, 13 bp, Homo sapiens
gagagacactccc

SEQ ID NO: 3876989 - DNA, 19 bp, Homo sapiens
gagagacgtgtacatagtg

SEQ ID NO: 3876990 - DNA, 19 bp, Homo sapiens
gagagactgaaagcagcag

SEQ ID NO: 3876991 - DNA, 17 bp, Homo sapiens
gagagactgagggagag

SEQ ID NO: 3876992 - DNA, 14 bp, Homo sapiens
gagagagagagagg

SEQ ID NO: 3876993 - DNA, 15 bp, Homo sapiens
gagagagagagaggt

SEQ ID NO: 3876994 - DNA, 16 bp, Homo sapiens
gagagagagagaggtt

SEQ ID NO: 3876995 - DNA, 19 bp, Homo sapiens
gagagagatctagaaagtg

SEQ ID NO: 3876996 - DNA, 21 bp, Homo sapiens
gagagaggttctggggaggaa

SEQ ID NO: 3876997 - DNA, 23 bp, Homo sapiens
gagagattttgtcgggacagaga

SEQ ID NO: 3876998 - DNA, 12 bp, Homo sapiens
gagagcagaggg

SEQ ID NO: 3876999 - DNA, 13 bp, Homo sapiens
gagagcagctggc

SEQ ID NO: 3877000 - DNA, 14 bp, Homo sapiens
gagagcagctggct

SEQ ID NO: 3877001 - DNA, 13 bp, Homo sapiens
gagagccagccct

SEQ ID NO: 3877002 - DNA, 14 bp, Homo sapiens
gagagccagccctc

SEQ ID NO: 3877003 - DNA, 13 bp, Homo sapiens
gagagccagctct

SEQ ID NO: 3877004 - DNA, 17 bp, Homo sapiens
gagagccagctctctct

SEQ ID NO: 3877005 - DNA, 19 bp, Homo sapiens
gagagccctgctgtgggag

SEQ ID NO: 3877006 - DNA, 13 bp, Homo sapiens
gagagccctggga

SEQ ID NO: 3877007 - DNA, 21 bp, Homo sapiens
gagagcctgctcccccacccc

SEQ ID NO: 3877008 - DNA, 19 bp, Homo sapiens
gagagctagaacccggcag

SEQ ID NO: 3877009 - DNA, 17 bp, Homo sapiens
gagagctagaacctaga

SEQ ID NO: 3877010 - DNA, 20 bp, Homo sapiens
gagagctagaacctggagag

SEQ ID NO: 3877011 - DNA, 14 bp, Homo sapiens
gagagctaggagca

SEQ ID NO: 3877012 - DNA, 14 bp, Homo sapiens
gagaggaagatgaa

SEQ ID NO: 3877013 - DNA, 19 bp, Homo sapiens
gagaggaatgcctgtgtga

SEQ ID NO: 3877014 - DNA, 19 bp, Homo sapiens
gagaggagcacctgaaccc

SEQ ID NO: 3877015 - DNA, 24 bp, Homo sapiens
gagaggccctggatcagcgtggcc

SEQ ID NO: 3877016 - DNA, 16 bp, Homo sapiens
gagaggcggcctcgtg

SEQ ID NO: 3877017 - DNA, 13 bp, Homo sapiens
gagagggagggag

SEQ ID NO: 3877018 - DNA, 14 bp, Homo sapiens
gagagggcccagct

SEQ ID NO: 3877019 - DNA, 16 bp, Homo sapiens
gagagggcccagctgt

SEQ ID NO: 3877020 - DNA, 21 bp, Homo sapiens
gagagggctgttggacagctg

SEQ ID NO: 3877021 - DNA, 23 bp, Homo sapiens
gagagggctgttggacagctgct

SEQ ID NO: 3877022 - DNA, 18 bp, Homo sapiens
gagaggggaagggccagt

SEQ ID NO: 3877023 - DNA, 21 bp, Homo sapiens
gagaggggaataatagaagaa

SEQ ID NO: 3877024 - DNA, 18 bp, Homo sapiens
gagaggggcctgggaaag

SEQ ID NO: 3877025 - DNA, 19 bp, Homo sapiens
gagaggggcctgggaaagg

SEQ ID NO: 3877026 - DNA, 13 bp, Homo sapiens
gagagggtctgga

SEQ ID NO: 3877027 - DNA, 18 bp, Homo sapiens
gagaggttctggggagga

SEQ ID NO: 3877028 - DNA, 18 bp, Homo sapiens
gagagtagccgagagcct

SEQ ID NO: 3877029 - DNA, 21 bp, Homo sapiens
gagagtcctttgggattctag

SEQ ID NO: 3877030 - DNA, 22 bp, Homo sapiens
gagagtcctttgggattctagg

SEQ ID NO: 3877031 - DNA, 21 bp, Homo sapiens
gagagtggctcctcccggtgc

SEQ ID NO: 3877032 - DNA, 12 bp, Homo sapiens
gagagtggctta

SEQ ID NO: 3877033 - DNA, 13 bp, Homo sapiens
gagagttggctca

SEQ ID NO: 3877034 - DNA, 19 bp, Homo sapiens
gagagttggctcaggcaga

SEQ ID NO: 3877035 - DNA, 21 bp, Homo sapiens
gagatactctccctgacattt

SEQ ID NO: 3877036 - DNA, 12 bp, Homo sapiens
gagatatgcaca

SEQ ID NO: 3877037 - DNA, 17 bp, Homo sapiens
gagatatggcagcgaaa

SEQ ID NO: 3877038 - DNA, 12 bp, Homo sapiens
gagatcagagtc

SEQ ID NO: 3877039 - DNA, 17 bp, Homo sapiens
gagatcctaactgagaa

SEQ ID NO: 3877040 - DNA, 22 bp, Homo sapiens
gagatcgtgccgttactctcca

SEQ ID NO: 3877041 - DNA, 18 bp, Homo sapiens
gagatctgggaggtctcc

SEQ ID NO: 3877042 - DNA, 15 bp, Homo sapiens
gagatgatgatgatg

SEQ ID NO: 3877043 - DNA, 14 bp, Homo sapiens
gagatgcagaggta

SEQ ID NO: 3877044 - DNA, 19 bp, Homo sapiens
gagatgcctccaccgctgc

SEQ ID NO: 3877045 - DNA, 20 bp, Homo sapiens
gagatgcctccaccgctgcc

SEQ ID NO: 3877046 - DNA, 22 bp, Homo sapiens
gagatgcctccaccgctgccta

SEQ ID NO: 3877047 - DNA, 23 bp, Homo sapiens
gagatgcctccaccgctgcctaa

SEQ ID NO: 3877048 - DNA, 22 bp, Homo sapiens
gagatggacccctcccttgctc

SEQ ID NO: 3877049 - DNA, 15 bp, Homo sapiens
gagatggtcagtgtg

SEQ ID NO: 3877050 - DNA, 23 bp, Homo sapiens
gagattaattttaacttaaattt

SEQ ID NO: 3877051 - DNA, 21 bp, Homo sapiens
gagattgcaccactgcactcc

SEQ ID NO: 3877052 - DNA, 17 bp, Homo sapiens
gagattgcgccactgca

SEQ ID NO: 3877053 - DNA, 15 bp, Homo sapiens
gagatttgccagcac

SEQ ID NO: 3877054 - DNA, 13 bp, Homo sapiens
gagcaaagcctgt

SEQ ID NO: 3877055 - DNA, 14 bp, Homo sapiens
gagcaaagcctgtt

SEQ ID NO: 3877056 - DNA, 14 bp, Homo sapiens
gagcaaagtctaaa

SEQ ID NO: 3877057 - DNA, 14 bp, Homo sapiens
gagcaacccctgta

SEQ ID NO: 3877058 - DNA, 15 bp, Homo sapiens
gagcaaccgtggccc

SEQ ID NO: 3877059 - DNA, 21 bp, Homo sapiens
gagcaaccgtggcccttcctg

SEQ ID NO: 3877060 - DNA, 22 bp, Homo sapiens
gagcaaccgtggcccttcctgg

SEQ ID NO: 3877061 - DNA, 16 bp, Homo sapiens
gagcaactctccactc

SEQ ID NO: 3877062 - DNA, 13 bp, Homo sapiens
gagcacagccctg

SEQ ID NO: 3877063 - DNA, 14 bp, Homo sapiens
gagcacagccctgg

SEQ ID NO: 3877064 - DNA, 15 bp, Homo sapiens
gagcacagccctggg

SEQ ID NO: 3877065 - DNA, 19 bp, Homo sapiens
gagcacagccctgggaggg

SEQ ID NO: 3877066 - DNA, 15 bp, Homo sapiens
gagcacaggcagctg

SEQ ID NO: 3877067 - DNA, 13 bp, Homo sapiens
gagcaccaggcac

SEQ ID NO: 3877068 - DNA, 15 bp, Homo sapiens
gagcaccaggcacga

SEQ ID NO: 3877069 - DNA, 23 bp, Homo sapiens
gagcaccaggcacgaacccacct

SEQ ID NO: 3877070 - DNA, 12 bp, Homo sapiens
gagcaccccctc

SEQ ID NO: 3877071 - DNA, 13 bp, Homo sapiens
gagcactgccagg

SEQ ID NO: 3877072 - DNA, 14 bp, Homo sapiens
gagcactgccagga

SEQ ID NO: 3877073 - DNA, 17 bp, Homo sapiens
gagcactgccaggaggg

SEQ ID NO: 3877074 - DNA, 23 bp, Homo sapiens
gagcactggccagagagggccca

SEQ ID NO: 3877075 - DNA, 13 bp, Homo sapiens
gagcactgggttg

SEQ ID NO: 3877076 - DNA, 20 bp, Homo sapiens
gagcagaaataaaaagcatg

SEQ ID NO: 3877077 - DNA, 21 bp, Homo sapiens
gagcagacaggaggaatcatg

SEQ ID NO: 3877078 - DNA, 23 bp, Homo sapiens
gagcagagctgatggagaaggaa

SEQ ID NO: 3877079 - DNA, 19 bp, Homo sapiens
gagcagaggagtccagggc

SEQ ID NO: 3877080 - DNA, 13 bp, Homo sapiens
gagcagcctgatg

SEQ ID NO: 3877081 - DNA, 14 bp, Homo sapiens
gagcagcctgatgg

SEQ ID NO: 3877082 - DNA, 14 bp, Homo sapiens
gagcagctgagcag

SEQ ID NO: 3877083 - DNA, 15 bp, Homo sapiens
gagcagctggctctc

SEQ ID NO: 3877084 - DNA, 14 bp, Homo sapiens
gagcaggaatggga

SEQ ID NO: 3877085 - DNA, 15 bp, Homo sapiens
gagcaggcacatgga

SEQ ID NO: 3877086 - DNA, 17 bp, Homo sapiens
gagcaggcccgacagag

SEQ ID NO: 3877087 - DNA, 22 bp, Homo sapiens
gagcaggcccgacagagagatg

SEQ ID NO: 3877088 - DNA, 16 bp, Homo sapiens
gagcaggggtctgagc

SEQ ID NO: 3877089 - DNA, 17 bp, Homo sapiens
gagcaggggtctgagcc

SEQ ID NO: 3877090 - DNA, 18 bp, Homo sapiens
gagcaggggtctgagcca

SEQ ID NO: 3877091 - DNA, 20 bp, Homo sapiens
gagcagtcagggtgggaaga

SEQ ID NO: 3877092 - DNA, 21 bp, Homo sapiens
gagcagtggccgcaagcgcag

SEQ ID NO: 3877093 - DNA, 21 bp, Homo sapiens
gagcataataaatggatgagg

SEQ ID NO: 3877094 - DNA, 20 bp, Homo sapiens
gagcatcatgcctctgaggc

SEQ ID NO: 3877095 - DNA, 16 bp, Homo sapiens
gagcatggctgtgagg

SEQ ID NO: 3877096 - DNA, 19 bp, Homo sapiens
gagcatggctgtgaggatg

SEQ ID NO: 3877097 - DNA, 13 bp, Homo sapiens
gaccacctgccca

SEQ ID NO: 3877098 - DNA, 15 bp, Homo sapiens
gaccacgggcctcag

SEQ ID NO: 3877099 - DNA, 20 bp, Homo sapiens
gaccacgggcctcagtttcc

SEQ ID NO: 3877100 - DNA, 17 bp, Homo sapiens
gaccactgtcctggctg

SEQ ID NO: 3877101 - DNA, 11 bp, Homo sapiens
gaccagaccta

SEQ ID NO: 3877102 - DNA, 21 bp, Homo sapiens
gaccagagccccacacggagg

SEQ ID NO: 3877103 - DNA, 23 bp, Homo sapiens
gaccagcctgttggacccgctct

SEQ ID NO: 3877104 - DNA, 14 bp, Homo sapiens
gaccaggactatag

SEQ ID NO: 3877105 - DNA, 16 bp, Homo sapiens
gaccaggcaccaggca

SEQ ID NO: 3877106 - DNA, 23 bp, Homo sapiens
gaccagggcttttcccaggaata

SEQ ID NO: 3877107 - DNA, 23 bp, Homo sapiens
gaccaggggtgatttcagagagg

SEQ ID NO: 3877108 - DNA, 21 bp, Homo sapiens
gaccaggttattttaaaaaga

SEQ ID NO: 3877109 - DNA, 14 bp, Homo sapiens
gaccagtactggga

SEQ ID NO: 3877110 - DNA, 16 bp, Homo sapiens
gaccagttctggccag

SEQ ID NO: 3877111 - DNA, 16 bp, Homo sapiens
gaccataacagccaac

SEQ ID NO: 3877112 - DNA, 21 bp, Homo sapiens
gaccatcctggcccctccaga

SEQ ID NO: 3877113 - DNA, 14 bp, Homo sapiens
gaccattgacctca

SEQ ID NO: 3877114 - DNA, 16 bp, Homo sapiens
gaccattgtcttccaa

SEQ ID NO: 3877115 - DNA, 18 bp, Homo sapiens
gaccattgtcttccaacc

SEQ ID NO: 3877116 - DNA, 11 bp, Homo sapiens
gacccaaagac

SEQ ID NO: 3877117 - DNA, 17 bp, Homo sapiens
gacccaagaggtgggga

SEQ ID NO: 3877118 - DNA, 14 bp, Homo sapiens
gacccaaggaggaa

SEQ ID NO: 3877119 - DNA, 14 bp, Homo sapiens
gacccacagcctct

SEQ ID NO: 3877120 - DNA, 14 bp, Homo sapiens
gacccacatgccat

SEQ ID NO: 3877121 - DNA, 19 bp, Homo sapiens
gacccaccaaactgcacac

SEQ ID NO: 3877122 - DNA, 20 bp, Homo sapiens
gacccacccatcttcctgct

SEQ ID NO: 3877123 - DNA, 22 bp, Homo sapiens
gacccacccatcttcctgctgc

SEQ ID NO: 3877124 - DNA, 17 bp, Homo sapiens
gacccagacacatcgca

SEQ ID NO: 3877125 - DNA, 15 bp, Homo sapiens
gacccagatcctcac

SEQ ID NO: 3877126 - DNA, 18 bp, Homo sapiens
gacccagctactctgtcc

SEQ ID NO: 3877127 - DNA, 20 bp, Homo sapiens
gacccagctactctgtccag

SEQ ID NO: 3877128 - DNA, 23 bp, Homo sapiens
gacccagctactctgtccaggcc

SEQ ID NO: 3877129 - DNA, 17 bp, Homo sapiens
gacccaggccgcctgcc

SEQ ID NO: 3877130 - DNA, 18 bp, Homo sapiens
gacccaggccgcctgcca

SEQ ID NO: 3877131 - DNA, 18 bp, Homo sapiens
gaccccaaagagcctgga

SEQ ID NO: 3877132 - DNA, 23 bp, Homo sapiens
gaccccaaagagcctggagaagc

SEQ ID NO: 3877133 - DNA, 19 bp, Homo sapiens
gaccccagcggctgagtca

SEQ ID NO: 3877134 - DNA, 11 bp, Homo sapiens
gaccccagggc

SEQ ID NO: 3877135 - DNA, 14 bp, Homo sapiens
gaccccagggcaca

SEQ ID NO: 3877136 - DNA, 18 bp, Homo sapiens
gaccccagggcacaggag

SEQ ID NO: 3877137 - DNA, 12 bp, Homo sapiens
gacccccaacca

SEQ ID NO: 3877138 - DNA, 20 bp, Homo sapiens
gaccccccaccaccagccgg

SEQ ID NO: 3877139 - DNA, 18 bp, Homo sapiens
gaccccgggcgtggacca

SEQ ID NO: 3877140 - DNA, 23 bp, Homo sapiens
gacccctcccttgctcagtgcct

SEQ ID NO: 3877141 - DNA, 13 bp, Homo sapiens
gacccctggcttt

SEQ ID NO: 3877142 - DNA, 18 bp, Homo sapiens
gaccccttcctttcctct

SEQ ID NO: 3877143 - DNA, 22 bp, Homo sapiens
gacccgaagcccaggctgaaga

SEQ ID NO: 3877144 - DNA, 14 bp, Homo sapiens
gacccgctctggac

SEQ ID NO: 3877145 - DNA, 19 bp, Homo sapiens
gacccggcaccccctgcag

SEQ ID NO: 3877146 - DNA, 22 bp, Homo sapiens
gaccctccaccgcagaaggaag

SEQ ID NO: 3877147 - DNA, 15 bp, Homo sapiens
gaccctcgcagcagg

SEQ ID NO: 3877148 - DNA, 17 bp, Homo sapiens
gaccctcgcagcaggtg

SEQ ID NO: 3877149 - DNA, 11 bp, Homo sapiens
gaccctgagac

SEQ ID NO: 3877150 - DNA, 20 bp, Homo sapiens
gaccctgagtccgggaggca

SEQ ID NO: 3877151 - DNA, 22 bp, Homo sapiens
gaccctgcccatacccctgcct

SEQ ID NO: 3877152 - DNA, 23 bp, Homo sapiens
gaccctgcccttgtttggggcag

SEQ ID NO: 3877153 - DNA, 15 bp, Homo sapiens
gaccctgcctgagcc

SEQ ID NO: 3877154 - DNA, 11 bp, Homo sapiens
gaccctggaat

SEQ ID NO: 3877155 - DNA, 19 bp, Homo sapiens
gaccctggaattcagcacc

SEQ ID NO: 3877156 - DNA, 21 bp, Homo sapiens
gaccctggaattcagcaccct

SEQ ID NO: 3877157 - DNA, 22 bp, Homo sapiens
gaccctggaattcagcaccctg

SEQ ID NO: 3877158 - DNA, 17 bp, Homo sapiens
gaccctgttttccacac

SEQ ID NO: 3877159 - DNA, 21 bp, Homo sapiens
gacccttcccaatcagcactg

SEQ ID NO: 3877160 - DNA, 15 bp, Homo sapiens
gacccttgcattaga

SEQ ID NO: 3877161 - DNA, 22 bp, Homo sapiens
gaccctttccttccttccctgg

SEQ ID NO: 3877162 - DNA, 20 bp, Homo sapiens
gaccgctacaccactctggc

SEQ ID NO: 3877163 - DNA, 16 bp, Homo sapiens
gaccgcttcacccctg

SEQ ID NO: 3877164 - DNA, 17 bp, Homo sapiens
gaccgcttcccagaggc

SEQ ID NO: 3877165 - DNA, 14 bp, Homo sapiens
gaccgggggccaga

SEQ ID NO: 3877166 - DNA, 14 bp, Homo sapiens
gaccgggtgggcct

SEQ ID NO: 3877167 - DNA, 15 bp, Homo sapiens
gaccgggtgggcctg

SEQ ID NO: 3877168 - DNA, 16 bp, Homo sapiens
gaccgggtgggcctgg

SEQ ID NO: 3877169 - DNA, 19 bp, Homo sapiens
gaccgggtgggcctggcct

SEQ ID NO: 3877170 - DNA, 17 bp, Homo sapiens
gaccgtggccctgccct

SEQ ID NO: 3877171 - DNA, 16 bp, Homo sapiens
gaccgtgtcccaagga

SEQ ID NO: 3877172 - DNA, 18 bp, Homo sapiens
gaccgttttcatcctggc

SEQ ID NO: 3877173 - DNA, 22 bp, Homo sapiens
gaccgttttcatcctggcctcc

SEQ ID NO: 3877174 - DNA, 15 bp, Homo sapiens
gacctagacctgggc

SEQ ID NO: 3877175 - DNA, 18 bp, Homo sapiens
gacctagacctgggccaa

SEQ ID NO: 3877176 - DNA, 21 bp, Homo sapiens
gacctatgtcctaaggacaca

SEQ ID NO: 3877177 - DNA, 22 bp, Homo sapiens
gacctatgtcctaaggacacac

SEQ ID NO: 3877178 - DNA, 16 bp, Homo sapiens
gacctcacagtgaccc

SEQ ID NO: 3877179 - DNA, 20 bp, Homo sapiens
gacctcacagtgacccttcc

SEQ ID NO: 3877180 - DNA, 21 bp, Homo sapiens
gacctcacagtgacccttccc

SEQ ID NO: 3877181 - DNA, 22 bp, Homo sapiens
gacctcacagtgacccttccca

SEQ ID NO: 3877182 - DNA, 19 bp, Homo sapiens
gacctcagctgcacattcc

SEQ ID NO: 3877183 - DNA, 21 bp, Homo sapiens
gacctcagctgcacattcctg

SEQ ID NO: 3877184 - DNA, 15 bp, Homo sapiens
gacctcccagcccta

SEQ ID NO: 3877185 - DNA, 21 bp, Homo sapiens
gacctcccagccctatggatg

SEQ ID NO: 3877186 - DNA, 22 bp, Homo sapiens
gacctcccagccctatggatgt

SEQ ID NO: 3877187 - DNA, 14 bp, Homo sapiens
gacctccccacccc

SEQ ID NO: 3877188 - DNA, 16 bp, Homo sapiens
gacctccggggagagc

SEQ ID NO: 3877189 - DNA, 15 bp, Homo sapiens
gacctcgtcctcccc

SEQ ID NO: 3877190 - DNA, 17 bp, Homo sapiens
gacctcgtcctccccct

SEQ ID NO: 3877191 - DNA, 18 bp, Homo sapiens
gacctcgtcctccccctg

SEQ ID NO: 3877192 - DNA, 19 bp, Homo sapiens
gacctcgtcctccccctgc

SEQ ID NO: 3877193 - DNA, 22 bp, Homo sapiens
gacctcgtcctccccctgccag

SEQ ID NO: 3877194 - DNA, 23 bp, Homo sapiens
gacctgaagggtgacatcccagg

SEQ ID NO: 3877195 - DNA, 13 bp, Homo sapiens
gacctgaccggca

SEQ ID NO: 3877196 - DNA, 17 bp, Homo sapiens
gacctgagcctgccgag

SEQ ID NO: 3877197 - DNA, 18 bp, Homo sapiens
gacctgaggctcctgtgc

SEQ ID NO: 3877198 - DNA, 21 bp, Homo sapiens
gacctgagtcggccccacatg

SEQ ID NO: 3877199 - DNA, 15 bp, Homo sapiens
gacctgatcacctct

SEQ ID NO: 3877200 - DNA, 20 bp, Homo sapiens
gacctgcctctcacacacat

SEQ ID NO: 3877201 - DNA, 20 bp, Homo sapiens
gacctgcggctgctgtgtgc

SEQ ID NO: 3877202 - DNA, 19 bp, Homo sapiens
gacctgctgagctctgaga

SEQ ID NO: 3877203 - DNA, 18 bp, Homo sapiens
gacctgttagatgtgaca

SEQ ID NO: 3877204 - DNA, 23 bp, Homo sapiens
gaccttcctgccaccagtcactg

SEQ ID NO: 3877205 - DNA, 19 bp, Homo sapiens
gaccttgaagggtaaagaa

SEQ ID NO: 3877206 - DNA, 13 bp, Homo sapiens
gaccttgtgatct

SEQ ID NO: 3877207 - DNA, 21 bp, Homo sapiens
gacctttgtcatctttcttct

SEQ ID NO: 3877208 - DNA, 17 bp, Homo sapiens
gaccttttctctcccat

SEQ ID NO: 3877209 - DNA, 18 bp, Homo sapiens
gaccttttctctcccata

SEQ ID NO: 3877210 - DNA, 15 bp, Homo sapiens
gacgatctttgaata

SEQ ID NO: 3877211 - DNA, 12 bp, Homo sapiens
gacgcagcagct

SEQ ID NO: 3877212 - DNA, 22 bp, Homo sapiens
gacgcagccctgggggccagct

SEQ ID NO: 3877213 - DNA, 14 bp, Homo sapiens
gacgcatcctgcag

SEQ ID NO: 3877214 - DNA, 20 bp, Homo sapiens
gacgcccagctgaggctggg

SEQ ID NO: 3877215 - DNA, 21 bp, Homo sapiens
gacgctgccgctgccgctgca

SEQ ID NO: 3877216 - DNA, 21 bp, Homo sapiens
gacgcttccagaccacctgcc

SEQ ID NO: 3877217 - DNA, 22 bp, Homo sapiens
gacgcttccagaccacctgcca

SEQ ID NO: 3877218 - DNA, 23 bp, Homo sapiens
gacgcttccagaccacctgccag

SEQ ID NO: 3877219 - DNA, 21 bp, Homo sapiens
gacggaagcctttttccccaa

SEQ ID NO: 3877220 - DNA, 12 bp, Homo sapiens
gacggctggacc

SEQ ID NO: 3877221 - DNA, 17 bp, Homo sapiens
gacggctggacctgcac

SEQ ID NO: 3877222 - DNA, 17 bp, Homo sapiens
gacgggagcctcctctg

SEQ ID NO: 3877223 - DNA, 23 bp, Homo sapiens
gacggtgttgcagagacgcaagg

SEQ ID NO: 3877224 - DNA, 23 bp, Homo sapiens
gacggttaacttgtatattccac

SEQ ID NO: 3877225 - DNA, 22 bp, Homo sapiens
gacgtcatcggaggctgggccc

SEQ ID NO: 3877226 - DNA, 13 bp, Homo sapiens
gacgtttccatca

SEQ ID NO: 3877227 - DNA, 17 bp, Homo sapiens
gacgtttttgtgctgtg

SEQ ID NO: 3877228 - DNA, 18 bp, Homo sapiens
gactaaaaatattataac

SEQ ID NO: 3877229 - DNA, 14 bp, Homo sapiens
gactaacactcaga

SEQ ID NO: 3877230 - DNA, 18 bp, Homo sapiens
gactaatagagacacaga

SEQ ID NO: 3877231 - DNA, 17 bp, Homo sapiens
gactaattaaaatctgg

SEQ ID NO: 3877232 - DNA, 18 bp, Homo sapiens
gactaatttaaaaaataa

SEQ ID NO: 3877233 - DNA, 18 bp, Homo sapiens
gactacacatcagggctt

SEQ ID NO: 3877234 - DNA, 20 bp, Homo sapiens
gactaccagctaactccagt

SEQ ID NO: 3877235 - DNA, 15 bp, Homo sapiens
gactagaacctggag

SEQ ID NO: 3877236 - DNA, 16 bp, Homo sapiens
gactagaacctggagg

SEQ ID NO: 3877237 - DNA, 15 bp, Homo sapiens
gactagagctttctt

SEQ ID NO: 3877238 - DNA, 16 bp, Homo sapiens
gactagaggcagggag

SEQ ID NO: 3877239 - DNA, 16 bp, Homo sapiens
gactataaacattaaa

SEQ ID NO: 3877240 - DNA, 18 bp, Homo sapiens
gactatcacatacaattt

SEQ ID NO: 3877241 - DNA, 20 bp, Homo sapiens
gactatggagcctggcacag

SEQ ID NO: 3877242 - DNA, 12 bp, Homo sapiens
gactcaaagaga

SEQ ID NO: 3877243 - DNA, 19 bp, Homo sapiens
gactcaaatctccagtatt

SEQ ID NO: 3877244 - DNA, 18 bp, Homo sapiens
gactcaagggtccagaag

SEQ ID NO: 3877245 - DNA, 21 bp, Homo sapiens
gactcacaagaagaccagact

SEQ ID NO: 3877246 - DNA, 12 bp, Homo sapiens
gactcacccaag

SEQ ID NO: 3877247 - DNA, 16 bp, Homo sapiens
gactcagactccattt

SEQ ID NO: 3877248 - DNA, 11 bp, Homo sapiens
gactccaaaga

SEQ ID NO: 3877249 - DNA, 19 bp, Homo sapiens
gactccagaatctgctgtt

SEQ ID NO: 3877250 - DNA, 23 bp, Homo sapiens
gactccagaatctgctgttgcca

SEQ ID NO: 3877251 - DNA, 15 bp, Homo sapiens
gactccagagtctga

SEQ ID NO: 3877252 - DNA, 19 bp, Homo sapiens
gactccagagtctgagccc

SEQ ID NO: 3877253 - DNA, 21 bp, Homo sapiens
gactccagcgcctgccctccc

SEQ ID NO: 3877254 - DNA, 14 bp, Homo sapiens
gactccctccatgt

SEQ ID NO: 3877255 - DNA, 13 bp, Homo sapiens
gactccctgtggg

SEQ ID NO: 3877256 - DNA, 24 bp, Homo sapiens
gactccctgtgggggtggccatcc

SEQ ID NO: 3877257 - DNA, 17 bp, Homo sapiens
gactccgagaacaacag

SEQ ID NO: 3877258 - DNA, 19 bp, Homo sapiens
gactccgggaccattgacc

SEQ ID NO: 3877259 - DNA, 14 bp, Homo sapiens
gactcctcccacaa

SEQ ID NO: 3877260 - DNA, 13 bp, Homo sapiens
gactcctttctct

SEQ ID NO: 3877261 - DNA, 21 bp, Homo sapiens
gactctaaattctttatttct

SEQ ID NO: 3877262 - DNA, 21 bp, Homo sapiens
gactctacctgcaagatttca

SEQ ID NO: 3877263 - DNA, 20 bp, Homo sapiens
gactctgaaaaacattccag

SEQ ID NO: 3877264 - DNA, 16 bp, Homo sapiens
gactctgccccttctg

SEQ ID NO: 3877265 - DNA, 23 bp, Homo sapiens
gactctgccccttctgtttccat

SEQ ID NO: 3877266 - DNA, 20 bp, Homo sapiens
gactctgggtccctcggagc

SEQ ID NO: 3877267 - DNA, 9 bp, Homo sapiens
gactcttgt

SEQ ID NO: 3877268 - DNA, 20 bp, Homo sapiens
gactcttttatctgagtttt

SEQ ID NO: 3877269 - DNA, 21 bp, Homo sapiens
gactgaaagcagcagctagga

SEQ ID NO: 3877270 - DNA, 15 bp, Homo sapiens
gactgagcacctgct

SEQ ID NO: 3877271 - DNA, 15 bp, Homo sapiens
gactgagggagagac

SEQ ID NO: 3877272 - DNA, 15 bp, Homo sapiens
gactgcacagcggcc

SEQ ID NO: 3877273 - DNA, 14 bp, Homo sapiens
gactgcgctggacg

SEQ ID NO: 3877274 - DNA, 15 bp, Homo sapiens
gactggaaccaggga

SEQ ID NO: 3877275 - DNA, 17 bp, Homo sapiens
gactggaaccagggaga

SEQ ID NO: 3877276 - DNA, 13 bp, Homo sapiens
gactggagcccga

SEQ ID NO: 3877277 - DNA, 15 bp, Homo sapiens
gactggagtgaggct

SEQ ID NO: 3877278 - DNA, 22 bp, Homo sapiens
gactggagtgaggcttccaggc

SEQ ID NO: 3877279 - DNA, 14 bp, Homo sapiens
gactggcacagttt

SEQ ID NO: 3877280 - DNA, 16 bp, Homo sapiens
gactggcacttagccc

SEQ ID NO: 3877281 - DNA, 21 bp, Homo sapiens
gactggctcacccctctcccc

SEQ ID NO: 3877282 - DNA, 20 bp, Homo sapiens
gactgggaccaggcaccagg

SEQ ID NO: 3877283 - DNA, 13 bp, Homo sapiens
gactgggaggtag

SEQ ID NO: 3877284 - DNA, 15 bp, Homo sapiens
gactgggctagggag

SEQ ID NO: 3877285 - DNA, 20 bp, Homo sapiens
gactggtgctataggctgga

SEQ ID NO: 3877286 - DNA, 23 bp, Homo sapiens
gactgtctcaagagggcactggt

SEQ ID NO: 3877287 - DNA, 11 bp, Homo sapiens
gactgtgaaag

SEQ ID NO: 3877288 - DNA, 18 bp, Homo sapiens
gactgttgtacaagctca

SEQ ID NO: 3877289 - DNA, 17 bp, Homo sapiens
gacttcacaaaatgcaa

SEQ ID NO: 3877290 - DNA, 18 bp, Homo sapiens
gacttcacaaaatgcaag

SEQ ID NO: 3877291 - DNA, 14 bp, Homo sapiens
gacttcacactgca

SEQ ID NO: 3877292 - DNA, 16 bp, Homo sapiens
gacttcacactgcaag

SEQ ID NO: 3877293 - DNA, 22 bp, Homo sapiens
gacttcacactgcaagagcctt

SEQ ID NO: 3877294 - DNA, 22 bp, Homo sapiens
gacttcctggggccccgctggg

SEQ ID NO: 3877295 - DNA, 22 bp, Homo sapiens
gacttcctggtgaggcccagcc

SEQ ID NO: 3877296 - DNA, 17 bp, Homo sapiens
gacttctaagtaaaacc

SEQ ID NO: 3877297 - DNA, 18 bp, Homo sapiens
gacttctaagtaaaacca

SEQ ID NO: 3877298 - DNA, 19 bp, Homo sapiens
gacttctaagtaaaaccac

SEQ ID NO: 3877299 - DNA, 16 bp, Homo sapiens
gacttctggaaggctg

SEQ ID NO: 3877300 - DNA, 20 bp, Homo sapiens
gacttcttggtttggggaga

SEQ ID NO: 3877301 - DNA, 18 bp, Homo sapiens
gacttgggcacccccagc

SEQ ID NO: 3877302 - DNA, 20 bp, Homo sapiens
gacttgggcacccccagcct

SEQ ID NO: 3877303 - DNA, 21 bp, Homo sapiens
gacttgggcacccccagcctg

SEQ ID NO: 3877304 - DNA, 22 bp, Homo sapiens
gacttgggcacccccagcctgg

SEQ ID NO: 3877305 - DNA, 23 bp, Homo sapiens
gacttgggcacccccagcctggg

SEQ ID NO: 3877306 - DNA, 16 bp, Homo sapiens
gacttggggaccagag

SEQ ID NO: 3877307 - DNA, 12 bp, Homo sapiens
gacttgtgccag

SEQ ID NO: 3877308 - DNA, 15 bp, Homo sapiens
gactttatacagaac

SEQ ID NO: 3877309 - DNA, 12 bp, Homo sapiens
gactttcaggta

SEQ ID NO: 3877310 - DNA, 14 bp, Homo sapiens
gactttcaggtact

SEQ ID NO: 3877311 - DNA, 13 bp, Homo sapiens
gactttgtgatcc

SEQ ID NO: 3877312 - DNA, 17 bp, Homo sapiens
gacttttccatgtatct

SEQ ID NO: 3877313 - DNA, 18 bp, Homo sapiens
gacttttccatgtatcta

SEQ ID NO: 3877314 - DNA, 16 bp, Homo sapiens
gactttttagccagtg

SEQ ID NO: 3877315 - DNA, 19 bp, Homo sapiens
gactttttagccagtgact

SEQ ID NO: 3877316 - DNA, 16 bp, Homo sapiens
gactttttataatgtg

SEQ ID NO: 3877317 - DNA, 14 bp, Homo sapiens
gagaaaaaccaatg

SEQ ID NO: 3877318 - DNA, 16 bp, Homo sapiens
gagaaaaagaaatgca

SEQ ID NO: 3877319 - DNA, 17 bp, Homo sapiens
gagaaaaagctcctgtc

SEQ ID NO: 3877320 - DNA, 18 bp, Homo sapiens
gagaaaacttatttgagt

SEQ ID NO: 3877321 - DNA, 14 bp, Homo sapiens
gagaaaaggagaaa

SEQ ID NO: 3877322 - DNA, 19 bp, Homo sapiens
gagaaacagagacaggccc

SEQ ID NO: 3877323 - DNA, 22 bp, Homo sapiens
gagaaactgagaaatgaatgct

SEQ ID NO: 3877324 - DNA, 13 bp, Homo sapiens
gagaaagaagaga

SEQ ID NO: 3877325 - DNA, 18 bp, Homo sapiens
gagaaagaagagacagga

SEQ ID NO: 3877326 - DNA, 13 bp, Homo sapiens
gagaaagactatt

SEQ ID NO: 3877327 - DNA, 15 bp, Homo sapiens
gagaaaggagccgga

SEQ ID NO: 3877328 - DNA, 20 bp, Homo sapiens
gagaaaggattaagatacac

SEQ ID NO: 3877329 - DNA, 11 bp, Homo sapiens
gagaaattatt

SEQ ID NO: 3877330 - DNA, 14 bp, Homo sapiens
gagaaattctgtgg

SEQ ID NO: 3877331 - DNA, 16 bp, Homo sapiens
gagaacaagtcacagc

SEQ ID NO: 3877332 - DNA, 14 bp, Homo sapiens
gagaacctggcctt

SEQ ID NO: 3877333 - DNA, 16 bp, Homo sapiens
gagaacctggccttca

SEQ ID NO: 3877334 - DNA, 16 bp, Homo sapiens
gagaagaaagaacgga

SEQ ID NO: 3877335 - DNA, 12 bp, Homo sapiens
gagaagaagctg

SEQ ID NO: 3877336 - DNA, 16 bp, Homo sapiens
gagaagaagctgagga

SEQ ID NO: 3877337 - DNA, 21 bp, Homo sapiens
gagaagaattttcagacccca

SEQ ID NO: 3877338 - DNA, 14 bp, Homo sapiens
gagaagcagcctcc

SEQ ID NO: 3877339 - DNA, 16 bp, Homo sapiens
gagaagcagcctccta

SEQ ID NO: 3877340 - DNA, 14 bp, Homo sapiens
gagaagccacgctg

SEQ ID NO: 3877341 - DNA, 19 bp, Homo sapiens
gagaagctaaaacctgagc

SEQ ID NO: 3877342 - DNA, 14 bp, Homo sapiens
gagaagctgagaag

SEQ ID NO: 3877343 - DNA, 15 bp, Homo sapiens
gagaagctgagaaga

SEQ ID NO: 3877344 - DNA, 17 bp, Homo sapiens
gagaagctgagaagaag

SEQ ID NO: 3877345 - DNA, 20 bp, Homo sapiens
gagaaggacccggaggggcc

SEQ ID NO: 3877346 - DNA, 17 bp, Homo sapiens
gagaaggatctagaatg

SEQ ID NO: 3877347 - DNA, 14 bp, Homo sapiens
gagaagggaagcct

SEQ ID NO: 3877348 - DNA, 15 bp, Homo sapiens
gagaagggggattgg

SEQ ID NO: 3877349 - DNA, 19 bp, Homo sapiens
gagaagggggattggaggg

SEQ ID NO: 3877350 - DNA, 21 bp, Homo sapiens
gagaagtgagggctgggcagc

SEQ ID NO: 3877351 - DNA, 18 bp, Homo sapiens
gagaagttcatatttctt

SEQ ID NO: 3877352 - DNA, 16 bp, Homo sapiens
gagaagtttctggccc

SEQ ID NO: 3877353 - DNA, 21 bp, Homo sapiens
gagaagtttctggccctggct

SEQ ID NO: 3877354 - DNA, 17 bp, Homo sapiens
gaatctatatttaacaa

SEQ ID NO: 3877355 - DNA, 17 bp, Homo sapiens
gaatctgcagggagcaa

SEQ ID NO: 3877356 - DNA, 21 bp, Homo sapiens
gaatctgctgttgccatagcc

SEQ ID NO: 3877357 - DNA, 18 bp, Homo sapiens
gaatctgttactgaaatg

SEQ ID NO: 3877358 - DNA, 23 bp, Homo sapiens
gaatctgttactgaaatgaggag

SEQ ID NO: 3877359 - DNA, 16 bp, Homo sapiens
gaatgaaaattgtatg

SEQ ID NO: 3877360 - DNA, 22 bp, Homo sapiens
gaatgacatcaacattccccca

SEQ ID NO: 3877361 - DNA, 19 bp, Homo sapiens
gaatgaccacgggcctcag

SEQ ID NO: 3877362 - DNA, 18 bp, Homo sapiens
gaatgcagattcctgggc

SEQ ID NO: 3877363 - DNA, 20 bp, Homo sapiens
gaatgcagattcctgggcct

SEQ ID NO: 3877364 - DNA, 22 bp, Homo sapiens
gaatgcagattcctgggcctgt

SEQ ID NO: 3877365 - DNA, 23 bp, Homo sapiens
gaatgcagattcctgggcctgtc

SEQ ID NO: 3877366 - DNA, 22 bp, Homo sapiens
gaatgcccacaggcaaatgcat

SEQ ID NO: 3877367 - DNA, 22 bp, Homo sapiens
gaatgcctcaatgtgaccaggg

SEQ ID NO: 3877368 - DNA, 19 bp, Homo sapiens
gaatgccttccgggccggg

SEQ ID NO: 3877369 - DNA, 22 bp, Homo sapiens
gaatgctcaagtttttcagaaa

SEQ ID NO: 3877370 - DNA, 13 bp, Homo sapiens
gaatgctgagacc

SEQ ID NO: 3877371 - DNA, 15 bp, Homo sapiens
gaatgctgtatatgt

SEQ ID NO: 3877372 - DNA, 14 bp, Homo sapiens
gaatggatggggag

SEQ ID NO: 3877373 - DNA, 15 bp, Homo sapiens
gaatggatggggaga

SEQ ID NO: 3877374 - DNA, 24 bp, Homo sapiens
gaatggccctagaactgtgcctag

SEQ ID NO: 3877375 - DNA, 22 bp, Homo sapiens
gaatggtgtgaacccgggaagc

SEQ ID NO: 3877376 - DNA, 20 bp, Homo sapiens
gaatggttccatgcctgagg

SEQ ID NO: 3877377 - DNA, 17 bp, Homo sapiens
gaatgtcccttttccta

SEQ ID NO: 3877378 - DNA, 12 bp, Homo sapiens
gaatgtctcagc

SEQ ID NO: 3877379 - DNA, 22 bp, Homo sapiens
gaatgtgagtgtgtttgtgtgc

SEQ ID NO: 3877380 - DNA, 17 bp, Homo sapiens
gaatgttccctgcaccc

SEQ ID NO: 3877381 - DNA, 22 bp, Homo sapiens
gaatgttccctgcaccctggaa

SEQ ID NO: 3877382 - DNA, 20 bp, Homo sapiens
gaattaaataaacccttcct

SEQ ID NO: 3877383 - DNA, 13 bp, Homo sapiens
gaattaagttatt

SEQ ID NO: 3877384 - DNA, 14 bp, Homo sapiens
gaattaagttattg

SEQ ID NO: 3877385 - DNA, 22 bp, Homo sapiens
gaattatatctaatttatacaa

SEQ ID NO: 3877386 - DNA, 20 bp, Homo sapiens
gaattatttttgtgtttcta

SEQ ID NO: 3877387 - DNA, 17 bp, Homo sapiens
gaattcagcaccctggg

SEQ ID NO: 3877388 - DNA, 18 bp, Homo sapiens
gaattcatgtgaaaataa

SEQ ID NO: 3877389 - DNA, 17 bp, Homo sapiens
gaattctaaatgctggt

SEQ ID NO: 3877390 - DNA, 13 bp, Homo sapiens
gaattctgtgaag

SEQ ID NO: 3877391 - DNA, 16 bp, Homo sapiens
gaattctgtgaagaat

SEQ ID NO: 3877392 - DNA, 18 bp, Homo sapiens
gaattgaacccaggaggt

SEQ ID NO: 3877393 - DNA, 20 bp, Homo sapiens
gaattgcctgcagagagaag

SEQ ID NO: 3877394 - DNA, 21 bp, Homo sapiens
gaattgcctgcagagagaagc

SEQ ID NO: 3877395 - DNA, 22 bp, Homo sapiens
gaattggaccatcctatttaac

SEQ ID NO: 3877396 - DNA, 18 bp, Homo sapiens
gaatttaaaaataagaaa

SEQ ID NO: 3877397 - DNA, 14 bp, Homo sapiens
gaatttcctatctg

SEQ ID NO: 3877398 - DNA, 20 bp, Homo sapiens
gaatttggtgtggctgtatt

SEQ ID NO: 3877399 - DNA, 14 bp, Homo sapiens
gaatttgtaagttt

SEQ ID NO: 3877400 - DNA, 21 bp, Homo sapiens
gaattttctttgtgtagcttt

SEQ ID NO: 3877401 - DNA, 15 bp, Homo sapiens
gaattttgttgctgt

SEQ ID NO: 3877402 - DNA, 15 bp, Homo sapiens
gaatttttaatgact

SEQ ID NO: 3877403 - DNA, 20 bp, Homo sapiens
gacaaaaacagcctcacaga

SEQ ID NO: 3877404 - DNA, 11 bp, Homo sapiens
gacaaaatgga

SEQ ID NO: 3877405 - DNA, 17 bp, Homo sapiens
gacaaacacctcccagg

SEQ ID NO: 3877406 - DNA, 22 bp, Homo sapiens
gacaaacacctcccaggagaca

SEQ ID NO: 3877407 - DNA, 17 bp, Homo sapiens
gacaaaccactgtacat

SEQ ID NO: 3877408 - DNA, 21 bp, Homo sapiens
gacaaaccactgtacatatat

SEQ ID NO: 3877409 - DNA, 16 bp, Homo sapiens
gacaaaccagagcaga

SEQ ID NO: 3877410 - DNA, 22 bp, Homo sapiens
gacaaagagaataaagacttca

SEQ ID NO: 3877411 - DNA, 13 bp, Homo sapiens
gacaaaggagcct

SEQ ID NO: 3877412 - DNA, 17 bp, Homo sapiens
gacaaaggagcctgtga

SEQ ID NO: 3877413 - DNA, 23 bp, Homo sapiens
gacaaatattgttaccatgaaga

SEQ ID NO: 3877414 - DNA, 15 bp, Homo sapiens
gacaaattgtaacta

SEQ ID NO: 3877415 - DNA, 17 bp, Homo sapiens
gacaacatcccacagtg

SEQ ID NO: 3877416 - DNA, 24 bp, Homo sapiens
gacaaccccatcatatgacatgcc

SEQ ID NO: 3877417 - DNA, 14 bp, Homo sapiens
gacaacctgcccct

SEQ ID NO: 3877418 - DNA, 19 bp, Homo sapiens
gacaactggtccactcagg

SEQ ID NO: 3877419 - DNA, 20 bp, Homo sapiens
gacaagaaaagaggaaaaaa

SEQ ID NO: 3877420 - DNA, 17 bp, Homo sapiens
gacaagaagctcccaga

SEQ ID NO: 3877421 - DNA, 18 bp, Homo sapiens
gacaagaagctcccagat

SEQ ID NO: 3877422 - DNA, 13 bp, Homo sapiens
gacaagaagctgc

SEQ ID NO: 3877423 - DNA, 18 bp, Homo sapiens
gacaagaatggaatagaa

SEQ ID NO: 3877424 - DNA, 14 bp, Homo sapiens
gacaagagctgctg

SEQ ID NO: 3877425 - DNA, 15 bp, Homo sapiens
gacaagagctgctgt

SEQ ID NO: 3877426 - DNA, 19 bp, Homo sapiens
gacaagagctgctgtcctt

SEQ ID NO: 3877427 - DNA, 19 bp, Homo sapiens
gacaagataaaggaagtca

SEQ ID NO: 3877428 - DNA, 13 bp, Homo sapiens
gacaagggctgac

SEQ ID NO: 3877429 - DNA, 16 bp, Homo sapiens
gacaaggtagacatgg

SEQ ID NO: 3877430 - DNA, 14 bp, Homo sapiens
gacaatccactctc

SEQ ID NO: 3877431 - DNA, 14 bp, Homo sapiens
gacaatgccttggg

SEQ ID NO: 3877432 - DNA, 14 bp, Homo sapiens
gacacacacacaca

SEQ ID NO: 3877433 - DNA, 20 bp, Homo sapiens
gacacacagtctcagtccag

SEQ ID NO: 3877434 - DNA, 12 bp, Homo sapiens
gacacacctctg

SEQ ID NO: 3877435 - DNA, 22 bp, Homo sapiens
gacacacgtatttatatttgga

SEQ ID NO: 3877436 - DNA, 20 bp, Homo sapiens
gacacagacccacacatgtt

SEQ ID NO: 3877437 - DNA, 14 bp, Homo sapiens
gacacagagatgga

SEQ ID NO: 3877438 - DNA, 22 bp, Homo sapiens
gacacagagtggagccctcagt

SEQ ID NO: 3877439 - DNA, 18 bp, Homo sapiens
gacacaggaaaccaacac

SEQ ID NO: 3877440 - DNA, 12 bp, Homo sapiens
gacacaggcctg

SEQ ID NO: 3877441 - DNA, 22 bp, Homo sapiens
gacacaggtgcctcacgcctgt

SEQ ID NO: 3877442 - DNA, 15 bp, Homo sapiens
gacacataatttgaa

SEQ ID NO: 3877443 - DNA, 16 bp, Homo sapiens
gacacatcaaatgccc

SEQ ID NO: 3877444 - DNA, 21 bp, Homo sapiens
gacacatcccggcctcttcca

SEQ ID NO: 3877445 - DNA, 23 bp, Homo sapiens
gacacattctcctgtgcccctca

SEQ ID NO: 3877446 - DNA, 21 bp, Homo sapiens
gacaccccccgccccccacct

SEQ ID NO: 3877447 - DNA, 15 bp, Homo sapiens
gacacctaccatgct

SEQ ID NO: 3877448 - DNA, 18 bp, Homo sapiens
gacacctaccatgctgct

SEQ ID NO: 3877449 - DNA, 15 bp, Homo sapiens
gacacctgcacctcc

SEQ ID NO: 3877450 - DNA, 20 bp, Homo sapiens
gacacctgcacctcccccca

SEQ ID NO: 3877451 - DNA, 11 bp, Homo sapiens
gacacctgccc

SEQ ID NO: 3877452 - DNA, 13 bp, Homo sapiens
gacacctgcccca

SEQ ID NO: 3877453 - DNA, 16 bp, Homo sapiens
gacacctgccccagcg

SEQ ID NO: 3877454 - DNA, 23 bp, Homo sapiens
gacacctgccctgccctgccacc

SEQ ID NO: 3877455 - DNA, 14 bp, Homo sapiens
gacacgtggcctgc

SEQ ID NO: 3877456 - DNA, 19 bp, Homo sapiens
gacactcctataaggagag

SEQ ID NO: 3877457 - DNA, 22 bp, Homo sapiens
gacactctagtgacttcctggt

SEQ ID NO: 3877458 - DNA, 12 bp, Homo sapiens
gacactgctgca

SEQ ID NO: 3877459 - DNA, 19 bp, Homo sapiens
gacagaccccttggctttt

SEQ ID NO: 3877460 - DNA, 20 bp, Homo sapiens
gacagaccggggttcaagcc

SEQ ID NO: 3877461 - DNA, 14 bp, Homo sapiens
gacagagaaatgtg

SEQ ID NO: 3877462 - DNA, 15 bp, Homo sapiens
gacagagacacctgc

SEQ ID NO: 3877463 - DNA, 16 bp, Homo sapiens
gacagagacacctgca

SEQ ID NO: 3877464 - DNA, 17 bp, Homo sapiens
gacagagacacctgcac

SEQ ID NO: 3877465 - DNA, 18 bp, Homo sapiens
gacagagacacctgcacc

SEQ ID NO: 3877466 - DNA, 13 bp, Homo sapiens
gacagagagatga

SEQ ID NO: 3877467 - DNA, 16 bp, Homo sapiens
gacagagccctgtgag

SEQ ID NO: 3877468 - DNA, 19 bp, Homo sapiens
gacagagccgcaaatcaac

SEQ ID NO: 3877469 - DNA, 20 bp, Homo sapiens
gacagatacatagatggacc

SEQ ID NO: 3877470 - DNA, 22 bp, Homo sapiens
gacagatacatagatggaccag

SEQ ID NO: 3877471 - DNA, 17 bp, Homo sapiens
gacagcacttggctcct

SEQ ID NO: 3877472 - DNA, 12 bp, Homo sapiens
gacagcaggtgg

SEQ ID NO: 3877473 - DNA, 20 bp, Homo sapiens
gacagcataccttggactga

SEQ ID NO: 3877474 - DNA, 21 bp, Homo sapiens
gacagcataccttggactgac

SEQ ID NO: 3877475 - DNA, 11 bp, Homo sapiens
gacagcccagc

SEQ ID NO: 3877476 - DNA, 13 bp, Homo sapiens
gacagcccagcct

SEQ ID NO: 3877477 - DNA, 13 bp, Homo sapiens
gacagccccaggg

SEQ ID NO: 3877478 - DNA, 13 bp, Homo sapiens
gacagcctggcac

SEQ ID NO: 3877479 - DNA, 15 bp, Homo sapiens
gacagctgacagata

SEQ ID NO: 3877480 - DNA, 14 bp, Homo sapiens
gacagctgtccctg

SEQ ID NO: 3877481 - DNA, 16 bp, Homo sapiens
gacagctgtccctgtc

SEQ ID NO: 3877482 - DNA, 17 bp, Homo sapiens
gacagctgtccctgtca

SEQ ID NO: 3877483 - DNA, 19 bp, Homo sapiens
gacagctgtccctgtcacc

SEQ ID NO: 3877484 - DNA, 22 bp, Homo sapiens
gacagctgtccctgtcaccaag

SEQ ID NO: 3877485 - DNA, 20 bp, Homo sapiens
gacagctttcccctcatttt

SEQ ID NO: 3877486 - DNA, 19 bp, Homo sapiens
gacaggactaacactcaga

SEQ ID NO: 3877487 - DNA, 22 bp, Homo sapiens
gacaggactaacactcagaagc

SEQ ID NO: 3877488 - DNA, 12 bp, Homo sapiens
gacaggagaaat

SEQ ID NO: 3877489 - DNA, 24 bp, Homo sapiens
gacaggagaaatgcatccattcct

SEQ ID NO: 3877490 - DNA, 20 bp, Homo sapiens
gacaggagggcaagggccat

SEQ ID NO: 3877491 - DNA, 16 bp, Homo sapiens
gacaggcccaagagat

SEQ ID NO: 3877492 - DNA, 15 bp, Homo sapiens
gacagggaagagcag

SEQ ID NO: 3877493 - DNA, 18 bp, Homo sapiens
gacagggcaatcttgtcc

SEQ ID NO: 3877494 - DNA, 21 bp, Homo sapiens
gacaggttcccagcagctggg

SEQ ID NO: 3877495 - DNA, 16 bp, Homo sapiens
gacagtattctcagtg

SEQ ID NO: 3877496 - DNA, 18 bp, Homo sapiens
gacagttggcagagaagg

SEQ ID NO: 3877497 - DNA, 24 bp, Homo sapiens
gacagttggcagagaaggcctctt

SEQ ID NO: 3877498 - DNA, 18 bp, Homo sapiens
gacatataccttctcaaa

SEQ ID NO: 3877499 - DNA, 19 bp, Homo sapiens
gacatcaaatttgccacca

SEQ ID NO: 3877500 - DNA, 23 bp, Homo sapiens
gacatcccaggaggggcctctga

SEQ ID NO: 3877501 - DNA, 16 bp, Homo sapiens
gacatgcactgaccct

SEQ ID NO: 3877502 - DNA, 20 bp, Homo sapiens
gacatgcactgacccttcca

SEQ ID NO: 3877503 - DNA, 13 bp, Homo sapiens
gacatgccaccct

SEQ ID NO: 3877504 - DNA, 14 bp, Homo sapiens
gacatgccaccctc

SEQ ID NO: 3877505 - DNA, 18 bp, Homo sapiens
gacatgccaccctctcca

SEQ ID NO: 3877506 - DNA, 15 bp, Homo sapiens
gacatggagagagac

SEQ ID NO: 3877507 - DNA, 18 bp, Homo sapiens
gacatgtttttgttttct

SEQ ID NO: 3877508 - DNA, 13 bp, Homo sapiens
gacattatgtgtg

SEQ ID NO: 3877509 - DNA, 21 bp, Homo sapiens
gacattatgtgtgcatgtgtg

SEQ ID NO: 3877510 - DNA, 14 bp, Homo sapiens
gacattccaacaat

SEQ ID NO: 3877511 - DNA, 13 bp, Homo sapiens
gacattgcctcca

SEQ ID NO: 3877512 - DNA, 20 bp, Homo sapiens
gacattgcctccacctctcc

SEQ ID NO: 3877513 - DNA, 19 bp, Homo sapiens
gacattgtagagcttctgg

SEQ ID NO: 3877514 - DNA, 18 bp, Homo sapiens
gacattgttaaaataaag

SEQ ID NO: 3877515 - DNA, 21 bp, Homo sapiens
gacatttctaacatatgtatt

SEQ ID NO: 3877516 - DNA, 22 bp, Homo sapiens
gaccaacatggagaaaccctgt

SEQ ID NO: 3877517 - DNA, 13 bp, Homo sapiens
gaccaacctgacc

SEQ ID NO: 3877518 - DNA, 15 bp, Homo sapiens
gaccaactggcttct

SEQ ID NO: 3877519 - DNA, 22 bp, Homo sapiens
gaccaactggcttctgtgcact

SEQ ID NO: 3877520 - DNA, 20 bp, Homo sapiens
gaccaagaaaaagaaaaaaa

SEQ ID NO: 3877521 - DNA, 18 bp, Homo sapiens
gaccaagagagaaagaag

SEQ ID NO: 3877522 - DNA, 18 bp, Homo sapiens
gaccaatattcaaatgcg

SEQ ID NO: 3877523 - DNA, 11 bp, Homo sapiens
gaccacctgcc

SEQ ID NO: 3877524 - DNA, 15 bp, Homo sapiens
gaccacctgccagcc

SEQ ID NO: 3877525 - DNA, 15 bp, Homo sapiens
gaaaccccagggcag

SEQ ID NO: 3877526 - DNA, 17 bp, Homo sapiens
gaaaccgtaattttatt

SEQ ID NO: 3877527 - DNA, 13 bp, Homo sapiens
gaaacctgaaaaa

SEQ ID NO: 3877528 - DNA, 18 bp, Homo sapiens
gaaaccttgcagcatttt

SEQ ID NO: 3877529 - DNA, 14 bp, Homo sapiens
gaaacgcagacact

SEQ ID NO: 3877530 - DNA, 19 bp, Homo sapiens
gaaacgtacttaactgtgt

SEQ ID NO: 3877531 - DNA, 17 bp, Homo sapiens
gaaactcaccatgtaaa

SEQ ID NO: 3877532 - DNA, 23 bp, Homo sapiens
gaaactgaaaactgtaaatacaa

SEQ ID NO: 3877533 - DNA, 16 bp, Homo sapiens
gaaactgtatgattaa

SEQ ID NO: 3877534 - DNA, 20 bp, Homo sapiens
gaaactgtatgattaagcaa

SEQ ID NO: 3877535 - DNA, 18 bp, Homo sapiens
gaaactttgatctctgct

SEQ ID NO: 3877536 - DNA, 24 bp, Homo sapiens
gaaagaaaaataccatgtctctaa

SEQ ID NO: 3877537 - DNA, 12 bp, Homo sapiens
gaaagaaaagac

SEQ ID NO: 3877538 - DNA, 16 bp, Homo sapiens
gaaagaaaagaccctg

SEQ ID NO: 3877539 - DNA, 21 bp, Homo sapiens
gaaagaaaagaccctgagact

SEQ ID NO: 3877540 - DNA, 17 bp, Homo sapiens
gaaagaaaattagtaat

SEQ ID NO: 3877541 - DNA, 20 bp, Homo sapiens
gaaagaaacgtacttaactg

SEQ ID NO: 3877542 - DNA, 16 bp, Homo sapiens
gaaagaacggaagaag

SEQ ID NO: 3877543 - DNA, 11 bp, Homo sapiens
gaaagaagaga

SEQ ID NO: 3877544 - DNA, 15 bp, Homo sapiens
gaaagaatataaagt

SEQ ID NO: 3877545 - DNA, 17 bp, Homo sapiens
gaaagaatataaagtta

SEQ ID NO: 3877546 - DNA, 13 bp, Homo sapiens
gaaagaattattt

SEQ ID NO: 3877547 - DNA, 21 bp, Homo sapiens
gaaagacggattgcattagaa

SEQ ID NO: 3877548 - DNA, 19 bp, Homo sapiens
gaaagactattcaaacagt

SEQ ID NO: 3877549 - DNA, 23 bp, Homo sapiens
gaaagactggacggggaaaccta

SEQ ID NO: 3877550 - DNA, 11 bp, Homo sapiens
gaaagagacca

SEQ ID NO: 3877551 - DNA, 21 bp, Homo sapiens
gaaagaggtgaccccagggca

SEQ ID NO: 3877552 - DNA, 23 bp, Homo sapiens
gaaagaggtgaccccagggcaca

SEQ ID NO: 3877553 - DNA, 15 bp, Homo sapiens
gaaagatccaccctc

SEQ ID NO: 3877554 - DNA, 22 bp, Homo sapiens
gaaagatggctgtgcctctgcc

SEQ ID NO: 3877555 - DNA, 12 bp, Homo sapiens
gaaagcagcagc

SEQ ID NO: 3877556 - DNA, 14 bp, Homo sapiens
gaaagccatttgtt

SEQ ID NO: 3877557 - DNA, 21 bp, Homo sapiens
gaaagccctcccccttcccct

SEQ ID NO: 3877558 - DNA, 16 bp, Homo sapiens
gaaagctagagatatg

SEQ ID NO: 3877559 - DNA, 22 bp, Homo sapiens
gaaagctccacggtgcgtggct

SEQ ID NO: 3877560 - DNA, 21 bp, Homo sapiens
gaaagctggtaaactatttgt

SEQ ID NO: 3877561 - DNA, 15 bp, Homo sapiens
gaaagctgtttattt

SEQ ID NO: 3877562 - DNA, 11 bp, Homo sapiens
gaaaggaaaac

SEQ ID NO: 3877563 - DNA, 15 bp, Homo sapiens
gaaaggaaaaccagg

SEQ ID NO: 3877564 - DNA, 18 bp, Homo sapiens
gaaaggaagctccactgt

SEQ ID NO: 3877565 - DNA, 17 bp, Homo sapiens
gaaaggaggcatgcctc

SEQ ID NO: 3877566 - DNA, 19 bp, Homo sapiens
gaaaggaggcatgcctctg

SEQ ID NO: 3877567 - DNA, 20 bp, Homo sapiens
gaaaggatgtaaacagtgcc

SEQ ID NO: 3877568 - DNA, 14 bp, Homo sapiens
gaaaggattaagat

SEQ ID NO: 3877569 - DNA, 17 bp, Homo sapiens
gaaaggctctgaaagcc

SEQ ID NO: 3877570 - DNA, 21 bp, Homo sapiens
gaaagggacccgaagcccagg

SEQ ID NO: 3877571 - DNA, 13 bp, Homo sapiens
gaaagggagggct

SEQ ID NO: 3877572 - DNA, 14 bp, Homo sapiens
gaaagggagggctc

SEQ ID NO: 3877573 - DNA, 17 bp, Homo sapiens
gaaagggagggctctga

SEQ ID NO: 3877574 - DNA, 20 bp, Homo sapiens
gaaagggagggctctgaggc

SEQ ID NO: 3877575 - DNA, 18 bp, Homo sapiens
gaaagggctatggcaagg

SEQ ID NO: 3877576 - DNA, 23 bp, Homo sapiens
gaaagggtctgataaacacagag

SEQ ID NO: 3877577 - DNA, 14 bp, Homo sapiens
gaaaggtttcaaga

SEQ ID NO: 3877578 - DNA, 21 bp, Homo sapiens
gaaaggtttcaagacttgata

SEQ ID NO: 3877579 - DNA, 20 bp, Homo sapiens
gaaagtatattttcctccca

SEQ ID NO: 3877580 - DNA, 16 bp, Homo sapiens
gaaagtctgtgtccaa

SEQ ID NO: 3877581 - DNA, 17 bp, Homo sapiens
gaaagtgaataaacttc

SEQ ID NO: 3877582 - DNA, 21 bp, Homo sapiens
gaaagtgaataaacttcagca

SEQ ID NO: 3877583 - DNA, 15 bp, Homo sapiens
gaaagtgcagaatca

SEQ ID NO: 3877584 - DNA, 15 bp, Homo sapiens
gaaataaaacctttc

SEQ ID NO: 3877585 - DNA, 20 bp, Homo sapiens
gaaataaaatgaaatgtctt

SEQ ID NO: 3877586 - DNA, 19 bp, Homo sapiens
gaaataaacttattcctcc

SEQ ID NO: 3877587 - DNA, 20 bp, Homo sapiens
gaaataaacttattcctcct

SEQ ID NO: 3877588 - DNA, 20 bp, Homo sapiens
gaaataaattggtgataagt

SEQ ID NO: 3877589 - DNA, 21 bp, Homo sapiens
gaaataaattggtgataagtg

SEQ ID NO: 3877590 - DNA, 18 bp, Homo sapiens
gaaataaattttgtttca

SEQ ID NO: 3877591 - DNA, 18 bp, Homo sapiens
gaaatacacaagtaaaca

SEQ ID NO: 3877592 - DNA, 19 bp, Homo sapiens
gaaatacacaagtaaacat

SEQ ID NO: 3877593 - DNA, 13 bp, Homo sapiens
gaaatactgctct

SEQ ID NO: 3877594 - DNA, 22 bp, Homo sapiens
gaaatactgctctgaatatttt

SEQ ID NO: 3877595 - DNA, 21 bp, Homo sapiens
gaaatactttatctgtgacca

SEQ ID NO: 3877596 - DNA, 20 bp, Homo sapiens
gaaatagctccgtggagcag

SEQ ID NO: 3877597 - DNA, 15 bp, Homo sapiens
gaaatataatgcaaa

SEQ ID NO: 3877598 - DNA, 16 bp, Homo sapiens
gaaatatagttctgat

SEQ ID NO: 3877599 - DNA, 15 bp, Homo sapiens
gaaatatatatacat

SEQ ID NO: 3877600 - DNA, 23 bp, Homo sapiens
gaaatatcagttactcagccctg

SEQ ID NO: 3877601 - DNA, 15 bp, Homo sapiens
gaaatatgattttat

SEQ ID NO: 3877602 - DNA, 22 bp, Homo sapiens
gaaatatgattttatttgacaa

SEQ ID NO: 3877603 - DNA, 23 bp, Homo sapiens
gaaatattataaatccaaagtaa

SEQ ID NO: 3877604 - DNA, 13 bp, Homo sapiens
gaaatatttaagt

SEQ ID NO: 3877605 - DNA, 22 bp, Homo sapiens
gaaatatttaagtatatagtat

SEQ ID NO: 3877606 - DNA, 18 bp, Homo sapiens
gaaatcaaatatgcaaag

SEQ ID NO: 3877607 - DNA, 23 bp, Homo sapiens
gaaatcaaatatgcaaagcactg

SEQ ID NO: 3877608 - DNA, 15 bp, Homo sapiens
gaaatcacaggggcg

SEQ ID NO: 3877609 - DNA, 17 bp, Homo sapiens
gaaatcacaggggcggg

SEQ ID NO: 3877610 - DNA, 18 bp, Homo sapiens
gaaatcatcgaaaattca

SEQ ID NO: 3877611 - DNA, 16 bp, Homo sapiens
gaaatcattgtagaaa

SEQ ID NO: 3877612 - DNA, 19 bp, Homo sapiens
gaaatccctgtttaatatt

SEQ ID NO: 3877613 - DNA, 21 bp, Homo sapiens
gaaatccctgtttaatattta

SEQ ID NO: 3877614 - DNA, 17 bp, Homo sapiens
gaaatctccagtgtgcg

SEQ ID NO: 3877615 - DNA, 14 bp, Homo sapiens
gaaatgataaagat

SEQ ID NO: 3877616 - DNA, 21 bp, Homo sapiens
gaaatgctattgttgtgggct

SEQ ID NO: 3877617 - DNA, 18 bp, Homo sapiens
gaaatgctgatggataac

SEQ ID NO: 3877618 - DNA, 13 bp, Homo sapiens
gaaatggagggtg

SEQ ID NO: 3877619 - DNA, 16 bp, Homo sapiens
gaaatgtatcctgata

SEQ ID NO: 3877620 - DNA, 18 bp, Homo sapiens
gaaatgtgaagggtgggg

SEQ ID NO: 3877621 - DNA, 20 bp, Homo sapiens
gaaattaccagagttgttct

SEQ ID NO: 3877622 - DNA, 15 bp, Homo sapiens
gaaattatttaataa

SEQ ID NO: 3877623 - DNA, 13 bp, Homo sapiens
gaaattcccccac

SEQ ID NO: 3877624 - DNA, 21 bp, Homo sapiens
gaaattcccccacttgggagc

SEQ ID NO: 3877625 - DNA, 19 bp, Homo sapiens
gaaattcctgtagcatctt

SEQ ID NO: 3877626 - DNA, 12 bp, Homo sapiens
gaaattctgtgg

SEQ ID NO: 3877627 - DNA, 13 bp, Homo sapiens
gaaattgctattt

SEQ ID NO: 3877628 - DNA, 11 bp, Homo sapiens
gaaatttcaga

SEQ ID NO: 3877629 - DNA, 21 bp, Homo sapiens
gaaatttcagattcccagagc

SEQ ID NO: 3877630 - DNA, 23 bp, Homo sapiens
gaaatttcagattcccagagcaa

SEQ ID NO: 3877631 - DNA, 19 bp, Homo sapiens
gaaatttcccacaccccag

SEQ ID NO: 3877632 - DNA, 15 bp, Homo sapiens
gaaatttgatttcta

SEQ ID NO: 3877633 - DNA, 17 bp, Homo sapiens
gaacaaaaattgggttt

SEQ ID NO: 3877634 - DNA, 21 bp, Homo sapiens
gaacaaaagttcgaaagaaaa

SEQ ID NO: 3877635 - DNA, 22 bp, Homo sapiens
gaacaaagaacggcatgtgaat

SEQ ID NO: 3877636 - DNA, 13 bp, Homo sapiens
gaacaacaacaac

SEQ ID NO: 3877637 - DNA, 15 bp, Homo sapiens
gaacaacaacaacaa

SEQ ID NO: 3877638 - DNA, 23 bp, Homo sapiens
gaacaactatttataaactagat

SEQ ID NO: 3877639 - DNA, 13 bp, Homo sapiens
gaacaagagaaaa

SEQ ID NO: 3877640 - DNA, 16 bp, Homo sapiens
gaacaagcattctcct

SEQ ID NO: 3877641 - DNA, 14 bp, Homo sapiens
gaacaagtcacagc

SEQ ID NO: 3877642 - DNA, 16 bp, Homo sapiens
gaacaagtcacagctg

SEQ ID NO: 3877643 - DNA, 20 bp, Homo sapiens
gaacaatagctattgcatgt

SEQ ID NO: 3877644 - DNA, 21 bp, Homo sapiens
gaacaatagctattgcatgta

SEQ ID NO: 3877645 - DNA, 24 bp, Homo sapiens
gaacacaattgatacttcaggtgc

SEQ ID NO: 3877646 - DNA, 20 bp, Homo sapiens
gaacacactcagcagccccc

SEQ ID NO: 3877647 - DNA, 22 bp, Homo sapiens
gaacacccactggccagtccta

SEQ ID NO: 3877648 - DNA, 14 bp, Homo sapiens
gaacacccctgtgc

SEQ ID NO: 3877649 - DNA, 21 bp, Homo sapiens
gaacacccgactcctcaaaag

SEQ ID NO: 3877650 - DNA, 21 bp, Homo sapiens
gaacagaaaacaaaagagaga

SEQ ID NO: 3877651 - DNA, 16 bp, Homo sapiens
gaacagagactctgga

SEQ ID NO: 3877652 - DNA, 16 bp, Homo sapiens
gaacagagcgggcctc

SEQ ID NO: 3877653 - DNA, 23 bp, Homo sapiens
gaacagccaaatgcatggtgcag

SEQ ID NO: 3877654 - DNA, 20 bp, Homo sapiens
gaacagctcttcactcagcc

SEQ ID NO: 3877655 - DNA, 23 bp, Homo sapiens
gaacagctcttcactcagccaca

SEQ ID NO: 3877656 - DNA, 14 bp, Homo sapiens
gaacaggtggatgt

SEQ ID NO: 3877657 - DNA, 18 bp, Homo sapiens
gaacagtcacccttctgg

SEQ ID NO: 3877658 - DNA, 15 bp, Homo sapiens
gaacataaagcaaat

SEQ ID NO: 3877659 - DNA, 23 bp, Homo sapiens
gaacatcaccgacgcgtctcctg

SEQ ID NO: 3877660 - DNA, 16 bp, Homo sapiens
gaacatgcacatttat

SEQ ID NO: 3877661 - DNA, 20 bp, Homo sapiens
gaacatgtcggagtagaaat

SEQ ID NO: 3877662 - DNA, 19 bp, Homo sapiens
gaacatgtgggaggaagaa

SEQ ID NO: 3877663 - DNA, 19 bp, Homo sapiens
gaacattcgaggtgtcacc

SEQ ID NO: 3877664 - DNA, 20 bp, Homo sapiens
gaacatttcttatgattttt

SEQ ID NO: 3877665 - DNA, 18 bp, Homo sapiens
gaaccaagcttcagagcc

SEQ ID NO: 3877666 - DNA, 23 bp, Homo sapiens
gaaccaagcttcagagcctagcc

SEQ ID NO: 3877667 - DNA, 15 bp, Homo sapiens
gaaccaaggcagcct

SEQ ID NO: 3877668 - DNA, 16 bp, Homo sapiens
gaaccagggaggagag

SEQ ID NO: 3877669 - DNA, 16 bp, Homo sapiens
gaacccaggacaagca

SEQ ID NO: 3877670 - DNA, 16 bp, Homo sapiens
gaacccaggaggtgga

SEQ ID NO: 3877671 - DNA, 15 bp, Homo sapiens
gaacccttgtgcttg

SEQ ID NO: 3877672 - DNA, 18 bp, Homo sapiens
gaacccttgtgcttggtg

SEQ ID NO: 3877673 - DNA, 22 bp, Homo sapiens
gaacccttttcctccagacaga

SEQ ID NO: 3877674 - DNA, 22 bp, Homo sapiens
gaacctaaagtagcaggactcg

SEQ ID NO: 3877675 - DNA, 20 bp, Homo sapiens
gaacctaactccccacccca

SEQ ID NO: 3877676 - DNA, 17 bp, Homo sapiens
gaacctagaagggctag

SEQ ID NO: 3877677 - DNA, 19 bp, Homo sapiens
gaacctagtactctctgct

SEQ ID NO: 3877678 - DNA, 15 bp, Homo sapiens
gaacctcagtttcct

SEQ ID NO: 3877679 - DNA, 18 bp, Homo sapiens
gaacctcagtttcctcat

SEQ ID NO: 3877680 - DNA, 15 bp, Homo sapiens
gaacctcctatttta

SEQ ID NO: 3877681 - DNA, 13 bp, Homo sapiens
gaacctggagggg

SEQ ID NO: 3877682 - DNA, 11 bp, Homo sapiens
gaacctggcct

SEQ ID NO: 3877683 - DNA, 14 bp, Homo sapiens
gaacctggccttca

SEQ ID NO: 3877684 - DNA, 15 bp, Homo sapiens
gaacctgtactgggt

SEQ ID NO: 3877685 - DNA, 20 bp, Homo sapiens
gaaccttaacctctctaagc

SEQ ID NO: 3877686 - DNA, 21 bp, Homo sapiens
gaaccttaacctctctaagcc

SEQ ID NO: 3877687 - DNA, 15 bp, Homo sapiens
gaaccttccctccaa

SEQ ID NO: 3877688 - DNA, 18 bp, Homo sapiens
gaacgagcactggccaga

SEQ ID NO: 3877689 - DNA, 22 bp, Homo sapiens
gaacgtgactgccccaactcct

SEQ ID NO: 3877690 - DNA, 22 bp, Homo sapiens
gaactacgcttgctcatttttt

SEQ ID NO: 3877691 - DNA, 15 bp, Homo sapiens
gaactatgaactaca

SEQ ID NO: 3877692 - DNA, 20 bp, Homo sapiens
gaactcagagcccctccctg

SEQ ID NO: 3877693 - DNA, 17 bp, Homo sapiens
gaactcccagcaacaca

SEQ ID NO: 3877694 - DNA, 16 bp, Homo sapiens
gaactctccaaatatt

SEQ ID NO: 3877695 - DNA, 13 bp, Homo sapiens
gaactctgacaag

SEQ ID NO: 3877696 - DNA, 15 bp, Homo sapiens
gaactctgacaaggg

SEQ ID NO: 3877697 - DNA, 17 bp, Homo sapiens
gaactctggcttccagg

SEQ ID NO: 3877698 - DNA, 19 bp, Homo sapiens
gaactctggcttccaggta

SEQ ID NO: 3877699 - DNA, 20 bp, Homo sapiens
gaactctggcttccaggtat

SEQ ID NO: 3877700 - DNA, 19 bp, Homo sapiens
gaactgaagggggcggcct

SEQ ID NO: 3877701 - DNA, 21 bp, Homo sapiens
gaactgagccaaacacactgt

SEQ ID NO: 3877702 - DNA, 18 bp, Homo sapiens
gaactgccccatctcctc

SEQ ID NO: 3877703 - DNA, 22 bp, Homo sapiens
gaactgctaaatactgtacata

SEQ ID NO: 3877704 - DNA, 15 bp, Homo sapiens
gaactggccaagctg

SEQ ID NO: 3877705 - DNA, 14 bp, Homo sapiens
gaactggttcaaga

SEQ ID NO: 3877706 - DNA, 20 bp, Homo sapiens
gaactggttcaagagacact

SEQ ID NO: 3877707 - DNA, 22 bp, Homo sapiens
gaactgttctggcctcagacca

SEQ ID NO: 3877708 - DNA, 21 bp, Homo sapiens
gaacttacacttggagcccgt

SEQ ID NO: 3877709 - DNA, 14 bp, Homo sapiens
gaacttgaggacac

SEQ ID NO: 3877710 - DNA, 16 bp, Homo sapiens
gaacttgaggacacat

SEQ ID NO: 3877711 - DNA, 22 bp, Homo sapiens
gaagaaaactcctttagcaggt

SEQ ID NO: 3877712 - DNA, 13 bp, Homo sapiens
gaagaaaagcact

SEQ ID NO: 3877713 - DNA, 16 bp, Homo sapiens
gaagaaacaggggatc

SEQ ID NO: 3877714 - DNA, 20 bp, Homo sapiens
gaagaaagaacggaagaaga

SEQ ID NO: 3877715 - DNA, 12 bp, Homo sapiens
gaagaaatccat

SEQ ID NO: 3877716 - DNA, 14 bp, Homo sapiens
gaagaaattcctgt

SEQ ID NO: 3877717 - DNA, 13 bp, Homo sapiens
gaagaagccccgt

SEQ ID NO: 3877718 - DNA, 15 bp, Homo sapiens
gaagaagctgaggat

SEQ ID NO: 3877719 - DNA, 17 bp, Homo sapiens
gaagaatattcaggact

SEQ ID NO: 3877720 - DNA, 19 bp, Homo sapiens
gaagaattgaacccaggag

SEQ ID NO: 3877721 - DNA, 18 bp, Homo sapiens
gaagacaaaccactgtac

SEQ ID NO: 3877722 - DNA, 20 bp, Homo sapiens
gaagacaaaccactgtacat

SEQ ID NO: 3877723 - DNA, 20 bp, Homo sapiens
gaagacatggagactcctgc

SEQ ID NO: 3877724 - DNA, 21 bp, Homo sapiens
gaagacatggagactcctgcc

SEQ ID NO: 3877725 - DNA, 18 bp, Homo sapiens
gaagaccagactgtggag

SEQ ID NO: 3877726 - DNA, 12 bp, Homo sapiens
gaagactggaag

SEQ ID NO: 3877727 - DNA, 13 bp, Homo sapiens
gaagagaagctga

SEQ ID NO: 3877728 - DNA, 14 bp, Homo sapiens
gaagagaaggagca

SEQ ID NO: 3877729 - DNA, 11 bp, Homo sapiens
gaagagagaga

SEQ ID NO: 3877730 - DNA, 13 bp, Homo sapiens
gaagagagagaga

SEQ ID NO: 3877731 - DNA, 20 bp, Homo sapiens
gaagagaggcacctgctgga

SEQ ID NO: 3877732 - DNA, 17 bp, Homo sapiens
gaagagatcaggaagag

SEQ ID NO: 3877733 - DNA, 22 bp, Homo sapiens
gaagagatgtggcaaagtgctg

SEQ ID NO: 3877734 - DNA, 13 bp, Homo sapiens
gaagagcagcctg

SEQ ID NO: 3877735 - DNA, 14 bp, Homo sapiens
gaagagcagcctga

SEQ ID NO: 3877736 - DNA, 18 bp, Homo sapiens
gaagagcaggcacatgga

SEQ ID NO: 3877737 - DNA, 12 bp, Homo sapiens
gaagagctcttc

SEQ ID NO: 3877738 - DNA, 23 bp, Homo sapiens
gaagagctgttcacagccagact

SEQ ID NO: 3877739 - DNA, 22 bp, Homo sapiens
gaagagggaatggatggggaga

SEQ ID NO: 3877740 - DNA, 23 bp, Homo sapiens
gaagagtttaactttgggcccag

SEQ ID NO: 3877741 - DNA, 17 bp, Homo sapiens
gaagatgaagagaagct

SEQ ID NO: 3877742 - DNA, 24 bp, Homo sapiens
gaagatgcgagcgctatcttcaca

SEQ ID NO: 3877743 - DNA, 14 bp, Homo sapiens
gaagatgtgattta

SEQ ID NO: 3877744 - DNA, 21 bp, Homo sapiens
gaagatgttgtcattatgtac

SEQ ID NO: 3877745 - DNA, 12 bp, Homo sapiens
gaagcaggcaga

SEQ ID NO: 3877746 - DNA, 16 bp, Homo sapiens
gaagcaggcagagcgg

SEQ ID NO: 3877747 - DNA, 19 bp, Homo sapiens
gaagcaggcagagcgggga

SEQ ID NO: 3877748 - DNA, 23 bp, Homo sapiens
gaagcaggcagagcggggaggtg

SEQ ID NO: 3877749 - DNA, 22 bp, Homo sapiens
gaagcagtgcctcgaggcaccg

SEQ ID NO: 3877750 - DNA, 17 bp, Homo sapiens
gaagcatgtaggagaat

SEQ ID NO: 3877751 - DNA, 18 bp, Homo sapiens
gaagccaacttggctttc

SEQ ID NO: 3877752 - DNA, 15 bp, Homo sapiens
gaagccacgctgtcc

SEQ ID NO: 3877753 - DNA, 17 bp, Homo sapiens
gaagccacgctgtcctc

SEQ ID NO: 3877754 - DNA, 13 bp, Homo sapiens
gaagccaggagca

SEQ ID NO: 3877755 - DNA, 14 bp, Homo sapiens
gaagccaggagcaa

SEQ ID NO: 3877756 - DNA, 18 bp, Homo sapiens
gaagccaggagcaaatgt

SEQ ID NO: 3877757 - DNA, 18 bp, Homo sapiens
gaagcccaataaacctct

SEQ ID NO: 3877758 - DNA, 13 bp, Homo sapiens
gaagcccaggctg

SEQ ID NO: 3877759 - DNA, 10 bp, Homo sapiens
gaagcccagt

SEQ ID NO: 3877760 - DNA, 16 bp, Homo sapiens
gaagccccaagccatg

SEQ ID NO: 3877761 - DNA, 14 bp, Homo sapiens
gaagccctccttcc

SEQ ID NO: 3877762 - DNA, 11 bp, Homo sapiens
gaagccctgga

SEQ ID NO: 3877763 - DNA, 22 bp, Homo sapiens
gaagccgtctgactccagagtc

SEQ ID NO: 3877764 - DNA, 24 bp, Homo sapiens
gaagccgtctgactccagagtctg

SEQ ID NO: 3877765 - DNA, 14 bp, Homo sapiens
gaagcctaaataaa

SEQ ID NO: 3877766 - DNA, 21 bp, Homo sapiens
gaagcctggactctaagctgg

SEQ ID NO: 3877767 - DNA, 17 bp, Homo sapiens
gaagcctgggggcctgg

SEQ ID NO: 3877768 - DNA, 19 bp, Homo sapiens
gaagcctgggggcctggct

SEQ ID NO: 3877769 - DNA, 14 bp, Homo sapiens
gaagcgctcatctg

SEQ ID NO: 3877770 - DNA, 16 bp, Homo sapiens
gaagctaacagggaag

SEQ ID NO: 3877771 - DNA, 14 bp, Homo sapiens
gaagctaagctgca

SEQ ID NO: 3877772 - DNA, 17 bp, Homo sapiens
gaagctattgagaaaga

SEQ ID NO: 3877773 - DNA, 19 bp, Homo sapiens
gaagctattgatgtttcca

SEQ ID NO: 3877774 - DNA, 20 bp, Homo sapiens
gaagctattgatgtttccag

SEQ ID NO: 3877775 - DNA, 16 bp, Homo sapiens
gaagctccactgtcac

SEQ ID NO: 3877776 - DNA, 16 bp, Homo sapiens
gaagctcccagatgct

SEQ ID NO: 3877777 - DNA, 14 bp, Homo sapiens
gaagctgagaagaa

SEQ ID NO: 3877778 - DNA, 15 bp, Homo sapiens
gaagctgagaagaag

SEQ ID NO: 3877779 - DNA, 21 bp, Homo sapiens
gaagctgagaagaagctgagg

SEQ ID NO: 3877780 - DNA, 14 bp, Homo sapiens
gaagctgaggatcc

SEQ ID NO: 3877781 - DNA, 12 bp, Homo sapiens
gaagctgtgtcc

SEQ ID NO: 3877782 - DNA, 20 bp, Homo sapiens
gaagctgtgtccttgcacct

SEQ ID NO: 3877783 - DNA, 15 bp, Homo sapiens
gaaggaactctggct

SEQ ID NO: 3877784 - DNA, 23 bp, Homo sapiens
gaaggaactctggcttccaggta

SEQ ID NO: 3877785 - DNA, 17 bp, Homo sapiens
gaaggaatagccagaga

SEQ ID NO: 3877786 - DNA, 19 bp, Homo sapiens
gaaggaatagccagagagg

SEQ ID NO: 3877787 - DNA, 22 bp, Homo sapiens
gaaggacccggaggggcctggc

SEQ ID NO: 3877788 - DNA, 23 bp, Homo sapiens
gaaggacccggaggggcctggca

SEQ ID NO: 3877789 - DNA, 13 bp, Homo sapiens
gaaggagaaagga

SEQ ID NO: 3877790 - DNA, 15 bp, Homo sapiens
gaaggagactcacct

SEQ ID NO: 3877791 - DNA, 15 bp, Homo sapiens
gaaggaggcagactg

SEQ ID NO: 3877792 - DNA, 16 bp, Homo sapiens
gaaggagggcagagcc

SEQ ID NO: 3877793 - DNA, 15 bp, Homo sapiens
gaaggaggtgaggga

SEQ ID NO: 3877794 - DNA, 17 bp, Homo sapiens
gaaggaggtgagggatg

SEQ ID NO: 3877795 - DNA, 19 bp, Homo sapiens
gaaggcacaggtgtaaata

SEQ ID NO: 3877796 - DNA, 14 bp, Homo sapiens
gaaggcagctgctc

SEQ ID NO: 3877797 - DNA, 16 bp, Homo sapiens
gaaggcaggcagggct

SEQ ID NO: 3877798 - DNA, 18 bp, Homo sapiens
gaaggcaggcagggctct

SEQ ID NO: 3877799 - DNA, 13 bp, Homo sapiens
gaaggcagggaaa

SEQ ID NO: 3877800 - DNA, 17 bp, Homo sapiens
gaaggcagggaggaggc

SEQ ID NO: 3877801 - DNA, 15 bp, Homo sapiens
gaaggcagggcagag

SEQ ID NO: 3877802 - DNA, 18 bp, Homo sapiens
gaaggcctcttgtgctca

SEQ ID NO: 3877803 - DNA, 21 bp, Homo sapiens
gaaggcgtgcaaggggctcag

SEQ ID NO: 3877804 - DNA, 13 bp, Homo sapiens
gaaggctggctga

SEQ ID NO: 3877805 - DNA, 15 bp, Homo sapiens
gaagggaaaacagtc

SEQ ID NO: 3877806 - DNA, 12 bp, Homo sapiens
gaagggaagcct

SEQ ID NO: 3877807 - DNA, 17 bp, Homo sapiens
gaagggaccttgaaggg

SEQ ID NO: 3877808 - DNA, 20 bp, Homo sapiens
gaagggaccttgaagggtaa

SEQ ID NO: 3877809 - DNA, 21 bp, Homo sapiens
gaagggagaaggatctagaat

SEQ ID NO: 3877810 - DNA, 20 bp, Homo sapiens
gaagggagttgctcactcag

SEQ ID NO: 3877811 - DNA, 23 bp, Homo sapiens
gaagggagttgctcactcaggac

SEQ ID NO: 3877812 - DNA, 10 bp, Homo sapiens
gaagggccag

SEQ ID NO: 3877813 - DNA, 14 bp, Homo sapiens
gaagggccagccct

SEQ ID NO: 3877814 - DNA, 15 bp, Homo sapiens
gaagggccaggagag

SEQ ID NO: 3877815 - DNA, 14 bp, Homo sapiens
gaagggccagtctg

SEQ ID NO: 3877816 - DNA, 20 bp, Homo sapiens
gaagggccagtctgggctgc

SEQ ID NO: 3877817 - DNA, 19 bp, Homo sapiens
gaaggggacgcgggctgtg

SEQ ID NO: 3877818 - DNA, 22 bp, Homo sapiens
gaaggggccccggggctggcaa

SEQ ID NO: 3877819 - DNA, 23 bp, Homo sapiens
gaaggggccccggggctggcaag

SEQ ID NO: 3877820 - DNA, 22 bp, Homo sapiens
gaagggtgggaagcttgctggc

SEQ ID NO: 3877821 - DNA, 15 bp, Homo sapiens
gaaggtgctgagctt

SEQ ID NO: 3877822 - DNA, 20 bp, Homo sapiens
gaaggttaggatttaacagt

SEQ ID NO: 3877823 - DNA, 15 bp, Homo sapiens
gaagtaaatttgtcc

SEQ ID NO: 3877824 - DNA, 18 bp, Homo sapiens
gaagtaacttttacaaaa

SEQ ID NO: 3877825 - DNA, 19 bp, Homo sapiens
gaagtacatgaagagcagc

SEQ ID NO: 3877826 - DNA, 22 bp, Homo sapiens
gaagtcagcccgaatgcctgtc

SEQ ID NO: 3877827 - DNA, 16 bp, Homo sapiens
gaagtctaggagctgg

SEQ ID NO: 3877828 - DNA, 22 bp, Homo sapiens
gaagtctaggagctgggaggaa

SEQ ID NO: 3877829 - DNA, 18 bp, Homo sapiens
gaagtgaaggagaaagga

SEQ ID NO: 3877830 - DNA, 12 bp, Homo sapiens
gaagtgctcccc

SEQ ID NO: 3877831 - DNA, 18 bp, Homo sapiens
gaagtgctccccacacgt

SEQ ID NO: 3877832 - DNA, 18 bp, Homo sapiens
gaagtggaccaggacagg

SEQ ID NO: 3877833 - DNA, 16 bp, Homo sapiens
gaagtgtcgaaagcaa

SEQ ID NO: 3877834 - DNA, 18 bp, Homo sapiens
gaagtgttcaagaaataa

SEQ ID NO: 3877835 - DNA, 15 bp, Homo sapiens
gaagttaacagagac

SEQ ID NO: 3877836 - DNA, 20 bp, Homo sapiens
gaagttgtgccttttatagc

SEQ ID NO: 3877837 - DNA, 18 bp, Homo sapiens
gaataaacttcagcacca

SEQ ID NO: 3877838 - DNA, 19 bp, Homo sapiens
gaataaagacttcatgttc

SEQ ID NO: 3877839 - DNA, 13 bp, Homo sapiens
gaataaatgttca

SEQ ID NO: 3877840 - DNA, 14 bp, Homo sapiens
gaataaatgttcaa

SEQ ID NO: 3877841 - DNA, 18 bp, Homo sapiens
gaataagctcccagggcc

SEQ ID NO: 3877842 - DNA, 18 bp, Homo sapiens
gaataagtgctgtttgag

SEQ ID NO: 3877843 - DNA, 21 bp, Homo sapiens
gaataagtgctgtttgagatg

SEQ ID NO: 3877844 - DNA, 14 bp, Homo sapiens
gaatacagaaaatg

SEQ ID NO: 3877845 - DNA, 14 bp, Homo sapiens
gaatacagaaagat

SEQ ID NO: 3877846 - DNA, 15 bp, Homo sapiens
gaatacccccagaga

SEQ ID NO: 3877847 - DNA, 16 bp, Homo sapiens
gaatacccccagagac

SEQ ID NO: 3877848 - DNA, 18 bp, Homo sapiens
gaatacccccagagacct

SEQ ID NO: 3877849 - DNA, 19 bp, Homo sapiens
gaatacccccagagacctt

SEQ ID NO: 3877850 - DNA, 18 bp, Homo sapiens
gaatagccagagaggagc

SEQ ID NO: 3877851 - DNA, 16 bp, Homo sapiens
gaatagtctgtgtgca

SEQ ID NO: 3877852 - DNA, 18 bp, Homo sapiens
gaatatatcagaatctgt

SEQ ID NO: 3877853 - DNA, 20 bp, Homo sapiens
gaatattcagagaatatcaa

SEQ ID NO: 3877854 - DNA, 20 bp, Homo sapiens
gaatatttacaataaagagt

SEQ ID NO: 3877855 - DNA, 14 bp, Homo sapiens
gaatcaaaactctc

SEQ ID NO: 3877856 - DNA, 15 bp, Homo sapiens
gaatcaaaactctcc

SEQ ID NO: 3877857 - DNA, 16 bp, Homo sapiens
gaatcaaagacatgga

SEQ ID NO: 3877858 - DNA, 14 bp, Homo sapiens
gaatcaaggaatcc

SEQ ID NO: 3877859 - DNA, 15 bp, Homo sapiens
gaatcacctggaggg

SEQ ID NO: 3877860 - DNA, 21 bp, Homo sapiens
gaatcagcttttaataaaatt

SEQ ID NO: 3877861 - DNA, 13 bp, Homo sapiens
gaatcataatttt

SEQ ID NO: 3877862 - DNA, 15 bp, Homo sapiens
gaatcataattttca

SEQ ID NO: 3877863 - DNA, 17 bp, Homo sapiens
gaatcatgtcaggcctg

SEQ ID NO: 3877864 - DNA, 24 bp, Homo sapiens
gaatccacccatcctaccaatgca

SEQ ID NO: 3877865 - DNA, 22 bp, Homo sapiens
gaatccgcctgcagaggacaga

SEQ ID NO: 3877866 - DNA, 12 bp, Homo sapiens
gaatcctgcctc

SEQ ID NO: 3877867 - DNA, 20 bp, Homo sapiens
cttccccagactcagctcca

SEQ ID NO: 3877868 - DNA, 23 bp, Homo sapiens
cttccccagactcagctccagaa

SEQ ID NO: 3877869 - DNA, 13 bp, Homo sapiens
cttccccatctcc

SEQ ID NO: 3877870 - DNA, 19 bp, Homo sapiens
cttccccatctccatttca

SEQ ID NO: 3877871 - DNA, 15 bp, Homo sapiens
cttccccctccaatc

SEQ ID NO: 3877872 - DNA, 18 bp, Homo sapiens
cttcccctacacctccct

SEQ ID NO: 3877873 - DNA, 15 bp, Homo sapiens
cttcccctgcctggt

SEQ ID NO: 3877874 - DNA, 20 bp, Homo sapiens
cttccccttttgcctggctg

SEQ ID NO: 3877875 - DNA, 21 bp, Homo sapiens
cttccccttttgcctggctgt

SEQ ID NO: 3877876 - DNA, 22 bp, Homo sapiens
cttccctaatcctccaagtctt

SEQ ID NO: 3877877 - DNA, 20 bp, Homo sapiens
cttccctccccacagtcctc

SEQ ID NO: 3877878 - DNA, 13 bp, Homo sapiens
cttccctccttcc

SEQ ID NO: 3877879 - DNA, 13 bp, Homo sapiens
cttccctctttcc

SEQ ID NO: 3877880 - DNA, 23 bp, Homo sapiens
cttccctctttccccacctcttc

SEQ ID NO: 3877881 - DNA, 11 bp, Homo sapiens
cttccctgctt

SEQ ID NO: 3877882 - DNA, 12 bp, Homo sapiens
cttccctgggaa

SEQ ID NO: 3877883 - DNA, 13 bp, Homo sapiens
cttccctgggaag

SEQ ID NO: 3877884 - DNA, 14 bp, Homo sapiens
cttcccttctctcc

SEQ ID NO: 3877885 - DNA, 17 bp, Homo sapiens
cttcccttctctccttc

SEQ ID NO: 3877886 - DNA, 19 bp, Homo sapiens
cttcccttctctccttccc

SEQ ID NO: 3877887 - DNA, 20 bp, Homo sapiens
cttcccttctctccttccct

SEQ ID NO: 3877888 - DNA, 21 bp, Homo sapiens
cttcctccagacccctgtggc

SEQ ID NO: 3877889 - DNA, 24 bp, Homo sapiens
cttcctccgtccacccaggctgca

SEQ ID NO: 3877890 - DNA, 19 bp, Homo sapiens
cttcctcctccacagtgct

SEQ ID NO: 3877891 - DNA, 17 bp, Homo sapiens
cttcctcctgaagcctc

SEQ ID NO: 3877892 - DNA, 19 bp, Homo sapiens
cttcctcctgaagcctctg

SEQ ID NO: 3877893 - DNA, 13 bp, Homo sapiens
cttcctcctgatg

SEQ ID NO: 3877894 - DNA, 14 bp, Homo sapiens
cttcctctccactg

SEQ ID NO: 3877895 - DNA, 15 bp, Homo sapiens
cttcctctccactgc

SEQ ID NO: 3877896 - DNA, 16 bp, Homo sapiens
cttcctctccactgcc

SEQ ID NO: 3877897 - DNA, 19 bp, Homo sapiens
cttcctctccactgccttc

SEQ ID NO: 3877898 - DNA, 11 bp, Homo sapiens
cttcctctgct

SEQ ID NO: 3877899 - DNA, 13 bp, Homo sapiens
cttcctctgctga

SEQ ID NO: 3877900 - DNA, 14 bp, Homo sapiens
cttcctctgttcta

SEQ ID NO: 3877901 - DNA, 19 bp, Homo sapiens
cttcctctgttctatccca

SEQ ID NO: 3877902 - DNA, 15 bp, Homo sapiens
cttcctgattcccca

SEQ ID NO: 3877903 - DNA, 13 bp, Homo sapiens
cttcctgcaagga

SEQ ID NO: 3877904 - DNA, 15 bp, Homo sapiens
cttcctgcaaggact

SEQ ID NO: 3877905 - DNA, 13 bp, Homo sapiens
cttcctgccacca

SEQ ID NO: 3877906 - DNA, 15 bp, Homo sapiens
cttcctgccaccagt

SEQ ID NO: 3877907 - DNA, 21 bp, Homo sapiens
cttcctgccaccagtcactgt

SEQ ID NO: 3877908 - DNA, 21 bp, Homo sapiens
cttcctgccccaactccttcc

SEQ ID NO: 3877909 - DNA, 13 bp, Homo sapiens
cttcctgctgctg

SEQ ID NO: 3877910 - DNA, 16 bp, Homo sapiens
cttcctggacagctgt

SEQ ID NO: 3877911 - DNA, 17 bp, Homo sapiens
cttcctggacagctgtg

SEQ ID NO: 3877912 - DNA, 20 bp, Homo sapiens
cttcctggacagctgtgcct

SEQ ID NO: 3877913 - DNA, 23 bp, Homo sapiens
cttcctggacagctgtgcctcgc

SEQ ID NO: 3877914 - DNA, 24 bp, Homo sapiens
cttcctggacagctgtgcctcgct

SEQ ID NO: 3877915 - DNA, 17 bp, Homo sapiens
cttcctggacctgagtc

SEQ ID NO: 3877916 - DNA, 12 bp, Homo sapiens
cttcctggcctc

SEQ ID NO: 3877917 - DNA, 21 bp, Homo sapiens
cttcctggcctcactggctgg

SEQ ID NO: 3877918 - DNA, 17 bp, Homo sapiens
cttcctggggccccgct

SEQ ID NO: 3877919 - DNA, 21 bp, Homo sapiens
cttcctgggtcctgttcccta

SEQ ID NO: 3877920 - DNA, 23 bp, Homo sapiens
cttcctgggtcctgttccctacc

SEQ ID NO: 3877921 - DNA, 20 bp, Homo sapiens
cttcctggtgaggcccagcc

SEQ ID NO: 3877922 - DNA, 23 bp, Homo sapiens
cttcctgtaacacaagccacaga

SEQ ID NO: 3877923 - DNA, 23 bp, Homo sapiens
cttcctgtccactctcggggccc

SEQ ID NO: 3877924 - DNA, 17 bp, Homo sapiens
cttcctgtcccacctct

SEQ ID NO: 3877925 - DNA, 13 bp, Homo sapiens
cttcctgtgactt

SEQ ID NO: 3877926 - DNA, 22 bp, Homo sapiens
cttcctgtgtactctttatttc

SEQ ID NO: 3877927 - DNA, 19 bp, Homo sapiens
cttccttaattcactccca

SEQ ID NO: 3877928 - DNA, 21 bp, Homo sapiens
cttccttaattcactcccaca

SEQ ID NO: 3877929 - DNA, 16 bp, Homo sapiens
cttccttacccaaact

SEQ ID NO: 3877930 - DNA, 19 bp, Homo sapiens
cttccttactcccaggcac

SEQ ID NO: 3877931 - DNA, 21 bp, Homo sapiens
cttccttccgctcctttacct

SEQ ID NO: 3877932 - DNA, 15 bp, Homo sapiens
cttccttctgcaccc

SEQ ID NO: 3877933 - DNA, 15 bp, Homo sapiens
cttccttctttctct

SEQ ID NO: 3877934 - DNA, 19 bp, Homo sapiens
cttccttctttctcttccc

SEQ ID NO: 3877935 - DNA, 20 bp, Homo sapiens
cttccttctttctcttccct

SEQ ID NO: 3877936 - DNA, 19 bp, Homo sapiens
cttcctttaggtctggttg

SEQ ID NO: 3877937 - DNA, 14 bp, Homo sapiens
cttcgactcaggat

SEQ ID NO: 3877938 - DNA, 15 bp, Homo sapiens
cttcgactcaggatc

SEQ ID NO: 3877939 - DNA, 21 bp, Homo sapiens
cttcgatacaccgggcctgga

SEQ ID NO: 3877940 - DNA, 17 bp, Homo sapiens
cttcgctgccaggacac

SEQ ID NO: 3877941 - DNA, 20 bp, Homo sapiens
cttcgctgccaggacacctg

SEQ ID NO: 3877942 - DNA, 15 bp, Homo sapiens
cttcgctgctctagc

SEQ ID NO: 3877943 - DNA, 19 bp, Homo sapiens
cttcgctgctctagctggc

SEQ ID NO: 3877944 - DNA, 19 bp, Homo sapiens
cttcggtgtttaaagtcaa

SEQ ID NO: 3877945 - DNA, 15 bp, Homo sapiens
cttcggtttctgagc

SEQ ID NO: 3877946 - DNA, 16 bp, Homo sapiens
cttcggtttctgagca

SEQ ID NO: 3877947 - DNA, 23 bp, Homo sapiens
cttctaacctcagccaaacacag

SEQ ID NO: 3877948 - DNA, 11 bp, Homo sapiens
cttctaatata

SEQ ID NO: 3877949 - DNA, 15 bp, Homo sapiens
cttctaatatatttt

SEQ ID NO: 3877950 - DNA, 18 bp, Homo sapiens
cttctaatatatttttat

SEQ ID NO: 3877951 - DNA, 17 bp, Homo sapiens
cttctaccttaaaatgt

SEQ ID NO: 3877952 - DNA, 15 bp, Homo sapiens
cttctatcccaggag

SEQ ID NO: 3877953 - DNA, 21 bp, Homo sapiens
cttctatgcagtattgccaca

SEQ ID NO: 3877954 - DNA, 17 bp, Homo sapiens
cttctatttaaaaaata

SEQ ID NO: 3877955 - DNA, 18 bp, Homo sapiens
cttctatttaaaaaataa

SEQ ID NO: 3877956 - DNA, 13 bp, Homo sapiens
cttctattttatt

SEQ ID NO: 3877957 - DNA, 14 bp, Homo sapiens
cttctattttgtaa

SEQ ID NO: 3877958 - DNA, 20 bp, Homo sapiens
cttctcaggacacaggcctg

SEQ ID NO: 3877959 - DNA, 12 bp, Homo sapiens
cttctcagtgtt

SEQ ID NO: 3877960 - DNA, 21 bp, Homo sapiens
cttctcatcatattgtatgta

SEQ ID NO: 3877961 - DNA, 21 bp, Homo sapiens
cttctcattccaacagtgagt

SEQ ID NO: 3877962 - DNA, 13 bp, Homo sapiens
cttctccactgga

SEQ ID NO: 3877963 - DNA, 14 bp, Homo sapiens
cttctccactggat

SEQ ID NO: 3877964 - DNA, 17 bp, Homo sapiens
cttctccactggatgga

SEQ ID NO: 3877965 - DNA, 17 bp, Homo sapiens
cttctccatctggcagg

SEQ ID NO: 3877966 - DNA, 14 bp, Homo sapiens
cttctcccatctag

SEQ ID NO: 3877967 - DNA, 13 bp, Homo sapiens
cttctcctgtgac

SEQ ID NO: 3877968 - DNA, 14 bp, Homo sapiens
cttctcctttcaca

SEQ ID NO: 3877969 - DNA, 20 bp, Homo sapiens
cttctcctttcacaaccttc

SEQ ID NO: 3877970 - DNA, 15 bp, Homo sapiens
cttctctacagactt

SEQ ID NO: 3877971 - DNA, 16 bp, Homo sapiens
cttctctccttccctc

SEQ ID NO: 3877972 - DNA, 13 bp, Homo sapiens
cttctcttcctgt

SEQ ID NO: 3877973 - DNA, 13 bp, Homo sapiens
cttctgacctccc

SEQ ID NO: 3877974 - DNA, 12 bp, Homo sapiens
cttctgcaccca

SEQ ID NO: 3877975 - DNA, 14 bp, Homo sapiens
cttctgcagcaact

SEQ ID NO: 3877976 - DNA, 20 bp, Homo sapiens
cttctgcagcaactcccacg

SEQ ID NO: 3877977 - DNA, 15 bp, Homo sapiens
cttctgcttctccct

SEQ ID NO: 3877978 - DNA, 16 bp, Homo sapiens
cttctggaaggctggc

SEQ ID NO: 3877979 - DNA, 17 bp, Homo sapiens
cttctggaaggctggct

SEQ ID NO: 3877980 - DNA, 18 bp, Homo sapiens
cttctggaaggctggctg

SEQ ID NO: 3877981 - DNA, 19 bp, Homo sapiens
cttctggaaggctggctga

SEQ ID NO: 3877982 - DNA, 16 bp, Homo sapiens
cttctggagtctccag

SEQ ID NO: 3877983 - DNA, 18 bp, Homo sapiens
cttctggagtctccagtg

SEQ ID NO: 3877984 - DNA, 13 bp, Homo sapiens
cttctggctcctc

SEQ ID NO: 3877985 - DNA, 20 bp, Homo sapiens
cttctggcttccttctctca

SEQ ID NO: 3877986 - DNA, 16 bp, Homo sapiens
cttctgggcaaggggg

SEQ ID NO: 3877987 - DNA, 18 bp, Homo sapiens
cttctgtccaggacatga

SEQ ID NO: 3877988 - DNA, 13 bp, Homo sapiens
cttctgtggctca

SEQ ID NO: 3877989 - DNA, 17 bp, Homo sapiens
cttctgttgcgccactg

SEQ ID NO: 3877990 - DNA, 16 bp, Homo sapiens
cttcttaaaggcctgg

SEQ ID NO: 3877991 - DNA, 17 bp, Homo sapiens
cttcttaaaggcctgga

SEQ ID NO: 3877992 - DNA, 23 bp, Homo sapiens
cttcttattcatgctttctcctt

SEQ ID NO: 3877993 - DNA, 15 bp, Homo sapiens
cttcttcacccagct

SEQ ID NO: 3877994 - DNA, 18 bp, Homo sapiens
cttcttcacccagctaat

SEQ ID NO: 3877995 - DNA, 20 bp, Homo sapiens
cttcttcagaagacactgca

SEQ ID NO: 3877996 - DNA, 14 bp, Homo sapiens
cttcttcagggact

SEQ ID NO: 3877997 - DNA, 17 bp, Homo sapiens
cttcttcggggaactcc

SEQ ID NO: 3877998 - DNA, 21 bp, Homo sapiens
cttcttctacttcagtcttct

SEQ ID NO: 3877999 - DNA, 19 bp, Homo sapiens
cttcttggcttctgggacc

SEQ ID NO: 3878000 - DNA, 19 bp, Homo sapiens
cttcttggtttggggagaa

SEQ ID NO: 3878001 - DNA, 15 bp, Homo sapiens
cttcttgtgtcctga

SEQ ID NO: 3878002 - DNA, 14 bp, Homo sapiens
cttctttaaatcaa

SEQ ID NO: 3878003 - DNA, 17 bp, Homo sapiens
cttctttaaatcaaaag

SEQ ID NO: 3878004 - DNA, 19 bp, Homo sapiens
cttctttaaatcaaaagct

SEQ ID NO: 3878005 - DNA, 22 bp, Homo sapiens
cttctttaaatcaaaagctgct

SEQ ID NO: 3878006 - DNA, 16 bp, Homo sapiens
cttctttgtcttagct

SEQ ID NO: 3878007 - DNA, 17 bp, Homo sapiens
cttgaaacagcctgggt

SEQ ID NO: 3878008 - DNA, 18 bp, Homo sapiens
cttgaacatgttttgtat

SEQ ID NO: 3878009 - DNA, 21 bp, Homo sapiens
cttgaactgttctggcctcag

SEQ ID NO: 3878010 - DNA, 16 bp, Homo sapiens
cttgaatttcatgctt

SEQ ID NO: 3878011 - DNA, 14 bp, Homo sapiens
cttgacaacagact

SEQ ID NO: 3878012 - DNA, 24 bp, Homo sapiens
cttgacaacatcccacagtggcac

SEQ ID NO: 3878013 - DNA, 16 bp, Homo sapiens
cttgacacggtgaaat

SEQ ID NO: 3878014 - DNA, 14 bp, Homo sapiens
cttgacatgtaatg

SEQ ID NO: 3878015 - DNA, 12 bp, Homo sapiens
cttgacattcct

SEQ ID NO: 3878016 - DNA, 13 bp, Homo sapiens
cttgacattcctt

SEQ ID NO: 3878017 - DNA, 23 bp, Homo sapiens
cttgacattccttgtcaccagca

SEQ ID NO: 3878018 - DNA, 20 bp, Homo sapiens
cttgaccagacctagacctg

SEQ ID NO: 3878019 - DNA, 22 bp, Homo sapiens
cttgaccatcgtccttcctctc

SEQ ID NO: 3878020 - DNA, 19 bp, Homo sapiens
cttgactatcacatacaat

SEQ ID NO: 3878021 - DNA, 22 bp, Homo sapiens
cttgagagaaaaagtgcccctt

SEQ ID NO: 3878022 - DNA, 14 bp, Homo sapiens
cttgagcccaggag

SEQ ID NO: 3878023 - DNA, 14 bp, Homo sapiens
cttgaggacacatg

SEQ ID NO: 3878024 - DNA, 15 bp, Homo sapiens
cttgaggacacatgt

SEQ ID NO: 3878025 - DNA, 16 bp, Homo sapiens
cttgaggacacatgtc

SEQ ID NO: 3878026 - DNA, 14 bp, Homo sapiens
cttgaggagtgtga

SEQ ID NO: 3878027 - DNA, 16 bp, Homo sapiens
cttgaggattttgagt

SEQ ID NO: 3878028 - DNA, 16 bp, Homo sapiens
cttgcaagcagcctcc

SEQ ID NO: 3878029 - DNA, 17 bp, Homo sapiens
cttgcacaagcttgtat

SEQ ID NO: 3878030 - DNA, 18 bp, Homo sapiens
cttgcacatatttgaatg

SEQ ID NO: 3878031 - DNA, 16 bp, Homo sapiens
cttgcacccctcactc

SEQ ID NO: 3878032 - DNA, 20 bp, Homo sapiens
cttgcacccctcactctggc

SEQ ID NO: 3878033 - DNA, 23 bp, Homo sapiens
cttgcatcaatttttcttatttc

SEQ ID NO: 3878034 - DNA, 19 bp, Homo sapiens
cttgcatcctcctcccaac

SEQ ID NO: 3878035 - DNA, 18 bp, Homo sapiens
cttgcattgaatatatta

SEQ ID NO: 3878036 - DNA, 17 bp, Homo sapiens
cttgccaaattccatgt

SEQ ID NO: 3878037 - DNA, 18 bp, Homo sapiens
cttgccaagctttcttct

SEQ ID NO: 3878038 - DNA, 21 bp, Homo sapiens
cttgccaccggggaacccagc

SEQ ID NO: 3878039 - DNA, 22 bp, Homo sapiens
cttgcccagagatgcctccacc

SEQ ID NO: 3878040 - DNA, 14 bp, Homo sapiens
cttgcccccatccc

SEQ ID NO: 3878041 - DNA, 15 bp, Homo sapiens
cttgcccccatccct

SEQ ID NO: 3878042 - DNA, 18 bp, Homo sapiens
cttgcccccatccctcgg

SEQ ID NO: 3878043 - DNA, 23 bp, Homo sapiens
cttgccccctcatctcactgccc

SEQ ID NO: 3878044 - DNA, 19 bp, Homo sapiens
cttgcccctccagagacag

SEQ ID NO: 3878045 - DNA, 16 bp, Homo sapiens
cttgcccgccagcctc

SEQ ID NO: 3878046 - DNA, 17 bp, Homo sapiens
cttgcccgccagcctca

SEQ ID NO: 3878047 - DNA, 18 bp, Homo sapiens
cttgcccgccagcctcag

SEQ ID NO: 3878048 - DNA, 13 bp, Homo sapiens
cttgccctgacct

SEQ ID NO: 3878049 - DNA, 14 bp, Homo sapiens
cttgccctgacctc

SEQ ID NO: 3878050 - DNA, 19 bp, Homo sapiens
cttgccctgacctcccagc

SEQ ID NO: 3878051 - DNA, 19 bp, Homo sapiens
cttgccgagcctaatgaaa

SEQ ID NO: 3878052 - DNA, 12 bp, Homo sapiens
cttgcctgaggc

SEQ ID NO: 3878053 - DNA, 15 bp, Homo sapiens
cttgcctgaggctca

SEQ ID NO: 3878054 - DNA, 14 bp, Homo sapiens
cttgcgtcctgcag

SEQ ID NO: 3878055 - DNA, 24 bp, Homo sapiens
cttgcgtcctgcagaggaccacag

SEQ ID NO: 3878056 - DNA, 20 bp, Homo sapiens
cttgctcagtgcctcctggc

SEQ ID NO: 3878057 - DNA, 12 bp, Homo sapiens
cttgctccaggg

SEQ ID NO: 3878058 - DNA, 15 bp, Homo sapiens
cttgctccagggtct

SEQ ID NO: 3878059 - DNA, 18 bp, Homo sapiens
cttgctcctccttctgct

SEQ ID NO: 3878060 - DNA, 20 bp, Homo sapiens
cttgctcgctgtaaaatctt

SEQ ID NO: 3878061 - DNA, 19 bp, Homo sapiens
cttgctctcccctgccctg

SEQ ID NO: 3878062 - DNA, 16 bp, Homo sapiens
cttgctcttctttctg

SEQ ID NO: 3878063 - DNA, 21 bp, Homo sapiens
cttgctggacggggactgggg

SEQ ID NO: 3878064 - DNA, 14 bp, Homo sapiens
cttgctggcttctg

SEQ ID NO: 3878065 - DNA, 19 bp, Homo sapiens
cttgctgtaactcagacat

SEQ ID NO: 3878066 - DNA, 11 bp, Homo sapiens
cttgcttctgc

SEQ ID NO: 3878067 - DNA, 21 bp, Homo sapiens
cttgcttctgcagcaactccc

SEQ ID NO: 3878068 - DNA, 14 bp, Homo sapiens
cttgctttgctgtc

SEQ ID NO: 3878069 - DNA, 15 bp, Homo sapiens
cttgctttgggcttt

SEQ ID NO: 3878070 - DNA, 17 bp, Homo sapiens
cttgctttgggctttgc

SEQ ID NO: 3878071 - DNA, 13 bp, Homo sapiens
cttgctttttcaa

SEQ ID NO: 3878072 - DNA, 14 bp, Homo sapiens
cttggaaaaaaatt

SEQ ID NO: 3878073 - DNA, 16 bp, Homo sapiens
cttggaaaaaaattac

SEQ ID NO: 3878074 - DNA, 20 bp, Homo sapiens
cttggaaaaatccagaaaga

SEQ ID NO: 3878075 - DNA, 19 bp, Homo sapiens
cttggaaagttcagccaga

SEQ ID NO: 3878076 - DNA, 13 bp, Homo sapiens
cttggaagagctc

SEQ ID NO: 3878077 - DNA, 14 bp, Homo sapiens
cttggaagagctct

SEQ ID NO: 3878078 - DNA, 22 bp, Homo sapiens
cttggaagtcgtttcaggacat

SEQ ID NO: 3878079 - DNA, 22 bp, Homo sapiens
cttggaatgaattctctctaaa

SEQ ID NO: 3878080 - DNA, 13 bp, Homo sapiens
cttggacagttag

SEQ ID NO: 3878081 - DNA, 14 bp, Homo sapiens
cttggacctctgct

SEQ ID NO: 3878082 - DNA, 16 bp, Homo sapiens
cttggactcattttaa

SEQ ID NO: 3878083 - DNA, 21 bp, Homo sapiens
cttggacttcctggggccccg

SEQ ID NO: 3878084 - DNA, 13 bp, Homo sapiens
cttggagagcagc

SEQ ID NO: 3878085 - DNA, 14 bp, Homo sapiens
cttggagagcagct

SEQ ID NO: 3878086 - DNA, 22 bp, Homo sapiens
cttggagagcagctggctctcc

SEQ ID NO: 3878087 - DNA, 18 bp, Homo sapiens
cttggagcccgtgcagta

SEQ ID NO: 3878088 - DNA, 16 bp, Homo sapiens
cttggagcctgaacat

SEQ ID NO: 3878089 - DNA, 18 bp, Homo sapiens
cttggataatgctgttgc

SEQ ID NO: 3878090 - DNA, 15 bp, Homo sapiens
cttggatttctgaat

SEQ ID NO: 3878091 - DNA, 15 bp, Homo sapiens
cttggcaacagaagc

SEQ ID NO: 3878092 - DNA, 16 bp, Homo sapiens
cttggcagagaggacc

SEQ ID NO: 3878093 - DNA, 18 bp, Homo sapiens
cttggcagtattccatgg

SEQ ID NO: 3878094 - DNA, 21 bp, Homo sapiens
cttggccgccatccgggacgc

SEQ ID NO: 3878095 - DNA, 10 bp, Homo sapiens
cttggccttg

SEQ ID NO: 3878096 - DNA, 12 bp, Homo sapiens
cttggctgtgag

SEQ ID NO: 3878097 - DNA, 13 bp, Homo sapiens
cttggctgtgagg

SEQ ID NO: 3878098 - DNA, 18 bp, Homo sapiens
cttgggaatggatcctgg

SEQ ID NO: 3878099 - DNA, 20 bp, Homo sapiens
cttgggaggctgaggcagga

SEQ ID NO: 3878100 - DNA, 22 bp, Homo sapiens
cttgggaggttttattctgact

SEQ ID NO: 3878101 - DNA, 17 bp, Homo sapiens
cttgggagtcaggacct

SEQ ID NO: 3878102 - DNA, 13 bp, Homo sapiens
cttgggcaccccc

SEQ ID NO: 3878103 - DNA, 18 bp, Homo sapiens
cttgggcacccccagcct

SEQ ID NO: 3878104 - DNA, 22 bp, Homo sapiens
cttgggcacccccagcctgggc

SEQ ID NO: 3878105 - DNA, 23 bp, Homo sapiens
cttgggcatccacccagtgctgc

SEQ ID NO: 3878106 - DNA, 18 bp, Homo sapiens
cttgggctcctggctgcc

SEQ ID NO: 3878107 - DNA, 20 bp, Homo sapiens
cttgggctcctggctgccag

SEQ ID NO: 3878108 - DNA, 17 bp, Homo sapiens
cttggggcctggcttgc

SEQ ID NO: 3878109 - DNA, 19 bp, Homo sapiens
cttggggcctggcttgctc

SEQ ID NO: 3878110 - DNA, 20 bp, Homo sapiens
cttggggctcgccccaccca

SEQ ID NO: 3878111 - DNA, 22 bp, Homo sapiens
cttggggctcgccccacccagg

SEQ ID NO: 3878112 - DNA, 16 bp, Homo sapiens
cttggggctggagagg

SEQ ID NO: 3878113 - DNA, 13 bp, Homo sapiens
cttggggggtgat

SEQ ID NO: 3878114 - DNA, 15 bp, Homo sapiens
cttggggtcccaggg

SEQ ID NO: 3878115 - DNA, 18 bp, Homo sapiens
cttggggtcccagggaag

SEQ ID NO: 3878116 - DNA, 20 bp, Homo sapiens
cttggggttcccccagacag

SEQ ID NO: 3878117 - DNA, 23 bp, Homo sapiens
cttgggtcgccctaccctcactc

SEQ ID NO: 3878118 - DNA, 23 bp, Homo sapiens
cttggtaaattgtaaacagctaa

SEQ ID NO: 3878119 - DNA, 13 bp, Homo sapiens
cttggtccctggt

SEQ ID NO: 3878120 - DNA, 17 bp, Homo sapiens
cttggtccctggtccct

SEQ ID NO: 3878121 - DNA, 22 bp, Homo sapiens
cttggtgaatttttttttccta

SEQ ID NO: 3878122 - DNA, 15 bp, Homo sapiens
cttggtgactgtccc

SEQ ID NO: 3878123 - DNA, 21 bp, Homo sapiens
cttggtggctgagcttggccc

SEQ ID NO: 3878124 - DNA, 17 bp, Homo sapiens
cttggtgtccacctggc

SEQ ID NO: 3878125 - DNA, 16 bp, Homo sapiens
ctttccccacctcttc

SEQ ID NO: 3878126 - DNA, 20 bp, Homo sapiens
ctttccccacctcttccttc

SEQ ID NO: 3878127 - DNA, 14 bp, Homo sapiens
ctttccctccccaa

SEQ ID NO: 3878128 - DNA, 21 bp, Homo sapiens
ctttcctaaagtctctgctgc

SEQ ID NO: 3878129 - DNA, 23 bp, Homo sapiens
ctttcctagactaattaaaatct

SEQ ID NO: 3878130 - DNA, 18 bp, Homo sapiens
ctttcctatcatggagtg

SEQ ID NO: 3878131 - DNA, 12 bp, Homo sapiens
ctttcctcccca

SEQ ID NO: 3878132 - DNA, 13 bp, Homo sapiens
ctttcctccccac

SEQ ID NO: 3878133 - DNA, 17 bp, Homo sapiens
ctttcctccccaccttc

SEQ ID NO: 3878134 - DNA, 19 bp, Homo sapiens
ctttcctccccaccttccc

SEQ ID NO: 3878135 - DNA, 11 bp, Homo sapiens
ctttcctctga

SEQ ID NO: 3878136 - DNA, 12 bp, Homo sapiens
ctttcctgtgcc

SEQ ID NO: 3878137 - DNA, 21 bp, Homo sapiens
ctttctacacctgttgcacct

SEQ ID NO: 3878138 - DNA, 15 bp, Homo sapiens
ctttctccagccagc

SEQ ID NO: 3878139 - DNA, 23 bp, Homo sapiens
ctttctcccccgacactgctgca

SEQ ID NO: 3878140 - DNA, 15 bp, Homo sapiens
ctttctccctcaccc

SEQ ID NO: 3878141 - DNA, 15 bp, Homo sapiens
ctttctcgctggaat

SEQ ID NO: 3878142 - DNA, 14 bp, Homo sapiens
ctttctctccttct

SEQ ID NO: 3878143 - DNA, 20 bp, Homo sapiens
ctttctctgagagagatgat

SEQ ID NO: 3878144 - DNA, 14 bp, Homo sapiens
ctttctctggctcc

SEQ ID NO: 3878145 - DNA, 16 bp, Homo sapiens
ctttctgtaaccataa

SEQ ID NO: 3878146 - DNA, 14 bp, Homo sapiens
ctttcttcctctgc

SEQ ID NO: 3878147 - DNA, 16 bp, Homo sapiens
ctttcttcctctgctg

SEQ ID NO: 3878148 - DNA, 22 bp, Homo sapiens
ctttcttctacaaccagagccc

SEQ ID NO: 3878149 - DNA, 17 bp, Homo sapiens
ctttctttacctgagac

SEQ ID NO: 3878150 - DNA, 17 bp, Homo sapiens
ctttctttctaactcca

SEQ ID NO: 3878151 - DNA, 14 bp, Homo sapiens
ctttctttttctgg

SEQ ID NO: 3878152 - DNA, 17 bp, Homo sapiens
ctttctttttctggaaa

SEQ ID NO: 3878153 - DNA, 20 bp, Homo sapiens
ctttctttttctgtctctct

SEQ ID NO: 3878154 - DNA, 12 bp, Homo sapiens
ctttgaaaagaa

SEQ ID NO: 3878155 - DNA, 13 bp, Homo sapiens
ctttgaaaagaaa

SEQ ID NO: 3878156 - DNA, 17 bp, Homo sapiens
ctttgaatacccccaga

SEQ ID NO: 3878157 - DNA, 19 bp, Homo sapiens
ctttgaatacccccagaga

SEQ ID NO: 3878158 - DNA, 23 bp, Homo sapiens
ctttgaatgctttttgaatgtta

SEQ ID NO: 3878159 - DNA, 21 bp, Homo sapiens
ctttgacgggaggcctcagtt

SEQ ID NO: 3878160 - DNA, 14 bp, Homo sapiens
ctttgagaaagaaa

SEQ ID NO: 3878161 - DNA, 18 bp, Homo sapiens
ctttgagaaaggattaag

SEQ ID NO: 3878162 - DNA, 17 bp, Homo sapiens
ctttgagaatgtgattc

SEQ ID NO: 3878163 - DNA, 17 bp, Homo sapiens
ctttgaggacaaagaga

SEQ ID NO: 3878164 - DNA, 17 bp, Homo sapiens
ctttgaggttgctttgt

SEQ ID NO: 3878165 - DNA, 13 bp, Homo sapiens
ctttgagtaccaa

SEQ ID NO: 3878166 - DNA, 21 bp, Homo sapiens
ctttgagtgtcttaattaaaa

SEQ ID NO: 3878167 - DNA, 15 bp, Homo sapiens
ctttgatctctgctt

SEQ ID NO: 3878168 - DNA, 21 bp, Homo sapiens
ctttgatgcatttccacactg

SEQ ID NO: 3878169 - DNA, 18 bp, Homo sapiens
ctttgatgtcatatggaa

SEQ ID NO: 3878170 - DNA, 20 bp, Homo sapiens
ctttgatttccaagtaatat

SEQ ID NO: 3878171 - DNA, 18 bp, Homo sapiens
ctttgcacagctctccgg

SEQ ID NO: 3878172 - DNA, 15 bp, Homo sapiens
ctttgcaggctctgg

SEQ ID NO: 3878173 - DNA, 18 bp, Homo sapiens
ctttgccatgggcctgct

SEQ ID NO: 3878174 - DNA, 18 bp, Homo sapiens
ctttgctacaataaatgc

SEQ ID NO: 3878175 - DNA, 19 bp, Homo sapiens
ctttgctacaataaatgct

SEQ ID NO: 3878176 - DNA, 22 bp, Homo sapiens
ctttgctacaataaatgctgaa

SEQ ID NO: 3878177 - DNA, 16 bp, Homo sapiens
ctttggaaaaatcttg

SEQ ID NO: 3878178 - DNA, 16 bp, Homo sapiens
ctttggaagaaacagg

SEQ ID NO: 3878179 - DNA, 23 bp, Homo sapiens
ctttggaatgactataaacatta

SEQ ID NO: 3878180 - DNA, 18 bp, Homo sapiens
ctttggcagaccatctcc

SEQ ID NO: 3878181 - DNA, 20 bp, Homo sapiens
ctttggcagaccatctccag

SEQ ID NO: 3878182 - DNA, 21 bp, Homo sapiens
ctttggcagaccatctccagc

SEQ ID NO: 3878183 - DNA, 16 bp, Homo sapiens
ctttggcttctcctgt

SEQ ID NO: 3878184 - DNA, 12 bp, Homo sapiens
ctttggcttttt

SEQ ID NO: 3878185 - DNA, 16 bp, Homo sapiens
ctttgggatcagcctc

SEQ ID NO: 3878186 - DNA, 20 bp, Homo sapiens
ctttgggctgccctggtgct

SEQ ID NO: 3878187 - DNA, 21 bp, Homo sapiens
ctttgggctgccctggtgctg

SEQ ID NO: 3878188 - DNA, 23 bp, Homo sapiens
ctttgggtactactgctgcaaag

SEQ ID NO: 3878189 - DNA, 14 bp, Homo sapiens
ctttggtagaaaag

SEQ ID NO: 3878190 - DNA, 22 bp, Homo sapiens
ctttggtgcagaggtttcttga

SEQ ID NO: 3878191 - DNA, 21 bp, Homo sapiens
ctttggttgcttaactggctg

SEQ ID NO: 3878192 - DNA, 15 bp, Homo sapiens
ctttgtaaaggtcag

SEQ ID NO: 3878193 - DNA, 21 bp, Homo sapiens
ctttgtaatgtcaccaccttc

SEQ ID NO: 3878194 - DNA, 12 bp, Homo sapiens
ctttgtatgcac

SEQ ID NO: 3878195 - DNA, 17 bp, Homo sapiens
ctttgtctctagccggg

SEQ ID NO: 3878196 - DNA, 14 bp, Homo sapiens
ctttgtgacaggaa

SEQ ID NO: 3878197 - DNA, 22 bp, Homo sapiens
ctttgtgacaggaaagccctcc

SEQ ID NO: 3878198 - DNA, 14 bp, Homo sapiens
ctttgtgcctttga

SEQ ID NO: 3878199 - DNA, 19 bp, Homo sapiens
ctttgttaaaaatattttc

SEQ ID NO: 3878200 - DNA, 17 bp, Homo sapiens
ctttgttctttatttgt

SEQ ID NO: 3878201 - DNA, 14 bp, Homo sapiens
ctttgttttctaaa

SEQ ID NO: 3878202 - DNA, 16 bp, Homo sapiens
ctttgttttgcactga

SEQ ID NO: 3878203 - DNA, 22 bp, Homo sapiens
cttttaaaggggcagaaaaact

SEQ ID NO: 3878204 - DNA, 14 bp, Homo sapiens
cttttaagaaacac

SEQ ID NO: 3878205 - DNA, 18 bp, Homo sapiens
cttttaatatgctgtggg

SEQ ID NO: 3878206 - DNA, 20 bp, Homo sapiens
cttttactcctttgcattcc

SEQ ID NO: 3878207 - DNA, 23 bp, Homo sapiens
cttttagagccccccgtgtggct

SEQ ID NO: 3878208 - DNA, 12 bp, Homo sapiens
cttttatagcta

SEQ ID NO: 3878209 - DNA, 13 bp, Homo sapiens
cttttatcaaaca

SEQ ID NO: 3878210 - DNA, 17 bp, Homo sapiens
cttttattcatttgagt

SEQ ID NO: 3878211 - DNA, 19 bp, Homo sapiens
cttggtgtccacctggccc

SEQ ID NO: 3878212 - DNA, 19 bp, Homo sapiens
cttggtgtgaccctctgaa

SEQ ID NO: 3878213 - DNA, 16 bp, Homo sapiens
cttggttcctctacta

SEQ ID NO: 3878214 - DNA, 20 bp, Homo sapiens
cttggtttggacacagtgtt

SEQ ID NO: 3878215 - DNA, 21 bp, Homo sapiens
cttggtttggacacagtgttc

SEQ ID NO: 3878216 - DNA, 16 bp, Homo sapiens
cttggtttttggctct

SEQ ID NO: 3878217 - DNA, 12 bp, Homo sapiens
cttgtaaataaa

SEQ ID NO: 3878218 - DNA, 12 bp, Homo sapiens
cttgtacatatt

SEQ ID NO: 3878219 - DNA, 17 bp, Homo sapiens
cttgtagaccactgtcc

SEQ ID NO: 3878220 - DNA, 14 bp, Homo sapiens
cttgtagccagccg

SEQ ID NO: 3878221 - DNA, 16 bp, Homo sapiens
cttgtagccagccggg

SEQ ID NO: 3878222 - DNA, 21 bp, Homo sapiens
cttgtagccagccggggcgag

SEQ ID NO: 3878223 - DNA, 13 bp, Homo sapiens
cttgtataaatgt

SEQ ID NO: 3878224 - DNA, 17 bp, Homo sapiens
cttgtataaatgtatat

SEQ ID NO: 3878225 - DNA, 19 bp, Homo sapiens
cttgtataaatgtatatac

SEQ ID NO: 3878226 - DNA, 21 bp, Homo sapiens
cttgtataaatgtatatacac

SEQ ID NO: 3878227 - DNA, 14 bp, Homo sapiens
cttgtatatacata

SEQ ID NO: 3878228 - DNA, 17 bp, Homo sapiens
cttgtatatacatatta

SEQ ID NO: 3878229 - DNA, 18 bp, Homo sapiens
cttgtatatacttcactc

SEQ ID NO: 3878230 - DNA, 15 bp, Homo sapiens
cttgtcaggacccag

SEQ ID NO: 3878231 - DNA, 14 bp, Homo sapiens
cttgtccacagtct

SEQ ID NO: 3878232 - DNA, 16 bp, Homo sapiens
cttgtccctgcccaga

SEQ ID NO: 3878233 - DNA, 13 bp, Homo sapiens
cttgtcctctccc

SEQ ID NO: 3878234 - DNA, 13 bp, Homo sapiens
cttgtcctgccag

SEQ ID NO: 3878235 - DNA, 17 bp, Homo sapiens
cttgtcctgccagctgc

SEQ ID NO: 3878236 - DNA, 20 bp, Homo sapiens
cttgtcctgccagctgcctt

SEQ ID NO: 3878237 - DNA, 18 bp, Homo sapiens
cttgtcctgctctcttca

SEQ ID NO: 3878238 - DNA, 22 bp, Homo sapiens
cttgtcctgctctcttcaggag

SEQ ID NO: 3878239 - DNA, 12 bp, Homo sapiens
cttgtctctcat

SEQ ID NO: 3878240 - DNA, 16 bp, Homo sapiens
cttgtctgaggcctca

SEQ ID NO: 3878241 - DNA, 19 bp, Homo sapiens
cttgtctgaggcctcatcc

SEQ ID NO: 3878242 - DNA, 23 bp, Homo sapiens
cttgtctgattggctcacccaag

SEQ ID NO: 3878243 - DNA, 16 bp, Homo sapiens
cttgtgcatgtttact

SEQ ID NO: 3878244 - DNA, 17 bp, Homo sapiens
cttgtgccctgccccca

SEQ ID NO: 3878245 - DNA, 14 bp, Homo sapiens
cttgtgctgagaat

SEQ ID NO: 3878246 - DNA, 23 bp, Homo sapiens
cttgtgcttggtggggctcgtgg

SEQ ID NO: 3878247 - DNA, 24 bp, Homo sapiens
cttgtgcttggtggggctcgtggc

SEQ ID NO: 3878248 - DNA, 18 bp, Homo sapiens
cttgtgtcagagacagac

SEQ ID NO: 3878249 - DNA, 15 bp, Homo sapiens
cttgtgtctctgtgc

SEQ ID NO: 3878250 - DNA, 13 bp, Homo sapiens
cttgttctgtcac

SEQ ID NO: 3878251 - DNA, 13 bp, Homo sapiens
cttgttgtggagg

SEQ ID NO: 3878252 - DNA, 23 bp, Homo sapiens
cttgtttgattttagctgcagaa

SEQ ID NO: 3878253 - DNA, 18 bp, Homo sapiens
cttgtttggggcaggagt

SEQ ID NO: 3878254 - DNA, 20 bp, Homo sapiens
cttgttttttttttccactt

SEQ ID NO: 3878255 - DNA, 22 bp, Homo sapiens
ctttaaaataaggataataatc

SEQ ID NO: 3878256 - DNA, 23 bp, Homo sapiens
ctttaaaataaggataataatca

SEQ ID NO: 3878257 - DNA, 17 bp, Homo sapiens
ctttaaactaccctcca

SEQ ID NO: 3878258 - DNA, 13 bp, Homo sapiens
ctttaaagactta

SEQ ID NO: 3878259 - DNA, 14 bp, Homo sapiens
ctttaaagacttaa

SEQ ID NO: 3878260 - DNA, 17 bp, Homo sapiens
ctttaaagacttaagat

SEQ ID NO: 3878261 - DNA, 21 bp, Homo sapiens
ctttaaagtgtaataatatga

SEQ ID NO: 3878262 - DNA, 14 bp, Homo sapiens
ctttaaatcaaaag

SEQ ID NO: 3878263 - DNA, 19 bp, Homo sapiens
ctttaaatcaaaagctgct

SEQ ID NO: 3878264 - DNA, 13 bp, Homo sapiens
ctttaaattcaag

SEQ ID NO: 3878265 - DNA, 17 bp, Homo sapiens
ctttaacaaaacaagaa

SEQ ID NO: 3878266 - DNA, 19 bp, Homo sapiens
ctttaacaaaacaagaaag

SEQ ID NO: 3878267 - DNA, 22 bp, Homo sapiens
ctttaacaaaacaagaaagaaa

SEQ ID NO: 3878268 - DNA, 18 bp, Homo sapiens
ctttaaccctctcttccc

SEQ ID NO: 3878269 - DNA, 19 bp, Homo sapiens
ctttaaccctctcttccct

SEQ ID NO: 3878270 - DNA, 15 bp, Homo sapiens
ctttaagactgagca

SEQ ID NO: 3878271 - DNA, 17 bp, Homo sapiens
ctttaattctcatgtga

SEQ ID NO: 3878272 - DNA, 14 bp, Homo sapiens
ctttacatgcaatt

SEQ ID NO: 3878273 - DNA, 16 bp, Homo sapiens
ctttacatgctgtgct

SEQ ID NO: 3878274 - DNA, 21 bp, Homo sapiens
ctttacatttgataaactaaa

SEQ ID NO: 3878275 - DNA, 22 bp, Homo sapiens
ctttacattttatttattagct

SEQ ID NO: 3878276 - DNA, 20 bp, Homo sapiens
ctttacctaccaccttccct

SEQ ID NO: 3878277 - DNA, 13 bp, Homo sapiens
ctttacctgagac

SEQ ID NO: 3878278 - DNA, 21 bp, Homo sapiens
ctttactcccttcctggcctc

SEQ ID NO: 3878279 - DNA, 14 bp, Homo sapiens
ctttacttttaaac

SEQ ID NO: 3878280 - DNA, 14 bp, Homo sapiens
ctttagatttaatg

SEQ ID NO: 3878281 - DNA, 12 bp, Homo sapiens
ctttataaactt

SEQ ID NO: 3878282 - DNA, 22 bp, Homo sapiens
ctttatcagtgatggtctcaca

SEQ ID NO: 3878283 - DNA, 16 bp, Homo sapiens
ctttatccttaggaaa

SEQ ID NO: 3878284 - DNA, 16 bp, Homo sapiens
ctttatctgtcacaca

SEQ ID NO: 3878285 - DNA, 13 bp, Homo sapiens
ctttatgctgtgt

SEQ ID NO: 3878286 - DNA, 14 bp, Homo sapiens
ctttattgtgatct

SEQ ID NO: 3878287 - DNA, 21 bp, Homo sapiens
ctttatttatggcttataaat

SEQ ID NO: 3878288 - DNA, 17 bp, Homo sapiens
ctttatttctagcagag

SEQ ID NO: 3878289 - DNA, 22 bp, Homo sapiens
ctttatttgtttatatttaatt

SEQ ID NO: 3878290 - DNA, 14 bp, Homo sapiens
ctttcaaaaacatg

SEQ ID NO: 3878291 - DNA, 12 bp, Homo sapiens
ctttcaattgta

SEQ ID NO: 3878292 - DNA, 15 bp, Homo sapiens
ctttcacaaaaaaga

SEQ ID NO: 3878293 - DNA, 14 bp, Homo sapiens
ctttcagctgtgaa

SEQ ID NO: 3878294 - DNA, 17 bp, Homo sapiens
ctttccaccctattccc

SEQ ID NO: 3878295 - DNA, 22 bp, Homo sapiens
ctttccatttggtttagaacat

SEQ ID NO: 3878296 - DNA, 21 bp, Homo sapiens
ctttcccatgctgaattattt

SEQ ID NO: 3878297 - DNA, 17 bp, Homo sapiens
cttttattctgtacctt

SEQ ID NO: 3878298 - DNA, 12 bp, Homo sapiens
cttttcacggga

SEQ ID NO: 3878299 - DNA, 20 bp, Homo sapiens
cttttcactgctggctgcct

SEQ ID NO: 3878300 - DNA, 16 bp, Homo sapiens
cttttccaagcccttt

SEQ ID NO: 3878301 - DNA, 18 bp, Homo sapiens
cttttccactcctatgga

SEQ ID NO: 3878302 - DNA, 16 bp, Homo sapiens
cttttccaggatcctg

SEQ ID NO: 3878303 - DNA, 14 bp, Homo sapiens
cttttcccaggaat

SEQ ID NO: 3878304 - DNA, 21 bp, Homo sapiens
cttttctttattgctgtgaat

SEQ ID NO: 3878305 - DNA, 19 bp, Homo sapiens
cttttctttttcccttgaa

SEQ ID NO: 3878306 - DNA, 14 bp, Homo sapiens
cttttctttttctc

SEQ ID NO: 3878307 - DNA, 12 bp, Homo sapiens
cttttgactctt

SEQ ID NO: 3878308 - DNA, 14 bp, Homo sapiens
cttttgagaggggt

SEQ ID NO: 3878309 - DNA, 16 bp, Homo sapiens
cttttgatggggagaa

SEQ ID NO: 3878310 - DNA, 14 bp, Homo sapiens
cttttgctgctgct

SEQ ID NO: 3878311 - DNA, 17 bp, Homo sapiens
cttttgctgtctttctc

SEQ ID NO: 3878312 - DNA, 18 bp, Homo sapiens
cttttgctgtctttctct

SEQ ID NO: 3878313 - DNA, 16 bp, Homo sapiens
cttttgcttggcagag

SEQ ID NO: 3878314 - DNA, 12 bp, Homo sapiens
cttttggccttg

SEQ ID NO: 3878315 - DNA, 13 bp, Homo sapiens
cttttgtttcagg

SEQ ID NO: 3878316 - DNA, 22 bp, Homo sapiens
ctttttaaaaagtactctttaa

SEQ ID NO: 3878317 - DNA, 14 bp, Homo sapiens
ctttttagccagtg

SEQ ID NO: 3878318 - DNA, 18 bp, Homo sapiens
ctttttagtcttttactc

SEQ ID NO: 3878319 - DNA, 23 bp, Homo sapiens
ctttttataatgtggatttccta

SEQ ID NO: 3878320 - DNA, 16 bp, Homo sapiens
ctttttcaacttggaa

SEQ ID NO: 3878321 - DNA, 23 bp, Homo sapiens
ctttttcaacttggaaaaagaaa

SEQ ID NO: 3878322 - DNA, 19 bp, Homo sapiens
ctttttctggaaattttgt

SEQ ID NO: 3878323 - DNA, 17 bp, Homo sapiens
ctttttctgtctctctt

SEQ ID NO: 3878324 - DNA, 16 bp, Homo sapiens
ctttttctttataaac

SEQ ID NO: 3878325 - DNA, 15 bp, Homo sapiens
gaaaaaaaagaaagc

SEQ ID NO: 3878326 - DNA, 16 bp, Homo sapiens
gaaaaaaatgactaaa

SEQ ID NO: 3878327 - DNA, 17 bp, Homo sapiens
gaaaaacacggcagctg

SEQ ID NO: 3878328 - DNA, 23 bp, Homo sapiens
gaaaaacacggcagctgtagctc

SEQ ID NO: 3878329 - DNA, 18 bp, Homo sapiens
gaaaaacatctgaaagcc

SEQ ID NO: 3878330 - DNA, 20 bp, Homo sapiens
gaaaaacttccatgaggcca

SEQ ID NO: 3878331 - DNA, 13 bp, Homo sapiens
gaaaaagaaatgc

SEQ ID NO: 3878332 - DNA, 14 bp, Homo sapiens
gaaaaagaaatgca

SEQ ID NO: 3878333 - DNA, 16 bp, Homo sapiens
gaaaaatcttgggcaa

SEQ ID NO: 3878334 - DNA, 18 bp, Homo sapiens
gaaaaccaagccgtggct

SEQ ID NO: 3878335 - DNA, 21 bp, Homo sapiens
gaaaaccaagccgtggcttcc

SEQ ID NO: 3878336 - DNA, 22 bp, Homo sapiens
gaaaactatcctgcgggtttta

SEQ ID NO: 3878337 - DNA, 16 bp, Homo sapiens
gaaaactgaaaatcta

SEQ ID NO: 3878338 - DNA, 16 bp, Homo sapiens
gaaaactgacagagga

SEQ ID NO: 3878339 - DNA, 12 bp, Homo sapiens
gaaaacttgaat

SEQ ID NO: 3878340 - DNA, 16 bp, Homo sapiens
gaaaacttgaatctgt

SEQ ID NO: 3878341 - DNA, 19 bp, Homo sapiens
gaaaagaatacagaaagat

SEQ ID NO: 3878342 - DNA, 16 bp, Homo sapiens
gaaaagaccagggctt

SEQ ID NO: 3878343 - DNA, 20 bp, Homo sapiens
gaaaagactccaaagaaatg

SEQ ID NO: 3878344 - DNA, 18 bp, Homo sapiens
gaaaagaggaaaaaaagc

SEQ ID NO: 3878345 - DNA, 17 bp, Homo sapiens
gaaaagcacctgccgac

SEQ ID NO: 3878346 - DNA, 18 bp, Homo sapiens
gaaaagcatcagaaagag

SEQ ID NO: 3878347 - DNA, 11 bp, Homo sapiens
gaaaagcccag

SEQ ID NO: 3878348 - DNA, 12 bp, Homo sapiens
gaaaaggcctgg

SEQ ID NO: 3878349 - DNA, 13 bp, Homo sapiens
gaaaaggcctggg

SEQ ID NO: 3878350 - DNA, 23 bp, Homo sapiens
gaaaaggtagcttacctgacaca

SEQ ID NO: 3878351 - DNA, 15 bp, Homo sapiens
gaaaagtagaattat

SEQ ID NO: 3878352 - DNA, 17 bp, Homo sapiens
gaaaagtagaattatat

SEQ ID NO: 3878353 - DNA, 16 bp, Homo sapiens
gaaaagtgaatgctca

SEQ ID NO: 3878354 - DNA, 19 bp, Homo sapiens
gaaaataagtgaataataa

SEQ ID NO: 3878355 - DNA, 18 bp, Homo sapiens
gaaaataatagccatcct

SEQ ID NO: 3878356 - DNA, 13 bp, Homo sapiens
gaaaatataaatg

SEQ ID NO: 3878357 - DNA, 15 bp, Homo sapiens
gaaaatataaatgca

SEQ ID NO: 3878358 - DNA, 18 bp, Homo sapiens
gaaaatatttgtatcaca

SEQ ID NO: 3878359 - DNA, 14 bp, Homo sapiens
gaaaatcaaagtaa

SEQ ID NO: 3878360 - DNA, 20 bp, Homo sapiens
gaaaatcagttatattcttt

SEQ ID NO: 3878361 - DNA, 14 bp, Homo sapiens
gaaaatcctctggc

SEQ ID NO: 3878362 - DNA, 14 bp, Homo sapiens
gaaaatctaatatt

SEQ ID NO: 3878363 - DNA, 22 bp, Homo sapiens
gaaaattaggatttcatgattt

SEQ ID NO: 3878364 - DNA, 14 bp, Homo sapiens
gaaacaaaaacact

SEQ ID NO: 3878365 - DNA, 23 bp, Homo sapiens
gaaacaaaaacactaaaaataaa

SEQ ID NO: 3878366 - DNA, 18 bp, Homo sapiens
gaaacaacttgtgttcta

SEQ ID NO: 3878367 - DNA, 14 bp, Homo sapiens
gaaacacaatattt

SEQ ID NO: 3878368 - DNA, 18 bp, Homo sapiens
gaaacaccgagtctctgt

SEQ ID NO: 3878369 - DNA, 15 bp, Homo sapiens
gaaacagaagtagaa

SEQ ID NO: 3878370 - DNA, 14 bp, Homo sapiens
gaaacagagacagg

SEQ ID NO: 3878371 - DNA, 13 bp, Homo sapiens
gaaacagagagag

SEQ ID NO: 3878372 - DNA, 16 bp, Homo sapiens
gaaacagagagagaca

SEQ ID NO: 3878373 - DNA, 15 bp, Homo sapiens
gaaacagataccata

SEQ ID NO: 3878374 - DNA, 15 bp, Homo sapiens
gaaacagatgataaa

SEQ ID NO: 3878375 - DNA, 21 bp, Homo sapiens
gaaacagatgataaatattta

SEQ ID NO: 3878376 - DNA, 18 bp, Homo sapiens
gaaacaggggatcaaagt

SEQ ID NO: 3878377 - DNA, 15 bp, Homo sapiens
gaaacatggttttga

SEQ ID NO: 3878378 - DNA, 18 bp, Homo sapiens
gaaacattccgaagaggg

SEQ ID NO: 3878379 - DNA, 14 bp, Homo sapiens
gaaaccaaagccag

SEQ ID NO: 3878380 - DNA, 19 bp, Homo sapiens
gaaaccacaggcccttggg

SEQ ID NO: 3878381 - DNA, 15 bp, Homo sapiens
gaaacccaaggaaca

SEQ ID NO: 3878382 - DNA, 16 bp, Homo sapiens
gaaaccccaagcagca

SEQ ID NO: 3878383 - DNA, 17 bp, Homo sapiens
gaaaccccaagcagcat

SEQ ID NO: 3878384 - DNA, 15 bp, Homo sapiens
cttaaaaaaatgaca

SEQ ID NO: 3878385 - DNA, 22 bp, Homo sapiens
cttaaaatagcaacactctata

SEQ ID NO: 3878386 - DNA, 18 bp, Homo sapiens
cttaaaatattcctgcat

SEQ ID NO: 3878387 - DNA, 13 bp, Homo sapiens
cttaaaatatttt

SEQ ID NO: 3878388 - DNA, 21 bp, Homo sapiens
cttaaagaaagtcgaattaat

SEQ ID NO: 3878389 - DNA, 22 bp, Homo sapiens
cttaaagaaagtcgaattaata

SEQ ID NO: 3878390 - DNA, 18 bp, Homo sapiens
cttaaagctgcctgtagt

SEQ ID NO: 3878391 - DNA, 23 bp, Homo sapiens
cttaaagctgcctgtagttagga

SEQ ID NO: 3878392 - DNA, 17 bp, Homo sapiens
cttaaaggaaaagtcaa

SEQ ID NO: 3878393 - DNA, 19 bp, Homo sapiens
cttaaaggaaaagtcaaca

SEQ ID NO: 3878394 - DNA, 22 bp, Homo sapiens
cttaaaggaaaagtcaacatct

SEQ ID NO: 3878395 - DNA, 14 bp, Homo sapiens
cttaaaggcctgga

SEQ ID NO: 3878396 - DNA, 16 bp, Homo sapiens
cttaaaggcctggaac

SEQ ID NO: 3878397 - DNA, 12 bp, Homo sapiens
cttaaataaatt

SEQ ID NO: 3878398 - DNA, 15 bp, Homo sapiens
cttaaatttttgtca

SEQ ID NO: 3878399 - DNA, 15 bp, Homo sapiens
cttaacggctccagg

SEQ ID NO: 3878400 - DNA, 17 bp, Homo sapiens
cttaactgtgtgaagaa

SEQ ID NO: 3878401 - DNA, 21 bp, Homo sapiens
cttaactgtgtgaagaaatgg

SEQ ID NO: 3878402 - DNA, 19 bp, Homo sapiens
cttaaggagaggagaaact

SEQ ID NO: 3878403 - DNA, 17 bp, Homo sapiens
cttaagggttgaaggca

SEQ ID NO: 3878404 - DNA, 18 bp, Homo sapiens
cttaagggttgaaggcag

SEQ ID NO: 3878405 - DNA, 21 bp, Homo sapiens
cttaagggttgaaggcagtct

SEQ ID NO: 3878406 - DNA, 23 bp, Homo sapiens
cttaagggttgaaggcagtctga

SEQ ID NO: 3878407 - DNA, 15 bp, Homo sapiens
cttaatattattggg

SEQ ID NO: 3878408 - DNA, 23 bp, Homo sapiens
cttaatcaagaatattcaaatgt

SEQ ID NO: 3878409 - DNA, 14 bp, Homo sapiens
cttaatgtttattc

SEQ ID NO: 3878410 - DNA, 15 bp, Homo sapiens
cttaatgtttattcc

SEQ ID NO: 3878411 - DNA, 16 bp, Homo sapiens
cttaatgtttattcct

SEQ ID NO: 3878412 - DNA, 20 bp, Homo sapiens
cttaattaaaagaatatttt

SEQ ID NO: 3878413 - DNA, 22 bp, Homo sapiens
cttacaaaaacaagacacccaa

SEQ ID NO: 3878414 - DNA, 16 bp, Homo sapiens
cttacacttggagccc

SEQ ID NO: 3878415 - DNA, 17 bp, Homo sapiens
cttacacttggagcccg

SEQ ID NO: 3878416 - DNA, 18 bp, Homo sapiens
cttacagttttaaattct

SEQ ID NO: 3878417 - DNA, 16 bp, Homo sapiens
cttacataatttttta

SEQ ID NO: 3878418 - DNA, 22 bp, Homo sapiens
cttacattagcagtttgctttg

SEQ ID NO: 3878419 - DNA, 11 bp, Homo sapiens
cttacattcct

SEQ ID NO: 3878420 - DNA, 15 bp, Homo sapiens
cttacattgtgaaac

SEQ ID NO: 3878421 - DNA, 18 bp, Homo sapiens
cttacctaaacagatata

SEQ ID NO: 3878422 - DNA, 21 bp, Homo sapiens
cttacctaaacagatataaat

SEQ ID NO: 3878423 - DNA, 17 bp, Homo sapiens
cttacctcctgcccagg

SEQ ID NO: 3878424 - DNA, 11 bp, Homo sapiens
cttacctgaca

SEQ ID NO: 3878425 - DNA, 16 bp, Homo sapiens
cttacctgacacaaga

SEQ ID NO: 3878426 - DNA, 20 bp, Homo sapiens
cttacctgtatgtctccagt

SEQ ID NO: 3878427 - DNA, 12 bp, Homo sapiens
cttactcctgtg

SEQ ID NO: 3878428 - DNA, 15 bp, Homo sapiens
cttactcctgtggga

SEQ ID NO: 3878429 - DNA, 20 bp, Homo sapiens
cttactcctgtgggagcctc

SEQ ID NO: 3878430 - DNA, 14 bp, Homo sapiens
cttactctgagccc

SEQ ID NO: 3878431 - DNA, 15 bp, Homo sapiens
cttactctgagccca

SEQ ID NO: 3878432 - DNA, 16 bp, Homo sapiens
cttactctgagcccag

SEQ ID NO: 3878433 - DNA, 17 bp, Homo sapiens
cttactctgagcccagg

SEQ ID NO: 3878434 - DNA, 20 bp, Homo sapiens
cttactctgagcccaggccg

SEQ ID NO: 3878435 - DNA, 17 bp, Homo sapiens
cttactctttcactcag

SEQ ID NO: 3878436 - DNA, 13 bp, Homo sapiens
cttactgcagaat

SEQ ID NO: 3878437 - DNA, 15 bp, Homo sapiens
cttacttattcttcc

SEQ ID NO: 3878438 - DNA, 15 bp, Homo sapiens
cttagaacctttctt

SEQ ID NO: 3878439 - DNA, 18 bp, Homo sapiens
cttagaagtggaccagga

SEQ ID NO: 3878440 - DNA, 23 bp, Homo sapiens
cttagaagtggaccaggacagga

SEQ ID NO: 3878441 - DNA, 15 bp, Homo sapiens
cttagaataaaattg

SEQ ID NO: 3878442 - DNA, 20 bp, Homo sapiens
cttagagaatgttctcctaa

SEQ ID NO: 3878443 - DNA, 16 bp, Homo sapiens
cttagagattgcccca

SEQ ID NO: 3878444 - DNA, 21 bp, Homo sapiens
cttagattagctctggaccag

SEQ ID NO: 3878445 - DNA, 11 bp, Homo sapiens
cttagcacttc

SEQ ID NO: 3878446 - DNA, 21 bp, Homo sapiens
cttagcatgcctccaaaaatt

SEQ ID NO: 3878447 - DNA, 12 bp, Homo sapiens
cttagcccaaga

SEQ ID NO: 3878448 - DNA, 21 bp, Homo sapiens
cttagcccaagaggtctgagc

SEQ ID NO: 3878449 - DNA, 22 bp, Homo sapiens
cttagcccaagaggtctgagcc

SEQ ID NO: 3878450 - DNA, 17 bp, Homo sapiens
cttagccgtccatggca

SEQ ID NO: 3878451 - DNA, 20 bp, Homo sapiens
cttagccgtccatggcacca

SEQ ID NO: 3878452 - DNA, 14 bp, Homo sapiens
cttagccttgtgcc

SEQ ID NO: 3878453 - DNA, 16 bp, Homo sapiens
cttagccttgtgccct

SEQ ID NO: 3878454 - DNA, 18 bp, Homo sapiens
cttagccttgtgccctgc

SEQ ID NO: 3878455 - DNA, 19 bp, Homo sapiens
cttagccttgtgccctgcc

SEQ ID NO: 3878456 - DNA, 14 bp, Homo sapiens
cttagctatcagaa

SEQ ID NO: 3878457 - DNA, 19 bp, Homo sapiens
cttagctgaacaatgaatg

SEQ ID NO: 3878458 - DNA, 20 bp, Homo sapiens
cttaggaaaatgcttctgtt

SEQ ID NO: 3878459 - DNA, 16 bp, Homo sapiens
cttaggagcagagctc

SEQ ID NO: 3878460 - DNA, 17 bp, Homo sapiens
cttaggcattatttaat

SEQ ID NO: 3878461 - DNA, 22 bp, Homo sapiens
cttaggcattatttaatgtttg

SEQ ID NO: 3878462 - DNA, 17 bp, Homo sapiens
cttaggtgccaggctgt

SEQ ID NO: 3878463 - DNA, 23 bp, Homo sapiens
cttagtcgaatgttagattcctc

SEQ ID NO: 3878464 - DNA, 21 bp, Homo sapiens
cttagtgcccgcctaggagtt

SEQ ID NO: 3878465 - DNA, 22 bp, Homo sapiens
cttataaatgtgtattctggct

SEQ ID NO: 3878466 - DNA, 22 bp, Homo sapiens
cttataagtgggagctaaataa

SEQ ID NO: 3878467 - DNA, 14 bp, Homo sapiens
cttataccaaaggg

SEQ ID NO: 3878468 - DNA, 17 bp, Homo sapiens
cttataccaaagggaaa

SEQ ID NO: 3878469 - DNA, 23 bp, Homo sapiens
cttatagtcaatgtttcttttat

SEQ ID NO: 3878470 - DNA, 18 bp, Homo sapiens
cttatatgtgtattgcta

SEQ ID NO: 3878471 - DNA, 23 bp, Homo sapiens
cttatcagctacttaagagaaat

SEQ ID NO: 3878472 - DNA, 19 bp, Homo sapiens
cttatccaggactctgtca

SEQ ID NO: 3878473 - DNA, 22 bp, Homo sapiens
cttatggggacagcataccttg

SEQ ID NO: 3878474 - DNA, 13 bp, Homo sapiens
cttatgtattatt

SEQ ID NO: 3878475 - DNA, 17 bp, Homo sapiens
cttatgtattattttct

SEQ ID NO: 3878476 - DNA, 20 bp, Homo sapiens
cttattcccaactgctctgc

SEQ ID NO: 3878477 - DNA, 16 bp, Homo sapiens
cttatttccctcatct

SEQ ID NO: 3878478 - DNA, 12 bp, Homo sapiens
cttatttgagtg

SEQ ID NO: 3878479 - DNA, 19 bp, Homo sapiens
cttattttcaagaaactga

SEQ ID NO: 3878480 - DNA, 17 bp, Homo sapiens
cttcaaatccatccaga

SEQ ID NO: 3878481 - DNA, 14 bp, Homo sapiens
cttcaagctgtccc

SEQ ID NO: 3878482 - DNA, 15 bp, Homo sapiens
cttcaagctgtcccc

SEQ ID NO: 3878483 - DNA, 17 bp, Homo sapiens
cttcaaggtgtaaaata

SEQ ID NO: 3878484 - DNA, 17 bp, Homo sapiens
cttcaagtgatatatgt

SEQ ID NO: 3878485 - DNA, 18 bp, Homo sapiens
cttcaagtgatatatgta

SEQ ID NO: 3878486 - DNA, 15 bp, Homo sapiens
cttcaattaataaaa

SEQ ID NO: 3878487 - DNA, 21 bp, Homo sapiens
cttcacaacctccgtgctggg

SEQ ID NO: 3878488 - DNA, 20 bp, Homo sapiens
cttcacactgcaagagcctt

SEQ ID NO: 3878489 - DNA, 12 bp, Homo sapiens
cttcacagtgtt

SEQ ID NO: 3878490 - DNA, 14 bp, Homo sapiens
cttcacagtgtttc

SEQ ID NO: 3878491 - DNA, 14 bp, Homo sapiens
cttcacccctgcac

SEQ ID NO: 3878492 - DNA, 17 bp, Homo sapiens
cttcaccttcaccttca

SEQ ID NO: 3878493 - DNA, 19 bp, Homo sapiens
cttcacctttggtgcagag

SEQ ID NO: 3878494 - DNA, 22 bp, Homo sapiens
cttcacctttggtgcagaggtt

SEQ ID NO: 3878495 - DNA, 15 bp, Homo sapiens
cttcactcactgtca

SEQ ID NO: 3878496 - DNA, 17 bp, Homo sapiens
cttcactgtgaggggaa

SEQ ID NO: 3878497 - DNA, 19 bp, Homo sapiens
cttcactgtgaggggaagg

SEQ ID NO: 3878498 - DNA, 23 bp, Homo sapiens
cttcactgtgaggggaaggcctt

SEQ ID NO: 3878499 - DNA, 19 bp, Homo sapiens
cttcactgttgaaaattat

SEQ ID NO: 3878500 - DNA, 15 bp, Homo sapiens
cttcagaacatgctg

SEQ ID NO: 3878501 - DNA, 20 bp, Homo sapiens
cttcagaaggggacctgttt

SEQ ID NO: 3878502 - DNA, 21 bp, Homo sapiens
cttcagaatatggacaaagaa

SEQ ID NO: 3878503 - DNA, 12 bp, Homo sapiens
cttcagagcagg

SEQ ID NO: 3878504 - DNA, 20 bp, Homo sapiens
cttcagagcctagccacctc

SEQ ID NO: 3878505 - DNA, 11 bp, Homo sapiens
cttcagagctc

SEQ ID NO: 3878506 - DNA, 13 bp, Homo sapiens
cttcagagctctt

SEQ ID NO: 3878507 - DNA, 15 bp, Homo sapiens
cttcagatcagtgct

SEQ ID NO: 3878508 - DNA, 23 bp, Homo sapiens
cttcagcataattcggaagggaa

SEQ ID NO: 3878509 - DNA, 18 bp, Homo sapiens
cttcagcatatttatagc

SEQ ID NO: 3878510 - DNA, 17 bp, Homo sapiens
cttcagccacctctctt

SEQ ID NO: 3878511 - DNA, 13 bp, Homo sapiens
cttcagccctggc

SEQ ID NO: 3878512 - DNA, 21 bp, Homo sapiens
cttcagctcccatagcgctgg

SEQ ID NO: 3878513 - DNA, 15 bp, Homo sapiens
cttcaggctcttctc

SEQ ID NO: 3878514 - DNA, 16 bp, Homo sapiens
cttcaggctcttctcc

SEQ ID NO: 3878515 - DNA, 18 bp, Homo sapiens
cttcaggctcttctcctt

SEQ ID NO: 3878516 - DNA, 11 bp, Homo sapiens
cttcagggcca

SEQ ID NO: 3878517 - DNA, 14 bp, Homo sapiens
cttcagggccagaa

SEQ ID NO: 3878518 - DNA, 20 bp, Homo sapiens
cttcaggttgttctgtataa

SEQ ID NO: 3878519 - DNA, 11 bp, Homo sapiens
cttcagtgccc

SEQ ID NO: 3878520 - DNA, 15 bp, Homo sapiens
cttcagtgggagaaa

SEQ ID NO: 3878521 - DNA, 20 bp, Homo sapiens
cttcagtgtatggaaataaa

SEQ ID NO: 3878522 - DNA, 17 bp, Homo sapiens
cttcagttgttttcccg

SEQ ID NO: 3878523 - DNA, 21 bp, Homo sapiens
cttcatcaatttttatacata

SEQ ID NO: 3878524 - DNA, 16 bp, Homo sapiens
cttcatccctttccag

SEQ ID NO: 3878525 - DNA, 12 bp, Homo sapiens
cttcatcttgac

SEQ ID NO: 3878526 - DNA, 15 bp, Homo sapiens
cttcatcttgacatg

SEQ ID NO: 3878527 - DNA, 13 bp, Homo sapiens
cttcatgcctcag

SEQ ID NO: 3878528 - DNA, 20 bp, Homo sapiens
cttcatgcctcagtttcccc

SEQ ID NO: 3878529 - DNA, 16 bp, Homo sapiens
cttccaaccccagctg

SEQ ID NO: 3878530 - DNA, 17 bp, Homo sapiens
cttccaaccccagctgg

SEQ ID NO: 3878531 - DNA, 18 bp, Homo sapiens
cttccaaccccagctggc

SEQ ID NO: 3878532 - DNA, 16 bp, Homo sapiens
cttccaagcaaaggtg

SEQ ID NO: 3878533 - DNA, 22 bp, Homo sapiens
cttccacccattcccccatgtg

SEQ ID NO: 3878534 - DNA, 17 bp, Homo sapiens
cttccaccgggcctgaa

SEQ ID NO: 3878535 - DNA, 16 bp, Homo sapiens
cttccacctcctagag

SEQ ID NO: 3878536 - DNA, 17 bp, Homo sapiens
cttccagaccacctgcc

SEQ ID NO: 3878537 - DNA, 23 bp, Homo sapiens
cttccagaccacctgccagccat

SEQ ID NO: 3878538 - DNA, 21 bp, Homo sapiens
cttccagagagtcctctggat

SEQ ID NO: 3878539 - DNA, 17 bp, Homo sapiens
cttccaggagcccagag

SEQ ID NO: 3878540 - DNA, 10 bp, Homo sapiens
cttccaggct

SEQ ID NO: 3878541 - DNA, 18 bp, Homo sapiens
cttccaggtatctccagg

SEQ ID NO: 3878542 - DNA, 21 bp, Homo sapiens
cttccataatctggactcctc

SEQ ID NO: 3878543 - DNA, 16 bp, Homo sapiens
cttccatgtcgcctct

SEQ ID NO: 3878544 - DNA, 20 bp, Homo sapiens
cttccatgtcgcctctgcat

SEQ ID NO: 3878545 - DNA, 15 bp, Homo sapiens
cttcccaatcagcac

SEQ ID NO: 3878546 - DNA, 18 bp, Homo sapiens
cttcccaatcagcactga

SEQ ID NO: 3878547 - DNA, 19 bp, Homo sapiens
cttcccaatcagcactgaa

SEQ ID NO: 3878548 - DNA, 21 bp, Homo sapiens
cttcccaatcagcactgaaaa

SEQ ID NO: 3878549 - DNA, 22 bp, Homo sapiens
cttcccaatcagcactgaaaat

SEQ ID NO: 3878550 - DNA, 11 bp, Homo sapiens
cttcccagagg

SEQ ID NO: 3878551 - DNA, 17 bp, Homo sapiens
cttcccagaggcagagc

SEQ ID NO: 3878552 - DNA, 19 bp, Homo sapiens
cttcccaggagtggaggag

SEQ ID NO: 3878553 - DNA, 18 bp, Homo sapiens
cttcccatcactggagca

SEQ ID NO: 3878554 - DNA, 17 bp, Homo sapiens
cttcccatccccagcga

SEQ ID NO: 3878555 - DNA, 19 bp, Homo sapiens
cttccccagactcagctcc

SEQ ID NO: 3878556 - DNA, 17 bp, Homo sapiens
ctgtggaggcctgatgc

SEQ ID NO: 3878557 - DNA, 17 bp, Homo sapiens
ctgtggattccagcatt

SEQ ID NO: 3878558 - DNA, 15 bp, Homo sapiens
ctgtggcacagactt

SEQ ID NO: 3878559 - DNA, 12 bp, Homo sapiens
ctgtggccagag

SEQ ID NO: 3878560 - DNA, 16 bp, Homo sapiens
ctgtggcctcacttcc

SEQ ID NO: 3878561 - DNA, 21 bp, Homo sapiens
ctgtggcctcacttccctggg

SEQ ID NO: 3878562 - DNA, 16 bp, Homo sapiens
ctgtggcctgtgtcca

SEQ ID NO: 3878563 - DNA, 19 bp, Homo sapiens
ctgtggcctgtgtccagca

SEQ ID NO: 3878564 - DNA, 15 bp, Homo sapiens
ctgtggcggtgcctg

SEQ ID NO: 3878565 - DNA, 18 bp, Homo sapiens
ctgtggcggtgcctgggt

SEQ ID NO: 3878566 - DNA, 15 bp, Homo sapiens
ctgtgggagcctcgc

SEQ ID NO: 3878567 - DNA, 14 bp, Homo sapiens
ctgtgggccaggag

SEQ ID NO: 3878568 - DNA, 17 bp, Homo sapiens
ctgtgggcttggccttg

SEQ ID NO: 3878569 - DNA, 18 bp, Homo sapiens
ctgtgggcttggccttgt

SEQ ID NO: 3878570 - DNA, 19 bp, Homo sapiens
ctgtgggcttggccttgtg

SEQ ID NO: 3878571 - DNA, 21 bp, Homo sapiens
ctgtgggggtggccatccctg

SEQ ID NO: 3878572 - DNA, 19 bp, Homo sapiens
ctgtgggtgctaagggtaa

SEQ ID NO: 3878573 - DNA, 13 bp, Homo sapiens
ctgtggtcttgga

SEQ ID NO: 3878574 - DNA, 15 bp, Homo sapiens
ctgtggttgcatttg

SEQ ID NO: 3878575 - DNA, 16 bp, Homo sapiens
ctgtgtagctgtgacc

SEQ ID NO: 3878576 - DNA, 19 bp, Homo sapiens
ctgtgtagctgtgacctgc

SEQ ID NO: 3878577 - DNA, 20 bp, Homo sapiens
ctgtgtagctgtgacctgct

SEQ ID NO: 3878578 - DNA, 22 bp, Homo sapiens
ctgtgtagctgtgacctgctga

SEQ ID NO: 3878579 - DNA, 23 bp, Homo sapiens
ctgtgtagctgtgacctgctgag

SEQ ID NO: 3878580 - DNA, 19 bp, Homo sapiens
ctgtgtattttttaaagct

SEQ ID NO: 3878581 - DNA, 23 bp, Homo sapiens
ctgtgtattttttaaagctacaa

SEQ ID NO: 3878582 - DNA, 16 bp, Homo sapiens
ctgtgtcagcctgtcc

SEQ ID NO: 3878583 - DNA, 12 bp, Homo sapiens
ctgtgtccaatt

SEQ ID NO: 3878584 - DNA, 17 bp, Homo sapiens
ctgtgtccagcagctgc

SEQ ID NO: 3878585 - DNA, 23 bp, Homo sapiens
ctgtgtcccccccagtgcaggga

SEQ ID NO: 3878586 - DNA, 15 bp, Homo sapiens
ctgtgtcctctcccc

SEQ ID NO: 3878587 - DNA, 14 bp, Homo sapiens
ctgtgtccttgcac

SEQ ID NO: 3878588 - DNA, 22 bp, Homo sapiens
ctgtgtccttgcacctgcatcc

SEQ ID NO: 3878589 - DNA, 13 bp, Homo sapiens
ctgtgtctgcacc

SEQ ID NO: 3878590 - DNA, 14 bp, Homo sapiens
ctgtgtgaagaaat

SEQ ID NO: 3878591 - DNA, 16 bp, Homo sapiens
ctgtgtgaagaaatgg

SEQ ID NO: 3878592 - DNA, 15 bp, Homo sapiens
ctgtgtgcagtgaag

SEQ ID NO: 3878593 - DNA, 14 bp, Homo sapiens
ctgtgtggggaggc

SEQ ID NO: 3878594 - DNA, 23 bp, Homo sapiens
ctgtgtggggaggcagctccaac

SEQ ID NO: 3878595 - DNA, 16 bp, Homo sapiens
ctgtgtgggtctgggg

SEQ ID NO: 3878596 - DNA, 18 bp, Homo sapiens
ctgtgtgggtctggggag

SEQ ID NO: 3878597 - DNA, 14 bp, Homo sapiens
ctgtgttcttgctg

SEQ ID NO: 3878598 - DNA, 15 bp, Homo sapiens
ctgtgttcttgctga

SEQ ID NO: 3878599 - DNA, 17 bp, Homo sapiens
ctgtgttggccaggctg

SEQ ID NO: 3878600 - DNA, 19 bp, Homo sapiens
ctgttaaaagatgaaaata

SEQ ID NO: 3878601 - DNA, 18 bp, Homo sapiens
ctgttacccagagaatat

SEQ ID NO: 3878602 - DNA, 14 bp, Homo sapiens
ctgttactgaaatg

SEQ ID NO: 3878603 - DNA, 18 bp, Homo sapiens
ctgttacttgaaatacca

SEQ ID NO: 3878604 - DNA, 12 bp, Homo sapiens
ctgttcacagcc

SEQ ID NO: 3878605 - DNA, 14 bp, Homo sapiens
ctgttcacccacag

SEQ ID NO: 3878606 - DNA, 19 bp, Homo sapiens
ctgttcaccttatgtatta

SEQ ID NO: 3878607 - DNA, 14 bp, Homo sapiens
ctgttccacttctc

SEQ ID NO: 3878608 - DNA, 16 bp, Homo sapiens
ctgttccacttctcta

SEQ ID NO: 3878609 - DNA, 23 bp, Homo sapiens
ctgttccagcccaggcagagatc

SEQ ID NO: 3878610 - DNA, 14 bp, Homo sapiens
ctgttctcaaatgc

SEQ ID NO: 3878611 - DNA, 13 bp, Homo sapiens
ctgttctgcactg

SEQ ID NO: 3878612 - DNA, 15 bp, Homo sapiens
ctgttctgcactgaa

SEQ ID NO: 3878613 - DNA, 17 bp, Homo sapiens
ctgttctgcactgaaaa

SEQ ID NO: 3878614 - DNA, 18 bp, Homo sapiens
ctgttctgcactgaaaag

SEQ ID NO: 3878615 - DNA, 22 bp, Homo sapiens
ctgttctgtgtgggtctgggga

SEQ ID NO: 3878616 - DNA, 23 bp, Homo sapiens
ctgttgagtgcaacaagagcaaa

SEQ ID NO: 3878617 - DNA, 23 bp, Homo sapiens
ctgttgatcccacttcactgtga

SEQ ID NO: 3878618 - DNA, 17 bp, Homo sapiens
ctgttgatgaggcctct

SEQ ID NO: 3878619 - DNA, 20 bp, Homo sapiens
ctgttgatgaggcctcttgg

SEQ ID NO: 3878620 - DNA, 18 bp, Homo sapiens
ctgttgccatagccccat

SEQ ID NO: 3878621 - DNA, 11 bp, Homo sapiens
ctgttgctcaa

SEQ ID NO: 3878622 - DNA, 21 bp, Homo sapiens
ctgttgctcaaatctattcag

SEQ ID NO: 3878623 - DNA, 22 bp, Homo sapiens
ctgttgctcaaatctattcaga

SEQ ID NO: 3878624 - DNA, 15 bp, Homo sapiens
ctgttgctggactga

SEQ ID NO: 3878625 - DNA, 18 bp, Homo sapiens
ctgttgctggactgagga

SEQ ID NO: 3878626 - DNA, 16 bp, Homo sapiens
ctgttggacagctgct

SEQ ID NO: 3878627 - DNA, 20 bp, Homo sapiens
ctgttggacccgctctggac

SEQ ID NO: 3878628 - DNA, 12 bp, Homo sapiens
ctgttggcctcg

SEQ ID NO: 3878629 - DNA, 14 bp, Homo sapiens
ctgttggcctcgcc

SEQ ID NO: 3878630 - DNA, 17 bp, Homo sapiens
ctgttggcctcgcctgg

SEQ ID NO: 3878631 - DNA, 19 bp, Homo sapiens
ctgttggcctcgcctgggc

SEQ ID NO: 3878632 - DNA, 20 bp, Homo sapiens
ctgttggcctcgcctgggcc

SEQ ID NO: 3878633 - DNA, 21 bp, Homo sapiens
ctgttgtgtatagatgcaaga

SEQ ID NO: 3878634 - DNA, 18 bp, Homo sapiens
ctgttgttgcagggaagt

SEQ ID NO: 3878635 - DNA, 20 bp, Homo sapiens
ctgttgttttgttttaaata

SEQ ID NO: 3878636 - DNA, 19 bp, Homo sapiens
ctgtttgagatgtgatgct

SEQ ID NO: 3878637 - DNA, 22 bp, Homo sapiens
ctgtttgagatgtgatgctggt

SEQ ID NO: 3878638 - DNA, 20 bp, Homo sapiens
ctgtttgtttgacaaagaaa

SEQ ID NO: 3878639 - DNA, 13 bp, Homo sapiens
ctgttttaaatta

SEQ ID NO: 3878640 - DNA, 22 bp, Homo sapiens
ctgttttacaaaaaagaaaaga

SEQ ID NO: 3878641 - DNA, 13 bp, Homo sapiens
ctgttttttagtt

SEQ ID NO: 3878642 - DNA, 13 bp, Homo sapiens
ctggttttaacaa

SEQ ID NO: 3878643 - DNA, 14 bp, Homo sapiens
ctgtaaacccctgg

SEQ ID NO: 3878644 - DNA, 13 bp, Homo sapiens
ctgtaaactataa

SEQ ID NO: 3878645 - DNA, 19 bp, Homo sapiens
ctgtaaactcaaaacttaa

SEQ ID NO: 3878646 - DNA, 13 bp, Homo sapiens
ctgtaaatacaaa

SEQ ID NO: 3878647 - DNA, 21 bp, Homo sapiens
ctgtaaatacaaaataaaatt

SEQ ID NO: 3878648 - DNA, 16 bp, Homo sapiens
ctgtaaatatccacag

SEQ ID NO: 3878649 - DNA, 18 bp, Homo sapiens
ctgtaaatatccacagac

SEQ ID NO: 3878650 - DNA, 16 bp, Homo sapiens
ctgtaaatatgtttgt

SEQ ID NO: 3878651 - DNA, 17 bp, Homo sapiens
ctgtaaatatgtttgtg

SEQ ID NO: 3878652 - DNA, 18 bp, Homo sapiens
ctgtaaatatgtttgtgc

SEQ ID NO: 3878653 - DNA, 22 bp, Homo sapiens
ctgtaaatatgtttgtgcctta

SEQ ID NO: 3878654 - DNA, 23 bp, Homo sapiens
ctgtaaatatgtttgtgccttaa

SEQ ID NO: 3878655 - DNA, 12 bp, Homo sapiens
ctgtaaatcact

SEQ ID NO: 3878656 - DNA, 13 bp, Homo sapiens
ctgtaaatcactt

SEQ ID NO: 3878657 - DNA, 18 bp, Homo sapiens
ctgtaaatcacttgtaaa

SEQ ID NO: 3878658 - DNA, 17 bp, Homo sapiens
ctgtaacacaagccaca

SEQ ID NO: 3878659 - DNA, 21 bp, Homo sapiens
ctgtaacacagctgagagact

SEQ ID NO: 3878660 - DNA, 15 bp, Homo sapiens
ctgtaactcagacat

SEQ ID NO: 3878661 - DNA, 18 bp, Homo sapiens
ctgtaactgctgagccac

SEQ ID NO: 3878662 - DNA, 19 bp, Homo sapiens
ctgtaactgctgagccact

SEQ ID NO: 3878663 - DNA, 14 bp, Homo sapiens
ctgtaatcccagca

SEQ ID NO: 3878664 - DNA, 15 bp, Homo sapiens
ctgtaatcccagcac

SEQ ID NO: 3878665 - DNA, 15 bp, Homo sapiens
ctgtaatcccagcag

SEQ ID NO: 3878666 - DNA, 22 bp, Homo sapiens
ctgtaatgagaacttcaatcac

SEQ ID NO: 3878667 - DNA, 22 bp, Homo sapiens
ctgtaatggaactgaccccctc

SEQ ID NO: 3878668 - DNA, 13 bp, Homo sapiens
ctgtaattaagtg

SEQ ID NO: 3878669 - DNA, 15 bp, Homo sapiens
ctgtaattaatattc

SEQ ID NO: 3878670 - DNA, 20 bp, Homo sapiens
ctgtaattttgtttgtaatc

SEQ ID NO: 3878671 - DNA, 22 bp, Homo sapiens
ctgtaattttgtttgtaatcct

SEQ ID NO: 3878672 - DNA, 15 bp, Homo sapiens
ctgtacaaaaacaaa

SEQ ID NO: 3878673 - DNA, 20 bp, Homo sapiens
ctgtaccaagccccttggcc

SEQ ID NO: 3878674 - DNA, 13 bp, Homo sapiens
ctgtactcagagc

SEQ ID NO: 3878675 - DNA, 14 bp, Homo sapiens
ctgtactcagagca

SEQ ID NO: 3878676 - DNA, 18 bp, Homo sapiens
ctgtactcagagcagagc

SEQ ID NO: 3878677 - DNA, 20 bp, Homo sapiens
ctgtactcagagcagagcaa

SEQ ID NO: 3878678 - DNA, 19 bp, Homo sapiens
ctgtactgggttatttttg

SEQ ID NO: 3878679 - DNA, 20 bp, Homo sapiens
ctgtactgggttatttttgt

SEQ ID NO: 3878680 - DNA, 13 bp, Homo sapiens
ctgtacttaataa

SEQ ID NO: 3878681 - DNA, 12 bp, Homo sapiens
ctgtagcatctt

SEQ ID NO: 3878682 - DNA, 17 bp, Homo sapiens
ctgtagcatcttctgga

SEQ ID NO: 3878683 - DNA, 24 bp, Homo sapiens
ctgtagccatggctcaggcaagcc

SEQ ID NO: 3878684 - DNA, 22 bp, Homo sapiens
ctgtagctgatgaaactcctga

SEQ ID NO: 3878685 - DNA, 17 bp, Homo sapiens
ctgtagggctggaccta

SEQ ID NO: 3878686 - DNA, 21 bp, Homo sapiens
ctgtaggtggaagaaatttag

SEQ ID NO: 3878687 - DNA, 23 bp, Homo sapiens
ctgtaggtggtgttgagaaagaa

SEQ ID NO: 3878688 - DNA, 19 bp, Homo sapiens
ctgtagtagccctttctgt

SEQ ID NO: 3878689 - DNA, 15 bp, Homo sapiens
ctgtagtcccagcca

SEQ ID NO: 3878690 - DNA, 23 bp, Homo sapiens
ctgtagtcccagccactcgggag

SEQ ID NO: 3878691 - DNA, 15 bp, Homo sapiens
ctgtagttaggaaat

SEQ ID NO: 3878692 - DNA, 20 bp, Homo sapiens
ctgtataaacattaaatgtc

SEQ ID NO: 3878693 - DNA, 19 bp, Homo sapiens
ctgtataatctatttacat

SEQ ID NO: 3878694 - DNA, 15 bp, Homo sapiens
ctgtataatttaaca

SEQ ID NO: 3878695 - DNA, 23 bp, Homo sapiens
ctgtatataatactaaagtgtct

SEQ ID NO: 3878696 - DNA, 15 bp, Homo sapiens
ctgtatatacatttc

SEQ ID NO: 3878697 - DNA, 19 bp, Homo sapiens
ctgtatatatatatgtgtg

SEQ ID NO: 3878698 - DNA, 20 bp, Homo sapiens
ctgtatatatatatgtgtgt

SEQ ID NO: 3878699 - DNA, 22 bp, Homo sapiens
ctgtatatatatatgtgtgtgt

SEQ ID NO: 3878700 - DNA, 14 bp, Homo sapiens
ctgtatatgttgta

SEQ ID NO: 3878701 - DNA, 19 bp, Homo sapiens
ctgtatatgttgtaataaa

SEQ ID NO: 3878702 - DNA, 23 bp, Homo sapiens
ctgtatggcacttattatgaggc

SEQ ID NO: 3878703 - DNA, 16 bp, Homo sapiens
ctgtatgtctgcctaa

SEQ ID NO: 3878704 - DNA, 14 bp, Homo sapiens
ctgtcaagtacaag

SEQ ID NO: 3878705 - DNA, 19 bp, Homo sapiens
ctgtcaatgattattttca

SEQ ID NO: 3878706 - DNA, 20 bp, Homo sapiens
ctgtcacccaggctggagta

SEQ ID NO: 3878707 - DNA, 19 bp, Homo sapiens
ctgtcacgcagccaccagg

SEQ ID NO: 3878708 - DNA, 19 bp, Homo sapiens
ctgtcacgtgaaatattta

SEQ ID NO: 3878709 - DNA, 24 bp, Homo sapiens
ctgtcactgctctggactgtgtgg

SEQ ID NO: 3878710 - DNA, 17 bp, Homo sapiens
ctgtcagagctgttggc

SEQ ID NO: 3878711 - DNA, 18 bp, Homo sapiens
ctgtcagagctgttggcc

SEQ ID NO: 3878712 - DNA, 22 bp, Homo sapiens
ctgtcagagctgttggcctcgc

SEQ ID NO: 3878713 - DNA, 21 bp, Homo sapiens
ctgtcagatgggaagacatga

SEQ ID NO: 3878714 - DNA, 21 bp, Homo sapiens
ctgtcagctcccctcggagaa

SEQ ID NO: 3878715 - DNA, 14 bp, Homo sapiens
ctgtcatagaaagt

SEQ ID NO: 3878716 - DNA, 15 bp, Homo sapiens
ctgtcatcactccct

SEQ ID NO: 3878717 - DNA, 16 bp, Homo sapiens
ctgtcatcactccctg

SEQ ID NO: 3878718 - DNA, 18 bp, Homo sapiens
ctgtcatcactccctgga

SEQ ID NO: 3878719 - DNA, 20 bp, Homo sapiens
ctgtcatcactccctggatg

SEQ ID NO: 3878720 - DNA, 21 bp, Homo sapiens
ctgtcatcactccctggatgt

SEQ ID NO: 3878721 - DNA, 14 bp, Homo sapiens
ctgtcattcaaatg

SEQ ID NO: 3878722 - DNA, 23 bp, Homo sapiens
ctgtcattcccaccaccctgagg

SEQ ID NO: 3878723 - DNA, 11 bp, Homo sapiens
ctgtccaagga

SEQ ID NO: 3878724 - DNA, 14 bp, Homo sapiens
ctgtccactctcgg

SEQ ID NO: 3878725 - DNA, 12 bp, Homo sapiens
ctgtccaggaca

SEQ ID NO: 3878726 - DNA, 19 bp, Homo sapiens
ctgtccaggcactgctgcc

SEQ ID NO: 3878727 - DNA, 20 bp, Homo sapiens
ctgtccaggcactgctgccc

SEQ ID NO: 3878728 - DNA, 22 bp, Homo sapiens
ctgtccaggcactgctgcccag

SEQ ID NO: 3878729 - DNA, 23 bp, Homo sapiens
ctgtccaggcactgctgcccagc

SEQ ID NO: 3878730 - DNA, 14 bp, Homo sapiens
ctgtccaggccact

SEQ ID NO: 3878731 - DNA, 15 bp, Homo sapiens
ctgtccaggccactg

SEQ ID NO: 3878732 - DNA, 16 bp, Homo sapiens
ctgtccaggccactgt

SEQ ID NO: 3878733 - DNA, 19 bp, Homo sapiens
ctgtccaggccactgtggc

SEQ ID NO: 3878734 - DNA, 19 bp, Homo sapiens
ctgtcccaccaactctgca

SEQ ID NO: 3878735 - DNA, 21 bp, Homo sapiens
ctgtcccaccaactctgcact

SEQ ID NO: 3878736 - DNA, 21 bp, Homo sapiens
ctgtcccaccgggagcctccc

SEQ ID NO: 3878737 - DNA, 14 bp, Homo sapiens
ctgtcccacctctt

SEQ ID NO: 3878738 - DNA, 15 bp, Homo sapiens
ctgtcccctctgtca

SEQ ID NO: 3878739 - DNA, 17 bp, Homo sapiens
ctgtccctacccactct

SEQ ID NO: 3878740 - DNA, 18 bp, Homo sapiens
ctgtccctacccactctt

SEQ ID NO: 3878741 - DNA, 19 bp, Homo sapiens
ctgtccctacccactcttt

SEQ ID NO: 3878742 - DNA, 12 bp, Homo sapiens
ctgtccctgtca

SEQ ID NO: 3878743 - DNA, 15 bp, Homo sapiens
ctgtccctgtcacca

SEQ ID NO: 3878744 - DNA, 19 bp, Homo sapiens
ctgtccgcctctgcccgca

SEQ ID NO: 3878745 - DNA, 21 bp, Homo sapiens
ctgtccgcctctgcccgcaga

SEQ ID NO: 3878746 - DNA, 21 bp, Homo sapiens
ctgtcctcaaaataaggggca

SEQ ID NO: 3878747 - DNA, 18 bp, Homo sapiens
ctgtcctcccatcccctg

SEQ ID NO: 3878748 - DNA, 21 bp, Homo sapiens
ctgtcctcccatcccctggac

SEQ ID NO: 3878749 - DNA, 12 bp, Homo sapiens
ctgtcctcctcg

SEQ ID NO: 3878750 - DNA, 23 bp, Homo sapiens
ctgtcctcctcggatcaccgaga

SEQ ID NO: 3878751 - DNA, 13 bp, Homo sapiens
ctgtcctgcctct

SEQ ID NO: 3878752 - DNA, 22 bp, Homo sapiens
ctgtcctgcctctctgctccag

SEQ ID NO: 3878753 - DNA, 20 bp, Homo sapiens
ctgtcctgttttactggacc

SEQ ID NO: 3878754 - DNA, 13 bp, Homo sapiens
ctgtcgagacact

SEQ ID NO: 3878755 - DNA, 14 bp, Homo sapiens
ctgtcgtgtttaca

SEQ ID NO: 3878756 - DNA, 19 bp, Homo sapiens
ctgtcgtgtttacaaaagg

SEQ ID NO: 3878757 - DNA, 19 bp, Homo sapiens
ctgtctatgttgtgatcct

SEQ ID NO: 3878758 - DNA, 19 bp, Homo sapiens
ctgtctcaagagggcactg

SEQ ID NO: 3878759 - DNA, 18 bp, Homo sapiens
ctgtctcctggtctgtgc

SEQ ID NO: 3878760 - DNA, 23 bp, Homo sapiens
ctgtctcgagcgccctgcagacc

SEQ ID NO: 3878761 - DNA, 15 bp, Homo sapiens
ctgtctctagccact

SEQ ID NO: 3878762 - DNA, 20 bp, Homo sapiens
ctgtctctagccactttggt

SEQ ID NO: 3878763 - DNA, 12 bp, Homo sapiens
ctgtctctcttg

SEQ ID NO: 3878764 - DNA, 15 bp, Homo sapiens
ctgtctgctcagaca

SEQ ID NO: 3878765 - DNA, 21 bp, Homo sapiens
ctgtctggtgtagctcctctg

SEQ ID NO: 3878766 - DNA, 13 bp, Homo sapiens
ctgtctgtcacca

SEQ ID NO: 3878767 - DNA, 16 bp, Homo sapiens
ctgtctgtcaccagct

SEQ ID NO: 3878768 - DNA, 13 bp, Homo sapiens
ctgtctgtcctgg

SEQ ID NO: 3878769 - DNA, 14 bp, Homo sapiens
ctgtcttcacaacc

SEQ ID NO: 3878770 - DNA, 15 bp, Homo sapiens
ctgtgaaaatgagga

SEQ ID NO: 3878771 - DNA, 18 bp, Homo sapiens
ctgtgaaagtatgtgata

SEQ ID NO: 3878772 - DNA, 18 bp, Homo sapiens
ctgtgaacatggactctt

SEQ ID NO: 3878773 - DNA, 15 bp, Homo sapiens
ctgtgaacccaggac

SEQ ID NO: 3878774 - DNA, 17 bp, Homo sapiens
ctgtgaacccaggacaa

SEQ ID NO: 3878775 - DNA, 22 bp, Homo sapiens
ctgtgaacccaggacaagcatg

SEQ ID NO: 3878776 - DNA, 16 bp, Homo sapiens
ctgtgaagaatgaagt

SEQ ID NO: 3878777 - DNA, 14 bp, Homo sapiens
ctgtgacctgctga

SEQ ID NO: 3878778 - DNA, 16 bp, Homo sapiens
ctgtgacctgctgagc

SEQ ID NO: 3878779 - DNA, 23 bp, Homo sapiens
ctgtgacctgctgagctctgaga

SEQ ID NO: 3878780 - DNA, 14 bp, Homo sapiens
ctgtgactcttttt

SEQ ID NO: 3878781 - DNA, 18 bp, Homo sapiens
ctgtgactgccaaggtgt

SEQ ID NO: 3878782 - DNA, 16 bp, Homo sapiens
ctgtgagcccctggtc

SEQ ID NO: 3878783 - DNA, 18 bp, Homo sapiens
ctgtgaggcaggggcgga

SEQ ID NO: 3878784 - DNA, 15 bp, Homo sapiens
ctgtgaggcccctgg

SEQ ID NO: 3878785 - DNA, 17 bp, Homo sapiens
ctgtgaggcccctggac

SEQ ID NO: 3878786 - DNA, 17 bp, Homo sapiens
ctgtgattaacttgctt

SEQ ID NO: 3878787 - DNA, 19 bp, Homo sapiens
ctgtgattaacttgcttag

SEQ ID NO: 3878788 - DNA, 18 bp, Homo sapiens
ctgtgcaccttacattcc

SEQ ID NO: 3878789 - DNA, 18 bp, Homo sapiens
ctgtgcactagcctgtga

SEQ ID NO: 3878790 - DNA, 20 bp, Homo sapiens
ctgtgcagcagcccagcttc

SEQ ID NO: 3878791 - DNA, 23 bp, Homo sapiens
ctgtgcagcagcccagcttcctg

SEQ ID NO: 3878792 - DNA, 13 bp, Homo sapiens
ctgtgccagagcc

SEQ ID NO: 3878793 - DNA, 14 bp, Homo sapiens
ctgtgccagagcct

SEQ ID NO: 3878794 - DNA, 17 bp, Homo sapiens
ctgtgccagagcctggg

SEQ ID NO: 3878795 - DNA, 22 bp, Homo sapiens
ctgtgccagagcctggggctct

SEQ ID NO: 3878796 - DNA, 11 bp, Homo sapiens
ctgtgccagct

SEQ ID NO: 3878797 - DNA, 12 bp, Homo sapiens
ctgtgccagctc

SEQ ID NO: 3878798 - DNA, 13 bp, Homo sapiens
ctgtgccagctca

SEQ ID NO: 3878799 - DNA, 15 bp, Homo sapiens
ctgtgcccctcagag

SEQ ID NO: 3878800 - DNA, 16 bp, Homo sapiens
ctgtgcccctcagaga

SEQ ID NO: 3878801 - DNA, 22 bp, Homo sapiens
ctgtgcctcgctccccactctg

SEQ ID NO: 3878802 - DNA, 24 bp, Homo sapiens
ctgtgcctcgctccccactctgct

SEQ ID NO: 3878803 - DNA, 14 bp, Homo sapiens
ctgtgcctctgcct

SEQ ID NO: 3878804 - DNA, 15 bp, Homo sapiens
ctgtgcctctgcctg

SEQ ID NO: 3878805 - DNA, 19 bp, Homo sapiens
ctgtgcctgctagagcaac

SEQ ID NO: 3878806 - DNA, 10 bp, Homo sapiens
ctgtgcctta

SEQ ID NO: 3878807 - DNA, 11 bp, Homo sapiens
ctgtgccttac

SEQ ID NO: 3878808 - DNA, 21 bp, Homo sapiens
ctgtgctcttttggtggggag

SEQ ID NO: 3878809 - DNA, 12 bp, Homo sapiens
ctgtgctgtgcc

SEQ ID NO: 3878810 - DNA, 15 bp, Homo sapiens
ctgtgctgtgcctgc

SEQ ID NO: 3878811 - DNA, 17 bp, Homo sapiens
ctgtgctgtgcctgcta

SEQ ID NO: 3878812 - DNA, 21 bp, Homo sapiens
ctgtgctgtgcctgctagagc

SEQ ID NO: 3878813 - DNA, 13 bp, Homo sapiens
ctgtggaggcctg

SEQ ID NO: 3878814 - DNA, 15 bp, Homo sapiens
ctggccaccctggcc

SEQ ID NO: 3878815 - DNA, 17 bp, Homo sapiens
ctggccaccctggcccg

SEQ ID NO: 3878816 - DNA, 16 bp, Homo sapiens
ctggccagacgctgcc

SEQ ID NO: 3878817 - DNA, 17 bp, Homo sapiens
ctggccagagagggccc

SEQ ID NO: 3878818 - DNA, 18 bp, Homo sapiens
ctggccagagagggccca

SEQ ID NO: 3878819 - DNA, 21 bp, Homo sapiens
ctggccagagagggcccagct

SEQ ID NO: 3878820 - DNA, 23 bp, Homo sapiens
ctggccagagagggcccagctgt

SEQ ID NO: 3878821 - DNA, 15 bp, Homo sapiens
ctggccagcaccctc

SEQ ID NO: 3878822 - DNA, 16 bp, Homo sapiens
ctggccagcaccctct

SEQ ID NO: 3878823 - DNA, 22 bp, Homo sapiens
ctggccagcaccctctcctggg

SEQ ID NO: 3878824 - DNA, 23 bp, Homo sapiens
ctggccagcaccctctcctgggg

SEQ ID NO: 3878825 - DNA, 18 bp, Homo sapiens
ctggccagtcctagagct

SEQ ID NO: 3878826 - DNA, 20 bp, Homo sapiens
ctggccagtcctagagctcc

SEQ ID NO: 3878827 - DNA, 13 bp, Homo sapiens
ctggccatcccca

SEQ ID NO: 3878828 - DNA, 19 bp, Homo sapiens
ctggccattttcttgcctg

SEQ ID NO: 3878829 - DNA, 20 bp, Homo sapiens
ctggccattttcttgcctga

SEQ ID NO: 3878830 - DNA, 24 bp, Homo sapiens
ctggccattttcttgcctgaggct

SEQ ID NO: 3878831 - DNA, 11 bp, Homo sapiens
ctggcccagcc

SEQ ID NO: 3878832 - DNA, 16 bp, Homo sapiens
ctggcccatagaaaca

SEQ ID NO: 3878833 - DNA, 21 bp, Homo sapiens
ctggcccatagaaacatgaca

SEQ ID NO: 3878834 - DNA, 23 bp, Homo sapiens
ctggccccaccctcgtggacacc

SEQ ID NO: 3878835 - DNA, 13 bp, Homo sapiens
ctggcccccctcc

SEQ ID NO: 3878836 - DNA, 18 bp, Homo sapiens
ctggcccccctccaggca

SEQ ID NO: 3878837 - DNA, 20 bp, Homo sapiens
ctggcccctccagaccctgc

SEQ ID NO: 3878838 - DNA, 21 bp, Homo sapiens
ctggcccctccagaccctgcc

SEQ ID NO: 3878839 - DNA, 21 bp, Homo sapiens
ctggcccgtcatgttcctcaa

SEQ ID NO: 3878840 - DNA, 15 bp, Homo sapiens
ctggccctgcctcat

SEQ ID NO: 3878841 - DNA, 12 bp, Homo sapiens
ctggccctggct

SEQ ID NO: 3878842 - DNA, 15 bp, Homo sapiens
ctggccctttctgga

SEQ ID NO: 3878843 - DNA, 18 bp, Homo sapiens
ctggccctttctggacca

SEQ ID NO: 3878844 - DNA, 19 bp, Homo sapiens
ctggccggggcccctcacc

SEQ ID NO: 3878845 - DNA, 17 bp, Homo sapiens
ctggcctcactggctgg

SEQ ID NO: 3878846 - DNA, 19 bp, Homo sapiens
ctggcctcactggctgggg

SEQ ID NO: 3878847 - DNA, 15 bp, Homo sapiens
ctggcctcagcagga

SEQ ID NO: 3878848 - DNA, 13 bp, Homo sapiens
ctggcctccacag

SEQ ID NO: 3878849 - DNA, 19 bp, Homo sapiens
ctggcctcccaataaagct

SEQ ID NO: 3878850 - DNA, 14 bp, Homo sapiens
ctggcctctagaac

SEQ ID NO: 3878851 - DNA, 18 bp, Homo sapiens
ctggcctgagctggggcc

SEQ ID NO: 3878852 - DNA, 15 bp, Homo sapiens
ctggcctgatcttgg

SEQ ID NO: 3878853 - DNA, 23 bp, Homo sapiens
ctggcctgctgggaaccccgcag

SEQ ID NO: 3878854 - DNA, 12 bp, Homo sapiens
ctggcctggatc

SEQ ID NO: 3878855 - DNA, 22 bp, Homo sapiens
ctggcctggatctccccactct

SEQ ID NO: 3878856 - DNA, 14 bp, Homo sapiens
ctggcctggccggc

SEQ ID NO: 3878857 - DNA, 12 bp, Homo sapiens
ctggcctggctc

SEQ ID NO: 3878858 - DNA, 13 bp, Homo sapiens
ctggcctggctcc

SEQ ID NO: 3878859 - DNA, 17 bp, Homo sapiens
ctggcctggctccccac

SEQ ID NO: 3878860 - DNA, 17 bp, Homo sapiens
ctggccttgtcaggacc

SEQ ID NO: 3878861 - DNA, 22 bp, Homo sapiens
ctggccttgtcaggacccaggc

SEQ ID NO: 3878862 - DNA, 14 bp, Homo sapiens
ctggccttttccta

SEQ ID NO: 3878863 - DNA, 16 bp, Homo sapiens
ctggcggcgcagaggg

SEQ ID NO: 3878864 - DNA, 17 bp, Homo sapiens
ctggcggctactcagca

SEQ ID NO: 3878865 - DNA, 23 bp, Homo sapiens
ctggcggctactcagcagccctc

SEQ ID NO: 3878866 - DNA, 14 bp, Homo sapiens
ctggcggggcagga

SEQ ID NO: 3878867 - DNA, 17 bp, Homo sapiens
ctggcggggcaggaggc

SEQ ID NO: 3878868 - DNA, 20 bp, Homo sapiens
ctggcggggcaggaggcctg

SEQ ID NO: 3878869 - DNA, 15 bp, Homo sapiens
ctggctcacccctct

SEQ ID NO: 3878870 - DNA, 16 bp, Homo sapiens
ctggctcacccctctc

SEQ ID NO: 3878871 - DNA, 18 bp, Homo sapiens
ctggctcccacaggccct

SEQ ID NO: 3878872 - DNA, 16 bp, Homo sapiens
ctggctccccacgagt

SEQ ID NO: 3878873 - DNA, 21 bp, Homo sapiens
ctggctccccacgagtcacct

SEQ ID NO: 3878874 - DNA, 14 bp, Homo sapiens
ctggctcctccttc

SEQ ID NO: 3878875 - DNA, 15 bp, Homo sapiens
ctggctcctccttcc

SEQ ID NO: 3878876 - DNA, 14 bp, Homo sapiens
ctggctctccacct

SEQ ID NO: 3878877 - DNA, 24 bp, Homo sapiens
ctggctctgcaatgggcactggga

SEQ ID NO: 3878878 - DNA, 19 bp, Homo sapiens
ctggctgaccccaaagagc

SEQ ID NO: 3878879 - DNA, 21 bp, Homo sapiens
ctggctgaggatttcaagcct

SEQ ID NO: 3878880 - DNA, 22 bp, Homo sapiens
ctggctgaggatttcaagcctg

SEQ ID NO: 3878881 - DNA, 24 bp, Homo sapiens
ctggctgagtggaatgcagggaag

SEQ ID NO: 3878882 - DNA, 22 bp, Homo sapiens
ctggctgcaagggccagagttc

SEQ ID NO: 3878883 - DNA, 12 bp, Homo sapiens
ctggctgccagg

SEQ ID NO: 3878884 - DNA, 13 bp, Homo sapiens
ctggctgccaggc

SEQ ID NO: 3878885 - DNA, 15 bp, Homo sapiens
ctggctgccaggcgt

SEQ ID NO: 3878886 - DNA, 16 bp, Homo sapiens
ctggctgccaggcgtt

SEQ ID NO: 3878887 - DNA, 18 bp, Homo sapiens
ctggctgccaggcgttgg

SEQ ID NO: 3878888 - DNA, 19 bp, Homo sapiens
ctggctgccttagaacctt

SEQ ID NO: 3878889 - DNA, 14 bp, Homo sapiens
ctggctggctgagg

SEQ ID NO: 3878890 - DNA, 13 bp, Homo sapiens
ctggctggggcag

SEQ ID NO: 3878891 - DNA, 14 bp, Homo sapiens
ctggctggggcaga

SEQ ID NO: 3878892 - DNA, 15 bp, Homo sapiens
ctggctggggcagag

SEQ ID NO: 3878893 - DNA, 16 bp, Homo sapiens
ctggctggggcagagg

SEQ ID NO: 3878894 - DNA, 15 bp, Homo sapiens
ctggctgtggaggcc

SEQ ID NO: 3878895 - DNA, 16 bp, Homo sapiens
ctggctgtggaggcct

SEQ ID NO: 3878896 - DNA, 17 bp, Homo sapiens
ctggctgtggaggcctg

SEQ ID NO: 3878897 - DNA, 15 bp, Homo sapiens
ctggcttattcccaa

SEQ ID NO: 3878898 - DNA, 16 bp, Homo sapiens
ctggcttccaggtatc

SEQ ID NO: 3878899 - DNA, 22 bp, Homo sapiens
ctggcttccaggtatctccagg

SEQ ID NO: 3878900 - DNA, 18 bp, Homo sapiens
ctggcttccttctctcaa

SEQ ID NO: 3878901 - DNA, 13 bp, Homo sapiens
ctggcttctgtgc

SEQ ID NO: 3878902 - DNA, 17 bp, Homo sapiens
ctggcttgctccagggt

SEQ ID NO: 3878903 - DNA, 18 bp, Homo sapiens
ctggcttgctccagggtc

SEQ ID NO: 3878904 - DNA, 22 bp, Homo sapiens
ctggcttgctccagggtcttgg

SEQ ID NO: 3878905 - DNA, 17 bp, Homo sapiens
ctggcttgtaactccac

SEQ ID NO: 3878906 - DNA, 16 bp, Homo sapiens
ctggctttgtctctag

SEQ ID NO: 3878907 - DNA, 17 bp, Homo sapiens
ctggcttttcactgctg

SEQ ID NO: 3878908 - DNA, 23 bp, Homo sapiens
ctggcttttcactgctggctgcc

SEQ ID NO: 3878909 - DNA, 22 bp, Homo sapiens
ctggcttttcgcttgcttctgc

SEQ ID NO: 3878910 - DNA, 23 bp, Homo sapiens
ctgggaaaaaagttttgatgaaa

SEQ ID NO: 3878911 - DNA, 17 bp, Homo sapiens
ctgggaaaacagaggaa

SEQ ID NO: 3878912 - DNA, 17 bp, Homo sapiens
ctgggaaacagggagcc

SEQ ID NO: 3878913 - DNA, 15 bp, Homo sapiens
ctgggaaaggaaaac

SEQ ID NO: 3878914 - DNA, 23 bp, Homo sapiens
ctgggaaaggaaaaccagggata

SEQ ID NO: 3878915 - DNA, 24 bp, Homo sapiens
ctgggaaaggaaaaccagggatag

SEQ ID NO: 3878916 - DNA, 17 bp, Homo sapiens
ctgggaaaggacccacc

SEQ ID NO: 3878917 - DNA, 21 bp, Homo sapiens
ctgggaaaggacccacccatc

SEQ ID NO: 3878918 - DNA, 17 bp, Homo sapiens
ctgggaaccccgcagcc

SEQ ID NO: 3878919 - DNA, 21 bp, Homo sapiens
ctgggaaccccgcagcccgtg

SEQ ID NO: 3878920 - DNA, 23 bp, Homo sapiens
ctgggaactggttcaagagacac

SEQ ID NO: 3878921 - DNA, 19 bp, Homo sapiens
ctgggaagctgtactcaga

SEQ ID NO: 3878922 - DNA, 20 bp, Homo sapiens
ctgggaagctgtactcagag

SEQ ID NO: 3878923 - DNA, 23 bp, Homo sapiens
ctgggaaggctacttcggggctg

SEQ ID NO: 3878924 - DNA, 21 bp, Homo sapiens
ctgggaatggaaggctttgcc

SEQ ID NO: 3878925 - DNA, 13 bp, Homo sapiens
ctgggacccagct

SEQ ID NO: 3878926 - DNA, 14 bp, Homo sapiens
ctgggacccagcta

SEQ ID NO: 3878927 - DNA, 22 bp, Homo sapiens
ctgggacccagctactctgtcc

SEQ ID NO: 3878928 - DNA, 12 bp, Homo sapiens
ctgggacccctc

SEQ ID NO: 3878929 - DNA, 23 bp, Homo sapiens
ctgggacccctcccaacctcaat

SEQ ID NO: 3878930 - DNA, 17 bp, Homo sapiens
ctgggaccgctacacca

SEQ ID NO: 3878931 - DNA, 14 bp, Homo sapiens
ctgggacctgtgtt

SEQ ID NO: 3878932 - DNA, 14 bp, Homo sapiens
ctgggactcccagt

SEQ ID NO: 3878933 - DNA, 22 bp, Homo sapiens
ctgggaggtctccactgaggat

SEQ ID NO: 3878934 - DNA, 15 bp, Homo sapiens
ctgggagtgttctgt

SEQ ID NO: 3878935 - DNA, 17 bp, Homo sapiens
ctgggatgagccgctgt

SEQ ID NO: 3878936 - DNA, 14 bp, Homo sapiens
ctgggatggaccct

SEQ ID NO: 3878937 - DNA, 17 bp, Homo sapiens
ctgggatggaccctcgc

SEQ ID NO: 3878938 - DNA, 16 bp, Homo sapiens
ctgggatgggaccagg

SEQ ID NO: 3878939 - DNA, 20 bp, Homo sapiens
ctgggattacaggcatgagc

SEQ ID NO: 3878940 - DNA, 19 bp, Homo sapiens
ctgggatttcttcgctgct

SEQ ID NO: 3878941 - DNA, 20 bp, Homo sapiens
ctgggatttcttcgctgctc

SEQ ID NO: 3878942 - DNA, 23 bp, Homo sapiens
ctgggatttcttcgctgctctag

SEQ ID NO: 3878943 - DNA, 18 bp, Homo sapiens
ctgggcaaacccttctct

SEQ ID NO: 3878944 - DNA, 12 bp, Homo sapiens
ctgggcaagaac

SEQ ID NO: 3878945 - DNA, 20 bp, Homo sapiens
ctgggcaatgaaaccaaagc

SEQ ID NO: 3878946 - DNA, 19 bp, Homo sapiens
ctgggcaatgatggcaatt

SEQ ID NO: 3878947 - DNA, 17 bp, Homo sapiens
ctgggcacccacctcca

SEQ ID NO: 3878948 - DNA, 18 bp, Homo sapiens
ctgggcacccacctccac

SEQ ID NO: 3878949 - DNA, 20 bp, Homo sapiens
ctgggcacccacctccaccc

SEQ ID NO: 3878950 - DNA, 16 bp, Homo sapiens
ctgggcagctgtcatg

SEQ ID NO: 3878951 - DNA, 20 bp, Homo sapiens
ctgggccaaaagggcagcca

SEQ ID NO: 3878952 - DNA, 15 bp, Homo sapiens
ctgggccagcctcag

SEQ ID NO: 3878953 - DNA, 18 bp, Homo sapiens
ctgggcccacagagatgc

SEQ ID NO: 3878954 - DNA, 12 bp, Homo sapiens
ctgggcccaggc

SEQ ID NO: 3878955 - DNA, 17 bp, Homo sapiens
ctgggcccaggctctgg

SEQ ID NO: 3878956 - DNA, 19 bp, Homo sapiens
ctgggcccaggctctggga

SEQ ID NO: 3878957 - DNA, 20 bp, Homo sapiens
ctgggcccaggctctgggaa

SEQ ID NO: 3878958 - DNA, 15 bp, Homo sapiens
ctgggccccacctac

SEQ ID NO: 3878959 - DNA, 15 bp, Homo sapiens
ctgggcccctccacg

SEQ ID NO: 3878960 - DNA, 12 bp, Homo sapiens
ctgggcccctgg

SEQ ID NO: 3878961 - DNA, 17 bp, Homo sapiens
ctgggcccctgggatgg

SEQ ID NO: 3878962 - DNA, 13 bp, Homo sapiens
ctgggccctgggg

SEQ ID NO: 3878963 - DNA, 15 bp, Homo sapiens
ctgggccctggggcc

SEQ ID NO: 3878964 - DNA, 17 bp, Homo sapiens
ctgggccctggggcctg

SEQ ID NO: 3878965 - DNA, 18 bp, Homo sapiens
ctgggccctggggcctgt

SEQ ID NO: 3878966 - DNA, 20 bp, Homo sapiens
ctgggccctggggcctgtac

SEQ ID NO: 3878967 - DNA, 17 bp, Homo sapiens
ctgggccggccagcctt

SEQ ID NO: 3878968 - DNA, 16 bp, Homo sapiens
ctgggcctatggagag

SEQ ID NO: 3878969 - DNA, 20 bp, Homo sapiens
ctgggcctatggagagccct

SEQ ID NO: 3878970 - DNA, 21 bp, Homo sapiens
ctgggcctcagttcaacctgg

SEQ ID NO: 3878971 - DNA, 14 bp, Homo sapiens
ctgggcctgctgct

SEQ ID NO: 3878972 - DNA, 17 bp, Homo sapiens
ctgggcctgctgctgag

SEQ ID NO: 3878973 - DNA, 18 bp, Homo sapiens
ctgggcctgctgctgaga

SEQ ID NO: 3878974 - DNA, 22 bp, Homo sapiens
ctgggcctgctgctgagaacct

SEQ ID NO: 3878975 - DNA, 21 bp, Homo sapiens
ctgggcctgcttttccaggat

SEQ ID NO: 3878976 - DNA, 12 bp, Homo sapiens
ctgggcctgtgc

SEQ ID NO: 3878977 - DNA, 17 bp, Homo sapiens
ctgggcctgtgcagcag

SEQ ID NO: 3878978 - DNA, 22 bp, Homo sapiens
ctgggcctgtgcagcagcccag

SEQ ID NO: 3878979 - DNA, 14 bp, Homo sapiens
ctgggcctttcctg

SEQ ID NO: 3878980 - DNA, 18 bp, Homo sapiens
ctgggcctttcctgtgcc

SEQ ID NO: 3878981 - DNA, 14 bp, Homo sapiens
ctgggctcagggct

SEQ ID NO: 3878982 - DNA, 16 bp, Homo sapiens
ctgggctcagggctgg

SEQ ID NO: 3878983 - DNA, 21 bp, Homo sapiens
ctgggctcagggctggagtgc

SEQ ID NO: 3878984 - DNA, 13 bp, Homo sapiens
ctgggctctccac

SEQ ID NO: 3878985 - DNA, 21 bp, Homo sapiens
ctgggctctccacctcagcct

SEQ ID NO: 3878986 - DNA, 21 bp, Homo sapiens
ctgggctgtctgtcaccagct

SEQ ID NO: 3878987 - DNA, 22 bp, Homo sapiens
ctgggcttcagggtatcccaga

SEQ ID NO: 3878988 - DNA, 21 bp, Homo sapiens
ctggggaacagagcgggcctc

SEQ ID NO: 3878989 - DNA, 21 bp, Homo sapiens
ctggggaggaagggccaggag

SEQ ID NO: 3878990 - DNA, 22 bp, Homo sapiens
ctggggaggaagggccaggaga

SEQ ID NO: 3878991 - DNA, 15 bp, Homo sapiens
ctggggatgtgggag

SEQ ID NO: 3878992 - DNA, 13 bp, Homo sapiens
ctggggcagaggg

SEQ ID NO: 3878993 - DNA, 15 bp, Homo sapiens
ctggggcagaggggc

SEQ ID NO: 3878994 - DNA, 20 bp, Homo sapiens
ctggggcagaggggcagccg

SEQ ID NO: 3878995 - DNA, 22 bp, Homo sapiens
ctggggcatgtgtgcctgtggc

SEQ ID NO: 3878996 - DNA, 22 bp, Homo sapiens
ctggggccacaaatcaaagcaa

SEQ ID NO: 3878997 - DNA, 18 bp, Homo sapiens
ctggggccctgggcctca

SEQ ID NO: 3878998 - DNA, 15 bp, Homo sapiens
ctggggcctggagag

SEQ ID NO: 3878999 - DNA, 19 bp, Homo sapiens
ctggggcctgtactgcctg

SEQ ID NO: 3879000 - DNA, 20 bp, Homo sapiens
ctggggcctgtactgcctgc

SEQ ID NO: 3879001 - DNA, 22 bp, Homo sapiens
ctggggcctgtactgcctgctt

SEQ ID NO: 3879002 - DNA, 23 bp, Homo sapiens
ctggggcctgtactgcctgcttg

SEQ ID NO: 3879003 - DNA, 20 bp, Homo sapiens
ctggggcttctcctgaccca

SEQ ID NO: 3879004 - DNA, 19 bp, Homo sapiens
ctggggcttgcaagaggag

SEQ ID NO: 3879005 - DNA, 17 bp, Homo sapiens
ctgggggaagccctgga

SEQ ID NO: 3879006 - DNA, 12 bp, Homo sapiens
ctgggggcagtg

SEQ ID NO: 3879007 - DNA, 15 bp, Homo sapiens
ctgggggccagctgg

SEQ ID NO: 3879008 - DNA, 15 bp, Homo sapiens
ctgggggcctggctg

SEQ ID NO: 3879009 - DNA, 18 bp, Homo sapiens
ctgggggcctggctggct

SEQ ID NO: 3879010 - DNA, 23 bp, Homo sapiens
ctgggggcctggctggctgaggg

SEQ ID NO: 3879011 - DNA, 16 bp, Homo sapiens
ctgggggcgggggagc

SEQ ID NO: 3879012 - DNA, 18 bp, Homo sapiens
ctgggggcgggggagcca

SEQ ID NO: 3879013 - DNA, 23 bp, Homo sapiens
ctgggggcttcgcttccttagcc

SEQ ID NO: 3879014 - DNA, 13 bp, Homo sapiens
ctgggggtggcag

SEQ ID NO: 3879015 - DNA, 20 bp, Homo sapiens
ctgggggttctttcttcctc

SEQ ID NO: 3879016 - DNA, 23 bp, Homo sapiens
ctgggggttctttcttcctctgc

SEQ ID NO: 3879017 - DNA, 12 bp, Homo sapiens
ctggggtacagg

SEQ ID NO: 3879018 - DNA, 19 bp, Homo sapiens
ctggggttcagcccctcct

SEQ ID NO: 3879019 - DNA, 22 bp, Homo sapiens
ctggggttcagcccctcctctg

SEQ ID NO: 3879020 - DNA, 15 bp, Homo sapiens
ctgggtccctcggag

SEQ ID NO: 3879021 - DNA, 21 bp, Homo sapiens
ctgggtccctcggagctgcca

SEQ ID NO: 3879022 - DNA, 23 bp, Homo sapiens
ctgggtccttgcacccctcactc

SEQ ID NO: 3879023 - DNA, 16 bp, Homo sapiens
ctgggtctcactcctg

SEQ ID NO: 3879024 - DNA, 24 bp, Homo sapiens
ctgggtgagaatcctgcctctccc

SEQ ID NO: 3879025 - DNA, 13 bp, Homo sapiens
ctgggtggcctcg

SEQ ID NO: 3879026 - DNA, 21 bp, Homo sapiens
ctgggtggctactctgtgcca

SEQ ID NO: 3879027 - DNA, 22 bp, Homo sapiens
ctgggtggctactctgtgccag

SEQ ID NO: 3879028 - DNA, 22 bp, Homo sapiens
ctgggtggggctgctcctccag

SEQ ID NO: 3879029 - DNA, 12 bp, Homo sapiens
ctgggtgggtga

SEQ ID NO: 3879030 - DNA, 22 bp, Homo sapiens
ctgggtgtggccccgcagtgcc

SEQ ID NO: 3879031 - DNA, 22 bp, Homo sapiens
ctgggtttattacatggcagtg

SEQ ID NO: 3879032 - DNA, 18 bp, Homo sapiens
ctgggttttctaactgta

SEQ ID NO: 3879033 - DNA, 20 bp, Homo sapiens
ctgggttttctaactgtaaa

SEQ ID NO: 3879034 - DNA, 19 bp, Homo sapiens
ctggtaaactatttgtctt

SEQ ID NO: 3879035 - DNA, 21 bp, Homo sapiens
ctggtatgaacttgaggacac

SEQ ID NO: 3879036 - DNA, 23 bp, Homo sapiens
ctggtatgaacttgaggacacat

SEQ ID NO: 3879037 - DNA, 22 bp, Homo sapiens
ctggtcacaggactctgcctcc

SEQ ID NO: 3879038 - DNA, 23 bp, Homo sapiens
ctggtcacaggactctgcctcct

SEQ ID NO: 3879039 - DNA, 18 bp, Homo sapiens
ctggtccctcgtccacag

SEQ ID NO: 3879040 - DNA, 19 bp, Homo sapiens
ctggtcctgagggtcccca

SEQ ID NO: 3879041 - DNA, 15 bp, Homo sapiens
ctggtctaggagctg

SEQ ID NO: 3879042 - DNA, 17 bp, Homo sapiens
ctggtctattttgattt

SEQ ID NO: 3879043 - DNA, 14 bp, Homo sapiens
ctggtctcctccca

SEQ ID NO: 3879044 - DNA, 22 bp, Homo sapiens
ctggtctcctcccaaaatacta

SEQ ID NO: 3879045 - DNA, 18 bp, Homo sapiens
ctggtctgtgctgccctg

SEQ ID NO: 3879046 - DNA, 18 bp, Homo sapiens
ctggtcttgtggaattgg

SEQ ID NO: 3879047 - DNA, 21 bp, Homo sapiens
ctggtgactgcgatcttcaga

SEQ ID NO: 3879048 - DNA, 20 bp, Homo sapiens
ctggtgaggcccagcctgtc

SEQ ID NO: 3879049 - DNA, 16 bp, Homo sapiens
ctggtgcactggcccc

SEQ ID NO: 3879050 - DNA, 16 bp, Homo sapiens
ctggtgcctatttatt

SEQ ID NO: 3879051 - DNA, 15 bp, Homo sapiens
ctggtgctgcaagga

SEQ ID NO: 3879052 - DNA, 12 bp, Homo sapiens
ctggtgctgtgg

SEQ ID NO: 3879053 - DNA, 17 bp, Homo sapiens
ctggtgctgtggccagg

SEQ ID NO: 3879054 - DNA, 23 bp, Homo sapiens
ctggtgctgtggccagggtgaga

SEQ ID NO: 3879055 - DNA, 21 bp, Homo sapiens
ctggtgcttctcctctcctag

SEQ ID NO: 3879056 - DNA, 12 bp, Homo sapiens
ctggtggcacca

SEQ ID NO: 3879057 - DNA, 22 bp, Homo sapiens
ctggtggcaccagatgcaacct

SEQ ID NO: 3879058 - DNA, 20 bp, Homo sapiens
ctggtggcccgacagcctgg

SEQ ID NO: 3879059 - DNA, 21 bp, Homo sapiens
ctggtggcccgacagcctggc

SEQ ID NO: 3879060 - DNA, 14 bp, Homo sapiens
ctggtggggcagct

SEQ ID NO: 3879061 - DNA, 16 bp, Homo sapiens
ctggtggggcagctcc

SEQ ID NO: 3879062 - DNA, 20 bp, Homo sapiens
ctggtggggcagctcctctg

SEQ ID NO: 3879063 - DNA, 14 bp, Homo sapiens
ctggtgtcaggcag

SEQ ID NO: 3879064 - DNA, 23 bp, Homo sapiens
ctggtgttaagatatattttgag

SEQ ID NO: 3879065 - DNA, 19 bp, Homo sapiens
ctggttaattccataaccc

SEQ ID NO: 3879066 - DNA, 14 bp, Homo sapiens
ctggttagaaatgc

SEQ ID NO: 3879067 - DNA, 23 bp, Homo sapiens
ctggttagaaatgcagaatccta

SEQ ID NO: 3879068 - DNA, 19 bp, Homo sapiens
ctggttgcttcagacctga

SEQ ID NO: 3879069 - DNA, 17 bp, Homo sapiens
ctggttggagagctaga

SEQ ID NO: 3879070 - DNA, 14 bp, Homo sapiens
ctggacagctgtgc

SEQ ID NO: 3879071 - DNA, 14 bp, Homo sapiens
ctggaccccgcctc

SEQ ID NO: 3879072 - DNA, 20 bp, Homo sapiens
ctggaccccgcctcccagcc

SEQ ID NO: 3879073 - DNA, 18 bp, Homo sapiens
ctggaccgcttcccagag

SEQ ID NO: 3879074 - DNA, 21 bp, Homo sapiens
ctggaccgcttcccagaggcc

SEQ ID NO: 3879075 - DNA, 13 bp, Homo sapiens
ctggacctgagtc

SEQ ID NO: 3879076 - DNA, 19 bp, Homo sapiens
ctggacgcccagctgaggc

SEQ ID NO: 3879077 - DNA, 15 bp, Homo sapiens
ctggacggggactgg

SEQ ID NO: 3879078 - DNA, 17 bp, Homo sapiens
ctggactcctctgtcca

SEQ ID NO: 3879079 - DNA, 18 bp, Homo sapiens
ctggactcctctgtccag

SEQ ID NO: 3879080 - DNA, 20 bp, Homo sapiens
ctggactcctctgtccaggc

SEQ ID NO: 3879081 - DNA, 22 bp, Homo sapiens
ctggactcctctgtccaggcac

SEQ ID NO: 3879082 - DNA, 15 bp, Homo sapiens
ctggactctggcacc

SEQ ID NO: 3879083 - DNA, 16 bp, Homo sapiens
ctggactgaggaccac

SEQ ID NO: 3879084 - DNA, 17 bp, Homo sapiens
ctggactgggaggtaga

SEQ ID NO: 3879085 - DNA, 23 bp, Homo sapiens
ctggactgggttttgtctctgca

SEQ ID NO: 3879086 - DNA, 15 bp, Homo sapiens
ctggagaactagaga

SEQ ID NO: 3879087 - DNA, 17 bp, Homo sapiens
ctggagaagctgatgct

SEQ ID NO: 3879088 - DNA, 19 bp, Homo sapiens
ctggagaagctgatgcttt

SEQ ID NO: 3879089 - DNA, 21 bp, Homo sapiens
ctggagaccgcttcacccctg

SEQ ID NO: 3879090 - DNA, 22 bp, Homo sapiens
ctggagaccgcttcacccctgc

SEQ ID NO: 3879091 - DNA, 17 bp, Homo sapiens
ctggagagaagtttctg

SEQ ID NO: 3879092 - DNA, 19 bp, Homo sapiens
ctggagagccagaacctgg

SEQ ID NO: 3879093 - DNA, 22 bp, Homo sapiens
ctggagagctagaacctggaga

SEQ ID NO: 3879094 - DNA, 13 bp, Homo sapiens
ctggagaggggcc

SEQ ID NO: 3879095 - DNA, 13 bp, Homo sapiens
ctggagatgatga

SEQ ID NO: 3879096 - DNA, 12 bp, Homo sapiens
ctggagcaagag

SEQ ID NO: 3879097 - DNA, 13 bp, Homo sapiens
ctggagcaccagg

SEQ ID NO: 3879098 - DNA, 15 bp, Homo sapiens
ctggagcaccaggca

SEQ ID NO: 3879099 - DNA, 12 bp, Homo sapiens
ctggagcatctg

SEQ ID NO: 3879100 - DNA, 23 bp, Homo sapiens
ctggagcatctgactcacaagaa

SEQ ID NO: 3879101 - DNA, 15 bp, Homo sapiens
ctggagccagagaga

SEQ ID NO: 3879102 - DNA, 17 bp, Homo sapiens
ctggagcccgagggcct

SEQ ID NO: 3879103 - DNA, 14 bp, Homo sapiens
ctggagctggcttt

SEQ ID NO: 3879104 - DNA, 12 bp, Homo sapiens
ctggaggacctg

SEQ ID NO: 3879105 - DNA, 16 bp, Homo sapiens
ctggaggacctgagcc

SEQ ID NO: 3879106 - DNA, 19 bp, Homo sapiens
ctggaggacctgagcctgc

SEQ ID NO: 3879107 - DNA, 21 bp, Homo sapiens
ctggaggacctgagcctgccg

SEQ ID NO: 3879108 - DNA, 19 bp, Homo sapiens
ctggaggatccctccatcc

SEQ ID NO: 3879109 - DNA, 16 bp, Homo sapiens
ctggaggctgcagagc

SEQ ID NO: 3879110 - DNA, 22 bp, Homo sapiens
ctggagggctagaacctggcag

SEQ ID NO: 3879111 - DNA, 19 bp, Homo sapiens
ctggagggctagaatctgg

SEQ ID NO: 3879112 - DNA, 21 bp, Homo sapiens
ctggaggggctagaacctaga

SEQ ID NO: 3879113 - DNA, 14 bp, Homo sapiens
ctggagtcccctgg

SEQ ID NO: 3879114 - DNA, 20 bp, Homo sapiens
ctggagtcccctgggcctgg

SEQ ID NO: 3879115 - DNA, 14 bp, Homo sapiens
ctggagtctccagt

SEQ ID NO: 3879116 - DNA, 21 bp, Homo sapiens
ctggagtgaggcttccaggct

SEQ ID NO: 3879117 - DNA, 20 bp, Homo sapiens
ctggatatgttgttaaacac

SEQ ID NO: 3879118 - DNA, 19 bp, Homo sapiens
ctggatcagcgtggccttg

SEQ ID NO: 3879119 - DNA, 17 bp, Homo sapiens
ctggatccatcaggcca

SEQ ID NO: 3879120 - DNA, 13 bp, Homo sapiens
ctggatgagactt

SEQ ID NO: 3879121 - DNA, 21 bp, Homo sapiens
ctggatggaggaaaaccaagc

SEQ ID NO: 3879122 - DNA, 21 bp, Homo sapiens
ctggatggatttgaagcaaag

SEQ ID NO: 3879123 - DNA, 19 bp, Homo sapiens
ctggatgtcccctgtccca

SEQ ID NO: 3879124 - DNA, 17 bp, Homo sapiens
ctggatgtgtggggcat

SEQ ID NO: 3879125 - DNA, 22 bp, Homo sapiens
ctggattgatcggagcctcctc

SEQ ID NO: 3879126 - DNA, 21 bp, Homo sapiens
ctggcaaaggtggctctccag

SEQ ID NO: 3879127 - DNA, 22 bp, Homo sapiens
ctggcaagctagaacctggagg

SEQ ID NO: 3879128 - DNA, 21 bp, Homo sapiens
ctggcaatgaaaaattctcag

SEQ ID NO: 3879129 - DNA, 14 bp, Homo sapiens
ctggcacaggactg

SEQ ID NO: 3879130 - DNA, 18 bp, Homo sapiens
ctggcacaggactgattc

SEQ ID NO: 3879131 - DNA, 15 bp, Homo sapiens
ctggcacagggcagt

SEQ ID NO: 3879132 - DNA, 17 bp, Homo sapiens
ctggcacagggcagtgg

SEQ ID NO: 3879133 - DNA, 21 bp, Homo sapiens
ctggcacagttttctgagaaa

SEQ ID NO: 3879134 - DNA, 18 bp, Homo sapiens
ctggcacttagcccaaga

SEQ ID NO: 3879135 - DNA, 14 bp, Homo sapiens
ctggcacttggaga

SEQ ID NO: 3879136 - DNA, 18 bp, Homo sapiens
ctggcagagcccccaagg

SEQ ID NO: 3879137 - DNA, 14 bp, Homo sapiens
ctggcagccacact

SEQ ID NO: 3879138 - DNA, 22 bp, Homo sapiens
ctggcagccacacttctcagga

SEQ ID NO: 3879139 - DNA, 17 bp, Homo sapiens
ctggcagccgtgccttc

SEQ ID NO: 3879140 - DNA, 18 bp, Homo sapiens
ctggcagctcctctcctt

SEQ ID NO: 3879141 - DNA, 20 bp, Homo sapiens
ctggcagctgagagccctgc

SEQ ID NO: 3879142 - DNA, 14 bp, Homo sapiens
ctggcaggaagtct

SEQ ID NO: 3879143 - DNA, 18 bp, Homo sapiens
ctggcagggtgggatgga

SEQ ID NO: 3879144 - DNA, 21 bp, Homo sapiens
ctggcaggtgcagatgggctg

SEQ ID NO: 3879145 - DNA, 21 bp, Homo sapiens
ctggcatgtcagagccaggct

SEQ ID NO: 3879146 - DNA, 16 bp, Homo sapiens
ctggcattaattatta

SEQ ID NO: 3879147 - DNA, 18 bp, Homo sapiens
ctggcattaattattaat

SEQ ID NO: 3879148 - DNA, 15 bp, Homo sapiens
ctggcattacagctg

SEQ ID NO: 3879149 - DNA, 13 bp, Homo sapiens
ctggccaagctga

SEQ ID NO: 3879150 - DNA, 15 bp, Homo sapiens
ctggccaagctgagg

SEQ ID NO: 3879151 - DNA, 19 bp, Homo sapiens
ctggccaagctgaggtgcc

SEQ ID NO: 3879152 - DNA, 21 bp, Homo sapiens
ctggccaagctgaggtgccca

SEQ ID NO: 3879153 - DNA, 22 bp, Homo sapiens
ctggccaagctgaggtgcccag

SEQ ID NO: 3879154 - DNA, 10 bp, Homo sapiens
ctggccaccc

SEQ ID NO: 3879155 - DNA, 13 bp, Homo sapiens
ctggccaccctgg

SEQ ID NO: 3879156 - DNA, 22 bp, Homo sapiens
ctgctgctgtaactgctgagcc

SEQ ID NO: 3879157 - DNA, 20 bp, Homo sapiens
ctgctggcacctcagacaat

SEQ ID NO: 3879158 - DNA, 14 bp, Homo sapiens
ctgctggcctggat

SEQ ID NO: 3879159 - DNA, 15 bp, Homo sapiens
ctgctggcctggatc

SEQ ID NO: 3879160 - DNA, 16 bp, Homo sapiens
ctgctggcctggatct

SEQ ID NO: 3879161 - DNA, 14 bp, Homo sapiens
ctgctggctgcctt

SEQ ID NO: 3879162 - DNA, 19 bp, Homo sapiens
ctgctgggaccccagctag

SEQ ID NO: 3879163 - DNA, 22 bp, Homo sapiens
ctgctgggaccccagctagggc

SEQ ID NO: 3879164 - DNA, 23 bp, Homo sapiens
ctgctgggaccccagctagggct

SEQ ID NO: 3879165 - DNA, 14 bp, Homo sapiens
ctgctgggctctcc

SEQ ID NO: 3879166 - DNA, 17 bp, Homo sapiens
ctgctgggctctccacc

SEQ ID NO: 3879167 - DNA, 18 bp, Homo sapiens
ctgctgggctctccacct

SEQ ID NO: 3879168 - DNA, 19 bp, Homo sapiens
ctgctgggctctccacctc

SEQ ID NO: 3879169 - DNA, 12 bp, Homo sapiens
ctgctggggcat

SEQ ID NO: 3879170 - DNA, 14 bp, Homo sapiens
ctgctggggcatgt

SEQ ID NO: 3879171 - DNA, 15 bp, Homo sapiens
ctgctggggcatgtg

SEQ ID NO: 3879172 - DNA, 21 bp, Homo sapiens
ctgctggggcatgtgtgcctg

SEQ ID NO: 3879173 - DNA, 20 bp, Homo sapiens
ctgctggtaatttgtatctg

SEQ ID NO: 3879174 - DNA, 18 bp, Homo sapiens
ctgctggtgcagagctga

SEQ ID NO: 3879175 - DNA, 15 bp, Homo sapiens
ctgctgtaactgctg

SEQ ID NO: 3879176 - DNA, 17 bp, Homo sapiens
ctgctgtaactgctgag

SEQ ID NO: 3879177 - DNA, 18 bp, Homo sapiens
ctgctgtaactgctgagc

SEQ ID NO: 3879178 - DNA, 21 bp, Homo sapiens
ctgctgtaactgctgagccac

SEQ ID NO: 3879179 - DNA, 14 bp, Homo sapiens
ctgctgtggcctca

SEQ ID NO: 3879180 - DNA, 15 bp, Homo sapiens
ctgctgtggcctcac

SEQ ID NO: 3879181 - DNA, 19 bp, Homo sapiens
ctgctgtgggagagcgaag

SEQ ID NO: 3879182 - DNA, 16 bp, Homo sapiens
ctgctgttgccatagc

SEQ ID NO: 3879183 - DNA, 18 bp, Homo sapiens
ctgctgttgctggactga

SEQ ID NO: 3879184 - DNA, 15 bp, Homo sapiens
ctgcttacccttcac

SEQ ID NO: 3879185 - DNA, 12 bp, Homo sapiens
ctgcttacctga

SEQ ID NO: 3879186 - DNA, 14 bp, Homo sapiens
ctgcttacctgacg

SEQ ID NO: 3879187 - DNA, 24 bp, Homo sapiens
ctgcttccaattttctggaataca

SEQ ID NO: 3879188 - DNA, 19 bp, Homo sapiens
ctgcttcctaggccccaga

SEQ ID NO: 3879189 - DNA, 22 bp, Homo sapiens
ctgcttcctaggccccagagca

SEQ ID NO: 3879190 - DNA, 19 bp, Homo sapiens
ctgcttccttctgcaccca

SEQ ID NO: 3879191 - DNA, 15 bp, Homo sapiens
ctgcttctagtattt

SEQ ID NO: 3879192 - DNA, 15 bp, Homo sapiens
ctgcttctgtccagg

SEQ ID NO: 3879193 - DNA, 16 bp, Homo sapiens
ctgcttctgtccagga

SEQ ID NO: 3879194 - DNA, 21 bp, Homo sapiens
ctgcttgactatcacatacaa

SEQ ID NO: 3879195 - DNA, 22 bp, Homo sapiens
ctgcttgactatcacatacaat

SEQ ID NO: 3879196 - DNA, 22 bp, Homo sapiens
ctgcttggggggtgatgagggc

SEQ ID NO: 3879197 - DNA, 17 bp, Homo sapiens
ctgcttggtcaaatccc

SEQ ID NO: 3879198 - DNA, 17 bp, Homo sapiens
ctgcttgtccctgccca

SEQ ID NO: 3879199 - DNA, 13 bp, Homo sapiens
ctgcttgtcctgc

SEQ ID NO: 3879200 - DNA, 16 bp, Homo sapiens
ctgcttgtcctgctct

SEQ ID NO: 3879201 - DNA, 18 bp, Homo sapiens
ctgctttccagcctgggc

SEQ ID NO: 3879202 - DNA, 20 bp, Homo sapiens
ctgctttgggctgccctggt

SEQ ID NO: 3879203 - DNA, 21 bp, Homo sapiens
ctgctttgggctgccctggtg

SEQ ID NO: 3879204 - DNA, 22 bp, Homo sapiens
ctgctttgggctgccctggtgc

SEQ ID NO: 3879205 - DNA, 14 bp, Homo sapiens
ctgcttttccagga

SEQ ID NO: 3879206 - DNA, 16 bp, Homo sapiens
ctgcttttccaggatc

SEQ ID NO: 3879207 - DNA, 17 bp, Homo sapiens
ctgcttttccaggatcc

SEQ ID NO: 3879208 - DNA, 19 bp, Homo sapiens
ctgcttttccaggatcctg

SEQ ID NO: 3879209 - DNA, 23 bp, Homo sapiens
ctgcttttccaggatcctgcagg

SEQ ID NO: 3879210 - DNA, 15 bp, Homo sapiens
ctgcttttgctgggg

SEQ ID NO: 3879211 - DNA, 16 bp, Homo sapiens
ctgcttttgctggggt

SEQ ID NO: 3879212 - DNA, 19 bp, Homo sapiens
ctggaaaaaaaatatatat

SEQ ID NO: 3879213 - DNA, 17 bp, Homo sapiens
ctggaaaactcaggatt

SEQ ID NO: 3879214 - DNA, 20 bp, Homo sapiens
ctggaaaccacacttcttga

SEQ ID NO: 3879215 - DNA, 23 bp, Homo sapiens
ctggaaatatcagttactcagcc

SEQ ID NO: 3879216 - DNA, 20 bp, Homo sapiens
ctggaaatctgttttgtata

SEQ ID NO: 3879217 - DNA, 23 bp, Homo sapiens
ctggaacatgggcattgggttct

SEQ ID NO: 3879218 - DNA, 20 bp, Homo sapiens
ctggaaccagggaggagagg

SEQ ID NO: 3879219 - DNA, 23 bp, Homo sapiens
ctggaaccagggaggagaggaaa

SEQ ID NO: 3879220 - DNA, 12 bp, Homo sapiens
ctggaagagagg

SEQ ID NO: 3879221 - DNA, 16 bp, Homo sapiens
ctggaagcctggactc

SEQ ID NO: 3879222 - DNA, 12 bp, Homo sapiens
ctggaagctgag

SEQ ID NO: 3879223 - DNA, 14 bp, Homo sapiens
ctggaagctgagca

SEQ ID NO: 3879224 - DNA, 20 bp, Homo sapiens
ctggaagctgggaggtcagg

SEQ ID NO: 3879225 - DNA, 12 bp, Homo sapiens
ctggaagctgtg

SEQ ID NO: 3879226 - DNA, 16 bp, Homo sapiens
ctggaagctgtgtcct

SEQ ID NO: 3879227 - DNA, 14 bp, Homo sapiens
ctggaaggcagggc

SEQ ID NO: 3879228 - DNA, 17 bp, Homo sapiens
ctggaaggcagggcaga

SEQ ID NO: 3879229 - DNA, 21 bp, Homo sapiens
ctggaaggcagggcagaggga

SEQ ID NO: 3879230 - DNA, 16 bp, Homo sapiens
ctggaaggctggctga

SEQ ID NO: 3879231 - DNA, 17 bp, Homo sapiens
ctggaaggctggctgag

SEQ ID NO: 3879232 - DNA, 19 bp, Homo sapiens
ctggaaggctggctgagtg

SEQ ID NO: 3879233 - DNA, 22 bp, Homo sapiens
ctggaagggctagaacctgtag

SEQ ID NO: 3879234 - DNA, 16 bp, Homo sapiens
ctggaatcaatttccc

SEQ ID NO: 3879235 - DNA, 18 bp, Homo sapiens
ctggaatcaatttcccag

SEQ ID NO: 3879236 - DNA, 22 bp, Homo sapiens
ctggaatcaatttcccagaagg

SEQ ID NO: 3879237 - DNA, 19 bp, Homo sapiens
ctggaatcgatctgtactg

SEQ ID NO: 3879238 - DNA, 22 bp, Homo sapiens
ctggaattcagcaccctgggtg

SEQ ID NO: 3879239 - DNA, 14 bp, Homo sapiens
ctggacaacccaga

SEQ ID NO: 3879240 - DNA, 14 bp, Homo sapiens
ctggacaagaagct

SEQ ID NO: 3879241 - DNA, 22 bp, Homo sapiens
ctggacacttatggggacagca

SEQ ID NO: 3879242 - DNA, 19 bp, Homo sapiens
ctgccataccgctggggaa

SEQ ID NO: 3879243 - DNA, 14 bp, Homo sapiens
ctgccatgccactg

SEQ ID NO: 3879244 - DNA, 16 bp, Homo sapiens
ctgccatgccactgcc

SEQ ID NO: 3879245 - DNA, 18 bp, Homo sapiens
ctgccatgccactgccag

SEQ ID NO: 3879246 - DNA, 19 bp, Homo sapiens
ctgccatgccactgccagg

SEQ ID NO: 3879247 - DNA, 19 bp, Homo sapiens
ctgccatgcctcaagaaca

SEQ ID NO: 3879248 - DNA, 21 bp, Homo sapiens
ctgccatgcctcaagaacacc

SEQ ID NO: 3879249 - DNA, 17 bp, Homo sapiens
ctgcccaacctgctctc

SEQ ID NO: 3879250 - DNA, 19 bp, Homo sapiens
ctgcccaacctgctctcct

SEQ ID NO: 3879251 - DNA, 16 bp, Homo sapiens
ctgcccaatgctttgg

SEQ ID NO: 3879252 - DNA, 13 bp, Homo sapiens
ctgcccacttcag

SEQ ID NO: 3879253 - DNA, 22 bp, Homo sapiens
ctgcccagaattcccagctgtc

SEQ ID NO: 3879254 - DNA, 17 bp, Homo sapiens
ctgcccaggagagccag

SEQ ID NO: 3879255 - DNA, 19 bp, Homo sapiens
ctgcccatacccctgcctg

SEQ ID NO: 3879256 - DNA, 22 bp, Homo sapiens
ctgcccatgtgtcccctcactc

SEQ ID NO: 3879257 - DNA, 16 bp, Homo sapiens
ctgccccaactcctgg

SEQ ID NO: 3879258 - DNA, 17 bp, Homo sapiens
ctgccccaactcctgga

SEQ ID NO: 3879259 - DNA, 12 bp, Homo sapiens
ctgccccaagca

SEQ ID NO: 3879260 - DNA, 19 bp, Homo sapiens
ctgccccaagcagccagcc

SEQ ID NO: 3879261 - DNA, 14 bp, Homo sapiens
ctgccccaagcccc

SEQ ID NO: 3879262 - DNA, 12 bp, Homo sapiens
ctgccccaccct

SEQ ID NO: 3879263 - DNA, 13 bp, Homo sapiens
ctgccccagaggc

SEQ ID NO: 3879264 - DNA, 13 bp, Homo sapiens
ctgccccagcgcg

SEQ ID NO: 3879265 - DNA, 19 bp, Homo sapiens
ctgccccagggctcccggc

SEQ ID NO: 3879266 - DNA, 12 bp, Homo sapiens
ctgcccccatcc

SEQ ID NO: 3879267 - DNA, 20 bp, Homo sapiens
ctgcccccatcccacatgat

SEQ ID NO: 3879268 - DNA, 21 bp, Homo sapiens
ctgccccgttccctgtcagag

SEQ ID NO: 3879269 - DNA, 12 bp, Homo sapiens
ctgccctcaggg

SEQ ID NO: 3879270 - DNA, 14 bp, Homo sapiens
ctgccctcccatgt

SEQ ID NO: 3879271 - DNA, 23 bp, Homo sapiens
ctgccctcccatgttgcatgcct

SEQ ID NO: 3879272 - DNA, 16 bp, Homo sapiens
ctgccctccctggggt

SEQ ID NO: 3879273 - DNA, 14 bp, Homo sapiens
ctgccctctctcag

SEQ ID NO: 3879274 - DNA, 13 bp, Homo sapiens
ctgccctgccacc

SEQ ID NO: 3879275 - DNA, 15 bp, Homo sapiens
ctgccctgccacctg

SEQ ID NO: 3879276 - DNA, 18 bp, Homo sapiens
ctgccctgccacctgtct

SEQ ID NO: 3879277 - DNA, 20 bp, Homo sapiens
ctgccctgccacctgtctgt

SEQ ID NO: 3879278 - DNA, 15 bp, Homo sapiens
ctgccctgccctgcc

SEQ ID NO: 3879279 - DNA, 14 bp, Homo sapiens
ctgccctgcctgcc

SEQ ID NO: 3879280 - DNA, 15 bp, Homo sapiens
ctgccctgcctgccc

SEQ ID NO: 3879281 - DNA, 16 bp, Homo sapiens
ctgccctgcctgccca

SEQ ID NO: 3879282 - DNA, 11 bp, Homo sapiens
ctgccctgctg

SEQ ID NO: 3879283 - DNA, 14 bp, Homo sapiens
ctgccctggaggga

SEQ ID NO: 3879284 - DNA, 12 bp, Homo sapiens
ctgccctggtgc

SEQ ID NO: 3879285 - DNA, 15 bp, Homo sapiens
ctgccctggtgctgc

SEQ ID NO: 3879286 - DNA, 21 bp, Homo sapiens
ctgccctgtaccccagcactt

SEQ ID NO: 3879287 - DNA, 14 bp, Homo sapiens
ctgcccttcgctgc

SEQ ID NO: 3879288 - DNA, 16 bp, Homo sapiens
ctgcccttcgctgcca

SEQ ID NO: 3879289 - DNA, 19 bp, Homo sapiens
ctgcccttcgctgccagga

SEQ ID NO: 3879290 - DNA, 21 bp, Homo sapiens
ctgcccttcgctgccaggaca

SEQ ID NO: 3879291 - DNA, 12 bp, Homo sapiens
ctgcccttgttt

SEQ ID NO: 3879292 - DNA, 21 bp, Homo sapiens
ctgcccttgtttggggcagga

SEQ ID NO: 3879293 - DNA, 23 bp, Homo sapiens
ctgcccttgtttggggcaggagt

SEQ ID NO: 3879294 - DNA, 19 bp, Homo sapiens
ctgccgacctcgtcctccc

SEQ ID NO: 3879295 - DNA, 14 bp, Homo sapiens
ctgccgagcaaccg

SEQ ID NO: 3879296 - DNA, 16 bp, Homo sapiens
ctgccgagcaaccgtg

SEQ ID NO: 3879297 - DNA, 21 bp, Homo sapiens
ctgccgagcaaccgtggccct

SEQ ID NO: 3879298 - DNA, 17 bp, Homo sapiens
ctgccgcaccccagagt

SEQ ID NO: 3879299 - DNA, 14 bp, Homo sapiens
ctgccgcctcccag

SEQ ID NO: 3879300 - DNA, 13 bp, Homo sapiens
ctgccgctgcacc

SEQ ID NO: 3879301 - DNA, 14 bp, Homo sapiens
ctgccgctgcacca

SEQ ID NO: 3879302 - DNA, 15 bp, Homo sapiens
ctgccgctgcaccac

SEQ ID NO: 3879303 - DNA, 16 bp, Homo sapiens
ctgccgctgcaccacg

SEQ ID NO: 3879304 - DNA, 18 bp, Homo sapiens
ctgccgctgccgctgcac

SEQ ID NO: 3879305 - DNA, 20 bp, Homo sapiens
ctgccgctgccgctgcacca

SEQ ID NO: 3879306 - DNA, 19 bp, Homo sapiens
ctgccgggttctagtctcc

SEQ ID NO: 3879307 - DNA, 21 bp, Homo sapiens
ctgccgggttctagtctcctt

SEQ ID NO: 3879308 - DNA, 23 bp, Homo sapiens
ctgccgggttctagtctcctttg

SEQ ID NO: 3879309 - DNA, 12 bp, Homo sapiens
ctgcctagaaaa

SEQ ID NO: 3879310 - DNA, 18 bp, Homo sapiens
ctgcctatttattggggt

SEQ ID NO: 3879311 - DNA, 22 bp, Homo sapiens
ctgcctccaagatttcagaagc

SEQ ID NO: 3879312 - DNA, 16 bp, Homo sapiens
ctgcctcccagccctg

SEQ ID NO: 3879313 - DNA, 21 bp, Homo sapiens
ctgcctcccagccctgccagg

SEQ ID NO: 3879314 - DNA, 15 bp, Homo sapiens
ctgcctctactggga

SEQ ID NO: 3879315 - DNA, 17 bp, Homo sapiens
ctgcctctactgggaag

SEQ ID NO: 3879316 - DNA, 18 bp, Homo sapiens
ctgcctctactgggaagg

SEQ ID NO: 3879317 - DNA, 16 bp, Homo sapiens
ctgcctctcacacaca

SEQ ID NO: 3879318 - DNA, 15 bp, Homo sapiens
ctgcctctctgctcc

SEQ ID NO: 3879319 - DNA, 22 bp, Homo sapiens
ctgcctctctgctccagagaga

SEQ ID NO: 3879320 - DNA, 16 bp, Homo sapiens
ctgcctctgccatgcc

SEQ ID NO: 3879321 - DNA, 16 bp, Homo sapiens
ctgcctgagcccagga

SEQ ID NO: 3879322 - DNA, 17 bp, Homo sapiens
ctgcctgataccctgct

SEQ ID NO: 3879323 - DNA, 19 bp, Homo sapiens
ctgcctgcagcctccccca

SEQ ID NO: 3879324 - DNA, 17 bp, Homo sapiens
ctgcctgccgcccaaag

SEQ ID NO: 3879325 - DNA, 15 bp, Homo sapiens
ctgcctgcggcccag

SEQ ID NO: 3879326 - DNA, 13 bp, Homo sapiens
ctgcctgcttggg

SEQ ID NO: 3879327 - DNA, 15 bp, Homo sapiens
ctgcctggaggacct

SEQ ID NO: 3879328 - DNA, 21 bp, Homo sapiens
ctgcctggaggacctgagcct

SEQ ID NO: 3879329 - DNA, 12 bp, Homo sapiens
ctgcactgaaaa

SEQ ID NO: 3879330 - DNA, 19 bp, Homo sapiens
ctgcactgacccacagcct

SEQ ID NO: 3879331 - DNA, 17 bp, Homo sapiens
ctgcactgggtgtggcc

SEQ ID NO: 3879332 - DNA, 16 bp, Homo sapiens
ctgcacttcagacacc

SEQ ID NO: 3879333 - DNA, 20 bp, Homo sapiens
ctgcagaacgtattggtcca

SEQ ID NO: 3879334 - DNA, 13 bp, Homo sapiens
ctgcagaccctgc

SEQ ID NO: 3879335 - DNA, 14 bp, Homo sapiens
ctgcagagagaagc

SEQ ID NO: 3879336 - DNA, 15 bp, Homo sapiens
ctgcagatagccaga

SEQ ID NO: 3879337 - DNA, 20 bp, Homo sapiens
ctgcagatagccagacacat

SEQ ID NO: 3879338 - DNA, 24 bp, Homo sapiens
ctgcagatagccagacacatggct

SEQ ID NO: 3879339 - DNA, 13 bp, Homo sapiens
ctgcagcaactcc

SEQ ID NO: 3879340 - DNA, 17 bp, Homo sapiens
ctgcagcaactcccacg

SEQ ID NO: 3879341 - DNA, 14 bp, Homo sapiens
ctgcagccagccca

SEQ ID NO: 3879342 - DNA, 17 bp, Homo sapiens
ctgcagccagcccagcc

SEQ ID NO: 3879343 - DNA, 24 bp, Homo sapiens
ctgcagcccggcgccaccatcctg

SEQ ID NO: 3879344 - DNA, 13 bp, Homo sapiens
ctgcagcctcccc

SEQ ID NO: 3879345 - DNA, 14 bp, Homo sapiens
ctgcagcctccccc

SEQ ID NO: 3879346 - DNA, 13 bp, Homo sapiens
ctgcagcctcctc

SEQ ID NO: 3879347 - DNA, 16 bp, Homo sapiens
ctgcagcctcctcctg

SEQ ID NO: 3879348 - DNA, 17 bp, Homo sapiens
ctgcagcctcctcctga

SEQ ID NO: 3879349 - DNA, 20 bp, Homo sapiens
ctgcagctatgcgcaatgtg

SEQ ID NO: 3879350 - DNA, 21 bp, Homo sapiens
ctgcagctatgcgcaatgtgg

SEQ ID NO: 3879351 - DNA, 19 bp, Homo sapiens
ctgcagctgcaccatcaca

SEQ ID NO: 3879352 - DNA, 12 bp, Homo sapiens
ctgcagctgctg

SEQ ID NO: 3879353 - DNA, 19 bp, Homo sapiens
ctgcagctgggccccatgc

SEQ ID NO: 3879354 - DNA, 21 bp, Homo sapiens
ctgcagctgggccccatgctc

SEQ ID NO: 3879355 - DNA, 24 bp, Homo sapiens
ctgcagctgggccccatgctctgc

SEQ ID NO: 3879356 - DNA, 12 bp, Homo sapiens
ctgcagcttcct

SEQ ID NO: 3879357 - DNA, 13 bp, Homo sapiens
ctgcagcttcctg

SEQ ID NO: 3879358 - DNA, 16 bp, Homo sapiens
ctgcagcttgtagcca

SEQ ID NO: 3879359 - DNA, 15 bp, Homo sapiens
ctgcaggaacgagca

SEQ ID NO: 3879360 - DNA, 19 bp, Homo sapiens
ctgcaggaacgagcactgg

SEQ ID NO: 3879361 - DNA, 22 bp, Homo sapiens
ctgcaggaacgagcactggcca

SEQ ID NO: 3879362 - DNA, 24 bp, Homo sapiens
ctgcaggaacgagcactggccaga

SEQ ID NO: 3879363 - DNA, 14 bp, Homo sapiens
ctgcaggccccgct

SEQ ID NO: 3879364 - DNA, 22 bp, Homo sapiens
ctgcaggccccgcttgtccagc

SEQ ID NO: 3879365 - DNA, 17 bp, Homo sapiens
ctgcagggactgccagt

SEQ ID NO: 3879366 - DNA, 23 bp, Homo sapiens
ctgcagggagcaactctccactc

SEQ ID NO: 3879367 - DNA, 16 bp, Homo sapiens
ctgcagggccaagcac

SEQ ID NO: 3879368 - DNA, 20 bp, Homo sapiens
ctgcagggggtgtgtctgct

SEQ ID NO: 3879369 - DNA, 17 bp, Homo sapiens
ctgcagtatttataaga

SEQ ID NO: 3879370 - DNA, 16 bp, Homo sapiens
ctgcagtgaggctgtg

SEQ ID NO: 3879371 - DNA, 20 bp, Homo sapiens
ctgcatcagctgctgaaaca

SEQ ID NO: 3879372 - DNA, 14 bp, Homo sapiens
ctgcatctactcag

SEQ ID NO: 3879373 - DNA, 20 bp, Homo sapiens
ctgcatgcctggtctttcct

SEQ ID NO: 3879374 - DNA, 22 bp, Homo sapiens
ctgcatgcctggtctttcctct

SEQ ID NO: 3879375 - DNA, 23 bp, Homo sapiens
ctgcatgcctggtctttcctctg

SEQ ID NO: 3879376 - DNA, 12 bp, Homo sapiens
ctgcatgctctg

SEQ ID NO: 3879377 - DNA, 13 bp, Homo sapiens
ctgcatgctctgg

SEQ ID NO: 3879378 - DNA, 14 bp, Homo sapiens
ctgcatgctctgga

SEQ ID NO: 3879379 - DNA, 16 bp, Homo sapiens
ctgcatgctctggaag

SEQ ID NO: 3879380 - DNA, 17 bp, Homo sapiens
ctgcatgtgttgtacaa

SEQ ID NO: 3879381 - DNA, 15 bp, Homo sapiens
ctgcattagaaatta

SEQ ID NO: 3879382 - DNA, 18 bp, Homo sapiens
ctgcatttataaatgtgt

SEQ ID NO: 3879383 - DNA, 13 bp, Homo sapiens
ctgcatttctgag

SEQ ID NO: 3879384 - DNA, 14 bp, Homo sapiens
ctgcatttgtgaaa

SEQ ID NO: 3879385 - DNA, 15 bp, Homo sapiens
ctgcatttgtgaaat

SEQ ID NO: 3879386 - DNA, 12 bp, Homo sapiens
ctgccaagagag

SEQ ID NO: 3879387 - DNA, 12 bp, Homo sapiens
ctgccacacagg

SEQ ID NO: 3879388 - DNA, 22 bp, Homo sapiens
ctgccacacttcaggctcttct

SEQ ID NO: 3879389 - DNA, 12 bp, Homo sapiens
ctgccacagaga

SEQ ID NO: 3879390 - DNA, 18 bp, Homo sapiens
ctgccaccaccagaaagc

SEQ ID NO: 3879391 - DNA, 14 bp, Homo sapiens
ctgccaccacgtct

SEQ ID NO: 3879392 - DNA, 17 bp, Homo sapiens
ctgccaccacgtctgcc

SEQ ID NO: 3879393 - DNA, 20 bp, Homo sapiens
ctgccaccacgtctgccagg

SEQ ID NO: 3879394 - DNA, 12 bp, Homo sapiens
ctgccaccagtc

SEQ ID NO: 3879395 - DNA, 14 bp, Homo sapiens
ctgccaccatcctg

SEQ ID NO: 3879396 - DNA, 22 bp, Homo sapiens
ctgccacccaggcaggccctgc

SEQ ID NO: 3879397 - DNA, 19 bp, Homo sapiens
ctgccacccgcttcctgtt

SEQ ID NO: 3879398 - DNA, 11 bp, Homo sapiens
ctgccacctcc

SEQ ID NO: 3879399 - DNA, 14 bp, Homo sapiens
ctgccacctcccct

SEQ ID NO: 3879400 - DNA, 12 bp, Homo sapiens
ctgccacctgtc

SEQ ID NO: 3879401 - DNA, 11 bp, Homo sapiens
ctgccagccat

SEQ ID NO: 3879402 - DNA, 11 bp, Homo sapiens
ctgccaggaca

SEQ ID NO: 3879403 - DNA, 13 bp, Homo sapiens
ctgccaggacacc

SEQ ID NO: 3879404 - DNA, 14 bp, Homo sapiens
ctgccaggacacct

SEQ ID NO: 3879405 - DNA, 17 bp, Homo sapiens
ctgccaggacacctgcc

SEQ ID NO: 3879406 - DNA, 14 bp, Homo sapiens
ctgccaggcacctg

SEQ ID NO: 3879407 - DNA, 20 bp, Homo sapiens
ctgccaggcacctggcctgc

SEQ ID NO: 3879408 - DNA, 21 bp, Homo sapiens
ctgccaggcacctggcctgct

SEQ ID NO: 3879409 - DNA, 14 bp, Homo sapiens
ctgccaggcgttgg

SEQ ID NO: 3879410 - DNA, 21 bp, Homo sapiens
ctgccaggcgttggtgccact

SEQ ID NO: 3879411 - DNA, 20 bp, Homo sapiens
ctgccagtccccctgcccca

SEQ ID NO: 3879412 - DNA, 21 bp, Homo sapiens
ctgccagtccccctgccccag

SEQ ID NO: 3879413 - DNA, 22 bp, Homo sapiens
ctgccagtccccctgccccagg

SEQ ID NO: 3879414 - DNA, 12 bp, Homo sapiens
ctgccagtgcct

SEQ ID NO: 3879415 - DNA, 22 bp, Homo sapiens
ctgccagtgccttacctcctgc

SEQ ID NO: 3879416 - DNA, 12 bp, Homo sapiens
ctgaaggagatt

SEQ ID NO: 3879417 - DNA, 16 bp, Homo sapiens
ctgaaggagattttcc

SEQ ID NO: 3879418 - DNA, 20 bp, Homo sapiens
ctgaaggagattttccttcc

SEQ ID NO: 3879419 - DNA, 21 bp, Homo sapiens
ctgaaggagattttccttcct

SEQ ID NO: 3879420 - DNA, 16 bp, Homo sapiens
ctgaaggggcacacca

SEQ ID NO: 3879421 - DNA, 21 bp, Homo sapiens
ctgaaggggcacaccactgcc

SEQ ID NO: 3879422 - DNA, 17 bp, Homo sapiens
ctgaagggtgacatccc

SEQ ID NO: 3879423 - DNA, 15 bp, Homo sapiens
ctgaagtcactgcac

SEQ ID NO: 3879424 - DNA, 17 bp, Homo sapiens
ctgaagtcactgcacag

SEQ ID NO: 3879425 - DNA, 22 bp, Homo sapiens
ctgaagtcactgcacagtgcat

SEQ ID NO: 3879426 - DNA, 14 bp, Homo sapiens
ctgaagttctgagc

SEQ ID NO: 3879427 - DNA, 15 bp, Homo sapiens
ctgaataacatttgt

SEQ ID NO: 3879428 - DNA, 21 bp, Homo sapiens
ctgaatataacaacctttaaa

SEQ ID NO: 3879429 - DNA, 19 bp, Homo sapiens
ctgaatctgataggaaaag

SEQ ID NO: 3879430 - DNA, 23 bp, Homo sapiens
ctgaatgcctcaatgtgaccagg

SEQ ID NO: 3879431 - DNA, 22 bp, Homo sapiens
ctgaatggaaggtttgtatatt

SEQ ID NO: 3879432 - DNA, 22 bp, Homo sapiens
ctgaatgtgcctaatggagaag

SEQ ID NO: 3879433 - DNA, 23 bp, Homo sapiens
ctgaatgtgcctaatggagaaga

SEQ ID NO: 3879434 - DNA, 19 bp, Homo sapiens
ctgaatgtttattccttga

SEQ ID NO: 3879435 - DNA, 15 bp, Homo sapiens
ctgaatttcaggcat

SEQ ID NO: 3879436 - DNA, 22 bp, Homo sapiens
ctgaatttcaggcattttgttc

SEQ ID NO: 3879437 - DNA, 16 bp, Homo sapiens
ctgacaacctgtgcag

SEQ ID NO: 3879438 - DNA, 12 bp, Homo sapiens
ctgacaagggct

SEQ ID NO: 3879439 - DNA, 19 bp, Homo sapiens
ctgacacataatttgaatg

SEQ ID NO: 3879440 - DNA, 18 bp, Homo sapiens
ctgacaccgtccctcagt

SEQ ID NO: 3879441 - DNA, 20 bp, Homo sapiens
ctgacaccgtccctcagtga

SEQ ID NO: 3879442 - DNA, 21 bp, Homo sapiens
ctgacacctaccatgctgctt

SEQ ID NO: 3879443 - DNA, 18 bp, Homo sapiens
ctgacagatgtcagccga

SEQ ID NO: 3879444 - DNA, 19 bp, Homo sapiens
ctgacaggttcccagcagc

SEQ ID NO: 3879445 - DNA, 22 bp, Homo sapiens
ctgaccacggacgtttccatca

SEQ ID NO: 3879446 - DNA, 18 bp, Homo sapiens
ctgaccatttcaggggtc

SEQ ID NO: 3879447 - DNA, 17 bp, Homo sapiens
ctgacccaagaggtggg

SEQ ID NO: 3879448 - DNA, 13 bp, Homo sapiens
ctgacccagtccc

SEQ ID NO: 3879449 - DNA, 15 bp, Homo sapiens
ctgacccagtccctg

SEQ ID NO: 3879450 - DNA, 14 bp, Homo sapiens
ctgacccagtgaga

SEQ ID NO: 3879451 - DNA, 14 bp, Homo sapiens
ctgacccctgcacc

SEQ ID NO: 3879452 - DNA, 17 bp, Homo sapiens
ctgacccttccagacat

SEQ ID NO: 3879453 - DNA, 16 bp, Homo sapiens
ctgaccggcacctgcg

SEQ ID NO: 3879454 - DNA, 16 bp, Homo sapiens
ctgacctcccagccct

SEQ ID NO: 3879455 - DNA, 23 bp, Homo sapiens
ctgacctcccagccctatggatg

SEQ ID NO: 3879456 - DNA, 19 bp, Homo sapiens
ctgacctgatcacctctgg

SEQ ID NO: 3879457 - DNA, 20 bp, Homo sapiens
ctgacctgatcacctctggc

SEQ ID NO: 3879458 - DNA, 18 bp, Homo sapiens
ctgacctgcctctcacac

SEQ ID NO: 3879459 - DNA, 15 bp, Homo sapiens
ctgacctgctgtgca

SEQ ID NO: 3879460 - DNA, 21 bp, Homo sapiens
ctgaccttggagagacacagc

SEQ ID NO: 3879461 - DNA, 21 bp, Homo sapiens
ctgacctttgtcatctttctt

SEQ ID NO: 3879462 - DNA, 23 bp, Homo sapiens
ctgacctttgtcatctttcttct

SEQ ID NO: 3879463 - DNA, 22 bp, Homo sapiens
ctgacgccctgcgttggagcca

SEQ ID NO: 3879464 - DNA, 16 bp, Homo sapiens
ctgacggaagccaact

SEQ ID NO: 3879465 - DNA, 22 bp, Homo sapiens
ctgacggaagccaacttggctt

SEQ ID NO: 3879466 - DNA, 21 bp, Homo sapiens
ctgactaccagctaactccag

SEQ ID NO: 3879467 - DNA, 14 bp, Homo sapiens
ctgactcacaagaa

SEQ ID NO: 3879468 - DNA, 15 bp, Homo sapiens
ctgactcacaagaag

SEQ ID NO: 3879469 - DNA, 16 bp, Homo sapiens
ctgactcacaagaaga

SEQ ID NO: 3879470 - DNA, 14 bp, Homo sapiens
ctgactccagagtc

SEQ ID NO: 3879471 - DNA, 15 bp, Homo sapiens
ctgactccagagtct

SEQ ID NO: 3879472 - DNA, 20 bp, Homo sapiens
ctgactccagagtctgagcc

SEQ ID NO: 3879473 - DNA, 19 bp, Homo sapiens
ctgactccagtgagctgga

SEQ ID NO: 3879474 - DNA, 20 bp, Homo sapiens
ctgactccagtgagctggaa

SEQ ID NO: 3879475 - DNA, 14 bp, Homo sapiens
ctgactccctgtgg

SEQ ID NO: 3879476 - DNA, 17 bp, Homo sapiens
ctgactcctctaagcca

SEQ ID NO: 3879477 - DNA, 19 bp, Homo sapiens
ctgactcctctaagccact

SEQ ID NO: 3879478 - DNA, 21 bp, Homo sapiens
ctgactcggtcaaaatatttt

SEQ ID NO: 3879479 - DNA, 22 bp, Homo sapiens
ctgactggtgctataggctgga

SEQ ID NO: 3879480 - DNA, 16 bp, Homo sapiens
ctgacttcctctgatt

SEQ ID NO: 3879481 - DNA, 14 bp, Homo sapiens
ctgactttgctctt

SEQ ID NO: 3879482 - DNA, 16 bp, Homo sapiens
ctgactttgctctttc

SEQ ID NO: 3879483 - DNA, 12 bp, Homo sapiens
ctgagaaagact

SEQ ID NO: 3879484 - DNA, 19 bp, Homo sapiens
ctgagaaagactattcaaa

SEQ ID NO: 3879485 - DNA, 20 bp, Homo sapiens
ctgagaaagactattcaaac

SEQ ID NO: 3879486 - DNA, 13 bp, Homo sapiens
ctgagaacctggc

SEQ ID NO: 3879487 - DNA, 14 bp, Homo sapiens
ctgagaacctggcc

SEQ ID NO: 3879488 - DNA, 15 bp, Homo sapiens
ctgagaacctggcct

SEQ ID NO: 3879489 - DNA, 18 bp, Homo sapiens
ctgagaacctggccttca

SEQ ID NO: 3879490 - DNA, 18 bp, Homo sapiens
ctgagaagaagctgagga

SEQ ID NO: 3879491 - DNA, 17 bp, Homo sapiens
ctgagaaggcgaggaga

SEQ ID NO: 3879492 - DNA, 15 bp, Homo sapiens
ctgagaattccaagg

SEQ ID NO: 3879493 - DNA, 22 bp, Homo sapiens
ctgagaattttctacctgtgtt

SEQ ID NO: 3879494 - DNA, 19 bp, Homo sapiens
ctgagaccagttgggagca

SEQ ID NO: 3879495 - DNA, 15 bp, Homo sapiens
ctgagacggcagaga

SEQ ID NO: 3879496 - DNA, 20 bp, Homo sapiens
ctgagactataactgtcatc

SEQ ID NO: 3879497 - DNA, 14 bp, Homo sapiens
ctgagactccagaa

SEQ ID NO: 3879498 - DNA, 20 bp, Homo sapiens
ctgagactccagaatctgct

SEQ ID NO: 3879499 - DNA, 21 bp, Homo sapiens
ctgagactccagaatctgctg

SEQ ID NO: 3879500 - DNA, 20 bp, Homo sapiens
ctgagagacccaaggaggaa

SEQ ID NO: 3879501 - DNA, 18 bp, Homo sapiens
ctgagagacttttaatca

SEQ ID NO: 3879502 - DNA, 22 bp, Homo sapiens
ctgagagcagatggtcctccat

SEQ ID NO: 3879503 - DNA, 12 bp, Homo sapiens
ctgagagccctg

SEQ ID NO: 3879504 - DNA, 14 bp, Homo sapiens
ctgagagccctgct

SEQ ID NO: 3879505 - DNA, 19 bp, Homo sapiens
ctgagagccctgctgtggg

SEQ ID NO: 3879506 - DNA, 20 bp, Homo sapiens
ctgagagccctgctgtggga

SEQ ID NO: 3879507 - DNA, 15 bp, Homo sapiens
ctgagaggccctgga

SEQ ID NO: 3879508 - DNA, 15 bp, Homo sapiens
ctgagcaaatgtggc

SEQ ID NO: 3879509 - DNA, 21 bp, Homo sapiens
ctgagcaaatgtggctcctgg

SEQ ID NO: 3879510 - DNA, 14 bp, Homo sapiens
ctgagcaagagctg

SEQ ID NO: 3879511 - DNA, 17 bp, Homo sapiens
ctgagcaagagctggca

SEQ ID NO: 3879512 - DNA, 18 bp, Homo sapiens
ctgagcaccccctcattc

SEQ ID NO: 3879513 - DNA, 16 bp, Homo sapiens
ctgagcaccctctccg

SEQ ID NO: 3879514 - DNA, 13 bp, Homo sapiens
ctgagcacctgct

SEQ ID NO: 3879515 - DNA, 13 bp, Homo sapiens
ctgagcactgcca

SEQ ID NO: 3879516 - DNA, 22 bp, Homo sapiens
ctgagcactgccaggagggaca

SEQ ID NO: 3879517 - DNA, 20 bp, Homo sapiens
ctgagcaggcccgacagaga

SEQ ID NO: 3879518 - DNA, 22 bp, Homo sapiens
ctgagcaggcccgacagagaga

SEQ ID NO: 3879519 - DNA, 23 bp, Homo sapiens
ctgagcaggcccgacagagagat

SEQ ID NO: 3879520 - DNA, 17 bp, Homo sapiens
ctgagcagggccgggga

SEQ ID NO: 3879521 - DNA, 21 bp, Homo sapiens
ctgagcagggccggggaactg

SEQ ID NO: 3879522 - DNA, 22 bp, Homo sapiens
ctgagccaaacacactgtaaat

SEQ ID NO: 3879523 - DNA, 15 bp, Homo sapiens
ctgagccactcgcag

SEQ ID NO: 3879524 - DNA, 11 bp, Homo sapiens
ctgagcccagg

SEQ ID NO: 3879525 - DNA, 15 bp, Homo sapiens
ctgagcccaggccgt

SEQ ID NO: 3879526 - DNA, 19 bp, Homo sapiens
ctgagcccaggccgttccc

SEQ ID NO: 3879527 - DNA, 13 bp, Homo sapiens
ctgagcccaggga

SEQ ID NO: 3879528 - DNA, 17 bp, Homo sapiens
ctgagcccagggaggcc

SEQ ID NO: 3879529 - DNA, 17 bp, Homo sapiens
ctgagctcacaaggcag

SEQ ID NO: 3879530 - DNA, 20 bp, Homo sapiens
ctgagctcacaaggcagcaa

SEQ ID NO: 3879531 - DNA, 12 bp, Homo sapiens
ctgagctctgag

SEQ ID NO: 3879532 - DNA, 16 bp, Homo sapiens
ctgagctctgagaggc

SEQ ID NO: 3879533 - DNA, 21 bp, Homo sapiens
ctgagctctgagaggccctgg

SEQ ID NO: 3879534 - DNA, 15 bp, Homo sapiens
ctgagctggggccac

SEQ ID NO: 3879535 - DNA, 16 bp, Homo sapiens
ctgagctggggccaca

SEQ ID NO: 3879536 - DNA, 15 bp, Homo sapiens
ctgagctggggcctg

SEQ ID NO: 3879537 - DNA, 16 bp, Homo sapiens
ctgagctggggcctgg

SEQ ID NO: 3879538 - DNA, 22 bp, Homo sapiens
ctgagctggggcctggagaggg

SEQ ID NO: 3879539 - DNA, 15 bp, Homo sapiens
ctgagcttagccttg

SEQ ID NO: 3879540 - DNA, 21 bp, Homo sapiens
ctgagcttagccttgtgccct

SEQ ID NO: 3879541 - DNA, 22 bp, Homo sapiens
ctgagcttagccttgtgccctg

SEQ ID NO: 3879542 - DNA, 17 bp, Homo sapiens
ctgagcttggccctatt

SEQ ID NO: 3879543 - DNA, 16 bp, Homo sapiens
ctgagctttggggaca

SEQ ID NO: 3879544 - DNA, 22 bp, Homo sapiens
ctgagctttggggacagttggc

SEQ ID NO: 3879545 - DNA, 13 bp, Homo sapiens
ctgaggaagaagg

SEQ ID NO: 3879546 - DNA, 21 bp, Homo sapiens
ctgaggacatggagagagact

SEQ ID NO: 3879547 - DNA, 15 bp, Homo sapiens
ctgaggactggagac

SEQ ID NO: 3879548 - DNA, 18 bp, Homo sapiens
ctgaggagtagctgagag

SEQ ID NO: 3879549 - DNA, 23 bp, Homo sapiens
ctgaggagtagctgagaggaaga

SEQ ID NO: 3879550 - DNA, 21 bp, Homo sapiens
ctgaggagtattaagaatgca

SEQ ID NO: 3879551 - DNA, 22 bp, Homo sapiens
ctgaggagtattaagaatgcag

SEQ ID NO: 3879552 - DNA, 15 bp, Homo sapiens
ctgaggagtctgagg

SEQ ID NO: 3879553 - DNA, 19 bp, Homo sapiens
ctgaggatcctcacaggag

SEQ ID NO: 3879554 - DNA, 20 bp, Homo sapiens
ctgaggatcctcacaggagc

SEQ ID NO: 3879555 - DNA, 22 bp, Homo sapiens
ctgaggatcctcacaggagcag

SEQ ID NO: 3879556 - DNA, 16 bp, Homo sapiens
ctgaggatctagcttc

SEQ ID NO: 3879557 - DNA, 14 bp, Homo sapiens
ctgaggatttcaag

SEQ ID NO: 3879558 - DNA, 15 bp, Homo sapiens
ctgaggcagaagaat

SEQ ID NO: 3879559 - DNA, 12 bp, Homo sapiens
ctgaggccagcc

SEQ ID NO: 3879560 - DNA, 20 bp, Homo sapiens
ctgaggccagcctggcctcc

SEQ ID NO: 3879561 - DNA, 22 bp, Homo sapiens
ctgaggccagcctggcctcctg

SEQ ID NO: 3879562 - DNA, 18 bp, Homo sapiens
ctgaggccattatttcaa

SEQ ID NO: 3879563 - DNA, 19 bp, Homo sapiens
ctgaggccccttaactcat

SEQ ID NO: 3879564 - DNA, 17 bp, Homo sapiens
ctgaggctcaagaggcc

SEQ ID NO: 3879565 - DNA, 19 bp, Homo sapiens
ctgaggctcaagaggccca

SEQ ID NO: 3879566 - DNA, 20 bp, Homo sapiens
ctgaggctcaagaggcccag

SEQ ID NO: 3879567 - DNA, 20 bp, Homo sapiens
ctgaggctcctgtgctactt

SEQ ID NO: 3879568 - DNA, 18 bp, Homo sapiens
ctgaggcttccagagagt

SEQ ID NO: 3879569 - DNA, 12 bp, Homo sapiens
ctgagggagaga

SEQ ID NO: 3879570 - DNA, 16 bp, Homo sapiens
ctgagggagagactct

SEQ ID NO: 3879571 - DNA, 19 bp, Homo sapiens
ctgagggcagttcgcagcc

SEQ ID NO: 3879572 - DNA, 22 bp, Homo sapiens
ctgagggcagttcgcagccacc

SEQ ID NO: 3879573 - DNA, 23 bp, Homo sapiens
ctgaggggggccgtgcccagggg

SEQ ID NO: 3879574 - DNA, 15 bp, Homo sapiens
ctgagggtccccacc

SEQ ID NO: 3879575 - DNA, 19 bp, Homo sapiens
ctgagggtccccacctggg

SEQ ID NO: 3879576 - DNA, 14 bp, Homo sapiens
ctgaggtcctgagc

SEQ ID NO: 3879577 - DNA, 20 bp, Homo sapiens
ctgaggtcctgagcactgcc

SEQ ID NO: 3879578 - DNA, 21 bp, Homo sapiens
ctgaggtcctgagcactgcca

SEQ ID NO: 3879579 - DNA, 19 bp, Homo sapiens
ctgaggtgcccaggagaag

SEQ ID NO: 3879580 - DNA, 14 bp, Homo sapiens
ctgagtaccttcta

SEQ ID NO: 3879581 - DNA, 20 bp, Homo sapiens
ctgagtagctgggattacag

SEQ ID NO: 3879582 - DNA, 23 bp, Homo sapiens
ctgagtcaccctacctgtgcctg

SEQ ID NO: 3879583 - DNA, 15 bp, Homo sapiens
ctgagtcacctcctc

SEQ ID NO: 3879584 - DNA, 17 bp, Homo sapiens
ctgagtcaggacttgaa

SEQ ID NO: 3879585 - DNA, 18 bp, Homo sapiens
ctgagtcatgatctccct

SEQ ID NO: 3879586 - DNA, 19 bp, Homo sapiens
ctgagtcatgatctccctg

SEQ ID NO: 3879587 - DNA, 13 bp, Homo sapiens
ctgagtcctgtct

SEQ ID NO: 3879588 - DNA, 20 bp, Homo sapiens
ctgagtcggccccacatggg

SEQ ID NO: 3879589 - DNA, 16 bp, Homo sapiens
ctgagtctcctgtgcc

SEQ ID NO: 3879590 - DNA, 14 bp, Homo sapiens
ctgagtctgagtcc

SEQ ID NO: 3879591 - DNA, 18 bp, Homo sapiens
ctgagtctgagtcctgtc

SEQ ID NO: 3879592 - DNA, 22 bp, Homo sapiens
ctgagtctgctatattttcatg

SEQ ID NO: 3879593 - DNA, 13 bp, Homo sapiens
ctgagtcttggcc

SEQ ID NO: 3879594 - DNA, 18 bp, Homo sapiens
ctgagtcttggcctgcct

SEQ ID NO: 3879595 - DNA, 21 bp, Homo sapiens
ctgagtgaaaaatctgtggaa

SEQ ID NO: 3879596 - DNA, 18 bp, Homo sapiens
ctgagtggaatgcaggga

SEQ ID NO: 3879597 - DNA, 23 bp, Homo sapiens
ctgagtggcttgtgattctggga

SEQ ID NO: 3879598 - DNA, 18 bp, Homo sapiens
ctgagttacttgtctgag

SEQ ID NO: 3879599 - DNA, 21 bp, Homo sapiens
ctgagttacttgtctgaggcc

SEQ ID NO: 3879600 - DNA, 24 bp, Homo sapiens
ctgagttacttgtctgaggcctca

SEQ ID NO: 3879601 - DNA, 18 bp, Homo sapiens
ctgagtttcattctcctg

SEQ ID NO: 3879602 - DNA, 20 bp, Homo sapiens
ctgagtttcattctcctgcc

SEQ ID NO: 3879603 - DNA, 19 bp, Homo sapiens
ctgataaaattgtgatgtt

SEQ ID NO: 3879604 - DNA, 12 bp, Homo sapiens
ctgataaacatt

SEQ ID NO: 3879605 - DNA, 16 bp, Homo sapiens
ctgataacaacctgga

SEQ ID NO: 3879606 - DNA, 15 bp, Homo sapiens
ctgatacccagagca

SEQ ID NO: 3879607 - DNA, 14 bp, Homo sapiens
ctgataggaaaaga

SEQ ID NO: 3879608 - DNA, 17 bp, Homo sapiens
ctgatcaaaaataaact

SEQ ID NO: 3879609 - DNA, 23 bp, Homo sapiens
ctgatcaaaaataaactagtttc

SEQ ID NO: 3879610 - DNA, 18 bp, Homo sapiens
ctgatcaagtcaccggag

SEQ ID NO: 3879611 - DNA, 19 bp, Homo sapiens
ctgatcgggataacaaaat

SEQ ID NO: 3879612 - DNA, 15 bp, Homo sapiens
ctgatcttggctcac

SEQ ID NO: 3879613 - DNA, 17 bp, Homo sapiens
ctgatgcatcagaaagg

SEQ ID NO: 3879614 - DNA, 14 bp, Homo sapiens
ctgatgccccttcc

SEQ ID NO: 3879615 - DNA, 19 bp, Homo sapiens
ctgatgccccttccccaag

SEQ ID NO: 3879616 - DNA, 18 bp, Homo sapiens
ctgatgcgaaaacttgaa

SEQ ID NO: 3879617 - DNA, 21 bp, Homo sapiens
ctgatgcgaaaacttgaatct

SEQ ID NO: 3879618 - DNA, 12 bp, Homo sapiens
ctgatgctgccc

SEQ ID NO: 3879619 - DNA, 14 bp, Homo sapiens
ctgatgctgccccg

SEQ ID NO: 3879620 - DNA, 23 bp, Homo sapiens
ctgatggaccgggtgggcctggc

SEQ ID NO: 3879621 - DNA, 16 bp, Homo sapiens
ctgatggagaaggaag

SEQ ID NO: 3879622 - DNA, 17 bp, Homo sapiens
ctgatggagaaggaagg

SEQ ID NO: 3879623 - DNA, 11 bp, Homo sapiens
ctgatggccaa

SEQ ID NO: 3879624 - DNA, 16 bp, Homo sapiens
ctgatggccaagagca

SEQ ID NO: 3879625 - DNA, 17 bp, Homo sapiens
ctgatggccaagggggt

SEQ ID NO: 3879626 - DNA, 15 bp, Homo sapiens
ctgatggtgagctgg

SEQ ID NO: 3879627 - DNA, 12 bp, Homo sapiens
ctgattatcagg

SEQ ID NO: 3879628 - DNA, 13 bp, Homo sapiens
ctgattccccact

SEQ ID NO: 3879629 - DNA, 19 bp, Homo sapiens
ctgattctgggatgctcct

SEQ ID NO: 3879630 - DNA, 19 bp, Homo sapiens
ctgattgggtgccatgtgg

SEQ ID NO: 3879631 - DNA, 14 bp, Homo sapiens
ctgatttaatgttt

SEQ ID NO: 3879632 - DNA, 15 bp, Homo sapiens
ctgatttaatgtttt

SEQ ID NO: 3879633 - DNA, 17 bp, Homo sapiens
ctgatttaatgttttct

SEQ ID NO: 3879634 - DNA, 16 bp, Homo sapiens
ctgatttagatatgca

SEQ ID NO: 3879635 - DNA, 15 bp, Homo sapiens
ctgatttccaggccc

SEQ ID NO: 3879636 - DNA, 16 bp, Homo sapiens
ctgatttccaggcccc

SEQ ID NO: 3879637 - DNA, 18 bp, Homo sapiens
ctgatttccaggcccctg

SEQ ID NO: 3879638 - DNA, 21 bp, Homo sapiens
ctgattttcaaagctttttcc

SEQ ID NO: 3879639 - DNA, 19 bp, Homo sapiens
ctgcaacctcttcctcctg

SEQ ID NO: 3879640 - DNA, 13 bp, Homo sapiens
ctgcaagagcctt

SEQ ID NO: 3879641 - DNA, 19 bp, Homo sapiens
ctgcaagagccttggtgtc

SEQ ID NO: 3879642 - DNA, 23 bp, Homo sapiens
ctgcaagagccttggtgtccacc

SEQ ID NO: 3879643 - DNA, 18 bp, Homo sapiens
ctgcaagcagggctctgc

SEQ ID NO: 3879644 - DNA, 14 bp, Homo sapiens
ctgcaagccccagg

SEQ ID NO: 3879645 - DNA, 19 bp, Homo sapiens
ctgcaagccccagggcctg

SEQ ID NO: 3879646 - DNA, 20 bp, Homo sapiens
ctgcaagccccagggcctgg

SEQ ID NO: 3879647 - DNA, 21 bp, Homo sapiens
ctgcaagccccagggcctggg

SEQ ID NO: 3879648 - DNA, 22 bp, Homo sapiens
ctgcaaggaagggtgggaagct

SEQ ID NO: 3879649 - DNA, 18 bp, Homo sapiens
ctgcaagggccagagttc

SEQ ID NO: 3879650 - DNA, 17 bp, Homo sapiens
ctgcaaggtctttggtt

SEQ ID NO: 3879651 - DNA, 14 bp, Homo sapiens
ctgcaatctccagg

SEQ ID NO: 3879652 - DNA, 21 bp, Homo sapiens
ctgcaatgggcactgggatga

SEQ ID NO: 3879653 - DNA, 15 bp, Homo sapiens
ctgcaattgcttagg

SEQ ID NO: 3879654 - DNA, 16 bp, Homo sapiens
ctgcaattgcttagga

SEQ ID NO: 3879655 - DNA, 20 bp, Homo sapiens
ctgcacaaagcccttccatg

SEQ ID NO: 3879656 - DNA, 13 bp, Homo sapiens
ctgcacacacagc

SEQ ID NO: 3879657 - DNA, 19 bp, Homo sapiens
ctgcacagcggcccctgca

SEQ ID NO: 3879658 - DNA, 22 bp, Homo sapiens
ctgcacagtgcatctcagccca

SEQ ID NO: 3879659 - DNA, 13 bp, Homo sapiens
ctgcacattcctg

SEQ ID NO: 3879660 - DNA, 16 bp, Homo sapiens
ctgcacattcctggcc

SEQ ID NO: 3879661 - DNA, 22 bp, Homo sapiens
ctgcaccagagtgaaagggcta

SEQ ID NO: 3879662 - DNA, 14 bp, Homo sapiens
ctgcaccatcacac

SEQ ID NO: 3879663 - DNA, 13 bp, Homo sapiens
ctgcacccagggg

SEQ ID NO: 3879664 - DNA, 18 bp, Homo sapiens
ctgcaccctggaaagggg

SEQ ID NO: 3879665 - DNA, 13 bp, Homo sapiens
ctgcaccgcttgg

SEQ ID NO: 3879666 - DNA, 17 bp, Homo sapiens
ctgcacctccccccact

SEQ ID NO: 3879667 - DNA, 22 bp, Homo sapiens
ctgcacctccccccactgcagg

SEQ ID NO: 3879668 - DNA, 21 bp, Homo sapiens
ctgcactaaaacccatcttcc

SEQ ID NO: 3879669 - DNA, 12 bp, Homo sapiens
ctgcactccaga

SEQ ID NO: 3879670 - DNA, 18 bp, Homo sapiens
ctgcactccatggccacc

SEQ ID NO: 3879671 - DNA, 19 bp, Homo sapiens
ctgcactccatggccaccc

SEQ ID NO: 3879672 - DNA, 16 bp, Homo sapiens
ctcttcaccccccact

SEQ ID NO: 3879673 - DNA, 15 bp, Homo sapiens
ctcttcactcagcca

SEQ ID NO: 3879674 - DNA, 22 bp, Homo sapiens
ctcttcactcagccacacccca

SEQ ID NO: 3879675 - DNA, 14 bp, Homo sapiens
ctcttcattttgag

SEQ ID NO: 3879676 - DNA, 16 bp, Homo sapiens
ctcttccccttgccct

SEQ ID NO: 3879677 - DNA, 23 bp, Homo sapiens
ctcttccccttgcccttgccctg

SEQ ID NO: 3879678 - DNA, 16 bp, Homo sapiens
ctcttccctccttccc

SEQ ID NO: 3879679 - DNA, 12 bp, Homo sapiens
ctcttcctcctg

SEQ ID NO: 3879680 - DNA, 14 bp, Homo sapiens
ctcttcctgcaagg

SEQ ID NO: 3879681 - DNA, 15 bp, Homo sapiens
ctcttcggtttctga

SEQ ID NO: 3879682 - DNA, 18 bp, Homo sapiens
ctcttctatttaaaaaat

SEQ ID NO: 3879683 - DNA, 17 bp, Homo sapiens
ctcttctattttgtaaa

SEQ ID NO: 3879684 - DNA, 12 bp, Homo sapiens
ctcttctccact

SEQ ID NO: 3879685 - DNA, 14 bp, Homo sapiens
ctcttctcttcctg

SEQ ID NO: 3879686 - DNA, 15 bp, Homo sapiens
ctcttctcttcctgt

SEQ ID NO: 3879687 - DNA, 18 bp, Homo sapiens
ctcttctgccagcctccc

SEQ ID NO: 3879688 - DNA, 17 bp, Homo sapiens
ctcttcttgagcagacc

SEQ ID NO: 3879689 - DNA, 22 bp, Homo sapiens
ctcttctttaaagggatggcaa

SEQ ID NO: 3879690 - DNA, 15 bp, Homo sapiens
ctcttctttctgaga

SEQ ID NO: 3879691 - DNA, 17 bp, Homo sapiens
ctcttgccactgcctct

SEQ ID NO: 3879692 - DNA, 19 bp, Homo sapiens
ctcttgccactgcctcttc

SEQ ID NO: 3879693 - DNA, 20 bp, Homo sapiens
ctcttgccactgcctcttcc

SEQ ID NO: 3879694 - DNA, 14 bp, Homo sapiens
ctcttgcctctctc

SEQ ID NO: 3879695 - DNA, 12 bp, Homo sapiens
ctcttgctcaaa

SEQ ID NO: 3879696 - DNA, 20 bp, Homo sapiens
ctcttggacctctgctctga

SEQ ID NO: 3879697 - DNA, 22 bp, Homo sapiens
ctcttgggagtcaggacctccg

SEQ ID NO: 3879698 - DNA, 16 bp, Homo sapiens
ctcttggtccctggtc

SEQ ID NO: 3879699 - DNA, 14 bp, Homo sapiens
ctcttgtacagtta

SEQ ID NO: 3879700 - DNA, 13 bp, Homo sapiens
ctcttgttgcaga

SEQ ID NO: 3879701 - DNA, 16 bp, Homo sapiens
ctctttcactcaggct

SEQ ID NO: 3879702 - DNA, 12 bp, Homo sapiens
ctctttctccct

SEQ ID NO: 3879703 - DNA, 17 bp, Homo sapiens
ctctttctttttctgtc

SEQ ID NO: 3879704 - DNA, 22 bp, Homo sapiens
ctctttctttttctgtctctct

SEQ ID NO: 3879705 - DNA, 22 bp, Homo sapiens
ctctttgacgggaggcctcagt

SEQ ID NO: 3879706 - DNA, 16 bp, Homo sapiens
ctctttgctacaataa

SEQ ID NO: 3879707 - DNA, 19 bp, Homo sapiens
ctctttgctacaataaatg

SEQ ID NO: 3879708 - DNA, 21 bp, Homo sapiens
ctctttgctacaataaatgct

SEQ ID NO: 3879709 - DNA, 20 bp, Homo sapiens
ctctttggggtcagccaggg

SEQ ID NO: 3879710 - DNA, 21 bp, Homo sapiens
ctcttttacaatcctaatcat

SEQ ID NO: 3879711 - DNA, 17 bp, Homo sapiens
ctcttttccctctctag

SEQ ID NO: 3879712 - DNA, 23 bp, Homo sapiens
ctcttttgttcctggctttgaca

SEQ ID NO: 3879713 - DNA, 20 bp, Homo sapiens
ctctttttagggccaggcag

SEQ ID NO: 3879714 - DNA, 17 bp, Homo sapiens
ctcttttttattctgtt

SEQ ID NO: 3879715 - DNA, 19 bp, Homo sapiens
ctcttttttattctgtttt

SEQ ID NO: 3879716 - DNA, 21 bp, Homo sapiens
ctcttttttattctgttttct

SEQ ID NO: 3879717 - DNA, 14 bp, Homo sapiens
ctgaaaaaaagttt

SEQ ID NO: 3879718 - DNA, 20 bp, Homo sapiens
ctgaaaacatttcaaagctg

SEQ ID NO: 3879719 - DNA, 14 bp, Homo sapiens
ctgaaaactgtaaa

SEQ ID NO: 3879720 - DNA, 16 bp, Homo sapiens
ctgaaaactgtaaata

SEQ ID NO: 3879721 - DNA, 19 bp, Homo sapiens
ctgaaaactgtaaatacaa

SEQ ID NO: 3879722 - DNA, 20 bp, Homo sapiens
ctgaaaagcaattgccctgt

SEQ ID NO: 3879723 - DNA, 18 bp, Homo sapiens
ctgaaaataccatcaggc

SEQ ID NO: 3879724 - DNA, 17 bp, Homo sapiens
ctgaaaatctaatatta

SEQ ID NO: 3879725 - DNA, 21 bp, Homo sapiens
ctgaaaatgttgttatgctat

SEQ ID NO: 3879726 - DNA, 22 bp, Homo sapiens
ctgaaacattccgaagagggaa

SEQ ID NO: 3879727 - DNA, 13 bp, Homo sapiens
ctgaaagacagaa

SEQ ID NO: 3879728 - DNA, 18 bp, Homo sapiens
ctgaaagacagaatgtca

SEQ ID NO: 3879729 - DNA, 21 bp, Homo sapiens
ctgaaagacagaatgtcacca

SEQ ID NO: 3879730 - DNA, 16 bp, Homo sapiens
ctgaaagcagcagcta

SEQ ID NO: 3879731 - DNA, 19 bp, Homo sapiens
ctgaaagcagcagctagga

SEQ ID NO: 3879732 - DNA, 11 bp, Homo sapiens
ctgaaagccac

SEQ ID NO: 3879733 - DNA, 23 bp, Homo sapiens
ctgaaagccatttgttggggcag

SEQ ID NO: 3879734 - DNA, 23 bp, Homo sapiens
ctgaaatcttgggcaaaatgaca

SEQ ID NO: 3879735 - DNA, 22 bp, Homo sapiens
ctgaaatgaggagagaaggaca

SEQ ID NO: 3879736 - DNA, 13 bp, Homo sapiens
ctgaaatttcaga

SEQ ID NO: 3879737 - DNA, 19 bp, Homo sapiens
ctgaacacatactagaaag

SEQ ID NO: 3879738 - DNA, 16 bp, Homo sapiens
ctgaaccatccctgat

SEQ ID NO: 3879739 - DNA, 15 bp, Homo sapiens
ctgaacctcagtttc

SEQ ID NO: 3879740 - DNA, 14 bp, Homo sapiens
ctgaacgagggata

SEQ ID NO: 3879741 - DNA, 13 bp, Homo sapiens
ctgaacggggaga

SEQ ID NO: 3879742 - DNA, 22 bp, Homo sapiens
ctgaacttcaggataataaagt

SEQ ID NO: 3879743 - DNA, 13 bp, Homo sapiens
ctgaagaacagta

SEQ ID NO: 3879744 - DNA, 15 bp, Homo sapiens
ctgaagaatcaagag

SEQ ID NO: 3879745 - DNA, 20 bp, Homo sapiens
ctgaagacaaaccactgtac

SEQ ID NO: 3879746 - DNA, 21 bp, Homo sapiens
ctgaagacaaaccactgtaca

SEQ ID NO: 3879747 - DNA, 16 bp, Homo sapiens
ctgaagacctccacat

SEQ ID NO: 3879748 - DNA, 22 bp, Homo sapiens
ctgaagagacagttatttatag

SEQ ID NO: 3879749 - DNA, 22 bp, Homo sapiens
ctgaagaggcaagagacagaat

SEQ ID NO: 3879750 - DNA, 12 bp, Homo sapiens
ctgaagccagat

SEQ ID NO: 3879751 - DNA, 14 bp, Homo sapiens
ctgaagccattgtc

SEQ ID NO: 3879752 - DNA, 16 bp, Homo sapiens
ctgaagcctctgccct

SEQ ID NO: 3879753 - DNA, 21 bp, Homo sapiens
ctgaagcctctgccctgcctc

SEQ ID NO: 3879754 - DNA, 19 bp, Homo sapiens
ctgaagctattgatgtttc

SEQ ID NO: 3879755 - DNA, 17 bp, Homo sapiens
ctgaagctgacagcact

SEQ ID NO: 3879756 - DNA, 18 bp, Homo sapiens
ctgaagctttaccagctg

SEQ ID NO: 3879757 - DNA, 23 bp, Homo sapiens
ctgaaggaatagccagagaggag

SEQ ID NO: 3879758 - DNA, 18 bp, Homo sapiens
ctccttttgctgtctttc

SEQ ID NO: 3879759 - DNA, 21 bp, Homo sapiens
ctccttttgtccccagggccc

SEQ ID NO: 3879760 - DNA, 16 bp, Homo sapiens
ctcctttttctacctt

SEQ ID NO: 3879761 - DNA, 16 bp, Homo sapiens
ctcgaaccaaggcagc

SEQ ID NO: 3879762 - DNA, 17 bp, Homo sapiens
ctcgaaccaaggcagcc

SEQ ID NO: 3879763 - DNA, 19 bp, Homo sapiens
ctcgaaccaaggcagcctc

SEQ ID NO: 3879764 - DNA, 20 bp, Homo sapiens
ctcgaaccaaggcagcctcc

SEQ ID NO: 3879765 - DNA, 19 bp, Homo sapiens
ctcgagaccatcctggccc

SEQ ID NO: 3879766 - DNA, 12 bp, Homo sapiens
ctcgagcgccct

SEQ ID NO: 3879767 - DNA, 15 bp, Homo sapiens
ctcgagcgccctgca

SEQ ID NO: 3879768 - DNA, 20 bp, Homo sapiens
ctcgagcgccctgcagaccc

SEQ ID NO: 3879769 - DNA, 14 bp, Homo sapiens
ctcgaggcaccggc

SEQ ID NO: 3879770 - DNA, 22 bp, Homo sapiens
ctcgaggcaccggcgctgcagg

SEQ ID NO: 3879771 - DNA, 23 bp, Homo sapiens
ctcgagggttgggttcatctgag

SEQ ID NO: 3879772 - DNA, 21 bp, Homo sapiens
ctcgcaacccgtgccaagtcc

SEQ ID NO: 3879773 - DNA, 13 bp, Homo sapiens
ctcgcagcctggc

SEQ ID NO: 3879774 - DNA, 20 bp, Homo sapiens
ctcgcagcctggcggggcag

SEQ ID NO: 3879775 - DNA, 16 bp, Homo sapiens
ctcgccacggggaggg

SEQ ID NO: 3879776 - DNA, 19 bp, Homo sapiens
ctcgccacggggaggggga

SEQ ID NO: 3879777 - DNA, 12 bp, Homo sapiens
ctcgccctgggt

SEQ ID NO: 3879778 - DNA, 13 bp, Homo sapiens
ctcgcctgggccc

SEQ ID NO: 3879779 - DNA, 14 bp, Homo sapiens
ctcgcctgggccca

SEQ ID NO: 3879780 - DNA, 21 bp, Homo sapiens
ctcgcctgggcccaggctctg

SEQ ID NO: 3879781 - DNA, 15 bp, Homo sapiens
ctcgctccccactct

SEQ ID NO: 3879782 - DNA, 23 bp, Homo sapiens
ctcgctggaatcaatttcccaga

SEQ ID NO: 3879783 - DNA, 17 bp, Homo sapiens
ctcggaagccgtctgac

SEQ ID NO: 3879784 - DNA, 19 bp, Homo sapiens
ctcggaagccgtctgactc

SEQ ID NO: 3879785 - DNA, 20 bp, Homo sapiens
ctcgggacacctgccctgcc

SEQ ID NO: 3879786 - DNA, 15 bp, Homo sapiens
ctcgggaggctgaga

SEQ ID NO: 3879787 - DNA, 19 bp, Homo sapiens
ctcgggaggctgagacagg

SEQ ID NO: 3879788 - DNA, 21 bp, Homo sapiens
ctcggggcccttggggcctgg

SEQ ID NO: 3879789 - DNA, 15 bp, Homo sapiens
ctcggggtgcacagg

SEQ ID NO: 3879790 - DNA, 16 bp, Homo sapiens
ctcggggtgcacagga

SEQ ID NO: 3879791 - DNA, 14 bp, Homo sapiens
ctcgggtgcatttg

SEQ ID NO: 3879792 - DNA, 10 bp, Homo sapiens
ctcggtgtaa

SEQ ID NO: 3879793 - DNA, 17 bp, Homo sapiens
ctcgtccacaggggcag

SEQ ID NO: 3879794 - DNA, 12 bp, Homo sapiens
ctcgtcctcccc

SEQ ID NO: 3879795 - DNA, 15 bp, Homo sapiens
ctcgtcctccccctg

SEQ ID NO: 3879796 - DNA, 16 bp, Homo sapiens
ctcgtcctccccctgc

SEQ ID NO: 3879797 - DNA, 22 bp, Homo sapiens
ctcgtcctccccctgccagtgc

SEQ ID NO: 3879798 - DNA, 24 bp, Homo sapiens
ctcgtcctccccctgccagtgcct

SEQ ID NO: 3879799 - DNA, 15 bp, Homo sapiens
ctcgtcctgtcccag

SEQ ID NO: 3879800 - DNA, 12 bp, Homo sapiens
ctcgtggacacc

SEQ ID NO: 3879801 - DNA, 14 bp, Homo sapiens
ctcgtggacacctg

SEQ ID NO: 3879802 - DNA, 23 bp, Homo sapiens
ctcgtggccttccccttttgcct

SEQ ID NO: 3879803 - DNA, 16 bp, Homo sapiens
ctcgtggtagaagcca

SEQ ID NO: 3879804 - DNA, 12 bp, Homo sapiens
ctcgtgtgattt

SEQ ID NO: 3879805 - DNA, 22 bp, Homo sapiens
ctcgtttgctctagtcttgctt

SEQ ID NO: 3879806 - DNA, 14 bp, Homo sapiens
ctcgtttgggagtg

SEQ ID NO: 3879807 - DNA, 19 bp, Homo sapiens
ctctaaaaataaaatgatg

SEQ ID NO: 3879808 - DNA, 23 bp, Homo sapiens
ctctaacccccagtgccacagag

SEQ ID NO: 3879809 - DNA, 13 bp, Homo sapiens
ctctaacgcctga

SEQ ID NO: 3879810 - DNA, 13 bp, Homo sapiens
ctctaagccactc

SEQ ID NO: 3879811 - DNA, 14 bp, Homo sapiens
ctctaagctggagc

SEQ ID NO: 3879812 - DNA, 15 bp, Homo sapiens
ctctaagtttagaag

SEQ ID NO: 3879813 - DNA, 22 bp, Homo sapiens
ctctaattggaagaaattcctg

SEQ ID NO: 3879814 - DNA, 18 bp, Homo sapiens
ctctacccggcccagaga

SEQ ID NO: 3879815 - DNA, 22 bp, Homo sapiens
ctctactaaaaatacaaaaaat

SEQ ID NO: 3879816 - DNA, 13 bp, Homo sapiens
ctctactgggaag

SEQ ID NO: 3879817 - DNA, 19 bp, Homo sapiens
ctctacttagcatgtccct

SEQ ID NO: 3879818 - DNA, 16 bp, Homo sapiens
ctctagaacacccact

SEQ ID NO: 3879819 - DNA, 18 bp, Homo sapiens
ctctagaacacccactgg

SEQ ID NO: 3879820 - DNA, 17 bp, Homo sapiens
ctctagaacatgcacat

SEQ ID NO: 3879821 - DNA, 13 bp, Homo sapiens
ctctagccaggag

SEQ ID NO: 3879822 - DNA, 17 bp, Homo sapiens
ctctagccaggagtctg

SEQ ID NO: 3879823 - DNA, 14 bp, Homo sapiens
ctctagctggcagg

SEQ ID NO: 3879824 - DNA, 17 bp, Homo sapiens
ctctagctggcaggaca

SEQ ID NO: 3879825 - DNA, 20 bp, Homo sapiens
ctctaggggtcaggctccat

SEQ ID NO: 3879826 - DNA, 22 bp, Homo sapiens
ctctagtgacttcctggtgagg

SEQ ID NO: 3879827 - DNA, 17 bp, Homo sapiens
ctctagtgctactgcta

SEQ ID NO: 3879828 - DNA, 18 bp, Homo sapiens
ctctattaagatttccaa

SEQ ID NO: 3879829 - DNA, 12 bp, Homo sapiens
ctctattcctga

SEQ ID NO: 3879830 - DNA, 15 bp, Homo sapiens
ctctattcctgaccc

SEQ ID NO: 3879831 - DNA, 16 bp, Homo sapiens
ctctattcctgaccct

SEQ ID NO: 3879832 - DNA, 20 bp, Homo sapiens
ctctattcctgaccctccct

SEQ ID NO: 3879833 - DNA, 14 bp, Homo sapiens
ctctatttaatatt

SEQ ID NO: 3879834 - DNA, 16 bp, Homo sapiens
ctctatttaatattta

SEQ ID NO: 3879835 - DNA, 17 bp, Homo sapiens
ctctatttaatatttat

SEQ ID NO: 3879836 - DNA, 14 bp, Homo sapiens
ctctcacacacata

SEQ ID NO: 3879837 - DNA, 19 bp, Homo sapiens
ctctcacccgggactctcc

SEQ ID NO: 3879838 - DNA, 15 bp, Homo sapiens
ctctcactaaacttt

SEQ ID NO: 3879839 - DNA, 16 bp, Homo sapiens
ctctcagaaggtattc

SEQ ID NO: 3879840 - DNA, 13 bp, Homo sapiens
ctctcaggagcac

SEQ ID NO: 3879841 - DNA, 16 bp, Homo sapiens
ctctcaggagcacagg

SEQ ID NO: 3879842 - DNA, 18 bp, Homo sapiens
ctctcaggagcacaggca

SEQ ID NO: 3879843 - DNA, 20 bp, Homo sapiens
ctctcaggagcacaggcagc

SEQ ID NO: 3879844 - DNA, 14 bp, Homo sapiens
ctctcaggatcaag

SEQ ID NO: 3879845 - DNA, 13 bp, Homo sapiens
ctctcaggcgcat

SEQ ID NO: 3879846 - DNA, 18 bp, Homo sapiens
ctctcaggggccagtgag

SEQ ID NO: 3879847 - DNA, 13 bp, Homo sapiens
ctctcatgcctgc

SEQ ID NO: 3879848 - DNA, 11 bp, Homo sapiens
ctctcattccc

SEQ ID NO: 3879849 - DNA, 14 bp, Homo sapiens
ctctcattccccag

SEQ ID NO: 3879850 - DNA, 20 bp, Homo sapiens
ctctcattccccaggtggct

SEQ ID NO: 3879851 - DNA, 21 bp, Homo sapiens
ctctcattccccaggtggctg

SEQ ID NO: 3879852 - DNA, 21 bp, Homo sapiens
ctctccaaatattattcaagt

SEQ ID NO: 3879853 - DNA, 22 bp, Homo sapiens
ctctccaaatattattcaagtg

SEQ ID NO: 3879854 - DNA, 23 bp, Homo sapiens
ctctccaaatattattcaagtgc

SEQ ID NO: 3879855 - DNA, 13 bp, Homo sapiens
ctctccaacctgg

SEQ ID NO: 3879856 - DNA, 14 bp, Homo sapiens
ctctccaattgtaa

SEQ ID NO: 3879857 - DNA, 10 bp, Homo sapiens
ctctccacct

SEQ ID NO: 3879858 - DNA, 13 bp, Homo sapiens
ctctccacctcag

SEQ ID NO: 3879859 - DNA, 15 bp, Homo sapiens
ctctccacctcagcc

SEQ ID NO: 3879860 - DNA, 16 bp, Homo sapiens
ctctccacctcagcct

SEQ ID NO: 3879861 - DNA, 17 bp, Homo sapiens
ctctccacctcagcctt

SEQ ID NO: 3879862 - DNA, 13 bp, Homo sapiens
ctctccacggtag

SEQ ID NO: 3879863 - DNA, 12 bp, Homo sapiens
ctctccactgcc

SEQ ID NO: 3879864 - DNA, 12 bp, Homo sapiens
ctctccactttg

SEQ ID NO: 3879865 - DNA, 19 bp, Homo sapiens
ctctccaggcacccttctt

SEQ ID NO: 3879866 - DNA, 13 bp, Homo sapiens
ctctccatgccca

SEQ ID NO: 3879867 - DNA, 21 bp, Homo sapiens
ctctcccaccccggcctccac

SEQ ID NO: 3879868 - DNA, 13 bp, Homo sapiens
ctctcccaggccc

SEQ ID NO: 3879869 - DNA, 21 bp, Homo sapiens
ctctcccaggccccatgacct

SEQ ID NO: 3879870 - DNA, 20 bp, Homo sapiens
ctctcccataccatcactga

SEQ ID NO: 3879871 - DNA, 19 bp, Homo sapiens
ctctccccctttcaaggaa

SEQ ID NO: 3879872 - DNA, 16 bp, Homo sapiens
ctctcccctccctctt

SEQ ID NO: 3879873 - DNA, 17 bp, Homo sapiens
ctctcccctccctcttc

SEQ ID NO: 3879874 - DNA, 17 bp, Homo sapiens
ctctcccctctgccctg

SEQ ID NO: 3879875 - DNA, 18 bp, Homo sapiens
ctctcccctgccctgctg

SEQ ID NO: 3879876 - DNA, 14 bp, Homo sapiens
ctctcccggctgcc

SEQ ID NO: 3879877 - DNA, 12 bp, Homo sapiens
ctctccctctgg

SEQ ID NO: 3879878 - DNA, 19 bp, Homo sapiens
ctctccctctggccctgcc

SEQ ID NO: 3879879 - DNA, 21 bp, Homo sapiens
ctctccctctggccctgcctt

SEQ ID NO: 3879880 - DNA, 20 bp, Homo sapiens
ctctcctaccccacctcatg

SEQ ID NO: 3879881 - DNA, 15 bp, Homo sapiens
ctctcctcagactgc

SEQ ID NO: 3879882 - DNA, 22 bp, Homo sapiens
ctctcctgtataaccccacctt

SEQ ID NO: 3879883 - DNA, 20 bp, Homo sapiens
ctctcctgtataatctctct

SEQ ID NO: 3879884 - DNA, 21 bp, Homo sapiens
ctctcctgtccaacctaaccc

SEQ ID NO: 3879885 - DNA, 13 bp, Homo sapiens
ctctccttccctc

SEQ ID NO: 3879886 - DNA, 17 bp, Homo sapiens
ctctccttcgtgtctct

SEQ ID NO: 3879887 - DNA, 18 bp, Homo sapiens
ctctccttgggctcctgg

SEQ ID NO: 3879888 - DNA, 23 bp, Homo sapiens
ctctccttgggctcctggctgcc

SEQ ID NO: 3879889 - DNA, 16 bp, Homo sapiens
ctctcgggccccccac

SEQ ID NO: 3879890 - DNA, 17 bp, Homo sapiens
ctctcgtaactggtttc

SEQ ID NO: 3879891 - DNA, 21 bp, Homo sapiens
ctctctaaaaataaaatgatg

SEQ ID NO: 3879892 - DNA, 22 bp, Homo sapiens
ctctctaaaaataaaatgatgt

SEQ ID NO: 3879893 - DNA, 20 bp, Homo sapiens
ctctctaaacccaaataaat

SEQ ID NO: 3879894 - DNA, 16 bp, Homo sapiens
ctctctaagtttagaa

SEQ ID NO: 3879895 - DNA, 21 bp, Homo sapiens
ctctctacccggcccagagac

SEQ ID NO: 3879896 - DNA, 12 bp, Homo sapiens
ctctctcctgta

SEQ ID NO: 3879897 - DNA, 22 bp, Homo sapiens
ctctctctacccggcccagaga

SEQ ID NO: 3879898 - DNA, 15 bp, Homo sapiens
ctctctctctttcct

SEQ ID NO: 3879899 - DNA, 21 bp, Homo sapiens
ctctctgcagccagcccagcc

SEQ ID NO: 3879900 - DNA, 20 bp, Homo sapiens
ctctctgcctatttattggg

SEQ ID NO: 3879901 - DNA, 12 bp, Homo sapiens
ctctctgctcca

SEQ ID NO: 3879902 - DNA, 13 bp, Homo sapiens
ctctctgctccag

SEQ ID NO: 3879903 - DNA, 18 bp, Homo sapiens
ctctctgctctagccagg

SEQ ID NO: 3879904 - DNA, 17 bp, Homo sapiens
ctctctggggccctggg

SEQ ID NO: 3879905 - DNA, 22 bp, Homo sapiens
ctctctggggccctgggcctca

SEQ ID NO: 3879906 - DNA, 19 bp, Homo sapiens
ctctctgtacaaaaacaaa

SEQ ID NO: 3879907 - DNA, 18 bp, Homo sapiens
ctctctgtataaacatta

SEQ ID NO: 3879908 - DNA, 13 bp, Homo sapiens
ctctcttcaggag

SEQ ID NO: 3879909 - DNA, 23 bp, Homo sapiens
ctctcttcaggaggccctggtgt

SEQ ID NO: 3879910 - DNA, 22 bp, Homo sapiens
ctctcttccagaagatgccctc

SEQ ID NO: 3879911 - DNA, 16 bp, Homo sapiens
ctctctttctccctca

SEQ ID NO: 3879912 - DNA, 17 bp, Homo sapiens
ctctcttttttttttct

SEQ ID NO: 3879913 - DNA, 21 bp, Homo sapiens
ctctgaaaagcaattgccctg

SEQ ID NO: 3879914 - DNA, 17 bp, Homo sapiens
ctctgaacaaacactga

SEQ ID NO: 3879915 - DNA, 21 bp, Homo sapiens
ctctgaacaaacactgaatca

SEQ ID NO: 3879916 - DNA, 18 bp, Homo sapiens
ctctgaatggtccagggt

SEQ ID NO: 3879917 - DNA, 19 bp, Homo sapiens
ctctgacaagggctgacct

SEQ ID NO: 3879918 - DNA, 16 bp, Homo sapiens
ctctgacccagtgaga

SEQ ID NO: 3879919 - DNA, 19 bp, Homo sapiens
ctctgagaattccaaggag

SEQ ID NO: 3879920 - DNA, 21 bp, Homo sapiens
ctctgagaattccaaggagtt

SEQ ID NO: 3879921 - DNA, 16 bp, Homo sapiens
ctctgagcaaatgtgg

SEQ ID NO: 3879922 - DNA, 11 bp, Homo sapiens
ctctgagccca

SEQ ID NO: 3879923 - DNA, 12 bp, Homo sapiens
ctctgagcccag

SEQ ID NO: 3879924 - DNA, 15 bp, Homo sapiens
ctctgagcccaggcc

SEQ ID NO: 3879925 - DNA, 13 bp, Homo sapiens
ctctgaggccagc

SEQ ID NO: 3879926 - DNA, 16 bp, Homo sapiens
ctctgaggccagcctg

SEQ ID NO: 3879927 - DNA, 10 bp, Homo sapiens
ctctgaggcg

SEQ ID NO: 3879928 - DNA, 12 bp, Homo sapiens
ctctgaggcgcc

SEQ ID NO: 3879929 - DNA, 19 bp, Homo sapiens
ctctgaggcgccccaaccc

SEQ ID NO: 3879930 - DNA, 18 bp, Homo sapiens
ctctgaggcttccagaga

SEQ ID NO: 3879931 - DNA, 17 bp, Homo sapiens
ctctgatacccagagca

SEQ ID NO: 3879932 - DNA, 17 bp, Homo sapiens
ctctgatatgggactga

SEQ ID NO: 3879933 - DNA, 21 bp, Homo sapiens
ctctgatatgggactgagcct

SEQ ID NO: 3879934 - DNA, 20 bp, Homo sapiens
ctctgatgcatcagaaaggg

SEQ ID NO: 3879935 - DNA, 22 bp, Homo sapiens
ctctgattttcaaagctttttc

SEQ ID NO: 3879936 - DNA, 17 bp, Homo sapiens
ctctgcaatgggcactg

SEQ ID NO: 3879937 - DNA, 16 bp, Homo sapiens
ctctgcactccatggc

SEQ ID NO: 3879938 - DNA, 17 bp, Homo sapiens
ctctgcactccatggcc

SEQ ID NO: 3879939 - DNA, 15 bp, Homo sapiens
ctctgcagccagccc

SEQ ID NO: 3879940 - DNA, 14 bp, Homo sapiens
ctctgcaggcacct

SEQ ID NO: 3879941 - DNA, 13 bp, Homo sapiens
ctctgcatgtgtg

SEQ ID NO: 3879942 - DNA, 14 bp, Homo sapiens
ctctgccacctccc

SEQ ID NO: 3879943 - DNA, 22 bp, Homo sapiens
ctctgccccaagcagccagcca

SEQ ID NO: 3879944 - DNA, 14 bp, Homo sapiens
ctctgccccaagcc

SEQ ID NO: 3879945 - DNA, 14 bp, Homo sapiens
ctctgccccaaggg

SEQ ID NO: 3879946 - DNA, 23 bp, Homo sapiens
ctctgccccaaggggcccacaaa

SEQ ID NO: 3879947 - DNA, 15 bp, Homo sapiens
ctctgccccagaggc

SEQ ID NO: 3879948 - DNA, 19 bp, Homo sapiens
ctctgccccttctgtttcc

SEQ ID NO: 3879949 - DNA, 21 bp, Homo sapiens
ctctgccccttgggcatccac

SEQ ID NO: 3879950 - DNA, 16 bp, Homo sapiens
ctctgccctgcctccc

SEQ ID NO: 3879951 - DNA, 16 bp, Homo sapiens
ctctgcctcctcttca

SEQ ID NO: 3879952 - DNA, 23 bp, Homo sapiens
ctctgcctggaggatccctccat

SEQ ID NO: 3879953 - DNA, 22 bp, Homo sapiens
ctctgccttttttcacagcccg

SEQ ID NO: 3879954 - DNA, 15 bp, Homo sapiens
ctctgcggtggtgcc

SEQ ID NO: 3879955 - DNA, 19 bp, Homo sapiens
ctctgcggtggtgccagag

SEQ ID NO: 3879956 - DNA, 20 bp, Homo sapiens
ctctgcggtggtgccagagg

SEQ ID NO: 3879957 - DNA, 22 bp, Homo sapiens
ctctgcgtgcagggacaaagag

SEQ ID NO: 3879958 - DNA, 14 bp, Homo sapiens
ctctgctctagcca

SEQ ID NO: 3879959 - DNA, 17 bp, Homo sapiens
ctctgctggcctggccg

SEQ ID NO: 3879960 - DNA, 21 bp, Homo sapiens
ctctgctggcctggccggcaa

SEQ ID NO: 3879961 - DNA, 21 bp, Homo sapiens
ctctgcttactaatgtgcccc

SEQ ID NO: 3879962 - DNA, 20 bp, Homo sapiens
ctctggaaaatgtgacccag

SEQ ID NO: 3879963 - DNA, 21 bp, Homo sapiens
ctctggaaaatgtgacccaga

SEQ ID NO: 3879964 - DNA, 15 bp, Homo sapiens
ctctggaagcctgga

SEQ ID NO: 3879965 - DNA, 23 bp, Homo sapiens
ctctggacatgatttagggaagc

SEQ ID NO: 3879966 - DNA, 16 bp, Homo sapiens
ctctggaccaaccctg

SEQ ID NO: 3879967 - DNA, 12 bp, Homo sapiens
ctctggactgtg

SEQ ID NO: 3879968 - DNA, 13 bp, Homo sapiens
ctctggagccaga

SEQ ID NO: 3879969 - DNA, 17 bp, Homo sapiens
ctctggaggctgcagag

SEQ ID NO: 3879970 - DNA, 15 bp, Homo sapiens
ctctggatccctgga

SEQ ID NO: 3879971 - DNA, 19 bp, Homo sapiens
ctctggatcctgctgtggc

SEQ ID NO: 3879972 - DNA, 22 bp, Homo sapiens
ctctggatcctgctgtggcctc

SEQ ID NO: 3879973 - DNA, 20 bp, Homo sapiens
ctctggatggcaccagaggc

SEQ ID NO: 3879974 - DNA, 13 bp, Homo sapiens
ctctggcacccag

SEQ ID NO: 3879975 - DNA, 14 bp, Homo sapiens
ctctggcagccaca

SEQ ID NO: 3879976 - DNA, 16 bp, Homo sapiens
ctctggcagccacact

SEQ ID NO: 3879977 - DNA, 22 bp, Homo sapiens
ctctggcagccacacttctcag

SEQ ID NO: 3879978 - DNA, 14 bp, Homo sapiens
ctctggccctgcct

SEQ ID NO: 3879979 - DNA, 18 bp, Homo sapiens
ctctggcctcagccgact

SEQ ID NO: 3879980 - DNA, 12 bp, Homo sapiens
ctctggctccag

SEQ ID NO: 3879981 - DNA, 14 bp, Homo sapiens
ctctggctccagaa

SEQ ID NO: 3879982 - DNA, 13 bp, Homo sapiens
ctctggctggcta

SEQ ID NO: 3879983 - DNA, 17 bp, Homo sapiens
ctctggcttccaggtat

SEQ ID NO: 3879984 - DNA, 18 bp, Homo sapiens
ctctgggctcagggctgg

SEQ ID NO: 3879985 - DNA, 19 bp, Homo sapiens
ctctgggctcagggctgga

SEQ ID NO: 3879986 - DNA, 17 bp, Homo sapiens
ctctgggtccctcggag

SEQ ID NO: 3879987 - DNA, 14 bp, Homo sapiens
ctctgtacaaaaac

SEQ ID NO: 3879988 - DNA, 13 bp, Homo sapiens
ctctgtcagatgg

SEQ ID NO: 3879989 - DNA, 20 bp, Homo sapiens
ctctgtcagccagccgccct

SEQ ID NO: 3879990 - DNA, 18 bp, Homo sapiens
ctctgtcatcactccctg

SEQ ID NO: 3879991 - DNA, 13 bp, Homo sapiens
ctctgtccaggcc

SEQ ID NO: 3879992 - DNA, 14 bp, Homo sapiens
ctctgtccaggcca

SEQ ID NO: 3879993 - DNA, 23 bp, Homo sapiens
ctctgtccaggccactgtggcca

SEQ ID NO: 3879994 - DNA, 18 bp, Homo sapiens
ctctgtctcgagcgccct

SEQ ID NO: 3879995 - DNA, 23 bp, Homo sapiens
ctctgtctcgagcgccctgcaga

SEQ ID NO: 3879996 - DNA, 15 bp, Homo sapiens
ctctgtgccagagcc

SEQ ID NO: 3879997 - DNA, 21 bp, Homo sapiens
ctctgtgctttgactcacctg

SEQ ID NO: 3879998 - DNA, 22 bp, Homo sapiens
ctctgtgcttttaaatgcataa

SEQ ID NO: 3879999 - DNA, 13 bp, Homo sapiens
ctctgtggcctgt

SEQ ID NO: 3880000 - DNA, 14 bp, Homo sapiens
ctctgtggcctgtg

SEQ ID NO: 3880001 - DNA, 15 bp, Homo sapiens
ctctgtggcctgtgt

SEQ ID NO: 3880002 - DNA, 16 bp, Homo sapiens
ctctgtggcctgtgtc

SEQ ID NO: 3880003 - DNA, 18 bp, Homo sapiens
ctctgtggcctgtgtcca

SEQ ID NO: 3880004 - DNA, 23 bp, Homo sapiens
ctctgtggcctgtgtccagcagc

SEQ ID NO: 3880005 - DNA, 17 bp, Homo sapiens
ctctgtgtcctctcccc

SEQ ID NO: 3880006 - DNA, 15 bp, Homo sapiens
ctctgtgtgcacaaa

SEQ ID NO: 3880007 - DNA, 20 bp, Homo sapiens
ctctgtgttgtgaatgtcat

SEQ ID NO: 3880008 - DNA, 13 bp, Homo sapiens
ctcttacccagaa

SEQ ID NO: 3880009 - DNA, 13 bp, Homo sapiens
ctcttagctgtct

SEQ ID NO: 3880010 - DNA, 18 bp, Homo sapiens
ctcttagctttctcaggg

SEQ ID NO: 3880011 - DNA, 16 bp, Homo sapiens
ctcttagtgcccgcct

SEQ ID NO: 3880012 - DNA, 12 bp, Homo sapiens
ctcttatgaaat

SEQ ID NO: 3880013 - DNA, 14 bp, Homo sapiens
ctcttatgaaatgg

SEQ ID NO: 3880014 - DNA, 16 bp, Homo sapiens
ctcttcaactgaccag

SEQ ID NO: 3880015 - DNA, 20 bp, Homo sapiens
ctcttcaactgaccagcctc

SEQ ID NO: 3880016 - DNA, 11 bp, Homo sapiens
ctcagtttcct

SEQ ID NO: 3880017 - DNA, 21 bp, Homo sapiens
ctcagtttcctcatctgcaga

SEQ ID NO: 3880018 - DNA, 17 bp, Homo sapiens
ctcagtttttcggtggg

SEQ ID NO: 3880019 - DNA, 20 bp, Homo sapiens
ctcagtttttcggtgggaca

SEQ ID NO: 3880020 - DNA, 15 bp, Homo sapiens
ctcataactcattgt

SEQ ID NO: 3880021 - DNA, 14 bp, Homo sapiens
ctcatacctctgac

SEQ ID NO: 3880022 - DNA, 15 bp, Homo sapiens
ctcatacctctgacc

SEQ ID NO: 3880023 - DNA, 14 bp, Homo sapiens
ctcatatatttaag

SEQ ID NO: 3880024 - DNA, 16 bp, Homo sapiens
ctcatatgtagccctc

SEQ ID NO: 3880025 - DNA, 20 bp, Homo sapiens
ctcatatgtagccctcatga

SEQ ID NO: 3880026 - DNA, 13 bp, Homo sapiens
ctcatatttaaag

SEQ ID NO: 3880027 - DNA, 12 bp, Homo sapiens
ctcatattttgt

SEQ ID NO: 3880028 - DNA, 15 bp, Homo sapiens
ctcatcacccagtcc

SEQ ID NO: 3880029 - DNA, 22 bp, Homo sapiens
ctcatcacccagtcctggccat

SEQ ID NO: 3880030 - DNA, 24 bp, Homo sapiens
ctcatcagtgtcctcttgctcaaa

SEQ ID NO: 3880031 - DNA, 17 bp, Homo sapiens
ctcatcatattgtatgt

SEQ ID NO: 3880032 - DNA, 22 bp, Homo sapiens
ctcatccagggtgttacaaggc

SEQ ID NO: 3880033 - DNA, 16 bp, Homo sapiens
ctcatccccagtccca

SEQ ID NO: 3880034 - DNA, 17 bp, Homo sapiens
ctcatccctcggaagcc

SEQ ID NO: 3880035 - DNA, 13 bp, Homo sapiens
ctcatcctgtgtg

SEQ ID NO: 3880036 - DNA, 17 bp, Homo sapiens
ctcatcgccagacaact

SEQ ID NO: 3880037 - DNA, 18 bp, Homo sapiens
ctcatctcactgcccagt

SEQ ID NO: 3880038 - DNA, 15 bp, Homo sapiens
ctcatgataatctgg

SEQ ID NO: 3880039 - DNA, 12 bp, Homo sapiens
ctcatgccacac

SEQ ID NO: 3880040 - DNA, 17 bp, Homo sapiens
ctcatgccacaccttct

SEQ ID NO: 3880041 - DNA, 21 bp, Homo sapiens
ctcatgcctgcctgataccct

SEQ ID NO: 3880042 - DNA, 23 bp, Homo sapiens
ctcatgcctggcccccctccagg

SEQ ID NO: 3880043 - DNA, 20 bp, Homo sapiens
ctcatggcgtaatgggcctg

SEQ ID NO: 3880044 - DNA, 15 bp, Homo sapiens
ctcatgtctcagcct

SEQ ID NO: 3880045 - DNA, 14 bp, Homo sapiens
ctcattacccaggt

SEQ ID NO: 3880046 - DNA, 18 bp, Homo sapiens
ctcattccaacagtgagt

SEQ ID NO: 3880047 - DNA, 14 bp, Homo sapiens
ctcattcccctcgt

SEQ ID NO: 3880048 - DNA, 17 bp, Homo sapiens
ctcattccttctggagg

SEQ ID NO: 3880049 - DNA, 16 bp, Homo sapiens
ctcattcgcctgtggg

SEQ ID NO: 3880050 - DNA, 22 bp, Homo sapiens
ctcatttaatcctcccttcctc

SEQ ID NO: 3880051 - DNA, 22 bp, Homo sapiens
ctcatttttttttttgtttctg

SEQ ID NO: 3880052 - DNA, 14 bp, Homo sapiens
ctccaaagccccac

SEQ ID NO: 3880053 - DNA, 22 bp, Homo sapiens
ctccaaaggaagtctaggagct

SEQ ID NO: 3880054 - DNA, 22 bp, Homo sapiens
ctccaaaggggctgctggggca

SEQ ID NO: 3880055 - DNA, 23 bp, Homo sapiens
ctccaaatattattcaagtgcct

SEQ ID NO: 3880056 - DNA, 20 bp, Homo sapiens
ctccaacaataaagagctca

SEQ ID NO: 3880057 - DNA, 21 bp, Homo sapiens
ctccaagaatacagaaaatgc

SEQ ID NO: 3880058 - DNA, 14 bp, Homo sapiens
ctccaagctccatc

SEQ ID NO: 3880059 - DNA, 18 bp, Homo sapiens
ctccaagctccatctcca

SEQ ID NO: 3880060 - DNA, 13 bp, Homo sapiens
ctccaagcttcaa

SEQ ID NO: 3880061 - DNA, 19 bp, Homo sapiens
ctccaagcttcaagtgata

SEQ ID NO: 3880062 - DNA, 14 bp, Homo sapiens
ctccaaggaccagg

SEQ ID NO: 3880063 - DNA, 22 bp, Homo sapiens
ctccaatcccaccaaccctcag

SEQ ID NO: 3880064 - DNA, 16 bp, Homo sapiens
ctccaattgtaaaaaa

SEQ ID NO: 3880065 - DNA, 12 bp, Homo sapiens
ctccacagtgct

SEQ ID NO: 3880066 - DNA, 14 bp, Homo sapiens
ctccacagtgctgc

SEQ ID NO: 3880067 - DNA, 15 bp, Homo sapiens
ctccacagtgctgct

SEQ ID NO: 3880068 - DNA, 16 bp, Homo sapiens
ctccacagtgctgctt

SEQ ID NO: 3880069 - DNA, 22 bp, Homo sapiens
ctccacagttcgacctgcggct

SEQ ID NO: 3880070 - DNA, 21 bp, Homo sapiens
ctccacatccaccccactgga

SEQ ID NO: 3880071 - DNA, 12 bp, Homo sapiens
ctccaccaaccc

SEQ ID NO: 3880072 - DNA, 20 bp, Homo sapiens
ctccacccccgccacggcca

SEQ ID NO: 3880073 - DNA, 16 bp, Homo sapiens
ctccaccccctccagc

SEQ ID NO: 3880074 - DNA, 16 bp, Homo sapiens
ctccaccgcagaagga

SEQ ID NO: 3880075 - DNA, 15 bp, Homo sapiens
ctccacctcagcctt

SEQ ID NO: 3880076 - DNA, 14 bp, Homo sapiens
ctccacctcctgag

SEQ ID NO: 3880077 - DNA, 22 bp, Homo sapiens
ctccacctcttcaccccccact

SEQ ID NO: 3880078 - DNA, 21 bp, Homo sapiens
ctccacgcctcctggccagac

SEQ ID NO: 3880079 - DNA, 21 bp, Homo sapiens
ctccacggtagcacttgacct

SEQ ID NO: 3880080 - DNA, 15 bp, Homo sapiens
ctccactcactccag

SEQ ID NO: 3880081 - DNA, 17 bp, Homo sapiens
ctccactcactccagcc

SEQ ID NO: 3880082 - DNA, 18 bp, Homo sapiens
ctccactcactccagccc

SEQ ID NO: 3880083 - DNA, 19 bp, Homo sapiens
ctccactcactccagccca

SEQ ID NO: 3880084 - DNA, 15 bp, Homo sapiens
ctccactccacctcc

SEQ ID NO: 3880085 - DNA, 17 bp, Homo sapiens
ctccactcccccacctg

SEQ ID NO: 3880086 - DNA, 21 bp, Homo sapiens
ctccactctccttcgtgtctc

SEQ ID NO: 3880087 - DNA, 22 bp, Homo sapiens
ctccactctccttcgtgtctct

SEQ ID NO: 3880088 - DNA, 15 bp, Homo sapiens
ctccactgccttcga

SEQ ID NO: 3880089 - DNA, 16 bp, Homo sapiens
ctccactggatggagg

SEQ ID NO: 3880090 - DNA, 12 bp, Homo sapiens
ctccactgtcac

SEQ ID NO: 3880091 - DNA, 16 bp, Homo sapiens
ctccactgtcacattg

SEQ ID NO: 3880092 - DNA, 16 bp, Homo sapiens
ctccagaagtggggct

SEQ ID NO: 3880093 - DNA, 21 bp, Homo sapiens
ctccagaataccttcttcgct

SEQ ID NO: 3880094 - DNA, 15 bp, Homo sapiens
ctccagaatctgctg

SEQ ID NO: 3880095 - DNA, 18 bp, Homo sapiens
ctccagacccctggcttt

SEQ ID NO: 3880096 - DNA, 15 bp, Homo sapiens
ctccagacccctgtg

SEQ ID NO: 3880097 - DNA, 19 bp, Homo sapiens
ctccagacccctgtggcag

SEQ ID NO: 3880098 - DNA, 14 bp, Homo sapiens
ctccagaccctgcc

SEQ ID NO: 3880099 - DNA, 17 bp, Homo sapiens
ctccagaccctgcctga

SEQ ID NO: 3880100 - DNA, 21 bp, Homo sapiens
ctccagaccctgcctgagccc

SEQ ID NO: 3880101 - DNA, 16 bp, Homo sapiens
ctccagagacaggaaa

SEQ ID NO: 3880102 - DNA, 18 bp, Homo sapiens
ctcctcaccccgtctggg

SEQ ID NO: 3880103 - DNA, 23 bp, Homo sapiens
ctcctccaaaggaagtctaggag

SEQ ID NO: 3880104 - DNA, 19 bp, Homo sapiens
ctcctccacagtgctgctt

SEQ ID NO: 3880105 - DNA, 19 bp, Homo sapiens
ctcctccactcactccagc

SEQ ID NO: 3880106 - DNA, 20 bp, Homo sapiens
ctcctccagggccacgtgcc

SEQ ID NO: 3880107 - DNA, 14 bp, Homo sapiens
ctcctcccacaatc

SEQ ID NO: 3880108 - DNA, 22 bp, Homo sapiens
ctcctcccaggcgccccttccc

SEQ ID NO: 3880109 - DNA, 14 bp, Homo sapiens
ctcctccttgcctg

SEQ ID NO: 3880110 - DNA, 22 bp, Homo sapiens
ctcctccttgcctgcttttctt

SEQ ID NO: 3880111 - DNA, 20 bp, Homo sapiens
ctcctcggccccctccatcg

SEQ ID NO: 3880112 - DNA, 13 bp, Homo sapiens
ctcctctaagcca

SEQ ID NO: 3880113 - DNA, 15 bp, Homo sapiens
ctcctctccaggcac

SEQ ID NO: 3880114 - DNA, 15 bp, Homo sapiens
ctcctctccctgcac

SEQ ID NO: 3880115 - DNA, 16 bp, Homo sapiens
ctcctctccttgggct

SEQ ID NO: 3880116 - DNA, 17 bp, Homo sapiens
ctcctctccttgggctc

SEQ ID NO: 3880117 - DNA, 20 bp, Homo sapiens
ctcctctccttgggctcctg

SEQ ID NO: 3880118 - DNA, 23 bp, Homo sapiens
ctcctctccttgggctcctggct

SEQ ID NO: 3880119 - DNA, 12 bp, Homo sapiens
ctcctctctgcc

SEQ ID NO: 3880120 - DNA, 15 bp, Homo sapiens
ctcctctctgccacc

SEQ ID NO: 3880121 - DNA, 13 bp, Homo sapiens
ctcctctgctgct

SEQ ID NO: 3880122 - DNA, 22 bp, Homo sapiens
ctcctctgcttgcatcacttgg

SEQ ID NO: 3880123 - DNA, 17 bp, Homo sapiens
ctcctctggcccagcct

SEQ ID NO: 3880124 - DNA, 15 bp, Homo sapiens
ctcctctgtccaggc

SEQ ID NO: 3880125 - DNA, 18 bp, Homo sapiens
ctcctcttcaactgacca

SEQ ID NO: 3880126 - DNA, 23 bp, Homo sapiens
ctcctcttcaactgaccagcctc

SEQ ID NO: 3880127 - DNA, 16 bp, Homo sapiens
ctcctgacctgaggct

SEQ ID NO: 3880128 - DNA, 16 bp, Homo sapiens
ctcctgacctgtcacc

SEQ ID NO: 3880129 - DNA, 17 bp, Homo sapiens
ctcctgagaaggcgagg

SEQ ID NO: 3880130 - DNA, 20 bp, Homo sapiens
ctcctgagaaggcgaggaga

SEQ ID NO: 3880131 - DNA, 21 bp, Homo sapiens
ctcctgagaaggcgaggagag

SEQ ID NO: 3880132 - DNA, 13 bp, Homo sapiens
ctcctgatggcca

SEQ ID NO: 3880133 - DNA, 15 bp, Homo sapiens
ctcctgatggccaag

SEQ ID NO: 3880134 - DNA, 20 bp, Homo sapiens
ctcctgatggccaagagcat

SEQ ID NO: 3880135 - DNA, 14 bp, Homo sapiens
ctcctgcccaggag

SEQ ID NO: 3880136 - DNA, 20 bp, Homo sapiens
ctcctgcccaggagagccag

SEQ ID NO: 3880137 - DNA, 22 bp, Homo sapiens
ctcctgcccaggagagccagcc

SEQ ID NO: 3880138 - DNA, 16 bp, Homo sapiens
ctcctgcctactcacg

SEQ ID NO: 3880139 - DNA, 11 bp, Homo sapiens
ctcctgcctgt

SEQ ID NO: 3880140 - DNA, 16 bp, Homo sapiens
ctcctggaaccaatcc

SEQ ID NO: 3880141 - DNA, 15 bp, Homo sapiens
ctcctggaagctgtg

SEQ ID NO: 3880142 - DNA, 16 bp, Homo sapiens
ctcctggagcatccca

SEQ ID NO: 3880143 - DNA, 19 bp, Homo sapiens
ctcctggagcatcccaggc

SEQ ID NO: 3880144 - DNA, 23 bp, Homo sapiens
ctcctggccagacgctgccgctg

SEQ ID NO: 3880145 - DNA, 14 bp, Homo sapiens
ctcctgggggtggc

SEQ ID NO: 3880146 - DNA, 15 bp, Homo sapiens
ctcctgggggtggca

SEQ ID NO: 3880147 - DNA, 18 bp, Homo sapiens
ctcctgggggtggcaggc

SEQ ID NO: 3880148 - DNA, 20 bp, Homo sapiens
ctcctgggggtggcaggcac

SEQ ID NO: 3880149 - DNA, 18 bp, Homo sapiens
ctcctgggggttctttct

SEQ ID NO: 3880150 - DNA, 20 bp, Homo sapiens
ctcctgggggttctttcttc

SEQ ID NO: 3880151 - DNA, 22 bp, Homo sapiens
ctcctgggggttctttcttcct

SEQ ID NO: 3880152 - DNA, 20 bp, Homo sapiens
ctcctgtataaccccacctt

SEQ ID NO: 3880153 - DNA, 14 bp, Homo sapiens
ctcctgtccaacct

SEQ ID NO: 3880154 - DNA, 19 bp, Homo sapiens
ctcctgtccctacccactc

SEQ ID NO: 3880155 - DNA, 22 bp, Homo sapiens
ctcctgtccctacccactcttt

SEQ ID NO: 3880156 - DNA, 21 bp, Homo sapiens
ctcctgtcctcccatcccctg

SEQ ID NO: 3880157 - DNA, 22 bp, Homo sapiens
ctcctgtgcccacatcccaggc

SEQ ID NO: 3880158 - DNA, 21 bp, Homo sapiens
ctcctgtgctctggaggctgc

SEQ ID NO: 3880159 - DNA, 16 bp, Homo sapiens
ctcctgtgggagcctc

SEQ ID NO: 3880160 - DNA, 18 bp, Homo sapiens
ctcctgtgggagcctcgc

SEQ ID NO: 3880161 - DNA, 19 bp, Homo sapiens
ctcctgtgggagcctcgca

SEQ ID NO: 3880162 - DNA, 13 bp, Homo sapiens
ctcctgtgtacag

SEQ ID NO: 3880163 - DNA, 17 bp, Homo sapiens
ctcctgtgtggaagaag

SEQ ID NO: 3880164 - DNA, 16 bp, Homo sapiens
ctccttactctgagcc

SEQ ID NO: 3880165 - DNA, 16 bp, Homo sapiens
ctccttatttatcaac

SEQ ID NO: 3880166 - DNA, 13 bp, Homo sapiens
ctccttcccctgt

SEQ ID NO: 3880167 - DNA, 22 bp, Homo sapiens
ctccttcccctgtggtcttgga

SEQ ID NO: 3880168 - DNA, 22 bp, Homo sapiens
ctccttcccgccgcccgacccc

SEQ ID NO: 3880169 - DNA, 10 bp, Homo sapiens
ctccttccct

SEQ ID NO: 3880170 - DNA, 18 bp, Homo sapiens
ctccttcccttctctcct

SEQ ID NO: 3880171 - DNA, 13 bp, Homo sapiens
ctccttcctgccc

SEQ ID NO: 3880172 - DNA, 14 bp, Homo sapiens
ctccttcgtgtctc

SEQ ID NO: 3880173 - DNA, 15 bp, Homo sapiens
ctccttcgtgtctct

SEQ ID NO: 3880174 - DNA, 14 bp, Homo sapiens
ctccttcttccctg

SEQ ID NO: 3880175 - DNA, 19 bp, Homo sapiens
ctccttgactccttgtggt

SEQ ID NO: 3880176 - DNA, 13 bp, Homo sapiens
ctccttgctctgc

SEQ ID NO: 3880177 - DNA, 15 bp, Homo sapiens
ctccttgggctcctg

SEQ ID NO: 3880178 - DNA, 16 bp, Homo sapiens
ctccttgggctcctgg

SEQ ID NO: 3880179 - DNA, 17 bp, Homo sapiens
ctccttgtggtttatgt

SEQ ID NO: 3880180 - DNA, 16 bp, Homo sapiens
ctcctttacctaccac

SEQ ID NO: 3880181 - DNA, 14 bp, Homo sapiens
ctcctttagcaggt

SEQ ID NO: 3880182 - DNA, 17 bp, Homo sapiens
ctcctttcacaaccttc

SEQ ID NO: 3880183 - DNA, 17 bp, Homo sapiens
ctcctttctccagccag

SEQ ID NO: 3880184 - DNA, 19 bp, Homo sapiens
ctcctttctccagccagca

SEQ ID NO: 3880185 - DNA, 13 bp, Homo sapiens
ctcctttctctat

SEQ ID NO: 3880186 - DNA, 14 bp, Homo sapiens
ctcctttctttcta

SEQ ID NO: 3880187 - DNA, 15 bp, Homo sapiens
ctcctttgcactgag

SEQ ID NO: 3880188 - DNA, 18 bp, Homo sapiens
ctccagagacaggaaaga

SEQ ID NO: 3880189 - DNA, 14 bp, Homo sapiens
ctccagagccagcc

SEQ ID NO: 3880190 - DNA, 15 bp, Homo sapiens
ctccagagccagcct

SEQ ID NO: 3880191 - DNA, 21 bp, Homo sapiens
ctccagagccagcctgggact

SEQ ID NO: 3880192 - DNA, 12 bp, Homo sapiens
ctccagagtctg

SEQ ID NO: 3880193 - DNA, 16 bp, Homo sapiens
ctccagagtctgagcc

SEQ ID NO: 3880194 - DNA, 18 bp, Homo sapiens
ctccagagtctgagcccc

SEQ ID NO: 3880195 - DNA, 19 bp, Homo sapiens
ctccagagtctgagccccc

SEQ ID NO: 3880196 - DNA, 16 bp, Homo sapiens
ctccagagtgtgcaga

SEQ ID NO: 3880197 - DNA, 13 bp, Homo sapiens
ctccagcatccag

SEQ ID NO: 3880198 - DNA, 14 bp, Homo sapiens
ctccagcatccagc

SEQ ID NO: 3880199 - DNA, 16 bp, Homo sapiens
ctccagcatccagcct

SEQ ID NO: 3880200 - DNA, 16 bp, Homo sapiens
ctccagcatcctgctt

SEQ ID NO: 3880201 - DNA, 11 bp, Homo sapiens
ctccagccagc

SEQ ID NO: 3880202 - DNA, 12 bp, Homo sapiens
ctccagccagca

SEQ ID NO: 3880203 - DNA, 24 bp, Homo sapiens
ctccagccagcaatgatgtccaga

SEQ ID NO: 3880204 - DNA, 20 bp, Homo sapiens
ctccagcccacacccctcca

SEQ ID NO: 3880205 - DNA, 11 bp, Homo sapiens
ctccagccctg

SEQ ID NO: 3880206 - DNA, 14 bp, Homo sapiens
ctccagccctgtcc

SEQ ID NO: 3880207 - DNA, 12 bp, Homo sapiens
ctccagcctctc

SEQ ID NO: 3880208 - DNA, 17 bp, Homo sapiens
ctccagcctctcccggc

SEQ ID NO: 3880209 - DNA, 24 bp, Homo sapiens
ctccagcctctcccggctgcctgc

SEQ ID NO: 3880210 - DNA, 13 bp, Homo sapiens
ctccagctttcct

SEQ ID NO: 3880211 - DNA, 15 bp, Homo sapiens
ctccagctttcctgt

SEQ ID NO: 3880212 - DNA, 16 bp, Homo sapiens
ctccagctttcctgta

SEQ ID NO: 3880213 - DNA, 22 bp, Homo sapiens
ctccaggatggtgcaggatggc

SEQ ID NO: 3880214 - DNA, 19 bp, Homo sapiens
ctccaggattgaagagcat

SEQ ID NO: 3880215 - DNA, 17 bp, Homo sapiens
ctccaggcaccatctcc

SEQ ID NO: 3880216 - DNA, 16 bp, Homo sapiens
ctccagggccacgtgc

SEQ ID NO: 3880217 - DNA, 19 bp, Homo sapiens
ctccagggccacgtgccag

SEQ ID NO: 3880218 - DNA, 18 bp, Homo sapiens
ctccagggtcttgggcta

SEQ ID NO: 3880219 - DNA, 22 bp, Homo sapiens
ctccagggtcttgggctactgg

SEQ ID NO: 3880220 - DNA, 17 bp, Homo sapiens
ctccagtctcctgacat

SEQ ID NO: 3880221 - DNA, 20 bp, Homo sapiens
ctccagtctcctgacattaa

SEQ ID NO: 3880222 - DNA, 15 bp, Homo sapiens
ctccagtgagctgga

SEQ ID NO: 3880223 - DNA, 16 bp, Homo sapiens
ctccagtggttgctgt

SEQ ID NO: 3880224 - DNA, 19 bp, Homo sapiens
ctccagtggttgctgttga

SEQ ID NO: 3880225 - DNA, 17 bp, Homo sapiens
ctccagttttcagttga

SEQ ID NO: 3880226 - DNA, 14 bp, Homo sapiens
ctccatatctcctt

SEQ ID NO: 3880227 - DNA, 15 bp, Homo sapiens
ctccatatggaggcc

SEQ ID NO: 3880228 - DNA, 17 bp, Homo sapiens
ctccatccggctcctgt

SEQ ID NO: 3880229 - DNA, 21 bp, Homo sapiens
ctccatccggctcctgtcatc

SEQ ID NO: 3880230 - DNA, 14 bp, Homo sapiens
ctccatctccactc

SEQ ID NO: 3880231 - DNA, 13 bp, Homo sapiens
ctccatgcccaac

SEQ ID NO: 3880232 - DNA, 11 bp, Homo sapiens
ctccatggagg

SEQ ID NO: 3880233 - DNA, 16 bp, Homo sapiens
ctccatggaggaggtg

SEQ ID NO: 3880234 - DNA, 15 bp, Homo sapiens
ctccatggccacccc

SEQ ID NO: 3880235 - DNA, 16 bp, Homo sapiens
ctccatggccaccccg

SEQ ID NO: 3880236 - DNA, 21 bp, Homo sapiens
ctccatggccaccccgtgcca

SEQ ID NO: 3880237 - DNA, 20 bp, Homo sapiens
ctccatggggaagtgctccc

SEQ ID NO: 3880238 - DNA, 16 bp, Homo sapiens
ctccattgctgttgtt

SEQ ID NO: 3880239 - DNA, 21 bp, Homo sapiens
ctccatttcacacaggtcctg

SEQ ID NO: 3880240 - DNA, 21 bp, Homo sapiens
ctcccaacccaattcaggact

SEQ ID NO: 3880241 - DNA, 12 bp, Homo sapiens
ctcccaacctca

SEQ ID NO: 3880242 - DNA, 23 bp, Homo sapiens
ctcccaacctcaatgccctgcca

SEQ ID NO: 3880243 - DNA, 16 bp, Homo sapiens
ctcccaataaagctgg

SEQ ID NO: 3880244 - DNA, 21 bp, Homo sapiens
ctcccacaggcccttcctctc

SEQ ID NO: 3880245 - DNA, 22 bp, Homo sapiens
ctcccaccccacccccttcagt

SEQ ID NO: 3880246 - DNA, 18 bp, Homo sapiens
ctcccaccccactccagc

SEQ ID NO: 3880247 - DNA, 19 bp, Homo sapiens
ctcccaccccggcctccac

SEQ ID NO: 3880248 - DNA, 19 bp, Homo sapiens
ctcccacgatgtcaaggac

SEQ ID NO: 3880249 - DNA, 14 bp, Homo sapiens
ctcccactgagttt

SEQ ID NO: 3880250 - DNA, 20 bp, Homo sapiens
ctcccactggaacagcccat

SEQ ID NO: 3880251 - DNA, 16 bp, Homo sapiens
ctcccagatgctgggg

SEQ ID NO: 3880252 - DNA, 19 bp, Homo sapiens
ctcccagcagccctaagga

SEQ ID NO: 3880253 - DNA, 21 bp, Homo sapiens
ctcccagccctatggatgtgg

SEQ ID NO: 3880254 - DNA, 11 bp, Homo sapiens
ctcccagcctg

SEQ ID NO: 3880255 - DNA, 15 bp, Homo sapiens
ctcccaggccccatg

SEQ ID NO: 3880256 - DNA, 19 bp, Homo sapiens
ctcccaggccccatgacct

SEQ ID NO: 3880257 - DNA, 19 bp, Homo sapiens
ctcccaggcgccccttccc

SEQ ID NO: 3880258 - DNA, 20 bp, Homo sapiens
ctcccaggcgccccttcccc

SEQ ID NO: 3880259 - DNA, 20 bp, Homo sapiens
ctcccaggtggattttgtgg

SEQ ID NO: 3880260 - DNA, 22 bp, Homo sapiens
ctcccaggtggattttgtggag

SEQ ID NO: 3880261 - DNA, 18 bp, Homo sapiens
ctcccatagcgctggctc

SEQ ID NO: 3880262 - DNA, 13 bp, Homo sapiens
ctcccatcccctg

SEQ ID NO: 3880263 - DNA, 15 bp, Homo sapiens
ctcccatcccctgga

SEQ ID NO: 3880264 - DNA, 23 bp, Homo sapiens
ctcccatcccctggactgggagg

SEQ ID NO: 3880265 - DNA, 14 bp, Homo sapiens
ctcccatctcctga

SEQ ID NO: 3880266 - DNA, 17 bp, Homo sapiens
ctcccatctctacccca

SEQ ID NO: 3880267 - DNA, 22 bp, Homo sapiens
ctccccaaaacctttccccaga

SEQ ID NO: 3880268 - DNA, 16 bp, Homo sapiens
ctccccacacgtgctc

SEQ ID NO: 3880269 - DNA, 22 bp, Homo sapiens
ctccccacagtcctcacagcct

SEQ ID NO: 3880270 - DNA, 23 bp, Homo sapiens
ctccccacccccgctgggggtgg

SEQ ID NO: 3880271 - DNA, 21 bp, Homo sapiens
ctccccacgagtcacctgcaa

SEQ ID NO: 3880272 - DNA, 23 bp, Homo sapiens
ctccccacgagtcacctgcaagc

SEQ ID NO: 3880273 - DNA, 14 bp, Homo sapiens
ctccccactctgct

SEQ ID NO: 3880274 - DNA, 12 bp, Homo sapiens
ctccccactgaa

SEQ ID NO: 3880275 - DNA, 15 bp, Homo sapiens
ctccccagccctggc

SEQ ID NO: 3880276 - DNA, 16 bp, Homo sapiens
ctccccagccctggct

SEQ ID NO: 3880277 - DNA, 12 bp, Homo sapiens
ctccccaggcca

SEQ ID NO: 3880278 - DNA, 14 bp, Homo sapiens
ctccccaggcctcc

SEQ ID NO: 3880279 - DNA, 17 bp, Homo sapiens
ctccccaggcctccagc

SEQ ID NO: 3880280 - DNA, 20 bp, Homo sapiens
ctccccaggcctccagcctc

SEQ ID NO: 3880281 - DNA, 21 bp, Homo sapiens
ctccccaggggagagggtctg

SEQ ID NO: 3880282 - DNA, 14 bp, Homo sapiens
ctccccatcccatg

SEQ ID NO: 3880283 - DNA, 15 bp, Homo sapiens
ctccccatcccatgt

SEQ ID NO: 3880284 - DNA, 16 bp, Homo sapiens
ctcccccacctgacaa

SEQ ID NO: 3880285 - DNA, 13 bp, Homo sapiens
ctcccccagagcc

SEQ ID NO: 3880286 - DNA, 14 bp, Homo sapiens
ctccccccactgca

SEQ ID NO: 3880287 - DNA, 14 bp, Homo sapiens
ctccccctcagatg

SEQ ID NO: 3880288 - DNA, 16 bp, Homo sapiens
ctccccctgccagtgc

SEQ ID NO: 3880289 - DNA, 15 bp, Homo sapiens
ctcccctattttaag

SEQ ID NO: 3880290 - DNA, 14 bp, Homo sapiens
ctcccctccctctt

SEQ ID NO: 3880291 - DNA, 16 bp, Homo sapiens
ctcccctccctcttcc

SEQ ID NO: 3880292 - DNA, 14 bp, Homo sapiens
ctcccctcggagaa

SEQ ID NO: 3880293 - DNA, 13 bp, Homo sapiens
ctcccctgccctg

SEQ ID NO: 3880294 - DNA, 15 bp, Homo sapiens
ctcccctgccctgct

SEQ ID NO: 3880295 - DNA, 20 bp, Homo sapiens
ctcccctgtcttctctcaaa

SEQ ID NO: 3880296 - DNA, 20 bp, Homo sapiens
ctcccggctatgggggcact

SEQ ID NO: 3880297 - DNA, 15 bp, Homo sapiens
ctccctaagaaaccc

SEQ ID NO: 3880298 - DNA, 18 bp, Homo sapiens
ctccctactcccctgggc

SEQ ID NO: 3880299 - DNA, 17 bp, Homo sapiens
ctccctcacccccaggt

SEQ ID NO: 3880300 - DNA, 12 bp, Homo sapiens
ctccctccaggg

SEQ ID NO: 3880301 - DNA, 16 bp, Homo sapiens
ctccctcctctggccc

SEQ ID NO: 3880302 - DNA, 17 bp, Homo sapiens
ctccctcctctggccca

SEQ ID NO: 3880303 - DNA, 22 bp, Homo sapiens
ctccctcctggagcatcccagg

SEQ ID NO: 3880304 - DNA, 13 bp, Homo sapiens
ctccctctcctgc

SEQ ID NO: 3880305 - DNA, 14 bp, Homo sapiens
ctccctctgcccca

SEQ ID NO: 3880306 - DNA, 20 bp, Homo sapiens
ctccctctgccccaagcagc

SEQ ID NO: 3880307 - DNA, 23 bp, Homo sapiens
ctccctctgccccaagcagccag

SEQ ID NO: 3880308 - DNA, 14 bp, Homo sapiens
ctccctctggccct

SEQ ID NO: 3880309 - DNA, 15 bp, Homo sapiens
ctccctctggccctg

SEQ ID NO: 3880310 - DNA, 19 bp, Homo sapiens
ctccctctggccctgcctt

SEQ ID NO: 3880311 - DNA, 12 bp, Homo sapiens
ctccctcttcct

SEQ ID NO: 3880312 - DNA, 16 bp, Homo sapiens
ctccctcttccttccc

SEQ ID NO: 3880313 - DNA, 17 bp, Homo sapiens
ctccctcttccttcccc

SEQ ID NO: 3880314 - DNA, 19 bp, Homo sapiens
ctccctcttccttccccca

SEQ ID NO: 3880315 - DNA, 19 bp, Homo sapiens
ctccctgaaccatccctga

SEQ ID NO: 3880316 - DNA, 21 bp, Homo sapiens
ctccctgacatttctaacata

SEQ ID NO: 3880317 - DNA, 16 bp, Homo sapiens
ctccctgactccctgt

SEQ ID NO: 3880318 - DNA, 12 bp, Homo sapiens
ctccctgagctt

SEQ ID NO: 3880319 - DNA, 13 bp, Homo sapiens
ctccctgcccctc

SEQ ID NO: 3880320 - DNA, 15 bp, Homo sapiens
ctccctgccgcctca

SEQ ID NO: 3880321 - DNA, 12 bp, Homo sapiens
ctccctggagtg

SEQ ID NO: 3880322 - DNA, 19 bp, Homo sapiens
ctccctggatgtgtggggc

SEQ ID NO: 3880323 - DNA, 18 bp, Homo sapiens
ctccctggctctcagaag

SEQ ID NO: 3880324 - DNA, 20 bp, Homo sapiens
ctccctggctctcagaaggt

SEQ ID NO: 3880325 - DNA, 19 bp, Homo sapiens
ctccctgtagctctgcctc

SEQ ID NO: 3880326 - DNA, 11 bp, Homo sapiens
ctccctgtcct

SEQ ID NO: 3880327 - DNA, 13 bp, Homo sapiens
ctccctgtcctcc

SEQ ID NO: 3880328 - DNA, 17 bp, Homo sapiens
ctccctgtgggggtggc

SEQ ID NO: 3880329 - DNA, 22 bp, Homo sapiens
ctcccttaggcattatttaatg

SEQ ID NO: 3880330 - DNA, 18 bp, Homo sapiens
ctcccttcaaccattccc

SEQ ID NO: 3880331 - DNA, 19 bp, Homo sapiens
ctcccttcaaccattcccc

SEQ ID NO: 3880332 - DNA, 22 bp, Homo sapiens
ctcccttcaaccattccccatg

SEQ ID NO: 3880333 - DNA, 14 bp, Homo sapiens
ctcccttcctggcc

SEQ ID NO: 3880334 - DNA, 16 bp, Homo sapiens
ctcccttcctggcctc

SEQ ID NO: 3880335 - DNA, 16 bp, Homo sapiens
ctccctttctcttctt

SEQ ID NO: 3880336 - DNA, 13 bp, Homo sapiens
ctccgagaacaac

SEQ ID NO: 3880337 - DNA, 14 bp, Homo sapiens
ctccgccattccaa

SEQ ID NO: 3880338 - DNA, 20 bp, Homo sapiens
ctccggcctgatgacagagc

SEQ ID NO: 3880339 - DNA, 20 bp, Homo sapiens
ctccgggaccattgacctca

SEQ ID NO: 3880340 - DNA, 23 bp, Homo sapiens
ctccgggaccattgacctcagct

SEQ ID NO: 3880341 - DNA, 15 bp, Homo sapiens
ctccggggtctgtgc

SEQ ID NO: 3880342 - DNA, 16 bp, Homo sapiens
ctccggggtctgtgct

SEQ ID NO: 3880343 - DNA, 12 bp, Homo sapiens
ctccgtcaggag

SEQ ID NO: 3880344 - DNA, 22 bp, Homo sapiens
ctccgtcaggagagacgcagcc

SEQ ID NO: 3880345 - DNA, 14 bp, Homo sapiens
ctccgtccacccag

SEQ ID NO: 3880346 - DNA, 16 bp, Homo sapiens
ctccgtccacccaggc

SEQ ID NO: 3880347 - DNA, 19 bp, Homo sapiens
ctccgtccacccaggctgc

SEQ ID NO: 3880348 - DNA, 20 bp, Homo sapiens
ctccgtccaggagcctgtgc

SEQ ID NO: 3880349 - DNA, 21 bp, Homo sapiens
ctccgtttatgggccttgctt

SEQ ID NO: 3880350 - DNA, 23 bp, Homo sapiens
ctcctaaacccccgctccagatc

SEQ ID NO: 3880351 - DNA, 19 bp, Homo sapiens
ctcctaagcagctgggact

SEQ ID NO: 3880352 - DNA, 20 bp, Homo sapiens
ctcctaagcagctgggacta

SEQ ID NO: 3880353 - DNA, 13 bp, Homo sapiens
ctcctacctggta

SEQ ID NO: 3880354 - DNA, 16 bp, Homo sapiens
ctcctagaggtgggca

SEQ ID NO: 3880355 - DNA, 19 bp, Homo sapiens
ctcctagaggtgggcagct

SEQ ID NO: 3880356 - DNA, 19 bp, Homo sapiens
ctcctagtttgacctcaca

SEQ ID NO: 3880357 - DNA, 22 bp, Homo sapiens
ctcctatcagaagtttctcagc

SEQ ID NO: 3880358 - DNA, 17 bp, Homo sapiens
ctcctatttttcagaat

SEQ ID NO: 3880359 - DNA, 20 bp, Homo sapiens
ctcctcacccccagctttgc

SEQ ID NO: 3880360 - DNA, 15 bp, Homo sapiens
ctcctcaccccgtct

SEQ ID NO: 3880361 - DNA, 12 bp, Homo sapiens
ctatttattggg

SEQ ID NO: 3880362 - DNA, 13 bp, Homo sapiens
ctatttattgggg

SEQ ID NO: 3880363 - DNA, 20 bp, Homo sapiens
ctatttgttcagagaggcct

SEQ ID NO: 3880364 - DNA, 15 bp, Homo sapiens
ctattttaaaaccat

SEQ ID NO: 3880365 - DNA, 12 bp, Homo sapiens
ctattttgtaaa

SEQ ID NO: 3880366 - DNA, 16 bp, Homo sapiens
ctcaaaacttaacata

SEQ ID NO: 3880367 - DNA, 18 bp, Homo sapiens
ctcaaaatatttgtacat

SEQ ID NO: 3880368 - DNA, 22 bp, Homo sapiens
ctcaaagagactccaagattca

SEQ ID NO: 3880369 - DNA, 22 bp, Homo sapiens
ctcaaatctattcagacaagca

SEQ ID NO: 3880370 - DNA, 17 bp, Homo sapiens
ctcaaatgacccaaaga

SEQ ID NO: 3880371 - DNA, 16 bp, Homo sapiens
ctcaaatgctaaatgc

SEQ ID NO: 3880372 - DNA, 18 bp, Homo sapiens
ctcaaatgtcagagctat

SEQ ID NO: 3880373 - DNA, 16 bp, Homo sapiens
ctcaaattaatctttc

SEQ ID NO: 3880374 - DNA, 17 bp, Homo sapiens
ctcaaattgttaggaag

SEQ ID NO: 3880375 - DNA, 13 bp, Homo sapiens
ctcaacagatctg

SEQ ID NO: 3880376 - DNA, 14 bp, Homo sapiens
ctcaacagatctgt

SEQ ID NO: 3880377 - DNA, 22 bp, Homo sapiens
ctcaacctaccaccccttcctg

SEQ ID NO: 3880378 - DNA, 18 bp, Homo sapiens
ctcaacgttgctccccat

SEQ ID NO: 3880379 - DNA, 19 bp, Homo sapiens
ctcaagaagacatggagac

SEQ ID NO: 3880380 - DNA, 22 bp, Homo sapiens
ctcaagaagacatggagactcc

SEQ ID NO: 3880381 - DNA, 14 bp, Homo sapiens
ctcaagaggcccag

SEQ ID NO: 3880382 - DNA, 15 bp, Homo sapiens
ctcaagaggcccagg

SEQ ID NO: 3880383 - DNA, 19 bp, Homo sapiens
ctcaagaggcccagggagc

SEQ ID NO: 3880384 - DNA, 21 bp, Homo sapiens
ctcaagagggcactggtggcc

SEQ ID NO: 3880385 - DNA, 13 bp, Homo sapiens
ctcaagctagcca

SEQ ID NO: 3880386 - DNA, 22 bp, Homo sapiens
ctcaagtgggaacgactgggca

SEQ ID NO: 3880387 - DNA, 14 bp, Homo sapiens
ctcaagttgaaaga

SEQ ID NO: 3880388 - DNA, 20 bp, Homo sapiens
ctcaagtttttcagaaagca

SEQ ID NO: 3880389 - DNA, 19 bp, Homo sapiens
ctcaatattcaataaagct

SEQ ID NO: 3880390 - DNA, 21 bp, Homo sapiens
ctcaatgcattgtcttgtgga

SEQ ID NO: 3880391 - DNA, 22 bp, Homo sapiens
ctcaatgcattgtcttgtggag

SEQ ID NO: 3880392 - DNA, 13 bp, Homo sapiens
ctcaatgccctgc

SEQ ID NO: 3880393 - DNA, 15 bp, Homo sapiens
ctcaatgccctgcca

SEQ ID NO: 3880394 - DNA, 15 bp, Homo sapiens
ctcaatgtgaccagg

SEQ ID NO: 3880395 - DNA, 16 bp, Homo sapiens
ctcaatgtgaccaggg

SEQ ID NO: 3880396 - DNA, 14 bp, Homo sapiens
ctcacaaggcagca

SEQ ID NO: 3880397 - DNA, 12 bp, Homo sapiens
ctcacacaggca

SEQ ID NO: 3880398 - DNA, 13 bp, Homo sapiens
ctcacacaggcat

SEQ ID NO: 3880399 - DNA, 21 bp, Homo sapiens
ctcacacaggcatttcctggg

SEQ ID NO: 3880400 - DNA, 14 bp, Homo sapiens
ctcacacccagagg

SEQ ID NO: 3880401 - DNA, 22 bp, Homo sapiens
ctcacaccctaataagtccaca

SEQ ID NO: 3880402 - DNA, 14 bp, Homo sapiens
ctcacagcctctcc

SEQ ID NO: 3880403 - DNA, 15 bp, Homo sapiens
ctcacaggagcagac

SEQ ID NO: 3880404 - DNA, 14 bp, Homo sapiens
ctcacagtgaccct

SEQ ID NO: 3880405 - DNA, 16 bp, Homo sapiens
ctcacagtgacccttc

SEQ ID NO: 3880406 - DNA, 13 bp, Homo sapiens
ctcacagttcctc

SEQ ID NO: 3880407 - DNA, 16 bp, Homo sapiens
ctcacagttcctcgcc

SEQ ID NO: 3880408 - DNA, 20 bp, Homo sapiens
ctcacagttcctcgccctgg

SEQ ID NO: 3880409 - DNA, 21 bp, Homo sapiens
ctcacagttcctcgccctggg

SEQ ID NO: 3880410 - DNA, 22 bp, Homo sapiens
ctcacagttcctcgccctgggt

SEQ ID NO: 3880411 - DNA, 23 bp, Homo sapiens
ctcacagttcctcgccctgggtc

SEQ ID NO: 3880412 - DNA, 16 bp, Homo sapiens
ctcacatcagagtgac

SEQ ID NO: 3880413 - DNA, 12 bp, Homo sapiens
ctcacatttatg

SEQ ID NO: 3880414 - DNA, 20 bp, Homo sapiens
ctcaccagaattgtgcaaat

SEQ ID NO: 3880415 - DNA, 23 bp, Homo sapiens
ctcaccagggtccgcaccagctg

SEQ ID NO: 3880416 - DNA, 24 bp, Homo sapiens
ctcaccagtgtcccctccactgtc

SEQ ID NO: 3880417 - DNA, 14 bp, Homo sapiens
ctcaccatgtaaaa

SEQ ID NO: 3880418 - DNA, 18 bp, Homo sapiens
ctcacccccagctttgct

SEQ ID NO: 3880419 - DNA, 16 bp, Homo sapiens
ctcacccccaggtgtt

SEQ ID NO: 3880420 - DNA, 15 bp, Homo sapiens
ctcaccccgtctggg

SEQ ID NO: 3880421 - DNA, 16 bp, Homo sapiens
ctcaccccgtctgggg

SEQ ID NO: 3880422 - DNA, 11 bp, Homo sapiens
ctcacctcctc

SEQ ID NO: 3880423 - DNA, 12 bp, Homo sapiens
ctcacctcctcc

SEQ ID NO: 3880424 - DNA, 15 bp, Homo sapiens
ctcacctctgcctca

SEQ ID NO: 3880425 - DNA, 16 bp, Homo sapiens
ctcacctctgcctcaa

SEQ ID NO: 3880426 - DNA, 19 bp, Homo sapiens
ctcacctctgcctcaatgt

SEQ ID NO: 3880427 - DNA, 15 bp, Homo sapiens
ctcacctgggccttt

SEQ ID NO: 3880428 - DNA, 16 bp, Homo sapiens
ctcacctgggcctttc

SEQ ID NO: 3880429 - DNA, 14 bp, Homo sapiens
ctcacgactcttcc

SEQ ID NO: 3880430 - DNA, 19 bp, Homo sapiens
ctcacgactcttcctgcaa

SEQ ID NO: 3880431 - DNA, 23 bp, Homo sapiens
ctcacgatgaaattgaacctggt

SEQ ID NO: 3880432 - DNA, 22 bp, Homo sapiens
ctcacgcctgtaatcccagcag

SEQ ID NO: 3880433 - DNA, 17 bp, Homo sapiens
ctcacgctcccccgcag

SEQ ID NO: 3880434 - DNA, 22 bp, Homo sapiens
ctcactatggtatgctggccag

SEQ ID NO: 3880435 - DNA, 23 bp, Homo sapiens
ctcactatggtatgctggccagc

SEQ ID NO: 3880436 - DNA, 24 bp, Homo sapiens
ctcactatggtatgctggccagca

SEQ ID NO: 3880437 - DNA, 14 bp, Homo sapiens
ctcactccaccacc

SEQ ID NO: 3880438 - DNA, 20 bp, Homo sapiens
ctcactccaccacccaaaag

SEQ ID NO: 3880439 - DNA, 15 bp, Homo sapiens
ctcactcctacctgg

SEQ ID NO: 3880440 - DNA, 16 bp, Homo sapiens
ctcactcctacctggt

SEQ ID NO: 3880441 - DNA, 17 bp, Homo sapiens
ctcactcctacctggta

SEQ ID NO: 3880442 - DNA, 13 bp, Homo sapiens
ctcactcctgagt

SEQ ID NO: 3880443 - DNA, 12 bp, Homo sapiens
ctcactcctgtt

SEQ ID NO: 3880444 - DNA, 19 bp, Homo sapiens
ctcactgctcaagaagaca

SEQ ID NO: 3880445 - DNA, 13 bp, Homo sapiens
ctcactggctggg

SEQ ID NO: 3880446 - DNA, 20 bp, Homo sapiens
ctcactggctggggcagagg

SEQ ID NO: 3880447 - DNA, 13 bp, Homo sapiens
ctcacttatacca

SEQ ID NO: 3880448 - DNA, 14 bp, Homo sapiens
ctcacttataccaa

SEQ ID NO: 3880449 - DNA, 15 bp, Homo sapiens
ctcacttccctggga

SEQ ID NO: 3880450 - DNA, 22 bp, Homo sapiens
ctcacttttctttattgctgtg

SEQ ID NO: 3880451 - DNA, 13 bp, Homo sapiens
ctcagaagaaaga

SEQ ID NO: 3880452 - DNA, 13 bp, Homo sapiens
ctcagaagcctgg

SEQ ID NO: 3880453 - DNA, 15 bp, Homo sapiens
ctcagaagcctgggg

SEQ ID NO: 3880454 - DNA, 20 bp, Homo sapiens
ctcagaagcctgggggcctg

SEQ ID NO: 3880455 - DNA, 13 bp, Homo sapiens
ctcagaaggtatt

SEQ ID NO: 3880456 - DNA, 15 bp, Homo sapiens
ctcagaatgctctac

SEQ ID NO: 3880457 - DNA, 16 bp, Homo sapiens
ctcagacaatccactc

SEQ ID NO: 3880458 - DNA, 22 bp, Homo sapiens
ctcagacaatccactctcagga

SEQ ID NO: 3880459 - DNA, 13 bp, Homo sapiens
ctcagacccccac

SEQ ID NO: 3880460 - DNA, 14 bp, Homo sapiens
ctcagacccccact

SEQ ID NO: 3880461 - DNA, 15 bp, Homo sapiens
ctcagacccccactc

SEQ ID NO: 3880462 - DNA, 16 bp, Homo sapiens
ctcagacccccactct

SEQ ID NO: 3880463 - DNA, 15 bp, Homo sapiens
ctcagagccacccct

SEQ ID NO: 3880464 - DNA, 16 bp, Homo sapiens
ctcagatcttgacagt

SEQ ID NO: 3880465 - DNA, 13 bp, Homo sapiens
ctcagatgatctc

SEQ ID NO: 3880466 - DNA, 17 bp, Homo sapiens
ctcagatgatctctcca

SEQ ID NO: 3880467 - DNA, 16 bp, Homo sapiens
ctcagcagccctcctc

SEQ ID NO: 3880468 - DNA, 16 bp, Homo sapiens
ctcagcaggaacctgt

SEQ ID NO: 3880469 - DNA, 16 bp, Homo sapiens
ctcagcatacctgctg

SEQ ID NO: 3880470 - DNA, 13 bp, Homo sapiens
ctcagccaaacac

SEQ ID NO: 3880471 - DNA, 19 bp, Homo sapiens
ctcagccataaagtgccag

SEQ ID NO: 3880472 - DNA, 21 bp, Homo sapiens
ctcagcccacatagtgatggt

SEQ ID NO: 3880473 - DNA, 16 bp, Homo sapiens
ctcagccctcagaaca

SEQ ID NO: 3880474 - DNA, 17 bp, Homo sapiens
ctcagccctcagaacaa

SEQ ID NO: 3880475 - DNA, 19 bp, Homo sapiens
ctcagccctccctgcccct

SEQ ID NO: 3880476 - DNA, 13 bp, Homo sapiens
ctcagccctgact

SEQ ID NO: 3880477 - DNA, 19 bp, Homo sapiens
ctcagccctgactggtgct

SEQ ID NO: 3880478 - DNA, 13 bp, Homo sapiens
ctcagcccttgcc

SEQ ID NO: 3880479 - DNA, 14 bp, Homo sapiens
ctcagcccttgccc

SEQ ID NO: 3880480 - DNA, 23 bp, Homo sapiens
ctcagcccttgcccccatccctc

SEQ ID NO: 3880481 - DNA, 16 bp, Homo sapiens
ctcagccgcagacaag

SEQ ID NO: 3880482 - DNA, 19 bp, Homo sapiens
ctcagccgcagacaagtaa

SEQ ID NO: 3880483 - DNA, 14 bp, Homo sapiens
ctcagcctccccct

SEQ ID NO: 3880484 - DNA, 16 bp, Homo sapiens
ctcagcctccccctgc

SEQ ID NO: 3880485 - DNA, 20 bp, Homo sapiens
ctcagcctccccctgctgct

SEQ ID NO: 3880486 - DNA, 13 bp, Homo sapiens
ctcagcctcctaa

SEQ ID NO: 3880487 - DNA, 14 bp, Homo sapiens
ctcagcctcctcag

SEQ ID NO: 3880488 - DNA, 11 bp, Homo sapiens
ctcagccttgg

SEQ ID NO: 3880489 - DNA, 13 bp, Homo sapiens
ctcagctcagcct

SEQ ID NO: 3880490 - DNA, 19 bp, Homo sapiens
ctcagctcccaaggctctg

SEQ ID NO: 3880491 - DNA, 14 bp, Homo sapiens
ctcagctgacacat

SEQ ID NO: 3880492 - DNA, 14 bp, Homo sapiens
ctcagctgcacatt

SEQ ID NO: 3880493 - DNA, 20 bp, Homo sapiens
ctcagctgcacattcctggc

SEQ ID NO: 3880494 - DNA, 22 bp, Homo sapiens
ctcagctgcacattcctggccc

SEQ ID NO: 3880495 - DNA, 14 bp, Homo sapiens
ctcagctgccaagc

SEQ ID NO: 3880496 - DNA, 21 bp, Homo sapiens
ctcagctttttgtcttttctg

SEQ ID NO: 3880497 - DNA, 22 bp, Homo sapiens
ctcaggaaatcaaatatgcaaa

SEQ ID NO: 3880498 - DNA, 14 bp, Homo sapiens
ctcaggaagaaacc

SEQ ID NO: 3880499 - DNA, 22 bp, Homo sapiens
ctcaggaagaaaccccaagcag

SEQ ID NO: 3880500 - DNA, 19 bp, Homo sapiens
ctcaggacacaggcctgtg

SEQ ID NO: 3880501 - DNA, 13 bp, Homo sapiens
ctcaggacccagg

SEQ ID NO: 3880502 - DNA, 15 bp, Homo sapiens
ctcaggacccaggcc

SEQ ID NO: 3880503 - DNA, 22 bp, Homo sapiens
ctcaggacggaaggtcagttgc

SEQ ID NO: 3880504 - DNA, 15 bp, Homo sapiens
ctcaggagcacaggc

SEQ ID NO: 3880505 - DNA, 20 bp, Homo sapiens
ctcaggaggcgaataaatgt

SEQ ID NO: 3880506 - DNA, 21 bp, Homo sapiens
ctcaggaggcgaataaatgtt

SEQ ID NO: 3880507 - DNA, 22 bp, Homo sapiens
ctcaggaggcgaataaatgttc

SEQ ID NO: 3880508 - DNA, 19 bp, Homo sapiens
ctcaggaggcgcagcccga

SEQ ID NO: 3880509 - DNA, 18 bp, Homo sapiens
ctcaggaggctgaggcag

SEQ ID NO: 3880510 - DNA, 23 bp, Homo sapiens
ctcaggcaagcccctcagccctt

SEQ ID NO: 3880511 - DNA, 18 bp, Homo sapiens
ctcaggcagacaagagct

SEQ ID NO: 3880512 - DNA, 14 bp, Homo sapiens
ctcaggctgctgct

SEQ ID NO: 3880513 - DNA, 15 bp, Homo sapiens
ctcaggcttgaaatg

SEQ ID NO: 3880514 - DNA, 23 bp, Homo sapiens
ctcagggacagagacacctgcac

SEQ ID NO: 3880515 - DNA, 14 bp, Homo sapiens
ctcaggggtggaga

SEQ ID NO: 3880516 - DNA, 16 bp, Homo sapiens
ctcaggggtggagaag

SEQ ID NO: 3880517 - DNA, 18 bp, Homo sapiens
ctcaggggtggagaagtg

SEQ ID NO: 3880518 - DNA, 15 bp, Homo sapiens
ctcaggtagtactgg

SEQ ID NO: 3880519 - DNA, 16 bp, Homo sapiens
ctcaggtagtactggg

SEQ ID NO: 3880520 - DNA, 18 bp, Homo sapiens
ctcaggtagtactgggaa

SEQ ID NO: 3880521 - DNA, 17 bp, Homo sapiens
ctcaggtgactggagcc

SEQ ID NO: 3880522 - DNA, 22 bp, Homo sapiens
ctcaggtgactggagcccgagg

SEQ ID NO: 3880523 - DNA, 16 bp, Homo sapiens
ctcaggtgccactccc

SEQ ID NO: 3880524 - DNA, 19 bp, Homo sapiens
ctcaggtgccactccctga

SEQ ID NO: 3880525 - DNA, 16 bp, Homo sapiens
ctcagtcatattctta

SEQ ID NO: 3880526 - DNA, 19 bp, Homo sapiens
ctcagtccagatgccttcc

SEQ ID NO: 3880527 - DNA, 13 bp, Homo sapiens
ctcagtgctctcc

SEQ ID NO: 3880528 - DNA, 22 bp, Homo sapiens
ctcagtgggacaaaccagagca

SEQ ID NO: 3880529 - DNA, 18 bp, Homo sapiens
ctcagtgttttagctgtt

SEQ ID NO: 3880530 - DNA, 20 bp, Homo sapiens
ctcagttaaaatgtctgttt

SEQ ID NO: 3880531 - DNA, 23 bp, Homo sapiens
ctcagttcaacctggtggcacca

SEQ ID NO: 3880532 - DNA, 16 bp, Homo sapiens
ctcagtttccccattg

SEQ ID NO: 3880533 - DNA, 12 bp, Homo sapiens
ctagacctgggc

SEQ ID NO: 3880534 - DNA, 14 bp, Homo sapiens
ctagacctgggcca

SEQ ID NO: 3880535 - DNA, 23 bp, Homo sapiens
ctagactggagtgaggcttccag

SEQ ID NO: 3880536 - DNA, 20 bp, Homo sapiens
ctagacttcagaacatgctg

SEQ ID NO: 3880537 - DNA, 22 bp, Homo sapiens
ctagacttcagaacatgctgga

SEQ ID NO: 3880538 - DNA, 17 bp, Homo sapiens
ctagagaagaggctggt

SEQ ID NO: 3880539 - DNA, 18 bp, Homo sapiens
ctagagacctctcaacag

SEQ ID NO: 3880540 - DNA, 18 bp, Homo sapiens
ctagagattttcttggca

SEQ ID NO: 3880541 - DNA, 16 bp, Homo sapiens
ctagagcaacccctgt

SEQ ID NO: 3880542 - DNA, 22 bp, Homo sapiens
ctagagcagcccaaatttttct

SEQ ID NO: 3880543 - DNA, 14 bp, Homo sapiens
ctagagctcctgtc

SEQ ID NO: 3880544 - DNA, 17 bp, Homo sapiens
ctagagctcctgtccct

SEQ ID NO: 3880545 - DNA, 19 bp, Homo sapiens
ctagagctcctgtccctac

SEQ ID NO: 3880546 - DNA, 21 bp, Homo sapiens
ctagagctcctgtccctaccc

SEQ ID NO: 3880547 - DNA, 24 bp, Homo sapiens
ctagagctgggaaacagggagccc

SEQ ID NO: 3880548 - DNA, 14 bp, Homo sapiens
ctagaggcagggag

SEQ ID NO: 3880549 - DNA, 15 bp, Homo sapiens
ctagaggcagggagg

SEQ ID NO: 3880550 - DNA, 18 bp, Homo sapiens
ctagaggcagggagggga

SEQ ID NO: 3880551 - DNA, 12 bp, Homo sapiens
ctagaggcctca

SEQ ID NO: 3880552 - DNA, 15 bp, Homo sapiens
ctagaggcctcagtt

SEQ ID NO: 3880553 - DNA, 22 bp, Homo sapiens
ctagagggatacactgaagtta

SEQ ID NO: 3880554 - DNA, 19 bp, Homo sapiens
ctagagggcgactctggtg

SEQ ID NO: 3880555 - DNA, 20 bp, Homo sapiens
ctagaggtgggcagctgggc

SEQ ID NO: 3880556 - DNA, 23 bp, Homo sapiens
ctagaggtgggcagctgggcccc

SEQ ID NO: 3880557 - DNA, 21 bp, Homo sapiens
ctagatctcctatttttcaga

SEQ ID NO: 3880558 - DNA, 16 bp, Homo sapiens
ctagatcttacatctg

SEQ ID NO: 3880559 - DNA, 14 bp, Homo sapiens
ctagccacctccca

SEQ ID NO: 3880560 - DNA, 15 bp, Homo sapiens
ctagccacctcccac

SEQ ID NO: 3880561 - DNA, 19 bp, Homo sapiens
ctagccacctcccacccca

SEQ ID NO: 3880562 - DNA, 15 bp, Homo sapiens
ctagccaggagtctg

SEQ ID NO: 3880563 - DNA, 20 bp, Homo sapiens
ctagcccacttgtcatccat

SEQ ID NO: 3880564 - DNA, 16 bp, Homo sapiens
ctagccgggccatgct

SEQ ID NO: 3880565 - DNA, 13 bp, Homo sapiens
ctagcctctccag

SEQ ID NO: 3880566 - DNA, 17 bp, Homo sapiens
ctagcctgggccagaga

SEQ ID NO: 3880567 - DNA, 22 bp, Homo sapiens
ctagccttaatcaggtcctcag

SEQ ID NO: 3880568 - DNA, 22 bp, Homo sapiens
ctagcgctgccgcaccccagag

SEQ ID NO: 3880569 - DNA, 15 bp, Homo sapiens
ctagctagaaatatg

SEQ ID NO: 3880570 - DNA, 21 bp, Homo sapiens
ctagctagaaatatgatttta

SEQ ID NO: 3880571 - DNA, 19 bp, Homo sapiens
ctagctagaagtgggccag

SEQ ID NO: 3880572 - DNA, 15 bp, Homo sapiens
ctagctggcaggaca

SEQ ID NO: 3880573 - DNA, 23 bp, Homo sapiens
ctagctgggcaaacccttctctt

SEQ ID NO: 3880574 - DNA, 17 bp, Homo sapiens
ctagcttcatgcctcag

SEQ ID NO: 3880575 - DNA, 18 bp, Homo sapiens
ctagcttcatgcctcagt

SEQ ID NO: 3880576 - DNA, 12 bp, Homo sapiens
ctaggaaagcag

SEQ ID NO: 3880577 - DNA, 14 bp, Homo sapiens
ctaggaaagcagtg

SEQ ID NO: 3880578 - DNA, 13 bp, Homo sapiens
ctaggactgagga

SEQ ID NO: 3880579 - DNA, 13 bp, Homo sapiens
ctaggagaagcag

SEQ ID NO: 3880580 - DNA, 20 bp, Homo sapiens
ctaggagaagcagcctccta

SEQ ID NO: 3880581 - DNA, 18 bp, Homo sapiens
ctaggagcaaagcctgtt

SEQ ID NO: 3880582 - DNA, 20 bp, Homo sapiens
ctaggagcaaagcctgttca

SEQ ID NO: 3880583 - DNA, 19 bp, Homo sapiens
ctaggagctgggaggaaaa

SEQ ID NO: 3880584 - DNA, 17 bp, Homo sapiens
ctaggagctgtctccag

SEQ ID NO: 3880585 - DNA, 14 bp, Homo sapiens
ctaggattcctccc

SEQ ID NO: 3880586 - DNA, 22 bp, Homo sapiens
ctaggattcctcccccagagcc

SEQ ID NO: 3880587 - DNA, 20 bp, Homo sapiens
ctaggcagttcaaagcagga

SEQ ID NO: 3880588 - DNA, 14 bp, Homo sapiens
ctaggcatcccagg

SEQ ID NO: 3880589 - DNA, 19 bp, Homo sapiens
ctaggccactcctccaaag

SEQ ID NO: 3880590 - DNA, 15 bp, Homo sapiens
ctaggcgagtgccag

SEQ ID NO: 3880591 - DNA, 17 bp, Homo sapiens
ctaggctgagctggcat

SEQ ID NO: 3880592 - DNA, 23 bp, Homo sapiens
ctaggcttcagcatatttatagc

SEQ ID NO: 3880593 - DNA, 11 bp, Homo sapiens
ctagggctgga

SEQ ID NO: 3880594 - DNA, 14 bp, Homo sapiens
ctaggggatgaggg

SEQ ID NO: 3880595 - DNA, 14 bp, Homo sapiens
ctaggggctggtcc

SEQ ID NO: 3880596 - DNA, 16 bp, Homo sapiens
ctaggtcctggcttct

SEQ ID NO: 3880597 - DNA, 22 bp, Homo sapiens
ctagtaatgggccaattaaaat

SEQ ID NO: 3880598 - DNA, 23 bp, Homo sapiens
ctagtactggggagaaataattg

SEQ ID NO: 3880599 - DNA, 18 bp, Homo sapiens
ctagtattgtccatatca

SEQ ID NO: 3880600 - DNA, 20 bp, Homo sapiens
ctagtcatagaaatacctca

SEQ ID NO: 3880601 - DNA, 15 bp, Homo sapiens
ctagtcctttactaa

SEQ ID NO: 3880602 - DNA, 15 bp, Homo sapiens
ctagtctcctttgca

SEQ ID NO: 3880603 - DNA, 21 bp, Homo sapiens
ctagtctcctttgcactgagg

SEQ ID NO: 3880604 - DNA, 13 bp, Homo sapiens
ctagtcttgcttt

SEQ ID NO: 3880605 - DNA, 13 bp, Homo sapiens
ctagtgaagatgt

SEQ ID NO: 3880606 - DNA, 16 bp, Homo sapiens
ctagtggaaatgagcg

SEQ ID NO: 3880607 - DNA, 15 bp, Homo sapiens
ctagtggcttcaaaa

SEQ ID NO: 3880608 - DNA, 17 bp, Homo sapiens
ctagtggggtctccctc

SEQ ID NO: 3880609 - DNA, 21 bp, Homo sapiens
ctagtgtgagtggcagccatg

SEQ ID NO: 3880610 - DNA, 18 bp, Homo sapiens
ctagttctcaatcactgc

SEQ ID NO: 3880611 - DNA, 20 bp, Homo sapiens
ctagttctcaatcactgctc

SEQ ID NO: 3880612 - DNA, 15 bp, Homo sapiens
ctagttgttatcaat

SEQ ID NO: 3880613 - DNA, 13 bp, Homo sapiens
ctagtttccagtg

SEQ ID NO: 3880614 - DNA, 14 bp, Homo sapiens
ctagtttccagtgg

SEQ ID NO: 3880615 - DNA, 18 bp, Homo sapiens
ctagttttctcctcccag

SEQ ID NO: 3880616 - DNA, 19 bp, Homo sapiens
ctagttttctcctcccagg

SEQ ID NO: 3880617 - DNA, 15 bp, Homo sapiens
ctagttttttttgta

SEQ ID NO: 3880618 - DNA, 16 bp, Homo sapiens
ctataaactactgtaa

SEQ ID NO: 3880619 - DNA, 22 bp, Homo sapiens
ctacagttgttttttgaaaaca

SEQ ID NO: 3880620 - DNA, 13 bp, Homo sapiens
ctacatcttcagc

SEQ ID NO: 3880621 - DNA, 16 bp, Homo sapiens
ctacatgaaacagaaa

SEQ ID NO: 3880622 - DNA, 13 bp, Homo sapiens
ctacattcctcag

SEQ ID NO: 3880623 - DNA, 15 bp, Homo sapiens
ctaccaaagcacctt

SEQ ID NO: 3880624 - DNA, 18 bp, Homo sapiens
ctaccaaatataaacttg

SEQ ID NO: 3880625 - DNA, 13 bp, Homo sapiens
ctaccaagtgacc

SEQ ID NO: 3880626 - DNA, 15 bp, Homo sapiens
ctaccaatgcatgca

SEQ ID NO: 3880627 - DNA, 14 bp, Homo sapiens
ctaccaccccttcc

SEQ ID NO: 3880628 - DNA, 16 bp, Homo sapiens
ctaccaccccttcctg

SEQ ID NO: 3880629 - DNA, 13 bp, Homo sapiens
ctaccaccttccc

SEQ ID NO: 3880630 - DNA, 16 bp, Homo sapiens
ctaccaccttccctct

SEQ ID NO: 3880631 - DNA, 13 bp, Homo sapiens
ctaccatgctgct

SEQ ID NO: 3880632 - DNA, 12 bp, Homo sapiens
ctaccatttcag

SEQ ID NO: 3880633 - DNA, 13 bp, Homo sapiens
ctaccatttcaga

SEQ ID NO: 3880634 - DNA, 14 bp, Homo sapiens
ctacccactctttg

SEQ ID NO: 3880635 - DNA, 21 bp, Homo sapiens
ctacccactctttgctacaat

SEQ ID NO: 3880636 - DNA, 21 bp, Homo sapiens
ctacccagagattgcttctca

SEQ ID NO: 3880637 - DNA, 13 bp, Homo sapiens
ctacccgagccca

SEQ ID NO: 3880638 - DNA, 15 bp, Homo sapiens
ctacccggcccagag

SEQ ID NO: 3880639 - DNA, 14 bp, Homo sapiens
ctaccctccagagt

SEQ ID NO: 3880640 - DNA, 18 bp, Homo sapiens
ctaccgttcccaaattgg

SEQ ID NO: 3880641 - DNA, 14 bp, Homo sapiens
ctacctgaggccta

SEQ ID NO: 3880642 - DNA, 22 bp, Homo sapiens
ctacctgaggcctatctgagac

SEQ ID NO: 3880643 - DNA, 13 bp, Homo sapiens
ctacctgccctct

SEQ ID NO: 3880644 - DNA, 12 bp, Homo sapiens
ctacctgtgcct

SEQ ID NO: 3880645 - DNA, 14 bp, Homo sapiens
ctacgtataaatat

SEQ ID NO: 3880646 - DNA, 21 bp, Homo sapiens
ctacgtataaatatgaaatga

SEQ ID NO: 3880647 - DNA, 20 bp, Homo sapiens
ctacgttctccagcccacac

SEQ ID NO: 3880648 - DNA, 15 bp, Homo sapiens
ctactacccgagccc

SEQ ID NO: 3880649 - DNA, 17 bp, Homo sapiens
ctactacccgagcccag

SEQ ID NO: 3880650 - DNA, 19 bp, Homo sapiens
ctactacccgagcccagct

SEQ ID NO: 3880651 - DNA, 22 bp, Homo sapiens
ctactagttttccttgaaaaaa

SEQ ID NO: 3880652 - DNA, 23 bp, Homo sapiens
ctactagttttccttgaaaaaaa

SEQ ID NO: 3880653 - DNA, 18 bp, Homo sapiens
ctactatgccagatgcct

SEQ ID NO: 3880654 - DNA, 22 bp, Homo sapiens
ctactcacacaggcatttcctg

SEQ ID NO: 3880655 - DNA, 17 bp, Homo sapiens
ctactcagcagccctcc

SEQ ID NO: 3880656 - DNA, 21 bp, Homo sapiens
ctactcagcagccctcctcac

SEQ ID NO: 3880657 - DNA, 22 bp, Homo sapiens
ctactcagcagccctcctcacc

SEQ ID NO: 3880658 - DNA, 17 bp, Homo sapiens
ctactcagctctcctgc

SEQ ID NO: 3880659 - DNA, 23 bp, Homo sapiens
ctactcaggaggctgaggcagaa

SEQ ID NO: 3880660 - DNA, 21 bp, Homo sapiens
ctactcatacttaagcaaaag

SEQ ID NO: 3880661 - DNA, 14 bp, Homo sapiens
ctactcctgtgctc

SEQ ID NO: 3880662 - DNA, 18 bp, Homo sapiens
ctactctcttgccagcat

SEQ ID NO: 3880663 - DNA, 18 bp, Homo sapiens
ctactctgtccaggccac

SEQ ID NO: 3880664 - DNA, 20 bp, Homo sapiens
ctactctgtccaggccactg

SEQ ID NO: 3880665 - DNA, 18 bp, Homo sapiens
ctactctgtgccagagcc

SEQ ID NO: 3880666 - DNA, 19 bp, Homo sapiens
ctactctgtgccagagcct

SEQ ID NO: 3880667 - DNA, 19 bp, Homo sapiens
ctactcttcctttctaaat

SEQ ID NO: 3880668 - DNA, 19 bp, Homo sapiens
ctactgctgcaaagtgcaa

SEQ ID NO: 3880669 - DNA, 16 bp, Homo sapiens
ctactggcagctcctc

SEQ ID NO: 3880670 - DNA, 15 bp, Homo sapiens
ctactggcattaatt

SEQ ID NO: 3880671 - DNA, 20 bp, Homo sapiens
ctactggcattaattattaa

SEQ ID NO: 3880672 - DNA, 14 bp, Homo sapiens
ctactgggaaggct

SEQ ID NO: 3880673 - DNA, 21 bp, Homo sapiens
ctactgtaagcaagaaaaata

SEQ ID NO: 3880674 - DNA, 19 bp, Homo sapiens
ctactgtaattaagtgcaa

SEQ ID NO: 3880675 - DNA, 22 bp, Homo sapiens
ctactgtaattaagtgcaattt

SEQ ID NO: 3880676 - DNA, 13 bp, Homo sapiens
ctacttaagagaa

SEQ ID NO: 3880677 - DNA, 22 bp, Homo sapiens
ctacttagcatgtccctaccga

SEQ ID NO: 3880678 - DNA, 15 bp, Homo sapiens
ctacttcctgcactg

SEQ ID NO: 3880679 - DNA, 13 bp, Homo sapiens
ctacttcttggaa

SEQ ID NO: 3880680 - DNA, 15 bp, Homo sapiens
ctacttcttggaaaa

SEQ ID NO: 3880681 - DNA, 14 bp, Homo sapiens
ctacttctttttct

SEQ ID NO: 3880682 - DNA, 19 bp, Homo sapiens
ctacttgaatactctcaca

SEQ ID NO: 3880683 - DNA, 19 bp, Homo sapiens
ctacttgttacctttccca

SEQ ID NO: 3880684 - DNA, 18 bp, Homo sapiens
ctactttgtctaaaaata

SEQ ID NO: 3880685 - DNA, 17 bp, Homo sapiens
ctacttttgcatgaaaa

SEQ ID NO: 3880686 - DNA, 17 bp, Homo sapiens
ctagaaaccagtatgga

SEQ ID NO: 3880687 - DNA, 20 bp, Homo sapiens
ctagaaagctctgcatgtgt

SEQ ID NO: 3880688 - DNA, 19 bp, Homo sapiens
ctagaacacaggcaaaatc

SEQ ID NO: 3880689 - DNA, 14 bp, Homo sapiens
ctagaacacccact

SEQ ID NO: 3880690 - DNA, 20 bp, Homo sapiens
ctagaacacccactggccag

SEQ ID NO: 3880691 - DNA, 21 bp, Homo sapiens
ctagaacacccactggccagt

SEQ ID NO: 3880692 - DNA, 16 bp, Homo sapiens
ctagaaccaagcttca

SEQ ID NO: 3880693 - DNA, 18 bp, Homo sapiens
ctagaaccaagcttcaga

SEQ ID NO: 3880694 - DNA, 23 bp, Homo sapiens
ctagaaccaagcttcagagccta

SEQ ID NO: 3880695 - DNA, 17 bp, Homo sapiens
ctagaacctagaagggc

SEQ ID NO: 3880696 - DNA, 18 bp, Homo sapiens
ctagaacctagaagggct

SEQ ID NO: 3880697 - DNA, 15 bp, Homo sapiens
ctagaacctggagag

SEQ ID NO: 3880698 - DNA, 16 bp, Homo sapiens
ctagaacctggagggc

SEQ ID NO: 3880699 - DNA, 18 bp, Homo sapiens
ctagaacctggagggctg

SEQ ID NO: 3880700 - DNA, 17 bp, Homo sapiens
ctagaagtgggccagga

SEQ ID NO: 3880701 - DNA, 19 bp, Homo sapiens
ctagaagtgggccaggaca

SEQ ID NO: 3880702 - DNA, 16 bp, Homo sapiens
ctagaatagccatgta

SEQ ID NO: 3880703 - DNA, 16 bp, Homo sapiens
ctagaatttgtatttt

SEQ ID NO: 3880704 - DNA, 18 bp, Homo sapiens
ctagaatttgtattttgc

SEQ ID NO: 3880705 - DNA, 21 bp, Homo sapiens
ccgggtgtggcctcagccctc

SEQ ID NO: 3880706 - DNA, 22 bp, Homo sapiens
ccgggtgtggcctcagccctca

SEQ ID NO: 3880707 - DNA, 11 bp, Homo sapiens
ccggtgtcctt

SEQ ID NO: 3880708 - DNA, 14 bp, Homo sapiens
ccgtaggcagcctc

SEQ ID NO: 3880709 - DNA, 22 bp, Homo sapiens
ccgtagttccctgaaaacccag

SEQ ID NO: 3880710 - DNA, 16 bp, Homo sapiens
ccgtcatgttcctcaa

SEQ ID NO: 3880711 - DNA, 15 bp, Homo sapiens
ccgtccacccaggct

SEQ ID NO: 3880712 - DNA, 19 bp, Homo sapiens
ccgtccacccaggctgcac

SEQ ID NO: 3880713 - DNA, 13 bp, Homo sapiens
ccgtccatggcac

SEQ ID NO: 3880714 - DNA, 15 bp, Homo sapiens
ccgtccatggcacca

SEQ ID NO: 3880715 - DNA, 23 bp, Homo sapiens
ccgtccatggcaccagccccctg

SEQ ID NO: 3880716 - DNA, 18 bp, Homo sapiens
ccgtcccaaacagagggc

SEQ ID NO: 3880717 - DNA, 18 bp, Homo sapiens
ccgtctccctaaaataaa

SEQ ID NO: 3880718 - DNA, 16 bp, Homo sapiens
ccgtctgactccagag

SEQ ID NO: 3880719 - DNA, 20 bp, Homo sapiens
ccgtctgactccagagtctg

SEQ ID NO: 3880720 - DNA, 21 bp, Homo sapiens
ccgtctggggttcagcccctc

SEQ ID NO: 3880721 - DNA, 22 bp, Homo sapiens
ccgtctggggttcagcccctcc

SEQ ID NO: 3880722 - DNA, 22 bp, Homo sapiens
ccgtcttagaagtggaccagga

SEQ ID NO: 3880723 - DNA, 14 bp, Homo sapiens
ccgtgaagcagtgc

SEQ ID NO: 3880724 - DNA, 23 bp, Homo sapiens
ccgtgatgtagggtaaggtgcct

SEQ ID NO: 3880725 - DNA, 16 bp, Homo sapiens
ccgtgcagtacaggca

SEQ ID NO: 3880726 - DNA, 12 bp, Homo sapiens
ccgtgcccaggg

SEQ ID NO: 3880727 - DNA, 14 bp, Homo sapiens
ccgtgccttcagct

SEQ ID NO: 3880728 - DNA, 16 bp, Homo sapiens
ccgtgccttcagctct

SEQ ID NO: 3880729 - DNA, 22 bp, Homo sapiens
ccgtgcctttctctggctccag

SEQ ID NO: 3880730 - DNA, 23 bp, Homo sapiens
ccgtgcctttctctggctccaga

SEQ ID NO: 3880731 - DNA, 16 bp, Homo sapiens
ccgtggaggctgctcg

SEQ ID NO: 3880732 - DNA, 16 bp, Homo sapiens
ccgtggccctgccctc

SEQ ID NO: 3880733 - DNA, 17 bp, Homo sapiens
ccgtggcccttcctgga

SEQ ID NO: 3880734 - DNA, 20 bp, Homo sapiens
ccgtggcccttcctggacag

SEQ ID NO: 3880735 - DNA, 11 bp, Homo sapiens
ccgtggcttcc

SEQ ID NO: 3880736 - DNA, 23 bp, Homo sapiens
ccgtggcttcccgctcagccctc

SEQ ID NO: 3880737 - DNA, 14 bp, Homo sapiens
ccgttactctccaa

SEQ ID NO: 3880738 - DNA, 14 bp, Homo sapiens
ccgttccccttggc

SEQ ID NO: 3880739 - DNA, 14 bp, Homo sapiens
ccgttccctgtcag

SEQ ID NO: 3880740 - DNA, 15 bp, Homo sapiens
ccgttctgctggcct

SEQ ID NO: 3880741 - DNA, 21 bp, Homo sapiens
cctaaaaacatttactgacca

SEQ ID NO: 3880742 - DNA, 14 bp, Homo sapiens
cctaaaagtaaaca

SEQ ID NO: 3880743 - DNA, 12 bp, Homo sapiens
cctaaaataaaa

SEQ ID NO: 3880744 - DNA, 23 bp, Homo sapiens
cctaaacagatataaatggctgg

SEQ ID NO: 3880745 - DNA, 11 bp, Homo sapiens
cctaaactgta

SEQ ID NO: 3880746 - DNA, 12 bp, Homo sapiens
cctaaagagata

SEQ ID NO: 3880747 - DNA, 22 bp, Homo sapiens
cctaaagaggaaaagtgcaatg

SEQ ID NO: 3880748 - DNA, 12 bp, Homo sapiens
cctaaccccttt

SEQ ID NO: 3880749 - DNA, 19 bp, Homo sapiens
cctaactgagaattttcta

SEQ ID NO: 3880750 - DNA, 14 bp, Homo sapiens
cctaaggacacact

SEQ ID NO: 3880751 - DNA, 16 bp, Homo sapiens
cctaaggatctctcag

SEQ ID NO: 3880752 - DNA, 23 bp, Homo sapiens
cctaattagggcatcctgcccct

SEQ ID NO: 3880753 - DNA, 14 bp, Homo sapiens
cctaattcctggca

SEQ ID NO: 3880754 - DNA, 17 bp, Homo sapiens
cctacacccttggactt

SEQ ID NO: 3880755 - DNA, 16 bp, Homo sapiens
cctacagatagtcaaa

SEQ ID NO: 3880756 - DNA, 14 bp, Homo sapiens
cctacatcttcagc

SEQ ID NO: 3880757 - DNA, 19 bp, Homo sapiens
cctacatcttcagctccca

SEQ ID NO: 3880758 - DNA, 21 bp, Homo sapiens
cctacatcttcagctcccata

SEQ ID NO: 3880759 - DNA, 19 bp, Homo sapiens
cctacatgaaacagaaaca

SEQ ID NO: 3880760 - DNA, 16 bp, Homo sapiens
cctaccaatgcatgca

SEQ ID NO: 3880761 - DNA, 14 bp, Homo sapiens
cctaccatgctgct

SEQ ID NO: 3880762 - DNA, 17 bp, Homo sapiens
cctacccactctttgct

SEQ ID NO: 3880763 - DNA, 13 bp, Homo sapiens
cctaccccacctc

SEQ ID NO: 3880764 - DNA, 20 bp, Homo sapiens
cctaccccacctcatgcctg

SEQ ID NO: 3880765 - DNA, 13 bp, Homo sapiens
cctaccctcactc

SEQ ID NO: 3880766 - DNA, 17 bp, Homo sapiens
cctacccttgtacccca

SEQ ID NO: 3880767 - DNA, 20 bp, Homo sapiens
cctaccgagtctcttctcca

SEQ ID NO: 3880768 - DNA, 22 bp, Homo sapiens
cctaccgagtctcttctccact

SEQ ID NO: 3880769 - DNA, 14 bp, Homo sapiens
cctacctgctgctg

SEQ ID NO: 3880770 - DNA, 21 bp, Homo sapiens
cctacgtcaaacatgaagtgt

SEQ ID NO: 3880771 - DNA, 17 bp, Homo sapiens
cctactactttgtgttt

SEQ ID NO: 3880772 - DNA, 23 bp, Homo sapiens
cctactagttttccttgaaaaaa

SEQ ID NO: 3880773 - DNA, 14 bp, Homo sapiens
cctactcacacagg

SEQ ID NO: 3880774 - DNA, 16 bp, Homo sapiens
cctactcccctgatcc

SEQ ID NO: 3880775 - DNA, 13 bp, Homo sapiens
cctagacctgggc

SEQ ID NO: 3880776 - DNA, 20 bp, Homo sapiens
cctagacctgggccaaaagg

SEQ ID NO: 3880777 - DNA, 21 bp, Homo sapiens
cctagactaattaaaatctgg

SEQ ID NO: 3880778 - DNA, 14 bp, Homo sapiens
cctagagaggctgg

SEQ ID NO: 3880779 - DNA, 16 bp, Homo sapiens
cctagagctcctgtcc

SEQ ID NO: 3880780 - DNA, 18 bp, Homo sapiens
cctagagctcctgtccct

SEQ ID NO: 3880781 - DNA, 22 bp, Homo sapiens
cctagagctcctgtccctaccc

SEQ ID NO: 3880782 - DNA, 20 bp, Homo sapiens
cctagatccacacacagagg

SEQ ID NO: 3880783 - DNA, 11 bp, Homo sapiens
cctagccacct

SEQ ID NO: 3880784 - DNA, 14 bp, Homo sapiens
cctagccacctccc

SEQ ID NO: 3880785 - DNA, 16 bp, Homo sapiens
cctagccacctcccac

SEQ ID NO: 3880786 - DNA, 23 bp, Homo sapiens
cctagccacctcccaccccactc

SEQ ID NO: 3880787 - DNA, 13 bp, Homo sapiens
cctagccctctca

SEQ ID NO: 3880788 - DNA, 20 bp, Homo sapiens
cctagccctctcacatttat

SEQ ID NO: 3880789 - DNA, 17 bp, Homo sapiens
cctaggaattcccagcc

SEQ ID NO: 3880790 - DNA, 20 bp, Homo sapiens
cctaggagaagcagcctcct

SEQ ID NO: 3880791 - DNA, 13 bp, Homo sapiens
ctatacaacaatg

SEQ ID NO: 3880792 - DNA, 15 bp, Homo sapiens
ctatacatttctgtt

SEQ ID NO: 3880793 - DNA, 22 bp, Homo sapiens
ctataccatatgtctgcttctg

SEQ ID NO: 3880794 - DNA, 19 bp, Homo sapiens
ctatagagagggggctctc

SEQ ID NO: 3880795 - DNA, 18 bp, Homo sapiens
ctatagctcttctattta

SEQ ID NO: 3880796 - DNA, 22 bp, Homo sapiens
ctatagctcttctatttaaaaa

SEQ ID NO: 3880797 - DNA, 22 bp, Homo sapiens
ctataggctggagaagctcacc

SEQ ID NO: 3880798 - DNA, 15 bp, Homo sapiens
ctataggtgctacaa

SEQ ID NO: 3880799 - DNA, 20 bp, Homo sapiens
ctataggtgctacaaaaaca

SEQ ID NO: 3880800 - DNA, 22 bp, Homo sapiens
ctatagtagtcaattagtacag

SEQ ID NO: 3880801 - DNA, 23 bp, Homo sapiens
ctatagtagtcaattagtacagt

SEQ ID NO: 3880802 - DNA, 18 bp, Homo sapiens
ctatataaggaggaaaac

SEQ ID NO: 3880803 - DNA, 19 bp, Homo sapiens
ctatatacatgtgtgtata

SEQ ID NO: 3880804 - DNA, 16 bp, Homo sapiens
ctatatagtttattga

SEQ ID NO: 3880805 - DNA, 13 bp, Homo sapiens
ctatatatataaa

SEQ ID NO: 3880806 - DNA, 13 bp, Homo sapiens
ctatatgatttat

SEQ ID NO: 3880807 - DNA, 16 bp, Homo sapiens
ctatatttaacaagat

SEQ ID NO: 3880808 - DNA, 13 bp, Homo sapiens
ctatatttagatt

SEQ ID NO: 3880809 - DNA, 23 bp, Homo sapiens
ctatatttagattgttaaaataa

SEQ ID NO: 3880810 - DNA, 15 bp, Homo sapiens
ctatcaaaacatatc

SEQ ID NO: 3880811 - DNA, 14 bp, Homo sapiens
ctatcaatatttaa

SEQ ID NO: 3880812 - DNA, 21 bp, Homo sapiens
ctatcaatcctgcccccagcc

SEQ ID NO: 3880813 - DNA, 14 bp, Homo sapiens
ctatcacacagtgg

SEQ ID NO: 3880814 - DNA, 16 bp, Homo sapiens
ctatcacatacaattt

SEQ ID NO: 3880815 - DNA, 12 bp, Homo sapiens
ctatccacccag

SEQ ID NO: 3880816 - DNA, 16 bp, Homo sapiens
ctatccacccagccca

SEQ ID NO: 3880817 - DNA, 17 bp, Homo sapiens
ctatccacccagcccat

SEQ ID NO: 3880818 - DNA, 15 bp, Homo sapiens
ctatccctgtacaga

SEQ ID NO: 3880819 - DNA, 19 bp, Homo sapiens
ctatccttccagtggctcg

SEQ ID NO: 3880820 - DNA, 20 bp, Homo sapiens
ctatccttggagagcagctg

SEQ ID NO: 3880821 - DNA, 23 bp, Homo sapiens
ctatctccaaatgagacacatta

SEQ ID NO: 3880822 - DNA, 23 bp, Homo sapiens
ctatctgagactataactgtcat

SEQ ID NO: 3880823 - DNA, 17 bp, Homo sapiens
ctatctgcatttataaa

SEQ ID NO: 3880824 - DNA, 22 bp, Homo sapiens
ctatctgcatttataaatgtgt

SEQ ID NO: 3880825 - DNA, 17 bp, Homo sapiens
ctatctgtatgtctgcc

SEQ ID NO: 3880826 - DNA, 13 bp, Homo sapiens
ctatgaaatgaaa

SEQ ID NO: 3880827 - DNA, 13 bp, Homo sapiens
ctatgaactacaa

SEQ ID NO: 3880828 - DNA, 15 bp, Homo sapiens
ctatgactgctcccc

SEQ ID NO: 3880829 - DNA, 22 bp, Homo sapiens
ctatgagaacaagtcacagctg

SEQ ID NO: 3880830 - DNA, 16 bp, Homo sapiens
ctatgatcacagtgac

SEQ ID NO: 3880831 - DNA, 17 bp, Homo sapiens
ctatgcaaatgcctcca

SEQ ID NO: 3880832 - DNA, 18 bp, Homo sapiens
ctatgcaatttttaaact

SEQ ID NO: 3880833 - DNA, 22 bp, Homo sapiens
ctatgcaatttttaaactagta

SEQ ID NO: 3880834 - DNA, 18 bp, Homo sapiens
ctatgctatttctggcct

SEQ ID NO: 3880835 - DNA, 11 bp, Homo sapiens
ctatggagagc

SEQ ID NO: 3880836 - DNA, 19 bp, Homo sapiens
ctatggagagccctgggac

SEQ ID NO: 3880837 - DNA, 19 bp, Homo sapiens
ctatggagcctggcacagg

SEQ ID NO: 3880838 - DNA, 16 bp, Homo sapiens
ctatggccctgcaaaa

SEQ ID NO: 3880839 - DNA, 21 bp, Homo sapiens
ctatggtatgctggccagcac

SEQ ID NO: 3880840 - DNA, 14 bp, Homo sapiens
ctatggtgaggtgt

SEQ ID NO: 3880841 - DNA, 23 bp, Homo sapiens
ctatggttcccaataaaagtgac

SEQ ID NO: 3880842 - DNA, 20 bp, Homo sapiens
ctatgtcaatttgtatatca

SEQ ID NO: 3880843 - DNA, 15 bp, Homo sapiens
ctatgtcctaaggac

SEQ ID NO: 3880844 - DNA, 13 bp, Homo sapiens
ctatgtcttgttt

SEQ ID NO: 3880845 - DNA, 11 bp, Homo sapiens
ctatgtgatgt

SEQ ID NO: 3880846 - DNA, 15 bp, Homo sapiens
ctatgtgatgttaac

SEQ ID NO: 3880847 - DNA, 16 bp, Homo sapiens
ctatgtggattagcta

SEQ ID NO: 3880848 - DNA, 18 bp, Homo sapiens
ctatgtgtcacagctctg

SEQ ID NO: 3880849 - DNA, 14 bp, Homo sapiens
ctatgttccctcca

SEQ ID NO: 3880850 - DNA, 16 bp, Homo sapiens
ctatgttgcccaggct

SEQ ID NO: 3880851 - DNA, 16 bp, Homo sapiens
ctattaagatttccaa

SEQ ID NO: 3880852 - DNA, 23 bp, Homo sapiens
ctattaagatttccaagtgccaa

SEQ ID NO: 3880853 - DNA, 23 bp, Homo sapiens
ctattactgtctggttttaacaa

SEQ ID NO: 3880854 - DNA, 16 bp, Homo sapiens
ctattacttgaacttt

SEQ ID NO: 3880855 - DNA, 20 bp, Homo sapiens
ctattacttgaactttccaa

SEQ ID NO: 3880856 - DNA, 21 bp, Homo sapiens
ctattataatttaatgcatgt

SEQ ID NO: 3880857 - DNA, 13 bp, Homo sapiens
ctattatgtaaca

SEQ ID NO: 3880858 - DNA, 21 bp, Homo sapiens
ctattatgtaacatccagaag

SEQ ID NO: 3880859 - DNA, 22 bp, Homo sapiens
ctattattttcactgtagaatg

SEQ ID NO: 3880860 - DNA, 16 bp, Homo sapiens
ctattcctgaccctcc

SEQ ID NO: 3880861 - DNA, 21 bp, Homo sapiens
ctattcctgaccctccctacc

SEQ ID NO: 3880862 - DNA, 15 bp, Homo sapiens
ctattctcaccagga

SEQ ID NO: 3880863 - DNA, 19 bp, Homo sapiens
ctattctctcctcagactg

SEQ ID NO: 3880864 - DNA, 15 bp, Homo sapiens
ctattctgagccttg

SEQ ID NO: 3880865 - DNA, 15 bp, Homo sapiens
ctattctgtgttgaa

SEQ ID NO: 3880866 - DNA, 21 bp, Homo sapiens
ctattgatgtttccagaaaat

SEQ ID NO: 3880867 - DNA, 22 bp, Homo sapiens
ctattgcatgtaaaatgcagtc

SEQ ID NO: 3880868 - DNA, 17 bp, Homo sapiens
ctattgggagggatgag

SEQ ID NO: 3880869 - DNA, 23 bp, Homo sapiens
ctattgtttaaaaacaggaaaaa

SEQ ID NO: 3880870 - DNA, 15 bp, Homo sapiens
ctatttaaaaaataa

SEQ ID NO: 3880871 - DNA, 16 bp, Homo sapiens
ctatttaaaaaataaa

SEQ ID NO: 3880872 - DNA, 14 bp, Homo sapiens
ctatttaacttgag

SEQ ID NO: 3880873 - DNA, 12 bp, Homo sapiens
ctatttaatatt

SEQ ID NO: 3880874 - DNA, 14 bp, Homo sapiens
ctatttaatattta

SEQ ID NO: 3880875 - DNA, 21 bp, Homo sapiens
ctatttataaactagatctcc

SEQ ID NO: 3880876 - DNA, 16 bp, Homo sapiens
ctatttattcattcag

SEQ ID NO: 3880877 - DNA, 16 bp, Homo sapiens
cgccagcctcagtgcc

SEQ ID NO: 3880878 - DNA, 17 bp, Homo sapiens
cgccagcctcagtgcca

SEQ ID NO: 3880879 - DNA, 19 bp, Homo sapiens
cgccagcctcagtgccact

SEQ ID NO: 3880880 - DNA, 20 bp, Homo sapiens
cgccagcctcagtgccactt

SEQ ID NO: 3880881 - DNA, 19 bp, Homo sapiens
cgccatccgggacgcttcc

SEQ ID NO: 3880882 - DNA, 14 bp, Homo sapiens
cgcccaaggggact

SEQ ID NO: 3880883 - DNA, 14 bp, Homo sapiens
cgccccacccaggg

SEQ ID NO: 3880884 - DNA, 14 bp, Homo sapiens
cgccccaggccctc

SEQ ID NO: 3880885 - DNA, 13 bp, Homo sapiens
cgccccccacctt

SEQ ID NO: 3880886 - DNA, 20 bp, Homo sapiens
cgcccctcgctgctgctact

SEQ ID NO: 3880887 - DNA, 13 bp, Homo sapiens
cgccccttccccc

SEQ ID NO: 3880888 - DNA, 19 bp, Homo sapiens
cgcccgactagcaggcatg

SEQ ID NO: 3880889 - DNA, 20 bp, Homo sapiens
cgccctgcagaccctgccct

SEQ ID NO: 3880890 - DNA, 21 bp, Homo sapiens
cgccctgcagaccctgccctt

SEQ ID NO: 3880891 - DNA, 18 bp, Homo sapiens
cgccctgcgttggagcca

SEQ ID NO: 3880892 - DNA, 19 bp, Homo sapiens
cgccctgcgttggagccac

SEQ ID NO: 3880893 - DNA, 21 bp, Homo sapiens
cgccctgcgttggagccactc

SEQ ID NO: 3880894 - DNA, 14 bp, Homo sapiens
cgccctgggctgtc

SEQ ID NO: 3880895 - DNA, 13 bp, Homo sapiens
cgccgggcaggcc

SEQ ID NO: 3880896 - DNA, 22 bp, Homo sapiens
cgcctcaatgtggttgcaaggc

SEQ ID NO: 3880897 - DNA, 18 bp, Homo sapiens
cgcctcccagccccaggg

SEQ ID NO: 3880898 - DNA, 13 bp, Homo sapiens
cgcctcctggcca

SEQ ID NO: 3880899 - DNA, 15 bp, Homo sapiens
cgcctcctggccaga

SEQ ID NO: 3880900 - DNA, 16 bp, Homo sapiens
cgcctcctggccagac

SEQ ID NO: 3880901 - DNA, 12 bp, Homo sapiens
cgcctctcccac

SEQ ID NO: 3880902 - DNA, 19 bp, Homo sapiens
cgcctctgcccgcagagcc

SEQ ID NO: 3880903 - DNA, 13 bp, Homo sapiens
cgcctgagcccag

SEQ ID NO: 3880904 - DNA, 21 bp, Homo sapiens
cgcctgagcccaggaggtgga

SEQ ID NO: 3880905 - DNA, 17 bp, Homo sapiens
cgcctgagcccagggag

SEQ ID NO: 3880906 - DNA, 22 bp, Homo sapiens
cgcctgccataccgctggggaa

SEQ ID NO: 3880907 - DNA, 23 bp, Homo sapiens
cgcctgccataccgctggggaac

SEQ ID NO: 3880908 - DNA, 16 bp, Homo sapiens
cgcctgggcccaggct

SEQ ID NO: 3880909 - DNA, 15 bp, Homo sapiens
cgcctgtagtcccag

SEQ ID NO: 3880910 - DNA, 22 bp, Homo sapiens
cgccttcctcctccacagtgct

SEQ ID NO: 3880911 - DNA, 12 bp, Homo sapiens
cgcgcacacaca

SEQ ID NO: 3880912 - DNA, 19 bp, Homo sapiens
cgcgcagcgcgtgcacagc

SEQ ID NO: 3880913 - DNA, 22 bp, Homo sapiens
cgcgcagcgcgtgcacagcgcg

SEQ ID NO: 3880914 - DNA, 17 bp, Homo sapiens
cgcggcttggccgccat

SEQ ID NO: 3880915 - DNA, 15 bp, Homo sapiens
cgcgggaggcaccag

SEQ ID NO: 3880916 - DNA, 15 bp, Homo sapiens
cgcggtgctctggcg

SEQ ID NO: 3880917 - DNA, 12 bp, Homo sapiens
cgcgtctcctgt

SEQ ID NO: 3880918 - DNA, 13 bp, Homo sapiens
cgcgtctcctgtt

SEQ ID NO: 3880919 - DNA, 21 bp, Homo sapiens
cgcgtctcctgtttttctggg

SEQ ID NO: 3880920 - DNA, 19 bp, Homo sapiens
cgcgtctgccccaccctca

SEQ ID NO: 3880921 - DNA, 15 bp, Homo sapiens
cgctaagacctcccc

SEQ ID NO: 3880922 - DNA, 23 bp, Homo sapiens
cgctacaccactctggcagccac

SEQ ID NO: 3880923 - DNA, 15 bp, Homo sapiens
cgctagagcagccca

SEQ ID NO: 3880924 - DNA, 17 bp, Homo sapiens
cgctagagcagcccaaa

SEQ ID NO: 3880925 - DNA, 16 bp, Homo sapiens
cgctcaggacccaggc

SEQ ID NO: 3880926 - DNA, 17 bp, Homo sapiens
cgctcaggacccaggcc

SEQ ID NO: 3880927 - DNA, 18 bp, Homo sapiens
cgctcaggacccaggccc

SEQ ID NO: 3880928 - DNA, 22 bp, Homo sapiens
cgctcaggacccaggccctcca

SEQ ID NO: 3880929 - DNA, 15 bp, Homo sapiens
cgctccccactctgc

SEQ ID NO: 3880930 - DNA, 19 bp, Homo sapiens
cgctccccactctgctctg

SEQ ID NO: 3880931 - DNA, 16 bp, Homo sapiens
cgctcctttacctacc

SEQ ID NO: 3880932 - DNA, 17 bp, Homo sapiens
cgctcctttacctacca

SEQ ID NO: 3880933 - DNA, 21 bp, Homo sapiens
cgctcctttacctaccacctt

SEQ ID NO: 3880934 - DNA, 21 bp, Homo sapiens
cgctctgctggcctggccggc

SEQ ID NO: 3880935 - DNA, 16 bp, Homo sapiens
cgctcttggtccctgg

SEQ ID NO: 3880936 - DNA, 14 bp, Homo sapiens
cgctgcaccacggc

SEQ ID NO: 3880937 - DNA, 23 bp, Homo sapiens
cgctgccaccacgtctgccaggc

SEQ ID NO: 3880938 - DNA, 16 bp, Homo sapiens
cgctgccaggacacct

SEQ ID NO: 3880939 - DNA, 19 bp, Homo sapiens
cgctgccaggacacctgcc

SEQ ID NO: 3880940 - DNA, 17 bp, Homo sapiens
cgctgcctaagtggctg

SEQ ID NO: 3880941 - DNA, 15 bp, Homo sapiens
cgctgccttgccatg

SEQ ID NO: 3880942 - DNA, 19 bp, Homo sapiens
cgctgctctagctggcagg

SEQ ID NO: 3880943 - DNA, 22 bp, Homo sapiens
cgctggaatcaatttcccagaa

SEQ ID NO: 3880944 - DNA, 15 bp, Homo sapiens
cgctggacaacccag

SEQ ID NO: 3880945 - DNA, 22 bp, Homo sapiens
cgctggacaacccagaactgga

SEQ ID NO: 3880946 - DNA, 13 bp, Homo sapiens
cgctggctcagga

SEQ ID NO: 3880947 - DNA, 17 bp, Homo sapiens
cgctggctcaggaagaa

SEQ ID NO: 3880948 - DNA, 21 bp, Homo sapiens
cgctggctcaggaagaaaccc

SEQ ID NO: 3880949 - DNA, 14 bp, Homo sapiens
cgctggggaacaga

SEQ ID NO: 3880950 - DNA, 19 bp, Homo sapiens
cgctgtcctctcgagccca

SEQ ID NO: 3880951 - DNA, 18 bp, Homo sapiens
cgctgtcgccccaggccc

SEQ ID NO: 3880952 - DNA, 16 bp, Homo sapiens
cgctgtgagcccctgg

SEQ ID NO: 3880953 - DNA, 17 bp, Homo sapiens
cgcttccagaccacctg

SEQ ID NO: 3880954 - DNA, 18 bp, Homo sapiens
cgcttccagaccacctgc

SEQ ID NO: 3880955 - DNA, 21 bp, Homo sapiens
cgcttccagaccacctgccag

SEQ ID NO: 3880956 - DNA, 23 bp, Homo sapiens
cgcttccagaccacctgccagcc

SEQ ID NO: 3880957 - DNA, 12 bp, Homo sapiens
cgcttcccagag

SEQ ID NO: 3880958 - DNA, 14 bp, Homo sapiens
cgcttcccagaggc

SEQ ID NO: 3880959 - DNA, 13 bp, Homo sapiens
cgcttctcctcca

SEQ ID NO: 3880960 - DNA, 14 bp, Homo sapiens
cgcttgcttctgca

SEQ ID NO: 3880961 - DNA, 15 bp, Homo sapiens
cgcttgcttctgcag

SEQ ID NO: 3880962 - DNA, 16 bp, Homo sapiens
cgcttgcttctgcagc

SEQ ID NO: 3880963 - DNA, 22 bp, Homo sapiens
cgagcaaccgtggcccttcctg

SEQ ID NO: 3880964 - DNA, 15 bp, Homo sapiens
cgagcactggccaga

SEQ ID NO: 3880965 - DNA, 18 bp, Homo sapiens
cgagcactggccagagag

SEQ ID NO: 3880966 - DNA, 15 bp, Homo sapiens
cgagcatcctggcca

SEQ ID NO: 3880967 - DNA, 12 bp, Homo sapiens
cgagcccagatg

SEQ ID NO: 3880968 - DNA, 14 bp, Homo sapiens
cgagccgggcctgg

SEQ ID NO: 3880969 - DNA, 17 bp, Homo sapiens
cgagccgggcctggggc

SEQ ID NO: 3880970 - DNA, 13 bp, Homo sapiens
cgagcgccctgca

SEQ ID NO: 3880971 - DNA, 16 bp, Homo sapiens
cgagctactctcttgc

SEQ ID NO: 3880972 - DNA, 21 bp, Homo sapiens
cgagctccttgggtcctgcaa

SEQ ID NO: 3880973 - DNA, 14 bp, Homo sapiens
cgagctgctctgct

SEQ ID NO: 3880974 - DNA, 15 bp, Homo sapiens
cgagctgctctgcta

SEQ ID NO: 3880975 - DNA, 15 bp, Homo sapiens
cgaggcaccggcgct

SEQ ID NO: 3880976 - DNA, 10 bp, Homo sapiens
cgaggctctt

SEQ ID NO: 3880977 - DNA, 14 bp, Homo sapiens
cgaggtagagtttg

SEQ ID NO: 3880978 - DNA, 15 bp, Homo sapiens
cgaggtcaacagaga

SEQ ID NO: 3880979 - DNA, 17 bp, Homo sapiens
cgaggtcaacagagaag

SEQ ID NO: 3880980 - DNA, 18 bp, Homo sapiens
cgaggtgtcaccctgcag

SEQ ID NO: 3880981 - DNA, 17 bp, Homo sapiens
cgaggttgccccttccc

SEQ ID NO: 3880982 - DNA, 22 bp, Homo sapiens
cgagtaagatattatttaaatg

SEQ ID NO: 3880983 - DNA, 20 bp, Homo sapiens
cgagtcaatcccctcattca

SEQ ID NO: 3880984 - DNA, 16 bp, Homo sapiens
cgagtctcttctccac

SEQ ID NO: 3880985 - DNA, 18 bp, Homo sapiens
cgagtctcttctccactg

SEQ ID NO: 3880986 - DNA, 20 bp, Homo sapiens
cgagtctcttctccactgga

SEQ ID NO: 3880987 - DNA, 11 bp, Homo sapiens
cgagtgccagg

SEQ ID NO: 3880988 - DNA, 14 bp, Homo sapiens
cgagtgccaggact

SEQ ID NO: 3880989 - DNA, 14 bp, Homo sapiens
cgatcaagtccaga

SEQ ID NO: 3880990 - DNA, 15 bp, Homo sapiens
cgatcaagtccagag

SEQ ID NO: 3880991 - DNA, 22 bp, Homo sapiens
cgatgtggccctggcctgctgg

SEQ ID NO: 3880992 - DNA, 14 bp, Homo sapiens
cgattaatttatgg

SEQ ID NO: 3880993 - DNA, 16 bp, Homo sapiens
cgattaatttatggtt

SEQ ID NO: 3880994 - DNA, 17 bp, Homo sapiens
cgattccctctcccagg

SEQ ID NO: 3880995 - DNA, 18 bp, Homo sapiens
cgcaacccttgctgctgc

SEQ ID NO: 3880996 - DNA, 20 bp, Homo sapiens
cgcaagcctgtaatcccagc

SEQ ID NO: 3880997 - DNA, 21 bp, Homo sapiens
cgcaagcgcagggaggatgcc

SEQ ID NO: 3880998 - DNA, 22 bp, Homo sapiens
cgcaagggagaagaaatccata

SEQ ID NO: 3880999 - DNA, 16 bp, Homo sapiens
cgcaagggcatcaggc

SEQ ID NO: 3881000 - DNA, 19 bp, Homo sapiens
cgcaagggcatcaggcact

SEQ ID NO: 3881001 - DNA, 21 bp, Homo sapiens
cgcaagggcatcaggcactgg

SEQ ID NO: 3881002 - DNA, 17 bp, Homo sapiens
cgcaagttcagggaagc

SEQ ID NO: 3881003 - DNA, 19 bp, Homo sapiens
cgcaagttcagggaagcag

SEQ ID NO: 3881004 - DNA, 10 bp, Homo sapiens
cgcacacaca

SEQ ID NO: 3881005 - DNA, 22 bp, Homo sapiens
cgcacacacaccggtcaccgag

SEQ ID NO: 3881006 - DNA, 17 bp, Homo sapiens
cgcaccagctgctctgc

SEQ ID NO: 3881007 - DNA, 16 bp, Homo sapiens
cgcaccttttatacca

SEQ ID NO: 3881008 - DNA, 22 bp, Homo sapiens
cgcactacatgtggtttataga

SEQ ID NO: 3881009 - DNA, 18 bp, Homo sapiens
cgcactcacccatgtgcc

SEQ ID NO: 3881010 - DNA, 12 bp, Homo sapiens
cgcagaaggaag

SEQ ID NO: 3881011 - DNA, 12 bp, Homo sapiens
cgcagagcccac

SEQ ID NO: 3881012 - DNA, 11 bp, Homo sapiens
cgcagaggcgg

SEQ ID NO: 3881013 - DNA, 21 bp, Homo sapiens
cgcagaggcggaaaccttgca

SEQ ID NO: 3881014 - DNA, 15 bp, Homo sapiens
cgcagagtaaaataa

SEQ ID NO: 3881015 - DNA, 20 bp, Homo sapiens
cgcagcaggtgcaagagaca

SEQ ID NO: 3881016 - DNA, 11 bp, Homo sapiens
cgcagccaccc

SEQ ID NO: 3881017 - DNA, 12 bp, Homo sapiens
cgcagccaccct

SEQ ID NO: 3881018 - DNA, 13 bp, Homo sapiens
cgcagccaccctg

SEQ ID NO: 3881019 - DNA, 14 bp, Homo sapiens
cgcagccaccctga

SEQ ID NO: 3881020 - DNA, 21 bp, Homo sapiens
cgcagccagccggtgcctggc

SEQ ID NO: 3881021 - DNA, 16 bp, Homo sapiens
cgcagcccgaagccca

SEQ ID NO: 3881022 - DNA, 18 bp, Homo sapiens
cgcagcccgaagcccagt

SEQ ID NO: 3881023 - DNA, 12 bp, Homo sapiens
cgcagcccgtga

SEQ ID NO: 3881024 - DNA, 20 bp, Homo sapiens
cgcagcccgtgaagcagtgc

SEQ ID NO: 3881025 - DNA, 22 bp, Homo sapiens
cgcagcccgtgaagcagtgcct

SEQ ID NO: 3881026 - DNA, 10 bp, Homo sapiens
cgcagccctg

SEQ ID NO: 3881027 - DNA, 15 bp, Homo sapiens
cgcagccctgctttg

SEQ ID NO: 3881028 - DNA, 19 bp, Homo sapiens
cgcagccctgggggccagc

SEQ ID NO: 3881029 - DNA, 21 bp, Homo sapiens
cgcagccgccgggcaggcctg

SEQ ID NO: 3881030 - DNA, 22 bp, Homo sapiens
cgcagcctggcggggcaggagg

SEQ ID NO: 3881031 - DNA, 14 bp, Homo sapiens
cgcagcggggtagg

SEQ ID NO: 3881032 - DNA, 17 bp, Homo sapiens
cgcaggatccgctgcca

SEQ ID NO: 3881033 - DNA, 19 bp, Homo sapiens
cgcaggatccgctgccacc

SEQ ID NO: 3881034 - DNA, 21 bp, Homo sapiens
cgcaggctatttgttcagaga

SEQ ID NO: 3881035 - DNA, 17 bp, Homo sapiens
cgcagggaggatgccac

SEQ ID NO: 3881036 - DNA, 19 bp, Homo sapiens
cgcagggaggatgccacag

SEQ ID NO: 3881037 - DNA, 22 bp, Homo sapiens
cgcagggaggatgccacagccc

SEQ ID NO: 3881038 - DNA, 12 bp, Homo sapiens
cgcagtccccag

SEQ ID NO: 3881039 - DNA, 15 bp, Homo sapiens
cgcagtccccagccc

SEQ ID NO: 3881040 - DNA, 16 bp, Homo sapiens
cgcagtccccagccct

SEQ ID NO: 3881041 - DNA, 13 bp, Homo sapiens
cgcagtctggcct

SEQ ID NO: 3881042 - DNA, 15 bp, Homo sapiens
cgcagtctggcctgg

SEQ ID NO: 3881043 - DNA, 22 bp, Homo sapiens
cgcagtctggcctgggcgacag

SEQ ID NO: 3881044 - DNA, 19 bp, Homo sapiens
cgcagtgcttctctacaga

SEQ ID NO: 3881045 - DNA, 12 bp, Homo sapiens
cgcatcatatgc

SEQ ID NO: 3881046 - DNA, 15 bp, Homo sapiens
cgcatcttctccatc

SEQ ID NO: 3881047 - DNA, 16 bp, Homo sapiens
cgccaaagtgcagccc

SEQ ID NO: 3881048 - DNA, 15 bp, Homo sapiens
cgccaccgctgcctt

SEQ ID NO: 3881049 - DNA, 18 bp, Homo sapiens
cgccacggccaccctcct

SEQ ID NO: 3881050 - DNA, 21 bp, Homo sapiens
cgcttgcttctgcagcaactc

SEQ ID NO: 3881051 - DNA, 17 bp, Homo sapiens
cgcttgtccagcgccta

SEQ ID NO: 3881052 - DNA, 15 bp, Homo sapiens
cggaaaccttgcagc

SEQ ID NO: 3881053 - DNA, 16 bp, Homo sapiens
cggaaaccttgcagca

SEQ ID NO: 3881054 - DNA, 22 bp, Homo sapiens
cggaagaagagatcaggaagag

SEQ ID NO: 3881055 - DNA, 22 bp, Homo sapiens
cggaagccgtctgactccagag

SEQ ID NO: 3881056 - DNA, 16 bp, Homo sapiens
cggaagggggaagtct

SEQ ID NO: 3881057 - DNA, 21 bp, Homo sapiens
cggaatcactctgtccttgga

SEQ ID NO: 3881058 - DNA, 16 bp, Homo sapiens
cggacagtgcccatgc

SEQ ID NO: 3881059 - DNA, 15 bp, Homo sapiens
cggacgtcctgctgg

SEQ ID NO: 3881060 - DNA, 16 bp, Homo sapiens
cggacgtttccatcag

SEQ ID NO: 3881061 - DNA, 24 bp, Homo sapiens
cggagaagagctgttcacagccag

SEQ ID NO: 3881062 - DNA, 17 bp, Homo sapiens
cggagagtacagtgagc

SEQ ID NO: 3881063 - DNA, 19 bp, Homo sapiens
cggagagtacagtgagcca

SEQ ID NO: 3881064 - DNA, 14 bp, Homo sapiens
cggagcacagccct

SEQ ID NO: 3881065 - DNA, 15 bp, Homo sapiens
cggagcacagccctg

SEQ ID NO: 3881066 - DNA, 18 bp, Homo sapiens
cggagcacagccctggga

SEQ ID NO: 3881067 - DNA, 21 bp, Homo sapiens
cggagcacagccctgggaggg

SEQ ID NO: 3881068 - DNA, 12 bp, Homo sapiens
cggagccccagg

SEQ ID NO: 3881069 - DNA, 22 bp, Homo sapiens
cggagccccaggcctctgtgtc

SEQ ID NO: 3881070 - DNA, 22 bp, Homo sapiens
cggaggcaccacgaagctgtga

SEQ ID NO: 3881071 - DNA, 18 bp, Homo sapiens
cggaggggcctggcagcc

SEQ ID NO: 3881072 - DNA, 20 bp, Homo sapiens
cggaggggttgcgggggagc

SEQ ID NO: 3881073 - DNA, 21 bp, Homo sapiens
cggagtagaaattgttcctga

SEQ ID NO: 3881074 - DNA, 16 bp, Homo sapiens
cggatctcactcagcc

SEQ ID NO: 3881075 - DNA, 18 bp, Homo sapiens
cggatgcacacacagatg

SEQ ID NO: 3881076 - DNA, 22 bp, Homo sapiens
cggcaaccccagttctgctcct

SEQ ID NO: 3881077 - DNA, 15 bp, Homo sapiens
cggcaccccctgcag

SEQ ID NO: 3881078 - DNA, 16 bp, Homo sapiens
cggcaccccctgcagc

SEQ ID NO: 3881079 - DNA, 17 bp, Homo sapiens
cggcaccccctgcagct

SEQ ID NO: 3881080 - DNA, 19 bp, Homo sapiens
cggcaccccctgcagcttg

SEQ ID NO: 3881081 - DNA, 17 bp, Homo sapiens
cggcacctgggccctgg

SEQ ID NO: 3881082 - DNA, 14 bp, Homo sapiens
cggcaggagcagga

SEQ ID NO: 3881083 - DNA, 16 bp, Homo sapiens
cggcaggagcaggaac

SEQ ID NO: 3881084 - DNA, 23 bp, Homo sapiens
cggcaggagcaggaacagagact

SEQ ID NO: 3881085 - DNA, 10 bp, Homo sapiens
cggccaccct

SEQ ID NO: 3881086 - DNA, 16 bp, Homo sapiens
cggccagggcctggtg

SEQ ID NO: 3881087 - DNA, 21 bp, Homo sapiens
cggcccagaagtttccctcaa

SEQ ID NO: 3881088 - DNA, 17 bp, Homo sapiens
cggcccagagacccctt

SEQ ID NO: 3881089 - DNA, 19 bp, Homo sapiens
cggcccagagaccccttcc

SEQ ID NO: 3881090 - DNA, 17 bp, Homo sapiens
cggccccctccatcggg

SEQ ID NO: 3881091 - DNA, 18 bp, Homo sapiens
cggccctcaaaagcactt

SEQ ID NO: 3881092 - DNA, 15 bp, Homo sapiens
cggccgggctgccct

SEQ ID NO: 3881093 - DNA, 12 bp, Homo sapiens
cggcctccactc

SEQ ID NO: 3881094 - DNA, 21 bp, Homo sapiens
cggcctccgtccaggagcctg

SEQ ID NO: 3881095 - DNA, 19 bp, Homo sapiens
cggcctcgtgccatgatct

SEQ ID NO: 3881096 - DNA, 13 bp, Homo sapiens
cggcctgctccca

SEQ ID NO: 3881097 - DNA, 18 bp, Homo sapiens
cggcctgctcccagcagc

SEQ ID NO: 3881098 - DNA, 19 bp, Homo sapiens
cggcctgctcccagcagcc

SEQ ID NO: 3881099 - DNA, 19 bp, Homo sapiens
cggccttcaactgaaaaga

SEQ ID NO: 3881100 - DNA, 15 bp, Homo sapiens
cggcgccaccatcct

SEQ ID NO: 3881101 - DNA, 17 bp, Homo sapiens
cggcgccaccatcctgc

SEQ ID NO: 3881102 - DNA, 13 bp, Homo sapiens
cggcgctgcaggt

SEQ ID NO: 3881103 - DNA, 12 bp, Homo sapiens
cggctactcagc

SEQ ID NO: 3881104 - DNA, 18 bp, Homo sapiens
cggctactcagcagccct

SEQ ID NO: 3881105 - DNA, 21 bp, Homo sapiens
cggctactcagcagccctcct

SEQ ID NO: 3881106 - DNA, 12 bp, Homo sapiens
cggctccaggtc

SEQ ID NO: 3881107 - DNA, 22 bp, Homo sapiens
cggctgagtcatgatctccctg

SEQ ID NO: 3881108 - DNA, 12 bp, Homo sapiens
cggctgcctgcc

SEQ ID NO: 3881109 - DNA, 17 bp, Homo sapiens
cggctgcttccttctgc

SEQ ID NO: 3881110 - DNA, 14 bp, Homo sapiens
cggcttcctgtcca

SEQ ID NO: 3881111 - DNA, 16 bp, Homo sapiens
cggcttcctgtccact

SEQ ID NO: 3881112 - DNA, 22 bp, Homo sapiens
cgggaagcctccgtcaggagag

SEQ ID NO: 3881113 - DNA, 15 bp, Homo sapiens
cgggacacctgccct

SEQ ID NO: 3881114 - DNA, 18 bp, Homo sapiens
cgggacgcttccagacca

SEQ ID NO: 3881115 - DNA, 22 bp, Homo sapiens
cgggagatggacccctcccttg

SEQ ID NO: 3881116 - DNA, 19 bp, Homo sapiens
cgggagcctccccctcaga

SEQ ID NO: 3881117 - DNA, 13 bp, Homo sapiens
cgggagcctcctc

SEQ ID NO: 3881118 - DNA, 13 bp, Homo sapiens
cgggaggcaccag

SEQ ID NO: 3881119 - DNA, 23 bp, Homo sapiens
cgggaggcaccagctctgtggcc

SEQ ID NO: 3881120 - DNA, 13 bp, Homo sapiens
cgggaggcctcag

SEQ ID NO: 3881121 - DNA, 16 bp, Homo sapiens
cgggaggctgagacag

SEQ ID NO: 3881122 - DNA, 17 bp, Homo sapiens
cgggaggctgagacagg

SEQ ID NO: 3881123 - DNA, 23 bp, Homo sapiens
cgggaggctgagacaggagaatc

SEQ ID NO: 3881124 - DNA, 17 bp, Homo sapiens
cgggcaggtcctgccca

SEQ ID NO: 3881125 - DNA, 23 bp, Homo sapiens
cgggcaggtcctgcccatgtgtc

SEQ ID NO: 3881126 - DNA, 21 bp, Homo sapiens
cgggcatggtggcgcaagcct

SEQ ID NO: 3881127 - DNA, 21 bp, Homo sapiens
cgggccactccttcctgcccc

SEQ ID NO: 3881128 - DNA, 21 bp, Homo sapiens
cgggccccccacacgcgtgtg

SEQ ID NO: 3881129 - DNA, 11 bp, Homo sapiens
cgggcctcagt

SEQ ID NO: 3881130 - DNA, 12 bp, Homo sapiens
cgggcctcagtt

SEQ ID NO: 3881131 - DNA, 20 bp, Homo sapiens
cgggcctggagaactagaga

SEQ ID NO: 3881132 - DNA, 23 bp, Homo sapiens
cgggcgcctgtagtcccagccac

SEQ ID NO: 3881133 - DNA, 13 bp, Homo sapiens
cgggctctggcca

SEQ ID NO: 3881134 - DNA, 16 bp, Homo sapiens
cgggctctggccaccc

SEQ ID NO: 3881135 - DNA, 16 bp, Homo sapiens
cgggctgggagctctg

SEQ ID NO: 3881136 - DNA, 20 bp, Homo sapiens
cggggaactggccaagctga

SEQ ID NO: 3881137 - DNA, 19 bp, Homo sapiens
cggggcaggaggcctggcc

SEQ ID NO: 3881138 - DNA, 14 bp, Homo sapiens
cggggccccagggc

SEQ ID NO: 3881139 - DNA, 15 bp, Homo sapiens
cggggccccagggct

SEQ ID NO: 3881140 - DNA, 21 bp, Homo sapiens
cggggcccttggggcctggct

SEQ ID NO: 3881141 - DNA, 12 bp, Homo sapiens
cggggctggcaa

SEQ ID NO: 3881142 - DNA, 16 bp, Homo sapiens
cggggctggcaagcag

SEQ ID NO: 3881143 - DNA, 19 bp, Homo sapiens
cgggggagccaacagcagc

SEQ ID NO: 3881144 - DNA, 18 bp, Homo sapiens
cgggggtgcggcaggagc

SEQ ID NO: 3881145 - DNA, 20 bp, Homo sapiens
cgggggtgcggcaggagcag

SEQ ID NO: 3881146 - DNA, 17 bp, Homo sapiens
cggggtctgtgctgtgc

SEQ ID NO: 3881147 - DNA, 12 bp, Homo sapiens
cggggtgcagaa

SEQ ID NO: 3881148 - DNA, 22 bp, Homo sapiens
cgggtctcacttataccaaagg

SEQ ID NO: 3881149 - DNA, 23 bp, Homo sapiens
cgggtgcatttgagagaagccac

SEQ ID NO: 3881150 - DNA, 18 bp, Homo sapiens
cgggtggctagtcagaga

SEQ ID NO: 3881151 - DNA, 17 bp, Homo sapiens
cgggtgggcctggcctg

SEQ ID NO: 3881152 - DNA, 19 bp, Homo sapiens
cgggtgggcctggcctgag

SEQ ID NO: 3881153 - DNA, 19 bp, Homo sapiens
cgggtgtgcctgccctgga

SEQ ID NO: 3881154 - DNA, 20 bp, Homo sapiens
cgggtgtgcctgccctggag

SEQ ID NO: 3881155 - DNA, 17 bp, Homo sapiens
cgggtgtggcctcagcc

SEQ ID NO: 3881156 - DNA, 20 bp, Homo sapiens
cgggtgtggcctcagccctc

SEQ ID NO: 3881157 - DNA, 12 bp, Homo sapiens
cggtactcccat

SEQ ID NO: 3881158 - DNA, 23 bp, Homo sapiens
cggtcatgcttttgccactttgg

SEQ ID NO: 3881159 - DNA, 15 bp, Homo sapiens
cggtcatgtgtgcat

SEQ ID NO: 3881160 - DNA, 17 bp, Homo sapiens
cggtcatgtgtgcatgt

SEQ ID NO: 3881161 - DNA, 18 bp, Homo sapiens
cggtcatgtgtgcatgtg

SEQ ID NO: 3881162 - DNA, 21 bp, Homo sapiens
cggtcctttaggcagcctgcc

SEQ ID NO: 3881163 - DNA, 20 bp, Homo sapiens
cggtgcctgggtggggctgc

SEQ ID NO: 3881164 - DNA, 17 bp, Homo sapiens
cggtgcgtggctgtggc

SEQ ID NO: 3881165 - DNA, 18 bp, Homo sapiens
cggtgcgtggctgtggca

SEQ ID NO: 3881166 - DNA, 20 bp, Homo sapiens
cggtgcgtggctgtggcaca

SEQ ID NO: 3881167 - DNA, 20 bp, Homo sapiens
cggtgctcgcttctcctcca

SEQ ID NO: 3881168 - DNA, 12 bp, Homo sapiens
cggtgctctggc

SEQ ID NO: 3881169 - DNA, 13 bp, Homo sapiens
cggtgctctggcg

SEQ ID NO: 3881170 - DNA, 14 bp, Homo sapiens
cggtgctctggcgg

SEQ ID NO: 3881171 - DNA, 20 bp, Homo sapiens
cggtggctcacacctgtaat

SEQ ID NO: 3881172 - DNA, 15 bp, Homo sapiens
cggtgggacagcccc

SEQ ID NO: 3881173 - DNA, 16 bp, Homo sapiens
cggttaacttgtatat

SEQ ID NO: 3881174 - DNA, 20 bp, Homo sapiens
cggttccacgtccccctggg

SEQ ID NO: 3881175 - DNA, 15 bp, Homo sapiens
cggttgcttcacctt

SEQ ID NO: 3881176 - DNA, 12 bp, Homo sapiens
cggtttctgagc

SEQ ID NO: 3881177 - DNA, 23 bp, Homo sapiens
cggtttggtttgttgtaaataaa

SEQ ID NO: 3881178 - DNA, 19 bp, Homo sapiens
cgtaatgattatatgacaa

SEQ ID NO: 3881179 - DNA, 14 bp, Homo sapiens
cgtaattttattat

SEQ ID NO: 3881180 - DNA, 12 bp, Homo sapiens
cgtaccagccag

SEQ ID NO: 3881181 - DNA, 14 bp, Homo sapiens
cgtaccagccagga

SEQ ID NO: 3881182 - DNA, 14 bp, Homo sapiens
cgtaggcagcctct

SEQ ID NO: 3881183 - DNA, 21 bp, Homo sapiens
cgtaggcagcctctctgctat

SEQ ID NO: 3881184 - DNA, 22 bp, Homo sapiens
cgtatgtcggcacgtcccatgt

SEQ ID NO: 3881185 - DNA, 15 bp, Homo sapiens
cgtattggtccagct

SEQ ID NO: 3881186 - DNA, 21 bp, Homo sapiens
cgtatttatatttggaaagag

SEQ ID NO: 3881187 - DNA, 12 bp, Homo sapiens
cgtattttaaaa

SEQ ID NO: 3881188 - DNA, 17 bp, Homo sapiens
cgtcaacgtgcatttta

SEQ ID NO: 3881189 - DNA, 15 bp, Homo sapiens
cgtcatgttcctcaa

SEQ ID NO: 3881190 - DNA, 23 bp, Homo sapiens
cgtccacaggggcaggcctggga

SEQ ID NO: 3881191 - DNA, 16 bp, Homo sapiens
cgtccacccaggctgc

SEQ ID NO: 3881192 - DNA, 19 bp, Homo sapiens
cgtccaggagcctgtgcct

SEQ ID NO: 3881193 - DNA, 17 bp, Homo sapiens
cgtccatggcaccagcc

SEQ ID NO: 3881194 - DNA, 19 bp, Homo sapiens
cgtccatggcaccagcccc

SEQ ID NO: 3881195 - DNA, 16 bp, Homo sapiens
cgtcccccagaacctc

SEQ ID NO: 3881196 - DNA, 13 bp, Homo sapiens
cgtccccctgggg

SEQ ID NO: 3881197 - DNA, 16 bp, Homo sapiens
cgtccctagcagtgaa

SEQ ID NO: 3881198 - DNA, 20 bp, Homo sapiens
cgtcccttggaaagttcagc

SEQ ID NO: 3881199 - DNA, 16 bp, Homo sapiens
cgtcctccccctgcca

SEQ ID NO: 3881200 - DNA, 20 bp, Homo sapiens
cgtcctgacgccctgcgttg

SEQ ID NO: 3881201 - DNA, 12 bp, Homo sapiens
cgtcctgcagag

SEQ ID NO: 3881202 - DNA, 15 bp, Homo sapiens
cgtctcctttgacat

SEQ ID NO: 3881203 - DNA, 13 bp, Homo sapiens
cgtctctgtcccg

SEQ ID NO: 3881204 - DNA, 14 bp, Homo sapiens
cgtctgactccaga

SEQ ID NO: 3881205 - DNA, 15 bp, Homo sapiens
cgtctgactccagag

SEQ ID NO: 3881206 - DNA, 16 bp, Homo sapiens
cgtctgactccagagt

SEQ ID NO: 3881207 - DNA, 18 bp, Homo sapiens
cgtctgactccagagtct

SEQ ID NO: 3881208 - DNA, 23 bp, Homo sapiens
cgtcttagaagtggaccaggaca

SEQ ID NO: 3881209 - DNA, 18 bp, Homo sapiens
cgtcttgctatttgagca

SEQ ID NO: 3881210 - DNA, 23 bp, Homo sapiens
cgtcttgggtcgccctaccctca

SEQ ID NO: 3881211 - DNA, 14 bp, Homo sapiens
cgtgaactcctgag

SEQ ID NO: 3881212 - DNA, 15 bp, Homo sapiens
cgtgaagcagtgcct

SEQ ID NO: 3881213 - DNA, 20 bp, Homo sapiens
cgtgaagcagtgcctcgagg

SEQ ID NO: 3881214 - DNA, 22 bp, Homo sapiens
cgtgaagcagtgcctcgaggca

SEQ ID NO: 3881215 - DNA, 15 bp, Homo sapiens
cgtgaatgtctcagc

SEQ ID NO: 3881216 - DNA, 16 bp, Homo sapiens
cgtgaatgtctcagcg

SEQ ID NO: 3881217 - DNA, 16 bp, Homo sapiens
cgtgacccttcagggc

SEQ ID NO: 3881218 - DNA, 16 bp, Homo sapiens
cgtgactcacccaagc

SEQ ID NO: 3881219 - DNA, 18 bp, Homo sapiens
cgtgactcacccaagcat

SEQ ID NO: 3881220 - DNA, 16 bp, Homo sapiens
cgtgactgccccaact

SEQ ID NO: 3881221 - DNA, 17 bp, Homo sapiens
cgtgactgccccaactc

SEQ ID NO: 3881222 - DNA, 20 bp, Homo sapiens
cgtgactgccccaactcctg

SEQ ID NO: 3881223 - DNA, 23 bp, Homo sapiens
cgtgatcaagttgaggggcttcc

SEQ ID NO: 3881224 - DNA, 23 bp, Homo sapiens
cgtgatgtagggtaaggtgcctt

SEQ ID NO: 3881225 - DNA, 16 bp, Homo sapiens
cgtgcaaggggctcag

SEQ ID NO: 3881226 - DNA, 14 bp, Homo sapiens
cgtgcacagcgcgg

SEQ ID NO: 3881227 - DNA, 22 bp, Homo sapiens
cgtgcactccctaagaaacccc

SEQ ID NO: 3881228 - DNA, 17 bp, Homo sapiens
cgtgcagggacaaagag

SEQ ID NO: 3881229 - DNA, 16 bp, Homo sapiens
cgtgcagtacaggcaa

SEQ ID NO: 3881230 - DNA, 16 bp, Homo sapiens
cgtgccagctctagtt

SEQ ID NO: 3881231 - DNA, 17 bp, Homo sapiens
cgtgccccgcctccccg

SEQ ID NO: 3881232 - DNA, 18 bp, Homo sapiens
cgtgccttcagctctaca

SEQ ID NO: 3881233 - DNA, 15 bp, Homo sapiens
cgtgcctttctctgg

SEQ ID NO: 3881234 - DNA, 22 bp, Homo sapiens
cgtgcgcaacaacaaggaccct

SEQ ID NO: 3881235 - DNA, 17 bp, Homo sapiens
cgtgcgtgttagtgtgt

SEQ ID NO: 3881236 - DNA, 17 bp, Homo sapiens
cgtgctcgcagcctggc

SEQ ID NO: 3881237 - DNA, 17 bp, Homo sapiens
cgtgctcttctgttctc

SEQ ID NO: 3881238 - DNA, 20 bp, Homo sapiens
cgtgctcttctgttctcaaa

SEQ ID NO: 3881239 - DNA, 16 bp, Homo sapiens
cgtgctttatttatgg

SEQ ID NO: 3881240 - DNA, 13 bp, Homo sapiens
cgtggacacctgc

SEQ ID NO: 3881241 - DNA, 18 bp, Homo sapiens
cgtggacacctgccctgc

SEQ ID NO: 3881242 - DNA, 19 bp, Homo sapiens
cgtggacacctgccctgcc

SEQ ID NO: 3881243 - DNA, 17 bp, Homo sapiens
cgtggcaaatataaaac

SEQ ID NO: 3881244 - DNA, 21 bp, Homo sapiens
cgtggcagataatcagcctct

SEQ ID NO: 3881245 - DNA, 22 bp, Homo sapiens
cgtggcagataatcagcctctt

SEQ ID NO: 3881246 - DNA, 15 bp, Homo sapiens
cgtggccctgccctc

SEQ ID NO: 3881247 - DNA, 13 bp, Homo sapiens
cgtggcctgcacc

SEQ ID NO: 3881248 - DNA, 22 bp, Homo sapiens
cgtggcctgcggccgggctgcc

SEQ ID NO: 3881249 - DNA, 13 bp, Homo sapiens
cgtggctgcaaaa

SEQ ID NO: 3881250 - DNA, 13 bp, Homo sapiens
cgtggctgtggca

SEQ ID NO: 3881251 - DNA, 15 bp, Homo sapiens
cgtggctgtggcaca

SEQ ID NO: 3881252 - DNA, 19 bp, Homo sapiens
cgtggcttcccgctcagcc

SEQ ID NO: 3881253 - DNA, 14 bp, Homo sapiens
cgtggtagaagcca

SEQ ID NO: 3881254 - DNA, 22 bp, Homo sapiens
cgtgtcaatgaatgccggggac

SEQ ID NO: 3881255 - DNA, 21 bp, Homo sapiens
cgtgtctataatggaaacatt

SEQ ID NO: 3881256 - DNA, 14 bp, Homo sapiens
cgtgtctctcccac

SEQ ID NO: 3881257 - DNA, 17 bp, Homo sapiens
cgtgtcttcaattaaaa

SEQ ID NO: 3881258 - DNA, 19 bp, Homo sapiens
cgtgttactgttgcactga

SEQ ID NO: 3881259 - DNA, 18 bp, Homo sapiens
cgtgttagtgtgtgtgca

SEQ ID NO: 3881260 - DNA, 22 bp, Homo sapiens
cgtgttagtgtgtgtgcatgtg

SEQ ID NO: 3881261 - DNA, 15 bp, Homo sapiens
cgttatatattgtat

SEQ ID NO: 3881262 - DNA, 13 bp, Homo sapiens
cgttccctgtcag

SEQ ID NO: 3881263 - DNA, 18 bp, Homo sapiens
cgttccttactgcagaat

SEQ ID NO: 3881264 - DNA, 19 bp, Homo sapiens
cgttctccagcccacaccc

SEQ ID NO: 3881265 - DNA, 20 bp, Homo sapiens
cgttctccagcccacacccc

SEQ ID NO: 3881266 - DNA, 17 bp, Homo sapiens
cgttctgctggcctgga

SEQ ID NO: 3881267 - DNA, 12 bp, Homo sapiens
cgttggagccac

SEQ ID NO: 3881268 - DNA, 15 bp, Homo sapiens
cgttggttctgcact

SEQ ID NO: 3881269 - DNA, 11 bp, Homo sapiens
cgtttccatca

SEQ ID NO: 3881270 - DNA, 15 bp, Homo sapiens
cgtttttgtgctgtg

SEQ ID NO: 3881271 - DNA, 22 bp, Homo sapiens
cgtttttgtgctgtgggcagca

SEQ ID NO: 3881272 - DNA, 22 bp, Homo sapiens
ctaaaactatggttcccaataa

SEQ ID NO: 3881273 - DNA, 13 bp, Homo sapiens
ctaaaagtaaaca

SEQ ID NO: 3881274 - DNA, 15 bp, Homo sapiens
ctaaaagtaaacatt

SEQ ID NO: 3881275 - DNA, 22 bp, Homo sapiens
ctaaaagtggtttttatttcct

SEQ ID NO: 3881276 - DNA, 18 bp, Homo sapiens
ctaaaataaaaaccagaa

SEQ ID NO: 3881277 - DNA, 19 bp, Homo sapiens
ctaaaataaaaaccagaat

SEQ ID NO: 3881278 - DNA, 13 bp, Homo sapiens
ctaaaatgacagc

SEQ ID NO: 3881279 - DNA, 18 bp, Homo sapiens
ctaaacagactatttaac

SEQ ID NO: 3881280 - DNA, 14 bp, Homo sapiens
ctaaacccaaataa

SEQ ID NO: 3881281 - DNA, 15 bp, Homo sapiens
ctaaacccaaataaa

SEQ ID NO: 3881282 - DNA, 20 bp, Homo sapiens
ctaaacgagtcaatcccctc

SEQ ID NO: 3881283 - DNA, 14 bp, Homo sapiens
ctaaagacagaaaa

SEQ ID NO: 3881284 - DNA, 20 bp, Homo sapiens
ctaaagatatcagagctctt

SEQ ID NO: 3881285 - DNA, 22 bp, Homo sapiens
ctaaagatatcagagctcttaa

SEQ ID NO: 3881286 - DNA, 17 bp, Homo sapiens
ctaaagcccaacctcct

SEQ ID NO: 3881287 - DNA, 18 bp, Homo sapiens
ctaaagtgcctaccccag

SEQ ID NO: 3881288 - DNA, 18 bp, Homo sapiens
ctaaagtttacagtaaat

SEQ ID NO: 3881289 - DNA, 14 bp, Homo sapiens
ctaaatactgtaca

SEQ ID NO: 3881290 - DNA, 11 bp, Homo sapiens
ctaaatatatg

SEQ ID NO: 3881291 - DNA, 20 bp, Homo sapiens
ctaaatgcaaacactgtgta

SEQ ID NO: 3881292 - DNA, 20 bp, Homo sapiens
ctaaatggctttaattatat

SEQ ID NO: 3881293 - DNA, 14 bp, Homo sapiens
ctaaattgtataca

SEQ ID NO: 3881294 - DNA, 21 bp, Homo sapiens
ctaaattgtatacattttgtt

SEQ ID NO: 3881295 - DNA, 19 bp, Homo sapiens
ctaacactcagaagcctgg

SEQ ID NO: 3881296 - DNA, 22 bp, Homo sapiens
ctaacactcagaagcctggggg

SEQ ID NO: 3881297 - DNA, 23 bp, Homo sapiens
ctaacactcagaagcctgggggc

SEQ ID NO: 3881298 - DNA, 14 bp, Homo sapiens
ctaacagggaaggc

SEQ ID NO: 3881299 - DNA, 15 bp, Homo sapiens
ctaacagggaaggca

SEQ ID NO: 3881300 - DNA, 16 bp, Homo sapiens
ctaacagggaaggcag

SEQ ID NO: 3881301 - DNA, 23 bp, Homo sapiens
ctaacataaaatctgtgaattaa

SEQ ID NO: 3881302 - DNA, 20 bp, Homo sapiens
ctaacccccagtgccacaga

SEQ ID NO: 3881303 - DNA, 21 bp, Homo sapiens
ctaacccccagtgccacagag

SEQ ID NO: 3881304 - DNA, 22 bp, Homo sapiens
ctaacccccagtgccacagaga

SEQ ID NO: 3881305 - DNA, 13 bp, Homo sapiens
ctaacctggctta

SEQ ID NO: 3881306 - DNA, 23 bp, Homo sapiens
ctaacctgtagaacacccctgtg

SEQ ID NO: 3881307 - DNA, 17 bp, Homo sapiens
ctaacgcctgagcccag

SEQ ID NO: 3881308 - DNA, 18 bp, Homo sapiens
ctaacgcctgagcccagg

SEQ ID NO: 3881309 - DNA, 19 bp, Homo sapiens
ctaacgcctgagcccaggg

SEQ ID NO: 3881310 - DNA, 23 bp, Homo sapiens
ctaacgggggtgcggcaggagca

SEQ ID NO: 3881311 - DNA, 13 bp, Homo sapiens
ctaactggaagca

SEQ ID NO: 3881312 - DNA, 12 bp, Homo sapiens
ctaactgtaaat

SEQ ID NO: 3881313 - DNA, 15 bp, Homo sapiens
ctaactgtaaatcac

SEQ ID NO: 3881314 - DNA, 17 bp, Homo sapiens
ctaactgtaaatcactt

SEQ ID NO: 3881315 - DNA, 19 bp, Homo sapiens
ctaactgtaaatcacttgt

SEQ ID NO: 3881316 - DNA, 20 bp, Homo sapiens
ctaactgtaaatcacttgta

SEQ ID NO: 3881317 - DNA, 21 bp, Homo sapiens
ctaactgtaaatcacttgtaa

SEQ ID NO: 3881318 - DNA, 15 bp, Homo sapiens
ctaagaaaccccagg

SEQ ID NO: 3881319 - DNA, 16 bp, Homo sapiens
ctaagaaatgctgaaa

SEQ ID NO: 3881320 - DNA, 15 bp, Homo sapiens
ctaagacctccccac

SEQ ID NO: 3881321 - DNA, 23 bp, Homo sapiens
ctaagacctccccacccccgctg

SEQ ID NO: 3881322 - DNA, 16 bp, Homo sapiens
ctaagagctagcgctg

SEQ ID NO: 3881323 - DNA, 18 bp, Homo sapiens
ctaagagctagcgctgcc

SEQ ID NO: 3881324 - DNA, 21 bp, Homo sapiens
ctaagatgagatttgccagca

SEQ ID NO: 3881325 - DNA, 13 bp, Homo sapiens
ctaagcagctggg

SEQ ID NO: 3881326 - DNA, 15 bp, Homo sapiens
ctaagcagctgggac

SEQ ID NO: 3881327 - DNA, 21 bp, Homo sapiens
ctaagccctcgaaccaaggca

SEQ ID NO: 3881328 - DNA, 12 bp, Homo sapiens
ctaagccctgtc

SEQ ID NO: 3881329 - DNA, 21 bp, Homo sapiens
ctaagccctgtcgagacactt

SEQ ID NO: 3881330 - DNA, 14 bp, Homo sapiens
ctaagcctcctttt

SEQ ID NO: 3881331 - DNA, 11 bp, Homo sapiens
ctaagcctgtt

SEQ ID NO: 3881332 - DNA, 17 bp, Homo sapiens
ctaagctaggaatgaaa

SEQ ID NO: 3881333 - DNA, 22 bp, Homo sapiens
ctaagctaggaatgaaatcctg

SEQ ID NO: 3881334 - DNA, 14 bp, Homo sapiens
ctaagctgcagctt

SEQ ID NO: 3881335 - DNA, 15 bp, Homo sapiens
ctaagctggagctct

SEQ ID NO: 3881336 - DNA, 17 bp, Homo sapiens
ctaagctggagctcttg

SEQ ID NO: 3881337 - DNA, 21 bp, Homo sapiens
ctaagctggagctcttggaag

SEQ ID NO: 3881338 - DNA, 23 bp, Homo sapiens
ctaagctggagctcttggaagag

SEQ ID NO: 3881339 - DNA, 11 bp, Homo sapiens
ctaaggacaca

SEQ ID NO: 3881340 - DNA, 13 bp, Homo sapiens
ctaaggacacact

SEQ ID NO: 3881341 - DNA, 16 bp, Homo sapiens
ctaaggacacactaat

SEQ ID NO: 3881342 - DNA, 15 bp, Homo sapiens
ctaaggatctctcag

SEQ ID NO: 3881343 - DNA, 17 bp, Homo sapiens
ctaaggatctctcagga

SEQ ID NO: 3881344 - DNA, 23 bp, Homo sapiens
ctaaggatctctcaggagcacag

SEQ ID NO: 3881345 - DNA, 22 bp, Homo sapiens
ctaaggccgtgtctctgaggac

SEQ ID NO: 3881346 - DNA, 14 bp, Homo sapiens
ctaagtaaaaccac

SEQ ID NO: 3881347 - DNA, 22 bp, Homo sapiens
ctaagttcatgtttgtaaatta

SEQ ID NO: 3881348 - DNA, 20 bp, Homo sapiens
ctaatagactaaatgaaatc

SEQ ID NO: 3881349 - DNA, 13 bp, Homo sapiens
ctaatattaaaaa

SEQ ID NO: 3881350 - DNA, 14 bp, Homo sapiens
ctaatattaaaaat

SEQ ID NO: 3881351 - DNA, 18 bp, Homo sapiens
ctaatatttaggcaagag

SEQ ID NO: 3881352 - DNA, 20 bp, Homo sapiens
ctaatcagcattctcactcc

SEQ ID NO: 3881353 - DNA, 21 bp, Homo sapiens
ctaatcagcattctcactcct

SEQ ID NO: 3881354 - DNA, 17 bp, Homo sapiens
ctaatcaggttgttaat

SEQ ID NO: 3881355 - DNA, 18 bp, Homo sapiens
ctaatctgtagggctgga

SEQ ID NO: 3881356 - DNA, 21 bp, Homo sapiens
ctaatctgtagggctggacct

SEQ ID NO: 3881357 - DNA, 18 bp, Homo sapiens
ctaatgaagggaaaggat

SEQ ID NO: 3881358 - DNA, 15 bp, Homo sapiens
ctaatgctaagaaat

SEQ ID NO: 3881359 - DNA, 18 bp, Homo sapiens
ctaatgctaagaaatgct

SEQ ID NO: 3881360 - DNA, 14 bp, Homo sapiens
ctaatggagaagac

SEQ ID NO: 3881361 - DNA, 16 bp, Homo sapiens
ctaattcccagagtgt

SEQ ID NO: 3881362 - DNA, 19 bp, Homo sapiens
ctaattctcttacccagaa

SEQ ID NO: 3881363 - DNA, 20 bp, Homo sapiens
ctaattctcttacccagaat

SEQ ID NO: 3881364 - DNA, 15 bp, Homo sapiens
ctaatttaaaccagc

SEQ ID NO: 3881365 - DNA, 16 bp, Homo sapiens
ctaatttaaaccagca

SEQ ID NO: 3881366 - DNA, 20 bp, Homo sapiens
ctaatttaaaccagcagaaa

SEQ ID NO: 3881367 - DNA, 19 bp, Homo sapiens
ctaatttatacaaaataat

SEQ ID NO: 3881368 - DNA, 21 bp, Homo sapiens
ctaatttatacaaaataattt

SEQ ID NO: 3881369 - DNA, 22 bp, Homo sapiens
ctaatttatacaaaataattta

SEQ ID NO: 3881370 - DNA, 23 bp, Homo sapiens
ctaatttatcctgaaatttcaga

SEQ ID NO: 3881371 - DNA, 20 bp, Homo sapiens
ctaatttttgtatttttcgt

SEQ ID NO: 3881372 - DNA, 16 bp, Homo sapiens
ctacaaaaacacagca

SEQ ID NO: 3881373 - DNA, 17 bp, Homo sapiens
ctacaaaaacacagcaa

SEQ ID NO: 3881374 - DNA, 12 bp, Homo sapiens
ctacaaaatgga

SEQ ID NO: 3881375 - DNA, 13 bp, Homo sapiens
ctacaagcatttg

SEQ ID NO: 3881376 - DNA, 12 bp, Homo sapiens
ctacaataaatg

SEQ ID NO: 3881377 - DNA, 18 bp, Homo sapiens
ctacaataaatgctgaat

SEQ ID NO: 3881378 - DNA, 19 bp, Homo sapiens
ctacaataaatgctgaatg

SEQ ID NO: 3881379 - DNA, 20 bp, Homo sapiens
ctacaataaatgctgaatga

SEQ ID NO: 3881380 - DNA, 15 bp, Homo sapiens
ctacacagtaaaaac

SEQ ID NO: 3881381 - DNA, 21 bp, Homo sapiens
ctacacagtgggaactctgac

SEQ ID NO: 3881382 - DNA, 23 bp, Homo sapiens
ctacacagtgggaactctgacaa

SEQ ID NO: 3881383 - DNA, 21 bp, Homo sapiens
ctacaccactctggcagccac

SEQ ID NO: 3881384 - DNA, 22 bp, Homo sapiens
ctacaccactctggcagccaca

SEQ ID NO: 3881385 - DNA, 20 bp, Homo sapiens
ctacacccttggacttgagg

SEQ ID NO: 3881386 - DNA, 19 bp, Homo sapiens
ctacagaaatactgctctg

SEQ ID NO: 3881387 - DNA, 14 bp, Homo sapiens
ctacagaacaaaga

SEQ ID NO: 3881388 - DNA, 14 bp, Homo sapiens
ctacagaataatgt

SEQ ID NO: 3881389 - DNA, 16 bp, Homo sapiens
ctacagacttctccag

SEQ ID NO: 3881390 - DNA, 15 bp, Homo sapiens
ctacagatagtcaaa

SEQ ID NO: 3881391 - DNA, 18 bp, Homo sapiens
ctacagctaatcagcatt

SEQ ID NO: 3881392 - DNA, 21 bp, Homo sapiens
ctacagctaatcagcattctc

SEQ ID NO: 3881393 - DNA, 18 bp, Homo sapiens
ctacaggagagggaagag

SEQ ID NO: 3881394 - DNA, 14 bp, Homo sapiens
ccttccccatctcc

SEQ ID NO: 3881395 - DNA, 21 bp, Homo sapiens
ccttcccccatcccctttcct

SEQ ID NO: 3881396 - DNA, 17 bp, Homo sapiens
ccttccccttctgtgtc

SEQ ID NO: 3881397 - DNA, 21 bp, Homo sapiens
ccttccccttctgtgtcacag

SEQ ID NO: 3881398 - DNA, 20 bp, Homo sapiens
ccttccccttttgcctggct

SEQ ID NO: 3881399 - DNA, 12 bp, Homo sapiens
ccttccctccaa

SEQ ID NO: 3881400 - DNA, 14 bp, Homo sapiens
ccttccctctttcc

SEQ ID NO: 3881401 - DNA, 15 bp, Homo sapiens
ccttccctctttccc

SEQ ID NO: 3881402 - DNA, 19 bp, Homo sapiens
ccttccctctttccccacc

SEQ ID NO: 3881403 - DNA, 13 bp, Homo sapiens
ccttccctgcttt

SEQ ID NO: 3881404 - DNA, 11 bp, Homo sapiens
ccttccctggc

SEQ ID NO: 3881405 - DNA, 14 bp, Homo sapiens
ccttccctgggaag

SEQ ID NO: 3881406 - DNA, 11 bp, Homo sapiens
ccttcccttct

SEQ ID NO: 3881407 - DNA, 21 bp, Homo sapiens
ccttccgctcctttacctacc

SEQ ID NO: 3881408 - DNA, 20 bp, Homo sapiens
ccttcctacacccttggact

SEQ ID NO: 3881409 - DNA, 16 bp, Homo sapiens
ccttcctacagatagt

SEQ ID NO: 3881410 - DNA, 14 bp, Homo sapiens
ccttcctcctccac

SEQ ID NO: 3881411 - DNA, 13 bp, Homo sapiens
ccttcctcctgaa

SEQ ID NO: 3881412 - DNA, 16 bp, Homo sapiens
ccttcctctccactgc

SEQ ID NO: 3881413 - DNA, 21 bp, Homo sapiens
ccttcctctccactgccttcg

SEQ ID NO: 3881414 - DNA, 16 bp, Homo sapiens
ccttcctgccaccagt

SEQ ID NO: 3881415 - DNA, 18 bp, Homo sapiens
ccttcctggacagctgtg

SEQ ID NO: 3881416 - DNA, 19 bp, Homo sapiens
ccttcctggacagctgtgc

SEQ ID NO: 3881417 - DNA, 21 bp, Homo sapiens
ccttcctggacagctgtgcct

SEQ ID NO: 3881418 - DNA, 12 bp, Homo sapiens
ccttcctggcct

SEQ ID NO: 3881419 - DNA, 22 bp, Homo sapiens
ccttcctggcctcactggctgg

SEQ ID NO: 3881420 - DNA, 17 bp, Homo sapiens
ccttcgaggttgcccct

SEQ ID NO: 3881421 - DNA, 20 bp, Homo sapiens
ccttcgatacaccgggcctg

SEQ ID NO: 3881422 - DNA, 23 bp, Homo sapiens
ccttcgctgccaggacacctgcc

SEQ ID NO: 3881423 - DNA, 20 bp, Homo sapiens
ccttcgtgtctctcccaccc

SEQ ID NO: 3881424 - DNA, 13 bp, Homo sapiens
ccttctgcaccca

SEQ ID NO: 3881425 - DNA, 18 bp, Homo sapiens
ccttctgcacccagaaat

SEQ ID NO: 3881426 - DNA, 22 bp, Homo sapiens
ccttctgcttctccctggctga

SEQ ID NO: 3881427 - DNA, 14 bp, Homo sapiens
ccttctgtggctca

SEQ ID NO: 3881428 - DNA, 12 bp, Homo sapiens
ccttctgtgtca

SEQ ID NO: 3881429 - DNA, 17 bp, Homo sapiens
ccttcttattctcactc

SEQ ID NO: 3881430 - DNA, 15 bp, Homo sapiens
ccttcttcacccagc

SEQ ID NO: 3881431 - DNA, 14 bp, Homo sapiens
ccttcttcgctgct

SEQ ID NO: 3881432 - DNA, 22 bp, Homo sapiens
ccttcttcggggaactcctgga

SEQ ID NO: 3881433 - DNA, 16 bp, Homo sapiens
ccttcttggcttctgg

SEQ ID NO: 3881434 - DNA, 17 bp, Homo sapiens
ccttctttaaatcaaaa

SEQ ID NO: 3881435 - DNA, 13 bp, Homo sapiens
ccttctttcctct

SEQ ID NO: 3881436 - DNA, 17 bp, Homo sapiens
ccttctttctcttccct

SEQ ID NO: 3881437 - DNA, 19 bp, Homo sapiens
ccttctttctcttccctcc

SEQ ID NO: 3881438 - DNA, 14 bp, Homo sapiens
ccttctttttcttc

SEQ ID NO: 3881439 - DNA, 17 bp, Homo sapiens
ccttcttttttgtctca

SEQ ID NO: 3881440 - DNA, 21 bp, Homo sapiens
ccttgaagggtaaagaagttt

SEQ ID NO: 3881441 - DNA, 17 bp, Homo sapiens
ccttgacaacagactga

SEQ ID NO: 3881442 - DNA, 23 bp, Homo sapiens
ccttgacattgtagagcttctgg

SEQ ID NO: 3881443 - DNA, 21 bp, Homo sapiens
ccttgagagtatcaggtctcc

SEQ ID NO: 3881444 - DNA, 19 bp, Homo sapiens
ccttgatggagatatttac

SEQ ID NO: 3881445 - DNA, 18 bp, Homo sapiens
ccttgcacccctcactct

SEQ ID NO: 3881446 - DNA, 13 bp, Homo sapiens
ccttgcccagaga

SEQ ID NO: 3881447 - DNA, 19 bp, Homo sapiens
ccttgcccagagatgcctc

SEQ ID NO: 3881448 - DNA, 18 bp, Homo sapiens
ccttgcccgccagcctca

SEQ ID NO: 3881449 - DNA, 14 bp, Homo sapiens
ccttgccctgacct

SEQ ID NO: 3881450 - DNA, 19 bp, Homo sapiens
ccttgccctgacctcccag

SEQ ID NO: 3881451 - DNA, 21 bp, Homo sapiens
ccttgctcctccttctgctgc

SEQ ID NO: 3881452 - DNA, 17 bp, Homo sapiens
ccttgctctgcaggcac

SEQ ID NO: 3881453 - DNA, 12 bp, Homo sapiens
ccttgctgctgc

SEQ ID NO: 3881454 - DNA, 14 bp, Homo sapiens
ccttgctgctgccc

SEQ ID NO: 3881455 - DNA, 16 bp, Homo sapiens
ccttgctgctgcccgc

SEQ ID NO: 3881456 - DNA, 14 bp, Homo sapiens
ccttgctttgctgt

SEQ ID NO: 3881457 - DNA, 15 bp, Homo sapiens
ccttgctttgggctt

SEQ ID NO: 3881458 - DNA, 18 bp, Homo sapiens
ccttgctttgggctttgc

SEQ ID NO: 3881459 - DNA, 19 bp, Homo sapiens
ccttggaaagttcagccag

SEQ ID NO: 3881460 - DNA, 19 bp, Homo sapiens
ccttggaaatactttatct

SEQ ID NO: 3881461 - DNA, 18 bp, Homo sapiens
ccttggacaacttttctc

SEQ ID NO: 3881462 - DNA, 18 bp, Homo sapiens
ccttggactcctcccaca

SEQ ID NO: 3881463 - DNA, 14 bp, Homo sapiens
ccttggagagcagc

SEQ ID NO: 3881464 - DNA, 19 bp, Homo sapiens
ccttggagagcagctggct

SEQ ID NO: 3881465 - DNA, 22 bp, Homo sapiens
ccttggataatgctgttgcctc

SEQ ID NO: 3881466 - DNA, 23 bp, Homo sapiens
ccttggatttctgaatggctgca

SEQ ID NO: 3881467 - DNA, 13 bp, Homo sapiens
ccttggcttcctc

SEQ ID NO: 3881468 - DNA, 22 bp, Homo sapiens
ccttggcttttgcttggcagag

SEQ ID NO: 3881469 - DNA, 11 bp, Homo sapiens
ccttgggacct

SEQ ID NO: 3881470 - DNA, 11 bp, Homo sapiens
ccttgggagag

SEQ ID NO: 3881471 - DNA, 16 bp, Homo sapiens
ccttgggcatccaccc

SEQ ID NO: 3881472 - DNA, 17 bp, Homo sapiens
ccttgggcatccaccca

SEQ ID NO: 3881473 - DNA, 23 bp, Homo sapiens
ccttgggcatccacccagtgctg

SEQ ID NO: 3881474 - DNA, 24 bp, Homo sapiens
ccttgggcatccacccagtgctgc

SEQ ID NO: 3881475 - DNA, 12 bp, Homo sapiens
ccttgggctcct

SEQ ID NO: 3881476 - DNA, 18 bp, Homo sapiens
ccttgggctcctggctgc

SEQ ID NO: 3881477 - DNA, 20 bp, Homo sapiens
ccttgggctcctggctgcca

SEQ ID NO: 3881478 - DNA, 17 bp, Homo sapiens
ccttggggcctggcttg

SEQ ID NO: 3881479 - DNA, 16 bp, Homo sapiens
ccttggtgtccacctg

SEQ ID NO: 3881480 - DNA, 19 bp, Homo sapiens
ccttggtgtccacctggcc

SEQ ID NO: 3881481 - DNA, 19 bp, Homo sapiens
ccttggtgtgaccctctga

SEQ ID NO: 3881482 - DNA, 21 bp, Homo sapiens
ccttggtttggacacagtgtt

SEQ ID NO: 3881483 - DNA, 14 bp, Homo sapiens
ccttgtcaccagca

SEQ ID NO: 3881484 - DNA, 17 bp, Homo sapiens
ccttgtcaggacccagg

SEQ ID NO: 3881485 - DNA, 14 bp, Homo sapiens
ccttgtcctctccc

SEQ ID NO: 3881486 - DNA, 17 bp, Homo sapiens
ccttgtcctgccagctg

SEQ ID NO: 3881487 - DNA, 19 bp, Homo sapiens
ccttgtcctgccagctgcc

SEQ ID NO: 3881488 - DNA, 13 bp, Homo sapiens
ccttgtctctcat

SEQ ID NO: 3881489 - DNA, 14 bp, Homo sapiens
ccttgtctctcatt

SEQ ID NO: 3881490 - DNA, 19 bp, Homo sapiens
ccttgtctttactgacaag

SEQ ID NO: 3881491 - DNA, 17 bp, Homo sapiens
ccttgtgaccttctcta

SEQ ID NO: 3881492 - DNA, 13 bp, Homo sapiens
ccttgtgccctgc

SEQ ID NO: 3881493 - DNA, 18 bp, Homo sapiens
ccttgtgccctgccccca

SEQ ID NO: 3881494 - DNA, 24 bp, Homo sapiens
ccttgtgcttggtggggctcgtgg

SEQ ID NO: 3881495 - DNA, 15 bp, Homo sapiens
ccttgtgtcagagct

SEQ ID NO: 3881496 - DNA, 19 bp, Homo sapiens
ccttgttttattcaaagac

SEQ ID NO: 3881497 - DNA, 13 bp, Homo sapiens
cctttaaaaaagc

SEQ ID NO: 3881498 - DNA, 13 bp, Homo sapiens
cctttacctacca

SEQ ID NO: 3881499 - DNA, 22 bp, Homo sapiens
cctttacctaccaccttccctc

SEQ ID NO: 3881500 - DNA, 17 bp, Homo sapiens
cctttaggcagcctgcc

SEQ ID NO: 3881501 - DNA, 15 bp, Homo sapiens
cctttcaaatttcac

SEQ ID NO: 3881502 - DNA, 22 bp, Homo sapiens
cctttcacaaaattttattcct

SEQ ID NO: 3881503 - DNA, 21 bp, Homo sapiens
cctttcaggagggtccccagc

SEQ ID NO: 3881504 - DNA, 12 bp, Homo sapiens
cctttcctcccc

SEQ ID NO: 3881505 - DNA, 13 bp, Homo sapiens
cctttcctcccca

SEQ ID NO: 3881506 - DNA, 19 bp, Homo sapiens
cctttcctgtgccaacctg

SEQ ID NO: 3881507 - DNA, 12 bp, Homo sapiens
cctttccttcct

SEQ ID NO: 3881508 - DNA, 21 bp, Homo sapiens
cctttccttccttccctggct

SEQ ID NO: 3881509 - DNA, 16 bp, Homo sapiens
cctttctccagccagc

SEQ ID NO: 3881510 - DNA, 22 bp, Homo sapiens
cctttctcgtggtagaagccag

SEQ ID NO: 3881511 - DNA, 11 bp, Homo sapiens
cctttctctga

SEQ ID NO: 3881512 - DNA, 12 bp, Homo sapiens
cctttctggacc

SEQ ID NO: 3881513 - DNA, 13 bp, Homo sapiens
cctttctgggagg

SEQ ID NO: 3881514 - DNA, 11 bp, Homo sapiens
cctttctgtgt

SEQ ID NO: 3881515 - DNA, 18 bp, Homo sapiens
cctttgagaatgtgattc

SEQ ID NO: 3881516 - DNA, 13 bp, Homo sapiens
cctttgcactgag

SEQ ID NO: 3881517 - DNA, 13 bp, Homo sapiens
cctttgcctcttg

SEQ ID NO: 3881518 - DNA, 12 bp, Homo sapiens
cctttggaaaaa

SEQ ID NO: 3881519 - DNA, 15 bp, Homo sapiens
cctttggccattcca

SEQ ID NO: 3881520 - DNA, 17 bp, Homo sapiens
cctttggtgcagaggtt

SEQ ID NO: 3881521 - DNA, 11 bp, Homo sapiens
ccttttatagc

SEQ ID NO: 3881522 - DNA, 13 bp, Homo sapiens
ccttttcacggga

SEQ ID NO: 3881523 - DNA, 18 bp, Homo sapiens
ccttttcatctccagtgt

SEQ ID NO: 3881524 - DNA, 13 bp, Homo sapiens
ccttttcctccag

SEQ ID NO: 3881525 - DNA, 16 bp, Homo sapiens
ccttttgatggggaga

SEQ ID NO: 3881526 - DNA, 17 bp, Homo sapiens
ccttttgcataagatta

SEQ ID NO: 3881527 - DNA, 14 bp, Homo sapiens
ccttttgcctggct

SEQ ID NO: 3881528 - DNA, 12 bp, Homo sapiens
ccttttgtattt

SEQ ID NO: 3881529 - DNA, 18 bp, Homo sapiens
ccttttgtccccagggcc

SEQ ID NO: 3881530 - DNA, 21 bp, Homo sapiens
ccttttgtccccagggcccct

SEQ ID NO: 3881531 - DNA, 22 bp, Homo sapiens
cctttttgacttttccaagccc

SEQ ID NO: 3881532 - DNA, 16 bp, Homo sapiens
cctttttttctctcct

SEQ ID NO: 3881533 - DNA, 12 bp, Homo sapiens
cgaaaacttgaa

SEQ ID NO: 3881534 - DNA, 18 bp, Homo sapiens
cgaaacaacttgtgttct

SEQ ID NO: 3881535 - DNA, 22 bp, Homo sapiens
cgaaacaggctactctcctcgg

SEQ ID NO: 3881536 - DNA, 16 bp, Homo sapiens
cgaaactgtatgatta

SEQ ID NO: 3881537 - DNA, 12 bp, Homo sapiens
cgaaccaaggca

SEQ ID NO: 3881538 - DNA, 15 bp, Homo sapiens
cgaacgctcttagct

SEQ ID NO: 3881539 - DNA, 14 bp, Homo sapiens
cgaagcccaggctg

SEQ ID NO: 3881540 - DNA, 17 bp, Homo sapiens
cgaagcccaggctgaag

SEQ ID NO: 3881541 - DNA, 23 bp, Homo sapiens
cgaagctgtgaactcagagcccc

SEQ ID NO: 3881542 - DNA, 18 bp, Homo sapiens
cgaagctttgaaggccga

SEQ ID NO: 3881543 - DNA, 22 bp, Homo sapiens
cgaaggggccccggggctggca

SEQ ID NO: 3881544 - DNA, 11 bp, Homo sapiens
cgaagtggctc

SEQ ID NO: 3881545 - DNA, 15 bp, Homo sapiens
cgaataaatgttcaa

SEQ ID NO: 3881546 - DNA, 19 bp, Homo sapiens
cgaataaatgttcaaactg

SEQ ID NO: 3881547 - DNA, 15 bp, Homo sapiens
cgaatgtttcaaatc

SEQ ID NO: 3881548 - DNA, 23 bp, Homo sapiens
cgaatttggtgtggctgtattca

SEQ ID NO: 3881549 - DNA, 17 bp, Homo sapiens
cgaatttttcagatgat

SEQ ID NO: 3881550 - DNA, 14 bp, Homo sapiens
cgaccacctgccca

SEQ ID NO: 3881551 - DNA, 19 bp, Homo sapiens
cgacctcgtcctccccctg

SEQ ID NO: 3881552 - DNA, 18 bp, Homo sapiens
cgactcttcctgcaaagg

SEQ ID NO: 3881553 - DNA, 16 bp, Homo sapiens
cgactgcacagcggcc

SEQ ID NO: 3881554 - DNA, 16 bp, Homo sapiens
cgactgtgaaagtatg

SEQ ID NO: 3881555 - DNA, 17 bp, Homo sapiens
cgactttatacagaact

SEQ ID NO: 3881556 - DNA, 19 bp, Homo sapiens
cgagaccatcctggcccct

SEQ ID NO: 3881557 - DNA, 15 bp, Homo sapiens
cgagacggctggacc

SEQ ID NO: 3881558 - DNA, 16 bp, Homo sapiens
cgagacggctggacct

SEQ ID NO: 3881559 - DNA, 18 bp, Homo sapiens
cgagactgagaggcagaa

SEQ ID NO: 3881560 - DNA, 12 bp, Homo sapiens
cgagagaggcgc

SEQ ID NO: 3881561 - DNA, 15 bp, Homo sapiens
cgagagcctgctccc

SEQ ID NO: 3881562 - DNA, 14 bp, Homo sapiens
cgagaggtccctgc

SEQ ID NO: 3881563 - DNA, 15 bp, Homo sapiens
cgagaggtccctgct

SEQ ID NO: 3881564 - DNA, 18 bp, Homo sapiens
cgagaggtccctgcttac

SEQ ID NO: 3881565 - DNA, 15 bp, Homo sapiens
cgagataatgtatat

SEQ ID NO: 3881566 - DNA, 16 bp, Homo sapiens
cgagcaaccgtggccc

SEQ ID NO: 3881567 - DNA, 16 bp, Homo sapiens
cctggcacagggcagt

SEQ ID NO: 3881568 - DNA, 18 bp, Homo sapiens
cctggcacagggcagtgg

SEQ ID NO: 3881569 - DNA, 18 bp, Homo sapiens
cctggcagccgtgccttc

SEQ ID NO: 3881570 - DNA, 19 bp, Homo sapiens
cctggcaggttagaaccta

SEQ ID NO: 3881571 - DNA, 20 bp, Homo sapiens
cctggcaggttagaacctag

SEQ ID NO: 3881572 - DNA, 17 bp, Homo sapiens
cctggcatgacactcta

SEQ ID NO: 3881573 - DNA, 19 bp, Homo sapiens
cctggcatggtgctttcag

SEQ ID NO: 3881574 - DNA, 17 bp, Homo sapiens
cctggcatgtcagagcc

SEQ ID NO: 3881575 - DNA, 19 bp, Homo sapiens
cctggccattttcttgcct

SEQ ID NO: 3881576 - DNA, 13 bp, Homo sapiens
cctggcccataga

SEQ ID NO: 3881577 - DNA, 15 bp, Homo sapiens
cctggccccatgtct

SEQ ID NO: 3881578 - DNA, 17 bp, Homo sapiens
cctggcccccctccagg

SEQ ID NO: 3881579 - DNA, 23 bp, Homo sapiens
cctggcccctccagaccctgcct

SEQ ID NO: 3881580 - DNA, 15 bp, Homo sapiens
cctggccctcttctt

SEQ ID NO: 3881581 - DNA, 13 bp, Homo sapiens
cctggcctcactg

SEQ ID NO: 3881582 - DNA, 19 bp, Homo sapiens
cctggcctcactggctggg

SEQ ID NO: 3881583 - DNA, 22 bp, Homo sapiens
cctggcctcactggctggggca

SEQ ID NO: 3881584 - DNA, 17 bp, Homo sapiens
cctggcctcctgcctct

SEQ ID NO: 3881585 - DNA, 18 bp, Homo sapiens
cctggcctcctgcctcta

SEQ ID NO: 3881586 - DNA, 13 bp, Homo sapiens
cctggcctccttt

SEQ ID NO: 3881587 - DNA, 17 bp, Homo sapiens
cctggcctgagctgggg

SEQ ID NO: 3881588 - DNA, 13 bp, Homo sapiens
cctggcctggctc

SEQ ID NO: 3881589 - DNA, 21 bp, Homo sapiens
cctggcctgtggagagaaagc

SEQ ID NO: 3881590 - DNA, 18 bp, Homo sapiens
cctggccttcagtgtacc

SEQ ID NO: 3881591 - DNA, 21 bp, Homo sapiens
cctggccttgtcaggacccag

SEQ ID NO: 3881592 - DNA, 15 bp, Homo sapiens
cctggcggggcagga

SEQ ID NO: 3881593 - DNA, 19 bp, Homo sapiens
cctggcggggcaggaggcc

SEQ ID NO: 3881594 - DNA, 17 bp, Homo sapiens
cctggctcccacaggcc

SEQ ID NO: 3881595 - DNA, 13 bp, Homo sapiens
cctggctccccac

SEQ ID NO: 3881596 - DNA, 22 bp, Homo sapiens
cctggctccccacgagtcacct

SEQ ID NO: 3881597 - DNA, 16 bp, Homo sapiens
cctggctctcagaagg

SEQ ID NO: 3881598 - DNA, 22 bp, Homo sapiens
cctggctctgcaatgggcactg

SEQ ID NO: 3881599 - DNA, 16 bp, Homo sapiens
cctggctgccaggcgt

SEQ ID NO: 3881600 - DNA, 18 bp, Homo sapiens
cctggctgccaggcgttg

SEQ ID NO: 3881601 - DNA, 22 bp, Homo sapiens
cctggctgctctcatgcctgcc

SEQ ID NO: 3881602 - DNA, 17 bp, Homo sapiens
cctggctggctgagggc

SEQ ID NO: 3881603 - DNA, 18 bp, Homo sapiens
cctggctggctgagggca

SEQ ID NO: 3881604 - DNA, 20 bp, Homo sapiens
cctggctggctgagggcagt

SEQ ID NO: 3881605 - DNA, 12 bp, Homo sapiens
cctggctgtgga

SEQ ID NO: 3881606 - DNA, 13 bp, Homo sapiens
cctggctgtggag

SEQ ID NO: 3881607 - DNA, 14 bp, Homo sapiens
cctggctgtggagg

SEQ ID NO: 3881608 - DNA, 16 bp, Homo sapiens
cctggctgtggaggcc

SEQ ID NO: 3881609 - DNA, 19 bp, Homo sapiens
cctggctgtggaggcctga

SEQ ID NO: 3881610 - DNA, 21 bp, Homo sapiens
cctggctgtggaggcctgatg

SEQ ID NO: 3881611 - DNA, 13 bp, Homo sapiens
cctggcttctaga

SEQ ID NO: 3881612 - DNA, 16 bp, Homo sapiens
cctggcttgcttgccg

SEQ ID NO: 3881613 - DNA, 18 bp, Homo sapiens
cctggcttttcactgctg

SEQ ID NO: 3881614 - DNA, 13 bp, Homo sapiens
cctgggaaaggaa

SEQ ID NO: 3881615 - DNA, 21 bp, Homo sapiens
cctgggaaaggaaaaccaggg

SEQ ID NO: 3881616 - DNA, 18 bp, Homo sapiens
cctgggaaaggacccacc

SEQ ID NO: 3881617 - DNA, 12 bp, Homo sapiens
cctgggacccag

SEQ ID NO: 3881618 - DNA, 16 bp, Homo sapiens
cctgggacccagctac

SEQ ID NO: 3881619 - DNA, 18 bp, Homo sapiens
cctgggacccagctactc

SEQ ID NO: 3881620 - DNA, 14 bp, Homo sapiens
cctgggactcccag

SEQ ID NO: 3881621 - DNA, 15 bp, Homo sapiens
cctgggcacccacct

SEQ ID NO: 3881622 - DNA, 19 bp, Homo sapiens
cctgggcacccacctccac

SEQ ID NO: 3881623 - DNA, 21 bp, Homo sapiens
cctgggcacccacctccaccc

SEQ ID NO: 3881624 - DNA, 22 bp, Homo sapiens
cctgggcacccacctccacccc

SEQ ID NO: 3881625 - DNA, 22 bp, Homo sapiens
cctgggccaaaagggcagccag

SEQ ID NO: 3881626 - DNA, 22 bp, Homo sapiens
cctgggcccaggctctgggaag

SEQ ID NO: 3881627 - DNA, 14 bp, Homo sapiens
cctgggccccacca

SEQ ID NO: 3881628 - DNA, 21 bp, Homo sapiens
cctgggccccaccacctaggc

SEQ ID NO: 3881629 - DNA, 15 bp, Homo sapiens
cctgggccctggggc

SEQ ID NO: 3881630 - DNA, 16 bp, Homo sapiens
cctgggccctggggcc

SEQ ID NO: 3881631 - DNA, 20 bp, Homo sapiens
cctgggccctggggcctgta

SEQ ID NO: 3881632 - DNA, 21 bp, Homo sapiens
cctgggccctggggcctgtac

SEQ ID NO: 3881633 - DNA, 19 bp, Homo sapiens
cctgggcctatggagagcc

SEQ ID NO: 3881634 - DNA, 20 bp, Homo sapiens
cctgggcctatggagagccc

SEQ ID NO: 3881635 - DNA, 22 bp, Homo sapiens
cctgggcctatggagagccctg

SEQ ID NO: 3881636 - DNA, 17 bp, Homo sapiens
cctgggcctgctgctga

SEQ ID NO: 3881637 - DNA, 12 bp, Homo sapiens
cctgggcctgtc

SEQ ID NO: 3881638 - DNA, 13 bp, Homo sapiens
cctgggcctgtcc

SEQ ID NO: 3881639 - DNA, 15 bp, Homo sapiens
cctgggcctgtcccc

SEQ ID NO: 3881640 - DNA, 20 bp, Homo sapiens
cctgggcctgtcccccaagg

SEQ ID NO: 3881641 - DNA, 13 bp, Homo sapiens
cctgggcctgtgc

SEQ ID NO: 3881642 - DNA, 19 bp, Homo sapiens
cctgggcctgtgcagcagc

SEQ ID NO: 3881643 - DNA, 20 bp, Homo sapiens
cctgggcctgtgcagcagcc

SEQ ID NO: 3881644 - DNA, 21 bp, Homo sapiens
cctgggcctgtgcagcagccc

SEQ ID NO: 3881645 - DNA, 19 bp, Homo sapiens
cctgggctgtctgtcacca

SEQ ID NO: 3881646 - DNA, 13 bp, Homo sapiens
cctggggccccgc

SEQ ID NO: 3881647 - DNA, 18 bp, Homo sapiens
cctggggccccgctggga

SEQ ID NO: 3881648 - DNA, 18 bp, Homo sapiens
cctggggcctgtactgcc

SEQ ID NO: 3881649 - DNA, 19 bp, Homo sapiens
cctggggcctgtactgcct

SEQ ID NO: 3881650 - DNA, 22 bp, Homo sapiens
cctggggcctgtactgcctgct

SEQ ID NO: 3881651 - DNA, 23 bp, Homo sapiens
cctggggcctgtactgcctgctt

SEQ ID NO: 3881652 - DNA, 20 bp, Homo sapiens
cctggggctcctttctccag

SEQ ID NO: 3881653 - DNA, 22 bp, Homo sapiens
cctggggctcctttctccagcc

SEQ ID NO: 3881654 - DNA, 23 bp, Homo sapiens
cctggggctctaacgcctgagcc

SEQ ID NO: 3881655 - DNA, 18 bp, Homo sapiens
cctggggcttctcctgac

SEQ ID NO: 3881656 - DNA, 16 bp, Homo sapiens
cctgggggaagccctg

SEQ ID NO: 3881657 - DNA, 18 bp, Homo sapiens
cctgggggaagccctgga

SEQ ID NO: 3881658 - DNA, 14 bp, Homo sapiens
cctgggggcagtga

SEQ ID NO: 3881659 - DNA, 16 bp, Homo sapiens
cctgggggcagtgact

SEQ ID NO: 3881660 - DNA, 20 bp, Homo sapiens
cctgggggcagtgactggca

SEQ ID NO: 3881661 - DNA, 13 bp, Homo sapiens
cctgggggccagc

SEQ ID NO: 3881662 - DNA, 14 bp, Homo sapiens
cctgggggccagct

SEQ ID NO: 3881663 - DNA, 21 bp, Homo sapiens
cctgggggccagctggtgctg

SEQ ID NO: 3881664 - DNA, 23 bp, Homo sapiens
cctgggggcctggctggctgagg

SEQ ID NO: 3881665 - DNA, 18 bp, Homo sapiens
cctgggggtggcaggcac

SEQ ID NO: 3881666 - DNA, 21 bp, Homo sapiens
cctgggggttctttcttcctc

SEQ ID NO: 3881667 - DNA, 18 bp, Homo sapiens
cctgggtctaaggggttg

SEQ ID NO: 3881668 - DNA, 22 bp, Homo sapiens
cctgggtgagaatcctgcctct

SEQ ID NO: 3881669 - DNA, 22 bp, Homo sapiens
cctgggtggctactctgtgcca

SEQ ID NO: 3881670 - DNA, 16 bp, Homo sapiens
cctgggtggggctgct

SEQ ID NO: 3881671 - DNA, 19 bp, Homo sapiens
cctgggtggggctgctcct

SEQ ID NO: 3881672 - DNA, 23 bp, Homo sapiens
cctgggtggtatagggcgtttgg

SEQ ID NO: 3881673 - DNA, 17 bp, Homo sapiens
cctgggttttctaactg

SEQ ID NO: 3881674 - DNA, 20 bp, Homo sapiens
cctgggttttctaactgtaa

SEQ ID NO: 3881675 - DNA, 21 bp, Homo sapiens
cctgggttttctaactgtaaa

SEQ ID NO: 3881676 - DNA, 14 bp, Homo sapiens
cctggtacagcagg

SEQ ID NO: 3881677 - DNA, 15 bp, Homo sapiens
cctggtacagcaggg

SEQ ID NO: 3881678 - DNA, 16 bp, Homo sapiens
cctggtcctagacata

SEQ ID NO: 3881679 - DNA, 18 bp, Homo sapiens
cctggtctgtgctgccct

SEQ ID NO: 3881680 - DNA, 17 bp, Homo sapiens
cctggtgaggcccagcc

SEQ ID NO: 3881681 - DNA, 19 bp, Homo sapiens
cctggtgaggcccagcctg

SEQ ID NO: 3881682 - DNA, 19 bp, Homo sapiens
cctggtgcactggccccac

SEQ ID NO: 3881683 - DNA, 20 bp, Homo sapiens
cctggtgcactggccccacc

SEQ ID NO: 3881684 - DNA, 21 bp, Homo sapiens
cctggtgcagaggtgagcaga

SEQ ID NO: 3881685 - DNA, 15 bp, Homo sapiens
cctggtgctgccaca

SEQ ID NO: 3881686 - DNA, 18 bp, Homo sapiens
cctggtgctgccacactt

SEQ ID NO: 3881687 - DNA, 14 bp, Homo sapiens
cctggtgcttctcc

SEQ ID NO: 3881688 - DNA, 20 bp, Homo sapiens
cctggtgcttctcctctcct

SEQ ID NO: 3881689 - DNA, 15 bp, Homo sapiens
cctggtggggcagct

SEQ ID NO: 3881690 - DNA, 19 bp, Homo sapiens
cctggtggggcagctcctc

SEQ ID NO: 3881691 - DNA, 15 bp, Homo sapiens
cctggttactctggt

SEQ ID NO: 3881692 - DNA, 15 bp, Homo sapiens
cctggtttagcctgg

SEQ ID NO: 3881693 - DNA, 19 bp, Homo sapiens
cctgtaacacaagccacag

SEQ ID NO: 3881694 - DNA, 20 bp, Homo sapiens
cctgtaacacaagccacaga

SEQ ID NO: 3881695 - DNA, 23 bp, Homo sapiens
cctgtaacacaagccacagaagc

SEQ ID NO: 3881696 - DNA, 13 bp, Homo sapiens
cctgtaatcccag

SEQ ID NO: 3881697 - DNA, 16 bp, Homo sapiens
cctgtaatcccagcac

SEQ ID NO: 3881698 - DNA, 17 bp, Homo sapiens
cctgtaatcccagcact

SEQ ID NO: 3881699 - DNA, 16 bp, Homo sapiens
cctgtaatcccagcta

SEQ ID NO: 3881700 - DNA, 17 bp, Homo sapiens
cctgtactgcctgcttg

SEQ ID NO: 3881701 - DNA, 14 bp, Homo sapiens
cctgtagagctaga

SEQ ID NO: 3881702 - DNA, 13 bp, Homo sapiens
cctgtagcatctt

SEQ ID NO: 3881703 - DNA, 18 bp, Homo sapiens
cctgtagcatcttctgga

SEQ ID NO: 3881704 - DNA, 14 bp, Homo sapiens
cctgtagctctgcc

SEQ ID NO: 3881705 - DNA, 15 bp, Homo sapiens
cctgtagctctgcct

SEQ ID NO: 3881706 - DNA, 13 bp, Homo sapiens
cctgtagtcccag

SEQ ID NO: 3881707 - DNA, 18 bp, Homo sapiens
cctgtagtcccagccact

SEQ ID NO: 3881708 - DNA, 19 bp, Homo sapiens
cctgtagtcccagccactc

SEQ ID NO: 3881709 - DNA, 14 bp, Homo sapiens
cctgtagtgagaaa

SEQ ID NO: 3881710 - DNA, 14 bp, Homo sapiens
cctgtagttaggaa

SEQ ID NO: 3881711 - DNA, 16 bp, Homo sapiens
cctgtagttaggaaat

SEQ ID NO: 3881712 - DNA, 19 bp, Homo sapiens
cctgtagttaggaaataaa

SEQ ID NO: 3881713 - DNA, 21 bp, Homo sapiens
cctgtagttaggaaataaaac

SEQ ID NO: 3881714 - DNA, 12 bp, Homo sapiens
cctgtatagtta

SEQ ID NO: 3881715 - DNA, 20 bp, Homo sapiens
cctgtatataatactaaagt

SEQ ID NO: 3881716 - DNA, 22 bp, Homo sapiens
cctgtatataatactaaagtgt

SEQ ID NO: 3881717 - DNA, 19 bp, Homo sapiens
cctgtatattatggtgtaa

SEQ ID NO: 3881718 - DNA, 16 bp, Homo sapiens
cctgtatgtctccagt

SEQ ID NO: 3881719 - DNA, 17 bp, Homo sapiens
cctgtcagtttcatgga

SEQ ID NO: 3881720 - DNA, 23 bp, Homo sapiens
cctgtccactctcggggcccttg

SEQ ID NO: 3881721 - DNA, 23 bp, Homo sapiens
cctgtcccaccaactctgcactc

SEQ ID NO: 3881722 - DNA, 23 bp, Homo sapiens
cctgtcccagaggttatctgcct

SEQ ID NO: 3881723 - DNA, 14 bp, Homo sapiens
cctgtcccccaagg

SEQ ID NO: 3881724 - DNA, 22 bp, Homo sapiens
cctgtccccctgagatcagagt

SEQ ID NO: 3881725 - DNA, 23 bp, Homo sapiens
cctgtccccctgagatcagagtc

SEQ ID NO: 3881726 - DNA, 16 bp, Homo sapiens
cctgtcccctgaaaaa

SEQ ID NO: 3881727 - DNA, 18 bp, Homo sapiens
cctgtcccctgaaaaact

SEQ ID NO: 3881728 - DNA, 13 bp, Homo sapiens
cctgtcctcctcg

SEQ ID NO: 3881729 - DNA, 15 bp, Homo sapiens
cctgtcctcctcgga

SEQ ID NO: 3881730 - DNA, 14 bp, Homo sapiens
cctgtcctgcctct

SEQ ID NO: 3881731 - DNA, 20 bp, Homo sapiens
cctgtcctggtacagcaggg

SEQ ID NO: 3881732 - DNA, 14 bp, Homo sapiens
cctgtcgagacact

SEQ ID NO: 3881733 - DNA, 15 bp, Homo sapiens
cctgtcgagacactt

SEQ ID NO: 3881734 - DNA, 17 bp, Homo sapiens
cctgtcgagacacttgc

SEQ ID NO: 3881735 - DNA, 13 bp, Homo sapiens
cctgtctcctttc

SEQ ID NO: 3881736 - DNA, 21 bp, Homo sapiens
cctgtctctagccactttggt

SEQ ID NO: 3881737 - DNA, 15 bp, Homo sapiens
cctgtctctgcctgc

SEQ ID NO: 3881738 - DNA, 15 bp, Homo sapiens
cctgtgaacccagga

SEQ ID NO: 3881739 - DNA, 16 bp, Homo sapiens
cctgtgaacccaggac

SEQ ID NO: 3881740 - DNA, 14 bp, Homo sapiens
cctgtgacaaaatt

SEQ ID NO: 3881741 - DNA, 14 bp, Homo sapiens
cctgtgaggcaggg

SEQ ID NO: 3881742 - DNA, 13 bp, Homo sapiens
cctgtgccaacct

SEQ ID NO: 3881743 - DNA, 15 bp, Homo sapiens
cctgtgccaacctga

SEQ ID NO: 3881744 - DNA, 11 bp, Homo sapiens
cctgtgccagc

SEQ ID NO: 3881745 - DNA, 13 bp, Homo sapiens
cctgtgccagctc

SEQ ID NO: 3881746 - DNA, 14 bp, Homo sapiens
cctgtgccagctca

SEQ ID NO: 3881747 - DNA, 15 bp, Homo sapiens
cctgtgccagctcag

SEQ ID NO: 3881748 - DNA, 23 bp, Homo sapiens
cctgtgcccacatcccaggcttc

SEQ ID NO: 3881749 - DNA, 16 bp, Homo sapiens
cctgtgcccctcagag

SEQ ID NO: 3881750 - DNA, 20 bp, Homo sapiens
cctgtggcagaaaagaggag

SEQ ID NO: 3881751 - DNA, 16 bp, Homo sapiens
cctgtggcagaccggg

SEQ ID NO: 3881752 - DNA, 16 bp, Homo sapiens
cctgtggccaggaggt

SEQ ID NO: 3881753 - DNA, 15 bp, Homo sapiens
cctgtggccttgccc

SEQ ID NO: 3881754 - DNA, 17 bp, Homo sapiens
cctgtggccttgcccgc

SEQ ID NO: 3881755 - DNA, 19 bp, Homo sapiens
cctgtggccttgcccgcca

SEQ ID NO: 3881756 - DNA, 22 bp, Homo sapiens
cctgtggccttgcccgccagcc

SEQ ID NO: 3881757 - DNA, 18 bp, Homo sapiens
cctgtggcggtgcctggg

SEQ ID NO: 3881758 - DNA, 20 bp, Homo sapiens
cctgtggcggtgcctgggtg

SEQ ID NO: 3881759 - DNA, 13 bp, Homo sapiens
cctgtgggaagag

SEQ ID NO: 3881760 - DNA, 21 bp, Homo sapiens
cctgtgggaagagaagggaag

SEQ ID NO: 3881761 - DNA, 13 bp, Homo sapiens
cctgtgggagcct

SEQ ID NO: 3881762 - DNA, 15 bp, Homo sapiens
cctgtgggagcctcg

SEQ ID NO: 3881763 - DNA, 14 bp, Homo sapiens
cctgtgggccagga

SEQ ID NO: 3881764 - DNA, 17 bp, Homo sapiens
cctgtggggcctgatgg

SEQ ID NO: 3881765 - DNA, 21 bp, Homo sapiens
cctgtggggcctgatggtgct

SEQ ID NO: 3881766 - DNA, 17 bp, Homo sapiens
cctgtgggggtggccat

SEQ ID NO: 3881767 - DNA, 21 bp, Homo sapiens
cctgtgggggtggccatccct

SEQ ID NO: 3881768 - DNA, 19 bp, Homo sapiens
cctgtggtgacaggcccag

SEQ ID NO: 3881769 - DNA, 12 bp, Homo sapiens
cctgtgtacagg

SEQ ID NO: 3881770 - DNA, 15 bp, Homo sapiens
cctgtgtagctgtga

SEQ ID NO: 3881771 - DNA, 19 bp, Homo sapiens
cctgtgtagctgtgacctg

SEQ ID NO: 3881772 - DNA, 21 bp, Homo sapiens
cctgtgtagctgtgacctgct

SEQ ID NO: 3881773 - DNA, 17 bp, Homo sapiens
cctgtgtccagcagctg

SEQ ID NO: 3881774 - DNA, 15 bp, Homo sapiens
cctgtgtggacagga

SEQ ID NO: 3881775 - DNA, 20 bp, Homo sapiens
cctgttactattatctgtgc

SEQ ID NO: 3881776 - DNA, 18 bp, Homo sapiens
cctgttcatggcagatgt

SEQ ID NO: 3881777 - DNA, 13 bp, Homo sapiens
cctgttccctacc

SEQ ID NO: 3881778 - DNA, 20 bp, Homo sapiens
cctgttggacccgctctgga

SEQ ID NO: 3881779 - DNA, 14 bp, Homo sapiens
cctgtttaatattt

SEQ ID NO: 3881780 - DNA, 21 bp, Homo sapiens
cctgtttaatatttaaacagc

SEQ ID NO: 3881781 - DNA, 17 bp, Homo sapiens
cctgttttgttggaagg

SEQ ID NO: 3881782 - DNA, 15 bp, Homo sapiens
cctgtttttctgggt

SEQ ID NO: 3881783 - DNA, 22 bp, Homo sapiens
ccttaaaaggagagaagaaagt

SEQ ID NO: 3881784 - DNA, 13 bp, Homo sapiens
ccttaaatttttg

SEQ ID NO: 3881785 - DNA, 15 bp, Homo sapiens
ccttacattcctaga

SEQ ID NO: 3881786 - DNA, 14 bp, Homo sapiens
ccttacctcctgcc

SEQ ID NO: 3881787 - DNA, 17 bp, Homo sapiens
ccttactacttcttgga

SEQ ID NO: 3881788 - DNA, 21 bp, Homo sapiens
ccttactacttcttggaaaaa

SEQ ID NO: 3881789 - DNA, 14 bp, Homo sapiens
ccttactcctgtgg

SEQ ID NO: 3881790 - DNA, 15 bp, Homo sapiens
ccttactcctgtggg

SEQ ID NO: 3881791 - DNA, 21 bp, Homo sapiens
ccttactcctgtgggagcctc

SEQ ID NO: 3881792 - DNA, 22 bp, Homo sapiens
ccttactcctgtgggagcctcg

SEQ ID NO: 3881793 - DNA, 16 bp, Homo sapiens
ccttactctgagccca

SEQ ID NO: 3881794 - DNA, 19 bp, Homo sapiens
ccttactctgagcccaggc

SEQ ID NO: 3881795 - DNA, 22 bp, Homo sapiens
ccttactctgagcccaggccgt

SEQ ID NO: 3881796 - DNA, 21 bp, Homo sapiens
ccttagaaatcattgtagaaa

SEQ ID NO: 3881797 - DNA, 16 bp, Homo sapiens
ccttagaacctttctt

SEQ ID NO: 3881798 - DNA, 18 bp, Homo sapiens
ccttagattagctctgga

SEQ ID NO: 3881799 - DNA, 20 bp, Homo sapiens
ccttaggaaaatgcttctgt

SEQ ID NO: 3881800 - DNA, 19 bp, Homo sapiens
ccttaggcattatttaatg

SEQ ID NO: 3881801 - DNA, 23 bp, Homo sapiens
ccttagtccgcaagttcagggaa

SEQ ID NO: 3881802 - DNA, 15 bp, Homo sapiens
ccttataagcccagc

SEQ ID NO: 3881803 - DNA, 14 bp, Homo sapiens
ccttatccaggact

SEQ ID NO: 3881804 - DNA, 22 bp, Homo sapiens
ccttatttatatatcagttata

SEQ ID NO: 3881805 - DNA, 13 bp, Homo sapiens
ccttatttatcaa

SEQ ID NO: 3881806 - DNA, 18 bp, Homo sapiens
ccttattttcaagaaact

SEQ ID NO: 3881807 - DNA, 14 bp, Homo sapiens
ccttattttgtatt

SEQ ID NO: 3881808 - DNA, 15 bp, Homo sapiens
ccttattttgtatta

SEQ ID NO: 3881809 - DNA, 19 bp, Homo sapiens
ccttcacctttggtgcaga

SEQ ID NO: 3881810 - DNA, 22 bp, Homo sapiens
ccttcagggccagaaggagggc

SEQ ID NO: 3881811 - DNA, 20 bp, Homo sapiens
ccttcatcgaacaaactgat

SEQ ID NO: 3881812 - DNA, 14 bp, Homo sapiens
ccttccagacatac

SEQ ID NO: 3881813 - DNA, 22 bp, Homo sapiens
ccttccagacatacgaaacaca

SEQ ID NO: 3881814 - DNA, 23 bp, Homo sapiens
ccttccagctagtgacccacatg

SEQ ID NO: 3881815 - DNA, 15 bp, Homo sapiens
ccttccagtggctcg

SEQ ID NO: 3881816 - DNA, 22 bp, Homo sapiens
ccttccagtggctcgctccctg

SEQ ID NO: 3881817 - DNA, 19 bp, Homo sapiens
ccttccatgtcgcctctgc

SEQ ID NO: 3881818 - DNA, 19 bp, Homo sapiens
ccttcccaatcagcactga

SEQ ID NO: 3881819 - DNA, 12 bp, Homo sapiens
ccttcccagctc

SEQ ID NO: 3881820 - DNA, 13 bp, Homo sapiens
ccttcccagctct

SEQ ID NO: 3881821 - DNA, 15 bp, Homo sapiens
ccttcccatctcttc

SEQ ID NO: 3881822 - DNA, 12 bp, Homo sapiens
ccttccccagac

SEQ ID NO: 3881823 - DNA, 19 bp, Homo sapiens
ccttccccagactcagctc

SEQ ID NO: 3881824 - DNA, 13 bp, Homo sapiens
ccttccccatctc

SEQ ID NO: 3881825 - DNA, 21 bp, Homo sapiens
cctcaggcagaggatgttctg

SEQ ID NO: 3881826 - DNA, 22 bp, Homo sapiens
cctcaggcagaggatgttctgg

SEQ ID NO: 3881827 - DNA, 20 bp, Homo sapiens
cctcagggacagagacacct

SEQ ID NO: 3881828 - DNA, 21 bp, Homo sapiens
cctcagggacagagacacctg

SEQ ID NO: 3881829 - DNA, 24 bp, Homo sapiens
cctcagggacagagacacctgcac

SEQ ID NO: 3881830 - DNA, 23 bp, Homo sapiens
cctcagtcagttcccggagcaca

SEQ ID NO: 3881831 - DNA, 15 bp, Homo sapiens
cctcagttcaacctg

SEQ ID NO: 3881832 - DNA, 23 bp, Homo sapiens
cctcagttcaacctggtggcacc

SEQ ID NO: 3881833 - DNA, 11 bp, Homo sapiens
cctcagtttcc

SEQ ID NO: 3881834 - DNA, 12 bp, Homo sapiens
cctcagtttccc

SEQ ID NO: 3881835 - DNA, 16 bp, Homo sapiens
cctcagtttcctcatc

SEQ ID NO: 3881836 - DNA, 12 bp, Homo sapiens
cctcatatttaa

SEQ ID NO: 3881837 - DNA, 13 bp, Homo sapiens
cctcatatttaaa

SEQ ID NO: 3881838 - DNA, 23 bp, Homo sapiens
cctcatcccctcgtcctgtccca

SEQ ID NO: 3881839 - DNA, 14 bp, Homo sapiens
cctcatctccttta

SEQ ID NO: 3881840 - DNA, 24 bp, Homo sapiens
cctcatcttgccccctcatctcac

SEQ ID NO: 3881841 - DNA, 22 bp, Homo sapiens
cctcatgcctggcccccctcca

SEQ ID NO: 3881842 - DNA, 17 bp, Homo sapiens
cctcattcaggaaaact

SEQ ID NO: 3881843 - DNA, 21 bp, Homo sapiens
cctcattccaccttcccatgc

SEQ ID NO: 3881844 - DNA, 13 bp, Homo sapiens
cctcattcccctc

SEQ ID NO: 3881845 - DNA, 19 bp, Homo sapiens
cctcattcgcctgtgggaa

SEQ ID NO: 3881846 - DNA, 19 bp, Homo sapiens
cctcatttatccctcaacc

SEQ ID NO: 3881847 - DNA, 18 bp, Homo sapiens
cctccaaagccccacctt

SEQ ID NO: 3881848 - DNA, 19 bp, Homo sapiens
cctccaacaataaagagct

SEQ ID NO: 3881849 - DNA, 20 bp, Homo sapiens
cctccaacaataaagagctc

SEQ ID NO: 3881850 - DNA, 21 bp, Homo sapiens
cctccaagctccatctccact

SEQ ID NO: 3881851 - DNA, 22 bp, Homo sapiens
cctccaagctccatctccactc

SEQ ID NO: 3881852 - DNA, 23 bp, Homo sapiens
cctccaatcccaccaaccctcag

SEQ ID NO: 3881853 - DNA, 15 bp, Homo sapiens
cctccaatcctttcc

SEQ ID NO: 3881854 - DNA, 16 bp, Homo sapiens
cctccacagtgctgct

SEQ ID NO: 3881855 - DNA, 23 bp, Homo sapiens
cctccacagttcgacctgcggct

SEQ ID NO: 3881856 - DNA, 23 bp, Homo sapiens
cctccaccttgctcttctttctg

SEQ ID NO: 3881857 - DNA, 14 bp, Homo sapiens
cctccacgcctcct

SEQ ID NO: 3881858 - DNA, 12 bp, Homo sapiens
cctccactcccc

SEQ ID NO: 3881859 - DNA, 12 bp, Homo sapiens
cctccactgtca

SEQ ID NO: 3881860 - DNA, 13 bp, Homo sapiens
cctccactgtcac

SEQ ID NO: 3881861 - DNA, 12 bp, Homo sapiens
cctccagacaga

SEQ ID NO: 3881862 - DNA, 22 bp, Homo sapiens
cctccagacagatacagcccca

SEQ ID NO: 3881863 - DNA, 16 bp, Homo sapiens
cctccagacccctgtg

SEQ ID NO: 3881864 - DNA, 16 bp, Homo sapiens
cctccagaccctgcct

SEQ ID NO: 3881865 - DNA, 20 bp, Homo sapiens
cctccagagacaggaaagaa

SEQ ID NO: 3881866 - DNA, 12 bp, Homo sapiens
cctccagagcca

SEQ ID NO: 3881867 - DNA, 17 bp, Homo sapiens
cctccagagccagcctg

SEQ ID NO: 3881868 - DNA, 17 bp, Homo sapiens
cctccaggcatgctggc

SEQ ID NO: 3881869 - DNA, 22 bp, Homo sapiens
cctccaggcatgctggcctccc

SEQ ID NO: 3881870 - DNA, 18 bp, Homo sapiens
cctccagggaatccgcct

SEQ ID NO: 3881871 - DNA, 20 bp, Homo sapiens
cctccagggaatccgcctgc

SEQ ID NO: 3881872 - DNA, 14 bp, Homo sapiens
cctccatgctgcct

SEQ ID NO: 3881873 - DNA, 15 bp, Homo sapiens
cctccatgctgcctc

SEQ ID NO: 3881874 - DNA, 14 bp, Homo sapiens
cctccatggtggaa

SEQ ID NO: 3881875 - DNA, 13 bp, Homo sapiens
cctccatgtggcc

SEQ ID NO: 3881876 - DNA, 22 bp, Homo sapiens
cctccatgtggccccaggtgcc

SEQ ID NO: 3881877 - DNA, 23 bp, Homo sapiens
cctccatgtggccccaggtgcca

SEQ ID NO: 3881878 - DNA, 18 bp, Homo sapiens
cctccattgctgttgttg

SEQ ID NO: 3881879 - DNA, 13 bp, Homo sapiens
cctcccaacccag

SEQ ID NO: 3881880 - DNA, 13 bp, Homo sapiens
cctcccaacctca

SEQ ID NO: 3881881 - DNA, 22 bp, Homo sapiens
cctcccacaatctgggactttc

SEQ ID NO: 3881882 - DNA, 12 bp, Homo sapiens
cctcccacccca

SEQ ID NO: 3881883 - DNA, 13 bp, Homo sapiens
cctcccaccccac

SEQ ID NO: 3881884 - DNA, 14 bp, Homo sapiens
cctcccaccccact

SEQ ID NO: 3881885 - DNA, 23 bp, Homo sapiens
cctcccaccccactccagccctg

SEQ ID NO: 3881886 - DNA, 14 bp, Homo sapiens
cctcccagagtgct

SEQ ID NO: 3881887 - DNA, 18 bp, Homo sapiens
cctcccagagtgctagga

SEQ ID NO: 3881888 - DNA, 19 bp, Homo sapiens
cctcccagagtgctaggat

SEQ ID NO: 3881889 - DNA, 15 bp, Homo sapiens
cctcccagccccagg

SEQ ID NO: 3881890 - DNA, 12 bp, Homo sapiens
cctcccagccct

SEQ ID NO: 3881891 - DNA, 19 bp, Homo sapiens
cctcccagccctatggatg

SEQ ID NO: 3881892 - DNA, 17 bp, Homo sapiens
cctcccagccctgccag

SEQ ID NO: 3881893 - DNA, 14 bp, Homo sapiens
cctcccatcccctg

SEQ ID NO: 3881894 - DNA, 18 bp, Homo sapiens
cctccccacacctcccta

SEQ ID NO: 3881895 - DNA, 13 bp, Homo sapiens
cctccccacagtc

SEQ ID NO: 3881896 - DNA, 19 bp, Homo sapiens
cctccccacccccgctggg

SEQ ID NO: 3881897 - DNA, 18 bp, Homo sapiens
cctccccaccttccccag

SEQ ID NO: 3881898 - DNA, 22 bp, Homo sapiens
cctccccaggggagagggtctg

SEQ ID NO: 3881899 - DNA, 13 bp, Homo sapiens
cctccccagtcta

SEQ ID NO: 3881900 - DNA, 23 bp, Homo sapiens
cctcccccacaaataatgaacag

SEQ ID NO: 3881901 - DNA, 14 bp, Homo sapiens
cctcccccagagcc

SEQ ID NO: 3881902 - DNA, 15 bp, Homo sapiens
cctcccccagagcca

SEQ ID NO: 3881903 - DNA, 18 bp, Homo sapiens
cctccccccactgcaggc

SEQ ID NO: 3881904 - DNA, 18 bp, Homo sapiens
cctccccctgccagtgcc

SEQ ID NO: 3881905 - DNA, 19 bp, Homo sapiens
cctccccctgccagtgcct

SEQ ID NO: 3881906 - DNA, 14 bp, Homo sapiens
cctccccctgctgc

SEQ ID NO: 3881907 - DNA, 21 bp, Homo sapiens
cctccccgcagtgggaagtga

SEQ ID NO: 3881908 - DNA, 13 bp, Homo sapiens
cctcccctatcca

SEQ ID NO: 3881909 - DNA, 19 bp, Homo sapiens
cctcccctgtcttctctca

SEQ ID NO: 3881910 - DNA, 20 bp, Homo sapiens
cctcccctgtcttctctcaa

SEQ ID NO: 3881911 - DNA, 12 bp, Homo sapiens
cctccctcctcg

SEQ ID NO: 3881912 - DNA, 13 bp, Homo sapiens
cctccctcctcgt

SEQ ID NO: 3881913 - DNA, 13 bp, Homo sapiens
cctccctcctctg

SEQ ID NO: 3881914 - DNA, 17 bp, Homo sapiens
cctccctctgccccaag

SEQ ID NO: 3881915 - DNA, 18 bp, Homo sapiens
cctccctctgccccaagc

SEQ ID NO: 3881916 - DNA, 22 bp, Homo sapiens
cctccctctgccccaagcagcc

SEQ ID NO: 3881917 - DNA, 23 bp, Homo sapiens
cctccctctgccccaagcagcca

SEQ ID NO: 3881918 - DNA, 14 bp, Homo sapiens
cctccctctgctgt

SEQ ID NO: 3881919 - DNA, 18 bp, Homo sapiens
cctccctcttccttcccc

SEQ ID NO: 3881920 - DNA, 13 bp, Homo sapiens
cctccctgaacca

SEQ ID NO: 3881921 - DNA, 21 bp, Homo sapiens
cctccctgactccctgtgggg

SEQ ID NO: 3881922 - DNA, 14 bp, Homo sapiens
cctccctgctacca

SEQ ID NO: 3881923 - DNA, 22 bp, Homo sapiens
cctccctgctaccaaggcccag

SEQ ID NO: 3881924 - DNA, 14 bp, Homo sapiens
cctccctgtcctcc

SEQ ID NO: 3881925 - DNA, 18 bp, Homo sapiens
cctccgtccacccaggct

SEQ ID NO: 3881926 - DNA, 18 bp, Homo sapiens
cctccgtttatgggcctt

SEQ ID NO: 3881927 - DNA, 21 bp, Homo sapiens
cctcctaagcagctgggacta

SEQ ID NO: 3881928 - DNA, 21 bp, Homo sapiens
cctcctacagcactccacctt

SEQ ID NO: 3881929 - DNA, 19 bp, Homo sapiens
cctcctagctccaccctca

SEQ ID NO: 3881930 - DNA, 20 bp, Homo sapiens
cctcctattttaattggaat

SEQ ID NO: 3881931 - DNA, 14 bp, Homo sapiens
cctcctcaccccca

SEQ ID NO: 3881932 - DNA, 17 bp, Homo sapiens
cctcctgaagcctctgc

SEQ ID NO: 3881933 - DNA, 15 bp, Homo sapiens
cctcctgacctgtca

SEQ ID NO: 3881934 - DNA, 20 bp, Homo sapiens
cctcctgagaaggcgaggag

SEQ ID NO: 3881935 - DNA, 16 bp, Homo sapiens
cctcctgatggccaag

SEQ ID NO: 3881936 - DNA, 14 bp, Homo sapiens
cctcctgcccagga

SEQ ID NO: 3881937 - DNA, 15 bp, Homo sapiens
cctcctgcccaggag

SEQ ID NO: 3881938 - DNA, 21 bp, Homo sapiens
cctcctgcccaggagagccag

SEQ ID NO: 3881939 - DNA, 13 bp, Homo sapiens
cctcctgcctcta

SEQ ID NO: 3881940 - DNA, 14 bp, Homo sapiens
cctcctggccagac

SEQ ID NO: 3881941 - DNA, 17 bp, Homo sapiens
cctcctggccagacgct

SEQ ID NO: 3881942 - DNA, 12 bp, Homo sapiens
cctcctgggcag

SEQ ID NO: 3881943 - DNA, 16 bp, Homo sapiens
cctccttataagccca

SEQ ID NO: 3881944 - DNA, 21 bp, Homo sapiens
cctccttcccgccgcccgacc

SEQ ID NO: 3881945 - DNA, 14 bp, Homo sapiens
cctccttctgctgc

SEQ ID NO: 3881946 - DNA, 18 bp, Homo sapiens
cctccttcttcagggact

SEQ ID NO: 3881947 - DNA, 18 bp, Homo sapiens
cctccttgctctgcaggc

SEQ ID NO: 3881948 - DNA, 18 bp, Homo sapiens
cctccttttgcttgaaac

SEQ ID NO: 3881949 - DNA, 22 bp, Homo sapiens
cctcgaggcaccggcgctgcag

SEQ ID NO: 3881950 - DNA, 12 bp, Homo sapiens
cctcgccctggg

SEQ ID NO: 3881951 - DNA, 13 bp, Homo sapiens
cctcgccctgggt

SEQ ID NO: 3881952 - DNA, 12 bp, Homo sapiens
cctcgcctgggc

SEQ ID NO: 3881953 - DNA, 19 bp, Homo sapiens
cctcgcctgggcccaggct

SEQ ID NO: 3881954 - DNA, 20 bp, Homo sapiens
cctcgcctgggcccaggctc

SEQ ID NO: 3881955 - DNA, 23 bp, Homo sapiens
cctcgcctgggcccaggctctgg

SEQ ID NO: 3881956 - DNA, 21 bp, Homo sapiens
cctcgccttttaggctcagga

SEQ ID NO: 3881957 - DNA, 13 bp, Homo sapiens
cctcgctgctgct

SEQ ID NO: 3881958 - DNA, 17 bp, Homo sapiens
cctcgctgctgctacta

SEQ ID NO: 3881959 - DNA, 12 bp, Homo sapiens
cctcggagaaga

SEQ ID NO: 3881960 - DNA, 17 bp, Homo sapiens
cctcggatcaccgagag

SEQ ID NO: 3881961 - DNA, 21 bp, Homo sapiens
cctcgtccacaggggcaggcc

SEQ ID NO: 3881962 - DNA, 16 bp, Homo sapiens
cctcgtcccctgcctc

SEQ ID NO: 3881963 - DNA, 20 bp, Homo sapiens
cctcgtcctccccctgccag

SEQ ID NO: 3881964 - DNA, 21 bp, Homo sapiens
cctctaacccccagtgccaca

SEQ ID NO: 3881965 - DNA, 16 bp, Homo sapiens
cctctactgggaaggc

SEQ ID NO: 3881966 - DNA, 17 bp, Homo sapiens
cctctactgggaaggct

SEQ ID NO: 3881967 - DNA, 12 bp, Homo sapiens
cctctagaacac

SEQ ID NO: 3881968 - DNA, 23 bp, Homo sapiens
cctctagaacacccactggccag

SEQ ID NO: 3881969 - DNA, 24 bp, Homo sapiens
cctctagaacacccactggccagt

SEQ ID NO: 3881970 - DNA, 20 bp, Homo sapiens
cctctcaatattcaataaag

SEQ ID NO: 3881971 - DNA, 16 bp, Homo sapiens
cctctcactaaacttt

SEQ ID NO: 3881972 - DNA, 17 bp, Homo sapiens
cctctccaattgtaaaa

SEQ ID NO: 3881973 - DNA, 13 bp, Homo sapiens
cctctccactgcc

SEQ ID NO: 3881974 - DNA, 13 bp, Homo sapiens
cctctccaggcac

SEQ ID NO: 3881975 - DNA, 18 bp, Homo sapiens
cctctccatgcccaacct

SEQ ID NO: 3881976 - DNA, 14 bp, Homo sapiens
cctctcccacgatg

SEQ ID NO: 3881977 - DNA, 16 bp, Homo sapiens
cctctcccacgatgtc

SEQ ID NO: 3881978 - DNA, 14 bp, Homo sapiens
cctctcccaggccc

SEQ ID NO: 3881979 - DNA, 15 bp, Homo sapiens
cctctcccaggcccc

SEQ ID NO: 3881980 - DNA, 16 bp, Homo sapiens
cctctcccccgcccaa

SEQ ID NO: 3881981 - DNA, 16 bp, Homo sapiens
cctctcccctcatgga

SEQ ID NO: 3881982 - DNA, 17 bp, Homo sapiens
cctctcccggctgcctg

SEQ ID NO: 3881983 - DNA, 12 bp, Homo sapiens
cctctccctggg

SEQ ID NO: 3881984 - DNA, 12 bp, Homo sapiens
cctctccttgga

SEQ ID NO: 3881985 - DNA, 16 bp, Homo sapiens
cctctccttgggctcc

SEQ ID NO: 3881986 - DNA, 20 bp, Homo sapiens
cctctccttgggctcctggc

SEQ ID NO: 3881987 - DNA, 22 bp, Homo sapiens
cctctccttgggctcctggctg

SEQ ID NO: 3881988 - DNA, 14 bp, Homo sapiens
cctctcgagcccag

SEQ ID NO: 3881989 - DNA, 12 bp, Homo sapiens
cctctctctccg

SEQ ID NO: 3881990 - DNA, 21 bp, Homo sapiens
cctctcttcagcccctagtgc

SEQ ID NO: 3881991 - DNA, 12 bp, Homo sapiens
cctctcttccct

SEQ ID NO: 3881992 - DNA, 20 bp, Homo sapiens
cctctcttctctattcctga

SEQ ID NO: 3881993 - DNA, 17 bp, Homo sapiens
cctctgaccaacaggct

SEQ ID NO: 3881994 - DNA, 12 bp, Homo sapiens
cctctgaggcca

SEQ ID NO: 3881995 - DNA, 15 bp, Homo sapiens
cctctgaggccagcc

SEQ ID NO: 3881996 - DNA, 16 bp, Homo sapiens
cctctgaggccagcct

SEQ ID NO: 3881997 - DNA, 12 bp, Homo sapiens
cctctgatccct

SEQ ID NO: 3881998 - DNA, 14 bp, Homo sapiens
cctctgcagcactt

SEQ ID NO: 3881999 - DNA, 16 bp, Homo sapiens
cctctgcagcacttta

SEQ ID NO: 3882000 - DNA, 12 bp, Homo sapiens
cctctgccacct

SEQ ID NO: 3882001 - DNA, 16 bp, Homo sapiens
cctctgccacctcccc

SEQ ID NO: 3882002 - DNA, 16 bp, Homo sapiens
cctctgccatgcccag

SEQ ID NO: 3882003 - DNA, 18 bp, Homo sapiens
cctctgccatgcccagag

SEQ ID NO: 3882004 - DNA, 19 bp, Homo sapiens
cctctgccatgcccagaga

SEQ ID NO: 3882005 - DNA, 11 bp, Homo sapiens
cctctgcccca

SEQ ID NO: 3882006 - DNA, 15 bp, Homo sapiens
cctctgccccaagca

SEQ ID NO: 3882007 - DNA, 19 bp, Homo sapiens
cctctgccccaagcagcca

SEQ ID NO: 3882008 - DNA, 14 bp, Homo sapiens
cctctgccccaagg

SEQ ID NO: 3882009 - DNA, 15 bp, Homo sapiens
cctctgccccaaggg

SEQ ID NO: 3882010 - DNA, 20 bp, Homo sapiens
cctctgccccaaggggccca

SEQ ID NO: 3882011 - DNA, 14 bp, Homo sapiens
cctctgcccgcaga

SEQ ID NO: 3882012 - DNA, 16 bp, Homo sapiens
cctctgcccgcagagc

SEQ ID NO: 3882013 - DNA, 14 bp, Homo sapiens
cctctgccctgcct

SEQ ID NO: 3882014 - DNA, 12 bp, Homo sapiens
cctctgcctcaa

SEQ ID NO: 3882015 - DNA, 12 bp, Homo sapiens
cctctgcctgtc

SEQ ID NO: 3882016 - DNA, 20 bp, Homo sapiens
cctctgcctgtgcacggcca

SEQ ID NO: 3882017 - DNA, 16 bp, Homo sapiens
cctctggaaagcaaag

SEQ ID NO: 3882018 - DNA, 16 bp, Homo sapiens
cctctggatccctgga

SEQ ID NO: 3882019 - DNA, 19 bp, Homo sapiens
cctctggatcctgctgtgg

SEQ ID NO: 3882020 - DNA, 21 bp, Homo sapiens
cctctggatggcaccagaggc

SEQ ID NO: 3882021 - DNA, 16 bp, Homo sapiens
cctctggcccagccta

SEQ ID NO: 3882022 - DNA, 17 bp, Homo sapiens
cctctggccctgccttc

SEQ ID NO: 3882023 - DNA, 18 bp, Homo sapiens
cctctggccctgccttct

SEQ ID NO: 3882024 - DNA, 23 bp, Homo sapiens
cctctggctggctaactggaagc

SEQ ID NO: 3882025 - DNA, 14 bp, Homo sapiens
cctctgggcagctg

SEQ ID NO: 3882026 - DNA, 10 bp, Homo sapiens
cctctgggct

SEQ ID NO: 3882027 - DNA, 20 bp, Homo sapiens
cctctgtctcgagcgccctg

SEQ ID NO: 3882028 - DNA, 23 bp, Homo sapiens
cctctgtgaggaaagcacacagt

SEQ ID NO: 3882029 - DNA, 22 bp, Homo sapiens
cctaggagttgagtacagtgag

SEQ ID NO: 3882030 - DNA, 15 bp, Homo sapiens
cctaggccactcctc

SEQ ID NO: 3882031 - DNA, 18 bp, Homo sapiens
cctaggccactcctccaa

SEQ ID NO: 3882032 - DNA, 14 bp, Homo sapiens
cctaggccccagag

SEQ ID NO: 3882033 - DNA, 18 bp, Homo sapiens
cctaggctccaccccatc

SEQ ID NO: 3882034 - DNA, 16 bp, Homo sapiens
cctaggtgctggatgc

SEQ ID NO: 3882035 - DNA, 17 bp, Homo sapiens
cctagtactctctgctc

SEQ ID NO: 3882036 - DNA, 18 bp, Homo sapiens
cctagtactctctgctct

SEQ ID NO: 3882037 - DNA, 20 bp, Homo sapiens
cctagtactctctgctctag

SEQ ID NO: 3882038 - DNA, 21 bp, Homo sapiens
cctagtactctctgctctagc

SEQ ID NO: 3882039 - DNA, 23 bp, Homo sapiens
cctagtactctctgctctagcca

SEQ ID NO: 3882040 - DNA, 23 bp, Homo sapiens
cctagtgcttccacttctatgca

SEQ ID NO: 3882041 - DNA, 15 bp, Homo sapiens
cctagtttgacctca

SEQ ID NO: 3882042 - DNA, 23 bp, Homo sapiens
cctataaggagagttcaagcctg

SEQ ID NO: 3882043 - DNA, 19 bp, Homo sapiens
cctataatgtgtgtatgtg

SEQ ID NO: 3882044 - DNA, 23 bp, Homo sapiens
cctataccatatgtctgcttctg

SEQ ID NO: 3882045 - DNA, 13 bp, Homo sapiens
cctatagagaggg

SEQ ID NO: 3882046 - DNA, 15 bp, Homo sapiens
cctatagagaggggg

SEQ ID NO: 3882047 - DNA, 15 bp, Homo sapiens
cctatcaaaacatat

SEQ ID NO: 3882048 - DNA, 16 bp, Homo sapiens
cctatcaaaacatatc

SEQ ID NO: 3882049 - DNA, 18 bp, Homo sapiens
cctatcaaaacatatcaa

SEQ ID NO: 3882050 - DNA, 15 bp, Homo sapiens
cctatcacccaggct

SEQ ID NO: 3882051 - DNA, 17 bp, Homo sapiens
cctatcagaagtttctc

SEQ ID NO: 3882052 - DNA, 13 bp, Homo sapiens
cctatccacccag

SEQ ID NO: 3882053 - DNA, 13 bp, Homo sapiens
cctatccatcctg

SEQ ID NO: 3882054 - DNA, 17 bp, Homo sapiens
cctatccttccagtggc

SEQ ID NO: 3882055 - DNA, 20 bp, Homo sapiens
cctatccttggagagcagct

SEQ ID NO: 3882056 - DNA, 17 bp, Homo sapiens
cctatgacttgggcacc

SEQ ID NO: 3882057 - DNA, 22 bp, Homo sapiens
cctatgacttgggcacccccag

SEQ ID NO: 3882058 - DNA, 21 bp, Homo sapiens
cctatgcatggtgtagatgcc

SEQ ID NO: 3882059 - DNA, 21 bp, Homo sapiens
cctatggagagccctgggacc

SEQ ID NO: 3882060 - DNA, 22 bp, Homo sapiens
cctatggtataatggttgactg

SEQ ID NO: 3882061 - DNA, 19 bp, Homo sapiens
cctattatttccgggtgga

SEQ ID NO: 3882062 - DNA, 16 bp, Homo sapiens
cctattctcaccagga

SEQ ID NO: 3882063 - DNA, 19 bp, Homo sapiens
cctattctcaccaggaagg

SEQ ID NO: 3882064 - DNA, 12 bp, Homo sapiens
cctatttattgg

SEQ ID NO: 3882065 - DNA, 14 bp, Homo sapiens
cctattttaaaacc

SEQ ID NO: 3882066 - DNA, 21 bp, Homo sapiens
cctattttaaaaccatgcagc

SEQ ID NO: 3882067 - DNA, 16 bp, Homo sapiens
cctcaaaagcaccctt

SEQ ID NO: 3882068 - DNA, 11 bp, Homo sapiens
cctcaaactgg

SEQ ID NO: 3882069 - DNA, 14 bp, Homo sapiens
cctcaaatgtcaga

SEQ ID NO: 3882070 - DNA, 16 bp, Homo sapiens
cctcaagaacaccttt

SEQ ID NO: 3882071 - DNA, 16 bp, Homo sapiens
cctcaatgccctgcca

SEQ ID NO: 3882072 - DNA, 17 bp, Homo sapiens
cctcaatgccctgccat

SEQ ID NO: 3882073 - DNA, 19 bp, Homo sapiens
cctcaatgccctgccatta

SEQ ID NO: 3882074 - DNA, 17 bp, Homo sapiens
cctcaatggacttcaaa

SEQ ID NO: 3882075 - DNA, 19 bp, Homo sapiens
cctcaatggacttcaaatt

SEQ ID NO: 3882076 - DNA, 16 bp, Homo sapiens
cctcaatgtgaccagg

SEQ ID NO: 3882077 - DNA, 15 bp, Homo sapiens
cctcacacccagagg

SEQ ID NO: 3882078 - DNA, 12 bp, Homo sapiens
cctcacagcctc

SEQ ID NO: 3882079 - DNA, 13 bp, Homo sapiens
cctcacaggagca

SEQ ID NO: 3882080 - DNA, 14 bp, Homo sapiens
cctcacaggagcag

SEQ ID NO: 3882081 - DNA, 17 bp, Homo sapiens
cctcacccccagctttg

SEQ ID NO: 3882082 - DNA, 18 bp, Homo sapiens
cctcacctgggcctttcc

SEQ ID NO: 3882083 - DNA, 23 bp, Homo sapiens
cctcacctgggcctttcctgtgc

SEQ ID NO: 3882084 - DNA, 24 bp, Homo sapiens
cctcactatggtatgctggccagc

SEQ ID NO: 3882085 - DNA, 12 bp, Homo sapiens
cctcactcctgt

SEQ ID NO: 3882086 - DNA, 14 bp, Homo sapiens
cctcactctgtcag

SEQ ID NO: 3882087 - DNA, 16 bp, Homo sapiens
cctcactctgtcagcc

SEQ ID NO: 3882088 - DNA, 18 bp, Homo sapiens
cctcactctgtcagccag

SEQ ID NO: 3882089 - DNA, 19 bp, Homo sapiens
cctcactctgtcagccagc

SEQ ID NO: 3882090 - DNA, 20 bp, Homo sapiens
cctcactctgtcagccagcc

SEQ ID NO: 3882091 - DNA, 13 bp, Homo sapiens
cctcactggctgg

SEQ ID NO: 3882092 - DNA, 17 bp, Homo sapiens
cctcactggctggggca

SEQ ID NO: 3882093 - DNA, 23 bp, Homo sapiens
cctcactggctggggcagagggg

SEQ ID NO: 3882094 - DNA, 15 bp, Homo sapiens
cctcacttccctggg

SEQ ID NO: 3882095 - DNA, 16 bp, Homo sapiens
cctcacttccctggga

SEQ ID NO: 3882096 - DNA, 17 bp, Homo sapiens
cctcacttccctgggaa

SEQ ID NO: 3882097 - DNA, 18 bp, Homo sapiens
cctcagacaatccactct

SEQ ID NO: 3882098 - DNA, 23 bp, Homo sapiens
cctcagacaatccactctcagga

SEQ ID NO: 3882099 - DNA, 15 bp, Homo sapiens
cctcagactgctcaa

SEQ ID NO: 3882100 - DNA, 16 bp, Homo sapiens
cctcagagccacccct

SEQ ID NO: 3882101 - DNA, 11 bp, Homo sapiens
cctcagagctc

SEQ ID NO: 3882102 - DNA, 14 bp, Homo sapiens
cctcagatgatctc

SEQ ID NO: 3882103 - DNA, 19 bp, Homo sapiens
cctcagatgatctctccac

SEQ ID NO: 3882104 - DNA, 12 bp, Homo sapiens
cctcagccctca

SEQ ID NO: 3882105 - DNA, 13 bp, Homo sapiens
cctcagccctcag

SEQ ID NO: 3882106 - DNA, 17 bp, Homo sapiens
cctcagcccttgccccc

SEQ ID NO: 3882107 - DNA, 22 bp, Homo sapiens
cctcagcccttgcccccatccc

SEQ ID NO: 3882108 - DNA, 11 bp, Homo sapiens
cctcagctcag

SEQ ID NO: 3882109 - DNA, 12 bp, Homo sapiens
cctcagctcagc

SEQ ID NO: 3882110 - DNA, 13 bp, Homo sapiens
cctcagctcagcc

SEQ ID NO: 3882111 - DNA, 11 bp, Homo sapiens
cctcagctgca

SEQ ID NO: 3882112 - DNA, 19 bp, Homo sapiens
cctcagctgcacattcctg

SEQ ID NO: 3882113 - DNA, 12 bp, Homo sapiens
cctcagctgcca

SEQ ID NO: 3882114 - DNA, 14 bp, Homo sapiens
cctcagctgccaag

SEQ ID NO: 3882115 - DNA, 19 bp, Homo sapiens
ccgcaccagctgctctgcc

SEQ ID NO: 3882116 - DNA, 13 bp, Homo sapiens
ccgcaccccagag

SEQ ID NO: 3882117 - DNA, 13 bp, Homo sapiens
ccgcagaaggaag

SEQ ID NO: 3882118 - DNA, 22 bp, Homo sapiens
ccgcagccagccggtgcctggc

SEQ ID NO: 3882119 - DNA, 11 bp, Homo sapiens
ccgcagcccag

SEQ ID NO: 3882120 - DNA, 20 bp, Homo sapiens
ccgcagcccgtgaagcagtg

SEQ ID NO: 3882121 - DNA, 21 bp, Homo sapiens
ccgcagcccgtgaagcagtgc

SEQ ID NO: 3882122 - DNA, 22 bp, Homo sapiens
ccgcagggacggggactggccc

SEQ ID NO: 3882123 - DNA, 16 bp, Homo sapiens
ccgcagtccccagccc

SEQ ID NO: 3882124 - DNA, 18 bp, Homo sapiens
ccgcagtccccagccctt

SEQ ID NO: 3882125 - DNA, 16 bp, Homo sapiens
ccgcatcttctccatc

SEQ ID NO: 3882126 - DNA, 14 bp, Homo sapiens
ccgccacggccacc

SEQ ID NO: 3882127 - DNA, 14 bp, Homo sapiens
ccgccagcctcagt

SEQ ID NO: 3882128 - DNA, 16 bp, Homo sapiens
ccgccagcctcagtgc

SEQ ID NO: 3882129 - DNA, 18 bp, Homo sapiens
ccgccatccgggacgctt

SEQ ID NO: 3882130 - DNA, 21 bp, Homo sapiens
ccgcccctcgctgctgctact

SEQ ID NO: 3882131 - DNA, 18 bp, Homo sapiens
ccgcccctctccaaacac

SEQ ID NO: 3882132 - DNA, 13 bp, Homo sapiens
ccgccctggcagt

SEQ ID NO: 3882133 - DNA, 20 bp, Homo sapiens
ccgccctgggctgtctgtca

SEQ ID NO: 3882134 - DNA, 13 bp, Homo sapiens
ccgccgcccgacc

SEQ ID NO: 3882135 - DNA, 15 bp, Homo sapiens
ccgcctcccagcccc

SEQ ID NO: 3882136 - DNA, 17 bp, Homo sapiens
ccgcctctgcccgcaga

SEQ ID NO: 3882137 - DNA, 18 bp, Homo sapiens
ccgcctctgcccgcagag

SEQ ID NO: 3882138 - DNA, 14 bp, Homo sapiens
ccgcctgcagagga

SEQ ID NO: 3882139 - DNA, 18 bp, Homo sapiens
ccgcgagactgagaggca

SEQ ID NO: 3882140 - DNA, 12 bp, Homo sapiens
ccgcggtgctct

SEQ ID NO: 3882141 - DNA, 16 bp, Homo sapiens
ccgcggtgctctggcg

SEQ ID NO: 3882142 - DNA, 13 bp, Homo sapiens
ccgcgtctaccct

SEQ ID NO: 3882143 - DNA, 15 bp, Homo sapiens
ccgcgtctaccctgg

SEQ ID NO: 3882144 - DNA, 17 bp, Homo sapiens
ccgctacaccactctgg

SEQ ID NO: 3882145 - DNA, 19 bp, Homo sapiens
ccgctacaccactctggca

SEQ ID NO: 3882146 - DNA, 20 bp, Homo sapiens
ccgctagagcagcccaaatt

SEQ ID NO: 3882147 - DNA, 21 bp, Homo sapiens
ccgctcagccctccctgcccc

SEQ ID NO: 3882148 - DNA, 19 bp, Homo sapiens
ccgctcctcccctcttgag

SEQ ID NO: 3882149 - DNA, 12 bp, Homo sapiens
ccgctgccacca

SEQ ID NO: 3882150 - DNA, 24 bp, Homo sapiens
ccgctgccaccacgtctgccaggc

SEQ ID NO: 3882151 - DNA, 22 bp, Homo sapiens
ccgctggtgcctcccgggacga

SEQ ID NO: 3882152 - DNA, 18 bp, Homo sapiens
ccgctgtcgccccaggcc

SEQ ID NO: 3882153 - DNA, 20 bp, Homo sapiens
ccgctgtcgccccaggccct

SEQ ID NO: 3882154 - DNA, 22 bp, Homo sapiens
ccgctgtcgccccaggccctcc

SEQ ID NO: 3882155 - DNA, 18 bp, Homo sapiens
ccgctgtgagcccctggt

SEQ ID NO: 3882156 - DNA, 18 bp, Homo sapiens
ccgctgttcacccacagg

SEQ ID NO: 3882157 - DNA, 19 bp, Homo sapiens
ccgctgttcacccacaggg

SEQ ID NO: 3882158 - DNA, 17 bp, Homo sapiens
ccgcttcacccctgcac

SEQ ID NO: 3882159 - DNA, 19 bp, Homo sapiens
ccgcttgtccagcgcctag

SEQ ID NO: 3882160 - DNA, 13 bp, Homo sapiens
ccggagcacagcc

SEQ ID NO: 3882161 - DNA, 14 bp, Homo sapiens
ccggagcacagccc

SEQ ID NO: 3882162 - DNA, 16 bp, Homo sapiens
ccggagcacagccctg

SEQ ID NO: 3882163 - DNA, 20 bp, Homo sapiens
ccggagcacagccctgggag

SEQ ID NO: 3882164 - DNA, 19 bp, Homo sapiens
ccggagcaggggtctgagc

SEQ ID NO: 3882165 - DNA, 18 bp, Homo sapiens
ccggagtaatcaggcagc

SEQ ID NO: 3882166 - DNA, 15 bp, Homo sapiens
ccggcaccccctgca

SEQ ID NO: 3882167 - DNA, 16 bp, Homo sapiens
ccggcaccccctgcag

SEQ ID NO: 3882168 - DNA, 21 bp, Homo sapiens
ccggcaccccctgcagcttgt

SEQ ID NO: 3882169 - DNA, 13 bp, Homo sapiens
ccggcacctgcga

SEQ ID NO: 3882170 - DNA, 15 bp, Homo sapiens
ccggcacctgcgaga

SEQ ID NO: 3882171 - DNA, 14 bp, Homo sapiens
ccggccagggcctg

SEQ ID NO: 3882172 - DNA, 18 bp, Homo sapiens
ccggccagggcctggtgt

SEQ ID NO: 3882173 - DNA, 23 bp, Homo sapiens
ccggccccccctcttttggcctt

SEQ ID NO: 3882174 - DNA, 23 bp, Homo sapiens
ccggcctcagcacccctgtctct

SEQ ID NO: 3882175 - DNA, 16 bp, Homo sapiens
ccggcctgctcccagc

SEQ ID NO: 3882176 - DNA, 14 bp, Homo sapiens
ccggcgctgcaggt

SEQ ID NO: 3882177 - DNA, 17 bp, Homo sapiens
ccggctatgggggcact

SEQ ID NO: 3882178 - DNA, 22 bp, Homo sapiens
ccggctatgggggcactgagga

SEQ ID NO: 3882179 - DNA, 23 bp, Homo sapiens
ccggctatgggggcactgaggac

SEQ ID NO: 3882180 - DNA, 14 bp, Homo sapiens
ccgggacgcttcca

SEQ ID NO: 3882181 - DNA, 15 bp, Homo sapiens
ccgggacgcttccag

SEQ ID NO: 3882182 - DNA, 17 bp, Homo sapiens
ccgggacgcttccagac

SEQ ID NO: 3882183 - DNA, 18 bp, Homo sapiens
ccgggacgcttccagacc

SEQ ID NO: 3882184 - DNA, 20 bp, Homo sapiens
ccgggacgcttccagaccac

SEQ ID NO: 3882185 - DNA, 19 bp, Homo sapiens
ccgggactctccccctttc

SEQ ID NO: 3882186 - DNA, 16 bp, Homo sapiens
ccgggacttcaaagcc

SEQ ID NO: 3882187 - DNA, 19 bp, Homo sapiens
ccgggagcctccccctcag

SEQ ID NO: 3882188 - DNA, 15 bp, Homo sapiens
ccgggcaggtcctgc

SEQ ID NO: 3882189 - DNA, 16 bp, Homo sapiens
ccgggcaggtcctgcc

SEQ ID NO: 3882190 - DNA, 19 bp, Homo sapiens
ccgggcaggtcctgcccat

SEQ ID NO: 3882191 - DNA, 19 bp, Homo sapiens
ccgggccactccttcctgc

SEQ ID NO: 3882192 - DNA, 21 bp, Homo sapiens
ccgggccctccttgcctgttt

SEQ ID NO: 3882193 - DNA, 20 bp, Homo sapiens
ccgggctgcccttcgctgcc

SEQ ID NO: 3882194 - DNA, 21 bp, Homo sapiens
ccgggctgcccttcgctgcca

SEQ ID NO: 3882195 - DNA, 13 bp, Homo sapiens
ccgggctgggagc

SEQ ID NO: 3882196 - DNA, 18 bp, Homo sapiens
ccggggaactggccaagc

SEQ ID NO: 3882197 - DNA, 16 bp, Homo sapiens
ccggggagagcagagg

SEQ ID NO: 3882198 - DNA, 12 bp, Homo sapiens
ccggggctggca

SEQ ID NO: 3882199 - DNA, 22 bp, Homo sapiens
ccggggtctgtgctgtgcctgc

SEQ ID NO: 3882200 - DNA, 14 bp, Homo sapiens
ccgggtgggcctgg

SEQ ID NO: 3882201 - DNA, 16 bp, Homo sapiens
ccctgtgccagctcag

SEQ ID NO: 3882202 - DNA, 12 bp, Homo sapiens
ccctgtggcaga

SEQ ID NO: 3882203 - DNA, 18 bp, Homo sapiens
ccctgtgggggtggccat

SEQ ID NO: 3882204 - DNA, 19 bp, Homo sapiens
ccctgtgggggtggccatc

SEQ ID NO: 3882205 - DNA, 16 bp, Homo sapiens
ccctgttatctgctag

SEQ ID NO: 3882206 - DNA, 17 bp, Homo sapiens
ccctgttatctgctaga

SEQ ID NO: 3882207 - DNA, 14 bp, Homo sapiens
ccctgtttaatatt

SEQ ID NO: 3882208 - DNA, 17 bp, Homo sapiens
ccctgtttaatatttaa

SEQ ID NO: 3882209 - DNA, 19 bp, Homo sapiens
ccctgtttaatatttaaac

SEQ ID NO: 3882210 - DNA, 16 bp, Homo sapiens
cccttaggcattattt

SEQ ID NO: 3882211 - DNA, 14 bp, Homo sapiens
cccttatccaggac

SEQ ID NO: 3882212 - DNA, 12 bp, Homo sapiens
cccttattttca

SEQ ID NO: 3882213 - DNA, 18 bp, Homo sapiens
cccttcaaccattcccca

SEQ ID NO: 3882214 - DNA, 21 bp, Homo sapiens
cccttcacctttggtgcagag

SEQ ID NO: 3882215 - DNA, 12 bp, Homo sapiens
cccttcagggcc

SEQ ID NO: 3882216 - DNA, 13 bp, Homo sapiens
cccttcagggcca

SEQ ID NO: 3882217 - DNA, 13 bp, Homo sapiens
cccttccagacat

SEQ ID NO: 3882218 - DNA, 18 bp, Homo sapiens
cccttcccaatcagcact

SEQ ID NO: 3882219 - DNA, 14 bp, Homo sapiens
cccttcctccccag

SEQ ID NO: 3882220 - DNA, 17 bp, Homo sapiens
cccttcctggacagctg

SEQ ID NO: 3882221 - DNA, 23 bp, Homo sapiens
cccttcctggacagctgtgcctc

SEQ ID NO: 3882222 - DNA, 13 bp, Homo sapiens
cccttcctggcct

SEQ ID NO: 3882223 - DNA, 15 bp, Homo sapiens
cccttcctggcctca

SEQ ID NO: 3882224 - DNA, 18 bp, Homo sapiens
cccttcctggcctcactg

SEQ ID NO: 3882225 - DNA, 23 bp, Homo sapiens
cccttcctggcctcactggctgg

SEQ ID NO: 3882226 - DNA, 19 bp, Homo sapiens
cccttcctttcctctgcag

SEQ ID NO: 3882227 - DNA, 20 bp, Homo sapiens
cccttcctttcctctgcagc

SEQ ID NO: 3882228 - DNA, 13 bp, Homo sapiens
cccttcgctgcca

SEQ ID NO: 3882229 - DNA, 15 bp, Homo sapiens
cccttcgctgccagg

SEQ ID NO: 3882230 - DNA, 17 bp, Homo sapiens
cccttcgctgccaggac

SEQ ID NO: 3882231 - DNA, 18 bp, Homo sapiens
cccttcgctgccaggaca

SEQ ID NO: 3882232 - DNA, 22 bp, Homo sapiens
cccttcgctgccaggacacctg

SEQ ID NO: 3882233 - DNA, 23 bp, Homo sapiens
cccttctcattccaacagtgagt

SEQ ID NO: 3882234 - DNA, 13 bp, Homo sapiens
cccttctctcctt

SEQ ID NO: 3882235 - DNA, 19 bp, Homo sapiens
cccttctctccttccctct

SEQ ID NO: 3882236 - DNA, 12 bp, Homo sapiens
cccttctgcctt

SEQ ID NO: 3882237 - DNA, 12 bp, Homo sapiens
cccttctgggca

SEQ ID NO: 3882238 - DNA, 12 bp, Homo sapiens
cccttctgtgtc

SEQ ID NO: 3882239 - DNA, 17 bp, Homo sapiens
cccttctgtgtcacagt

SEQ ID NO: 3882240 - DNA, 15 bp, Homo sapiens
cccttctttaaatca

SEQ ID NO: 3882241 - DNA, 19 bp, Homo sapiens
cccttctttaaatcaaaag

SEQ ID NO: 3882242 - DNA, 19 bp, Homo sapiens
cccttctttttcttctttt

SEQ ID NO: 3882243 - DNA, 16 bp, Homo sapiens
cccttgagacctcagc

SEQ ID NO: 3882244 - DNA, 22 bp, Homo sapiens
cccttgcactaaagtatgtaaa

SEQ ID NO: 3882245 - DNA, 15 bp, Homo sapiens
cccttgccctgacct

SEQ ID NO: 3882246 - DNA, 17 bp, Homo sapiens
cccttgcccttgccctg

SEQ ID NO: 3882247 - DNA, 18 bp, Homo sapiens
cccttgcccttgccctga

SEQ ID NO: 3882248 - DNA, 22 bp, Homo sapiens
cccttgccgggccttttttcca

SEQ ID NO: 3882249 - DNA, 13 bp, Homo sapiens
cccttgctgctgc

SEQ ID NO: 3882250 - DNA, 16 bp, Homo sapiens
cccttggaaagttcag

SEQ ID NO: 3882251 - DNA, 23 bp, Homo sapiens
cccttggctgtgaggcccctgga

SEQ ID NO: 3882252 - DNA, 14 bp, Homo sapiens
cccttggcttcctc

SEQ ID NO: 3882253 - DNA, 19 bp, Homo sapiens
cccttggcttcctccgtcc

SEQ ID NO: 3882254 - DNA, 15 bp, Homo sapiens
cccttgggcatccac

SEQ ID NO: 3882255 - DNA, 17 bp, Homo sapiens
cccttggggcctggctt

SEQ ID NO: 3882256 - DNA, 20 bp, Homo sapiens
cccttggggtaagccagagc

SEQ ID NO: 3882257 - DNA, 22 bp, Homo sapiens
cccttggggtaagccagagcct

SEQ ID NO: 3882258 - DNA, 14 bp, Homo sapiens
cccttgtcctgcca

SEQ ID NO: 3882259 - DNA, 15 bp, Homo sapiens
cccttgtcctgccag

SEQ ID NO: 3882260 - DNA, 19 bp, Homo sapiens
cccttgtcctgccagctgc

SEQ ID NO: 3882261 - DNA, 23 bp, Homo sapiens
ccctttattaattcattaaattt

SEQ ID NO: 3882262 - DNA, 13 bp, Homo sapiens
ccctttcctcccc

SEQ ID NO: 3882263 - DNA, 23 bp, Homo sapiens
ccctttgggtactactgctgcaa

SEQ ID NO: 3882264 - DNA, 16 bp, Homo sapiens
cccttttacagctctt

SEQ ID NO: 3882265 - DNA, 22 bp, Homo sapiens
cccttttctttttcccttgaac

SEQ ID NO: 3882266 - DNA, 16 bp, Homo sapiens
ccgaagcccaggctga

SEQ ID NO: 3882267 - DNA, 17 bp, Homo sapiens
ccgaagcccaggctgaa

SEQ ID NO: 3882268 - DNA, 18 bp, Homo sapiens
ccgaagcccagtttccct

SEQ ID NO: 3882269 - DNA, 21 bp, Homo sapiens
ccgaagctaacagggaaggca

SEQ ID NO: 3882270 - DNA, 17 bp, Homo sapiens
ccgacagagagatgaag

SEQ ID NO: 3882271 - DNA, 13 bp, Homo sapiens
ccgacagcccagc

SEQ ID NO: 3882272 - DNA, 13 bp, Homo sapiens
ccgacagcctggc

SEQ ID NO: 3882273 - DNA, 15 bp, Homo sapiens
ccgacagcctggcac

SEQ ID NO: 3882274 - DNA, 15 bp, Homo sapiens
ccgaccacctgccca

SEQ ID NO: 3882275 - DNA, 13 bp, Homo sapiens
ccgagagaggcgc

SEQ ID NO: 3882276 - DNA, 13 bp, Homo sapiens
ccgagagcctgct

SEQ ID NO: 3882277 - DNA, 16 bp, Homo sapiens
ccgagattgcgccact

SEQ ID NO: 3882278 - DNA, 20 bp, Homo sapiens
ccgagcaaagtctaaagttt

SEQ ID NO: 3882279 - DNA, 12 bp, Homo sapiens
ccgagcagctga

SEQ ID NO: 3882280 - DNA, 14 bp, Homo sapiens
ccgagcagctgagc

SEQ ID NO: 3882281 - DNA, 16 bp, Homo sapiens
ccgagccgggcctggg

SEQ ID NO: 3882282 - DNA, 12 bp, Homo sapiens
ccgagggcctga

SEQ ID NO: 3882283 - DNA, 16 bp, Homo sapiens
ccgagtctcttctcca

SEQ ID NO: 3882284 - DNA, 18 bp, Homo sapiens
ccgcaagcgcagggagga

SEQ ID NO: 3882285 - DNA, 22 bp, Homo sapiens
ccgcaagttcagggaagcaggc

SEQ ID NO: 3882286 - DNA, 13 bp, Homo sapiens
ccgcaccagctgc

SEQ ID NO: 3882287 - DNA, 17 bp, Homo sapiens
ccgcaccagctgctctg

SEQ ID NO: 3882288 - DNA, 19 bp, Homo sapiens
cccgtgtccccggcctcag

SEQ ID NO: 3882289 - DNA, 17 bp, Homo sapiens
cccgttctgctggcctg

SEQ ID NO: 3882290 - DNA, 15 bp, Homo sapiens
ccctaaccaaatgct

SEQ ID NO: 3882291 - DNA, 18 bp, Homo sapiens
ccctaagagagcacctgg

SEQ ID NO: 3882292 - DNA, 14 bp, Homo sapiens
ccctaatcctccaa

SEQ ID NO: 3882293 - DNA, 13 bp, Homo sapiens
ccctacatcttca

SEQ ID NO: 3882294 - DNA, 18 bp, Homo sapiens
ccctacccactctttgct

SEQ ID NO: 3882295 - DNA, 14 bp, Homo sapiens
ccctacctgtgcct

SEQ ID NO: 3882296 - DNA, 18 bp, Homo sapiens
ccctacttcttttgctct

SEQ ID NO: 3882297 - DNA, 18 bp, Homo sapiens
ccctatagagagggggct

SEQ ID NO: 3882298 - DNA, 14 bp, Homo sapiens
ccctatccacccag

SEQ ID NO: 3882299 - DNA, 16 bp, Homo sapiens
ccctatccacccagcc

SEQ ID NO: 3882300 - DNA, 15 bp, Homo sapiens
ccctattccctaact

SEQ ID NO: 3882301 - DNA, 18 bp, Homo sapiens
ccctcaaatgtcagagct

SEQ ID NO: 3882302 - DNA, 14 bp, Homo sapiens
ccctcaccccaagg

SEQ ID NO: 3882303 - DNA, 21 bp, Homo sapiens
ccctcacccccaggtgttgcc

SEQ ID NO: 3882304 - DNA, 14 bp, Homo sapiens
ccctcagcccttgc

SEQ ID NO: 3882305 - DNA, 19 bp, Homo sapiens
ccctcagcccttgccccca

SEQ ID NO: 3882306 - DNA, 12 bp, Homo sapiens
ccctcagggatc

SEQ ID NO: 3882307 - DNA, 22 bp, Homo sapiens
ccctcagggatcttgcattccc

SEQ ID NO: 3882308 - DNA, 22 bp, Homo sapiens
ccctcagtcagttcccggagca

SEQ ID NO: 3882309 - DNA, 22 bp, Homo sapiens
ccctcattccaccttcccatgc

SEQ ID NO: 3882310 - DNA, 14 bp, Homo sapiens
ccctcattcccctc

SEQ ID NO: 3882311 - DNA, 15 bp, Homo sapiens
ccctcattcccctcg

SEQ ID NO: 3882312 - DNA, 11 bp, Homo sapiens
ccctcattttt

SEQ ID NO: 3882313 - DNA, 19 bp, Homo sapiens
ccctccaccgcagaaggaa

SEQ ID NO: 3882314 - DNA, 17 bp, Homo sapiens
ccctccacgcctcctgg

SEQ ID NO: 3882315 - DNA, 12 bp, Homo sapiens
ccctccactgtc

SEQ ID NO: 3882316 - DNA, 18 bp, Homo sapiens
ccctccagaccctgcctg

SEQ ID NO: 3882317 - DNA, 21 bp, Homo sapiens
ccctccagagacaggaaagaa

SEQ ID NO: 3882318 - DNA, 22 bp, Homo sapiens
ccctccaggcatgctggcctcc

SEQ ID NO: 3882319 - DNA, 13 bp, Homo sapiens
ccctccatgggct

SEQ ID NO: 3882320 - DNA, 21 bp, Homo sapiens
ccctccatgtggccccaggtg

SEQ ID NO: 3882321 - DNA, 23 bp, Homo sapiens
ccctccatgtggccccaggtgcc

SEQ ID NO: 3882322 - DNA, 12 bp, Homo sapiens
ccctcccaacct

SEQ ID NO: 3882323 - DNA, 18 bp, Homo sapiens
ccctcccaacctcaatgc

SEQ ID NO: 3882324 - DNA, 21 bp, Homo sapiens
ccctccccaaacccatcagac

SEQ ID NO: 3882325 - DNA, 14 bp, Homo sapiens
ccctccccagccct

SEQ ID NO: 3882326 - DNA, 12 bp, Homo sapiens
ccctccccaggg

SEQ ID NO: 3882327 - DNA, 15 bp, Homo sapiens
ccctcccccttcccc

SEQ ID NO: 3882328 - DNA, 20 bp, Homo sapiens
ccctccctgactccctgtgg

SEQ ID NO: 3882329 - DNA, 21 bp, Homo sapiens
ccctccctggcatgtcagagc

SEQ ID NO: 3882330 - DNA, 13 bp, Homo sapiens
ccctcctcacccc

SEQ ID NO: 3882331 - DNA, 13 bp, Homo sapiens
ccctcctggagca

SEQ ID NO: 3882332 - DNA, 11 bp, Homo sapiens
ccctccttcca

SEQ ID NO: 3882333 - DNA, 12 bp, Homo sapiens
ccctccttccct

SEQ ID NO: 3882334 - DNA, 19 bp, Homo sapiens
ccctcgaaccaaggcagcc

SEQ ID NO: 3882335 - DNA, 21 bp, Homo sapiens
ccctcgaaccaaggcagcctc

SEQ ID NO: 3882336 - DNA, 14 bp, Homo sapiens
ccctcgctgctgct

SEQ ID NO: 3882337 - DNA, 22 bp, Homo sapiens
ccctcggaagccgtctgactcc

SEQ ID NO: 3882338 - DNA, 13 bp, Homo sapiens
ccctcggagaaga

SEQ ID NO: 3882339 - DNA, 13 bp, Homo sapiens
ccctcgtccacag

SEQ ID NO: 3882340 - DNA, 17 bp, Homo sapiens
ccctcgtggacacctgc

SEQ ID NO: 3882341 - DNA, 19 bp, Homo sapiens
ccctcgtggacacctgccc

SEQ ID NO: 3882342 - DNA, 22 bp, Homo sapiens
ccctcgtggacacctgccctgc

SEQ ID NO: 3882343 - DNA, 14 bp, Homo sapiens
ccctctcttcccta

SEQ ID NO: 3882344 - DNA, 14 bp, Homo sapiens
ccctctgccctgta

SEQ ID NO: 3882345 - DNA, 16 bp, Homo sapiens
ccctctgccctgtata

SEQ ID NO: 3882346 - DNA, 22 bp, Homo sapiens
ccctctggatcctgctgtggcc

SEQ ID NO: 3882347 - DNA, 22 bp, Homo sapiens
ccctctgtcatcactccctgga

SEQ ID NO: 3882348 - DNA, 18 bp, Homo sapiens
ccctctgttgccaggcta

SEQ ID NO: 3882349 - DNA, 14 bp, Homo sapiens
ccctcttccttccc

SEQ ID NO: 3882350 - DNA, 23 bp, Homo sapiens
ccctcttgaggtggtgccttctc

SEQ ID NO: 3882351 - DNA, 17 bp, Homo sapiens
ccctgaaaacccagaga

SEQ ID NO: 3882352 - DNA, 14 bp, Homo sapiens
ccctgaacaagaat

SEQ ID NO: 3882353 - DNA, 16 bp, Homo sapiens
ccctgaacctcagttt

SEQ ID NO: 3882354 - DNA, 19 bp, Homo sapiens
ccctgaacctcagtttcct

SEQ ID NO: 3882355 - DNA, 21 bp, Homo sapiens
ccctgaacctcagtttcctca

SEQ ID NO: 3882356 - DNA, 15 bp, Homo sapiens
ccctgacctcccagc

SEQ ID NO: 3882357 - DNA, 21 bp, Homo sapiens
ccctgacctcccagccctatg

SEQ ID NO: 3882358 - DNA, 22 bp, Homo sapiens
ccctgacctcccagccctatgg

SEQ ID NO: 3882359 - DNA, 18 bp, Homo sapiens
ccctgactccctgtgggg

SEQ ID NO: 3882360 - DNA, 18 bp, Homo sapiens
ccctgagatcagagtcct

SEQ ID NO: 3882361 - DNA, 14 bp, Homo sapiens
ccctgagcaggatt

SEQ ID NO: 3882362 - DNA, 13 bp, Homo sapiens
ccctgaggactgg

SEQ ID NO: 3882363 - DNA, 14 bp, Homo sapiens
ccctgaggactgga

SEQ ID NO: 3882364 - DNA, 18 bp, Homo sapiens
ccctgaggagtctgaggt

SEQ ID NO: 3882365 - DNA, 21 bp, Homo sapiens
ccctgaggagtctgaggtcct

SEQ ID NO: 3882366 - DNA, 17 bp, Homo sapiens
ccctgagtcaccaggaa

SEQ ID NO: 3882367 - DNA, 23 bp, Homo sapiens
ccctgagtggatctccaaggacc

SEQ ID NO: 3882368 - DNA, 20 bp, Homo sapiens
ccctgatcaagtcaccggag

SEQ ID NO: 3882369 - DNA, 23 bp, Homo sapiens
ccctgcacaaagcccttccatgt

SEQ ID NO: 3882370 - DNA, 12 bp, Homo sapiens
ccctgcaccctg

SEQ ID NO: 3882371 - DNA, 13 bp, Homo sapiens
ccctgcaccctgg

SEQ ID NO: 3882372 - DNA, 16 bp, Homo sapiens
ccctgcagaccctgcc

SEQ ID NO: 3882373 - DNA, 19 bp, Homo sapiens
ccctgcagaccctgccctt

SEQ ID NO: 3882374 - DNA, 22 bp, Homo sapiens
ccctgcagcttgtagccagccg

SEQ ID NO: 3882375 - DNA, 13 bp, Homo sapiens
ccctgcatcccct

SEQ ID NO: 3882376 - DNA, 15 bp, Homo sapiens
ccctgccacctgtct

SEQ ID NO: 3882377 - DNA, 13 bp, Homo sapiens
ccctgccaggagg

SEQ ID NO: 3882378 - DNA, 14 bp, Homo sapiens
ccctgccaggaggc

SEQ ID NO: 3882379 - DNA, 14 bp, Homo sapiens
ccctgccagtgcct

SEQ ID NO: 3882380 - DNA, 15 bp, Homo sapiens
ccctgcccatacccc

SEQ ID NO: 3882381 - DNA, 14 bp, Homo sapiens
ccctgcccccaaag

SEQ ID NO: 3882382 - DNA, 15 bp, Homo sapiens
ccctgcccccaaagg

SEQ ID NO: 3882383 - DNA, 13 bp, Homo sapiens
ccctgcccccatc

SEQ ID NO: 3882384 - DNA, 15 bp, Homo sapiens
ccctgcccccatctc

SEQ ID NO: 3882385 - DNA, 20 bp, Homo sapiens
ccctgcccccatctccccag

SEQ ID NO: 3882386 - DNA, 22 bp, Homo sapiens
ccctgcccccatctccccaggc

SEQ ID NO: 3882387 - DNA, 17 bp, Homo sapiens
ccctgcccctcccttca

SEQ ID NO: 3882388 - DNA, 23 bp, Homo sapiens
ccctgcccttgtttggggcagga

SEQ ID NO: 3882389 - DNA, 13 bp, Homo sapiens
ccctgccgcctca

SEQ ID NO: 3882390 - DNA, 11 bp, Homo sapiens
ccctgcctgca

SEQ ID NO: 3882391 - DNA, 18 bp, Homo sapiens
ccctgcctggaggacctg

SEQ ID NO: 3882392 - DNA, 21 bp, Homo sapiens
ccctgcctggaggacctgagc

SEQ ID NO: 3882393 - DNA, 23 bp, Homo sapiens
ccctgcctggaggacctgagcct

SEQ ID NO: 3882394 - DNA, 13 bp, Homo sapiens
ccctgcctgggtt

SEQ ID NO: 3882395 - DNA, 21 bp, Homo sapiens
ccctgcctgggttttctaact

SEQ ID NO: 3882396 - DNA, 17 bp, Homo sapiens
ccctgcgttggagccac

SEQ ID NO: 3882397 - DNA, 20 bp, Homo sapiens
ccctgcgttggagccactcc

SEQ ID NO: 3882398 - DNA, 10 bp, Homo sapiens
ccctgctcct

SEQ ID NO: 3882399 - DNA, 12 bp, Homo sapiens
ccctgctcctcc

SEQ ID NO: 3882400 - DNA, 19 bp, Homo sapiens
ccctgctgccgcctcccag

SEQ ID NO: 3882401 - DNA, 15 bp, Homo sapiens
ccctgctgctcatcc

SEQ ID NO: 3882402 - DNA, 13 bp, Homo sapiens
ccctgctgtggga

SEQ ID NO: 3882403 - DNA, 13 bp, Homo sapiens
ccctgcttacctg

SEQ ID NO: 3882404 - DNA, 23 bp, Homo sapiens
ccctgctttgggctgccctggtg

SEQ ID NO: 3882405 - DNA, 22 bp, Homo sapiens
ccctggaattcagcaccctggg

SEQ ID NO: 3882406 - DNA, 13 bp, Homo sapiens
ccctggagagaag

SEQ ID NO: 3882407 - DNA, 20 bp, Homo sapiens
ccctggagtcccctgggcct

SEQ ID NO: 3882408 - DNA, 22 bp, Homo sapiens
ccctggagtcccctgggcctgg

SEQ ID NO: 3882409 - DNA, 16 bp, Homo sapiens
ccctggatcagcgtgg

SEQ ID NO: 3882410 - DNA, 19 bp, Homo sapiens
ccctggatcagcgtggcct

SEQ ID NO: 3882411 - DNA, 20 bp, Homo sapiens
ccctggatcagcgtggcctt

SEQ ID NO: 3882412 - DNA, 19 bp, Homo sapiens
ccctggatccatcaggcca

SEQ ID NO: 3882413 - DNA, 15 bp, Homo sapiens
ccctggatgggcatt

SEQ ID NO: 3882414 - DNA, 21 bp, Homo sapiens
ccctggatgtcccctgtccca

SEQ ID NO: 3882415 - DNA, 22 bp, Homo sapiens
ccctggatgtcccctgtcccac

SEQ ID NO: 3882416 - DNA, 19 bp, Homo sapiens
ccctggatgtgtggggcat

SEQ ID NO: 3882417 - DNA, 13 bp, Homo sapiens
ccctggccctgcc

SEQ ID NO: 3882418 - DNA, 22 bp, Homo sapiens
ccctggcctgctgggctctcca

SEQ ID NO: 3882419 - DNA, 17 bp, Homo sapiens
ccctggctcccacaggc

SEQ ID NO: 3882420 - DNA, 19 bp, Homo sapiens
ccctggctcccacaggccc

SEQ ID NO: 3882421 - DNA, 20 bp, Homo sapiens
ccctggctcccacaggccct

SEQ ID NO: 3882422 - DNA, 13 bp, Homo sapiens
ccctggcttttca

SEQ ID NO: 3882423 - DNA, 17 bp, Homo sapiens
ccctggcttttcactgc

SEQ ID NO: 3882424 - DNA, 18 bp, Homo sapiens
ccctggcttttcactgct

SEQ ID NO: 3882425 - DNA, 18 bp, Homo sapiens
ccctgggccccaccacct

SEQ ID NO: 3882426 - DNA, 14 bp, Homo sapiens
ccctgggcccctcc

SEQ ID NO: 3882427 - DNA, 19 bp, Homo sapiens
ccctgggcccctccacgcc

SEQ ID NO: 3882428 - DNA, 14 bp, Homo sapiens
ccctgggcctcagt

SEQ ID NO: 3882429 - DNA, 11 bp, Homo sapiens
ccctgggcctg

SEQ ID NO: 3882430 - DNA, 17 bp, Homo sapiens
ccctgggcctgctgctg

SEQ ID NO: 3882431 - DNA, 19 bp, Homo sapiens
ccctgggcctgctgctgag

SEQ ID NO: 3882432 - DNA, 20 bp, Homo sapiens
ccctgggcctgctgctgaga

SEQ ID NO: 3882433 - DNA, 18 bp, Homo sapiens
ccctgggctgtctgtcac

SEQ ID NO: 3882434 - DNA, 12 bp, Homo sapiens
ccctggggcctg

SEQ ID NO: 3882435 - DNA, 22 bp, Homo sapiens
ccctggggcctgtactgcctgc

SEQ ID NO: 3882436 - DNA, 18 bp, Homo sapiens
ccctggggcttctcctga

SEQ ID NO: 3882437 - DNA, 21 bp, Homo sapiens
ccctggggcttctcctgaccc

SEQ ID NO: 3882438 - DNA, 18 bp, Homo sapiens
ccctgggggaagccctgg

SEQ ID NO: 3882439 - DNA, 21 bp, Homo sapiens
ccctgggggccagctggtgct

SEQ ID NO: 3882440 - DNA, 23 bp, Homo sapiens
ccctgggggccagctggtgctgc

SEQ ID NO: 3882441 - DNA, 15 bp, Homo sapiens
ccctgggtaactgtc

SEQ ID NO: 3882442 - DNA, 15 bp, Homo sapiens
ccctggtgcagaggt

SEQ ID NO: 3882443 - DNA, 14 bp, Homo sapiens
ccctggtgctgcca

SEQ ID NO: 3882444 - DNA, 16 bp, Homo sapiens
ccctggtgctgccaca

SEQ ID NO: 3882445 - DNA, 21 bp, Homo sapiens
ccctggtgctgccacacttca

SEQ ID NO: 3882446 - DNA, 19 bp, Homo sapiens
ccctggttatattctcacg

SEQ ID NO: 3882447 - DNA, 16 bp, Homo sapiens
ccctgtagctctgcct

SEQ ID NO: 3882448 - DNA, 18 bp, Homo sapiens
ccctgtagctctgcctcc

SEQ ID NO: 3882449 - DNA, 14 bp, Homo sapiens
ccctgtcagaggct

SEQ ID NO: 3882450 - DNA, 12 bp, Homo sapiens
ccctgtcccacc

SEQ ID NO: 3882451 - DNA, 16 bp, Homo sapiens
ccctgtcccaccaact

SEQ ID NO: 3882452 - DNA, 18 bp, Homo sapiens
ccctgtcccaccaactct

SEQ ID NO: 3882453 - DNA, 20 bp, Homo sapiens
ccctgtcccaccaactctgc

SEQ ID NO: 3882454 - DNA, 24 bp, Homo sapiens
ccctgtcccaccaactctgcactc

SEQ ID NO: 3882455 - DNA, 14 bp, Homo sapiens
ccctgtcctcctcg

SEQ ID NO: 3882456 - DNA, 16 bp, Homo sapiens
ccctgtcctcctcgga

SEQ ID NO: 3882457 - DNA, 16 bp, Homo sapiens
ccctgtcgagacactt

SEQ ID NO: 3882458 - DNA, 11 bp, Homo sapiens
ccctgtgccag

SEQ ID NO: 3882459 - DNA, 15 bp, Homo sapiens
ccctgtgccagctca

SEQ ID NO: 3882460 - DNA, 12 bp, Homo sapiens
ccccaaagcccc

SEQ ID NO: 3882461 - DNA, 22 bp, Homo sapiens
ccccaaccccgcggtgctctgg

SEQ ID NO: 3882462 - DNA, 16 bp, Homo sapiens
ccccaactccttccag

SEQ ID NO: 3882463 - DNA, 16 bp, Homo sapiens
ccccaagcagccagcc

SEQ ID NO: 3882464 - DNA, 18 bp, Homo sapiens
ccccaagcagccagccag

SEQ ID NO: 3882465 - DNA, 15 bp, Homo sapiens
ccccaagcctctgcc

SEQ ID NO: 3882466 - DNA, 16 bp, Homo sapiens
ccccaagcctctgccc

SEQ ID NO: 3882467 - DNA, 18 bp, Homo sapiens
ccccaagcctctgcccca

SEQ ID NO: 3882468 - DNA, 12 bp, Homo sapiens
ccccaagggaca

SEQ ID NO: 3882469 - DNA, 19 bp, Homo sapiens
ccccacagcacccaggctc

SEQ ID NO: 3882470 - DNA, 12 bp, Homo sapiens
ccccaccccctt

SEQ ID NO: 3882471 - DNA, 14 bp, Homo sapiens
ccccacctcttcct

SEQ ID NO: 3882472 - DNA, 17 bp, Homo sapiens
ccccaccttccccagac

SEQ ID NO: 3882473 - DNA, 21 bp, Homo sapiens
ccccacctttaagtcctctct

SEQ ID NO: 3882474 - DNA, 23 bp, Homo sapiens
ccccacgagtcacctgcaagccc

SEQ ID NO: 3882475 - DNA, 13 bp, Homo sapiens
ccccactccagcc

SEQ ID NO: 3882476 - DNA, 15 bp, Homo sapiens
ccccactccagccct

SEQ ID NO: 3882477 - DNA, 17 bp, Homo sapiens
ccccactccagccctgt

SEQ ID NO: 3882478 - DNA, 19 bp, Homo sapiens
ccccactctgctctgatgc

SEQ ID NO: 3882479 - DNA, 12 bp, Homo sapiens
ccccactgcagg

SEQ ID NO: 3882480 - DNA, 16 bp, Homo sapiens
ccccactgcaggcccc

SEQ ID NO: 3882481 - DNA, 21 bp, Homo sapiens
ccccactttcctacaaaatgg

SEQ ID NO: 3882482 - DNA, 22 bp, Homo sapiens
ccccactttcctacaaaatgga

SEQ ID NO: 3882483 - DNA, 21 bp, Homo sapiens
ccccagacacattctcctgtg

SEQ ID NO: 3882484 - DNA, 11 bp, Homo sapiens
ccccagagacc

SEQ ID NO: 3882485 - DNA, 21 bp, Homo sapiens
ccccagagaccttttctctcc

SEQ ID NO: 3882486 - DNA, 18 bp, Homo sapiens
ccccagaggcctctctct

SEQ ID NO: 3882487 - DNA, 16 bp, Homo sapiens
ccccagatctgcctgg

SEQ ID NO: 3882488 - DNA, 12 bp, Homo sapiens
ccccagcactga

SEQ ID NO: 3882489 - DNA, 23 bp, Homo sapiens
ccccagcagttgaatgacaacag

SEQ ID NO: 3882490 - DNA, 13 bp, Homo sapiens
ccccagccctggc

SEQ ID NO: 3882491 - DNA, 16 bp, Homo sapiens
ccccagccctggctct

SEQ ID NO: 3882492 - DNA, 15 bp, Homo sapiens
ccccagcccttctgc

SEQ ID NO: 3882493 - DNA, 15 bp, Homo sapiens
ccccagcctgacaaa

SEQ ID NO: 3882494 - DNA, 13 bp, Homo sapiens
ccccagcctgggc

SEQ ID NO: 3882495 - DNA, 15 bp, Homo sapiens
ccccagcctgggcct

SEQ ID NO: 3882496 - DNA, 23 bp, Homo sapiens
ccccagcgcggcttggccgccat

SEQ ID NO: 3882497 - DNA, 12 bp, Homo sapiens
ccccaggccagg

SEQ ID NO: 3882498 - DNA, 15 bp, Homo sapiens
ccccaggccctccct

SEQ ID NO: 3882499 - DNA, 17 bp, Homo sapiens
ccccaggcctccagcct

SEQ ID NO: 3882500 - DNA, 23 bp, Homo sapiens
ccccagggacaaaacactgtgtc

SEQ ID NO: 3882501 - DNA, 15 bp, Homo sapiens
ccccagggcacagga

SEQ ID NO: 3882502 - DNA, 18 bp, Homo sapiens
ccccagggcacaggagct

SEQ ID NO: 3882503 - DNA, 21 bp, Homo sapiens
ccccagggcccctccctctgc

SEQ ID NO: 3882504 - DNA, 13 bp, Homo sapiens
ccccagggttgaa

SEQ ID NO: 3882505 - DNA, 17 bp, Homo sapiens
ccccaggtgccaccaat

SEQ ID NO: 3882506 - DNA, 13 bp, Homo sapiens
ccccaggtggctg

SEQ ID NO: 3882507 - DNA, 23 bp, Homo sapiens
ccccaggtggctgacccagtccc

SEQ ID NO: 3882508 - DNA, 11 bp, Homo sapiens
ccccagtccca

SEQ ID NO: 3882509 - DNA, 14 bp, Homo sapiens
ccccagtgccacag

SEQ ID NO: 3882510 - DNA, 20 bp, Homo sapiens
ccccagtgccacagagaaga

SEQ ID NO: 3882511 - DNA, 19 bp, Homo sapiens
ccccagttctgctcctctc

SEQ ID NO: 3882512 - DNA, 12 bp, Homo sapiens
ccccatccctcg

SEQ ID NO: 3882513 - DNA, 16 bp, Homo sapiens
ccccatctccccaggc

SEQ ID NO: 3882514 - DNA, 17 bp, Homo sapiens
ccccatctccccaggcc

SEQ ID NO: 3882515 - DNA, 18 bp, Homo sapiens
ccccatctccccaggcct

SEQ ID NO: 3882516 - DNA, 20 bp, Homo sapiens
ccccatctccccaggcctcc

SEQ ID NO: 3882517 - DNA, 15 bp, Homo sapiens
ccccatgacctccag

SEQ ID NO: 3882518 - DNA, 15 bp, Homo sapiens
ccccatgggcttgga

SEQ ID NO: 3882519 - DNA, 17 bp, Homo sapiens
ccccatgggcttggact

SEQ ID NO: 3882520 - DNA, 22 bp, Homo sapiens
ccccatgggcttggacttcctg

SEQ ID NO: 3882521 - DNA, 16 bp, Homo sapiens
ccccattcttcctagt

SEQ ID NO: 3882522 - DNA, 13 bp, Homo sapiens
cccccaagcctct

SEQ ID NO: 3882523 - DNA, 19 bp, Homo sapiens
cccccaagctgttttcttc

SEQ ID NO: 3882524 - DNA, 18 bp, Homo sapiens
cccccaaggttttggagt

SEQ ID NO: 3882525 - DNA, 23 bp, Homo sapiens
cccccacccctaacctggcttat

SEQ ID NO: 3882526 - DNA, 18 bp, Homo sapiens
cccccacctttctcgctg

SEQ ID NO: 3882527 - DNA, 20 bp, Homo sapiens
cccccatctccccaggcctc

SEQ ID NO: 3882528 - DNA, 14 bp, Homo sapiens
cccccgctccagat

SEQ ID NO: 3882529 - DNA, 12 bp, Homo sapiens
ccccctccaggc

SEQ ID NO: 3882530 - DNA, 15 bp, Homo sapiens
ccccctccttgctct

SEQ ID NO: 3882531 - DNA, 14 bp, Homo sapiens
ccccctgcagcttg

SEQ ID NO: 3882532 - DNA, 14 bp, Homo sapiens
ccccctgccagtgc

SEQ ID NO: 3882533 - DNA, 23 bp, Homo sapiens
ccccctggggcttctcctgaccc

SEQ ID NO: 3882534 - DNA, 14 bp, Homo sapiens
cccccttcagtgcc

SEQ ID NO: 3882535 - DNA, 23 bp, Homo sapiens
cccccttcagtgcccaccaacat

SEQ ID NO: 3882536 - DNA, 23 bp, Homo sapiens
cccccttgaatctgcagggagca

SEQ ID NO: 3882537 - DNA, 18 bp, Homo sapiens
ccccgacactgctgcacc

SEQ ID NO: 3882538 - DNA, 12 bp, Homo sapiens
ccccgcagtccc

SEQ ID NO: 3882539 - DNA, 15 bp, Homo sapiens
ccccgcagtccccag

SEQ ID NO: 3882540 - DNA, 19 bp, Homo sapiens
ccccgcagtccccagccct

SEQ ID NO: 3882541 - DNA, 21 bp, Homo sapiens
ccccgcagtccccagcccttc

SEQ ID NO: 3882542 - DNA, 14 bp, Homo sapiens
ccccgccacggcca

SEQ ID NO: 3882543 - DNA, 13 bp, Homo sapiens
ccccgctccagat

SEQ ID NO: 3882544 - DNA, 17 bp, Homo sapiens
ccccgcttgtccagcgc

SEQ ID NO: 3882545 - DNA, 14 bp, Homo sapiens
ccccggcctcagca

SEQ ID NO: 3882546 - DNA, 12 bp, Homo sapiens
ccccggggctgg

SEQ ID NO: 3882547 - DNA, 13 bp, Homo sapiens
ccccggggctggc

SEQ ID NO: 3882548 - DNA, 17 bp, Homo sapiens
ccccgggggaggaaggg

SEQ ID NO: 3882549 - DNA, 17 bp, Homo sapiens
ccccgggtgcctcagag

SEQ ID NO: 3882550 - DNA, 20 bp, Homo sapiens
ccccgtctggggttcagccc

SEQ ID NO: 3882551 - DNA, 12 bp, Homo sapiens
ccccgtgtggct

SEQ ID NO: 3882552 - DNA, 18 bp, Homo sapiens
cccctaagagagcacctg

SEQ ID NO: 3882553 - DNA, 20 bp, Homo sapiens
cccctagtgctattctgtgt

SEQ ID NO: 3882554 - DNA, 19 bp, Homo sapiens
cccctatccacccagccca

SEQ ID NO: 3882555 - DNA, 17 bp, Homo sapiens
cccctcacctgggcctt

SEQ ID NO: 3882556 - DNA, 14 bp, Homo sapiens
cccctcactctggc

SEQ ID NO: 3882557 - DNA, 15 bp, Homo sapiens
cccctcactctgtca

SEQ ID NO: 3882558 - DNA, 15 bp, Homo sapiens
cccctcagcccttgc

SEQ ID NO: 3882559 - DNA, 14 bp, Homo sapiens
cccctccactgtca

SEQ ID NO: 3882560 - DNA, 17 bp, Homo sapiens
cccctccagaccctgcc

SEQ ID NO: 3882561 - DNA, 23 bp, Homo sapiens
cccctccagaccctgcctgagcc

SEQ ID NO: 3882562 - DNA, 11 bp, Homo sapiens
cccctccagct

SEQ ID NO: 3882563 - DNA, 19 bp, Homo sapiens
cccctccctcctctggccc

SEQ ID NO: 3882564 - DNA, 15 bp, Homo sapiens
cccctcggagaagag

SEQ ID NO: 3882565 - DNA, 23 bp, Homo sapiens
cccctcgtgtgactctcttggat

SEQ ID NO: 3882566 - DNA, 13 bp, Homo sapiens
cccctgaggactg

SEQ ID NO: 3882567 - DNA, 15 bp, Homo sapiens
cccctgaggactgga

SEQ ID NO: 3882568 - DNA, 14 bp, Homo sapiens
cccctgccagtgcc

SEQ ID NO: 3882569 - DNA, 22 bp, Homo sapiens
cccctgcccgaccccatctcat

SEQ ID NO: 3882570 - DNA, 13 bp, Homo sapiens
cccctgccctgct

SEQ ID NO: 3882571 - DNA, 16 bp, Homo sapiens
cccctgctgctcatcc

SEQ ID NO: 3882572 - DNA, 15 bp, Homo sapiens
cccctggagagaagt

SEQ ID NO: 3882573 - DNA, 22 bp, Homo sapiens
cccctggatgggcattgggctg

SEQ ID NO: 3882574 - DNA, 22 bp, Homo sapiens
cccctggatgtcccctgtccca

SEQ ID NO: 3882575 - DNA, 22 bp, Homo sapiens
cccctggggtctctgctgcatt

SEQ ID NO: 3882576 - DNA, 17 bp, Homo sapiens
cccctgtacccagctcc

SEQ ID NO: 3882577 - DNA, 11 bp, Homo sapiens
cccctgtccca

SEQ ID NO: 3882578 - DNA, 12 bp, Homo sapiens
cccctgtcccac

SEQ ID NO: 3882579 - DNA, 21 bp, Homo sapiens
cccctgtcccaccaactctgc

SEQ ID NO: 3882580 - DNA, 20 bp, Homo sapiens
cccctgtcttctctcaaagg

SEQ ID NO: 3882581 - DNA, 13 bp, Homo sapiens
cccctgtgccagc

SEQ ID NO: 3882582 - DNA, 14 bp, Homo sapiens
cccctgtgccagct

SEQ ID NO: 3882583 - DNA, 16 bp, Homo sapiens
cccctgtgccagctca

SEQ ID NO: 3882584 - DNA, 15 bp, Homo sapiens
cccctgttcactcta

SEQ ID NO: 3882585 - DNA, 13 bp, Homo sapiens
ccccttcagtgcc

SEQ ID NO: 3882586 - DNA, 16 bp, Homo sapiens
ccccttccccatctcc

SEQ ID NO: 3882587 - DNA, 12 bp, Homo sapiens
ccccttcctgtc

SEQ ID NO: 3882588 - DNA, 22 bp, Homo sapiens
ccccttcctgtcccacctcttc

SEQ ID NO: 3882589 - DNA, 15 bp, Homo sapiens
ccccttcctttcctc

SEQ ID NO: 3882590 - DNA, 23 bp, Homo sapiens
ccccttcctttcctctgcagcac

SEQ ID NO: 3882591 - DNA, 24 bp, Homo sapiens
ccccttgcccttgccctgacctcc

SEQ ID NO: 3882592 - DNA, 16 bp, Homo sapiens
ccccttgggcatccac

SEQ ID NO: 3882593 - DNA, 23 bp, Homo sapiens
ccccttgggcatccacccagtgc

SEQ ID NO: 3882594 - DNA, 14 bp, Homo sapiens
ccccttttgcctgg

SEQ ID NO: 3882595 - DNA, 22 bp, Homo sapiens
cccgaaggttatggtcaatccc

SEQ ID NO: 3882596 - DNA, 13 bp, Homo sapiens
cccgaatgcctgt

SEQ ID NO: 3882597 - DNA, 15 bp, Homo sapiens
cccgacagcctggca

SEQ ID NO: 3882598 - DNA, 14 bp, Homo sapiens
cccgaccccatctc

SEQ ID NO: 3882599 - DNA, 21 bp, Homo sapiens
cccgagaacatggcctaaggg

SEQ ID NO: 3882600 - DNA, 12 bp, Homo sapiens
cccgagcagctg

SEQ ID NO: 3882601 - DNA, 13 bp, Homo sapiens
cccgagcagctga

SEQ ID NO: 3882602 - DNA, 13 bp, Homo sapiens
cccgagcccagct

SEQ ID NO: 3882603 - DNA, 15 bp, Homo sapiens
cccgccacggccacc

SEQ ID NO: 3882604 - DNA, 13 bp, Homo sapiens
cccgccagcctca

SEQ ID NO: 3882605 - DNA, 14 bp, Homo sapiens
cccgccagcctcag

SEQ ID NO: 3882606 - DNA, 19 bp, Homo sapiens
cccgcccctcgctgctgct

SEQ ID NO: 3882607 - DNA, 13 bp, Homo sapiens
cccgcctgtcctg

SEQ ID NO: 3882608 - DNA, 14 bp, Homo sapiens
cccgcgggcctgga

SEQ ID NO: 3882609 - DNA, 19 bp, Homo sapiens
cccgctcagccctccctgc

SEQ ID NO: 3882610 - DNA, 14 bp, Homo sapiens
cccggagcacagcc

SEQ ID NO: 3882611 - DNA, 20 bp, Homo sapiens
cccggagcacagccctggga

SEQ ID NO: 3882612 - DNA, 17 bp, Homo sapiens
cccggaggggcctggca

SEQ ID NO: 3882613 - DNA, 21 bp, Homo sapiens
cccggagtaatcaggcagcct

SEQ ID NO: 3882614 - DNA, 11 bp, Homo sapiens
cccggcacccc

SEQ ID NO: 3882615 - DNA, 13 bp, Homo sapiens
cccggcaccccct

SEQ ID NO: 3882616 - DNA, 16 bp, Homo sapiens
cccggcaccccctgca

SEQ ID NO: 3882617 - DNA, 22 bp, Homo sapiens
cccggcccagagaccccttcct

SEQ ID NO: 3882618 - DNA, 15 bp, Homo sapiens
cccggcctcttccac

SEQ ID NO: 3882619 - DNA, 14 bp, Homo sapiens
cccggcgcggtggc

SEQ ID NO: 3882620 - DNA, 19 bp, Homo sapiens
cccggcgcggtggctcacg

SEQ ID NO: 3882621 - DNA, 19 bp, Homo sapiens
cccgggtgcctcagagcag

SEQ ID NO: 3882622 - DNA, 18 bp, Homo sapiens
cccgggtgtgcctgccct

SEQ ID NO: 3882623 - DNA, 18 bp, Homo sapiens
cccggtgcccaagaatag

SEQ ID NO: 3882624 - DNA, 14 bp, Homo sapiens
cccgtaatgcttag

SEQ ID NO: 3882625 - DNA, 15 bp, Homo sapiens
cccgtaggcagcctc

SEQ ID NO: 3882626 - DNA, 19 bp, Homo sapiens
cccgtaggcagcctctctg

SEQ ID NO: 3882627 - DNA, 18 bp, Homo sapiens
cccgtcatgttcctcaaa

SEQ ID NO: 3882628 - DNA, 12 bp, Homo sapiens
cccgtccctgcc

SEQ ID NO: 3882629 - DNA, 23 bp, Homo sapiens
cccgtctggggttcagcccctcc

SEQ ID NO: 3882630 - DNA, 20 bp, Homo sapiens
cccgtgaaagaattattttt

SEQ ID NO: 3882631 - DNA, 11 bp, Homo sapiens
cccgtgcagta

SEQ ID NO: 3882632 - DNA, 22 bp, Homo sapiens
cccgtgccaagtccaggtcctg

SEQ ID NO: 3882633 - DNA, 12 bp, Homo sapiens
cccgtggagggt

SEQ ID NO: 3882634 - DNA, 13 bp, Homo sapiens
cccaggccgttcc

SEQ ID NO: 3882635 - DNA, 21 bp, Homo sapiens
cccaggccgttccccttggct

SEQ ID NO: 3882636 - DNA, 16 bp, Homo sapiens
cccaggctccatgggg

SEQ ID NO: 3882637 - DNA, 19 bp, Homo sapiens
cccaggctccatggggaag

SEQ ID NO: 3882638 - DNA, 13 bp, Homo sapiens
cccaggctctggg

SEQ ID NO: 3882639 - DNA, 14 bp, Homo sapiens
cccaggctctggga

SEQ ID NO: 3882640 - DNA, 18 bp, Homo sapiens
cccaggctctgggaaggg

SEQ ID NO: 3882641 - DNA, 13 bp, Homo sapiens
cccaggctgcact

SEQ ID NO: 3882642 - DNA, 19 bp, Homo sapiens
cccaggctgcactgcagtg

SEQ ID NO: 3882643 - DNA, 19 bp, Homo sapiens
cccaggctggagtgcagtg

SEQ ID NO: 3882644 - DNA, 19 bp, Homo sapiens
cccagggacaagggaagga

SEQ ID NO: 3882645 - DNA, 21 bp, Homo sapiens
cccagggagcaatgggagggg

SEQ ID NO: 3882646 - DNA, 13 bp, Homo sapiens
cccagggcacagg

SEQ ID NO: 3882647 - DNA, 20 bp, Homo sapiens
cccagggcccctccctctgc

SEQ ID NO: 3882648 - DNA, 23 bp, Homo sapiens
cccagggcctgggggcagtgact

SEQ ID NO: 3882649 - DNA, 15 bp, Homo sapiens
cccagggctaccctc

SEQ ID NO: 3882650 - DNA, 21 bp, Homo sapiens
cccagggctccctcctggagc

SEQ ID NO: 3882651 - DNA, 22 bp, Homo sapiens
cccagggctccctcctggagca

SEQ ID NO: 3882652 - DNA, 13 bp, Homo sapiens
cccaggggagagg

SEQ ID NO: 3882653 - DNA, 15 bp, Homo sapiens
cccaggggagagggt

SEQ ID NO: 3882654 - DNA, 20 bp, Homo sapiens
cccaggtcctctgataccca

SEQ ID NO: 3882655 - DNA, 19 bp, Homo sapiens
cccaggtgccaccaataaa

SEQ ID NO: 3882656 - DNA, 13 bp, Homo sapiens
cccaggtgccagt

SEQ ID NO: 3882657 - DNA, 23 bp, Homo sapiens
cccaggtggctgacccagtccct

SEQ ID NO: 3882658 - DNA, 21 bp, Homo sapiens
cccagtcacctcttctgccag

SEQ ID NO: 3882659 - DNA, 12 bp, Homo sapiens
cccagtccctgg

SEQ ID NO: 3882660 - DNA, 14 bp, Homo sapiens
cccagtcctggcca

SEQ ID NO: 3882661 - DNA, 17 bp, Homo sapiens
cccagtctgttccccat

SEQ ID NO: 3882662 - DNA, 15 bp, Homo sapiens
cccagtgacctgacc

SEQ ID NO: 3882663 - DNA, 19 bp, Homo sapiens
cccagtgagattacagagg

SEQ ID NO: 3882664 - DNA, 14 bp, Homo sapiens
cccagtgccacaga

SEQ ID NO: 3882665 - DNA, 12 bp, Homo sapiens
cccagtgctgcc

SEQ ID NO: 3882666 - DNA, 17 bp, Homo sapiens
cccagtgctgccatgcc

SEQ ID NO: 3882667 - DNA, 18 bp, Homo sapiens
cccagtgctgccatgcca

SEQ ID NO: 3882668 - DNA, 21 bp, Homo sapiens
cccagtgctgccatgccactg

SEQ ID NO: 3882669 - DNA, 22 bp, Homo sapiens
cccagtgctgccatgccactgc

SEQ ID NO: 3882670 - DNA, 14 bp, Homo sapiens
cccagtgggacaga

SEQ ID NO: 3882671 - DNA, 18 bp, Homo sapiens
cccagtgggacagaggag

SEQ ID NO: 3882672 - DNA, 13 bp, Homo sapiens
cccagttctgctc

SEQ ID NO: 3882673 - DNA, 21 bp, Homo sapiens
cccagttctgctcctctccag

SEQ ID NO: 3882674 - DNA, 22 bp, Homo sapiens
cccagttctgctcctctccagg

SEQ ID NO: 3882675 - DNA, 22 bp, Homo sapiens
cccagtttgcagaaaagcacct

SEQ ID NO: 3882676 - DNA, 22 bp, Homo sapiens
cccagtttggctggttaattcc

SEQ ID NO: 3882677 - DNA, 20 bp, Homo sapiens
cccataatagttagccctca

SEQ ID NO: 3882678 - DNA, 16 bp, Homo sapiens
cccatacccctgcctg

SEQ ID NO: 3882679 - DNA, 17 bp, Homo sapiens
cccatacccctgcctgg

SEQ ID NO: 3882680 - DNA, 19 bp, Homo sapiens
cccatagaaacatgacact

SEQ ID NO: 3882681 - DNA, 21 bp, Homo sapiens
cccatagaaacatgacactga

SEQ ID NO: 3882682 - DNA, 17 bp, Homo sapiens
cccatagcgctggctca

SEQ ID NO: 3882683 - DNA, 20 bp, Homo sapiens
cccatagcgctggctcagga

SEQ ID NO: 3882684 - DNA, 21 bp, Homo sapiens
cccatcacctactcacacagg

SEQ ID NO: 3882685 - DNA, 12 bp, Homo sapiens
cccatcagcacc

SEQ ID NO: 3882686 - DNA, 21 bp, Homo sapiens
cccatcatatgacatgccacc

SEQ ID NO: 3882687 - DNA, 18 bp, Homo sapiens
cccatccatcagctccct

SEQ ID NO: 3882688 - DNA, 14 bp, Homo sapiens
cccatccccagcga

SEQ ID NO: 3882689 - DNA, 18 bp, Homo sapiens
cccatccccagcgattcc

SEQ ID NO: 3882690 - DNA, 12 bp, Homo sapiens
cccatccccttt

SEQ ID NO: 3882691 - DNA, 17 bp, Homo sapiens
cccatcccctttcctcc

SEQ ID NO: 3882692 - DNA, 23 bp, Homo sapiens
cccatcccctttcctccccacct

SEQ ID NO: 3882693 - DNA, 18 bp, Homo sapiens
cccatctaagctgcagct

SEQ ID NO: 3882694 - DNA, 21 bp, Homo sapiens
cccatctatgtcccttgctgt

SEQ ID NO: 3882695 - DNA, 17 bp, Homo sapiens
cccatctccccaggcct

SEQ ID NO: 3882696 - DNA, 22 bp, Homo sapiens
cccatctccccaggcctccagc

SEQ ID NO: 3882697 - DNA, 13 bp, Homo sapiens
cccatctcctccc

SEQ ID NO: 3882698 - DNA, 12 bp, Homo sapiens
cccatctcctga

SEQ ID NO: 3882699 - DNA, 15 bp, Homo sapiens
cccatcttcctgctg

SEQ ID NO: 3882700 - DNA, 16 bp, Homo sapiens
cccatcttcctgctgc

SEQ ID NO: 3882701 - DNA, 18 bp, Homo sapiens
cccatcttcctgctgctg

SEQ ID NO: 3882702 - DNA, 16 bp, Homo sapiens
cccatgacctccagct

SEQ ID NO: 3882703 - DNA, 15 bp, Homo sapiens
cccatgctctgcccc

SEQ ID NO: 3882704 - DNA, 14 bp, Homo sapiens
cccatgctgaatta

SEQ ID NO: 3882705 - DNA, 21 bp, Homo sapiens
cccatgggcttggacttcctg

SEQ ID NO: 3882706 - DNA, 23 bp, Homo sapiens
cccatgtatttatctctatttaa

SEQ ID NO: 3882707 - DNA, 23 bp, Homo sapiens
cccatgtgcatggaaatgtcctc

SEQ ID NO: 3882708 - DNA, 13 bp, Homo sapiens
cccatgtgccaag

SEQ ID NO: 3882709 - DNA, 23 bp, Homo sapiens
cccatgtttaaactttgtgcctt

SEQ ID NO: 3882710 - DNA, 23 bp, Homo sapiens
cccattctcatatgtagccctca

SEQ ID NO: 3882711 - DNA, 17 bp, Homo sapiens
cccattctctctcctgt

SEQ ID NO: 3882712 - DNA, 18 bp, Homo sapiens
cccattctctctcctgtc

SEQ ID NO: 3882713 - DNA, 19 bp, Homo sapiens
cccattctctctcctgtcc

SEQ ID NO: 3882714 - DNA, 21 bp, Homo sapiens
cccattgcatcacctctgtaa

SEQ ID NO: 3882715 - DNA, 17 bp, Homo sapiens
cccattttgagtgactc

SEQ ID NO: 3882716 - DNA, 23 bp, Homo sapiens
ccccaaacattaatcaccaaagt

SEQ ID NO: 3882717 - DNA, 14 bp, Homo sapiens
ccccaaaccagggt

SEQ ID NO: 3882718 - DNA, 19 bp, Homo sapiens
ccccaaagagcctggagaa

SEQ ID NO: 3882719 - DNA, 17 bp, Homo sapiens
ccatttcaactccagaa

SEQ ID NO: 3882720 - DNA, 16 bp, Homo sapiens
ccatttcacacaggtc

SEQ ID NO: 3882721 - DNA, 13 bp, Homo sapiens
ccatttcagagag

SEQ ID NO: 3882722 - DNA, 16 bp, Homo sapiens
ccatttgctttttcac

SEQ ID NO: 3882723 - DNA, 13 bp, Homo sapiens
ccatttgtactga

SEQ ID NO: 3882724 - DNA, 21 bp, Homo sapiens
ccattttatctttgaatggtc

SEQ ID NO: 3882725 - DNA, 16 bp, Homo sapiens
ccattttcttgcctga

SEQ ID NO: 3882726 - DNA, 21 bp, Homo sapiens
cccaaaacctttccccagaca

SEQ ID NO: 3882727 - DNA, 23 bp, Homo sapiens
cccaaaacctttccccagacaca

SEQ ID NO: 3882728 - DNA, 23 bp, Homo sapiens
cccaaacattaatcaccaaagta

SEQ ID NO: 3882729 - DNA, 23 bp, Homo sapiens
cccaaagaattcctgaagccaga

SEQ ID NO: 3882730 - DNA, 15 bp, Homo sapiens
cccaaagctcagact

SEQ ID NO: 3882731 - DNA, 14 bp, Homo sapiens
cccaaataaatgtg

SEQ ID NO: 3882732 - DNA, 17 bp, Homo sapiens
cccaaattggtgtttct

SEQ ID NO: 3882733 - DNA, 18 bp, Homo sapiens
cccaacctcaatgccctg

SEQ ID NO: 3882734 - DNA, 21 bp, Homo sapiens
cccaacctcaatgccctgcca

SEQ ID NO: 3882735 - DNA, 16 bp, Homo sapiens
cccaacctcctgacct

SEQ ID NO: 3882736 - DNA, 15 bp, Homo sapiens
cccaactcctggaag

SEQ ID NO: 3882737 - DNA, 16 bp, Homo sapiens
cccaactccttccagc

SEQ ID NO: 3882738 - DNA, 13 bp, Homo sapiens
cccaactgctctg

SEQ ID NO: 3882739 - DNA, 21 bp, Homo sapiens
cccaagaatagatgctgactg

SEQ ID NO: 3882740 - DNA, 18 bp, Homo sapiens
cccaagaggactgagact

SEQ ID NO: 3882741 - DNA, 15 bp, Homo sapiens
cccaagcagccagcc

SEQ ID NO: 3882742 - DNA, 15 bp, Homo sapiens
cccaagcctctgccc

SEQ ID NO: 3882743 - DNA, 22 bp, Homo sapiens
cccaagcctctgccccaagggg

SEQ ID NO: 3882744 - DNA, 18 bp, Homo sapiens
cccaagcctggtctcctc

SEQ ID NO: 3882745 - DNA, 19 bp, Homo sapiens
cccaagctgttttcttcta

SEQ ID NO: 3882746 - DNA, 14 bp, Homo sapiens
cccaaggagctgat

SEQ ID NO: 3882747 - DNA, 14 bp, Homo sapiens
cccaaggaggaaaa

SEQ ID NO: 3882748 - DNA, 17 bp, Homo sapiens
cccaaggctctgagcaa

SEQ ID NO: 3882749 - DNA, 17 bp, Homo sapiens
cccaagtgccatcccac

SEQ ID NO: 3882750 - DNA, 11 bp, Homo sapiens
cccaataaagc

SEQ ID NO: 3882751 - DNA, 17 bp, Homo sapiens
cccaatcagcactgaaa

SEQ ID NO: 3882752 - DNA, 16 bp, Homo sapiens
cccaatgcacatccat

SEQ ID NO: 3882753 - DNA, 16 bp, Homo sapiens
cccaatgctcctggag

SEQ ID NO: 3882754 - DNA, 22 bp, Homo sapiens
cccaatgctttgggaggccaag

SEQ ID NO: 3882755 - DNA, 24 bp, Homo sapiens
cccaatgctttgggaggccaaggc

SEQ ID NO: 3882756 - DNA, 12 bp, Homo sapiens
cccaatttaatt

SEQ ID NO: 3882757 - DNA, 13 bp, Homo sapiens
cccaatttatttt

SEQ ID NO: 3882758 - DNA, 14 bp, Homo sapiens
cccacaaaggggag

SEQ ID NO: 3882759 - DNA, 17 bp, Homo sapiens
cccacaaaggggagaag

SEQ ID NO: 3882760 - DNA, 23 bp, Homo sapiens
cccacaaaggggagaagggccag

SEQ ID NO: 3882761 - DNA, 14 bp, Homo sapiens
cccacacccctcca

SEQ ID NO: 3882762 - DNA, 23 bp, Homo sapiens
cccacacggaggcatctgcaccc

SEQ ID NO: 3882763 - DNA, 13 bp, Homo sapiens
cccacacgtgctc

SEQ ID NO: 3882764 - DNA, 18 bp, Homo sapiens
cccacacgtgctcgcagc

SEQ ID NO: 3882765 - DNA, 14 bp, Homo sapiens
cccacagcctctgg

SEQ ID NO: 3882766 - DNA, 20 bp, Homo sapiens
cccacagctcccaccccacc

SEQ ID NO: 3882767 - DNA, 16 bp, Homo sapiens
cccacaggcccttcct

SEQ ID NO: 3882768 - DNA, 18 bp, Homo sapiens
cccacaggcccttcctct

SEQ ID NO: 3882769 - DNA, 23 bp, Homo sapiens
cccacatattcacatacgtgtct

SEQ ID NO: 3882770 - DNA, 16 bp, Homo sapiens
cccacatcccaggctt

SEQ ID NO: 3882771 - DNA, 15 bp, Homo sapiens
cccacatccctgggc

SEQ ID NO: 3882772 - DNA, 18 bp, Homo sapiens
cccacatccctgggcctg

SEQ ID NO: 3882773 - DNA, 22 bp, Homo sapiens
cccacatccctgggcctgctgc

SEQ ID NO: 3882774 - DNA, 19 bp, Homo sapiens
cccacattcggaccctgcc

SEQ ID NO: 3882775 - DNA, 16 bp, Homo sapiens
cccaccaactctgcac

SEQ ID NO: 3882776 - DNA, 13 bp, Homo sapiens
cccaccacctagg

SEQ ID NO: 3882777 - DNA, 22 bp, Homo sapiens
cccaccaccttggactcctccc

SEQ ID NO: 3882778 - DNA, 20 bp, Homo sapiens
cccaccacgatgtggccctg

SEQ ID NO: 3882779 - DNA, 13 bp, Homo sapiens
cccaccccactcc

SEQ ID NO: 3882780 - DNA, 16 bp, Homo sapiens
cccaccccactccagc

SEQ ID NO: 3882781 - DNA, 17 bp, Homo sapiens
cccaccccactccagcc

SEQ ID NO: 3882782 - DNA, 19 bp, Homo sapiens
cccacccccttcagtgccc

SEQ ID NO: 3882783 - DNA, 21 bp, Homo sapiens
cccacccctaacctggcttat

SEQ ID NO: 3882784 - DNA, 20 bp, Homo sapiens
cccaccctcgtggacacctg

SEQ ID NO: 3882785 - DNA, 23 bp, Homo sapiens
cccaccgggccactccttcctgc

SEQ ID NO: 3882786 - DNA, 16 bp, Homo sapiens
cccacctcatgcctgg

SEQ ID NO: 3882787 - DNA, 20 bp, Homo sapiens
cccacctcatgcctggcccc

SEQ ID NO: 3882788 - DNA, 13 bp, Homo sapiens
cccacctcttcct

SEQ ID NO: 3882789 - DNA, 16 bp, Homo sapiens
cccacctcttccttcc

SEQ ID NO: 3882790 - DNA, 12 bp, Homo sapiens
cccacctgctga

SEQ ID NO: 3882791 - DNA, 16 bp, Homo sapiens
cccaccttgccaagct

SEQ ID NO: 3882792 - DNA, 20 bp, Homo sapiens
cccaccttgccaagctttct

SEQ ID NO: 3882793 - DNA, 20 bp, Homo sapiens
cccacctttaagtcctctct

SEQ ID NO: 3882794 - DNA, 19 bp, Homo sapiens
cccacgagtcacctgcaag

SEQ ID NO: 3882795 - DNA, 21 bp, Homo sapiens
cccacgtgagagaatctgcct

SEQ ID NO: 3882796 - DNA, 16 bp, Homo sapiens
cccactaagctttctc

SEQ ID NO: 3882797 - DNA, 19 bp, Homo sapiens
cccactaagctttctcctt

SEQ ID NO: 3882798 - DNA, 15 bp, Homo sapiens
cccactcaccagggt

SEQ ID NO: 3882799 - DNA, 17 bp, Homo sapiens
cccactccagccctgtc

SEQ ID NO: 3882800 - DNA, 20 bp, Homo sapiens
cccactccctggctctcaga

SEQ ID NO: 3882801 - DNA, 22 bp, Homo sapiens
cccactccctggctctcagaag

SEQ ID NO: 3882802 - DNA, 19 bp, Homo sapiens
cccactctcattccccagg

SEQ ID NO: 3882803 - DNA, 15 bp, Homo sapiens
cccactgcaggcccc

SEQ ID NO: 3882804 - DNA, 19 bp, Homo sapiens
cccactgcaggccccgctt

SEQ ID NO: 3882805 - DNA, 16 bp, Homo sapiens
cccactggactgggtt

SEQ ID NO: 3882806 - DNA, 23 bp, Homo sapiens
cccacttagccgtccatggcacc

SEQ ID NO: 3882807 - DNA, 13 bp, Homo sapiens
cccacttgtcatc

SEQ ID NO: 3882808 - DNA, 15 bp, Homo sapiens
cccacttgtcatcca

SEQ ID NO: 3882809 - DNA, 20 bp, Homo sapiens
cccagaaaaaaaaaaactta

SEQ ID NO: 3882810 - DNA, 18 bp, Homo sapiens
cccagaaattccttccca

SEQ ID NO: 3882811 - DNA, 21 bp, Homo sapiens
cccagaaattccttcccactc

SEQ ID NO: 3882812 - DNA, 14 bp, Homo sapiens
cccagagacaggaa

SEQ ID NO: 3882813 - DNA, 23 bp, Homo sapiens
cccagagaccccttcctttcctc

SEQ ID NO: 3882814 - DNA, 21 bp, Homo sapiens
cccagagaggaatcagacttc

SEQ ID NO: 3882815 - DNA, 14 bp, Homo sapiens
cccagagatgcctc

SEQ ID NO: 3882816 - DNA, 17 bp, Homo sapiens
cccagagatgcctccac

SEQ ID NO: 3882817 - DNA, 21 bp, Homo sapiens
cccagagatgcctccaccgct

SEQ ID NO: 3882818 - DNA, 23 bp, Homo sapiens
cccagagatgcctccaccgctgc

SEQ ID NO: 3882819 - DNA, 18 bp, Homo sapiens
cccagagcttattggcca

SEQ ID NO: 3882820 - DNA, 13 bp, Homo sapiens
cccagaggccagg

SEQ ID NO: 3882821 - DNA, 14 bp, Homo sapiens
cccagaggccagga

SEQ ID NO: 3882822 - DNA, 17 bp, Homo sapiens
cccagaggttatctgcc

SEQ ID NO: 3882823 - DNA, 13 bp, Homo sapiens
cccagagtcagag

SEQ ID NO: 3882824 - DNA, 20 bp, Homo sapiens
cccagagtcagaggagaaga

SEQ ID NO: 3882825 - DNA, 21 bp, Homo sapiens
cccagagtggagtctgagtct

SEQ ID NO: 3882826 - DNA, 15 bp, Homo sapiens
cccagagtgtgaaac

SEQ ID NO: 3882827 - DNA, 17 bp, Homo sapiens
cccagagtgtgaaactt

SEQ ID NO: 3882828 - DNA, 21 bp, Homo sapiens
cccagatcctctgctgactcc

SEQ ID NO: 3882829 - DNA, 13 bp, Homo sapiens
cccagatctgcct

SEQ ID NO: 3882830 - DNA, 14 bp, Homo sapiens
cccagatgctgggg

SEQ ID NO: 3882831 - DNA, 15 bp, Homo sapiens
cccagcaacacaagc

SEQ ID NO: 3882832 - DNA, 21 bp, Homo sapiens
cccagcactaaggccgtgtct

SEQ ID NO: 3882833 - DNA, 20 bp, Homo sapiens
cccagcactttgggaggcca

SEQ ID NO: 3882834 - DNA, 22 bp, Homo sapiens
cccagcactttgggaggccaag

SEQ ID NO: 3882835 - DNA, 21 bp, Homo sapiens
cccagcagccctggcctgtgg

SEQ ID NO: 3882836 - DNA, 16 bp, Homo sapiens
cccagcagctgggccg

SEQ ID NO: 3882837 - DNA, 19 bp, Homo sapiens
cccagcagctgggccggcc

SEQ ID NO: 3882838 - DNA, 21 bp, Homo sapiens
cccagcagctgggccggccag

SEQ ID NO: 3882839 - DNA, 19 bp, Homo sapiens
cccagcagggcctcaaagt

SEQ ID NO: 3882840 - DNA, 16 bp, Homo sapiens
cccagcagtttgggag

SEQ ID NO: 3882841 - DNA, 13 bp, Homo sapiens
cccagcccagctg

SEQ ID NO: 3882842 - DNA, 22 bp, Homo sapiens
cccagcccattctctctcctgt

SEQ ID NO: 3882843 - DNA, 18 bp, Homo sapiens
cccagccccctaagagag

SEQ ID NO: 3882844 - DNA, 17 bp, Homo sapiens
cccagccctatggatgt

SEQ ID NO: 3882845 - DNA, 18 bp, Homo sapiens
cccagccctatggatgtg

SEQ ID NO: 3882846 - DNA, 15 bp, Homo sapiens
cccagcccttctgcc

SEQ ID NO: 3882847 - DNA, 11 bp, Homo sapiens
cccagcctggg

SEQ ID NO: 3882848 - DNA, 12 bp, Homo sapiens
cccagcctgggc

SEQ ID NO: 3882849 - DNA, 18 bp, Homo sapiens
cccagcctgggcctatgg

SEQ ID NO: 3882850 - DNA, 19 bp, Homo sapiens
cccagcctgggcctatgga

SEQ ID NO: 3882851 - DNA, 14 bp, Homo sapiens
cccagcctgtcctg

SEQ ID NO: 3882852 - DNA, 21 bp, Homo sapiens
cccagcctgtcctggtacagc

SEQ ID NO: 3882853 - DNA, 22 bp, Homo sapiens
cccagcctgtcctggtacagca

SEQ ID NO: 3882854 - DNA, 23 bp, Homo sapiens
cccagcgattccctctcccaggc

SEQ ID NO: 3882855 - DNA, 21 bp, Homo sapiens
cccagcgcctgtgctgaggac

SEQ ID NO: 3882856 - DNA, 18 bp, Homo sapiens
cccagctaatctgtaggg

SEQ ID NO: 3882857 - DNA, 20 bp, Homo sapiens
cccagctaatctgtagggct

SEQ ID NO: 3882858 - DNA, 23 bp, Homo sapiens
cccagctaatctgtagggctgga

SEQ ID NO: 3882859 - DNA, 15 bp, Homo sapiens
cccagctacattcct

SEQ ID NO: 3882860 - DNA, 16 bp, Homo sapiens
cccagctacattcctc

SEQ ID NO: 3882861 - DNA, 19 bp, Homo sapiens
cccagctactctgtccagg

SEQ ID NO: 3882862 - DNA, 21 bp, Homo sapiens
cccagctactctgtccaggcc

SEQ ID NO: 3882863 - DNA, 22 bp, Homo sapiens
cccagctactctgtccaggcca

SEQ ID NO: 3882864 - DNA, 23 bp, Homo sapiens
cccagctactctgtccaggccac

SEQ ID NO: 3882865 - DNA, 16 bp, Homo sapiens
cccagctagggctgga

SEQ ID NO: 3882866 - DNA, 19 bp, Homo sapiens
cccagctatggccccaggg

SEQ ID NO: 3882867 - DNA, 20 bp, Homo sapiens
cccagctccttttgtcccca

SEQ ID NO: 3882868 - DNA, 21 bp, Homo sapiens
cccagctccttttgtccccag

SEQ ID NO: 3882869 - DNA, 13 bp, Homo sapiens
cccagctgaggct

SEQ ID NO: 3882870 - DNA, 11 bp, Homo sapiens
cccagctggcc

SEQ ID NO: 3882871 - DNA, 13 bp, Homo sapiens
cccagctggcctc

SEQ ID NO: 3882872 - DNA, 14 bp, Homo sapiens
cccagctggcctct

SEQ ID NO: 3882873 - DNA, 19 bp, Homo sapiens
cccagctgtagccatggct

SEQ ID NO: 3882874 - DNA, 21 bp, Homo sapiens
cccagctgtagccatggctca

SEQ ID NO: 3882875 - DNA, 23 bp, Homo sapiens
cccagctgtagccatggctcagg

SEQ ID NO: 3882876 - DNA, 12 bp, Homo sapiens
cccagcttcctg

SEQ ID NO: 3882877 - DNA, 15 bp, Homo sapiens
cccagcttcctggtg

SEQ ID NO: 3882878 - DNA, 18 bp, Homo sapiens
cccagctttatctgtcac

SEQ ID NO: 3882879 - DNA, 15 bp, Homo sapiens
cccaggaactgggcc

SEQ ID NO: 3882880 - DNA, 19 bp, Homo sapiens
cccaggagctgagtcacct

SEQ ID NO: 3882881 - DNA, 20 bp, Homo sapiens
cccaggagctgagtcacctc

SEQ ID NO: 3882882 - DNA, 14 bp, Homo sapiens
cccaggaggggcct

SEQ ID NO: 3882883 - DNA, 20 bp, Homo sapiens
cccaggagtttgagacaagc

SEQ ID NO: 3882884 - DNA, 14 bp, Homo sapiens
cccaggcatcccat

SEQ ID NO: 3882885 - DNA, 19 bp, Homo sapiens
cccaggcatcccatccctt

SEQ ID NO: 3882886 - DNA, 17 bp, Homo sapiens
cccaggccaggccacca

SEQ ID NO: 3882887 - DNA, 20 bp, Homo sapiens
cccaggccaggccaccagga

SEQ ID NO: 3882888 - DNA, 16 bp, Homo sapiens
cccaggccccatgacc

SEQ ID NO: 3882889 - DNA, 13 bp, Homo sapiens
cccaggccctccc

SEQ ID NO: 3882890 - DNA, 12 bp, Homo sapiens
cccaggccgcct

SEQ ID NO: 3882891 - DNA, 19 bp, Homo sapiens
ccatcatatgacatgccac

SEQ ID NO: 3882892 - DNA, 12 bp, Homo sapiens
ccatcccacatt

SEQ ID NO: 3882893 - DNA, 21 bp, Homo sapiens
ccatccccaaactgtgccctg

SEQ ID NO: 3882894 - DNA, 13 bp, Homo sapiens
ccatcccctggac

SEQ ID NO: 3882895 - DNA, 16 bp, Homo sapiens
ccatcccgaaaatctc

SEQ ID NO: 3882896 - DNA, 19 bp, Homo sapiens
ccatcccgaaaatctctcg

SEQ ID NO: 3882897 - DNA, 19 bp, Homo sapiens
ccatccctgggcccctcca

SEQ ID NO: 3882898 - DNA, 17 bp, Homo sapiens
ccatcccttcctcccca

SEQ ID NO: 3882899 - DNA, 18 bp, Homo sapiens
ccatcccttcctccccag

SEQ ID NO: 3882900 - DNA, 21 bp, Homo sapiens
ccatccgggacgcttccagac

SEQ ID NO: 3882901 - DNA, 15 bp, Homo sapiens
ccatcctgcagcctc

SEQ ID NO: 3882902 - DNA, 16 bp, Homo sapiens
ccatcctgcagcctcc

SEQ ID NO: 3882903 - DNA, 22 bp, Homo sapiens
ccatcctgcagcctcctcctga

SEQ ID NO: 3882904 - DNA, 18 bp, Homo sapiens
ccatcctggcccctccag

SEQ ID NO: 3882905 - DNA, 20 bp, Homo sapiens
ccatctatgtcccttgctgt

SEQ ID NO: 3882906 - DNA, 13 bp, Homo sapiens
ccatctcaggtgc

SEQ ID NO: 3882907 - DNA, 17 bp, Homo sapiens
ccatctcaggtgccact

SEQ ID NO: 3882908 - DNA, 11 bp, Homo sapiens
ccatctccagc

SEQ ID NO: 3882909 - DNA, 17 bp, Homo sapiens
ccatctccccaggcctc

SEQ ID NO: 3882910 - DNA, 19 bp, Homo sapiens
ccatctccccaggcctcca

SEQ ID NO: 3882911 - DNA, 18 bp, Homo sapiens
ccatctcctgatttctct

SEQ ID NO: 3882912 - DNA, 16 bp, Homo sapiens
ccatctggcagggtgg

SEQ ID NO: 3882913 - DNA, 23 bp, Homo sapiens
ccatctgggtccttgcacccctc

SEQ ID NO: 3882914 - DNA, 16 bp, Homo sapiens
ccatcttcctgctgct

SEQ ID NO: 3882915 - DNA, 14 bp, Homo sapiens
ccatctttctttgg

SEQ ID NO: 3882916 - DNA, 20 bp, Homo sapiens
ccatgaagacacgcttaaaa

SEQ ID NO: 3882917 - DNA, 20 bp, Homo sapiens
ccatgaccagttctggccag

SEQ ID NO: 3882918 - DNA, 15 bp, Homo sapiens
ccatgacctccagct

SEQ ID NO: 3882919 - DNA, 22 bp, Homo sapiens
ccatgacctccagctttcctgt

SEQ ID NO: 3882920 - DNA, 13 bp, Homo sapiens
ccatgagaagagg

SEQ ID NO: 3882921 - DNA, 19 bp, Homo sapiens
ccatgagaagagggcctgt

SEQ ID NO: 3882922 - DNA, 14 bp, Homo sapiens
ccatgattttacag

SEQ ID NO: 3882923 - DNA, 21 bp, Homo sapiens
ccatgcacacaaacacctcct

SEQ ID NO: 3882924 - DNA, 22 bp, Homo sapiens
ccatgcacacaaacacctccta

SEQ ID NO: 3882925 - DNA, 19 bp, Homo sapiens
ccatgccactgccaggcac

SEQ ID NO: 3882926 - DNA, 12 bp, Homo sapiens
ccatgcccaacc

SEQ ID NO: 3882927 - DNA, 16 bp, Homo sapiens
ccatgcctcaagaaca

SEQ ID NO: 3882928 - DNA, 17 bp, Homo sapiens
ccatgcctcatgccaca

SEQ ID NO: 3882929 - DNA, 20 bp, Homo sapiens
ccatgcctcatgccacacct

SEQ ID NO: 3882930 - DNA, 19 bp, Homo sapiens
ccatgctctgccccaagcc

SEQ ID NO: 3882931 - DNA, 16 bp, Homo sapiens
ccatgctgaattattt

SEQ ID NO: 3882932 - DNA, 21 bp, Homo sapiens
ccatgctggcggcgcagaggg

SEQ ID NO: 3882933 - DNA, 12 bp, Homo sapiens
ccatgctttcct

SEQ ID NO: 3882934 - DNA, 21 bp, Homo sapiens
ccatggacaatataaactgaa

SEQ ID NO: 3882935 - DNA, 20 bp, Homo sapiens
ccatggacacattttctcct

SEQ ID NO: 3882936 - DNA, 13 bp, Homo sapiens
ccatggaggaggt

SEQ ID NO: 3882937 - DNA, 12 bp, Homo sapiens
ccatggaggcag

SEQ ID NO: 3882938 - DNA, 19 bp, Homo sapiens
ccatggcaccagccccctg

SEQ ID NO: 3882939 - DNA, 21 bp, Homo sapiens
ccatggccaccccgtgccacc

SEQ ID NO: 3882940 - DNA, 15 bp, Homo sapiens
ccatggccttccctc

SEQ ID NO: 3882941 - DNA, 18 bp, Homo sapiens
ccatggctcaggcaagcc

SEQ ID NO: 3882942 - DNA, 22 bp, Homo sapiens
ccatgggatgttaagcaaagga

SEQ ID NO: 3882943 - DNA, 23 bp, Homo sapiens
ccatgggcctgctgcgtcagacc

SEQ ID NO: 3882944 - DNA, 12 bp, Homo sapiens
ccatgggcctgg

SEQ ID NO: 3882945 - DNA, 17 bp, Homo sapiens
ccatgggcctgggcctg

SEQ ID NO: 3882946 - DNA, 18 bp, Homo sapiens
ccatgggcctgggcctgc

SEQ ID NO: 3882947 - DNA, 19 bp, Homo sapiens
ccatgggcctgggcctgct

SEQ ID NO: 3882948 - DNA, 17 bp, Homo sapiens
ccatggggaagtgctcc

SEQ ID NO: 3882949 - DNA, 19 bp, Homo sapiens
ccatggggaagtgctcccc

SEQ ID NO: 3882950 - DNA, 22 bp, Homo sapiens
ccatggggaagtgctccccaca

SEQ ID NO: 3882951 - DNA, 21 bp, Homo sapiens
ccatggttaccgaggaccctg

SEQ ID NO: 3882952 - DNA, 23 bp, Homo sapiens
ccatgtagttttaacagaaccag

SEQ ID NO: 3882953 - DNA, 15 bp, Homo sapiens
ccatgtatctacctc

SEQ ID NO: 3882954 - DNA, 14 bp, Homo sapiens
ccatgtcacctcag

SEQ ID NO: 3882955 - DNA, 16 bp, Homo sapiens
ccatgtcacctcagct

SEQ ID NO: 3882956 - DNA, 17 bp, Homo sapiens
ccatgtcgcctctgcat

SEQ ID NO: 3882957 - DNA, 15 bp, Homo sapiens
ccatgtggagtggac

SEQ ID NO: 3882958 - DNA, 16 bp, Homo sapiens
ccatgtggccccaggt

SEQ ID NO: 3882959 - DNA, 20 bp, Homo sapiens
ccatgtggccccaggtgcca

SEQ ID NO: 3882960 - DNA, 21 bp, Homo sapiens
ccatgtggccccaggtgccac

SEQ ID NO: 3882961 - DNA, 22 bp, Homo sapiens
ccatgtttagattccaggatca

SEQ ID NO: 3882962 - DNA, 13 bp, Homo sapiens
ccatgtttgtaaa

SEQ ID NO: 3882963 - DNA, 15 bp, Homo sapiens
ccattacatgtttaa

SEQ ID NO: 3882964 - DNA, 18 bp, Homo sapiens
ccattactaaagacagaa

SEQ ID NO: 3882965 - DNA, 23 bp, Homo sapiens
ccattactctgcggtggtgccag

SEQ ID NO: 3882966 - DNA, 16 bp, Homo sapiens
ccattaggcatgccta

SEQ ID NO: 3882967 - DNA, 19 bp, Homo sapiens
ccattcccccatgtggctg

SEQ ID NO: 3882968 - DNA, 20 bp, Homo sapiens
ccattctcatatgtagccct

SEQ ID NO: 3882969 - DNA, 21 bp, Homo sapiens
ccattctcatatgtagccctc

SEQ ID NO: 3882970 - DNA, 14 bp, Homo sapiens
ccattctctctcct

SEQ ID NO: 3882971 - DNA, 19 bp, Homo sapiens
ccattctctctcctgtcca

SEQ ID NO: 3882972 - DNA, 19 bp, Homo sapiens
ccattcttcctagttttct

SEQ ID NO: 3882973 - DNA, 21 bp, Homo sapiens
ccattgacttgcacatctctg

SEQ ID NO: 3882974 - DNA, 14 bp, Homo sapiens
ccattggttctcct

SEQ ID NO: 3882975 - DNA, 17 bp, Homo sapiens
ccattggtttttgtagt

SEQ ID NO: 3882976 - DNA, 13 bp, Homo sapiens
ccattgtcttcca

SEQ ID NO: 3882977 - DNA, 20 bp, Homo sapiens
ccagggcgggagtgggggct

SEQ ID NO: 3882978 - DNA, 18 bp, Homo sapiens
ccaggggagagggtctgg

SEQ ID NO: 3882979 - DNA, 21 bp, Homo sapiens
ccaggggagagggtctggaga

SEQ ID NO: 3882980 - DNA, 23 bp, Homo sapiens
ccaggggtatatttagaccctgt

SEQ ID NO: 3882981 - DNA, 19 bp, Homo sapiens
ccaggggtgatttcagaga

SEQ ID NO: 3882982 - DNA, 20 bp, Homo sapiens
ccaggggtgcctgtgggggt

SEQ ID NO: 3882983 - DNA, 17 bp, Homo sapiens
ccagggtccgcaccagc

SEQ ID NO: 3882984 - DNA, 20 bp, Homo sapiens
ccagggtccgcaccagctgc

SEQ ID NO: 3882985 - DNA, 23 bp, Homo sapiens
ccagggtccgcaccagctgctct

SEQ ID NO: 3882986 - DNA, 24 bp, Homo sapiens
ccagggtccgcaccagctgctctg

SEQ ID NO: 3882987 - DNA, 19 bp, Homo sapiens
ccagggtcttgggctactg

SEQ ID NO: 3882988 - DNA, 21 bp, Homo sapiens
ccagggtcttgggctactggc

SEQ ID NO: 3882989 - DNA, 14 bp, Homo sapiens
ccagggtgagagct

SEQ ID NO: 3882990 - DNA, 23 bp, Homo sapiens
ccagggtgagagctgctctggaa

SEQ ID NO: 3882991 - DNA, 16 bp, Homo sapiens
ccagggttgatcacac

SEQ ID NO: 3882992 - DNA, 22 bp, Homo sapiens
ccagggttgatcacactctggg

SEQ ID NO: 3882993 - DNA, 18 bp, Homo sapiens
ccaggtaatgagggactg

SEQ ID NO: 3882994 - DNA, 23 bp, Homo sapiens
ccaggtaatgagggactggaacc

SEQ ID NO: 3882995 - DNA, 20 bp, Homo sapiens
ccaggtagggccagctcaca

SEQ ID NO: 3882996 - DNA, 15 bp, Homo sapiens
ccaggtatctccagg

SEQ ID NO: 3882997 - DNA, 16 bp, Homo sapiens
ccaggtatctccagga

SEQ ID NO: 3882998 - DNA, 15 bp, Homo sapiens
ccaggtcctggtggg

SEQ ID NO: 3882999 - DNA, 19 bp, Homo sapiens
ccaggtggctgacccagtc

SEQ ID NO: 3883000 - DNA, 23 bp, Homo sapiens
ccaggtggctgacccagtccctg

SEQ ID NO: 3883001 - DNA, 13 bp, Homo sapiens
ccaggtgggagag

SEQ ID NO: 3883002 - DNA, 18 bp, Homo sapiens
ccaggtgggagagacact

SEQ ID NO: 3883003 - DNA, 15 bp, Homo sapiens
ccaggtgttgccatt

SEQ ID NO: 3883004 - DNA, 21 bp, Homo sapiens
ccaggttagcctttgccctgt

SEQ ID NO: 3883005 - DNA, 20 bp, Homo sapiens
ccagtaaaaaaaaaaaatgg

SEQ ID NO: 3883006 - DNA, 21 bp, Homo sapiens
ccagtaagcacatgtttattc

SEQ ID NO: 3883007 - DNA, 22 bp, Homo sapiens
ccagtacagagaaattctgtgg

SEQ ID NO: 3883008 - DNA, 13 bp, Homo sapiens
ccagtactgggaa

SEQ ID NO: 3883009 - DNA, 13 bp, Homo sapiens
ccagtacttctaa

SEQ ID NO: 3883010 - DNA, 15 bp, Homo sapiens
ccagtatgagcccta

SEQ ID NO: 3883011 - DNA, 17 bp, Homo sapiens
ccagtatggaagggagg

SEQ ID NO: 3883012 - DNA, 13 bp, Homo sapiens
ccagtcccagagc

SEQ ID NO: 3883013 - DNA, 22 bp, Homo sapiens
ccagtccctgggggaagccctg

SEQ ID NO: 3883014 - DNA, 19 bp, Homo sapiens
ccagtcctagagctcctgt

SEQ ID NO: 3883015 - DNA, 18 bp, Homo sapiens
ccagtcgatatctcactt

SEQ ID NO: 3883016 - DNA, 22 bp, Homo sapiens
ccagtctacgttctccagccca

SEQ ID NO: 3883017 - DNA, 18 bp, Homo sapiens
ccagtctgggctgccggg

SEQ ID NO: 3883018 - DNA, 13 bp, Homo sapiens
ccagtgacctgac

SEQ ID NO: 3883019 - DNA, 18 bp, Homo sapiens
ccagtgacctgaccggca

SEQ ID NO: 3883020 - DNA, 22 bp, Homo sapiens
ccagtgatgtgctggagctggc

SEQ ID NO: 3883021 - DNA, 21 bp, Homo sapiens
ccagtgccttacctcctgccc

SEQ ID NO: 3883022 - DNA, 22 bp, Homo sapiens
ccagtgccttacctcctgccca

SEQ ID NO: 3883023 - DNA, 23 bp, Homo sapiens
ccagtgccttacctcctgcccag

SEQ ID NO: 3883024 - DNA, 20 bp, Homo sapiens
ccagtgctgccatgccactg

SEQ ID NO: 3883025 - DNA, 17 bp, Homo sapiens
ccagtgggacagaggag

SEQ ID NO: 3883026 - DNA, 23 bp, Homo sapiens
ccagtgggaggtgagaccacctc

SEQ ID NO: 3883027 - DNA, 19 bp, Homo sapiens
ccagtgtaaagaataaatg

SEQ ID NO: 3883028 - DNA, 16 bp, Homo sapiens
ccagtgtaaggcatag

SEQ ID NO: 3883029 - DNA, 14 bp, Homo sapiens
ccagtgtcccctcc

SEQ ID NO: 3883030 - DNA, 22 bp, Homo sapiens
ccagttaaggaccgtggccctg

SEQ ID NO: 3883031 - DNA, 14 bp, Homo sapiens
ccagttctgctcct

SEQ ID NO: 3883032 - DNA, 16 bp, Homo sapiens
ccagttctgctcctct

SEQ ID NO: 3883033 - DNA, 19 bp, Homo sapiens
ccagttgggagcactggag

SEQ ID NO: 3883034 - DNA, 22 bp, Homo sapiens
ccagtttccaagttcctgcact

SEQ ID NO: 3883035 - DNA, 16 bp, Homo sapiens
ccataaacttcatggt

SEQ ID NO: 3883036 - DNA, 15 bp, Homo sapiens
ccataagggactgtg

SEQ ID NO: 3883037 - DNA, 14 bp, Homo sapiens
ccataatctggact

SEQ ID NO: 3883038 - DNA, 13 bp, Homo sapiens
ccataccatcact

SEQ ID NO: 3883039 - DNA, 14 bp, Homo sapiens
ccataccatcactg

SEQ ID NO: 3883040 - DNA, 15 bp, Homo sapiens
ccatacccctgcctg

SEQ ID NO: 3883041 - DNA, 14 bp, Homo sapiens
ccataccgctgggg

SEQ ID NO: 3883042 - DNA, 18 bp, Homo sapiens
ccatagaaacatgacact

SEQ ID NO: 3883043 - DNA, 20 bp, Homo sapiens
ccatagaaacatgacactga

SEQ ID NO: 3883044 - DNA, 17 bp, Homo sapiens
ccatagagtttaacaca

SEQ ID NO: 3883045 - DNA, 21 bp, Homo sapiens
ccatagatgggtctggctgag

SEQ ID NO: 3883046 - DNA, 18 bp, Homo sapiens
ccatagcaagattgctta

SEQ ID NO: 3883047 - DNA, 15 bp, Homo sapiens
ccataggaatcatgt

SEQ ID NO: 3883048 - DNA, 15 bp, Homo sapiens
ccatatcagacctct

SEQ ID NO: 3883049 - DNA, 17 bp, Homo sapiens
ccatatcagacctctga

SEQ ID NO: 3883050 - DNA, 18 bp, Homo sapiens
ccatatcagacctctgat

SEQ ID NO: 3883051 - DNA, 22 bp, Homo sapiens
ccatatcagacctctgatccct

SEQ ID NO: 3883052 - DNA, 14 bp, Homo sapiens
ccatatctccttcc

SEQ ID NO: 3883053 - DNA, 15 bp, Homo sapiens
ccatattcacacctc

SEQ ID NO: 3883054 - DNA, 11 bp, Homo sapiens
ccatattttca

SEQ ID NO: 3883055 - DNA, 15 bp, Homo sapiens
ccatcaccctctggg

SEQ ID NO: 3883056 - DNA, 19 bp, Homo sapiens
ccatcacctactcacacag

SEQ ID NO: 3883057 - DNA, 15 bp, Homo sapiens
ccatcactgagtggc

SEQ ID NO: 3883058 - DNA, 21 bp, Homo sapiens
ccatcagcccaacgggaagca

SEQ ID NO: 3883059 - DNA, 14 bp, Homo sapiens
ccatcagggtgggc

SEQ ID NO: 3883060 - DNA, 21 bp, Homo sapiens
ccatcatacgcatggtcctgg

SEQ ID NO: 3883061 - DNA, 18 bp, Homo sapiens
ccatcatatgacatgcca

SEQ ID NO: 3883062 - DNA, 12 bp, Homo sapiens
ccagccccaggg

SEQ ID NO: 3883063 - DNA, 13 bp, Homo sapiens
ccagccccagggg

SEQ ID NO: 3883064 - DNA, 15 bp, Homo sapiens
ccagcccggcctgct

SEQ ID NO: 3883065 - DNA, 17 bp, Homo sapiens
ccagcccggcctgctcc

SEQ ID NO: 3883066 - DNA, 20 bp, Homo sapiens
ccagcccggcctgctcccag

SEQ ID NO: 3883067 - DNA, 17 bp, Homo sapiens
ccagccctccctgtcct

SEQ ID NO: 3883068 - DNA, 14 bp, Homo sapiens
ccagccctgccagg

SEQ ID NO: 3883069 - DNA, 18 bp, Homo sapiens
ccagccctgccaggaggc

SEQ ID NO: 3883070 - DNA, 19 bp, Homo sapiens
ccagccctgccaggaggct

SEQ ID NO: 3883071 - DNA, 17 bp, Homo sapiens
ccagccctgcctggagg

SEQ ID NO: 3883072 - DNA, 18 bp, Homo sapiens
ccagccctgcctggagga

SEQ ID NO: 3883073 - DNA, 17 bp, Homo sapiens
ccagccctggctctgca

SEQ ID NO: 3883074 - DNA, 16 bp, Homo sapiens
ccagcccttccctgct

SEQ ID NO: 3883075 - DNA, 13 bp, Homo sapiens
ccagcccttctgc

SEQ ID NO: 3883076 - DNA, 22 bp, Homo sapiens
ccagccctttgcaggcccagca

SEQ ID NO: 3883077 - DNA, 20 bp, Homo sapiens
ccagccggggcgagtggcac

SEQ ID NO: 3883078 - DNA, 15 bp, Homo sapiens
ccagccggtgcctgg

SEQ ID NO: 3883079 - DNA, 12 bp, Homo sapiens
ccagcctaccct

SEQ ID NO: 3883080 - DNA, 10 bp, Homo sapiens
ccagcctcag

SEQ ID NO: 3883081 - DNA, 12 bp, Homo sapiens
ccagcctcagct

SEQ ID NO: 3883082 - DNA, 18 bp, Homo sapiens
ccagcctcagctcagcct

SEQ ID NO: 3883083 - DNA, 19 bp, Homo sapiens
ccagcctcagctcagcctc

SEQ ID NO: 3883084 - DNA, 15 bp, Homo sapiens
ccagcctcagtgcca

SEQ ID NO: 3883085 - DNA, 16 bp, Homo sapiens
ccagcctccatgctgc

SEQ ID NO: 3883086 - DNA, 13 bp, Homo sapiens
ccagcctctcccg

SEQ ID NO: 3883087 - DNA, 21 bp, Homo sapiens
ccagcctctcccggctgcctg

SEQ ID NO: 3883088 - DNA, 22 bp, Homo sapiens
ccagcctctcccggctgcctgc

SEQ ID NO: 3883089 - DNA, 10 bp, Homo sapiens
ccagcctggc

SEQ ID NO: 3883090 - DNA, 17 bp, Homo sapiens
ccagcctggcctcctgc

SEQ ID NO: 3883091 - DNA, 19 bp, Homo sapiens
ccagcctggcctcctgcct

SEQ ID NO: 3883092 - DNA, 20 bp, Homo sapiens
ccagcctggcctcctgcctc

SEQ ID NO: 3883093 - DNA, 19 bp, Homo sapiens
ccagcctgggcctatggag

SEQ ID NO: 3883094 - DNA, 16 bp, Homo sapiens
ccagcctgtcctggta

SEQ ID NO: 3883095 - DNA, 13 bp, Homo sapiens
ccagcctgtgtgt

SEQ ID NO: 3883096 - DNA, 20 bp, Homo sapiens
ccagcctgttggacccgctc

SEQ ID NO: 3883097 - DNA, 21 bp, Homo sapiens
ccagcgattccctctcccagg

SEQ ID NO: 3883098 - DNA, 22 bp, Homo sapiens
ccagcgcctagtggggtctccc

SEQ ID NO: 3883099 - DNA, 21 bp, Homo sapiens
ccagcgcctgccctccctggg

SEQ ID NO: 3883100 - DNA, 20 bp, Homo sapiens
ccagcgcctgtgctgaggac

SEQ ID NO: 3883101 - DNA, 12 bp, Homo sapiens
ccagcgcggctt

SEQ ID NO: 3883102 - DNA, 14 bp, Homo sapiens
ccagctaactccag

SEQ ID NO: 3883103 - DNA, 23 bp, Homo sapiens
ccagctaactccagtctcctgac

SEQ ID NO: 3883104 - DNA, 20 bp, Homo sapiens
ccagctaatctgtagggctg

SEQ ID NO: 3883105 - DNA, 15 bp, Homo sapiens
ccagctacattcctc

SEQ ID NO: 3883106 - DNA, 23 bp, Homo sapiens
ccagctacattcctcagctgcca

SEQ ID NO: 3883107 - DNA, 15 bp, Homo sapiens
ccagctactcaggag

SEQ ID NO: 3883108 - DNA, 17 bp, Homo sapiens
ccagctactcaggaggc

SEQ ID NO: 3883109 - DNA, 20 bp, Homo sapiens
ccagctactcgggaggctga

SEQ ID NO: 3883110 - DNA, 22 bp, Homo sapiens
ccagctactctgtccaggccac

SEQ ID NO: 3883111 - DNA, 23 bp, Homo sapiens
ccagctactctgtccaggccact

SEQ ID NO: 3883112 - DNA, 14 bp, Homo sapiens
ccagctagggctgg

SEQ ID NO: 3883113 - DNA, 15 bp, Homo sapiens
ccagctagggctgga

SEQ ID NO: 3883114 - DNA, 20 bp, Homo sapiens
ccagctagggctggactctg

SEQ ID NO: 3883115 - DNA, 14 bp, Homo sapiens
ccagctagtgaccc

SEQ ID NO: 3883116 - DNA, 16 bp, Homo sapiens
ccagctatggccccag

SEQ ID NO: 3883117 - DNA, 19 bp, Homo sapiens
ccagctatggccccagggt

SEQ ID NO: 3883118 - DNA, 16 bp, Homo sapiens
ccagctctccctctgg

SEQ ID NO: 3883119 - DNA, 23 bp, Homo sapiens
ccagctctccctctggccctgcc

SEQ ID NO: 3883120 - DNA, 11 bp, Homo sapiens
ccagctctgtg

SEQ ID NO: 3883121 - DNA, 12 bp, Homo sapiens
ccagctctgtgg

SEQ ID NO: 3883122 - DNA, 20 bp, Homo sapiens
ccagctctgtggcctgtgtc

SEQ ID NO: 3883123 - DNA, 23 bp, Homo sapiens
ccagctgcagatgccacacctgc

SEQ ID NO: 3883124 - DNA, 12 bp, Homo sapiens
ccagctgcctgg

SEQ ID NO: 3883125 - DNA, 16 bp, Homo sapiens
ccagctgcctgggagg

SEQ ID NO: 3883126 - DNA, 14 bp, Homo sapiens
ccagctgctctgcc

SEQ ID NO: 3883127 - DNA, 15 bp, Homo sapiens
ccagctgctctgccc

SEQ ID NO: 3883128 - DNA, 21 bp, Homo sapiens
ccagctgctctgccccttggg

SEQ ID NO: 3883129 - DNA, 20 bp, Homo sapiens
ccagctggcctctagaacac

SEQ ID NO: 3883130 - DNA, 18 bp, Homo sapiens
ccagctggtgctgcaagg

SEQ ID NO: 3883131 - DNA, 19 bp, Homo sapiens
ccagctggtgctgcaagga

SEQ ID NO: 3883132 - DNA, 16 bp, Homo sapiens
ccagctgtagccatgg

SEQ ID NO: 3883133 - DNA, 20 bp, Homo sapiens
ccagctgtagccatggctca

SEQ ID NO: 3883134 - DNA, 24 bp, Homo sapiens
ccagctgtagccatggctcaggca

SEQ ID NO: 3883135 - DNA, 13 bp, Homo sapiens
ccagctgtctgtg

SEQ ID NO: 3883136 - DNA, 22 bp, Homo sapiens
ccagcttcctgtgggccaggag

SEQ ID NO: 3883137 - DNA, 15 bp, Homo sapiens
ccagcttctccaggc

SEQ ID NO: 3883138 - DNA, 14 bp, Homo sapiens
ccagcttgctcttc

SEQ ID NO: 3883139 - DNA, 18 bp, Homo sapiens
ccagctttatctgtcaca

SEQ ID NO: 3883140 - DNA, 12 bp, Homo sapiens
ccagctttcctg

SEQ ID NO: 3883141 - DNA, 20 bp, Homo sapiens
ccagctttgctaccaaagca

SEQ ID NO: 3883142 - DNA, 12 bp, Homo sapiens
ccaggaaggcag

SEQ ID NO: 3883143 - DNA, 13 bp, Homo sapiens
ccaggaaggcagc

SEQ ID NO: 3883144 - DNA, 20 bp, Homo sapiens
ccaggaaggcagctgctctt

SEQ ID NO: 3883145 - DNA, 19 bp, Homo sapiens
ccaggaatgcctcctccct

SEQ ID NO: 3883146 - DNA, 12 bp, Homo sapiens
ccaggacacctg

SEQ ID NO: 3883147 - DNA, 15 bp, Homo sapiens
ccaggacacctgccc

SEQ ID NO: 3883148 - DNA, 17 bp, Homo sapiens
ccaggacacctgcccca

SEQ ID NO: 3883149 - DNA, 21 bp, Homo sapiens
ccaggacacctgccccagcgc

SEQ ID NO: 3883150 - DNA, 13 bp, Homo sapiens
ccaggacaggccc

SEQ ID NO: 3883151 - DNA, 15 bp, Homo sapiens
ccaggacaggcccgg

SEQ ID NO: 3883152 - DNA, 18 bp, Homo sapiens
ccaggactatagcccagg

SEQ ID NO: 3883153 - DNA, 19 bp, Homo sapiens
ccaggactccccaggccag

SEQ ID NO: 3883154 - DNA, 22 bp, Homo sapiens
ccaggactccccaggccaggcc

SEQ ID NO: 3883155 - DNA, 14 bp, Homo sapiens
ccaggactctgccc

SEQ ID NO: 3883156 - DNA, 13 bp, Homo sapiens
ccaggagagagat

SEQ ID NO: 3883157 - DNA, 18 bp, Homo sapiens
ccaggagagccagccctc

SEQ ID NO: 3883158 - DNA, 19 bp, Homo sapiens
ccaggagagccagccctcc

SEQ ID NO: 3883159 - DNA, 15 bp, Homo sapiens
ccaggagcaaatgtt

SEQ ID NO: 3883160 - DNA, 15 bp, Homo sapiens
ccaggagcccagagg

SEQ ID NO: 3883161 - DNA, 16 bp, Homo sapiens
ccaggagcctgtgcct

SEQ ID NO: 3883162 - DNA, 15 bp, Homo sapiens
ccaggagctggagga

SEQ ID NO: 3883163 - DNA, 15 bp, Homo sapiens
ccaggaggctgcggc

SEQ ID NO: 3883164 - DNA, 21 bp, Homo sapiens
ccaggagggacaaaggagcct

SEQ ID NO: 3883165 - DNA, 14 bp, Homo sapiens
ccaggaggggcctc

SEQ ID NO: 3883166 - DNA, 20 bp, Homo sapiens
ccaggaggggcctctgaaat

SEQ ID NO: 3883167 - DNA, 15 bp, Homo sapiens
ccaggaggtcctcct

SEQ ID NO: 3883168 - DNA, 18 bp, Homo sapiens
ccaggaggtcctcctctc

SEQ ID NO: 3883169 - DNA, 18 bp, Homo sapiens
ccaggaggtcgaccccaa

SEQ ID NO: 3883170 - DNA, 22 bp, Homo sapiens
ccaggaggtggctatggccacc

SEQ ID NO: 3883171 - DNA, 19 bp, Homo sapiens
ccaggagttgacgcatcct

SEQ ID NO: 3883172 - DNA, 17 bp, Homo sapiens
ccaggagtttgagacaa

SEQ ID NO: 3883173 - DNA, 21 bp, Homo sapiens
ccaggagtttgagacaagccc

SEQ ID NO: 3883174 - DNA, 20 bp, Homo sapiens
ccaggatccctcccagatcc

SEQ ID NO: 3883175 - DNA, 16 bp, Homo sapiens
ccaggatgaaggcgtg

SEQ ID NO: 3883176 - DNA, 17 bp, Homo sapiens
ccaggatgaaggcgtgc

SEQ ID NO: 3883177 - DNA, 21 bp, Homo sapiens
ccaggatgaaggcgtgcaagg

SEQ ID NO: 3883178 - DNA, 23 bp, Homo sapiens
ccaggatggcccttcccactgga

SEQ ID NO: 3883179 - DNA, 16 bp, Homo sapiens
ccaggattcctctctc

SEQ ID NO: 3883180 - DNA, 18 bp, Homo sapiens
ccaggattcctctctcag

SEQ ID NO: 3883181 - DNA, 20 bp, Homo sapiens
ccaggattttaacaaaagca

SEQ ID NO: 3883182 - DNA, 12 bp, Homo sapiens
ccaggcacctgg

SEQ ID NO: 3883183 - DNA, 16 bp, Homo sapiens
ccaggcacctggcctg

SEQ ID NO: 3883184 - DNA, 17 bp, Homo sapiens
ccaggcacctggcctgc

SEQ ID NO: 3883185 - DNA, 19 bp, Homo sapiens
ccaggcacctggcctgctg

SEQ ID NO: 3883186 - DNA, 17 bp, Homo sapiens
ccaggcatcccatccct

SEQ ID NO: 3883187 - DNA, 12 bp, Homo sapiens
ccaggcatgctg

SEQ ID NO: 3883188 - DNA, 15 bp, Homo sapiens
ccaggcatggcgagg

SEQ ID NO: 3883189 - DNA, 19 bp, Homo sapiens
ccaggcatggcgaggctga

SEQ ID NO: 3883190 - DNA, 15 bp, Homo sapiens
ccaggccaccaggat

SEQ ID NO: 3883191 - DNA, 14 bp, Homo sapiens
ccaggccactgtgg

SEQ ID NO: 3883192 - DNA, 15 bp, Homo sapiens
ccaggccactgtggc

SEQ ID NO: 3883193 - DNA, 17 bp, Homo sapiens
ccaggccactgtggcca

SEQ ID NO: 3883194 - DNA, 22 bp, Homo sapiens
ccaggccactgtggccagagct

SEQ ID NO: 3883195 - DNA, 23 bp, Homo sapiens
ccaggccactgtggccagagctg

SEQ ID NO: 3883196 - DNA, 17 bp, Homo sapiens
ccaggcccctgaggact

SEQ ID NO: 3883197 - DNA, 18 bp, Homo sapiens
ccaggcccctgaggactg

SEQ ID NO: 3883198 - DNA, 19 bp, Homo sapiens
ccaggcccctgaggactgg

SEQ ID NO: 3883199 - DNA, 23 bp, Homo sapiens
ccaggcccctgaggactggagac

SEQ ID NO: 3883200 - DNA, 16 bp, Homo sapiens
ccaggcccggggctgg

SEQ ID NO: 3883201 - DNA, 18 bp, Homo sapiens
ccaggccctccatgggct

SEQ ID NO: 3883202 - DNA, 19 bp, Homo sapiens
ccaggccctccatgggcta

SEQ ID NO: 3883203 - DNA, 17 bp, Homo sapiens
ccaggcctccagcctct

SEQ ID NO: 3883204 - DNA, 20 bp, Homo sapiens
ccaggcctccagcctctccc

SEQ ID NO: 3883205 - DNA, 18 bp, Homo sapiens
ccaggcgccccttccccc

SEQ ID NO: 3883206 - DNA, 20 bp, Homo sapiens
ccaggcgttggtgccacttc

SEQ ID NO: 3883207 - DNA, 14 bp, Homo sapiens
ccaggctccatggg

SEQ ID NO: 3883208 - DNA, 15 bp, Homo sapiens
ccaggctctgcctgg

SEQ ID NO: 3883209 - DNA, 19 bp, Homo sapiens
ccaggctctggagccagag

SEQ ID NO: 3883210 - DNA, 12 bp, Homo sapiens
ccaggctctggg

SEQ ID NO: 3883211 - DNA, 14 bp, Homo sapiens
ccaggctctgggaa

SEQ ID NO: 3883212 - DNA, 23 bp, Homo sapiens
ccaggctcttcctggacctgagt

SEQ ID NO: 3883213 - DNA, 23 bp, Homo sapiens
ccaggctctttggggtcagccag

SEQ ID NO: 3883214 - DNA, 12 bp, Homo sapiens
ccaggctgcact

SEQ ID NO: 3883215 - DNA, 19 bp, Homo sapiens
ccaggctgcactgcagtga

SEQ ID NO: 3883216 - DNA, 12 bp, Homo sapiens
ccaggctggcct

SEQ ID NO: 3883217 - DNA, 23 bp, Homo sapiens
ccaggcttaaggagaggagaaac

SEQ ID NO: 3883218 - DNA, 13 bp, Homo sapiens
ccagggagaccga

SEQ ID NO: 3883219 - DNA, 17 bp, Homo sapiens
ccagggatgggggatgg

SEQ ID NO: 3883220 - DNA, 21 bp, Homo sapiens
ccagggatgggggatgggcca

SEQ ID NO: 3883221 - DNA, 22 bp, Homo sapiens
ccagggatgggggatgggccag

SEQ ID NO: 3883222 - DNA, 14 bp, Homo sapiens
ccagggcacaggag

SEQ ID NO: 3883223 - DNA, 20 bp, Homo sapiens
ccagggcacaggagctacct

SEQ ID NO: 3883224 - DNA, 22 bp, Homo sapiens
ccagggcacaggagctacctgt

SEQ ID NO: 3883225 - DNA, 19 bp, Homo sapiens
ccagggcatccgcagccca

SEQ ID NO: 3883226 - DNA, 19 bp, Homo sapiens
ccagggccacgtgccaggc

SEQ ID NO: 3883227 - DNA, 21 bp, Homo sapiens
ccagggccacgtgccaggccc

SEQ ID NO: 3883228 - DNA, 15 bp, Homo sapiens
ccagggccaggggtc

SEQ ID NO: 3883229 - DNA, 19 bp, Homo sapiens
ccagggccccagaacacag

SEQ ID NO: 3883230 - DNA, 12 bp, Homo sapiens
ccagggcccctc

SEQ ID NO: 3883231 - DNA, 22 bp, Homo sapiens
ccagggcccctccctctgcccc

SEQ ID NO: 3883232 - DNA, 15 bp, Homo sapiens
ccagggcctggtgtg

SEQ ID NO: 3883233 - DNA, 19 bp, Homo sapiens
ccagggcgggagtgggggc

SEQ ID NO: 3883234 - DNA, 18 bp, Homo sapiens
ccacgtctgccaggccca

SEQ ID NO: 3883235 - DNA, 22 bp, Homo sapiens
ccacgtctgccaggcccatctc

SEQ ID NO: 3883236 - DNA, 21 bp, Homo sapiens
ccacgtgagagaatctgcctg

SEQ ID NO: 3883237 - DNA, 22 bp, Homo sapiens
ccacgtgagagaatctgcctgt

SEQ ID NO: 3883238 - DNA, 13 bp, Homo sapiens
ccacgttctatat

SEQ ID NO: 3883239 - DNA, 14 bp, Homo sapiens
ccacgttctatata

SEQ ID NO: 3883240 - DNA, 19 bp, Homo sapiens
ccactaagctttctccttt

SEQ ID NO: 3883241 - DNA, 13 bp, Homo sapiens
ccactaccttctg

SEQ ID NO: 3883242 - DNA, 22 bp, Homo sapiens
ccactacctttgtccaggcctg

SEQ ID NO: 3883243 - DNA, 23 bp, Homo sapiens
ccactactgtgtagactcctgct

SEQ ID NO: 3883244 - DNA, 19 bp, Homo sapiens
ccactagagctgagagtct

SEQ ID NO: 3883245 - DNA, 23 bp, Homo sapiens
ccactagagctgagagtctgaaa

SEQ ID NO: 3883246 - DNA, 16 bp, Homo sapiens
ccactcacacttggag

SEQ ID NO: 3883247 - DNA, 17 bp, Homo sapiens
ccactcaccagggtccg

SEQ ID NO: 3883248 - DNA, 14 bp, Homo sapiens
ccactcagggctgc

SEQ ID NO: 3883249 - DNA, 20 bp, Homo sapiens
ccactcatgttgttcccaca

SEQ ID NO: 3883250 - DNA, 19 bp, Homo sapiens
ccactccagacccctggct

SEQ ID NO: 3883251 - DNA, 13 bp, Homo sapiens
ccactccagccct

SEQ ID NO: 3883252 - DNA, 14 bp, Homo sapiens
ccactccagccctg

SEQ ID NO: 3883253 - DNA, 16 bp, Homo sapiens
ccactcccccacctga

SEQ ID NO: 3883254 - DNA, 18 bp, Homo sapiens
ccactccctgagctttgg

SEQ ID NO: 3883255 - DNA, 12 bp, Homo sapiens
ccactcctccaa

SEQ ID NO: 3883256 - DNA, 15 bp, Homo sapiens
ccactcctcttattt

SEQ ID NO: 3883257 - DNA, 14 bp, Homo sapiens
ccactcgcagtcgc

SEQ ID NO: 3883258 - DNA, 18 bp, Homo sapiens
ccactcgcagtcgcagga

SEQ ID NO: 3883259 - DNA, 21 bp, Homo sapiens
ccactctaggggtcaggctcc

SEQ ID NO: 3883260 - DNA, 22 bp, Homo sapiens
ccactctaggggtcaggctcca

SEQ ID NO: 3883261 - DNA, 14 bp, Homo sapiens
ccactctcattccc

SEQ ID NO: 3883262 - DNA, 16 bp, Homo sapiens
ccactctcattcccca

SEQ ID NO: 3883263 - DNA, 19 bp, Homo sapiens
ccactctcattccccaggt

SEQ ID NO: 3883264 - DNA, 15 bp, Homo sapiens
ccactctcccctccc

SEQ ID NO: 3883265 - DNA, 18 bp, Homo sapiens
ccactctcccctccctct

SEQ ID NO: 3883266 - DNA, 11 bp, Homo sapiens
ccactctcctt

SEQ ID NO: 3883267 - DNA, 18 bp, Homo sapiens
ccactctgctctgatgca

SEQ ID NO: 3883268 - DNA, 23 bp, Homo sapiens
ccactctgctctgatgcatcaga

SEQ ID NO: 3883269 - DNA, 15 bp, Homo sapiens
ccactctggcagcca

SEQ ID NO: 3883270 - DNA, 17 bp, Homo sapiens
ccactctggcagccaca

SEQ ID NO: 3883271 - DNA, 19 bp, Homo sapiens
ccactctggcagccacact

SEQ ID NO: 3883272 - DNA, 21 bp, Homo sapiens
ccactctggcagccacacttc

SEQ ID NO: 3883273 - DNA, 23 bp, Homo sapiens
ccactctttgctacaataaatgc

SEQ ID NO: 3883274 - DNA, 22 bp, Homo sapiens
ccactgaaaacatttcaaagct

SEQ ID NO: 3883275 - DNA, 23 bp, Homo sapiens
ccactgaaaacatttcaaagctg

SEQ ID NO: 3883276 - DNA, 18 bp, Homo sapiens
ccactgagacggcagaga

SEQ ID NO: 3883277 - DNA, 13 bp, Homo sapiens
ccactgcaggccc

SEQ ID NO: 3883278 - DNA, 17 bp, Homo sapiens
ccactgcaggccccgct

SEQ ID NO: 3883279 - DNA, 11 bp, Homo sapiens
ccactgccagg

SEQ ID NO: 3883280 - DNA, 22 bp, Homo sapiens
ccactgccaggcacctggcctg

SEQ ID NO: 3883281 - DNA, 23 bp, Homo sapiens
ccactgccaggcacctggcctgc

SEQ ID NO: 3883282 - DNA, 13 bp, Homo sapiens
ccactgccctgcc

SEQ ID NO: 3883283 - DNA, 15 bp, Homo sapiens
ccactgccctgcctg

SEQ ID NO: 3883284 - DNA, 19 bp, Homo sapiens
ccactgccctgcctgccca

SEQ ID NO: 3883285 - DNA, 21 bp, Homo sapiens
ccactgccttcgatacaccgg

SEQ ID NO: 3883286 - DNA, 17 bp, Homo sapiens
ccactggaacagcccat

SEQ ID NO: 3883287 - DNA, 11 bp, Homo sapiens
ccactggaggt

SEQ ID NO: 3883288 - DNA, 14 bp, Homo sapiens
ccactggatcttca

SEQ ID NO: 3883289 - DNA, 15 bp, Homo sapiens
ccactggatcttcag

SEQ ID NO: 3883290 - DNA, 11 bp, Homo sapiens
ccactggccag

SEQ ID NO: 3883291 - DNA, 12 bp, Homo sapiens
ccactggccagt

SEQ ID NO: 3883292 - DNA, 23 bp, Homo sapiens
ccactggttaaaataaagcctat

SEQ ID NO: 3883293 - DNA, 12 bp, Homo sapiens
ccactgtacata

SEQ ID NO: 3883294 - DNA, 13 bp, Homo sapiens
ccactgtccgcct

SEQ ID NO: 3883295 - DNA, 23 bp, Homo sapiens
ccactgtccgcctctgcccgcag

SEQ ID NO: 3883296 - DNA, 17 bp, Homo sapiens
ccactgtgctgaattct

SEQ ID NO: 3883297 - DNA, 18 bp, Homo sapiens
ccactgtgcttacagtga

SEQ ID NO: 3883298 - DNA, 19 bp, Homo sapiens
ccacttagccgtccatggc

SEQ ID NO: 3883299 - DNA, 21 bp, Homo sapiens
ccacttagccgtccatggcac

SEQ ID NO: 3883300 - DNA, 12 bp, Homo sapiens
ccacttcactgt

SEQ ID NO: 3883301 - DNA, 14 bp, Homo sapiens
ccacttcagcccag

SEQ ID NO: 3883302 - DNA, 13 bp, Homo sapiens
ccacttccaggag

SEQ ID NO: 3883303 - DNA, 20 bp, Homo sapiens
ccacttccaggagcccagag

SEQ ID NO: 3883304 - DNA, 20 bp, Homo sapiens
ccacttcttaaaggcctgga

SEQ ID NO: 3883305 - DNA, 23 bp, Homo sapiens
ccacttcttaaaggcctggaacc

SEQ ID NO: 3883306 - DNA, 22 bp, Homo sapiens
ccacttgtcatccataaagcaa

SEQ ID NO: 3883307 - DNA, 17 bp, Homo sapiens
ccactttaagagagaaa

SEQ ID NO: 3883308 - DNA, 17 bp, Homo sapiens
ccagaaattagaaacct

SEQ ID NO: 3883309 - DNA, 16 bp, Homo sapiens
ccagaaattccttccc

SEQ ID NO: 3883310 - DNA, 22 bp, Homo sapiens
ccagaacaaggttccctctgag

SEQ ID NO: 3883311 - DNA, 17 bp, Homo sapiens
ccagaagaatattcagg

SEQ ID NO: 3883312 - DNA, 18 bp, Homo sapiens
ccagaagaatattcagga

SEQ ID NO: 3883313 - DNA, 16 bp, Homo sapiens
ccagaagatgccctcc

SEQ ID NO: 3883314 - DNA, 16 bp, Homo sapiens
ccagaaggagggcaga

SEQ ID NO: 3883315 - DNA, 22 bp, Homo sapiens
ccagaaggagggcagagccatg

SEQ ID NO: 3883316 - DNA, 21 bp, Homo sapiens
ccagaataagtgctgtttgag

SEQ ID NO: 3883317 - DNA, 13 bp, Homo sapiens
ccagaatctgctg

SEQ ID NO: 3883318 - DNA, 18 bp, Homo sapiens
ccagaatctgctgttgcc

SEQ ID NO: 3883319 - DNA, 15 bp, Homo sapiens
ccagacacagataca

SEQ ID NO: 3883320 - DNA, 22 bp, Homo sapiens
ccagacatacgaaacacaaacc

SEQ ID NO: 3883321 - DNA, 15 bp, Homo sapiens
ccagaccacctgcca

SEQ ID NO: 3883322 - DNA, 21 bp, Homo sapiens
ccagaccacctgccagccatc

SEQ ID NO: 3883323 - DNA, 15 bp, Homo sapiens
ccagaccattgtctt

SEQ ID NO: 3883324 - DNA, 19 bp, Homo sapiens
ccagaccattgtcttccaa

SEQ ID NO: 3883325 - DNA, 18 bp, Homo sapiens
ccagacccctggcttttc

SEQ ID NO: 3883326 - DNA, 24 bp, Homo sapiens
ccagacccctggcttttcactgct

SEQ ID NO: 3883327 - DNA, 19 bp, Homo sapiens
ccagacctagacctgggcc

SEQ ID NO: 3883328 - DNA, 24 bp, Homo sapiens
ccagacgctgccgctgccgctgca

SEQ ID NO: 3883329 - DNA, 14 bp, Homo sapiens
ccagactcagctcc

SEQ ID NO: 3883330 - DNA, 15 bp, Homo sapiens
ccagactcctttcct

SEQ ID NO: 3883331 - DNA, 18 bp, Homo sapiens
ccagactgtggagaaata

SEQ ID NO: 3883332 - DNA, 18 bp, Homo sapiens
ccagactttctacacctg

SEQ ID NO: 3883333 - DNA, 13 bp, Homo sapiens
ccagagacaggaa

SEQ ID NO: 3883334 - DNA, 14 bp, Homo sapiens
ccagagacaggaaa

SEQ ID NO: 3883335 - DNA, 16 bp, Homo sapiens
ccagagacaggaaaga

SEQ ID NO: 3883336 - DNA, 18 bp, Homo sapiens
ccagagacaggaaagaat

SEQ ID NO: 3883337 - DNA, 20 bp, Homo sapiens
ccagagaccccttcctttcc

SEQ ID NO: 3883338 - DNA, 22 bp, Homo sapiens
ccagagaccccttcctttcctc

SEQ ID NO: 3883339 - DNA, 20 bp, Homo sapiens
ccagagaggagcacctgaac

SEQ ID NO: 3883340 - DNA, 14 bp, Homo sapiens
ccagagagggccca

SEQ ID NO: 3883341 - DNA, 15 bp, Homo sapiens
ccagagagggcccag

SEQ ID NO: 3883342 - DNA, 17 bp, Homo sapiens
ccagagagggcccagct

SEQ ID NO: 3883343 - DNA, 21 bp, Homo sapiens
ccagagagggcccagctgtag

SEQ ID NO: 3883344 - DNA, 18 bp, Homo sapiens
ccagagagtggctcctcc

SEQ ID NO: 3883345 - DNA, 20 bp, Homo sapiens
ccagagatgcctccaccgct

SEQ ID NO: 3883346 - DNA, 21 bp, Homo sapiens
ccagagcacaagttccagctg

SEQ ID NO: 3883347 - DNA, 16 bp, Homo sapiens
ccagagcactgctcca

SEQ ID NO: 3883348 - DNA, 14 bp, Homo sapiens
ccagagcagagagc

SEQ ID NO: 3883349 - DNA, 20 bp, Homo sapiens
ccagagcattacgtgagcca

SEQ ID NO: 3883350 - DNA, 14 bp, Homo sapiens
ccagagccagcctg

SEQ ID NO: 3883351 - DNA, 17 bp, Homo sapiens
ccagagccagcctggga

SEQ ID NO: 3883352 - DNA, 20 bp, Homo sapiens
ccagagccagcctgggactc

SEQ ID NO: 3883353 - DNA, 20 bp, Homo sapiens
ccagagcccaagtgccatcc

SEQ ID NO: 3883354 - DNA, 23 bp, Homo sapiens
ccagagcccaagtgccatcccac

SEQ ID NO: 3883355 - DNA, 24 bp, Homo sapiens
ccagagcccaagtgccatcccaca

SEQ ID NO: 3883356 - DNA, 14 bp, Homo sapiens
ccagagccccacac

SEQ ID NO: 3883357 - DNA, 14 bp, Homo sapiens
ccagagccccccac

SEQ ID NO: 3883358 - DNA, 11 bp, Homo sapiens
ccagagcctgg

SEQ ID NO: 3883359 - DNA, 12 bp, Homo sapiens
ccagagcctggg

SEQ ID NO: 3883360 - DNA, 12 bp, Homo sapiens
ccagagctggaa

SEQ ID NO: 3883361 - DNA, 15 bp, Homo sapiens
ccagagctggaaggc

SEQ ID NO: 3883362 - DNA, 21 bp, Homo sapiens
ccagagctggaaggcagggca

SEQ ID NO: 3883363 - DNA, 22 bp, Homo sapiens
ccagagcttattggccactggg

SEQ ID NO: 3883364 - DNA, 16 bp, Homo sapiens
ccagaggcagagcctg

SEQ ID NO: 3883365 - DNA, 20 bp, Homo sapiens
ccagagggccaagagagaca

SEQ ID NO: 3883366 - DNA, 16 bp, Homo sapiens
ccagagggtagggcag

SEQ ID NO: 3883367 - DNA, 19 bp, Homo sapiens
ccagaggttatctgcctgg

SEQ ID NO: 3883368 - DNA, 22 bp, Homo sapiens
ccagaggttttaggaaacctgg

SEQ ID NO: 3883369 - DNA, 15 bp, Homo sapiens
ccagagtggagtctg

SEQ ID NO: 3883370 - DNA, 18 bp, Homo sapiens
ccagagtggagtctgagt

SEQ ID NO: 3883371 - DNA, 19 bp, Homo sapiens
ccagagtggagtctgagtc

SEQ ID NO: 3883372 - DNA, 21 bp, Homo sapiens
ccagagtgtgggaagggagag

SEQ ID NO: 3883373 - DNA, 13 bp, Homo sapiens
ccagatcactcaa

SEQ ID NO: 3883374 - DNA, 18 bp, Homo sapiens
ccagatctgcctgggcct

SEQ ID NO: 3883375 - DNA, 19 bp, Homo sapiens
ccagatctgcctgggcctg

SEQ ID NO: 3883376 - DNA, 22 bp, Homo sapiens
ccagatctgcctgggcctgtgc

SEQ ID NO: 3883377 - DNA, 16 bp, Homo sapiens
ccagatgccttcctgt

SEQ ID NO: 3883378 - DNA, 21 bp, Homo sapiens
ccagcaacacaagctggaagc

SEQ ID NO: 3883379 - DNA, 22 bp, Homo sapiens
ccagcaacatctcgagccccct

SEQ ID NO: 3883380 - DNA, 12 bp, Homo sapiens
ccagcacagggg

SEQ ID NO: 3883381 - DNA, 15 bp, Homo sapiens
ccagcacaggggccc

SEQ ID NO: 3883382 - DNA, 20 bp, Homo sapiens
ccagcacaggggccccagat

SEQ ID NO: 3883383 - DNA, 18 bp, Homo sapiens
ccagcaccctctcctggg

SEQ ID NO: 3883384 - DNA, 19 bp, Homo sapiens
ccagcaccctctcctgggg

SEQ ID NO: 3883385 - DNA, 12 bp, Homo sapiens
ccagcaccgagc

SEQ ID NO: 3883386 - DNA, 17 bp, Homo sapiens
ccagcactttgggaggc

SEQ ID NO: 3883387 - DNA, 12 bp, Homo sapiens
ccagcagaaaag

SEQ ID NO: 3883388 - DNA, 20 bp, Homo sapiens
ccagcagccctggcctgtgg

SEQ ID NO: 3883389 - DNA, 18 bp, Homo sapiens
ccagcagctgcgggtctg

SEQ ID NO: 3883390 - DNA, 14 bp, Homo sapiens
ccagcagctgggcc

SEQ ID NO: 3883391 - DNA, 21 bp, Homo sapiens
ccagcagctgggccggccagc

SEQ ID NO: 3883392 - DNA, 20 bp, Homo sapiens
ccagcaggccagggactcag

SEQ ID NO: 3883393 - DNA, 22 bp, Homo sapiens
ccagcaggccagggactcagcg

SEQ ID NO: 3883394 - DNA, 22 bp, Homo sapiens
ccagcagttgaatgacaacaga

SEQ ID NO: 3883395 - DNA, 15 bp, Homo sapiens
ccagcagtttgggag

SEQ ID NO: 3883396 - DNA, 13 bp, Homo sapiens
ccagcatccagcc

SEQ ID NO: 3883397 - DNA, 14 bp, Homo sapiens
ccagcatccagcct

SEQ ID NO: 3883398 - DNA, 19 bp, Homo sapiens
ccagcatccagcctgtgtg

SEQ ID NO: 3883399 - DNA, 14 bp, Homo sapiens
ccagcatcctgctt

SEQ ID NO: 3883400 - DNA, 17 bp, Homo sapiens
ccagcattttactactt

SEQ ID NO: 3883401 - DNA, 22 bp, Homo sapiens
ccagccactcgggaggctgaga

SEQ ID NO: 3883402 - DNA, 23 bp, Homo sapiens
ccagccaggatcccaagcgtccc

SEQ ID NO: 3883403 - DNA, 12 bp, Homo sapiens
ccagcccagccc

SEQ ID NO: 3883404 - DNA, 18 bp, Homo sapiens
ccagcccagcccagctgg

SEQ ID NO: 3883405 - DNA, 17 bp, Homo sapiens
ccagcccattctctctc

SEQ ID NO: 3883406 - DNA, 21 bp, Homo sapiens
ccaacagcttgaccagaccta

SEQ ID NO: 3883407 - DNA, 22 bp, Homo sapiens
ccaacagcttgaccagacctag

SEQ ID NO: 3883408 - DNA, 19 bp, Homo sapiens
ccaacagtcaaaacagaga

SEQ ID NO: 3883409 - DNA, 19 bp, Homo sapiens
ccaacatacccttctttaa

SEQ ID NO: 3883410 - DNA, 15 bp, Homo sapiens
ccaacatggagaaac

SEQ ID NO: 3883411 - DNA, 17 bp, Homo sapiens
ccaacatttaatgagca

SEQ ID NO: 3883412 - DNA, 21 bp, Homo sapiens
ccaaccaagagcacattctta

SEQ ID NO: 3883413 - DNA, 20 bp, Homo sapiens
ccaaccaagtggctcccaca

SEQ ID NO: 3883414 - DNA, 23 bp, Homo sapiens
ccaacccaattcaggactggctc

SEQ ID NO: 3883415 - DNA, 19 bp, Homo sapiens
ccaaccccagctggcctct

SEQ ID NO: 3883416 - DNA, 18 bp, Homo sapiens
ccaacccgtggaggctgc

SEQ ID NO: 3883417 - DNA, 18 bp, Homo sapiens
ccaaccctgtttcctgag

SEQ ID NO: 3883418 - DNA, 19 bp, Homo sapiens
ccaacctcaatgccctgcc

SEQ ID NO: 3883419 - DNA, 21 bp, Homo sapiens
ccaacctcaatgccctgccat

SEQ ID NO: 3883420 - DNA, 23 bp, Homo sapiens
ccaacctcaatgccctgccatta

SEQ ID NO: 3883421 - DNA, 13 bp, Homo sapiens
ccaacctgaccaa

SEQ ID NO: 3883422 - DNA, 19 bp, Homo sapiens
ccaacctgatgccccttcc

SEQ ID NO: 3883423 - DNA, 18 bp, Homo sapiens
ccaacctgcctgtgcatg

SEQ ID NO: 3883424 - DNA, 19 bp, Homo sapiens
ccaacgttaaaagacagtg

SEQ ID NO: 3883425 - DNA, 14 bp, Homo sapiens
ccaactaagccctc

SEQ ID NO: 3883426 - DNA, 15 bp, Homo sapiens
ccaactaagccctcg

SEQ ID NO: 3883427 - DNA, 15 bp, Homo sapiens
ccaactcctggaagc

SEQ ID NO: 3883428 - DNA, 18 bp, Homo sapiens
ccaactcctggagatttc

SEQ ID NO: 3883429 - DNA, 15 bp, Homo sapiens
ccaactccttccagc

SEQ ID NO: 3883430 - DNA, 16 bp, Homo sapiens
ccaactccttccagct

SEQ ID NO: 3883431 - DNA, 16 bp, Homo sapiens
ccaactctgcactcca

SEQ ID NO: 3883432 - DNA, 19 bp, Homo sapiens
ccaactcttcattttgagt

SEQ ID NO: 3883433 - DNA, 13 bp, Homo sapiens
ccaactggcttct

SEQ ID NO: 3883434 - DNA, 13 bp, Homo sapiens
ccaactggtcact

SEQ ID NO: 3883435 - DNA, 14 bp, Homo sapiens
ccaactttctgtaa

SEQ ID NO: 3883436 - DNA, 22 bp, Homo sapiens
ccaagaagggctagaacctgga

SEQ ID NO: 3883437 - DNA, 20 bp, Homo sapiens
ccaagaatagatgctgactg

SEQ ID NO: 3883438 - DNA, 16 bp, Homo sapiens
ccaagaccccagcttc

SEQ ID NO: 3883439 - DNA, 18 bp, Homo sapiens
ccaagacttggcaacaga

SEQ ID NO: 3883440 - DNA, 20 bp, Homo sapiens
ccaagacttggcaacagaag

SEQ ID NO: 3883441 - DNA, 13 bp, Homo sapiens
ccaagagagaaag

SEQ ID NO: 3883442 - DNA, 14 bp, Homo sapiens
ccaagagagaaaga

SEQ ID NO: 3883443 - DNA, 12 bp, Homo sapiens
ccaagagagaca

SEQ ID NO: 3883444 - DNA, 12 bp, Homo sapiens
ccaagagatgaa

SEQ ID NO: 3883445 - DNA, 16 bp, Homo sapiens
ccaagagcatcatgcc

SEQ ID NO: 3883446 - DNA, 23 bp, Homo sapiens
ccaagagcatcatgcctctgagg

SEQ ID NO: 3883447 - DNA, 18 bp, Homo sapiens
ccaagaggactgagactg

SEQ ID NO: 3883448 - DNA, 13 bp, Homo sapiens
ccaagaggtgggg

SEQ ID NO: 3883449 - DNA, 20 bp, Homo sapiens
ccaagatgggcacatgagga

SEQ ID NO: 3883450 - DNA, 14 bp, Homo sapiens
ccaagatttcagaa

SEQ ID NO: 3883451 - DNA, 21 bp, Homo sapiens
ccaagcagcattcagcacacc

SEQ ID NO: 3883452 - DNA, 23 bp, Homo sapiens
ccaagcagcattcagcacacccc

SEQ ID NO: 3883453 - DNA, 13 bp, Homo sapiens
ccaagcagccagc

SEQ ID NO: 3883454 - DNA, 18 bp, Homo sapiens
ccaagcagccagccagtc

SEQ ID NO: 3883455 - DNA, 22 bp, Homo sapiens
ccaagccatggtgacacacagc

SEQ ID NO: 3883456 - DNA, 22 bp, Homo sapiens
ccaagccccttggccctctccc

SEQ ID NO: 3883457 - DNA, 13 bp, Homo sapiens
ccaagccgtggct

SEQ ID NO: 3883458 - DNA, 14 bp, Homo sapiens
ccaagccgtggctt

SEQ ID NO: 3883459 - DNA, 15 bp, Homo sapiens
ccaagccgtggcttc

SEQ ID NO: 3883460 - DNA, 16 bp, Homo sapiens
ccaagccgtggcttcc

SEQ ID NO: 3883461 - DNA, 21 bp, Homo sapiens
ccaagccgtggcttcccgctc

SEQ ID NO: 3883462 - DNA, 13 bp, Homo sapiens
ccaagcctctgcc

SEQ ID NO: 3883463 - DNA, 22 bp, Homo sapiens
ccaagcctctgccccaaggggc

SEQ ID NO: 3883464 - DNA, 20 bp, Homo sapiens
ccaagcgaggtcaacagaga

SEQ ID NO: 3883465 - DNA, 15 bp, Homo sapiens
ccaagcgtcccgtcc

SEQ ID NO: 3883466 - DNA, 17 bp, Homo sapiens
ccaagctcacagttcct

SEQ ID NO: 3883467 - DNA, 19 bp, Homo sapiens
ccaagctgaagtgaaggag

SEQ ID NO: 3883468 - DNA, 19 bp, Homo sapiens
ccaagctgaggtgcccagg

SEQ ID NO: 3883469 - DNA, 22 bp, Homo sapiens
ccaagctggcagctgtcattca

SEQ ID NO: 3883470 - DNA, 15 bp, Homo sapiens
ccaagcttcagagcc

SEQ ID NO: 3883471 - DNA, 20 bp, Homo sapiens
ccaagcttcagagcctagcc

SEQ ID NO: 3883472 - DNA, 21 bp, Homo sapiens
ccaagcttcagagcctagcca

SEQ ID NO: 3883473 - DNA, 18 bp, Homo sapiens
ccaagcttgtgagagctg

SEQ ID NO: 3883474 - DNA, 19 bp, Homo sapiens
ccaagcttgtgagagctgg

SEQ ID NO: 3883475 - DNA, 14 bp, Homo sapiens
ccaaggaacaagag

SEQ ID NO: 3883476 - DNA, 13 bp, Homo sapiens
ccaaggaccaggt

SEQ ID NO: 3883477 - DNA, 14 bp, Homo sapiens
ccaaggagaaacag

SEQ ID NO: 3883478 - DNA, 18 bp, Homo sapiens
ccaaggagaaacagagac

SEQ ID NO: 3883479 - DNA, 23 bp, Homo sapiens
ccaaggagctgatttccaggccc

SEQ ID NO: 3883480 - DNA, 13 bp, Homo sapiens
ccaaggaggaaaa

SEQ ID NO: 3883481 - DNA, 21 bp, Homo sapiens
ccaaggaggaaaaacagacaa

SEQ ID NO: 3883482 - DNA, 14 bp, Homo sapiens
ccaaggcagcctcc

SEQ ID NO: 3883483 - DNA, 14 bp, Homo sapiens
ccaaggcccagcta

SEQ ID NO: 3883484 - DNA, 18 bp, Homo sapiens
ccaaggggacttgtgcca

SEQ ID NO: 3883485 - DNA, 21 bp, Homo sapiens
ccaaggggcccacaaagggga

SEQ ID NO: 3883486 - DNA, 15 bp, Homo sapiens
ccaaggttgtcctgg

SEQ ID NO: 3883487 - DNA, 14 bp, Homo sapiens
ccaagtatttatta

SEQ ID NO: 3883488 - DNA, 18 bp, Homo sapiens
ccaagtccaacctgcctg

SEQ ID NO: 3883489 - DNA, 19 bp, Homo sapiens
ccaagtccaacctgcctgt

SEQ ID NO: 3883490 - DNA, 16 bp, Homo sapiens
ccaagtggctcccaca

SEQ ID NO: 3883491 - DNA, 17 bp, Homo sapiens
ccaagttatattgaata

SEQ ID NO: 3883492 - DNA, 19 bp, Homo sapiens
ccaagttcctgcactccag

SEQ ID NO: 3883493 - DNA, 13 bp, Homo sapiens
ccaataaaagtga

SEQ ID NO: 3883494 - DNA, 14 bp, Homo sapiens
ccaataaaagtgac

SEQ ID NO: 3883495 - DNA, 15 bp, Homo sapiens
ccaataaaagtgact

SEQ ID NO: 3883496 - DNA, 23 bp, Homo sapiens
ccaataaagctggacaagaagct

SEQ ID NO: 3883497 - DNA, 13 bp, Homo sapiens
ccaatcagcactg

SEQ ID NO: 3883498 - DNA, 14 bp, Homo sapiens
ccaatcagcactga

SEQ ID NO: 3883499 - DNA, 23 bp, Homo sapiens
ccaatccaggtgggagagacact

SEQ ID NO: 3883500 - DNA, 17 bp, Homo sapiens
ccaatcccggtcatgct

SEQ ID NO: 3883501 - DNA, 18 bp, Homo sapiens
ccaatctgctcagcaggc

SEQ ID NO: 3883502 - DNA, 17 bp, Homo sapiens
ccaatgattcataacaa

SEQ ID NO: 3883503 - DNA, 19 bp, Homo sapiens
ccaatgcacatccattccc

SEQ ID NO: 3883504 - DNA, 17 bp, Homo sapiens
ccaatgcatgcagccac

SEQ ID NO: 3883505 - DNA, 21 bp, Homo sapiens
ccaatggagactgtctcaaga

SEQ ID NO: 3883506 - DNA, 16 bp, Homo sapiens
ccaattaaaatatata

SEQ ID NO: 3883507 - DNA, 18 bp, Homo sapiens
ccaattaaaatatatata

SEQ ID NO: 3883508 - DNA, 21 bp, Homo sapiens
ccaattcaggactggctcacc

SEQ ID NO: 3883509 - DNA, 13 bp, Homo sapiens
ccacaaaggggag

SEQ ID NO: 3883510 - DNA, 16 bp, Homo sapiens
ccacaaataatgaaca

SEQ ID NO: 3883511 - DNA, 20 bp, Homo sapiens
ccacaaatctatattaaagt

SEQ ID NO: 3883512 - DNA, 23 bp, Homo sapiens
ccacaaatctatattaaagtgtt

SEQ ID NO: 3883513 - DNA, 20 bp, Homo sapiens
ccacaagattcccagagaca

SEQ ID NO: 3883514 - DNA, 23 bp, Homo sapiens
ccacaagccattttttgaggaga

SEQ ID NO: 3883515 - DNA, 16 bp, Homo sapiens
ccacaagccttactca

SEQ ID NO: 3883516 - DNA, 21 bp, Homo sapiens
ccacaagccttactcacctct

SEQ ID NO: 3883517 - DNA, 17 bp, Homo sapiens
ccacaatgcctctccca

SEQ ID NO: 3883518 - DNA, 22 bp, Homo sapiens
ccacacacgcaggaactcccag

SEQ ID NO: 3883519 - DNA, 15 bp, Homo sapiens
ccacaccaaacctct

SEQ ID NO: 3883520 - DNA, 20 bp, Homo sapiens
ccacaccacagcaagccggc

SEQ ID NO: 3883521 - DNA, 14 bp, Homo sapiens
ccacaccgcagaag

SEQ ID NO: 3883522 - DNA, 15 bp, Homo sapiens
ccacaccgcagaagc

SEQ ID NO: 3883523 - DNA, 17 bp, Homo sapiens
ccacacctccctgaacc

SEQ ID NO: 3883524 - DNA, 21 bp, Homo sapiens
ccacacgtgctcgcagcctgg

SEQ ID NO: 3883525 - DNA, 22 bp, Homo sapiens
ccacacgtgctcgcagcctggc

SEQ ID NO: 3883526 - DNA, 16 bp, Homo sapiens
ccacacttcaggctct

SEQ ID NO: 3883527 - DNA, 23 bp, Homo sapiens
ccacacttctcaggacacaggcc

SEQ ID NO: 3883528 - DNA, 21 bp, Homo sapiens
ccacactttgagaacctgtgc

SEQ ID NO: 3883529 - DNA, 15 bp, Homo sapiens
ccacagacagatccc

SEQ ID NO: 3883530 - DNA, 16 bp, Homo sapiens
ccacagacagatccca

SEQ ID NO: 3883531 - DNA, 20 bp, Homo sapiens
ccacagacagatcccatcca

SEQ ID NO: 3883532 - DNA, 16 bp, Homo sapiens
ccacagcacccaggct

SEQ ID NO: 3883533 - DNA, 14 bp, Homo sapiens
ccacagcagctgaa

SEQ ID NO: 3883534 - DNA, 14 bp, Homo sapiens
ccacagccaacaaa

SEQ ID NO: 3883535 - DNA, 15 bp, Homo sapiens
ccacagctcccaccc

SEQ ID NO: 3883536 - DNA, 17 bp, Homo sapiens
ccacagctcccacccca

SEQ ID NO: 3883537 - DNA, 15 bp, Homo sapiens
ccacaggcccttcct

SEQ ID NO: 3883538 - DNA, 17 bp, Homo sapiens
ccacaggcccttcctct

SEQ ID NO: 3883539 - DNA, 23 bp, Homo sapiens
ccacaggcccttcctctccactg

SEQ ID NO: 3883540 - DNA, 15 bp, Homo sapiens
ccacaggcccttggg

SEQ ID NO: 3883541 - DNA, 16 bp, Homo sapiens
ccacagggaaccctgc

SEQ ID NO: 3883542 - DNA, 14 bp, Homo sapiens
ccacagggctaaga

SEQ ID NO: 3883543 - DNA, 20 bp, Homo sapiens
ccacagggctaagagctagc

SEQ ID NO: 3883544 - DNA, 14 bp, Homo sapiens
ccacaggggcaggc

SEQ ID NO: 3883545 - DNA, 15 bp, Homo sapiens
ccacaggggcaggcc

SEQ ID NO: 3883546 - DNA, 16 bp, Homo sapiens
ccacaggggcaggcct

SEQ ID NO: 3883547 - DNA, 18 bp, Homo sapiens
ccacaggggcaggcctgg

SEQ ID NO: 3883548 - DNA, 22 bp, Homo sapiens
ccacaggggcaggcctgggacc

SEQ ID NO: 3883549 - DNA, 23 bp, Homo sapiens
ccacaggtgtttatacagctcag

SEQ ID NO: 3883550 - DNA, 14 bp, Homo sapiens
ccacagtcaaagaa

SEQ ID NO: 3883551 - DNA, 18 bp, Homo sapiens
ccacagtcctcacagcct

SEQ ID NO: 3883552 - DNA, 17 bp, Homo sapiens
ccacagtctcccattct

SEQ ID NO: 3883553 - DNA, 14 bp, Homo sapiens
ccacagtgctgctt

SEQ ID NO: 3883554 - DNA, 14 bp, Homo sapiens
ccacagtgggtggc

SEQ ID NO: 3883555 - DNA, 19 bp, Homo sapiens
ccacagtgggtggcacctc

SEQ ID NO: 3883556 - DNA, 19 bp, Homo sapiens
ccacatacaacacaaagag

SEQ ID NO: 3883557 - DNA, 21 bp, Homo sapiens
ccacatagtgatggttcccct

SEQ ID NO: 3883558 - DNA, 15 bp, Homo sapiens
ccacatccacacacg

SEQ ID NO: 3883559 - DNA, 15 bp, Homo sapiens
ccacatcccaggctt

SEQ ID NO: 3883560 - DNA, 16 bp, Homo sapiens
ccacatccctgggcct

SEQ ID NO: 3883561 - DNA, 21 bp, Homo sapiens
ccacatccctgggcctgctgc

SEQ ID NO: 3883562 - DNA, 16 bp, Homo sapiens
ccacatctctgaaagc

SEQ ID NO: 3883563 - DNA, 14 bp, Homo sapiens
ccacatcttctcag

SEQ ID NO: 3883564 - DNA, 21 bp, Homo sapiens
ccacatgatcttgagatttct

SEQ ID NO: 3883565 - DNA, 20 bp, Homo sapiens
ccacatgccatttgtactga

SEQ ID NO: 3883566 - DNA, 21 bp, Homo sapiens
ccacattcggaccctgcccat

SEQ ID NO: 3883567 - DNA, 16 bp, Homo sapiens
ccacattggacttcct

SEQ ID NO: 3883568 - DNA, 18 bp, Homo sapiens
ccacattggacttccttg

SEQ ID NO: 3883569 - DNA, 16 bp, Homo sapiens
ccaccaaactgcacac

SEQ ID NO: 3883570 - DNA, 22 bp, Homo sapiens
ccaccaaactgcacacacagct

SEQ ID NO: 3883571 - DNA, 12 bp, Homo sapiens
ccaccaactctg

SEQ ID NO: 3883572 - DNA, 15 bp, Homo sapiens
ccaccaactctgcac

SEQ ID NO: 3883573 - DNA, 13 bp, Homo sapiens
ccaccaataaaaa

SEQ ID NO: 3883574 - DNA, 15 bp, Homo sapiens
ccaccaataaaaatc

SEQ ID NO: 3883575 - DNA, 13 bp, Homo sapiens
ccaccacactccc

SEQ ID NO: 3883576 - DNA, 22 bp, Homo sapiens
ccaccaccttggactcctccca

SEQ ID NO: 3883577 - DNA, 20 bp, Homo sapiens
ccaccacgatgtggccctgg

SEQ ID NO: 3883578 - DNA, 21 bp, Homo sapiens
ccaccacgatgtggccctggc

SEQ ID NO: 3883579 - DNA, 16 bp, Homo sapiens
ccaccacgtctgccag

SEQ ID NO: 3883580 - DNA, 22 bp, Homo sapiens
ccaccacgtctgccaggcccat

SEQ ID NO: 3883581 - DNA, 11 bp, Homo sapiens
ccaccacgtgc

SEQ ID NO: 3883582 - DNA, 14 bp, Homo sapiens
ccaccactagagct

SEQ ID NO: 3883583 - DNA, 15 bp, Homo sapiens
ccaccactagagctg

SEQ ID NO: 3883584 - DNA, 15 bp, Homo sapiens
ccaccatcctgcagc

SEQ ID NO: 3883585 - DNA, 17 bp, Homo sapiens
ccaccatgcccagtcga

SEQ ID NO: 3883586 - DNA, 13 bp, Homo sapiens
ccacccaggctgc

SEQ ID NO: 3883587 - DNA, 16 bp, Homo sapiens
ccacccaggctgcact

SEQ ID NO: 3883588 - DNA, 21 bp, Homo sapiens
ccacccaggctgcactgcagt

SEQ ID NO: 3883589 - DNA, 23 bp, Homo sapiens
ccacccaggggaatgatctctga

SEQ ID NO: 3883590 - DNA, 17 bp, Homo sapiens
ccacccagtgctgccat

SEQ ID NO: 3883591 - DNA, 19 bp, Homo sapiens
ccacccagtgctgccatgc

SEQ ID NO: 3883592 - DNA, 22 bp, Homo sapiens
ccacccagtgctgccatgccac

SEQ ID NO: 3883593 - DNA, 18 bp, Homo sapiens
ccacccatcttcctgctg

SEQ ID NO: 3883594 - DNA, 16 bp, Homo sapiens
ccacccattcccccat

SEQ ID NO: 3883595 - DNA, 17 bp, Homo sapiens
ccaccccacccccttca

SEQ ID NO: 3883596 - DNA, 19 bp, Homo sapiens
ccaccccactccagccctg

SEQ ID NO: 3883597 - DNA, 22 bp, Homo sapiens
ccaccccataatctcattcaaa

SEQ ID NO: 3883598 - DNA, 14 bp, Homo sapiens
ccacccccgctggg

SEQ ID NO: 3883599 - DNA, 18 bp, Homo sapiens
ccaccccctccagctcca

SEQ ID NO: 3883600 - DNA, 17 bp, Homo sapiens
ccacccccttcagtgcc

SEQ ID NO: 3883601 - DNA, 14 bp, Homo sapiens
ccaccccttcctgt

SEQ ID NO: 3883602 - DNA, 19 bp, Homo sapiens
ccacccgtaggcagcctct

SEQ ID NO: 3883603 - DNA, 19 bp, Homo sapiens
ccacccgttctgctggcct

SEQ ID NO: 3883604 - DNA, 17 bp, Homo sapiens
ccaccctcgtggacacc

SEQ ID NO: 3883605 - DNA, 21 bp, Homo sapiens
ccaccctcgtggacacctgcc

SEQ ID NO: 3883606 - DNA, 13 bp, Homo sapiens
ccaccctctccat

SEQ ID NO: 3883607 - DNA, 15 bp, Homo sapiens
ccaccgctgcctaag

SEQ ID NO: 3883608 - DNA, 16 bp, Homo sapiens
ccaccgggagcctccc

SEQ ID NO: 3883609 - DNA, 20 bp, Homo sapiens
ccaccgggagcctccccctc

SEQ ID NO: 3883610 - DNA, 22 bp, Homo sapiens
ccaccgggagcctccccctcag

SEQ ID NO: 3883611 - DNA, 14 bp, Homo sapiens
ccaccgggccactc

SEQ ID NO: 3883612 - DNA, 18 bp, Homo sapiens
ccaccggggaacccagcc

SEQ ID NO: 3883613 - DNA, 17 bp, Homo sapiens
ccacctacttgtgactg

SEQ ID NO: 3883614 - DNA, 19 bp, Homo sapiens
ccacctacttgtgactgaa

SEQ ID NO: 3883615 - DNA, 10 bp, Homo sapiens
ccacctcagc

SEQ ID NO: 3883616 - DNA, 12 bp, Homo sapiens
ccacctcagcct

SEQ ID NO: 3883617 - DNA, 15 bp, Homo sapiens
ccacctcagccttgg

SEQ ID NO: 3883618 - DNA, 17 bp, Homo sapiens
ccacctcatgcctggcc

SEQ ID NO: 3883619 - DNA, 15 bp, Homo sapiens
ccacctcccacccca

SEQ ID NO: 3883620 - DNA, 16 bp, Homo sapiens
ccacctcccaccccac

SEQ ID NO: 3883621 - DNA, 18 bp, Homo sapiens
ccacctcccaccccactc

SEQ ID NO: 3883622 - DNA, 22 bp, Homo sapiens
ccacctcccaccccactccagc

SEQ ID NO: 3883623 - DNA, 23 bp, Homo sapiens
ccacctcccaccccactccagcc

SEQ ID NO: 3883624 - DNA, 23 bp, Homo sapiens
ccacctcctagaggtgggcagct

SEQ ID NO: 3883625 - DNA, 13 bp, Homo sapiens
ccacctctcaata

SEQ ID NO: 3883626 - DNA, 12 bp, Homo sapiens
ccacctcttcct

SEQ ID NO: 3883627 - DNA, 18 bp, Homo sapiens
ccacctcttctcttcctg

SEQ ID NO: 3883628 - DNA, 20 bp, Homo sapiens
ccacctcttctcttcctgta

SEQ ID NO: 3883629 - DNA, 23 bp, Homo sapiens
ccacctcttctcttcctgtaaca

SEQ ID NO: 3883630 - DNA, 19 bp, Homo sapiens
ccacctgacaatggcagct

SEQ ID NO: 3883631 - DNA, 20 bp, Homo sapiens
ccacctgacaatggcagcta

SEQ ID NO: 3883632 - DNA, 12 bp, Homo sapiens
ccacctgccagc

SEQ ID NO: 3883633 - DNA, 17 bp, Homo sapiens
ccacctgccagccatca

SEQ ID NO: 3883634 - DNA, 15 bp, Homo sapiens
ccacctgcctatcca

SEQ ID NO: 3883635 - DNA, 19 bp, Homo sapiens
ccacctgcctatccatcct

SEQ ID NO: 3883636 - DNA, 20 bp, Homo sapiens
ccacctgcctatccatcctg

SEQ ID NO: 3883637 - DNA, 21 bp, Homo sapiens
ccacctgcctatccatcctgc

SEQ ID NO: 3883638 - DNA, 12 bp, Homo sapiens
ccacctggcccc

SEQ ID NO: 3883639 - DNA, 22 bp, Homo sapiens
ccacctggccccatgtctctca

SEQ ID NO: 3883640 - DNA, 11 bp, Homo sapiens
ccacctgtctg

SEQ ID NO: 3883641 - DNA, 12 bp, Homo sapiens
ccaccttcccag

SEQ ID NO: 3883642 - DNA, 13 bp, Homo sapiens
ccaccttcccagc

SEQ ID NO: 3883643 - DNA, 18 bp, Homo sapiens
ccaccttccccagactca

SEQ ID NO: 3883644 - DNA, 11 bp, Homo sapiens
ccaccttccct

SEQ ID NO: 3883645 - DNA, 22 bp, Homo sapiens
ccaccttggactcctcccacaa

SEQ ID NO: 3883646 - DNA, 15 bp, Homo sapiens
ccacgaatttgctgg

SEQ ID NO: 3883647 - DNA, 16 bp, Homo sapiens
ccacgagggtcaggac

SEQ ID NO: 3883648 - DNA, 15 bp, Homo sapiens
ccacgagtcacctgc

SEQ ID NO: 3883649 - DNA, 23 bp, Homo sapiens
ccacgagtcacctgcaagcccca

SEQ ID NO: 3883650 - DNA, 18 bp, Homo sapiens
ccacgatgtggccctggc

SEQ ID NO: 3883651 - DNA, 15 bp, Homo sapiens
ccacgcctcctggcc

SEQ ID NO: 3883652 - DNA, 16 bp, Homo sapiens
ccacgcctcctggcca

SEQ ID NO: 3883653 - DNA, 17 bp, Homo sapiens
ccacgcctcctggccag

SEQ ID NO: 3883654 - DNA, 19 bp, Homo sapiens
ccacgcctcctggccagac

SEQ ID NO: 3883655 - DNA, 13 bp, Homo sapiens
ccacgctgtcctc

SEQ ID NO: 3883656 - DNA, 20 bp, Homo sapiens
ccacggacgtttccatcagg

SEQ ID NO: 3883657 - DNA, 15 bp, Homo sapiens
ccacggcacctgggc

SEQ ID NO: 3883658 - DNA, 14 bp, Homo sapiens
ccacgggcctcagt

SEQ ID NO: 3883659 - DNA, 16 bp, Homo sapiens
ccacgggcctcagttt

SEQ ID NO: 3883660 - DNA, 13 bp, Homo sapiens
ccacggggagggg

SEQ ID NO: 3883661 - DNA, 19 bp, Homo sapiens
ccacgggggcggcaggctg

SEQ ID NO: 3883662 - DNA, 13 bp, Homo sapiens
ccacggtgcgtgg

SEQ ID NO: 3883663 - DNA, 16 bp, Homo sapiens
ccacggtgcgtggctg

SEQ ID NO: 3883664 - DNA, 19 bp, Homo sapiens
cattgtcttccaaccccag

SEQ ID NO: 3883665 - DNA, 21 bp, Homo sapiens
cattgtcttccaaccccagct

SEQ ID NO: 3883666 - DNA, 17 bp, Homo sapiens
cattgtgtgagcttcta

SEQ ID NO: 3883667 - DNA, 16 bp, Homo sapiens
cattgttattgtggaa

SEQ ID NO: 3883668 - DNA, 16 bp, Homo sapiens
cattgttgctccctgt

SEQ ID NO: 3883669 - DNA, 18 bp, Homo sapiens
catttaaaatgattagaa

SEQ ID NO: 3883670 - DNA, 23 bp, Homo sapiens
catttaagaaggagttctgacat

SEQ ID NO: 3883671 - DNA, 13 bp, Homo sapiens
catttactgacca

SEQ ID NO: 3883672 - DNA, 21 bp, Homo sapiens
catttagttttatggcatgat

SEQ ID NO: 3883673 - DNA, 18 bp, Homo sapiens
catttatatatatatgta

SEQ ID NO: 3883674 - DNA, 22 bp, Homo sapiens
catttattgcactcagcttttt

SEQ ID NO: 3883675 - DNA, 16 bp, Homo sapiens
catttcaattctcaaa

SEQ ID NO: 3883676 - DNA, 14 bp, Homo sapiens
catttcacacaggt

SEQ ID NO: 3883677 - DNA, 23 bp, Homo sapiens
catttcacacaggtcctgaaagt

SEQ ID NO: 3883678 - DNA, 21 bp, Homo sapiens
catttcataaggcctgccctc

SEQ ID NO: 3883679 - DNA, 22 bp, Homo sapiens
catttcataaggcctgccctcc

SEQ ID NO: 3883680 - DNA, 21 bp, Homo sapiens
catttccaaatgaatgacctt

SEQ ID NO: 3883681 - DNA, 13 bp, Homo sapiens
catttcctgacag

SEQ ID NO: 3883682 - DNA, 17 bp, Homo sapiens
catttcgcccctcattt

SEQ ID NO: 3883683 - DNA, 18 bp, Homo sapiens
catttctactgtgactga

SEQ ID NO: 3883684 - DNA, 22 bp, Homo sapiens
catttctcaatcagtgcagtga

SEQ ID NO: 3883685 - DNA, 18 bp, Homo sapiens
catttctctccaggaagt

SEQ ID NO: 3883686 - DNA, 22 bp, Homo sapiens
catttctgagtttcattctcct

SEQ ID NO: 3883687 - DNA, 23 bp, Homo sapiens
catttctgcatcagctgctgaaa

SEQ ID NO: 3883688 - DNA, 21 bp, Homo sapiens
catttgaataaagcctgcttt

SEQ ID NO: 3883689 - DNA, 15 bp, Homo sapiens
catttgacagtgtgg

SEQ ID NO: 3883690 - DNA, 19 bp, Homo sapiens
catttgataaactaaaagc

SEQ ID NO: 3883691 - DNA, 14 bp, Homo sapiens
catttgatgtacat

SEQ ID NO: 3883692 - DNA, 15 bp, Homo sapiens
catttgatgtacatg

SEQ ID NO: 3883693 - DNA, 13 bp, Homo sapiens
catttgcaagctg

SEQ ID NO: 3883694 - DNA, 19 bp, Homo sapiens
catttgcacaggttttcag

SEQ ID NO: 3883695 - DNA, 23 bp, Homo sapiens
catttgccctgtggattccagca

SEQ ID NO: 3883696 - DNA, 16 bp, Homo sapiens
catttgctttttcacc

SEQ ID NO: 3883697 - DNA, 16 bp, Homo sapiens
catttggacaaaatgg

SEQ ID NO: 3883698 - DNA, 22 bp, Homo sapiens
catttgggaaattcagcttttg

SEQ ID NO: 3883699 - DNA, 16 bp, Homo sapiens
catttgttggaatgaa

SEQ ID NO: 3883700 - DNA, 21 bp, Homo sapiens
cattttaaaaaccaatcattt

SEQ ID NO: 3883701 - DNA, 22 bp, Homo sapiens
cattttaaaagcaattatattg

SEQ ID NO: 3883702 - DNA, 23 bp, Homo sapiens
cattttaaaagcaattatattgt

SEQ ID NO: 3883703 - DNA, 15 bp, Homo sapiens
cattttactacttgt

SEQ ID NO: 3883704 - DNA, 23 bp, Homo sapiens
cattttaggaaaaaaaaaagcat

SEQ ID NO: 3883705 - DNA, 13 bp, Homo sapiens
cattttaggcctc

SEQ ID NO: 3883706 - DNA, 14 bp, Homo sapiens
cattttaggcctcc

SEQ ID NO: 3883707 - DNA, 15 bp, Homo sapiens
cattttaggcctcct

SEQ ID NO: 3883708 - DNA, 16 bp, Homo sapiens
cattttagtgactgta

SEQ ID NO: 3883709 - DNA, 15 bp, Homo sapiens
cattttatttattag

SEQ ID NO: 3883710 - DNA, 12 bp, Homo sapiens
cattttcccaga

SEQ ID NO: 3883711 - DNA, 20 bp, Homo sapiens
cattttcctcgcctaggcct

SEQ ID NO: 3883712 - DNA, 16 bp, Homo sapiens
cattttctcctaggag

SEQ ID NO: 3883713 - DNA, 15 bp, Homo sapiens
cattttgttatagaa

SEQ ID NO: 3883714 - DNA, 23 bp, Homo sapiens
ccaaaacctttccccagacacat

SEQ ID NO: 3883715 - DNA, 22 bp, Homo sapiens
ccaaaagtcaaaaggtgcctgt

SEQ ID NO: 3883716 - DNA, 20 bp, Homo sapiens
ccaaaatactacacatccaa

SEQ ID NO: 3883717 - DNA, 12 bp, Homo sapiens
ccaaacactcca

SEQ ID NO: 3883718 - DNA, 22 bp, Homo sapiens
ccaaacattaatcaccaaagta

SEQ ID NO: 3883719 - DNA, 15 bp, Homo sapiens
ccaaacctgacagat

SEQ ID NO: 3883720 - DNA, 16 bp, Homo sapiens
ccaaactgttcaagaa

SEQ ID NO: 3883721 - DNA, 14 bp, Homo sapiens
ccaaagagcctgga

SEQ ID NO: 3883722 - DNA, 17 bp, Homo sapiens
ccaaagagcctggagaa

SEQ ID NO: 3883723 - DNA, 18 bp, Homo sapiens
ccaaagagcctggagaag

SEQ ID NO: 3883724 - DNA, 13 bp, Homo sapiens
ccaaagcatggac

SEQ ID NO: 3883725 - DNA, 23 bp, Homo sapiens
ccaaagccccttgctctcccctg

SEQ ID NO: 3883726 - DNA, 18 bp, Homo sapiens
ccaaaggaagtctaggag

SEQ ID NO: 3883727 - DNA, 12 bp, Homo sapiens
ccaaaggaatcg

SEQ ID NO: 3883728 - DNA, 17 bp, Homo sapiens
ccaaaggacagccgcct

SEQ ID NO: 3883729 - DNA, 20 bp, Homo sapiens
ccaaaggacattatgtgtgc

SEQ ID NO: 3883730 - DNA, 19 bp, Homo sapiens
ccaaaggggctgctggggc

SEQ ID NO: 3883731 - DNA, 23 bp, Homo sapiens
ccaaagtgccactcattcctgta

SEQ ID NO: 3883732 - DNA, 15 bp, Homo sapiens
ccaaataaatgtgta

SEQ ID NO: 3883733 - DNA, 21 bp, Homo sapiens
ccaaatattattcaagtgcct

SEQ ID NO: 3883734 - DNA, 23 bp, Homo sapiens
ccaaatattattcaagtgcctct

SEQ ID NO: 3883735 - DNA, 11 bp, Homo sapiens
ccaaatatttt

SEQ ID NO: 3883736 - DNA, 16 bp, Homo sapiens
ccaaatgaatgacctt

SEQ ID NO: 3883737 - DNA, 19 bp, Homo sapiens
ccaaatgatgccacttccc

SEQ ID NO: 3883738 - DNA, 22 bp, Homo sapiens
ccaaatgcatggtgcagttgac

SEQ ID NO: 3883739 - DNA, 20 bp, Homo sapiens
ccaaattgctgggattacag

SEQ ID NO: 3883740 - DNA, 16 bp, Homo sapiens
ccaacaatggggtggg

SEQ ID NO: 3883741 - DNA, 22 bp, Homo sapiens
ccaacacaatctttccttgtct

SEQ ID NO: 3883742 - DNA, 20 bp, Homo sapiens
ccaacacccaaagcatggac

SEQ ID NO: 3883743 - DNA, 22 bp, Homo sapiens
ccaacacccaaagcatggacta

SEQ ID NO: 3883744 - DNA, 20 bp, Homo sapiens
ccaacaccctgtctaaaaaa

SEQ ID NO: 3883745 - DNA, 19 bp, Homo sapiens
ccaacaccttcttggcttc

SEQ ID NO: 3883746 - DNA, 14 bp, Homo sapiens
ccaacagcttgacc

SEQ ID NO: 3883747 - DNA, 19 bp, Homo sapiens
ccaacagcttgaccagacc

SEQ ID NO: 3883748 - DNA, 20 bp, Homo sapiens
ccaacagcttgaccagacct

SEQ ID NO: 3883749 - DNA, 19 bp, Homo sapiens
catgttaggaaaatttcac

SEQ ID NO: 3883750 - DNA, 22 bp, Homo sapiens
catgttatatattttttgtagg

SEQ ID NO: 3883751 - DNA, 13 bp, Homo sapiens
catgttcctcaaa

SEQ ID NO: 3883752 - DNA, 22 bp, Homo sapiens
catgttgaagccactgccttca

SEQ ID NO: 3883753 - DNA, 19 bp, Homo sapiens
catgttggccaggctggtc

SEQ ID NO: 3883754 - DNA, 20 bp, Homo sapiens
catgtttaaactttgtgcct

SEQ ID NO: 3883755 - DNA, 23 bp, Homo sapiens
catgtttaaactttgtgcctttg

SEQ ID NO: 3883756 - DNA, 13 bp, Homo sapiens
catgtttacttta

SEQ ID NO: 3883757 - DNA, 18 bp, Homo sapiens
catgtttgagctcagacc

SEQ ID NO: 3883758 - DNA, 18 bp, Homo sapiens
cattaaaagaagactgga

SEQ ID NO: 3883759 - DNA, 21 bp, Homo sapiens
cattaaacactgtaatcttaa

SEQ ID NO: 3883760 - DNA, 13 bp, Homo sapiens
cattaaacctgga

SEQ ID NO: 3883761 - DNA, 19 bp, Homo sapiens
cattaatgtaggtttagat

SEQ ID NO: 3883762 - DNA, 14 bp, Homo sapiens
cattaatgtgttgg

SEQ ID NO: 3883763 - DNA, 13 bp, Homo sapiens
cattaatgttaat

SEQ ID NO: 3883764 - DNA, 21 bp, Homo sapiens
cattaatgttaattcagcact

SEQ ID NO: 3883765 - DNA, 21 bp, Homo sapiens
cattaattattattgctgttg

SEQ ID NO: 3883766 - DNA, 19 bp, Homo sapiens
cattacagtttggaagtgt

SEQ ID NO: 3883767 - DNA, 18 bp, Homo sapiens
cattacatcatcctcctt

SEQ ID NO: 3883768 - DNA, 14 bp, Homo sapiens
cattacatggctgt

SEQ ID NO: 3883769 - DNA, 19 bp, Homo sapiens
cattacatgtttaaattgt

SEQ ID NO: 3883770 - DNA, 21 bp, Homo sapiens
cattacatgtttaaattgtaa

SEQ ID NO: 3883771 - DNA, 21 bp, Homo sapiens
cattactgcctttggaagaaa

SEQ ID NO: 3883772 - DNA, 20 bp, Homo sapiens
cattacttgcacaagcttgt

SEQ ID NO: 3883773 - DNA, 22 bp, Homo sapiens
cattacttgcacaagcttgtat

SEQ ID NO: 3883774 - DNA, 18 bp, Homo sapiens
cattagaaattagctgtg

SEQ ID NO: 3883775 - DNA, 17 bp, Homo sapiens
cattagcagtttgcttt

SEQ ID NO: 3883776 - DNA, 20 bp, Homo sapiens
cattataactgaaggagaag

SEQ ID NO: 3883777 - DNA, 12 bp, Homo sapiens
cattatgtagaa

SEQ ID NO: 3883778 - DNA, 15 bp, Homo sapiens
cattatgtagaaata

SEQ ID NO: 3883779 - DNA, 17 bp, Homo sapiens
cattatgtagaaatatt

SEQ ID NO: 3883780 - DNA, 11 bp, Homo sapiens
cattatgtgtg

SEQ ID NO: 3883781 - DNA, 12 bp, Homo sapiens
cattatgtgtgc

SEQ ID NO: 3883782 - DNA, 19 bp, Homo sapiens
cattatgtgtgcatgtgtg

SEQ ID NO: 3883783 - DNA, 14 bp, Homo sapiens
cattattcctccag

SEQ ID NO: 3883784 - DNA, 13 bp, Homo sapiens
cattatttaatgt

SEQ ID NO: 3883785 - DNA, 16 bp, Homo sapiens
cattatttaatgtttg

SEQ ID NO: 3883786 - DNA, 18 bp, Homo sapiens
cattcaatatctgacagt

SEQ ID NO: 3883787 - DNA, 20 bp, Homo sapiens
cattcacatttgatgtacat

SEQ ID NO: 3883788 - DNA, 21 bp, Homo sapiens
cattcagcacaccccaaggga

SEQ ID NO: 3883789 - DNA, 23 bp, Homo sapiens
cattcaggaaaactgacagagga

SEQ ID NO: 3883790 - DNA, 20 bp, Homo sapiens
cattcaggaccccaacccct

SEQ ID NO: 3883791 - DNA, 18 bp, Homo sapiens
cattcatgccaaagcaaa

SEQ ID NO: 3883792 - DNA, 23 bp, Homo sapiens
cattccaacagctcaagtcttcc

SEQ ID NO: 3883793 - DNA, 16 bp, Homo sapiens
cattccaacagtgagt

SEQ ID NO: 3883794 - DNA, 23 bp, Homo sapiens
cattccaagggtatgggaagcca

SEQ ID NO: 3883795 - DNA, 20 bp, Homo sapiens
cattcccccatgtggctgaa

SEQ ID NO: 3883796 - DNA, 11 bp, Homo sapiens
cattcccctcg

SEQ ID NO: 3883797 - DNA, 15 bp, Homo sapiens
cattccctatcaaaa

SEQ ID NO: 3883798 - DNA, 20 bp, Homo sapiens
cattcccttggatgtagtct

SEQ ID NO: 3883799 - DNA, 23 bp, Homo sapiens
cattcccttggatgtagtctgag

SEQ ID NO: 3883800 - DNA, 23 bp, Homo sapiens
cattcctagagagcagaaataaa

SEQ ID NO: 3883801 - DNA, 13 bp, Homo sapiens
cattcctatttct

SEQ ID NO: 3883802 - DNA, 15 bp, Homo sapiens
cattcctcagctgcc

SEQ ID NO: 3883803 - DNA, 17 bp, Homo sapiens
cattcctcagctgccaa

SEQ ID NO: 3883804 - DNA, 19 bp, Homo sapiens
cattccttctggaggacac

SEQ ID NO: 3883805 - DNA, 17 bp, Homo sapiens
cattccttgtcaccagc

SEQ ID NO: 3883806 - DNA, 15 bp, Homo sapiens
cattcggaccctgcc

SEQ ID NO: 3883807 - DNA, 16 bp, Homo sapiens
cattcgtctgtcccag

SEQ ID NO: 3883808 - DNA, 20 bp, Homo sapiens
cattcgtctgtcccagagct

SEQ ID NO: 3883809 - DNA, 13 bp, Homo sapiens
cattctagatgct

SEQ ID NO: 3883810 - DNA, 20 bp, Homo sapiens
cattctcatatgtagccctc

SEQ ID NO: 3883811 - DNA, 11 bp, Homo sapiens
cattctcctgc

SEQ ID NO: 3883812 - DNA, 15 bp, Homo sapiens
cattctcctgcctgt

SEQ ID NO: 3883813 - DNA, 13 bp, Homo sapiens
cattcttcctagt

SEQ ID NO: 3883814 - DNA, 21 bp, Homo sapiens
cattcttcctagttttctcct

SEQ ID NO: 3883815 - DNA, 18 bp, Homo sapiens
cattctttatcttgacat

SEQ ID NO: 3883816 - DNA, 13 bp, Homo sapiens
cattgacctcagc

SEQ ID NO: 3883817 - DNA, 17 bp, Homo sapiens
cattgacctcagctgca

SEQ ID NO: 3883818 - DNA, 14 bp, Homo sapiens
cattgagatctcca

SEQ ID NO: 3883819 - DNA, 17 bp, Homo sapiens
cattgcaaagtgcgctc

SEQ ID NO: 3883820 - DNA, 14 bp, Homo sapiens
cattgcctccacct

SEQ ID NO: 3883821 - DNA, 22 bp, Homo sapiens
cattggatgtggagctcctgct

SEQ ID NO: 3883822 - DNA, 15 bp, Homo sapiens
cattgggctgacacc

SEQ ID NO: 3883823 - DNA, 23 bp, Homo sapiens
cattgggttgtagccaaaggttc

SEQ ID NO: 3883824 - DNA, 19 bp, Homo sapiens
cattgggttttatcagtgc

SEQ ID NO: 3883825 - DNA, 17 bp, Homo sapiens
cattgtagagcttctgg

SEQ ID NO: 3883826 - DNA, 14 bp, Homo sapiens
cattgtatatatgt

SEQ ID NO: 3883827 - DNA, 15 bp, Homo sapiens
cattgtatatatgtg

SEQ ID NO: 3883828 - DNA, 16 bp, Homo sapiens
cattgtatatatgtgt

SEQ ID NO: 3883829 - DNA, 20 bp, Homo sapiens
cattgtatatatgtgtgttt

SEQ ID NO: 3883830 - DNA, 17 bp, Homo sapiens
cattgtatgtatctatt

SEQ ID NO: 3883831 - DNA, 15 bp, Homo sapiens
cattgtattagatct

SEQ ID NO: 3883832 - DNA, 18 bp, Homo sapiens
cattgtctcagtgctggt

SEQ ID NO: 3883833 - DNA, 12 bp, Homo sapiens
cattgtcttcca

SEQ ID NO: 3883834 - DNA, 18 bp, Homo sapiens
cattgtcttccaacccca

SEQ ID NO: 3883835 - DNA, 17 bp, Homo sapiens
atggcttataaatgtgt

SEQ ID NO: 3883836 - DNA, 16 bp, Homo sapiens
atggctttgctttgtg

SEQ ID NO: 3883837 - DNA, 14 bp, Homo sapiens
atgggaaagtgcaa

SEQ ID NO: 3883838 - DNA, 15 bp, Homo sapiens
atgggaagatggtag

SEQ ID NO: 3883839 - DNA, 12 bp, Homo sapiens
atgggaagccat

SEQ ID NO: 3883840 - DNA, 22 bp, Homo sapiens
atgggacaaagttccaaaatgc

SEQ ID NO: 3883841 - DNA, 22 bp, Homo sapiens
atgggacatcaaatttgccacc

SEQ ID NO: 3883842 - DNA, 23 bp, Homo sapiens
atgggagagtagatggtgaaatt

SEQ ID NO: 3883843 - DNA, 16 bp, Homo sapiens
atgggagatggtcagt

SEQ ID NO: 3883844 - DNA, 19 bp, Homo sapiens
atgggagggagggagaggt

SEQ ID NO: 3883845 - DNA, 14 bp, Homo sapiens
atgggagggggctc

SEQ ID NO: 3883846 - DNA, 15 bp, Homo sapiens
atgggagggggctcc

SEQ ID NO: 3883847 - DNA, 19 bp, Homo sapiens
atgggatcccaggccaggg

SEQ ID NO: 3883848 - DNA, 23 bp, Homo sapiens
atgggcaattctgacttctccca

SEQ ID NO: 3883849 - DNA, 20 bp, Homo sapiens
atgggcagtgcctcctggga

SEQ ID NO: 3883850 - DNA, 14 bp, Homo sapiens
atgggcattgggct

SEQ ID NO: 3883851 - DNA, 22 bp, Homo sapiens
atgggccaattaaaatatatat

SEQ ID NO: 3883852 - DNA, 11 bp, Homo sapiens
atgggcctggg

SEQ ID NO: 3883853 - DNA, 18 bp, Homo sapiens
atgggcctgggcctgctt

SEQ ID NO: 3883854 - DNA, 19 bp, Homo sapiens
atggggctgaacggggaga

SEQ ID NO: 3883855 - DNA, 16 bp, Homo sapiens
atgggggatgggccag

SEQ ID NO: 3883856 - DNA, 18 bp, Homo sapiens
atgggggatgggccaggg

SEQ ID NO: 3883857 - DNA, 14 bp, Homo sapiens
atgggtattaaact

SEQ ID NO: 3883858 - DNA, 16 bp, Homo sapiens
atgggttggtgcttct

SEQ ID NO: 3883859 - DNA, 17 bp, Homo sapiens
atggtatgctggccagc

SEQ ID NO: 3883860 - DNA, 23 bp, Homo sapiens
atggtatgctggccagcaccctc

SEQ ID NO: 3883861 - DNA, 23 bp, Homo sapiens
atggtcacgaggtccagacccac

SEQ ID NO: 3883862 - DNA, 15 bp, Homo sapiens
atggtcagctcacac

SEQ ID NO: 3883863 - DNA, 16 bp, Homo sapiens
atggtcagctcacacc

SEQ ID NO: 3883864 - DNA, 20 bp, Homo sapiens
atggtcagtgtggagagggg

SEQ ID NO: 3883865 - DNA, 15 bp, Homo sapiens
atggtccggtgtcct

SEQ ID NO: 3883866 - DNA, 18 bp, Homo sapiens
atggtctcagaaaccaaa

SEQ ID NO: 3883867 - DNA, 16 bp, Homo sapiens
atggtgagctgggaag

SEQ ID NO: 3883868 - DNA, 22 bp, Homo sapiens
atggtgcagaaaaaaaaaaaga

SEQ ID NO: 3883869 - DNA, 14 bp, Homo sapiens
atggtgctgacctc

SEQ ID NO: 3883870 - DNA, 14 bp, Homo sapiens
atggtggtttgtca

SEQ ID NO: 3883871 - DNA, 12 bp, Homo sapiens
atggtgtaatgc

SEQ ID NO: 3883872 - DNA, 20 bp, Homo sapiens
atggtgtaatgcacaattta

SEQ ID NO: 3883873 - DNA, 18 bp, Homo sapiens
atggttccatgcctgagg

SEQ ID NO: 3883874 - DNA, 20 bp, Homo sapiens
atggttccatgcctgagggt

SEQ ID NO: 3883875 - DNA, 19 bp, Homo sapiens
atggttcccctgttcactc

SEQ ID NO: 3883876 - DNA, 22 bp, Homo sapiens
atggttctcagatcttgacagt

SEQ ID NO: 3883877 - DNA, 20 bp, Homo sapiens
atggtttttatttctcgggt

SEQ ID NO: 3883878 - DNA, 23 bp, Homo sapiens
atggtttttgcaagatttaacac

SEQ ID NO: 3883879 - DNA, 12 bp, Homo sapiens
atgtaaaatgca

SEQ ID NO: 3883880 - DNA, 13 bp, Homo sapiens
atgtaaaatgcag

SEQ ID NO: 3883881 - DNA, 15 bp, Homo sapiens
atgtaaaatgcagtc

SEQ ID NO: 3883882 - DNA, 21 bp, Homo sapiens
atgtaaaatgcagtccagaat

SEQ ID NO: 3883883 - DNA, 22 bp, Homo sapiens
atgtaaaatgcagtccagaata

SEQ ID NO: 3883884 - DNA, 15 bp, Homo sapiens
atgtaaacagtgcct

SEQ ID NO: 3883885 - DNA, 16 bp, Homo sapiens
atgtaaacagtgcctg

SEQ ID NO: 3883886 - DNA, 13 bp, Homo sapiens
atgtaaagtatgt

SEQ ID NO: 3883887 - DNA, 15 bp, Homo sapiens
atgtaacatccagaa

SEQ ID NO: 3883888 - DNA, 16 bp, Homo sapiens
atgtaacatccagaag

SEQ ID NO: 3883889 - DNA, 14 bp, Homo sapiens
atgtaactattgaa

SEQ ID NO: 3883890 - DNA, 17 bp, Homo sapiens
atgtaacttttgtaaga

SEQ ID NO: 3883891 - DNA, 14 bp, Homo sapiens
atgtaagggaaact

SEQ ID NO: 3883892 - DNA, 20 bp, Homo sapiens
atgtaagggaaactgccagc

SEQ ID NO: 3883893 - DNA, 13 bp, Homo sapiens
atgtaataaatct

SEQ ID NO: 3883894 - DNA, 17 bp, Homo sapiens
atgtacaaaagtaccat

SEQ ID NO: 3883895 - DNA, 15 bp, Homo sapiens
atgtacaagttttgt

SEQ ID NO: 3883896 - DNA, 20 bp, Homo sapiens
atgtacaagttttgtataaa

SEQ ID NO: 3883897 - DNA, 14 bp, Homo sapiens
atgtacatgtgtag

SEQ ID NO: 3883898 - DNA, 17 bp, Homo sapiens
atgtactgttattgaaa

SEQ ID NO: 3883899 - DNA, 14 bp, Homo sapiens
atgtacttcctgtg

SEQ ID NO: 3883900 - DNA, 23 bp, Homo sapiens
atgtagcccggccagggcctggt

SEQ ID NO: 3883901 - DNA, 14 bp, Homo sapiens
atgtagccctcatg

SEQ ID NO: 3883902 - DNA, 16 bp, Homo sapiens
atgtatacacacatat

SEQ ID NO: 3883903 - DNA, 17 bp, Homo sapiens
atgtatacacacatata

SEQ ID NO: 3883904 - DNA, 20 bp, Homo sapiens
atgtatacacacatatacat

SEQ ID NO: 3883905 - DNA, 12 bp, Homo sapiens
atgtatatacac

SEQ ID NO: 3883906 - DNA, 13 bp, Homo sapiens
atgtatatacaca

SEQ ID NO: 3883907 - DNA, 16 bp, Homo sapiens
atgtatatagatgtgc

SEQ ID NO: 3883908 - DNA, 17 bp, Homo sapiens
atgtatatatatatagt

SEQ ID NO: 3883909 - DNA, 16 bp, Homo sapiens
atgtatatgtatatat

SEQ ID NO: 3883910 - DNA, 22 bp, Homo sapiens
atgtatcctgataaacattaaa

SEQ ID NO: 3883911 - DNA, 17 bp, Homo sapiens
atgtatgtgaaagtgta

SEQ ID NO: 3883912 - DNA, 23 bp, Homo sapiens
atgtatgtgaaagtgtaaaatag

SEQ ID NO: 3883913 - DNA, 18 bp, Homo sapiens
atgtatgtgcacatgtgt

SEQ ID NO: 3883914 - DNA, 19 bp, Homo sapiens
atgtatgtgcacatgtgtc

SEQ ID NO: 3883915 - DNA, 13 bp, Homo sapiens
atgtatgtgtgtg

SEQ ID NO: 3883916 - DNA, 14 bp, Homo sapiens
atgtatgtgtgtgg

SEQ ID NO: 3883917 - DNA, 12 bp, Homo sapiens
atgtatgtttac

SEQ ID NO: 3883918 - DNA, 18 bp, Homo sapiens
atgtattaagccaaacat

SEQ ID NO: 3883919 - DNA, 22 bp, Homo sapiens
atgtattaagccaaacatgagt

SEQ ID NO: 3883920 - DNA, 21 bp, Homo sapiens
atgtattatcacatcaagcat

SEQ ID NO: 3883921 - DNA, 23 bp, Homo sapiens
catggagagagactcaaagagac

SEQ ID NO: 3883922 - DNA, 14 bp, Homo sapiens
catggaggagcttg

SEQ ID NO: 3883923 - DNA, 22 bp, Homo sapiens
catggaggagcttgggggatga

SEQ ID NO: 3883924 - DNA, 21 bp, Homo sapiens
catggaggaggtgtcccaagc

SEQ ID NO: 3883925 - DNA, 16 bp, Homo sapiens
catggaggcaggctcc

SEQ ID NO: 3883926 - DNA, 13 bp, Homo sapiens
catggatgagcac

SEQ ID NO: 3883927 - DNA, 14 bp, Homo sapiens
catggcaccagccc

SEQ ID NO: 3883928 - DNA, 20 bp, Homo sapiens
catggcagatgtaggaggga

SEQ ID NO: 3883929 - DNA, 21 bp, Homo sapiens
catggcagatgtaggagggac

SEQ ID NO: 3883930 - DNA, 23 bp, Homo sapiens
catggcagatgtaggagggactg

SEQ ID NO: 3883931 - DNA, 13 bp, Homo sapiens
catggccaggtgg

SEQ ID NO: 3883932 - DNA, 20 bp, Homo sapiens
catggcctattatattaaaa

SEQ ID NO: 3883933 - DNA, 18 bp, Homo sapiens
catggcctctggccaggc

SEQ ID NO: 3883934 - DNA, 12 bp, Homo sapiens
catggccttccc

SEQ ID NO: 3883935 - DNA, 13 bp, Homo sapiens
catggccttccct

SEQ ID NO: 3883936 - DNA, 18 bp, Homo sapiens
catggcgtaatgggcctg

SEQ ID NO: 3883937 - DNA, 16 bp, Homo sapiens
catggctcaggcaagc

SEQ ID NO: 3883938 - DNA, 18 bp, Homo sapiens
catggctcaggcaagccc

SEQ ID NO: 3883939 - DNA, 23 bp, Homo sapiens
catggctgtggttcctaagcctg

SEQ ID NO: 3883940 - DNA, 15 bp, Homo sapiens
catggcttaatgttt

SEQ ID NO: 3883941 - DNA, 20 bp, Homo sapiens
catggcttaatgtttattcc

SEQ ID NO: 3883942 - DNA, 20 bp, Homo sapiens
catgggaaaagaccagggct

SEQ ID NO: 3883943 - DNA, 13 bp, Homo sapiens
catgggaaaggag

SEQ ID NO: 3883944 - DNA, 14 bp, Homo sapiens
catgggagggaggg

SEQ ID NO: 3883945 - DNA, 17 bp, Homo sapiens
catgggcctgggcctgc

SEQ ID NO: 3883946 - DNA, 18 bp, Homo sapiens
catgggcctgggcctgct

SEQ ID NO: 3883947 - DNA, 23 bp, Homo sapiens
catgggcttggacttcctggggc

SEQ ID NO: 3883948 - DNA, 24 bp, Homo sapiens
catggggaagtgctccccacacgt

SEQ ID NO: 3883949 - DNA, 20 bp, Homo sapiens
catggtcccacatccctggg

SEQ ID NO: 3883950 - DNA, 22 bp, Homo sapiens
catggtcccacatccctgggcc

SEQ ID NO: 3883951 - DNA, 19 bp, Homo sapiens
catggtgacacacagcagc

SEQ ID NO: 3883952 - DNA, 16 bp, Homo sapiens
catggtgactaacagt

SEQ ID NO: 3883953 - DNA, 16 bp, Homo sapiens
catggtgatcagtgca

SEQ ID NO: 3883954 - DNA, 18 bp, Homo sapiens
catggtggcgcaagcctg

SEQ ID NO: 3883955 - DNA, 20 bp, Homo sapiens
catggttccttccctgggaa

SEQ ID NO: 3883956 - DNA, 15 bp, Homo sapiens
catgtaaaatgcagt

SEQ ID NO: 3883957 - DNA, 17 bp, Homo sapiens
catgtaaaatgcagtcc

SEQ ID NO: 3883958 - DNA, 16 bp, Homo sapiens
catgtaaattttgtat

SEQ ID NO: 3883959 - DNA, 15 bp, Homo sapiens
catgtaacaaccaga

SEQ ID NO: 3883960 - DNA, 20 bp, Homo sapiens
catgtaaggtcttcttgtgt

SEQ ID NO: 3883961 - DNA, 12 bp, Homo sapiens
catgtaataaat

SEQ ID NO: 3883962 - DNA, 14 bp, Homo sapiens
catgtaatcagttt

SEQ ID NO: 3883963 - DNA, 14 bp, Homo sapiens
catgtactataatg

SEQ ID NO: 3883964 - DNA, 20 bp, Homo sapiens
catgtactccagagggacag

SEQ ID NO: 3883965 - DNA, 20 bp, Homo sapiens
catgtagcaggactgaattg

SEQ ID NO: 3883966 - DNA, 10 bp, Homo sapiens
catgtatgtg

SEQ ID NO: 3883967 - DNA, 15 bp, Homo sapiens
catgtatgtgcacat

SEQ ID NO: 3883968 - DNA, 21 bp, Homo sapiens
catgtatgtgcacatgtgtct

SEQ ID NO: 3883969 - DNA, 11 bp, Homo sapiens
catgtatgtgt

SEQ ID NO: 3883970 - DNA, 13 bp, Homo sapiens
catgtatgtgtgt

SEQ ID NO: 3883971 - DNA, 15 bp, Homo sapiens
catgtatgtgtgtgt

SEQ ID NO: 3883972 - DNA, 15 bp, Homo sapiens
catgtattatcacat

SEQ ID NO: 3883973 - DNA, 23 bp, Homo sapiens
catgtatttatctctatttaata

SEQ ID NO: 3883974 - DNA, 20 bp, Homo sapiens
catgtcaccgtggaccttcc

SEQ ID NO: 3883975 - DNA, 13 bp, Homo sapiens
catgtcacctcag

SEQ ID NO: 3883976 - DNA, 14 bp, Homo sapiens
catgtcacctcagc

SEQ ID NO: 3883977 - DNA, 15 bp, Homo sapiens
catgtcacctcagct

SEQ ID NO: 3883978 - DNA, 17 bp, Homo sapiens
catgtcacctcagctga

SEQ ID NO: 3883979 - DNA, 15 bp, Homo sapiens
catgtcagagccagg

SEQ ID NO: 3883980 - DNA, 21 bp, Homo sapiens
catgtcaggcctgtgtgtgaa

SEQ ID NO: 3883981 - DNA, 19 bp, Homo sapiens
catgtccaagtccaacctg

SEQ ID NO: 3883982 - DNA, 24 bp, Homo sapiens
catgtccaagtccaacctgcctgt

SEQ ID NO: 3883983 - DNA, 16 bp, Homo sapiens
catgtccctaccgagt

SEQ ID NO: 3883984 - DNA, 16 bp, Homo sapiens
catgtcggagtagaaa

SEQ ID NO: 3883985 - DNA, 17 bp, Homo sapiens
catgtcggagtagaaat

SEQ ID NO: 3883986 - DNA, 17 bp, Homo sapiens
catgtctcagcctcctc

SEQ ID NO: 3883987 - DNA, 18 bp, Homo sapiens
catgtctcagcctcctca

SEQ ID NO: 3883988 - DNA, 23 bp, Homo sapiens
catgtgaaaataatagccatcct

SEQ ID NO: 3883989 - DNA, 20 bp, Homo sapiens
catgtgaattctgtgaagaa

SEQ ID NO: 3883990 - DNA, 19 bp, Homo sapiens
catgtgaggactgggggca

SEQ ID NO: 3883991 - DNA, 12 bp, Homo sapiens
catgtgcctgta

SEQ ID NO: 3883992 - DNA, 18 bp, Homo sapiens
catgtgctattgaactga

SEQ ID NO: 3883993 - DNA, 20 bp, Homo sapiens
catgtgctattgaactgagc

SEQ ID NO: 3883994 - DNA, 15 bp, Homo sapiens
catgtggcaacctgt

SEQ ID NO: 3883995 - DNA, 17 bp, Homo sapiens
catgtggccccaggtgc

SEQ ID NO: 3883996 - DNA, 15 bp, Homo sapiens
catgtggctgaagac

SEQ ID NO: 3883997 - DNA, 16 bp, Homo sapiens
catgtgggaggaagaa

SEQ ID NO: 3883998 - DNA, 16 bp, Homo sapiens
catgtgtcccctcact

SEQ ID NO: 3883999 - DNA, 24 bp, Homo sapiens
catgtgtcccctcactctgtcagc

SEQ ID NO: 3884000 - DNA, 14 bp, Homo sapiens
catgtgtgcatgtg

SEQ ID NO: 3884001 - DNA, 14 bp, Homo sapiens
catgtgtgcctgtg

SEQ ID NO: 3884002 - DNA, 11 bp, Homo sapiens
catgtgtgtat

SEQ ID NO: 3884003 - DNA, 13 bp, Homo sapiens
catgtgtgtataa

SEQ ID NO: 3884004 - DNA, 14 bp, Homo sapiens
catgtgtgtataag

SEQ ID NO: 3884005 - DNA, 13 bp, Homo sapiens
catgtgtgtatat

SEQ ID NO: 3884006 - DNA, 18 bp, Homo sapiens
catgttaggaaaatttca

SEQ ID NO: 3884007 - DNA, 19 bp, Homo sapiens
catcttcagctcccatagc

SEQ ID NO: 3884008 - DNA, 13 bp, Homo sapiens
catcttcctgctg

SEQ ID NO: 3884009 - DNA, 15 bp, Homo sapiens
catcttcctgctgct

SEQ ID NO: 3884010 - DNA, 14 bp, Homo sapiens
catcttctcagtgt

SEQ ID NO: 3884011 - DNA, 13 bp, Homo sapiens
catctttaagtat

SEQ ID NO: 3884012 - DNA, 21 bp, Homo sapiens
catctttcttctattttattc

SEQ ID NO: 3884013 - DNA, 15 bp, Homo sapiens
catctttgaaaagaa

SEQ ID NO: 3884014 - DNA, 17 bp, Homo sapiens
catctttgaaaagaaaa

SEQ ID NO: 3884015 - DNA, 14 bp, Homo sapiens
catcttttaatatg

SEQ ID NO: 3884016 - DNA, 21 bp, Homo sapiens
catgaaaaccattacctgact

SEQ ID NO: 3884017 - DNA, 18 bp, Homo sapiens
catgaacacacatggatg

SEQ ID NO: 3884018 - DNA, 17 bp, Homo sapiens
catgaagaccacatcca

SEQ ID NO: 3884019 - DNA, 19 bp, Homo sapiens
catgaagtcgttgtgaggg

SEQ ID NO: 3884020 - DNA, 16 bp, Homo sapiens
catgaatgcacactag

SEQ ID NO: 3884021 - DNA, 15 bp, Homo sapiens
catgacatgttatat

SEQ ID NO: 3884022 - DNA, 17 bp, Homo sapiens
catgacatgttatatat

SEQ ID NO: 3884023 - DNA, 19 bp, Homo sapiens
catgacatgttatatattt

SEQ ID NO: 3884024 - DNA, 17 bp, Homo sapiens
catgacatttctaagtg

SEQ ID NO: 3884025 - DNA, 21 bp, Homo sapiens
catgacctccagctttcctgt

SEQ ID NO: 3884026 - DNA, 15 bp, Homo sapiens
catgacgtaaaattt

SEQ ID NO: 3884027 - DNA, 19 bp, Homo sapiens
catgagaatctatatttaa

SEQ ID NO: 3884028 - DNA, 12 bp, Homo sapiens
catgagctgagt

SEQ ID NO: 3884029 - DNA, 13 bp, Homo sapiens
catgagtggatgg

SEQ ID NO: 3884030 - DNA, 14 bp, Homo sapiens
catgagtggatgga

SEQ ID NO: 3884031 - DNA, 14 bp, Homo sapiens
catgatattttcag

SEQ ID NO: 3884032 - DNA, 18 bp, Homo sapiens
catgatctccctgccgcc

SEQ ID NO: 3884033 - DNA, 21 bp, Homo sapiens
catgatctccctgccgcctca

SEQ ID NO: 3884034 - DNA, 22 bp, Homo sapiens
catgatcttgagatttctttta

SEQ ID NO: 3884035 - DNA, 15 bp, Homo sapiens
catgatgagctcctc

SEQ ID NO: 3884036 - DNA, 19 bp, Homo sapiens
catgatgagctcctcttcc

SEQ ID NO: 3884037 - DNA, 20 bp, Homo sapiens
catgatggtgctgacctctg

SEQ ID NO: 3884038 - DNA, 22 bp, Homo sapiens
catgatgttaaccagaataaag

SEQ ID NO: 3884039 - DNA, 14 bp, Homo sapiens
catgatttatatat

SEQ ID NO: 3884040 - DNA, 16 bp, Homo sapiens
catgatttatatatgg

SEQ ID NO: 3884041 - DNA, 17 bp, Homo sapiens
catgatttatatatggc

SEQ ID NO: 3884042 - DNA, 16 bp, Homo sapiens
catgattttatacata

SEQ ID NO: 3884043 - DNA, 17 bp, Homo sapiens
catgattttatacatag

SEQ ID NO: 3884044 - DNA, 18 bp, Homo sapiens
catgcaagtgctatgcca

SEQ ID NO: 3884045 - DNA, 12 bp, Homo sapiens
catgcaataatg

SEQ ID NO: 3884046 - DNA, 18 bp, Homo sapiens
catgcaatttattaaaat

SEQ ID NO: 3884047 - DNA, 20 bp, Homo sapiens
catgcacacaaacacctcct

SEQ ID NO: 3884048 - DNA, 12 bp, Homo sapiens
catgcacagctg

SEQ ID NO: 3884049 - DNA, 15 bp, Homo sapiens
catgcacagctgctt

SEQ ID NO: 3884050 - DNA, 17 bp, Homo sapiens
catgcactgacccttcc

SEQ ID NO: 3884051 - DNA, 22 bp, Homo sapiens
catgcactgacccttccagaca

SEQ ID NO: 3884052 - DNA, 19 bp, Homo sapiens
catgcagactcctcagatc

SEQ ID NO: 3884053 - DNA, 19 bp, Homo sapiens
catgcagcttcatcaattt

SEQ ID NO: 3884054 - DNA, 23 bp, Homo sapiens
catgcagcttcatcaatttttat

SEQ ID NO: 3884055 - DNA, 14 bp, Homo sapiens
catgcattcataca

SEQ ID NO: 3884056 - DNA, 16 bp, Homo sapiens
catgcattcctaagaa

SEQ ID NO: 3884057 - DNA, 14 bp, Homo sapiens
catgccaccctctc

SEQ ID NO: 3884058 - DNA, 15 bp, Homo sapiens
catgccactgccagg

SEQ ID NO: 3884059 - DNA, 12 bp, Homo sapiens
catgcccaacct

SEQ ID NO: 3884060 - DNA, 22 bp, Homo sapiens
catgcccagtcgatatctcact

SEQ ID NO: 3884061 - DNA, 12 bp, Homo sapiens
catgcctcagtt

SEQ ID NO: 3884062 - DNA, 13 bp, Homo sapiens
catgcctctgagg

SEQ ID NO: 3884063 - DNA, 21 bp, Homo sapiens
catgcctctgaggccagcctg

SEQ ID NO: 3884064 - DNA, 22 bp, Homo sapiens
catgcctctgaggccagcctgg

SEQ ID NO: 3884065 - DNA, 15 bp, Homo sapiens
catgcctgagggtgg

SEQ ID NO: 3884066 - DNA, 16 bp, Homo sapiens
catgcctgagggtgga

SEQ ID NO: 3884067 - DNA, 13 bp, Homo sapiens
catgcgcacaagg

SEQ ID NO: 3884068 - DNA, 14 bp, Homo sapiens
catgcgcaggctca

SEQ ID NO: 3884069 - DNA, 19 bp, Homo sapiens
catgcgtatatgtgcgtct

SEQ ID NO: 3884070 - DNA, 23 bp, Homo sapiens
catgctatctctgtgtgcacaaa

SEQ ID NO: 3884071 - DNA, 14 bp, Homo sapiens
catgctctgcccca

SEQ ID NO: 3884072 - DNA, 16 bp, Homo sapiens
catgctctgccccaag

SEQ ID NO: 3884073 - DNA, 13 bp, Homo sapiens
catgctctggaag

SEQ ID NO: 3884074 - DNA, 21 bp, Homo sapiens
catgctctggaagcctggact

SEQ ID NO: 3884075 - DNA, 18 bp, Homo sapiens
catgctgaagggaccttg

SEQ ID NO: 3884076 - DNA, 15 bp, Homo sapiens
catgctgaattattt

SEQ ID NO: 3884077 - DNA, 18 bp, Homo sapiens
catgctgaattattttgt

SEQ ID NO: 3884078 - DNA, 14 bp, Homo sapiens
catgctgcctccag

SEQ ID NO: 3884079 - DNA, 19 bp, Homo sapiens
catgctgctttttggcaca

SEQ ID NO: 3884080 - DNA, 23 bp, Homo sapiens
catgctggcggcgcagagggaag

SEQ ID NO: 3884081 - DNA, 19 bp, Homo sapiens
catgctgtgctctttgaag

SEQ ID NO: 3884082 - DNA, 23 bp, Homo sapiens
catgctttaaagtgtaataatat

SEQ ID NO: 3884083 - DNA, 23 bp, Homo sapiens
catgctttccttttcttccttct

SEQ ID NO: 3884084 - DNA, 13 bp, Homo sapiens
catgctttctcct

SEQ ID NO: 3884085 - DNA, 14 bp, Homo sapiens
catggaaaaatact

SEQ ID NO: 3884086 - DNA, 18 bp, Homo sapiens
catggaaaatgtcctgtg

SEQ ID NO: 3884087 - DNA, 16 bp, Homo sapiens
catggacaatataaac

SEQ ID NO: 3884088 - DNA, 14 bp, Homo sapiens
catggagaaaccct

SEQ ID NO: 3884089 - DNA, 20 bp, Homo sapiens
catggagaaaccctgtctct

SEQ ID NO: 3884090 - DNA, 15 bp, Homo sapiens
catggagactcctgc

SEQ ID NO: 3884091 - DNA, 21 bp, Homo sapiens
catggagactcctgccctgtt

SEQ ID NO: 3884092 - DNA, 12 bp, Homo sapiens
catggagagaga

SEQ ID NO: 3884093 - DNA, 18 bp, Homo sapiens
catcatgcctctgaggcc

SEQ ID NO: 3884094 - DNA, 19 bp, Homo sapiens
catcatgcctctgaggcca

SEQ ID NO: 3884095 - DNA, 23 bp, Homo sapiens
catcatgcctctgaggccagcct

SEQ ID NO: 3884096 - DNA, 22 bp, Homo sapiens
catccaactcctggagatttca

SEQ ID NO: 3884097 - DNA, 21 bp, Homo sapiens
catccaaggagaaacagagac

SEQ ID NO: 3884098 - DNA, 22 bp, Homo sapiens
catccacccagtgctgccatgc

SEQ ID NO: 3884099 - DNA, 23 bp, Homo sapiens
catccacccagtgctgccatgcc

SEQ ID NO: 3884100 - DNA, 14 bp, Homo sapiens
catccaccccactg

SEQ ID NO: 3884101 - DNA, 14 bp, Homo sapiens
catccagtttgttc

SEQ ID NO: 3884102 - DNA, 19 bp, Homo sapiens
catccataaagcaagctca

SEQ ID NO: 3884103 - DNA, 15 bp, Homo sapiens
catccatagtgcact

SEQ ID NO: 3884104 - DNA, 16 bp, Homo sapiens
catccatcagctccct

SEQ ID NO: 3884105 - DNA, 18 bp, Homo sapiens
catccatgtccaaccccc

SEQ ID NO: 3884106 - DNA, 15 bp, Homo sapiens
catccattcctcagg

SEQ ID NO: 3884107 - DNA, 13 bp, Homo sapiens
catcccagcccca

SEQ ID NO: 3884108 - DNA, 16 bp, Homo sapiens
catcccagccccaatt

SEQ ID NO: 3884109 - DNA, 20 bp, Homo sapiens
catcccagccccaattttct

SEQ ID NO: 3884110 - DNA, 22 bp, Homo sapiens
catcccaggaggggcctctgaa

SEQ ID NO: 3884111 - DNA, 22 bp, Homo sapiens
catcccaggcgggcggcacgcc

SEQ ID NO: 3884112 - DNA, 19 bp, Homo sapiens
catcccaggcttcaccctg

SEQ ID NO: 3884113 - DNA, 12 bp, Homo sapiens
catcccattgcc

SEQ ID NO: 3884114 - DNA, 13 bp, Homo sapiens
catcccattgccc

SEQ ID NO: 3884115 - DNA, 15 bp, Homo sapiens
catcccattgccctg

SEQ ID NO: 3884116 - DNA, 16 bp, Homo sapiens
catcccattgccctgg

SEQ ID NO: 3884117 - DNA, 17 bp, Homo sapiens
catcccattgccctggt

SEQ ID NO: 3884118 - DNA, 19 bp, Homo sapiens
catccccagaggtgaccca

SEQ ID NO: 3884119 - DNA, 18 bp, Homo sapiens
catcccctcgtcctgtcc

SEQ ID NO: 3884120 - DNA, 14 bp, Homo sapiens
catcccctggactg

SEQ ID NO: 3884121 - DNA, 14 bp, Homo sapiens
catcccctttcctc

SEQ ID NO: 3884122 - DNA, 16 bp, Homo sapiens
catcccctttcctccc

SEQ ID NO: 3884123 - DNA, 17 bp, Homo sapiens
catcccctttcctcccc

SEQ ID NO: 3884124 - DNA, 18 bp, Homo sapiens
catcccgtcttctccaac

SEQ ID NO: 3884125 - DNA, 19 bp, Homo sapiens
catccctcggaagccgtct

SEQ ID NO: 3884126 - DNA, 19 bp, Homo sapiens
catccctgggcccctccac

SEQ ID NO: 3884127 - DNA, 22 bp, Homo sapiens
catccctgggcccctccacgcc

SEQ ID NO: 3884128 - DNA, 14 bp, Homo sapiens
catccctgggcctg

SEQ ID NO: 3884129 - DNA, 16 bp, Homo sapiens
catccctgggcctgct

SEQ ID NO: 3884130 - DNA, 17 bp, Homo sapiens
catccctgggcctgctg

SEQ ID NO: 3884131 - DNA, 19 bp, Homo sapiens
catccctttgaaacaagat

SEQ ID NO: 3884132 - DNA, 13 bp, Homo sapiens
catccgcagccca

SEQ ID NO: 3884133 - DNA, 16 bp, Homo sapiens
catccgggacgcttcc

SEQ ID NO: 3884134 - DNA, 21 bp, Homo sapiens
catccgggacgcttccagacc

SEQ ID NO: 3884135 - DNA, 23 bp, Homo sapiens
catcctaagtgggaagtgaagcc

SEQ ID NO: 3884136 - DNA, 15 bp, Homo sapiens
catcctaccaatgca

SEQ ID NO: 3884137 - DNA, 19 bp, Homo sapiens
catcctaccaatgcatgca

SEQ ID NO: 3884138 - DNA, 12 bp, Homo sapiens
catcctgcagcc

SEQ ID NO: 3884139 - DNA, 12 bp, Homo sapiens
catcctggcccc

SEQ ID NO: 3884140 - DNA, 14 bp, Homo sapiens
catcctggcccctc

SEQ ID NO: 3884141 - DNA, 14 bp, Homo sapiens
catcctggcctcct

SEQ ID NO: 3884142 - DNA, 23 bp, Homo sapiens
catccttcatctggattccagag

SEQ ID NO: 3884143 - DNA, 20 bp, Homo sapiens
catcgaaaattcatttcaca

SEQ ID NO: 3884144 - DNA, 15 bp, Homo sapiens
catcgaacaaactga

SEQ ID NO: 3884145 - DNA, 13 bp, Homo sapiens
catcgcactgtgg

SEQ ID NO: 3884146 - DNA, 13 bp, Homo sapiens
catcgccagacaa

SEQ ID NO: 3884147 - DNA, 19 bp, Homo sapiens
catcggaggctgggcccct

SEQ ID NO: 3884148 - DNA, 23 bp, Homo sapiens
catcggaggctgggcccctggga

SEQ ID NO: 3884149 - DNA, 14 bp, Homo sapiens
catcgtagaagaga

SEQ ID NO: 3884150 - DNA, 15 bp, Homo sapiens
catcgtgacccttca

SEQ ID NO: 3884151 - DNA, 20 bp, Homo sapiens
catctaagctgcagcttcct

SEQ ID NO: 3884152 - DNA, 21 bp, Homo sapiens
catctaagctgcagcttcctg

SEQ ID NO: 3884153 - DNA, 23 bp, Homo sapiens
catctaatagcgggttactttca

SEQ ID NO: 3884154 - DNA, 18 bp, Homo sapiens
catctaatgtctcttcct

SEQ ID NO: 3884155 - DNA, 21 bp, Homo sapiens
catctaatgtctcttcctctg

SEQ ID NO: 3884156 - DNA, 21 bp, Homo sapiens
catctagagattttcttggca

SEQ ID NO: 3884157 - DNA, 23 bp, Homo sapiens
catctagagattttcttggcagt

SEQ ID NO: 3884158 - DNA, 12 bp, Homo sapiens
catctagcccct

SEQ ID NO: 3884159 - DNA, 13 bp, Homo sapiens
catctcactgccc

SEQ ID NO: 3884160 - DNA, 12 bp, Homo sapiens
catctcaggtgc

SEQ ID NO: 3884161 - DNA, 14 bp, Homo sapiens
catctcaggtgcca

SEQ ID NO: 3884162 - DNA, 21 bp, Homo sapiens
catctcaggtgccactccctg

SEQ ID NO: 3884163 - DNA, 15 bp, Homo sapiens
catctcattgtagag

SEQ ID NO: 3884164 - DNA, 19 bp, Homo sapiens
catctcatttaatcctccc

SEQ ID NO: 3884165 - DNA, 18 bp, Homo sapiens
catctccatttcacacag

SEQ ID NO: 3884166 - DNA, 13 bp, Homo sapiens
catctcccttcct

SEQ ID NO: 3884167 - DNA, 22 bp, Homo sapiens
catctcccttcctgtgggagca

SEQ ID NO: 3884168 - DNA, 23 bp, Homo sapiens
catctcctcccatggccttccct

SEQ ID NO: 3884169 - DNA, 16 bp, Homo sapiens
catctcctctatcaca

SEQ ID NO: 3884170 - DNA, 19 bp, Homo sapiens
catctcgagccccctggat

SEQ ID NO: 3884171 - DNA, 16 bp, Homo sapiens
catctgaaagccacgt

SEQ ID NO: 3884172 - DNA, 14 bp, Homo sapiens
catctgcagaatgg

SEQ ID NO: 3884173 - DNA, 16 bp, Homo sapiens
catctggattccagag

SEQ ID NO: 3884174 - DNA, 21 bp, Homo sapiens
catctgggaagatttctacct

SEQ ID NO: 3884175 - DNA, 16 bp, Homo sapiens
catctgggattcccac

SEQ ID NO: 3884176 - DNA, 20 bp, Homo sapiens
catctgtcaccaattggtta

SEQ ID NO: 3884177 - DNA, 18 bp, Homo sapiens
catctgttatcctgctag

SEQ ID NO: 3884178 - DNA, 12 bp, Homo sapiens
catctgttgttt

SEQ ID NO: 3884179 - DNA, 16 bp, Homo sapiens
catacagaggtaacta

SEQ ID NO: 3884180 - DNA, 13 bp, Homo sapiens
catacatacacat

SEQ ID NO: 3884181 - DNA, 17 bp, Homo sapiens
catacatacacatacat

SEQ ID NO: 3884182 - DNA, 14 bp, Homo sapiens
catacatacataca

SEQ ID NO: 3884183 - DNA, 17 bp, Homo sapiens
catacatacatacatat

SEQ ID NO: 3884184 - DNA, 14 bp, Homo sapiens
catacatacatata

SEQ ID NO: 3884185 - DNA, 16 bp, Homo sapiens
catacatacatatata

SEQ ID NO: 3884186 - DNA, 17 bp, Homo sapiens
catacatacatatatat

SEQ ID NO: 3884187 - DNA, 22 bp, Homo sapiens
catacatcctgctttccctccc

SEQ ID NO: 3884188 - DNA, 17 bp, Homo sapiens
catacccctgcctgggt

SEQ ID NO: 3884189 - DNA, 20 bp, Homo sapiens
catacccttctttaaatcaa

SEQ ID NO: 3884190 - DNA, 21 bp, Homo sapiens
catacccttctttaaatcaaa

SEQ ID NO: 3884191 - DNA, 19 bp, Homo sapiens
cataccgctggggaacaga

SEQ ID NO: 3884192 - DNA, 18 bp, Homo sapiens
catacctgctggtgcaga

SEQ ID NO: 3884193 - DNA, 15 bp, Homo sapiens
catacttaagcaaaa

SEQ ID NO: 3884194 - DNA, 16 bp, Homo sapiens
catagaaacatgacac

SEQ ID NO: 3884195 - DNA, 17 bp, Homo sapiens
catagaaacatgacact

SEQ ID NO: 3884196 - DNA, 21 bp, Homo sapiens
catagaaacgacaaatcacca

SEQ ID NO: 3884197 - DNA, 15 bp, Homo sapiens
catagaaactgagga

SEQ ID NO: 3884198 - DNA, 22 bp, Homo sapiens
catagagatatgcacacacaga

SEQ ID NO: 3884199 - DNA, 24 bp, Homo sapiens
catagagatatgcacacacagatg

SEQ ID NO: 3884200 - DNA, 16 bp, Homo sapiens
catagattaatggcac

SEQ ID NO: 3884201 - DNA, 19 bp, Homo sapiens
catagattaatggcactga

SEQ ID NO: 3884202 - DNA, 18 bp, Homo sapiens
catagattccctgagcag

SEQ ID NO: 3884203 - DNA, 16 bp, Homo sapiens
catagcgctggctcag

SEQ ID NO: 3884204 - DNA, 12 bp, Homo sapiens
cataggaaaagt

SEQ ID NO: 3884205 - DNA, 17 bp, Homo sapiens
cataggcggtcatgtgt

SEQ ID NO: 3884206 - DNA, 20 bp, Homo sapiens
cataggcggtcatgtgtgca

SEQ ID NO: 3884207 - DNA, 14 bp, Homo sapiens
catagtcacaaaaa

SEQ ID NO: 3884208 - DNA, 15 bp, Homo sapiens
catatacaaaagcaa

SEQ ID NO: 3884209 - DNA, 15 bp, Homo sapiens
catatacaaataaac

SEQ ID NO: 3884210 - DNA, 15 bp, Homo sapiens
catatacatatatat

SEQ ID NO: 3884211 - DNA, 18 bp, Homo sapiens
catatacctataatgtgt

SEQ ID NO: 3884212 - DNA, 21 bp, Homo sapiens
catatacctataatgtgtgta

SEQ ID NO: 3884213 - DNA, 23 bp, Homo sapiens
catatacctataatgtgtgtatg

SEQ ID NO: 3884214 - DNA, 21 bp, Homo sapiens
catatatatatacacatacat

SEQ ID NO: 3884215 - DNA, 19 bp, Homo sapiens
catatatatgccttatgta

SEQ ID NO: 3884216 - DNA, 16 bp, Homo sapiens
catatatcttatgtta

SEQ ID NO: 3884217 - DNA, 14 bp, Homo sapiens
catatattcatgta

SEQ ID NO: 3884218 - DNA, 23 bp, Homo sapiens
catatcaaaaagtattaaaacta

SEQ ID NO: 3884219 - DNA, 13 bp, Homo sapiens
catatcagaaaag

SEQ ID NO: 3884220 - DNA, 15 bp, Homo sapiens
catatcagaaaagta

SEQ ID NO: 3884221 - DNA, 22 bp, Homo sapiens
catatcagaaaagtagaattat

SEQ ID NO: 3884222 - DNA, 18 bp, Homo sapiens
catatcggaggtggtgga

SEQ ID NO: 3884223 - DNA, 15 bp, Homo sapiens
catatctccttcccc

SEQ ID NO: 3884224 - DNA, 21 bp, Homo sapiens
catatgcgtcccaagcagccg

SEQ ID NO: 3884225 - DNA, 16 bp, Homo sapiens
catatgggtgctggca

SEQ ID NO: 3884226 - DNA, 15 bp, Homo sapiens
catatgtctgcttct

SEQ ID NO: 3884227 - DNA, 18 bp, Homo sapiens
catattataaataaatgc

SEQ ID NO: 3884228 - DNA, 20 bp, Homo sapiens
catattataaataaatgcca

SEQ ID NO: 3884229 - DNA, 17 bp, Homo sapiens
catattgggtaatgttt

SEQ ID NO: 3884230 - DNA, 16 bp, Homo sapiens
catattggtattcact

SEQ ID NO: 3884231 - DNA, 13 bp, Homo sapiens
catattgtatgta

SEQ ID NO: 3884232 - DNA, 16 bp, Homo sapiens
catattgtatgtaagt

SEQ ID NO: 3884233 - DNA, 14 bp, Homo sapiens
catcaaatgctgta

SEQ ID NO: 3884234 - DNA, 20 bp, Homo sapiens
catcaaatgctgtagaatgc

SEQ ID NO: 3884235 - DNA, 19 bp, Homo sapiens
catcaagaaggtagcttga

SEQ ID NO: 3884236 - DNA, 14 bp, Homo sapiens
catcaattcccatt

SEQ ID NO: 3884237 - DNA, 16 bp, Homo sapiens
catcaatttttataca

SEQ ID NO: 3884238 - DNA, 14 bp, Homo sapiens
catcacccagtcct

SEQ ID NO: 3884239 - DNA, 15 bp, Homo sapiens
catcacccagtcctg

SEQ ID NO: 3884240 - DNA, 17 bp, Homo sapiens
catcacccagtcctggc

SEQ ID NO: 3884241 - DNA, 15 bp, Homo sapiens
catcaccctctgggc

SEQ ID NO: 3884242 - DNA, 17 bp, Homo sapiens
catcaccctctgggcag

SEQ ID NO: 3884243 - DNA, 21 bp, Homo sapiens
catcacctactcacacaggca

SEQ ID NO: 3884244 - DNA, 21 bp, Homo sapiens
catcacctttttgacttttcc

SEQ ID NO: 3884245 - DNA, 15 bp, Homo sapiens
catcactccctggat

SEQ ID NO: 3884246 - DNA, 20 bp, Homo sapiens
catcacttggggtcaccacc

SEQ ID NO: 3884247 - DNA, 14 bp, Homo sapiens
catcacttgtacaa

SEQ ID NO: 3884248 - DNA, 15 bp, Homo sapiens
catcacttttcagtg

SEQ ID NO: 3884249 - DNA, 12 bp, Homo sapiens
catcagaaaggg

SEQ ID NO: 3884250 - DNA, 18 bp, Homo sapiens
catcagaaagggagggct

SEQ ID NO: 3884251 - DNA, 23 bp, Homo sapiens
catcagaaagggagggctctgag

SEQ ID NO: 3884252 - DNA, 24 bp, Homo sapiens
catcagaaagggagggctctgagg

SEQ ID NO: 3884253 - DNA, 13 bp, Homo sapiens
catcagaagataa

SEQ ID NO: 3884254 - DNA, 11 bp, Homo sapiens
catcagaagga

SEQ ID NO: 3884255 - DNA, 14 bp, Homo sapiens
catcagctcccttt

SEQ ID NO: 3884256 - DNA, 15 bp, Homo sapiens
catcagctgctgaaa

SEQ ID NO: 3884257 - DNA, 11 bp, Homo sapiens
catcaggcact

SEQ ID NO: 3884258 - DNA, 14 bp, Homo sapiens
catcaggcactggt

SEQ ID NO: 3884259 - DNA, 17 bp, Homo sapiens
catcaggcttggaatga

SEQ ID NO: 3884260 - DNA, 22 bp, Homo sapiens
catcagggtgggccactctccc

SEQ ID NO: 3884261 - DNA, 16 bp, Homo sapiens
catcaggttccatccc

SEQ ID NO: 3884262 - DNA, 21 bp, Homo sapiens
catcatatgacatgccaccct

SEQ ID NO: 3884263 - DNA, 16 bp, Homo sapiens
catcatattgtatgta

SEQ ID NO: 3884264 - DNA, 17 bp, Homo sapiens
catcatgaccagcaaat

SEQ ID NO: 3884265 - DNA, 19 bp, Homo sapiens
tttttatacatatcagaaa

SEQ ID NO: 3884266 - DNA, 20 bp, Homo sapiens
tttttatacatatcagaaaa

SEQ ID NO: 3884267 - DNA, 13 bp, Homo sapiens
tttttattctgtt

SEQ ID NO: 3884268 - DNA, 14 bp, Homo sapiens
tttttcaaccagca

SEQ ID NO: 3884269 - DNA, 21 bp, Homo sapiens
tttttcaaccagcattttact

SEQ ID NO: 3884270 - DNA, 16 bp, Homo sapiens
tttttgagacagggtc

SEQ ID NO: 3884271 - DNA, 13 bp, Homo sapiens
ttttttccactta

SEQ ID NO: 3884272 - DNA, 11 bp, Homo sapiens
ttttttgtaac

SEQ ID NO: 3884273 - DNA, 16 bp, Homo sapiens
ttggaagagaggcacc

SEQ ID NO: 3884274 - DNA, 21 bp, Homo sapiens
ttggaagagaggcacctgctg

SEQ ID NO: 3884275 - DNA, 22 bp, Homo sapiens
ttggaagagaggcacctgctgg

SEQ ID NO: 3884276 - DNA, 16 bp, Homo sapiens
ttggaagttttcagga

SEQ ID NO: 3884277 - DNA, 13 bp, Homo sapiens
ttggacaaaatgg

SEQ ID NO: 3884278 - DNA, 17 bp, Homo sapiens
ttggacacactgtaaac

SEQ ID NO: 3884279 - DNA, 13 bp, Homo sapiens
ttggacctctgct

SEQ ID NO: 3884280 - DNA, 16 bp, Homo sapiens
ttggacctctgctctg

SEQ ID NO: 3884281 - DNA, 18 bp, Homo sapiens
ttggacctctgctctgag

SEQ ID NO: 3884282 - DNA, 14 bp, Homo sapiens
ttggagaaattatt

SEQ ID NO: 3884283 - DNA, 15 bp, Homo sapiens
ttggagaaattattt

SEQ ID NO: 3884284 - DNA, 17 bp, Homo sapiens
ttggagagcagctggct

SEQ ID NO: 3884285 - DNA, 21 bp, Homo sapiens
ttggagagggacgaagaaagg

SEQ ID NO: 3884286 - DNA, 18 bp, Homo sapiens
ttggagagtaaaaactga

SEQ ID NO: 3884287 - DNA, 12 bp, Homo sapiens
ttggagccactc

SEQ ID NO: 3884288 - DNA, 12 bp, Homo sapiens
ttggagggatgg

SEQ ID NO: 3884289 - DNA, 20 bp, Homo sapiens
ttggatgggagtgagacaga

SEQ ID NO: 3884290 - DNA, 17 bp, Homo sapiens
ttggattattcatttaa

SEQ ID NO: 3884291 - DNA, 18 bp, Homo sapiens
ttggattattcatttaaa

SEQ ID NO: 3884292 - DNA, 20 bp, Homo sapiens
ttggattattcatttaaaat

SEQ ID NO: 3884293 - DNA, 15 bp, Homo sapiens
ttggcaacagaagca

SEQ ID NO: 3884294 - DNA, 16 bp, Homo sapiens
ttggcaatagtttgca

SEQ ID NO: 3884295 - DNA, 23 bp, Homo sapiens
ttggcacagaaacacaatatttt

SEQ ID NO: 3884296 - DNA, 17 bp, Homo sapiens
ttggcagagaaggcctc

SEQ ID NO: 3884297 - DNA, 18 bp, Homo sapiens
ttggcagcccttgaactt

SEQ ID NO: 3884298 - DNA, 19 bp, Homo sapiens
ttggcagcttaacattgac

SEQ ID NO: 3884299 - DNA, 17 bp, Homo sapiens
ttggccgccatccggga

SEQ ID NO: 3884300 - DNA, 19 bp, Homo sapiens
ttggccgccatccgggacg

SEQ ID NO: 3884301 - DNA, 22 bp, Homo sapiens
ttggccgtggccatcagggtgg

SEQ ID NO: 3884302 - DNA, 16 bp, Homo sapiens
ttggcctcgcctgggc

SEQ ID NO: 3884303 - DNA, 18 bp, Homo sapiens
ttggcctcgcctgggccc

SEQ ID NO: 3884304 - DNA, 21 bp, Homo sapiens
ttggcctcgcctgggcccagg

SEQ ID NO: 3884305 - DNA, 21 bp, Homo sapiens
ttggcctgcctcccagccctg

SEQ ID NO: 3884306 - DNA, 15 bp, Homo sapiens
ttggctcaggcagac

SEQ ID NO: 3884307 - DNA, 14 bp, Homo sapiens
ttggctctttcaga

SEQ ID NO: 3884308 - DNA, 16 bp, Homo sapiens
ttggctgctcattcct

SEQ ID NO: 3884309 - DNA, 19 bp, Homo sapiens
ttggctgctcattccttct

SEQ ID NO: 3884310 - DNA, 16 bp, Homo sapiens
ttgggagcactggagt

SEQ ID NO: 3884311 - DNA, 23 bp, Homo sapiens
ttgggagggatgagagtggctta

SEQ ID NO: 3884312 - DNA, 21 bp, Homo sapiens
ttgggcacccccagcctgggc

SEQ ID NO: 3884313 - DNA, 20 bp, Homo sapiens
ttgggcagaagggagaagga

SEQ ID NO: 3884314 - DNA, 21 bp, Homo sapiens
ttgggcatccacccagtgctg

SEQ ID NO: 3884315 - DNA, 17 bp, Homo sapiens
ttgggccaaggtgtttc

SEQ ID NO: 3884316 - DNA, 17 bp, Homo sapiens
ttgggctcctggctgcc

SEQ ID NO: 3884317 - DNA, 16 bp, Homo sapiens
ttgggctgacacctac

SEQ ID NO: 3884318 - DNA, 22 bp, Homo sapiens
ttgggctgacacctaccatgct

SEQ ID NO: 3884319 - DNA, 23 bp, Homo sapiens
ttgggctgacacctaccatgctg

SEQ ID NO: 3884320 - DNA, 21 bp, Homo sapiens
ttggggagaaataaattttgt

SEQ ID NO: 3884321 - DNA, 12 bp, Homo sapiens
ttggggcctggc

SEQ ID NO: 3884322 - DNA, 14 bp, Homo sapiens
ttggggcctggctt

SEQ ID NO: 3884323 - DNA, 21 bp, Homo sapiens
ttggggcctggcttgctccag

SEQ ID NO: 3884324 - DNA, 19 bp, Homo sapiens
ttggggtcaccaccctccc

SEQ ID NO: 3884325 - DNA, 16 bp, Homo sapiens
ttggggtcagccaggg

SEQ ID NO: 3884326 - DNA, 21 bp, Homo sapiens
ttggggtgtttcaaaagtgga

SEQ ID NO: 3884327 - DNA, 20 bp, Homo sapiens
ttggggttcccccagacaga

SEQ ID NO: 3884328 - DNA, 19 bp, Homo sapiens
ttggtaacacaaattttca

SEQ ID NO: 3884329 - DNA, 16 bp, Homo sapiens
ttggtaacatcctttc

SEQ ID NO: 3884330 - DNA, 18 bp, Homo sapiens
ttggtaggcttatcaaaa

SEQ ID NO: 3884331 - DNA, 15 bp, Homo sapiens
ttggtctgctggtgt

SEQ ID NO: 3884332 - DNA, 18 bp, Homo sapiens
ttggtgataagtggaaaa

SEQ ID NO: 3884333 - DNA, 23 bp, Homo sapiens
ttggtgataagtggaaaaaagag

SEQ ID NO: 3884334 - DNA, 20 bp, Homo sapiens
ttggtgcagaggtttcttga

SEQ ID NO: 3884335 - DNA, 18 bp, Homo sapiens
ttggtgggctggcccagc

SEQ ID NO: 3884336 - DNA, 21 bp, Homo sapiens
ttggtggggctcgtggccttc

SEQ ID NO: 3884337 - DNA, 21 bp, Homo sapiens
ttggtgtggctgtattcagat

SEQ ID NO: 3884338 - DNA, 22 bp, Homo sapiens
ttggtgttacacagcccaagag

SEQ ID NO: 3884339 - DNA, 22 bp, Homo sapiens
ttggttgtaaatgctcgtgtga

SEQ ID NO: 3884340 - DNA, 19 bp, Homo sapiens
ttgtaaaaacaaaaagaca

SEQ ID NO: 3884341 - DNA, 23 bp, Homo sapiens
ttgtaaaagaacagtaaacattg

SEQ ID NO: 3884342 - DNA, 19 bp, Homo sapiens
ttgtaaacagctaataatg

SEQ ID NO: 3884343 - DNA, 16 bp, Homo sapiens
ttgtaaactcaaaata

SEQ ID NO: 3884344 - DNA, 18 bp, Homo sapiens
ttgtaaaggtcagagtca

SEQ ID NO: 3884345 - DNA, 19 bp, Homo sapiens
ttgtaaatatttatgtaaa

SEQ ID NO: 3884346 - DNA, 14 bp, Homo sapiens
ttgtaaatgctcgt

SEQ ID NO: 3884347 - DNA, 18 bp, Homo sapiens
ttgtaaatgctcgtgtga

SEQ ID NO: 3884348 - DNA, 21 bp, Homo sapiens
ttgtaaatgctcgtgtgattt

SEQ ID NO: 3884349 - DNA, 12 bp, Homo sapiens
ttgtaaatttta

SEQ ID NO: 3884350 - DNA, 13 bp, Homo sapiens
ttgtaacttcaaa

SEQ ID NO: 3884351 - DNA, 14 bp, Homo sapiens
ttgtaacttcaaat

SEQ ID NO: 3884352 - DNA, 14 bp, Homo sapiens
ttgtaagtttatgt

SEQ ID NO: 3884353 - DNA, 11 bp, Homo sapiens
ttgtaatagtc

SEQ ID NO: 3884354 - DNA, 14 bp, Homo sapiens
ttgtaatgtcacca

SEQ ID NO: 3884355 - DNA, 18 bp, Homo sapiens
ttgtaattgcttacattt

SEQ ID NO: 3884356 - DNA, 12 bp, Homo sapiens
ttgtacaaaata

SEQ ID NO: 3884357 - DNA, 13 bp, Homo sapiens
ttgtacactatct

SEQ ID NO: 3884358 - DNA, 13 bp, Homo sapiens
ttgtacagaattt

SEQ ID NO: 3884359 - DNA, 14 bp, Homo sapiens
tttccatttctcaa

SEQ ID NO: 3884360 - DNA, 12 bp, Homo sapiens
tttcccagaagg

SEQ ID NO: 3884361 - DNA, 12 bp, Homo sapiens
tttccccacctc

SEQ ID NO: 3884362 - DNA, 16 bp, Homo sapiens
tttcccctcagagctc

SEQ ID NO: 3884363 - DNA, 20 bp, Homo sapiens
tttcccctctgtgtcctctc

SEQ ID NO: 3884364 - DNA, 14 bp, Homo sapiens
tttccctgactcct

SEQ ID NO: 3884365 - DNA, 13 bp, Homo sapiens
tttccctgagagc

SEQ ID NO: 3884366 - DNA, 12 bp, Homo sapiens
tttccctgtgct

SEQ ID NO: 3884367 - DNA, 23 bp, Homo sapiens
tttcctacagaaatactgctctg

SEQ ID NO: 3884368 - DNA, 23 bp, Homo sapiens
tttcctagccctctcacatttat

SEQ ID NO: 3884369 - DNA, 13 bp, Homo sapiens
tttcctattttaa

SEQ ID NO: 3884370 - DNA, 15 bp, Homo sapiens
tttcctattttaaaa

SEQ ID NO: 3884371 - DNA, 16 bp, Homo sapiens
tttcctattttaaaac

SEQ ID NO: 3884372 - DNA, 19 bp, Homo sapiens
tttcctcgcctaggcctgt

SEQ ID NO: 3884373 - DNA, 22 bp, Homo sapiens
tttcctctccaattgtaaaaaa

SEQ ID NO: 3884374 - DNA, 23 bp, Homo sapiens
tttcctgacagaaggactcaggt

SEQ ID NO: 3884375 - DNA, 16 bp, Homo sapiens
tttcctggaaagactg

SEQ ID NO: 3884376 - DNA, 23 bp, Homo sapiens
tttcctgtatttgttcccaagag

SEQ ID NO: 3884377 - DNA, 16 bp, Homo sapiens
tttccttccttccctg

SEQ ID NO: 3884378 - DNA, 15 bp, Homo sapiens
tttccttgaaaaaaa

SEQ ID NO: 3884379 - DNA, 18 bp, Homo sapiens
tttccttttcttccttct

SEQ ID NO: 3884380 - DNA, 17 bp, Homo sapiens
tttccttttttgttatt

SEQ ID NO: 3884381 - DNA, 17 bp, Homo sapiens
tttcgcttgcttctgca

SEQ ID NO: 3884382 - DNA, 12 bp, Homo sapiens
tttctaactgta

SEQ ID NO: 3884383 - DNA, 14 bp, Homo sapiens
tttctaactgtaaa

SEQ ID NO: 3884384 - DNA, 15 bp, Homo sapiens
tttctaactgtaaat

SEQ ID NO: 3884385 - DNA, 16 bp, Homo sapiens
tttctaactgtaaatc

SEQ ID NO: 3884386 - DNA, 23 bp, Homo sapiens
tttctaactgtaaatcacttgta

SEQ ID NO: 3884387 - DNA, 16 bp, Homo sapiens
tttctacttttaaaga

SEQ ID NO: 3884388 - DNA, 22 bp, Homo sapiens
tttctagctagaaatatgattt

SEQ ID NO: 3884389 - DNA, 14 bp, Homo sapiens
tttctagtttcagt

SEQ ID NO: 3884390 - DNA, 21 bp, Homo sapiens
tttctagtttcagtaaataat

SEQ ID NO: 3884391 - DNA, 18 bp, Homo sapiens
tttctccagccagcaatg

SEQ ID NO: 3884392 - DNA, 18 bp, Homo sapiens
tttctcctactttacact

SEQ ID NO: 3884393 - DNA, 19 bp, Homo sapiens
tttctctccttcttccctg

SEQ ID NO: 3884394 - DNA, 18 bp, Homo sapiens
tttctctgagagagatga

SEQ ID NO: 3884395 - DNA, 12 bp, Homo sapiens
tttctctgagca

SEQ ID NO: 3884396 - DNA, 17 bp, Homo sapiens
tttctctgcttaccctt

SEQ ID NO: 3884397 - DNA, 17 bp, Homo sapiens
tttctctgtatagtact

SEQ ID NO: 3884398 - DNA, 16 bp, Homo sapiens
tttctcttcatacttt

SEQ ID NO: 3884399 - DNA, 12 bp, Homo sapiens
tttctcttccct

SEQ ID NO: 3884400 - DNA, 20 bp, Homo sapiens
tttctgaaatcgccgtgtta

SEQ ID NO: 3884401 - DNA, 19 bp, Homo sapiens
tttctgagcttttcatgga

SEQ ID NO: 3884402 - DNA, 19 bp, Homo sapiens
tttctgcagtagtctctgt

SEQ ID NO: 3884403 - DNA, 16 bp, Homo sapiens
tttctgctgtttaagg

SEQ ID NO: 3884404 - DNA, 20 bp, Homo sapiens
tttctggaatacatgaaata

SEQ ID NO: 3884405 - DNA, 16 bp, Homo sapiens
tttctggagcaagaga

SEQ ID NO: 3884406 - DNA, 18 bp, Homo sapiens
tttctggtgcctatttat

SEQ ID NO: 3884407 - DNA, 13 bp, Homo sapiens
tttctgtcattca

SEQ ID NO: 3884408 - DNA, 15 bp, Homo sapiens
tttctgttctgttga

SEQ ID NO: 3884409 - DNA, 15 bp, Homo sapiens
tttctgttggtgtat

SEQ ID NO: 3884410 - DNA, 13 bp, Homo sapiens
tttcttatgattt

SEQ ID NO: 3884411 - DNA, 23 bp, Homo sapiens
tttcttatgatttttaaaagttg

SEQ ID NO: 3884412 - DNA, 21 bp, Homo sapiens
tttcttcactgttgaaaatta

SEQ ID NO: 3884413 - DNA, 11 bp, Homo sapiens
tttcttcctct

SEQ ID NO: 3884414 - DNA, 16 bp, Homo sapiens
tttctttcacaaaaaa

SEQ ID NO: 3884415 - DNA, 16 bp, Homo sapiens
tttctttctttttctg

SEQ ID NO: 3884416 - DNA, 13 bp, Homo sapiens
tttctttgtaaag

SEQ ID NO: 3884417 - DNA, 15 bp, Homo sapiens
tttctttgtgtagct

SEQ ID NO: 3884418 - DNA, 21 bp, Homo sapiens
tttctttttctggaaattttg

SEQ ID NO: 3884419 - DNA, 21 bp, Homo sapiens
tttgaaagtgaataaacttca

SEQ ID NO: 3884420 - DNA, 20 bp, Homo sapiens
tttgaatgttatttgttatt

SEQ ID NO: 3884421 - DNA, 13 bp, Homo sapiens
tttgacagtgtgg

SEQ ID NO: 3884422 - DNA, 16 bp, Homo sapiens
tttgacatgaaaagat

SEQ ID NO: 3884423 - DNA, 22 bp, Homo sapiens
tttgacccactcacacttggag

SEQ ID NO: 3884424 - DNA, 18 bp, Homo sapiens
tttgacctcacagtgacc

SEQ ID NO: 3884425 - DNA, 20 bp, Homo sapiens
tttgacgggaggcctcagtt

SEQ ID NO: 3884426 - DNA, 15 bp, Homo sapiens
tttgagaaagaaata

SEQ ID NO: 3884427 - DNA, 14 bp, Homo sapiens
tttgagaatgtgat

SEQ ID NO: 3884428 - DNA, 18 bp, Homo sapiens
tttgagagaagccacgct

SEQ ID NO: 3884429 - DNA, 14 bp, Homo sapiens
tttgagcaattcat

SEQ ID NO: 3884430 - DNA, 18 bp, Homo sapiens
tttgagcaattcatttca

SEQ ID NO: 3884431 - DNA, 21 bp, Homo sapiens
tttgagcgcagagtaaaataa

SEQ ID NO: 3884432 - DNA, 20 bp, Homo sapiens
tttgaggaattatcatggga

SEQ ID NO: 3884433 - DNA, 21 bp, Homo sapiens
tttgaggaattatcatgggaa

SEQ ID NO: 3884434 - DNA, 20 bp, Homo sapiens
tttgaggagcagcttcagtt

SEQ ID NO: 3884435 - DNA, 21 bp, Homo sapiens
tttgaggagcagcttcagttg

SEQ ID NO: 3884436 - DNA, 22 bp, Homo sapiens
tttgaggagcagcttcagttgt

SEQ ID NO: 3884437 - DNA, 15 bp, Homo sapiens
tttgagttcaaattt

SEQ ID NO: 3884438 - DNA, 16 bp, Homo sapiens
tttgatgccaagaaag

SEQ ID NO: 3884439 - DNA, 13 bp, Homo sapiens
tttgatggggaga

SEQ ID NO: 3884440 - DNA, 17 bp, Homo sapiens
tttgatggggagaaagg

SEQ ID NO: 3884441 - DNA, 18 bp, Homo sapiens
tttgatgtacatgtgtag

SEQ ID NO: 3884442 - DNA, 20 bp, Homo sapiens
tttgattgtaaaaacaaaaa

SEQ ID NO: 3884443 - DNA, 18 bp, Homo sapiens
tttgatttccaagtaata

SEQ ID NO: 3884444 - DNA, 20 bp, Homo sapiens
tttgatttccaagtaatata

SEQ ID NO: 3884445 - DNA, 13 bp, Homo sapiens
tttgcacatgtga

SEQ ID NO: 3884446 - DNA, 14 bp, Homo sapiens
tttgcactgagggc

SEQ ID NO: 3884447 - DNA, 16 bp, Homo sapiens
tttgcactgagggcca

SEQ ID NO: 3884448 - DNA, 17 bp, Homo sapiens
tttgcactgagggccac

SEQ ID NO: 3884449 - DNA, 13 bp, Homo sapiens
tttgcactgtttt

SEQ ID NO: 3884450 - DNA, 20 bp, Homo sapiens
tttgcagaaaagcacctgcc

SEQ ID NO: 3884451 - DNA, 12 bp, Homo sapiens
tttgcaggctct

SEQ ID NO: 3884452 - DNA, 17 bp, Homo sapiens
tttgcagttgagagggg

SEQ ID NO: 3884453 - DNA, 13 bp, Homo sapiens
tttgcattccatg

SEQ ID NO: 3884454 - DNA, 17 bp, Homo sapiens
tttgcattccatgattt

SEQ ID NO: 3884455 - DNA, 18 bp, Homo sapiens
tttgccaccactagagct

SEQ ID NO: 3884456 - DNA, 19 bp, Homo sapiens
tttgccatgggcctgctgc

SEQ ID NO: 3884457 - DNA, 13 bp, Homo sapiens
tttgccctgcctg

SEQ ID NO: 3884458 - DNA, 20 bp, Homo sapiens
tttgcctcttttctctgtgc

SEQ ID NO: 3884459 - DNA, 11 bp, Homo sapiens
tttgcctggct

SEQ ID NO: 3884460 - DNA, 13 bp, Homo sapiens
tttgcctggctgt

SEQ ID NO: 3884461 - DNA, 22 bp, Homo sapiens
tttgcctggctgtggaggcctg

SEQ ID NO: 3884462 - DNA, 23 bp, Homo sapiens
tttgcctggctgtggaggcctga

SEQ ID NO: 3884463 - DNA, 14 bp, Homo sapiens
tttgctacaataaa

SEQ ID NO: 3884464 - DNA, 18 bp, Homo sapiens
tttgctctagtcttgctt

SEQ ID NO: 3884465 - DNA, 13 bp, Homo sapiens
tttgctctttctt

SEQ ID NO: 3884466 - DNA, 12 bp, Homo sapiens
tttgctgctgct

SEQ ID NO: 3884467 - DNA, 13 bp, Homo sapiens
tttgctgtctttc

SEQ ID NO: 3884468 - DNA, 21 bp, Homo sapiens
tttgctgtctttctctaaata

SEQ ID NO: 3884469 - DNA, 13 bp, Homo sapiens
tttggacaaaatg

SEQ ID NO: 3884470 - DNA, 16 bp, Homo sapiens
tttggcttctcctgtg

SEQ ID NO: 3884471 - DNA, 14 bp, Homo sapiens
tttgggaggccaag

SEQ ID NO: 3884472 - DNA, 20 bp, Homo sapiens
tttggggcaggagtagctga

SEQ ID NO: 3884473 - DNA, 13 bp, Homo sapiens
tttggtccctggg

SEQ ID NO: 3884474 - DNA, 18 bp, Homo sapiens
tttggtgctggtctattt

SEQ ID NO: 3884475 - DNA, 18 bp, Homo sapiens
tttggtgtggctgtattc

SEQ ID NO: 3884476 - DNA, 22 bp, Homo sapiens
tttggtgtggctgtattcagat

SEQ ID NO: 3884477 - DNA, 13 bp, Homo sapiens
tttgtaaaggtca

SEQ ID NO: 3884478 - DNA, 17 bp, Homo sapiens
tttgtaaattaatactt

SEQ ID NO: 3884479 - DNA, 11 bp, Homo sapiens
tttgtaacttc

SEQ ID NO: 3884480 - DNA, 21 bp, Homo sapiens
tttgtaagtttatgtctaaag

SEQ ID NO: 3884481 - DNA, 14 bp, Homo sapiens
tttgtacaaatact

SEQ ID NO: 3884482 - DNA, 10 bp, Homo sapiens
tttgtacaga

SEQ ID NO: 3884483 - DNA, 21 bp, Homo sapiens
tttgtacagaatttttaatga

SEQ ID NO: 3884484 - DNA, 19 bp, Homo sapiens
tttgtacatatgtaaaata

SEQ ID NO: 3884485 - DNA, 15 bp, Homo sapiens
tttgtacctatgtga

SEQ ID NO: 3884486 - DNA, 20 bp, Homo sapiens
tttgtaggggtcaaagaaat

SEQ ID NO: 3884487 - DNA, 23 bp, Homo sapiens
tttgtaggggtcaaagaaatgct

SEQ ID NO: 3884488 - DNA, 14 bp, Homo sapiens
tttgtataaataat

SEQ ID NO: 3884489 - DNA, 16 bp, Homo sapiens
tttgtatagtaaagtg

SEQ ID NO: 3884490 - DNA, 13 bp, Homo sapiens
tttgtatctgaag

SEQ ID NO: 3884491 - DNA, 13 bp, Homo sapiens
tttgtattttgct

SEQ ID NO: 3884492 - DNA, 14 bp, Homo sapiens
tttgtcatatattc

SEQ ID NO: 3884493 - DNA, 17 bp, Homo sapiens
tttgtcatatattcatg

SEQ ID NO: 3884494 - DNA, 20 bp, Homo sapiens
tttgtcatatattcatgtaa

SEQ ID NO: 3884495 - DNA, 21 bp, Homo sapiens
tttgtcatgaattcttatgct

SEQ ID NO: 3884496 - DNA, 23 bp, Homo sapiens
tttgtcattcaagcctgtgaata

SEQ ID NO: 3884497 - DNA, 20 bp, Homo sapiens
tttgtcattttaaaatctga

SEQ ID NO: 3884498 - DNA, 22 bp, Homo sapiens
tttgtccaatggctgtaaacta

SEQ ID NO: 3884499 - DNA, 20 bp, Homo sapiens
tttgtccccagggcccctcc

SEQ ID NO: 3884500 - DNA, 21 bp, Homo sapiens
tttgtcctttgagaaagaaat

SEQ ID NO: 3884501 - DNA, 16 bp, Homo sapiens
tttgtgaatctttgtg

SEQ ID NO: 3884502 - DNA, 22 bp, Homo sapiens
tttgtgagcatgggtgtgccct

SEQ ID NO: 3884503 - DNA, 13 bp, Homo sapiens
tttgtgccagccg

SEQ ID NO: 3884504 - DNA, 14 bp, Homo sapiens
tttgtgtacagtgt

SEQ ID NO: 3884505 - DNA, 19 bp, Homo sapiens
tttgttatttgtacagttc

SEQ ID NO: 3884506 - DNA, 14 bp, Homo sapiens
tttgttcaaagttg

SEQ ID NO: 3884507 - DNA, 14 bp, Homo sapiens
tttgttctacatga

SEQ ID NO: 3884508 - DNA, 21 bp, Homo sapiens
tttgttctccgggtgtggcct

SEQ ID NO: 3884509 - DNA, 15 bp, Homo sapiens
tttgttgaaattatg

SEQ ID NO: 3884510 - DNA, 15 bp, Homo sapiens
tttgttgctgtcaag

SEQ ID NO: 3884511 - DNA, 14 bp, Homo sapiens
tttgttttgcactg

SEQ ID NO: 3884512 - DNA, 22 bp, Homo sapiens
tttgtttttttccaactgtgtt

SEQ ID NO: 3884513 - DNA, 12 bp, Homo sapiens
ttttaaaaccat

SEQ ID NO: 3884514 - DNA, 15 bp, Homo sapiens
ttttaaaaccatgca

SEQ ID NO: 3884515 - DNA, 12 bp, Homo sapiens
ttttaaaagaaa

SEQ ID NO: 3884516 - DNA, 22 bp, Homo sapiens
ttttaaaagttactccttttag

SEQ ID NO: 3884517 - DNA, 16 bp, Homo sapiens
ttttaaaatctgattt

SEQ ID NO: 3884518 - DNA, 16 bp, Homo sapiens
ttttaaacaaaataga

SEQ ID NO: 3884519 - DNA, 17 bp, Homo sapiens
ttttaaaggtagagatg

SEQ ID NO: 3884520 - DNA, 12 bp, Homo sapiens
ttttaaatgttt

SEQ ID NO: 3884521 - DNA, 17 bp, Homo sapiens
ttttaaattataagatg

SEQ ID NO: 3884522 - DNA, 20 bp, Homo sapiens
ttttaaattatactgtagct

SEQ ID NO: 3884523 - DNA, 23 bp, Homo sapiens
ttttaacacataactagaaacct

SEQ ID NO: 3884524 - DNA, 22 bp, Homo sapiens
ttttaaccagtacttctaagag

SEQ ID NO: 3884525 - DNA, 17 bp, Homo sapiens
ttttaacttaaatttta

SEQ ID NO: 3884526 - DNA, 13 bp, Homo sapiens
ttttaagacgtga

SEQ ID NO: 3884527 - DNA, 22 bp, Homo sapiens
ttttaagacgtgaatgtctcag

SEQ ID NO: 3884528 - DNA, 20 bp, Homo sapiens
ttttaagggtttgtggaaaa

SEQ ID NO: 3884529 - DNA, 21 bp, Homo sapiens
ttttaataaaattgacaacat

SEQ ID NO: 3884530 - DNA, 15 bp, Homo sapiens
ttttaatattttgta

SEQ ID NO: 3884531 - DNA, 14 bp, Homo sapiens
ttttaatgtacaag

SEQ ID NO: 3884532 - DNA, 20 bp, Homo sapiens
ttttaatgtacaagttttgt

SEQ ID NO: 3884533 - DNA, 15 bp, Homo sapiens
ttttaattgattatt

SEQ ID NO: 3884534 - DNA, 19 bp, Homo sapiens
ttttacaaaaaagaaaaga

SEQ ID NO: 3884535 - DNA, 12 bp, Homo sapiens
ttttacaaaaca

SEQ ID NO: 3884536 - DNA, 18 bp, Homo sapiens
ttttacaataaataatct

SEQ ID NO: 3884537 - DNA, 13 bp, Homo sapiens
ttttacatgacca

SEQ ID NO: 3884538 - DNA, 15 bp, Homo sapiens
ttttactacttgtta

SEQ ID NO: 3884539 - DNA, 13 bp, Homo sapiens
ttttactgtgcat

SEQ ID NO: 3884540 - DNA, 22 bp, Homo sapiens
ttttacttgcattgaatatatt

SEQ ID NO: 3884541 - DNA, 18 bp, Homo sapiens
ttttacttttgttctgta

SEQ ID NO: 3884542 - DNA, 17 bp, Homo sapiens
ttttagagactatggag

SEQ ID NO: 3884543 - DNA, 22 bp, Homo sapiens
ttttagagccccccgtgtggct

SEQ ID NO: 3884544 - DNA, 20 bp, Homo sapiens
ttttagatgagattgtttta

SEQ ID NO: 3884545 - DNA, 22 bp, Homo sapiens
ttttataatgtggatttcctat

SEQ ID NO: 3884546 - DNA, 12 bp, Homo sapiens
ttttatacatat

SEQ ID NO: 3884547 - DNA, 20 bp, Homo sapiens
ttttatactccatacataac

SEQ ID NO: 3884548 - DNA, 13 bp, Homo sapiens
ttttatatttagt

SEQ ID NO: 3884549 - DNA, 15 bp, Homo sapiens
ttttatcatgacatg

SEQ ID NO: 3884550 - DNA, 17 bp, Homo sapiens
ttttatcatgacatgtt

SEQ ID NO: 3884551 - DNA, 19 bp, Homo sapiens
ttttatcatgacatgttat

SEQ ID NO: 3884552 - DNA, 23 bp, Homo sapiens
ttttatggaggctttgcatagat

SEQ ID NO: 3884553 - DNA, 22 bp, Homo sapiens
ttttatggcatgatttatatat

SEQ ID NO: 3884554 - DNA, 14 bp, Homo sapiens
ttttattaaagcaa

SEQ ID NO: 3884555 - DNA, 14 bp, Homo sapiens
ttttattcaagtta

SEQ ID NO: 3884556 - DNA, 14 bp, Homo sapiens
ttttcaaccagcat

SEQ ID NO: 3884557 - DNA, 22 bp, Homo sapiens
ttttcaaccagcattttactac

SEQ ID NO: 3884558 - DNA, 17 bp, Homo sapiens
ttttcaacgcagccctg

SEQ ID NO: 3884559 - DNA, 21 bp, Homo sapiens
ttttcaacgcagccctgcttt

SEQ ID NO: 3884560 - DNA, 22 bp, Homo sapiens
ttttcaacgcagccctgctttg

SEQ ID NO: 3884561 - DNA, 22 bp, Homo sapiens
ttttcaagagaagaaaaaatta

SEQ ID NO: 3884562 - DNA, 20 bp, Homo sapiens
ttttcactgctggctgcctt

SEQ ID NO: 3884563 - DNA, 16 bp, Homo sapiens
ttttcagactcagact

SEQ ID NO: 3884564 - DNA, 14 bp, Homo sapiens
ttttcatcctggcc

SEQ ID NO: 3884565 - DNA, 15 bp, Homo sapiens
ttttcatcctggcct

SEQ ID NO: 3884566 - DNA, 16 bp, Homo sapiens
ttttcattacaatgga

SEQ ID NO: 3884567 - DNA, 14 bp, Homo sapiens
ttttccatgtatct

SEQ ID NO: 3884568 - DNA, 20 bp, Homo sapiens
ttttcccagatacttcccat

SEQ ID NO: 3884569 - DNA, 21 bp, Homo sapiens
ttttcctccagacagatacag

SEQ ID NO: 3884570 - DNA, 23 bp, Homo sapiens
ttttcgaacattctttgcctggt

SEQ ID NO: 3884571 - DNA, 20 bp, Homo sapiens
ttttcgcttgcttctgcagc

SEQ ID NO: 3884572 - DNA, 23 bp, Homo sapiens
ttttctaactgtaaatcacttgt

SEQ ID NO: 3884573 - DNA, 17 bp, Homo sapiens
ttttctactttttttaa

SEQ ID NO: 3884574 - DNA, 14 bp, Homo sapiens
ttttctagactttc

SEQ ID NO: 3884575 - DNA, 18 bp, Homo sapiens
ttttctgagaaagactat

SEQ ID NO: 3884576 - DNA, 12 bp, Homo sapiens
ttttctgctgtt

SEQ ID NO: 3884577 - DNA, 13 bp, Homo sapiens
ttttctgctgttt

SEQ ID NO: 3884578 - DNA, 17 bp, Homo sapiens
ttttctggaatacatga

SEQ ID NO: 3884579 - DNA, 12 bp, Homo sapiens
ttttctgtctct

SEQ ID NO: 3884580 - DNA, 23 bp, Homo sapiens
ttttctgttactttgttttttaa

SEQ ID NO: 3884581 - DNA, 21 bp, Homo sapiens
ttttctgttgtacgtaaagct

SEQ ID NO: 3884582 - DNA, 13 bp, Homo sapiens
ttttcttatttca

SEQ ID NO: 3884583 - DNA, 14 bp, Homo sapiens
ttttgaaaagctaa

SEQ ID NO: 3884584 - DNA, 16 bp, Homo sapiens
ttttgaaactagaagt

SEQ ID NO: 3884585 - DNA, 20 bp, Homo sapiens
ttttgaactaataaaagcat

SEQ ID NO: 3884586 - DNA, 20 bp, Homo sapiens
ttttgagagaaccttatatt

SEQ ID NO: 3884587 - DNA, 10 bp, Homo sapiens
ttttgcacaa

SEQ ID NO: 3884588 - DNA, 13 bp, Homo sapiens
ttttgcactgaca

SEQ ID NO: 3884589 - DNA, 22 bp, Homo sapiens
ttttgcattgtgtgagcttcta

SEQ ID NO: 3884590 - DNA, 18 bp, Homo sapiens
ttttgcccttcacagtgt

SEQ ID NO: 3884591 - DNA, 15 bp, Homo sapiens
ttttgcctcttttct

SEQ ID NO: 3884592 - DNA, 19 bp, Homo sapiens
ttttgctggtgtctgagct

SEQ ID NO: 3884593 - DNA, 15 bp, Homo sapiens
ttttgctgtctttct

SEQ ID NO: 3884594 - DNA, 18 bp, Homo sapiens
ttttgcttaaaattttac

SEQ ID NO: 3884595 - DNA, 15 bp, Homo sapiens
ttttgtaaagatgcc

SEQ ID NO: 3884596 - DNA, 15 bp, Homo sapiens
ttttgtaacttcaaa

SEQ ID NO: 3884597 - DNA, 17 bp, Homo sapiens
ttttgtaacttcaaata

SEQ ID NO: 3884598 - DNA, 16 bp, Homo sapiens
ttttgtaataaaaggt

SEQ ID NO: 3884599 - DNA, 13 bp, Homo sapiens
ttttgtacagaat

SEQ ID NO: 3884600 - DNA, 14 bp, Homo sapiens
ttttgtacagaatt

SEQ ID NO: 3884601 - DNA, 22 bp, Homo sapiens
ttttgtacagaatttttaatga

SEQ ID NO: 3884602 - DNA, 23 bp, Homo sapiens
ttttgtaggggtcaaagaaatgc

SEQ ID NO: 3884603 - DNA, 20 bp, Homo sapiens
ttttgtattacatctaatgc

SEQ ID NO: 3884604 - DNA, 18 bp, Homo sapiens
ttttgtattctttactaa

SEQ ID NO: 3884605 - DNA, 10 bp, Homo sapiens
ttttgtattt

SEQ ID NO: 3884606 - DNA, 14 bp, Homo sapiens
ttttgtcttcctca

SEQ ID NO: 3884607 - DNA, 18 bp, Homo sapiens
ttttgtgaaaatgtcaaa

SEQ ID NO: 3884608 - DNA, 19 bp, Homo sapiens
ttttgtgatttagaactgt

SEQ ID NO: 3884609 - DNA, 12 bp, Homo sapiens
ttttgttataga

SEQ ID NO: 3884610 - DNA, 14 bp, Homo sapiens
ttttgttcaaagtt

SEQ ID NO: 3884611 - DNA, 18 bp, Homo sapiens
tttttaaaaagtactctt

SEQ ID NO: 3884612 - DNA, 12 bp, Homo sapiens
tttttaaagtct

SEQ ID NO: 3884613 - DNA, 20 bp, Homo sapiens
tttttaacactagaaaacat

SEQ ID NO: 3884614 - DNA, 15 bp, Homo sapiens
tttttaatgactttt

SEQ ID NO: 3884615 - DNA, 13 bp, Homo sapiens
tttttagtctttt

SEQ ID NO: 3884616 - DNA, 17 bp, Homo sapiens
tttttatacatatcaga

SEQ ID NO: 3884617 - DNA, 18 bp, Homo sapiens
tttttatacatatcagaa

SEQ ID NO: 3884618 - DNA, 22 bp, Homo sapiens
ttgtacagttaactctcccagg

SEQ ID NO: 3884619 - DNA, 11 bp, Homo sapiens
ttgtacagttc

SEQ ID NO: 3884620 - DNA, 12 bp, Homo sapiens
ttgtaccccatc

SEQ ID NO: 3884621 - DNA, 21 bp, Homo sapiens
ttgtacgtaaagcttaaattg

SEQ ID NO: 3884622 - DNA, 16 bp, Homo sapiens
ttgtacgtaatgtatt

SEQ ID NO: 3884623 - DNA, 14 bp, Homo sapiens
ttgtactatgttaa

SEQ ID NO: 3884624 - DNA, 21 bp, Homo sapiens
ttgtactattgtttaaaaaca

SEQ ID NO: 3884625 - DNA, 12 bp, Homo sapiens
ttgtagaaacac

SEQ ID NO: 3884626 - DNA, 13 bp, Homo sapiens
ttgtagaaatctg

SEQ ID NO: 3884627 - DNA, 15 bp, Homo sapiens
ttgtagccagccggg

SEQ ID NO: 3884628 - DNA, 23 bp, Homo sapiens
ttgtagttaatttattaagtctg

SEQ ID NO: 3884629 - DNA, 19 bp, Homo sapiens
ttgtagttcttgtgcatgt

SEQ ID NO: 3884630 - DNA, 17 bp, Homo sapiens
ttgtataaatgtatata

SEQ ID NO: 3884631 - DNA, 16 bp, Homo sapiens
ttgtatagtgtaaaat

SEQ ID NO: 3884632 - DNA, 20 bp, Homo sapiens
ttgtatatacatattataaa

SEQ ID NO: 3884633 - DNA, 13 bp, Homo sapiens
ttgtatatatctg

SEQ ID NO: 3884634 - DNA, 14 bp, Homo sapiens
ttgtatatatgtgt

SEQ ID NO: 3884635 - DNA, 15 bp, Homo sapiens
ttgtatatcatgaaa

SEQ ID NO: 3884636 - DNA, 20 bp, Homo sapiens
ttgtatattatggaagattt

SEQ ID NO: 3884637 - DNA, 16 bp, Homo sapiens
ttgtatattgtcagat

SEQ ID NO: 3884638 - DNA, 16 bp, Homo sapiens
ttgtatcacaaatctt

SEQ ID NO: 3884639 - DNA, 15 bp, Homo sapiens
ttgtatccagtgatg

SEQ ID NO: 3884640 - DNA, 13 bp, Homo sapiens
ttgtatgtactgt

SEQ ID NO: 3884641 - DNA, 14 bp, Homo sapiens
ttgtattacatcta

SEQ ID NO: 3884642 - DNA, 16 bp, Homo sapiens
ttgtattttaaatgtt

SEQ ID NO: 3884643 - DNA, 21 bp, Homo sapiens
ttgtattttaaatgttttaca

SEQ ID NO: 3884644 - DNA, 16 bp, Homo sapiens
ttgtcaccagcaacat

SEQ ID NO: 3884645 - DNA, 15 bp, Homo sapiens
ttgtcactgtcttca

SEQ ID NO: 3884646 - DNA, 16 bp, Homo sapiens
ttgtcaggacccaggc

SEQ ID NO: 3884647 - DNA, 19 bp, Homo sapiens
ttgtcaggttggagtgtaa

SEQ ID NO: 3884648 - DNA, 15 bp, Homo sapiens
ttgtcatatattcat

SEQ ID NO: 3884649 - DNA, 17 bp, Homo sapiens
ttgtcatatattcatgt

SEQ ID NO: 3884650 - DNA, 21 bp, Homo sapiens
ttgtcatatattcatgtaata

SEQ ID NO: 3884651 - DNA, 21 bp, Homo sapiens
ttgtcatctttcttctatttt

SEQ ID NO: 3884652 - DNA, 23 bp, Homo sapiens
ttgtcatggaaaatgtcctgtgg

SEQ ID NO: 3884653 - DNA, 23 bp, Homo sapiens
ttgtcattactgcctttggaaga

SEQ ID NO: 3884654 - DNA, 14 bp, Homo sapiens
ttgtcattatgtac

SEQ ID NO: 3884655 - DNA, 20 bp, Homo sapiens
ttgtcattttaaaatctgat

SEQ ID NO: 3884656 - DNA, 18 bp, Homo sapiens
ttgtccaatggctgtaaa

SEQ ID NO: 3884657 - DNA, 21 bp, Homo sapiens
ttgtccacagtctcccattct

SEQ ID NO: 3884658 - DNA, 13 bp, Homo sapiens
ttgtccctgctcc

SEQ ID NO: 3884659 - DNA, 14 bp, Homo sapiens
ttgtccctgtttca

SEQ ID NO: 3884660 - DNA, 12 bp, Homo sapiens
ttgtcctctccc

SEQ ID NO: 3884661 - DNA, 12 bp, Homo sapiens
ttgtcctgccag

SEQ ID NO: 3884662 - DNA, 13 bp, Homo sapiens
ttgtcctgccagc

SEQ ID NO: 3884663 - DNA, 14 bp, Homo sapiens
ttgtcctgccagct

SEQ ID NO: 3884664 - DNA, 15 bp, Homo sapiens
ttgtccttcagagct

SEQ ID NO: 3884665 - DNA, 15 bp, Homo sapiens
ttgtcctttgagaaa

SEQ ID NO: 3884666 - DNA, 17 bp, Homo sapiens
ttgtcctttgagaaaga

SEQ ID NO: 3884667 - DNA, 21 bp, Homo sapiens
ttgtctagaggtgagaccaaa

SEQ ID NO: 3884668 - DNA, 13 bp, Homo sapiens
ttgtctcaagatt

SEQ ID NO: 3884669 - DNA, 20 bp, Homo sapiens
ttgtctctcattctctttct

SEQ ID NO: 3884670 - DNA, 14 bp, Homo sapiens
ttgtctgaggcctc

SEQ ID NO: 3884671 - DNA, 14 bp, Homo sapiens
ttgtgaaaccacag

SEQ ID NO: 3884672 - DNA, 14 bp, Homo sapiens
ttgtgactgaaggg

SEQ ID NO: 3884673 - DNA, 12 bp, Homo sapiens
ttgtgactggca

SEQ ID NO: 3884674 - DNA, 15 bp, Homo sapiens
ttgtgactggcaccc

SEQ ID NO: 3884675 - DNA, 15 bp, Homo sapiens
ttgtgattttgtaca

SEQ ID NO: 3884676 - DNA, 17 bp, Homo sapiens
ttgtgcccactgtctct

SEQ ID NO: 3884677 - DNA, 19 bp, Homo sapiens
ttgtgctgtgggcagcacc

SEQ ID NO: 3884678 - DNA, 21 bp, Homo sapiens
ttgtgctgtgggcagcaccct

SEQ ID NO: 3884679 - DNA, 15 bp, Homo sapiens
ttgtggaacaaaagt

SEQ ID NO: 3884680 - DNA, 15 bp, Homo sapiens
ttgtggatgctccag

SEQ ID NO: 3884681 - DNA, 22 bp, Homo sapiens
ttgtgtaacaattttaatgcta

SEQ ID NO: 3884682 - DNA, 20 bp, Homo sapiens
ttgtgtactgataaaatact

SEQ ID NO: 3884683 - DNA, 15 bp, Homo sapiens
ttgtgtatgatccaa

SEQ ID NO: 3884684 - DNA, 19 bp, Homo sapiens
ttgtgtcagagctgggagt

SEQ ID NO: 3884685 - DNA, 22 bp, Homo sapiens
ttgtgttgccttagcacttctt

SEQ ID NO: 3884686 - DNA, 17 bp, Homo sapiens
ttgttaatattcatttt

SEQ ID NO: 3884687 - DNA, 17 bp, Homo sapiens
ttgttaccatgaagata

SEQ ID NO: 3884688 - DNA, 17 bp, Homo sapiens
ttgttatatatatcaag

SEQ ID NO: 3884689 - DNA, 12 bp, Homo sapiens
ttgttatgctat

SEQ ID NO: 3884690 - DNA, 11 bp, Homo sapiens
ttgttcctgat

SEQ ID NO: 3884691 - DNA, 22 bp, Homo sapiens
ttgttccttacctttacataat

SEQ ID NO: 3884692 - DNA, 14 bp, Homo sapiens
ttgttccttctgct

SEQ ID NO: 3884693 - DNA, 17 bp, Homo sapiens
ttgttccttctgcttct

SEQ ID NO: 3884694 - DNA, 15 bp, Homo sapiens
ttgttctgtattttc

SEQ ID NO: 3884695 - DNA, 13 bp, Homo sapiens
ttgttgattaatt

SEQ ID NO: 3884696 - DNA, 18 bp, Homo sapiens
ttgttgcagagatttcct

SEQ ID NO: 3884697 - DNA, 13 bp, Homo sapiens
ttgttggaatgaa

SEQ ID NO: 3884698 - DNA, 14 bp, Homo sapiens
ttgtttaaaatcat

SEQ ID NO: 3884699 - DNA, 20 bp, Homo sapiens
ttgtttaaatataaatgttt

SEQ ID NO: 3884700 - DNA, 18 bp, Homo sapiens
ttgtttctgagaaaagaa

SEQ ID NO: 3884701 - DNA, 14 bp, Homo sapiens
ttgtttgggagagt

SEQ ID NO: 3884702 - DNA, 22 bp, Homo sapiens
ttgttttaaccagtacttctaa

SEQ ID NO: 3884703 - DNA, 15 bp, Homo sapiens
ttgttttatgttcta

SEQ ID NO: 3884704 - DNA, 14 bp, Homo sapiens
ttgttttcattatc

SEQ ID NO: 3884705 - DNA, 14 bp, Homo sapiens
ttgtttttaaatca

SEQ ID NO: 3884706 - DNA, 18 bp, Homo sapiens
ttgttttttttttccact

SEQ ID NO: 3884707 - DNA, 11 bp, Homo sapiens
tttaaaaaagc

SEQ ID NO: 3884708 - DNA, 12 bp, Homo sapiens
tttaaaaaatac

SEQ ID NO: 3884709 - DNA, 23 bp, Homo sapiens
tttaaaaaccaatcattttaaga

SEQ ID NO: 3884710 - DNA, 16 bp, Homo sapiens
tttaaaagaaatttat

SEQ ID NO: 3884711 - DNA, 13 bp, Homo sapiens
tttaaaatctgat

SEQ ID NO: 3884712 - DNA, 16 bp, Homo sapiens
tttaaaatctgattta

SEQ ID NO: 3884713 - DNA, 12 bp, Homo sapiens
tttaaaatgatt

SEQ ID NO: 3884714 - DNA, 12 bp, Homo sapiens
tttaaagactta

SEQ ID NO: 3884715 - DNA, 15 bp, Homo sapiens
tttaaagacttaaga

SEQ ID NO: 3884716 - DNA, 18 bp, Homo sapiens
tttaaagtgtaataatat

SEQ ID NO: 3884717 - DNA, 19 bp, Homo sapiens
tttaaagttttatatgcat

SEQ ID NO: 3884718 - DNA, 13 bp, Homo sapiens
tttaaataaagta

SEQ ID NO: 3884719 - DNA, 22 bp, Homo sapiens
tttaaataaagtatcatgcatt

SEQ ID NO: 3884720 - DNA, 23 bp, Homo sapiens
tttaaataaagtatcatgcattc

SEQ ID NO: 3884721 - DNA, 18 bp, Homo sapiens
tttaaatgcataaatgca

SEQ ID NO: 3884722 - DNA, 10 bp, Homo sapiens
tttaaatgtt

SEQ ID NO: 3884723 - DNA, 16 bp, Homo sapiens
tttaaatgttgaaatc

SEQ ID NO: 3884724 - DNA, 21 bp, Homo sapiens
tttaaatgttgaaatcttaaa

SEQ ID NO: 3884725 - DNA, 19 bp, Homo sapiens
tttaaattataagatgtca

SEQ ID NO: 3884726 - DNA, 19 bp, Homo sapiens
tttaaattcacaatagaaa

SEQ ID NO: 3884727 - DNA, 14 bp, Homo sapiens
tttaaatttgttat

SEQ ID NO: 3884728 - DNA, 15 bp, Homo sapiens
tttaacaaaagcaag

SEQ ID NO: 3884729 - DNA, 17 bp, Homo sapiens
tttaaccagtacttcta

SEQ ID NO: 3884730 - DNA, 21 bp, Homo sapiens
tttaaccatggtgcttgttaa

SEQ ID NO: 3884731 - DNA, 13 bp, Homo sapiens
tttaactaattta

SEQ ID NO: 3884732 - DNA, 17 bp, Homo sapiens
tttaactaatttaaacc

SEQ ID NO: 3884733 - DNA, 16 bp, Homo sapiens
tttaacttaaatttta

SEQ ID NO: 3884734 - DNA, 16 bp, Homo sapiens
tttaagacgtgaatgt

SEQ ID NO: 3884735 - DNA, 21 bp, Homo sapiens
tttaagacgtgaatgtctcag

SEQ ID NO: 3884736 - DNA, 13 bp, Homo sapiens
tttaagagagaaa

SEQ ID NO: 3884737 - DNA, 14 bp, Homo sapiens
tttaagagagaaat

SEQ ID NO: 3884738 - DNA, 15 bp, Homo sapiens
tttaagccttttgtg

SEQ ID NO: 3884739 - DNA, 20 bp, Homo sapiens
tttaagggtttgtggaaaat

SEQ ID NO: 3884740 - DNA, 22 bp, Homo sapiens
tttaagggtttgtggaaaatga

SEQ ID NO: 3884741 - DNA, 21 bp, Homo sapiens
tttaagtatatagtatattta

SEQ ID NO: 3884742 - DNA, 14 bp, Homo sapiens
tttaatacagcagt

SEQ ID NO: 3884743 - DNA, 13 bp, Homo sapiens
tttaatagtttct

SEQ ID NO: 3884744 - DNA, 18 bp, Homo sapiens
tttaatatttaaacagca

SEQ ID NO: 3884745 - DNA, 20 bp, Homo sapiens
tttaatattttgtattttca

SEQ ID NO: 3884746 - DNA, 17 bp, Homo sapiens
tttaatctttgtgacag

SEQ ID NO: 3884747 - DNA, 17 bp, Homo sapiens
tttaatgactttttata

SEQ ID NO: 3884748 - DNA, 20 bp, Homo sapiens
tttaatgactttttataatg

SEQ ID NO: 3884749 - DNA, 17 bp, Homo sapiens
tttaatgtgtattgaag

SEQ ID NO: 3884750 - DNA, 13 bp, Homo sapiens
tttaatgttttct

SEQ ID NO: 3884751 - DNA, 15 bp, Homo sapiens
tttaattaactatgt

SEQ ID NO: 3884752 - DNA, 12 bp, Homo sapiens
tttaattcataa

SEQ ID NO: 3884753 - DNA, 13 bp, Homo sapiens
tttaattcataat

SEQ ID NO: 3884754 - DNA, 14 bp, Homo sapiens
tttaattcataatt

SEQ ID NO: 3884755 - DNA, 14 bp, Homo sapiens
tttaattgattatt

SEQ ID NO: 3884756 - DNA, 18 bp, Homo sapiens
tttaatttttacatgacc

SEQ ID NO: 3884757 - DNA, 13 bp, Homo sapiens
tttacaaaacata

SEQ ID NO: 3884758 - DNA, 21 bp, Homo sapiens
tttacaagtgtatatcagaaa

SEQ ID NO: 3884759 - DNA, 15 bp, Homo sapiens
tttacaataaatatt

SEQ ID NO: 3884760 - DNA, 17 bp, Homo sapiens
tttacaataaatattct

SEQ ID NO: 3884761 - DNA, 15 bp, Homo sapiens
tttacagtaaataaa

SEQ ID NO: 3884762 - DNA, 19 bp, Homo sapiens
tttacagtaaataaattgt

SEQ ID NO: 3884763 - DNA, 13 bp, Homo sapiens
tttacataattgc

SEQ ID NO: 3884764 - DNA, 18 bp, Homo sapiens
tttacatgaattgcattt

SEQ ID NO: 3884765 - DNA, 16 bp, Homo sapiens
tttacctgagaccagt

SEQ ID NO: 3884766 - DNA, 16 bp, Homo sapiens
tttacctgcaaaaaat

SEQ ID NO: 3884767 - DNA, 18 bp, Homo sapiens
tttacctgggatatgaca

SEQ ID NO: 3884768 - DNA, 17 bp, Homo sapiens
tttaccttttctgttgt

SEQ ID NO: 3884769 - DNA, 15 bp, Homo sapiens
tttactaaagagaca

SEQ ID NO: 3884770 - DNA, 22 bp, Homo sapiens
tttactaagccacaagaaattt

SEQ ID NO: 3884771 - DNA, 19 bp, Homo sapiens
tttactcccttcctggcct

SEQ ID NO: 3884772 - DNA, 14 bp, Homo sapiens
tttacttccacaga

SEQ ID NO: 3884773 - DNA, 14 bp, Homo sapiens
tttacttgtagaaa

SEQ ID NO: 3884774 - DNA, 15 bp, Homo sapiens
tttacttttaaacag

SEQ ID NO: 3884775 - DNA, 18 bp, Homo sapiens
tttacttttaaacagtga

SEQ ID NO: 3884776 - DNA, 18 bp, Homo sapiens
tttagagtagcatgagag

SEQ ID NO: 3884777 - DNA, 21 bp, Homo sapiens
tttagatcccatgtcacctca

SEQ ID NO: 3884778 - DNA, 17 bp, Homo sapiens
tttagctctgttcttta

SEQ ID NO: 3884779 - DNA, 16 bp, Homo sapiens
tttagggaagcaggga

SEQ ID NO: 3884780 - DNA, 15 bp, Homo sapiens
tttagggctgtagac

SEQ ID NO: 3884781 - DNA, 13 bp, Homo sapiens
tttataaatgtgt

SEQ ID NO: 3884782 - DNA, 23 bp, Homo sapiens
tttataagcaaatttcaaaagac

SEQ ID NO: 3884783 - DNA, 20 bp, Homo sapiens
tttataagcagatttaacaa

SEQ ID NO: 3884784 - DNA, 21 bp, Homo sapiens
tttataatgtggatttcctat

SEQ ID NO: 3884785 - DNA, 12 bp, Homo sapiens
tttatacaaaat

SEQ ID NO: 3884786 - DNA, 15 bp, Homo sapiens
tttatacaaaataat

SEQ ID NO: 3884787 - DNA, 23 bp, Homo sapiens
tttatacagaactgaattaagtt

SEQ ID NO: 3884788 - DNA, 21 bp, Homo sapiens
tttatacatagtcacaaaaat

SEQ ID NO: 3884789 - DNA, 12 bp, Homo sapiens
tttatacatatc

SEQ ID NO: 3884790 - DNA, 17 bp, Homo sapiens
tttatacatatcagaaa

SEQ ID NO: 3884791 - DNA, 19 bp, Homo sapiens
tttatacatatcagaaaag

SEQ ID NO: 3884792 - DNA, 20 bp, Homo sapiens
tttatacatatcagaaaagt

SEQ ID NO: 3884793 - DNA, 17 bp, Homo sapiens
tttatagtttgtacatg

SEQ ID NO: 3884794 - DNA, 23 bp, Homo sapiens
tttatatattggtaacatccttt

SEQ ID NO: 3884795 - DNA, 15 bp, Homo sapiens
tttatatccacatct

SEQ ID NO: 3884796 - DNA, 14 bp, Homo sapiens
tttatatttagtga

SEQ ID NO: 3884797 - DNA, 18 bp, Homo sapiens
tttatatttggaaagaga

SEQ ID NO: 3884798 - DNA, 21 bp, Homo sapiens
tttatatttggaaagagacca

SEQ ID NO: 3884799 - DNA, 21 bp, Homo sapiens
tttatcagtgcttaatgtgaa

SEQ ID NO: 3884800 - DNA, 21 bp, Homo sapiens
tttatccattcaactgaaaat

SEQ ID NO: 3884801 - DNA, 21 bp, Homo sapiens
tttatccttcaccagcaactc

SEQ ID NO: 3884802 - DNA, 13 bp, Homo sapiens
tttatctctattt

SEQ ID NO: 3884803 - DNA, 15 bp, Homo sapiens
tttatctgtcacaca

SEQ ID NO: 3884804 - DNA, 11 bp, Homo sapiens
tttatctttga

SEQ ID NO: 3884805 - DNA, 23 bp, Homo sapiens
tttatggaggatggagagagggg

SEQ ID NO: 3884806 - DNA, 20 bp, Homo sapiens
tttatggatcccaattcatt

SEQ ID NO: 3884807 - DNA, 24 bp, Homo sapiens
tttatggatcccaattcatttcat

SEQ ID NO: 3884808 - DNA, 16 bp, Homo sapiens
tttatggcatgattta

SEQ ID NO: 3884809 - DNA, 22 bp, Homo sapiens
tttatggcatgatttatatatg

SEQ ID NO: 3884810 - DNA, 20 bp, Homo sapiens
tttatggcttataaatgtgt

SEQ ID NO: 3884811 - DNA, 19 bp, Homo sapiens
tttatgtctaaagagcttt

SEQ ID NO: 3884812 - DNA, 12 bp, Homo sapiens
tttatgttctag

SEQ ID NO: 3884813 - DNA, 17 bp, Homo sapiens
tttatgttctcagaatc

SEQ ID NO: 3884814 - DNA, 14 bp, Homo sapiens
tttattaaagcaac

SEQ ID NO: 3884815 - DNA, 12 bp, Homo sapiens
tttattaacaaa

SEQ ID NO: 3884816 - DNA, 18 bp, Homo sapiens
tttattaacaaattatgt

SEQ ID NO: 3884817 - DNA, 14 bp, Homo sapiens
tttattaagtctgg

SEQ ID NO: 3884818 - DNA, 20 bp, Homo sapiens
tttattagctgtaaatacat

SEQ ID NO: 3884819 - DNA, 24 bp, Homo sapiens
tttattagctgtaaatacatgtgt

SEQ ID NO: 3884820 - DNA, 14 bp, Homo sapiens
tttattattgaaga

SEQ ID NO: 3884821 - DNA, 17 bp, Homo sapiens
tttattcattcagtgag

SEQ ID NO: 3884822 - DNA, 12 bp, Homo sapiens
tttattctgttt

SEQ ID NO: 3884823 - DNA, 15 bp, Homo sapiens
tttattctgttttct

SEQ ID NO: 3884824 - DNA, 18 bp, Homo sapiens
tttattctgttttcttgt

SEQ ID NO: 3884825 - DNA, 12 bp, Homo sapiens
tttattgacaat

SEQ ID NO: 3884826 - DNA, 21 bp, Homo sapiens
tttattgtcattactgccttt

SEQ ID NO: 3884827 - DNA, 13 bp, Homo sapiens
tttattgtgatct

SEQ ID NO: 3884828 - DNA, 12 bp, Homo sapiens
tttatttatggc

SEQ ID NO: 3884829 - DNA, 16 bp, Homo sapiens
tttatttattcactgt

SEQ ID NO: 3884830 - DNA, 23 bp, Homo sapiens
tttatttttgaacccctgtgtcc

SEQ ID NO: 3884831 - DNA, 13 bp, Homo sapiens
tttcaaaagtgat

SEQ ID NO: 3884832 - DNA, 13 bp, Homo sapiens
tttcaaaagtgga

SEQ ID NO: 3884833 - DNA, 20 bp, Homo sapiens
tttcaaactcctgactttgt

SEQ ID NO: 3884834 - DNA, 14 bp, Homo sapiens
tttcaaagaaggaa

SEQ ID NO: 3884835 - DNA, 15 bp, Homo sapiens
tttcaaccagcattt

SEQ ID NO: 3884836 - DNA, 16 bp, Homo sapiens
tttcaacgcagccctg

SEQ ID NO: 3884837 - DNA, 20 bp, Homo sapiens
tttcaacgcagccctgcttt

SEQ ID NO: 3884838 - DNA, 13 bp, Homo sapiens
tttcaactccaga

SEQ ID NO: 3884839 - DNA, 22 bp, Homo sapiens
tttcaagagaagaaaaaattaa

SEQ ID NO: 3884840 - DNA, 23 bp, Homo sapiens
tttcaagagaagaaaaaattaag

SEQ ID NO: 3884841 - DNA, 22 bp, Homo sapiens
tttcaagcctgcctaggaattc

SEQ ID NO: 3884842 - DNA, 15 bp, Homo sapiens
tttcaaggaaagtga

SEQ ID NO: 3884843 - DNA, 16 bp, Homo sapiens
tttcacaaccttctgt

SEQ ID NO: 3884844 - DNA, 22 bp, Homo sapiens
tttcacaaccttctgtggctca

SEQ ID NO: 3884845 - DNA, 13 bp, Homo sapiens
tttcacagttttt

SEQ ID NO: 3884846 - DNA, 20 bp, Homo sapiens
tttcacattaatggtctaaa

SEQ ID NO: 3884847 - DNA, 15 bp, Homo sapiens
tttcaccacattcgt

SEQ ID NO: 3884848 - DNA, 17 bp, Homo sapiens
tttcaccagatttgcta

SEQ ID NO: 3884849 - DNA, 18 bp, Homo sapiens
tttcacgggaactctcca

SEQ ID NO: 3884850 - DNA, 22 bp, Homo sapiens
tttcacgggaactctccaaata

SEQ ID NO: 3884851 - DNA, 17 bp, Homo sapiens
tttcactggagttacat

SEQ ID NO: 3884852 - DNA, 18 bp, Homo sapiens
tttcactggagttacatt

SEQ ID NO: 3884853 - DNA, 24 bp, Homo sapiens
tttcactgtagaatgatttcatgc

SEQ ID NO: 3884854 - DNA, 13 bp, Homo sapiens
tttcactttagct

SEQ ID NO: 3884855 - DNA, 19 bp, Homo sapiens
tttcagagccagtgaagga

SEQ ID NO: 3884856 - DNA, 15 bp, Homo sapiens
tttcagatatatatc

SEQ ID NO: 3884857 - DNA, 16 bp, Homo sapiens
tttcaggaccttttga

SEQ ID NO: 3884858 - DNA, 18 bp, Homo sapiens
tttcaggagggtccccag

SEQ ID NO: 3884859 - DNA, 19 bp, Homo sapiens
tttcaggatactctgtcag

SEQ ID NO: 3884860 - DNA, 21 bp, Homo sapiens
tttcaggatactctgtcagat

SEQ ID NO: 3884861 - DNA, 21 bp, Homo sapiens
tttcagttgatcactggcaat

SEQ ID NO: 3884862 - DNA, 20 bp, Homo sapiens
tttcataaggcctgccctcc

SEQ ID NO: 3884863 - DNA, 20 bp, Homo sapiens
tttcatagattgagaagttt

SEQ ID NO: 3884864 - DNA, 17 bp, Homo sapiens
tttcatccagtttgttc

SEQ ID NO: 3884865 - DNA, 23 bp, Homo sapiens
tttcatccctatgggattcagtg

SEQ ID NO: 3884866 - DNA, 13 bp, Homo sapiens
tttcatcctggcc

SEQ ID NO: 3884867 - DNA, 14 bp, Homo sapiens
tttcatcctggcct

SEQ ID NO: 3884868 - DNA, 15 bp, Homo sapiens
tttcatcctggcctc

SEQ ID NO: 3884869 - DNA, 20 bp, Homo sapiens
tttcattttttgcatcagta

SEQ ID NO: 3884870 - DNA, 15 bp, Homo sapiens
tttccaaataaaatg

SEQ ID NO: 3884871 - DNA, 12 bp, Homo sapiens
tttccacaccat

SEQ ID NO: 3884872 - DNA, 14 bp, Homo sapiens
tttccacaccatca

SEQ ID NO: 3884873 - DNA, 13 bp, Homo sapiens
tttccagaaaata

SEQ ID NO: 3884874 - DNA, 14 bp, Homo sapiens
tttccagaaaatat

SEQ ID NO: 3884875 - DNA, 21 bp, Homo sapiens
tttccagaaaatataaatgca

SEQ ID NO: 3884876 - DNA, 23 bp, Homo sapiens
tttccagaaaatataaatgcatg

SEQ ID NO: 3884877 - DNA, 18 bp, Homo sapiens
tttccaggatcctgcagg

SEQ ID NO: 3884878 - DNA, 17 bp, Homo sapiens
ttgatgtacatgtgtag

SEQ ID NO: 3884879 - DNA, 17 bp, Homo sapiens
ttgatgtttccagaaaa

SEQ ID NO: 3884880 - DNA, 17 bp, Homo sapiens
ttgattgtaaaaacaaa

SEQ ID NO: 3884881 - DNA, 12 bp, Homo sapiens
ttgatttatgca

SEQ ID NO: 3884882 - DNA, 19 bp, Homo sapiens
ttgcaagcagcctcctggg

SEQ ID NO: 3884883 - DNA, 14 bp, Homo sapiens
ttgcaaggccgctg

SEQ ID NO: 3884884 - DNA, 17 bp, Homo sapiens
ttgcaaggccgctgttc

SEQ ID NO: 3884885 - DNA, 16 bp, Homo sapiens
ttgcaataaaatagta

SEQ ID NO: 3884886 - DNA, 12 bp, Homo sapiens
ttgcacaatttg

SEQ ID NO: 3884887 - DNA, 19 bp, Homo sapiens
ttgcacaatttgagcaatt

SEQ ID NO: 3884888 - DNA, 17 bp, Homo sapiens
ttgcacatctctgcagt

SEQ ID NO: 3884889 - DNA, 12 bp, Homo sapiens
ttgcacatgtga

SEQ ID NO: 3884890 - DNA, 16 bp, Homo sapiens
ttgcaccatctgcttg

SEQ ID NO: 3884891 - DNA, 15 bp, Homo sapiens
ttgcactaaagtatg

SEQ ID NO: 3884892 - DNA, 18 bp, Homo sapiens
ttgcactatgaaaatcag

SEQ ID NO: 3884893 - DNA, 16 bp, Homo sapiens
ttgcactgacaagatg

SEQ ID NO: 3884894 - DNA, 21 bp, Homo sapiens
ttgcactgatgtccggagaga

SEQ ID NO: 3884895 - DNA, 19 bp, Homo sapiens
ttgcagaaaagcacctgcc

SEQ ID NO: 3884896 - DNA, 13 bp, Homo sapiens
ttgcaggctctgg

SEQ ID NO: 3884897 - DNA, 22 bp, Homo sapiens
ttgcagggaagtcttacttaaa

SEQ ID NO: 3884898 - DNA, 18 bp, Homo sapiens
ttgcagggagcatggctg

SEQ ID NO: 3884899 - DNA, 14 bp, Homo sapiens
ttgcagttgagagg

SEQ ID NO: 3884900 - DNA, 18 bp, Homo sapiens
ttgcatagattccctgag

SEQ ID NO: 3884901 - DNA, 15 bp, Homo sapiens
ttgcatgatgtattt

SEQ ID NO: 3884902 - DNA, 12 bp, Homo sapiens
ttgcattagaaa

SEQ ID NO: 3884903 - DNA, 13 bp, Homo sapiens
ttgcattccatga

SEQ ID NO: 3884904 - DNA, 17 bp, Homo sapiens
ttgcattgaatatatta

SEQ ID NO: 3884905 - DNA, 13 bp, Homo sapiens
ttgcatttctgct

SEQ ID NO: 3884906 - DNA, 17 bp, Homo sapiens
ttgccaactaagccctc

SEQ ID NO: 3884907 - DNA, 15 bp, Homo sapiens
ttgccacaaccctgt

SEQ ID NO: 3884908 - DNA, 20 bp, Homo sapiens
ttgccacaatgcctctccca

SEQ ID NO: 3884909 - DNA, 15 bp, Homo sapiens
ttgccacctgttaaa

SEQ ID NO: 3884910 - DNA, 18 bp, Homo sapiens
ttgccactgcctcttcct

SEQ ID NO: 3884911 - DNA, 21 bp, Homo sapiens
ttgccactttggcttctcctg

SEQ ID NO: 3884912 - DNA, 12 bp, Homo sapiens
ttgccagcacag

SEQ ID NO: 3884913 - DNA, 15 bp, Homo sapiens
ttgccagtgaagact

SEQ ID NO: 3884914 - DNA, 20 bp, Homo sapiens
ttgccatggagttgtgatca

SEQ ID NO: 3884915 - DNA, 15 bp, Homo sapiens
ttgccatgggcctgc

SEQ ID NO: 3884916 - DNA, 14 bp, Homo sapiens
ttgccatttctctg

SEQ ID NO: 3884917 - DNA, 16 bp, Homo sapiens
ttgcccagagatgcct

SEQ ID NO: 3884918 - DNA, 22 bp, Homo sapiens
ttgcccagagatgcctccaccg

SEQ ID NO: 3884919 - DNA, 20 bp, Homo sapiens
ttgcccaggctggagtgcag

SEQ ID NO: 3884920 - DNA, 14 bp, Homo sapiens
ttgccccagagccc

SEQ ID NO: 3884921 - DNA, 20 bp, Homo sapiens
ttgccccagagccccactcc

SEQ ID NO: 3884922 - DNA, 18 bp, Homo sapiens
ttgccccttccccatctc

SEQ ID NO: 3884923 - DNA, 12 bp, Homo sapiens
ttgccctgacct

SEQ ID NO: 3884924 - DNA, 13 bp, Homo sapiens
ttgccctgacctc

SEQ ID NO: 3884925 - DNA, 15 bp, Homo sapiens
ttgccctgacctccc

SEQ ID NO: 3884926 - DNA, 13 bp, Homo sapiens
ttgccctgttaaa

SEQ ID NO: 3884927 - DNA, 14 bp, Homo sapiens
ttgcccttgccctg

SEQ ID NO: 3884928 - DNA, 17 bp, Homo sapiens
ttgcccttgccctgacc

SEQ ID NO: 3884929 - DNA, 19 bp, Homo sapiens
ttgcctccttatttatcaa

SEQ ID NO: 3884930 - DNA, 17 bp, Homo sapiens
ttgcctgaggctcaaga

SEQ ID NO: 3884931 - DNA, 13 bp, Homo sapiens
ttgcctgcagaga

SEQ ID NO: 3884932 - DNA, 15 bp, Homo sapiens
ttgcctggctgtgga

SEQ ID NO: 3884933 - DNA, 20 bp, Homo sapiens
ttgcctggctgtggaggcct

SEQ ID NO: 3884934 - DNA, 21 bp, Homo sapiens
ttgcctggctgtggaggcctg

SEQ ID NO: 3884935 - DNA, 22 bp, Homo sapiens
ttgccttagcacttctttcctc

SEQ ID NO: 3884936 - DNA, 13 bp, Homo sapiens
ttgccttttgcaa

SEQ ID NO: 3884937 - DNA, 12 bp, Homo sapiens
ttgcgccactgc

SEQ ID NO: 3884938 - DNA, 15 bp, Homo sapiens
ttgcgtcctgcagag

SEQ ID NO: 3884939 - DNA, 13 bp, Homo sapiens
ttgctacaataaa

SEQ ID NO: 3884940 - DNA, 15 bp, Homo sapiens
ttgctacaataaatg

SEQ ID NO: 3884941 - DNA, 13 bp, Homo sapiens
ttgctacattttc

SEQ ID NO: 3884942 - DNA, 13 bp, Homo sapiens
ttgctattggaat

SEQ ID NO: 3884943 - DNA, 15 bp, Homo sapiens
ttgctattttatttg

SEQ ID NO: 3884944 - DNA, 20 bp, Homo sapiens
ttgctattttatttgtattc

SEQ ID NO: 3884945 - DNA, 16 bp, Homo sapiens
ttgctcaaaaatctgt

SEQ ID NO: 3884946 - DNA, 19 bp, Homo sapiens
ttgctcaggtgcaagtgcc

SEQ ID NO: 3884947 - DNA, 14 bp, Homo sapiens
ttgctcagtgcctc

SEQ ID NO: 3884948 - DNA, 17 bp, Homo sapiens
ttgctcagtgcctcctg

SEQ ID NO: 3884949 - DNA, 21 bp, Homo sapiens
ttgctctcccctgccctgctg

SEQ ID NO: 3884950 - DNA, 18 bp, Homo sapiens
ttgctcttctttctgaga

SEQ ID NO: 3884951 - DNA, 14 bp, Homo sapiens
ttgctgagcaccct

SEQ ID NO: 3884952 - DNA, 21 bp, Homo sapiens
ttgctggacggggactgggga

SEQ ID NO: 3884953 - DNA, 18 bp, Homo sapiens
ttgctgttgttgcaggga

SEQ ID NO: 3884954 - DNA, 13 bp, Homo sapiens
ttgctgttttgat

SEQ ID NO: 3884955 - DNA, 13 bp, Homo sapiens
ttgcttacatttt

SEQ ID NO: 3884956 - DNA, 22 bp, Homo sapiens
ttgcttagatgagggtgactgt

SEQ ID NO: 3884957 - DNA, 19 bp, Homo sapiens
ttgcttagtatggttctca

SEQ ID NO: 3884958 - DNA, 21 bp, Homo sapiens
ttgcttagtatggttctcaga

SEQ ID NO: 3884959 - DNA, 14 bp, Homo sapiens
ttgcttctgcagca

SEQ ID NO: 3884960 - DNA, 22 bp, Homo sapiens
ttgcttctgcagcaactcccac

SEQ ID NO: 3884961 - DNA, 15 bp, Homo sapiens
ttgctttcttttctc

SEQ ID NO: 3884962 - DNA, 21 bp, Homo sapiens
ttggaaaaatccagaaagaaa

SEQ ID NO: 3884963 - DNA, 14 bp, Homo sapiens
ttggaaagagacca

SEQ ID NO: 3884964 - DNA, 22 bp, Homo sapiens
ttggaacatgtcggagtagaaa

SEQ ID NO: 3884965 - DNA, 13 bp, Homo sapiens
tgtgcctgccctg

SEQ ID NO: 3884966 - DNA, 14 bp, Homo sapiens
tgtgcctgccctgg

SEQ ID NO: 3884967 - DNA, 15 bp, Homo sapiens
tgtgcctgccctgga

SEQ ID NO: 3884968 - DNA, 19 bp, Homo sapiens
tgtgcctgctagagcaacc

SEQ ID NO: 3884969 - DNA, 23 bp, Homo sapiens
tgtgcctttgggaggcagcatca

SEQ ID NO: 3884970 - DNA, 18 bp, Homo sapiens
tgtgcgtctctctttctc

SEQ ID NO: 3884971 - DNA, 20 bp, Homo sapiens
tgtgcgtgtgtgcatgtatg

SEQ ID NO: 3884972 - DNA, 14 bp, Homo sapiens
tgtgctactttgcc

SEQ ID NO: 3884973 - DNA, 16 bp, Homo sapiens
tgtgctactttgcctt

SEQ ID NO: 3884974 - DNA, 13 bp, Homo sapiens
tgtgctagatgtg

SEQ ID NO: 3884975 - DNA, 14 bp, Homo sapiens
tgtgctcacgctcc

SEQ ID NO: 3884976 - DNA, 16 bp, Homo sapiens
tgtgctctcaccagct

SEQ ID NO: 3884977 - DNA, 13 bp, Homo sapiens
tgtgctctggagg

SEQ ID NO: 3884978 - DNA, 15 bp, Homo sapiens
tgtgctctttgaaga

SEQ ID NO: 3884979 - DNA, 16 bp, Homo sapiens
tgtgctctttgaagag

SEQ ID NO: 3884980 - DNA, 21 bp, Homo sapiens
tgtgctgacggaagccaactt

SEQ ID NO: 3884981 - DNA, 22 bp, Homo sapiens
tgtgctgagaatagtgtctgat

SEQ ID NO: 3884982 - DNA, 17 bp, Homo sapiens
tgtgctggagctggctt

SEQ ID NO: 3884983 - DNA, 18 bp, Homo sapiens
tgtgctgtgcctgctaga

SEQ ID NO: 3884984 - DNA, 13 bp, Homo sapiens
tgtgcttatgttt

SEQ ID NO: 3884985 - DNA, 20 bp, Homo sapiens
tgtgctttgactcacctgtt

SEQ ID NO: 3884986 - DNA, 17 bp, Homo sapiens
tgtgctttgcattccta

SEQ ID NO: 3884987 - DNA, 19 bp, Homo sapiens
tgtggaaggcagggacaga

SEQ ID NO: 3884988 - DNA, 20 bp, Homo sapiens
tgtggaaggcagggacagag

SEQ ID NO: 3884989 - DNA, 23 bp, Homo sapiens
tgtggagaaataaaaatacctct

SEQ ID NO: 3884990 - DNA, 19 bp, Homo sapiens
tgtggagaggggtgcaccc

SEQ ID NO: 3884991 - DNA, 19 bp, Homo sapiens
tgtggagtggacattcaaa

SEQ ID NO: 3884992 - DNA, 17 bp, Homo sapiens
tgtggatgtgtaaatgg

SEQ ID NO: 3884993 - DNA, 23 bp, Homo sapiens
tgtggatgtgtaaatggagcttg

SEQ ID NO: 3884994 - DNA, 15 bp, Homo sapiens
tgtggcaaagtgctg

SEQ ID NO: 3884995 - DNA, 19 bp, Homo sapiens
tgtggcaaagtgctgtacc

SEQ ID NO: 3884996 - DNA, 14 bp, Homo sapiens
tgtggccagagctg

SEQ ID NO: 3884997 - DNA, 19 bp, Homo sapiens
tgtggccagagctggaagg

SEQ ID NO: 3884998 - DNA, 22 bp, Homo sapiens
tgtggccagagctggaaggcag

SEQ ID NO: 3884999 - DNA, 19 bp, Homo sapiens
tgtggccagggtgagagct

SEQ ID NO: 3885000 - DNA, 14 bp, Homo sapiens
tgtggccctggcct

SEQ ID NO: 3885001 - DNA, 15 bp, Homo sapiens
tgtggcctcacttcc

SEQ ID NO: 3885002 - DNA, 20 bp, Homo sapiens
tgtggcctcacttccctggg

SEQ ID NO: 3885003 - DNA, 21 bp, Homo sapiens
tgtggcctcacttccctggga

SEQ ID NO: 3885004 - DNA, 24 bp, Homo sapiens
tgtggcctcacttccctgggaact

SEQ ID NO: 3885005 - DNA, 11 bp, Homo sapiens
tgtggcctcag

SEQ ID NO: 3885006 - DNA, 15 bp, Homo sapiens
tgtggcctgtgtcca

SEQ ID NO: 3885007 - DNA, 21 bp, Homo sapiens
tgtggcctgtgtccagcagct

SEQ ID NO: 3885008 - DNA, 22 bp, Homo sapiens
tgtggcctgtgtccagcagctg

SEQ ID NO: 3885009 - DNA, 13 bp, Homo sapiens
tgtggcggtgcct

SEQ ID NO: 3885010 - DNA, 14 bp, Homo sapiens
tgtggctgtattca

SEQ ID NO: 3885011 - DNA, 17 bp, Homo sapiens
tgtggctttctttcttt

SEQ ID NO: 3885012 - DNA, 14 bp, Homo sapiens
tgtgggcagcaccc

SEQ ID NO: 3885013 - DNA, 17 bp, Homo sapiens
tgtgggggtggccatcc

SEQ ID NO: 3885014 - DNA, 20 bp, Homo sapiens
tgtgggggtggccatccctg

SEQ ID NO: 3885015 - DNA, 22 bp, Homo sapiens
tgtggtagggacttaaaaaact

SEQ ID NO: 3885016 - DNA, 21 bp, Homo sapiens
tgtggtatatttgtgtatgtg

SEQ ID NO: 3885017 - DNA, 15 bp, Homo sapiens
tgtggtgacaggccc

SEQ ID NO: 3885018 - DNA, 16 bp, Homo sapiens
tgtggtgagggaagac

SEQ ID NO: 3885019 - DNA, 13 bp, Homo sapiens
tgtggtgatgaaa

SEQ ID NO: 3885020 - DNA, 15 bp, Homo sapiens
tgtggtgtgtgtgct

SEQ ID NO: 3885021 - DNA, 18 bp, Homo sapiens
tgtggtttactagcagga

SEQ ID NO: 3885022 - DNA, 14 bp, Homo sapiens
tgtggtttatgtca

SEQ ID NO: 3885023 - DNA, 18 bp, Homo sapiens
tgtgtaataagaaagtat

SEQ ID NO: 3885024 - DNA, 16 bp, Homo sapiens
tgtgtactgataaaat

SEQ ID NO: 3885025 - DNA, 17 bp, Homo sapiens
tgtgtactgataaaata

SEQ ID NO: 3885026 - DNA, 19 bp, Homo sapiens
tgtgtagactcctgcttct

SEQ ID NO: 3885027 - DNA, 16 bp, Homo sapiens
tgtgtagctgtgacct

SEQ ID NO: 3885028 - DNA, 14 bp, Homo sapiens
tgtgtagggaaagt

SEQ ID NO: 3885029 - DNA, 17 bp, Homo sapiens
tgtgtataagtgcacac

SEQ ID NO: 3885030 - DNA, 16 bp, Homo sapiens
tgtgtatatatacata

SEQ ID NO: 3885031 - DNA, 23 bp, Homo sapiens
tgtgtatatatgtgtatatatac

SEQ ID NO: 3885032 - DNA, 14 bp, Homo sapiens
tgtgtatgatccaa

SEQ ID NO: 3885033 - DNA, 12 bp, Homo sapiens
tgtgtatgtata

SEQ ID NO: 3885034 - DNA, 19 bp, Homo sapiens
tgtgtatgtatacacacat

SEQ ID NO: 3885035 - DNA, 14 bp, Homo sapiens
tgtgtatgtatgtg

SEQ ID NO: 3885036 - DNA, 12 bp, Homo sapiens
tgtgtatgtgta

SEQ ID NO: 3885037 - DNA, 19 bp, Homo sapiens
tgtgtatttgtatgtactg

SEQ ID NO: 3885038 - DNA, 17 bp, Homo sapiens
tgtgtcacagttcttgg

SEQ ID NO: 3885039 - DNA, 16 bp, Homo sapiens
tgtgtcagagacagac

SEQ ID NO: 3885040 - DNA, 14 bp, Homo sapiens
tgtgtccagcagct

SEQ ID NO: 3885041 - DNA, 15 bp, Homo sapiens
tgtgtcccctcactc

SEQ ID NO: 3885042 - DNA, 22 bp, Homo sapiens
tgtgtcccctcactctgtcagc

SEQ ID NO: 3885043 - DNA, 13 bp, Homo sapiens
tgtgtcctctccc

SEQ ID NO: 3885044 - DNA, 17 bp, Homo sapiens
tgtgtccttccctgcat

SEQ ID NO: 3885045 - DNA, 14 bp, Homo sapiens
tgtgtccttgcacc

SEQ ID NO: 3885046 - DNA, 19 bp, Homo sapiens
tgtgtccttgcacctgcat

SEQ ID NO: 3885047 - DNA, 20 bp, Homo sapiens
tgtgtccttgcacctgcatc

SEQ ID NO: 3885048 - DNA, 20 bp, Homo sapiens
tgtgtctgcattgttattgt

SEQ ID NO: 3885049 - DNA, 12 bp, Homo sapiens
tgtgtctgtctt

SEQ ID NO: 3885050 - DNA, 19 bp, Homo sapiens
tgtgtctgtctttgtggga

SEQ ID NO: 3885051 - DNA, 13 bp, Homo sapiens
ttaaactagtaat

SEQ ID NO: 3885052 - DNA, 17 bp, Homo sapiens
ttaaacttgtcagaatt

SEQ ID NO: 3885053 - DNA, 13 bp, Homo sapiens
ttaaactttgtgc

SEQ ID NO: 3885054 - DNA, 20 bp, Homo sapiens
ttaaactttgtgcctttgac

SEQ ID NO: 3885055 - DNA, 16 bp, Homo sapiens
ttaaagacttaagatt

SEQ ID NO: 3885056 - DNA, 22 bp, Homo sapiens
ttaaagagcatggaaaaatact

SEQ ID NO: 3885057 - DNA, 19 bp, Homo sapiens
ttaaagcaacattttattt

SEQ ID NO: 3885058 - DNA, 12 bp, Homo sapiens
ttaaaggagtta

SEQ ID NO: 3885059 - DNA, 17 bp, Homo sapiens
ttaaagtaaaggcctca

SEQ ID NO: 3885060 - DNA, 16 bp, Homo sapiens
ttaaagtatatattta

SEQ ID NO: 3885061 - DNA, 23 bp, Homo sapiens
ttaaagtatgttattgcataatt

SEQ ID NO: 3885062 - DNA, 17 bp, Homo sapiens
ttaaagtgtaataatat

SEQ ID NO: 3885063 - DNA, 21 bp, Homo sapiens
ttaaataaagtatcatgcatt

SEQ ID NO: 3885064 - DNA, 15 bp, Homo sapiens
ttaaataaattcaaa

SEQ ID NO: 3885065 - DNA, 16 bp, Homo sapiens
ttaaataaattcaaac

SEQ ID NO: 3885066 - DNA, 21 bp, Homo sapiens
ttaaataaattcaaaccattt

SEQ ID NO: 3885067 - DNA, 23 bp, Homo sapiens
ttaaataaattcaaaccatttaa

SEQ ID NO: 3885068 - DNA, 12 bp, Homo sapiens
ttaaatcaaaag

SEQ ID NO: 3885069 - DNA, 20 bp, Homo sapiens
ttaaatgtatatgtcattta

SEQ ID NO: 3885070 - DNA, 20 bp, Homo sapiens
ttaaatgttgaaatcttaaa

SEQ ID NO: 3885071 - DNA, 16 bp, Homo sapiens
ttaaattgcttttgtt

SEQ ID NO: 3885072 - DNA, 18 bp, Homo sapiens
ttaaatttttgtcatttt

SEQ ID NO: 3885073 - DNA, 19 bp, Homo sapiens
ttaaatttttgtcatttta

SEQ ID NO: 3885074 - DNA, 18 bp, Homo sapiens
ttaacaaaacaagaaaga

SEQ ID NO: 3885075 - DNA, 19 bp, Homo sapiens
ttaacaaaacaagaaagaa

SEQ ID NO: 3885076 - DNA, 16 bp, Homo sapiens
ttaacaattccaaagg

SEQ ID NO: 3885077 - DNA, 19 bp, Homo sapiens
ttaacattgacttcttggt

SEQ ID NO: 3885078 - DNA, 21 bp, Homo sapiens
ttaaccttagagcttggacag

SEQ ID NO: 3885079 - DNA, 13 bp, Homo sapiens
ttaactaatttaa

SEQ ID NO: 3885080 - DNA, 22 bp, Homo sapiens
ttaacttgagggtaataaactt

SEQ ID NO: 3885081 - DNA, 19 bp, Homo sapiens
ttaagacgtgaatgtctca

SEQ ID NO: 3885082 - DNA, 20 bp, Homo sapiens
ttaagacgtgaatgtctcag

SEQ ID NO: 3885083 - DNA, 10 bp, Homo sapiens
ttaagacttt

SEQ ID NO: 3885084 - DNA, 14 bp, Homo sapiens
ttaagagagaaatc

SEQ ID NO: 3885085 - DNA, 13 bp, Homo sapiens
ttaagagatacat

SEQ ID NO: 3885086 - DNA, 18 bp, Homo sapiens
ttaagagatacattccct

SEQ ID NO: 3885087 - DNA, 16 bp, Homo sapiens
ttaagagtgaaataat

SEQ ID NO: 3885088 - DNA, 16 bp, Homo sapiens
ttaagatacactcctg

SEQ ID NO: 3885089 - DNA, 21 bp, Homo sapiens
ttaagatacactcctgctgtg

SEQ ID NO: 3885090 - DNA, 22 bp, Homo sapiens
ttaagccaatatttactcatca

SEQ ID NO: 3885091 - DNA, 15 bp, Homo sapiens
ttaagcttgaagatt

SEQ ID NO: 3885092 - DNA, 14 bp, Homo sapiens
ttaaggcagtgact

SEQ ID NO: 3885093 - DNA, 15 bp, Homo sapiens
ttaagtaaaccaaaa

SEQ ID NO: 3885094 - DNA, 17 bp, Homo sapiens
ttaagtatatagtatat

SEQ ID NO: 3885095 - DNA, 21 bp, Homo sapiens
ttaagtatatagtatatttat

SEQ ID NO: 3885096 - DNA, 13 bp, Homo sapiens
ttaagtgaatgtc

SEQ ID NO: 3885097 - DNA, 15 bp, Homo sapiens
ttaagtgcctgagac

SEQ ID NO: 3885098 - DNA, 12 bp, Homo sapiens
ttaagttacttc

SEQ ID NO: 3885099 - DNA, 19 bp, Homo sapiens
ttaatacctttggaaaaat

SEQ ID NO: 3885100 - DNA, 21 bp, Homo sapiens
ttaatacctttggaaaaatct

SEQ ID NO: 3885101 - DNA, 20 bp, Homo sapiens
ttaatagcttttattgtata

SEQ ID NO: 3885102 - DNA, 19 bp, Homo sapiens
ttaatatatcccagaaatt

SEQ ID NO: 3885103 - DNA, 15 bp, Homo sapiens
ttaatatttaaacag

SEQ ID NO: 3885104 - DNA, 22 bp, Homo sapiens
ttaatatttaaacagcagtgtt

SEQ ID NO: 3885105 - DNA, 20 bp, Homo sapiens
ttaatatttgctgacagctg

SEQ ID NO: 3885106 - DNA, 15 bp, Homo sapiens
ttaatattttgtatt

SEQ ID NO: 3885107 - DNA, 16 bp, Homo sapiens
ttaatattttgtattt

SEQ ID NO: 3885108 - DNA, 19 bp, Homo sapiens
ttaatattttgtattttca

SEQ ID NO: 3885109 - DNA, 19 bp, Homo sapiens
ttaatcaagaatattcaaa

SEQ ID NO: 3885110 - DNA, 14 bp, Homo sapiens
ttaatcccagccct

SEQ ID NO: 3885111 - DNA, 24 bp, Homo sapiens
ttaatctttctttacctgagacca

SEQ ID NO: 3885112 - DNA, 15 bp, Homo sapiens
ttaatgactttttat

SEQ ID NO: 3885113 - DNA, 18 bp, Homo sapiens
ttaatgactttttataat

SEQ ID NO: 3885114 - DNA, 14 bp, Homo sapiens
ttaatggcactgat

SEQ ID NO: 3885115 - DNA, 12 bp, Homo sapiens
ttaatggttttt

SEQ ID NO: 3885116 - DNA, 15 bp, Homo sapiens
ttaatgtttattcct

SEQ ID NO: 3885117 - DNA, 17 bp, Homo sapiens
ttaatgttttgtacaat

SEQ ID NO: 3885118 - DNA, 22 bp, Homo sapiens
ttaattcagcactgatttcaca

SEQ ID NO: 3885119 - DNA, 14 bp, Homo sapiens
ttaatttatggttt

SEQ ID NO: 3885120 - DNA, 14 bp, Homo sapiens
ttaatttatttcat

SEQ ID NO: 3885121 - DNA, 17 bp, Homo sapiens
ttaattttttttaatgt

SEQ ID NO: 3885122 - DNA, 18 bp, Homo sapiens
ttacaaaatgaagtttta

SEQ ID NO: 3885123 - DNA, 15 bp, Homo sapiens
ttacaacattcaact

SEQ ID NO: 3885124 - DNA, 21 bp, Homo sapiens
ttacaagaattgtccatgtgc

SEQ ID NO: 3885125 - DNA, 14 bp, Homo sapiens
ttacaataaatatt

SEQ ID NO: 3885126 - DNA, 15 bp, Homo sapiens
ttacacagcccaaga

SEQ ID NO: 3885127 - DNA, 14 bp, Homo sapiens
ttacacattatgtt

SEQ ID NO: 3885128 - DNA, 18 bp, Homo sapiens
ttacactctctgtacaaa

SEQ ID NO: 3885129 - DNA, 19 bp, Homo sapiens
ttacactctctgtacaaaa

SEQ ID NO: 3885130 - DNA, 20 bp, Homo sapiens
ttacactctctgtacaaaaa

SEQ ID NO: 3885131 - DNA, 15 bp, Homo sapiens
ttacacttggagccc

SEQ ID NO: 3885132 - DNA, 24 bp, Homo sapiens
ttcctgctgctgtaactgctgagc

SEQ ID NO: 3885133 - DNA, 17 bp, Homo sapiens
ttcctggacctgagtcg

SEQ ID NO: 3885134 - DNA, 18 bp, Homo sapiens
ttcctggcctcactggct

SEQ ID NO: 3885135 - DNA, 22 bp, Homo sapiens
ttcctggcctcactggctgggg

SEQ ID NO: 3885136 - DNA, 12 bp, Homo sapiens
ttcctggtgagg

SEQ ID NO: 3885137 - DNA, 19 bp, Homo sapiens
ttcctgtaacacaagccac

SEQ ID NO: 3885138 - DNA, 15 bp, Homo sapiens
ttcctgtagcatctt

SEQ ID NO: 3885139 - DNA, 17 bp, Homo sapiens
ttcctgtagcatcttct

SEQ ID NO: 3885140 - DNA, 18 bp, Homo sapiens
ttcctgtagcatcttctg

SEQ ID NO: 3885141 - DNA, 15 bp, Homo sapiens
ttcctgtcccacctc

SEQ ID NO: 3885142 - DNA, 23 bp, Homo sapiens
ttcctgttaggtattagaaagtg

SEQ ID NO: 3885143 - DNA, 15 bp, Homo sapiens
ttccttacccaaact

SEQ ID NO: 3885144 - DNA, 16 bp, Homo sapiens
ttccttactgcagaat

SEQ ID NO: 3885145 - DNA, 17 bp, Homo sapiens
ttccttgagaaaaacaa

SEQ ID NO: 3885146 - DNA, 14 bp, Homo sapiens
ttccttggtttgga

SEQ ID NO: 3885147 - DNA, 16 bp, Homo sapiens
ttccttgtcactggta

SEQ ID NO: 3885148 - DNA, 14 bp, Homo sapiens
ttccttgtctctca

SEQ ID NO: 3885149 - DNA, 10 bp, Homo sapiens
ttcctttcct

SEQ ID NO: 3885150 - DNA, 17 bp, Homo sapiens
ttcctttggaagaaaaa

SEQ ID NO: 3885151 - DNA, 14 bp, Homo sapiens
ttccttttcttcct

SEQ ID NO: 3885152 - DNA, 17 bp, Homo sapiens
ttccttttcttccttct

SEQ ID NO: 3885153 - DNA, 18 bp, Homo sapiens
ttccttttgatggggaga

SEQ ID NO: 3885154 - DNA, 20 bp, Homo sapiens
ttcgatacaccgggcctgga

SEQ ID NO: 3885155 - DNA, 16 bp, Homo sapiens
ttcgcctgtgggaaga

SEQ ID NO: 3885156 - DNA, 10 bp, Homo sapiens
ttcgctgcca

SEQ ID NO: 3885157 - DNA, 11 bp, Homo sapiens
ttcgctgccag

SEQ ID NO: 3885158 - DNA, 13 bp, Homo sapiens
ttcgctgccagga

SEQ ID NO: 3885159 - DNA, 17 bp, Homo sapiens
ttcgctgctagagaagg

SEQ ID NO: 3885160 - DNA, 13 bp, Homo sapiens
ttcgctttcctct

SEQ ID NO: 3885161 - DNA, 13 bp, Homo sapiens
ttcggggctggga

SEQ ID NO: 3885162 - DNA, 14 bp, Homo sapiens
ttcggtgggacagc

SEQ ID NO: 3885163 - DNA, 22 bp, Homo sapiens
ttcggtgggacagccccagggc

SEQ ID NO: 3885164 - DNA, 13 bp, Homo sapiens
ttcggtttctgag

SEQ ID NO: 3885165 - DNA, 19 bp, Homo sapiens
ttcgtagctttcccaaata

SEQ ID NO: 3885166 - DNA, 17 bp, Homo sapiens
ttcgtgtctctcccacc

SEQ ID NO: 3885167 - DNA, 13 bp, Homo sapiens
ttctaaaagaata

SEQ ID NO: 3885168 - DNA, 14 bp, Homo sapiens
ttctaaaagaatat

SEQ ID NO: 3885169 - DNA, 14 bp, Homo sapiens
ttctaaatgctggt

SEQ ID NO: 3885170 - DNA, 15 bp, Homo sapiens
ttctaaatgctggtc

SEQ ID NO: 3885171 - DNA, 16 bp, Homo sapiens
ttctaacatatgtatt

SEQ ID NO: 3885172 - DNA, 12 bp, Homo sapiens
ttctaactgtaa

SEQ ID NO: 3885173 - DNA, 13 bp, Homo sapiens
ttctaactgtaaa

SEQ ID NO: 3885174 - DNA, 20 bp, Homo sapiens
ttctaactgtaaatcacttg

SEQ ID NO: 3885175 - DNA, 24 bp, Homo sapiens
ttctaagtaaaaccacagcagttg

SEQ ID NO: 3885176 - DNA, 23 bp, Homo sapiens
ttctaatgtgtgaatcagagcac

SEQ ID NO: 3885177 - DNA, 14 bp, Homo sapiens
ttctacaaccagag

SEQ ID NO: 3885178 - DNA, 16 bp, Homo sapiens
ttctacaaccagagcc

SEQ ID NO: 3885179 - DNA, 19 bp, Homo sapiens
ttctacaagcatatttgag

SEQ ID NO: 3885180 - DNA, 19 bp, Homo sapiens
ttctacacagtgggaactc

SEQ ID NO: 3885181 - DNA, 18 bp, Homo sapiens
ttctacatagtaactctt

SEQ ID NO: 3885182 - DNA, 19 bp, Homo sapiens
ttctacatagtaactctta

SEQ ID NO: 3885183 - DNA, 15 bp, Homo sapiens
ttctagactttctgt

SEQ ID NO: 3885184 - DNA, 12 bp, Homo sapiens
ttctagagaaga

SEQ ID NO: 3885185 - DNA, 15 bp, Homo sapiens
ttctagaggcctcag

SEQ ID NO: 3885186 - DNA, 14 bp, Homo sapiens
ttctagcagagtga

SEQ ID NO: 3885187 - DNA, 16 bp, Homo sapiens
ttctagccaaactatt

SEQ ID NO: 3885188 - DNA, 19 bp, Homo sapiens
ttctagctagaaatatgat

SEQ ID NO: 3885189 - DNA, 22 bp, Homo sapiens
ttctagctagaaatatgatttt

SEQ ID NO: 3885190 - DNA, 23 bp, Homo sapiens
ttctagtctcctttgcactgagg

SEQ ID NO: 3885191 - DNA, 22 bp, Homo sapiens
ttctagtgatttcctgtataat

SEQ ID NO: 3885192 - DNA, 22 bp, Homo sapiens
ttctatagctcttctatttaaa

SEQ ID NO: 3885193 - DNA, 14 bp, Homo sapiens
ttctatcacatatt

SEQ ID NO: 3885194 - DNA, 17 bp, Homo sapiens
ttctatcaggaaaacaa

SEQ ID NO: 3885195 - DNA, 23 bp, Homo sapiens
ttctatcaggaaaacaaatcact

SEQ ID NO: 3885196 - DNA, 23 bp, Homo sapiens
ttctatcccacccaacagctcag

SEQ ID NO: 3885197 - DNA, 20 bp, Homo sapiens
ttctatcttgaatttcatgc

SEQ ID NO: 3885198 - DNA, 18 bp, Homo sapiens
ttctatgcaagccttgct

SEQ ID NO: 3885199 - DNA, 22 bp, Homo sapiens
ttctattcaaggtggccaaatt

SEQ ID NO: 3885200 - DNA, 13 bp, Homo sapiens
ttctattgaaaaa

SEQ ID NO: 3885201 - DNA, 20 bp, Homo sapiens
ttctatttaaaaaataaaaa

SEQ ID NO: 3885202 - DNA, 14 bp, Homo sapiens
ttctcaacctacca

SEQ ID NO: 3885203 - DNA, 14 bp, Homo sapiens
ttctcactccacca

SEQ ID NO: 3885204 - DNA, 15 bp, Homo sapiens
ttctcactccaccac

SEQ ID NO: 3885205 - DNA, 16 bp, Homo sapiens
ttctcactccaccacc

SEQ ID NO: 3885206 - DNA, 19 bp, Homo sapiens
ttctcagacttgttgtcta

SEQ ID NO: 3885207 - DNA, 14 bp, Homo sapiens
ttctcagatcttga

SEQ ID NO: 3885208 - DNA, 13 bp, Homo sapiens
ttctcagctccca

SEQ ID NO: 3885209 - DNA, 22 bp, Homo sapiens
ttctcagtcagtaattgccaaa

SEQ ID NO: 3885210 - DNA, 15 bp, Homo sapiens
ttctcagtttgtata

SEQ ID NO: 3885211 - DNA, 20 bp, Homo sapiens
ttctcataggaaaagtacat

SEQ ID NO: 3885212 - DNA, 22 bp, Homo sapiens
ttctcataggaaaagtacattt

SEQ ID NO: 3885213 - DNA, 18 bp, Homo sapiens
ttctcatatgtagccctc

SEQ ID NO: 3885214 - DNA, 15 bp, Homo sapiens
ttctcatcatattgt

SEQ ID NO: 3885215 - DNA, 17 bp, Homo sapiens
ttctcatcatattgtat

SEQ ID NO: 3885216 - DNA, 20 bp, Homo sapiens
ttctcatcatattgtatgta

SEQ ID NO: 3885217 - DNA, 20 bp, Homo sapiens
ttctcatgatttacagagaa

SEQ ID NO: 3885218 - DNA, 17 bp, Homo sapiens
ttcttgtgtcctgatga

SEQ ID NO: 3885219 - DNA, 14 bp, Homo sapiens
ttctttacctgaga

SEQ ID NO: 3885220 - DNA, 16 bp, Homo sapiens
ttctttactaaagata

SEQ ID NO: 3885221 - DNA, 13 bp, Homo sapiens
ttctttataaact

SEQ ID NO: 3885222 - DNA, 19 bp, Homo sapiens
ttctttcacaaaaaagaag

SEQ ID NO: 3885223 - DNA, 22 bp, Homo sapiens
ttctttcctcttccccttgccc

SEQ ID NO: 3885224 - DNA, 13 bp, Homo sapiens
ttctttctcttcc

SEQ ID NO: 3885225 - DNA, 14 bp, Homo sapiens
ttctttctcttccc

SEQ ID NO: 3885226 - DNA, 15 bp, Homo sapiens
ttctttgaaattgtt

SEQ ID NO: 3885227 - DNA, 12 bp, Homo sapiens
ttctttgtgtag

SEQ ID NO: 3885228 - DNA, 19 bp, Homo sapiens
ttctttgtgtagctttgct

SEQ ID NO: 3885229 - DNA, 23 bp, Homo sapiens
ttcttttgcccttcacagtgttt

SEQ ID NO: 3885230 - DNA, 12 bp, Homo sapiens
ttcttttgtaaa

SEQ ID NO: 3885231 - DNA, 15 bp, Homo sapiens
ttctttttattttct

SEQ ID NO: 3885232 - DNA, 16 bp, Homo sapiens
ttctttttattttctt

SEQ ID NO: 3885233 - DNA, 16 bp, Homo sapiens
ttctttttctggaaat

SEQ ID NO: 3885234 - DNA, 16 bp, Homo sapiens
ttgaaaagactccaaa

SEQ ID NO: 3885235 - DNA, 16 bp, Homo sapiens
ttgaaaagctaatgaa

SEQ ID NO: 3885236 - DNA, 11 bp, Homo sapiens
ttgaaaatgag

SEQ ID NO: 3885237 - DNA, 18 bp, Homo sapiens
ttgaaagtgaataaactt

SEQ ID NO: 3885238 - DNA, 16 bp, Homo sapiens
ttgaaatataatgcaa

SEQ ID NO: 3885239 - DNA, 13 bp, Homo sapiens
ttgaaatcttaaa

SEQ ID NO: 3885240 - DNA, 18 bp, Homo sapiens
ttgaaattatgtatgttt

SEQ ID NO: 3885241 - DNA, 19 bp, Homo sapiens
ttgaaattgtttaagtgtt

SEQ ID NO: 3885242 - DNA, 22 bp, Homo sapiens
ttgaacacaattgatacttcag

SEQ ID NO: 3885243 - DNA, 16 bp, Homo sapiens
ttgaagaaaagcactt

SEQ ID NO: 3885244 - DNA, 14 bp, Homo sapiens
ttgaagaaacagat

SEQ ID NO: 3885245 - DNA, 20 bp, Homo sapiens
ttgaagcctttttttagtaa

SEQ ID NO: 3885246 - DNA, 18 bp, Homo sapiens
ttgaaggaggtgagggat

SEQ ID NO: 3885247 - DNA, 21 bp, Homo sapiens
ttgaatacccccagagacctt

SEQ ID NO: 3885248 - DNA, 11 bp, Homo sapiens
ttgaatatatc

SEQ ID NO: 3885249 - DNA, 21 bp, Homo sapiens
ttgaatctgttactgaaatga

SEQ ID NO: 3885250 - DNA, 18 bp, Homo sapiens
ttgaatgacaacagaagc

SEQ ID NO: 3885251 - DNA, 23 bp, Homo sapiens
ttgaatgttatttgttattttca

SEQ ID NO: 3885252 - DNA, 16 bp, Homo sapiens
ttgaatttcctatctg

SEQ ID NO: 3885253 - DNA, 16 bp, Homo sapiens
ttgacaaaatttgttg

SEQ ID NO: 3885254 - DNA, 14 bp, Homo sapiens
ttgacaacagactg

SEQ ID NO: 3885255 - DNA, 18 bp, Homo sapiens
ttgacaacattttattac

SEQ ID NO: 3885256 - DNA, 14 bp, Homo sapiens
ttgacacggtgaaa

SEQ ID NO: 3885257 - DNA, 14 bp, Homo sapiens
ttgaccagacctag

SEQ ID NO: 3885258 - DNA, 15 bp, Homo sapiens
ttgaccagacctaga

SEQ ID NO: 3885259 - DNA, 22 bp, Homo sapiens
ttgaccagacctagacctgggc

SEQ ID NO: 3885260 - DNA, 23 bp, Homo sapiens
ttgaccagacctagacctgggcc

SEQ ID NO: 3885261 - DNA, 12 bp, Homo sapiens
ttgacccactca

SEQ ID NO: 3885262 - DNA, 21 bp, Homo sapiens
ttgacccactcacacttggag

SEQ ID NO: 3885263 - DNA, 21 bp, Homo sapiens
ttgaccgttttcatcctggcc

SEQ ID NO: 3885264 - DNA, 15 bp, Homo sapiens
ttgacgcatcctgca

SEQ ID NO: 3885265 - DNA, 20 bp, Homo sapiens
ttgacggatgattggattat

SEQ ID NO: 3885266 - DNA, 17 bp, Homo sapiens
ttgacgggaggcctcag

SEQ ID NO: 3885267 - DNA, 19 bp, Homo sapiens
ttgactatcacatacaatt

SEQ ID NO: 3885268 - DNA, 19 bp, Homo sapiens
ttgactcacctgttacttg

SEQ ID NO: 3885269 - DNA, 19 bp, Homo sapiens
ttgactcttttatctgagt

SEQ ID NO: 3885270 - DNA, 14 bp, Homo sapiens
ttgactttcaggta

SEQ ID NO: 3885271 - DNA, 22 bp, Homo sapiens
ttgagaatttggatacactctc

SEQ ID NO: 3885272 - DNA, 16 bp, Homo sapiens
ttgagacaagccctgg

SEQ ID NO: 3885273 - DNA, 18 bp, Homo sapiens
ttgagacaagccctggca

SEQ ID NO: 3885274 - DNA, 15 bp, Homo sapiens
ttgagacctcagcca

SEQ ID NO: 3885275 - DNA, 22 bp, Homo sapiens
ttgagacggcgcacctatcacc

SEQ ID NO: 3885276 - DNA, 17 bp, Homo sapiens
ttgagagaagagacaaa

SEQ ID NO: 3885277 - DNA, 23 bp, Homo sapiens
ttgagagaagccacgctgtcctc

SEQ ID NO: 3885278 - DNA, 13 bp, Homo sapiens
ttgagatgtgatg

SEQ ID NO: 3885279 - DNA, 18 bp, Homo sapiens
ttgagatgtgatgctggt

SEQ ID NO: 3885280 - DNA, 13 bp, Homo sapiens
ttgagcaattcat

SEQ ID NO: 3885281 - DNA, 15 bp, Homo sapiens
ttgagcaattcattt

SEQ ID NO: 3885282 - DNA, 11 bp, Homo sapiens
ttgaggacaca

SEQ ID NO: 3885283 - DNA, 16 bp, Homo sapiens
ttgaggacacatgtcc

SEQ ID NO: 3885284 - DNA, 13 bp, Homo sapiens
ttgaggagtgtga

SEQ ID NO: 3885285 - DNA, 15 bp, Homo sapiens
ttgaggattttgagt

SEQ ID NO: 3885286 - DNA, 16 bp, Homo sapiens
ttgaggattttgagta

SEQ ID NO: 3885287 - DNA, 13 bp, Homo sapiens
ttgagggtaggag

SEQ ID NO: 3885288 - DNA, 19 bp, Homo sapiens
ttgaggtggtgccttctca

SEQ ID NO: 3885289 - DNA, 23 bp, Homo sapiens
ttgagtaaataacaactccctga

SEQ ID NO: 3885290 - DNA, 18 bp, Homo sapiens
ttgagtacagtgaggagg

SEQ ID NO: 3885291 - DNA, 23 bp, Homo sapiens
ttgagtactagaatttgtatttt

SEQ ID NO: 3885292 - DNA, 18 bp, Homo sapiens
ttgagtagatctgcttct

SEQ ID NO: 3885293 - DNA, 17 bp, Homo sapiens
ttgagtcaaaagcctgg

SEQ ID NO: 3885294 - DNA, 21 bp, Homo sapiens
ttgagtctcttttttattctg

SEQ ID NO: 3885295 - DNA, 22 bp, Homo sapiens
ttgagtggatggaggagaaata

SEQ ID NO: 3885296 - DNA, 15 bp, Homo sapiens
ttgatatagaaagct

SEQ ID NO: 3885297 - DNA, 16 bp, Homo sapiens
ttgatatgagtataca

SEQ ID NO: 3885298 - DNA, 22 bp, Homo sapiens
ttgatattttcaacgcagccct

SEQ ID NO: 3885299 - DNA, 13 bp, Homo sapiens
ttgatcacagtgg

SEQ ID NO: 3885300 - DNA, 18 bp, Homo sapiens
ttgatcccacttcactgt

SEQ ID NO: 3885301 - DNA, 23 bp, Homo sapiens
ttgatcccacttcactgtgaggg

SEQ ID NO: 3885302 - DNA, 17 bp, Homo sapiens
ttgatgacccccaacca

SEQ ID NO: 3885303 - DNA, 14 bp, Homo sapiens
ttgatggagatatt

SEQ ID NO: 3885304 - DNA, 18 bp, Homo sapiens
ttctcatgtgatcctttt

SEQ ID NO: 3885305 - DNA, 20 bp, Homo sapiens
ttctcatgttgaagccactg

SEQ ID NO: 3885306 - DNA, 20 bp, Homo sapiens
ttctcattccaacagtgagt

SEQ ID NO: 3885307 - DNA, 20 bp, Homo sapiens
ttctcattttcaatgcacat

SEQ ID NO: 3885308 - DNA, 23 bp, Homo sapiens
ttctccaaatgattttcatcaat

SEQ ID NO: 3885309 - DNA, 18 bp, Homo sapiens
ttctccaggctctttggg

SEQ ID NO: 3885310 - DNA, 14 bp, Homo sapiens
ttctcccatctagt

SEQ ID NO: 3885311 - DNA, 21 bp, Homo sapiens
ttctcccccgacactgctgca

SEQ ID NO: 3885312 - DNA, 17 bp, Homo sapiens
ttctccgggtgtggcct

SEQ ID NO: 3885313 - DNA, 16 bp, Homo sapiens
ttctcctactttacac

SEQ ID NO: 3885314 - DNA, 17 bp, Homo sapiens
ttctcctccattgctgt

SEQ ID NO: 3885315 - DNA, 16 bp, Homo sapiens
ttctcctgtcagagat

SEQ ID NO: 3885316 - DNA, 22 bp, Homo sapiens
ttctcctgtgaccccaccttga

SEQ ID NO: 3885317 - DNA, 12 bp, Homo sapiens
ttctcctgtgct

SEQ ID NO: 3885318 - DNA, 18 bp, Homo sapiens
ttctcctttcacaacctt

SEQ ID NO: 3885319 - DNA, 13 bp, Homo sapiens
ttctcgggaaatt

SEQ ID NO: 3885320 - DNA, 17 bp, Homo sapiens
ttctctattcctgaccc

SEQ ID NO: 3885321 - DNA, 11 bp, Homo sapiens
ttctctcccat

SEQ ID NO: 3885322 - DNA, 21 bp, Homo sapiens
ttctctccttccctctttccc

SEQ ID NO: 3885323 - DNA, 14 bp, Homo sapiens
ttctctgtatagta

SEQ ID NO: 3885324 - DNA, 12 bp, Homo sapiens
ttctcttcctgt

SEQ ID NO: 3885325 - DNA, 21 bp, Homo sapiens
ttctgaaacttcataaatgtt

SEQ ID NO: 3885326 - DNA, 16 bp, Homo sapiens
ttctgaagctgacagc

SEQ ID NO: 3885327 - DNA, 19 bp, Homo sapiens
ttctgaagctgacagcact

SEQ ID NO: 3885328 - DNA, 15 bp, Homo sapiens
ttctgaatggctgca

SEQ ID NO: 3885329 - DNA, 15 bp, Homo sapiens
ttctgagaaagacta

SEQ ID NO: 3885330 - DNA, 22 bp, Homo sapiens
ttctgagagttggctcaggcag

SEQ ID NO: 3885331 - DNA, 13 bp, Homo sapiens
ttctgagctgggc

SEQ ID NO: 3885332 - DNA, 20 bp, Homo sapiens
ttctgagtgtttttactaca

SEQ ID NO: 3885333 - DNA, 12 bp, Homo sapiens
ttctgattccac

SEQ ID NO: 3885334 - DNA, 13 bp, Homo sapiens
ttctgcactgaaa

SEQ ID NO: 3885335 - DNA, 14 bp, Homo sapiens
ttctgcagcaactc

SEQ ID NO: 3885336 - DNA, 16 bp, Homo sapiens
ttctgcagcaactccc

SEQ ID NO: 3885337 - DNA, 17 bp, Homo sapiens
ttctgcagcaactccca

SEQ ID NO: 3885338 - DNA, 18 bp, Homo sapiens
ttctgcagcaactcccac

SEQ ID NO: 3885339 - DNA, 19 bp, Homo sapiens
ttctgcagtagtctctgtg

SEQ ID NO: 3885340 - DNA, 16 bp, Homo sapiens
ttctgcatcagctgct

SEQ ID NO: 3885341 - DNA, 15 bp, Homo sapiens
ttctgccttttttat

SEQ ID NO: 3885342 - DNA, 18 bp, Homo sapiens
ttctgctcttccaaagct

SEQ ID NO: 3885343 - DNA, 18 bp, Homo sapiens
ttctgctggcctggatct

SEQ ID NO: 3885344 - DNA, 13 bp, Homo sapiens
ttctgctgtttaa

SEQ ID NO: 3885345 - DNA, 19 bp, Homo sapiens
ttctggaaaaaaaatatat

SEQ ID NO: 3885346 - DNA, 21 bp, Homo sapiens
ttctggaaaaaaaatatatat

SEQ ID NO: 3885347 - DNA, 17 bp, Homo sapiens
ttctggaatacatgaaa

SEQ ID NO: 3885348 - DNA, 15 bp, Homo sapiens
ttctggagtctccag

SEQ ID NO: 3885349 - DNA, 17 bp, Homo sapiens
ttctggagtctccagtg

SEQ ID NO: 3885350 - DNA, 13 bp, Homo sapiens
ttctggcctcagc

SEQ ID NO: 3885351 - DNA, 15 bp, Homo sapiens
ttctggctgaaaaag

SEQ ID NO: 3885352 - DNA, 19 bp, Homo sapiens
ttctggctgaacactggca

SEQ ID NO: 3885353 - DNA, 15 bp, Homo sapiens
ttctggggaggaagg

SEQ ID NO: 3885354 - DNA, 18 bp, Homo sapiens
ttctgggtggcctcggga

SEQ ID NO: 3885355 - DNA, 17 bp, Homo sapiens
ttctggtcttcactgcc

SEQ ID NO: 3885356 - DNA, 19 bp, Homo sapiens
ttctggtgcctatttattc

SEQ ID NO: 3885357 - DNA, 12 bp, Homo sapiens
ttctgtattttc

SEQ ID NO: 3885358 - DNA, 13 bp, Homo sapiens
ttctgtgaagaat

SEQ ID NO: 3885359 - DNA, 16 bp, Homo sapiens
ttctgtggctcacaga

SEQ ID NO: 3885360 - DNA, 16 bp, Homo sapiens
ttctgtgttgaacaca

SEQ ID NO: 3885361 - DNA, 14 bp, Homo sapiens
ttctgttctgttga

SEQ ID NO: 3885362 - DNA, 19 bp, Homo sapiens
ttctgttgtaatagtccat

SEQ ID NO: 3885363 - DNA, 20 bp, Homo sapiens
ttctgtttccataggaatca

SEQ ID NO: 3885364 - DNA, 13 bp, Homo sapiens
ttcttaaagagtt

SEQ ID NO: 3885365 - DNA, 15 bp, Homo sapiens
ttcttaaaggcctgg

SEQ ID NO: 3885366 - DNA, 13 bp, Homo sapiens
ttcttacataatt

SEQ ID NO: 3885367 - DNA, 15 bp, Homo sapiens
ttcttatcttctgca

SEQ ID NO: 3885368 - DNA, 22 bp, Homo sapiens
ttcttattcatgctttctcctt

SEQ ID NO: 3885369 - DNA, 21 bp, Homo sapiens
ttcttcacccagctaatctgt

SEQ ID NO: 3885370 - DNA, 14 bp, Homo sapiens
ttcttcagaagaca

SEQ ID NO: 3885371 - DNA, 15 bp, Homo sapiens
ttcttcagtgcctag

SEQ ID NO: 3885372 - DNA, 18 bp, Homo sapiens
ttcttcatctgtgactcc

SEQ ID NO: 3885373 - DNA, 16 bp, Homo sapiens
ttcttcatcttgacat

SEQ ID NO: 3885374 - DNA, 21 bp, Homo sapiens
ttcttcattcaatacaagtgt

SEQ ID NO: 3885375 - DNA, 19 bp, Homo sapiens
ttcttcccatcactggagc

SEQ ID NO: 3885376 - DNA, 21 bp, Homo sapiens
ttcttccccaggtccttcctt

SEQ ID NO: 3885377 - DNA, 16 bp, Homo sapiens
ttcttccgtcacatat

SEQ ID NO: 3885378 - DNA, 18 bp, Homo sapiens
ttcttcgctgctagagaa

SEQ ID NO: 3885379 - DNA, 23 bp, Homo sapiens
ttcttcgctgctctagctggcag

SEQ ID NO: 3885380 - DNA, 20 bp, Homo sapiens
ttcttcggggaactcctgga

SEQ ID NO: 3885381 - DNA, 21 bp, Homo sapiens
ttcttctacaaccagagcccc

SEQ ID NO: 3885382 - DNA, 16 bp, Homo sapiens
ttcttgagtagatctg

SEQ ID NO: 3885383 - DNA, 19 bp, Homo sapiens
ttcttggaaaaaaattaca

SEQ ID NO: 3885384 - DNA, 20 bp, Homo sapiens
ttcttggaaaaaaattacaa

SEQ ID NO: 3885385 - DNA, 19 bp, Homo sapiens
ttcttggggtcccagggaa

SEQ ID NO: 3885386 - DNA, 13 bp, Homo sapiens
ttcttgtcaaaaa

SEQ ID NO: 3885387 - DNA, 20 bp, Homo sapiens
ttcttgtgaaaccacaggcc

SEQ ID NO: 3885388 - DNA, 15 bp, Homo sapiens
ttcttgtgcatgttt

SEQ ID NO: 3885389 - DNA, 14 bp, Homo sapiens
ttcttgtgcctcag

SEQ ID NO: 3885390 - DNA, 22 bp, Homo sapiens
ttccatgaagacacgcttaaaa

SEQ ID NO: 3885391 - DNA, 20 bp, Homo sapiens
ttccatgaagtttgaacttc

SEQ ID NO: 3885392 - DNA, 15 bp, Homo sapiens
ttccatgcctgaggg

SEQ ID NO: 3885393 - DNA, 16 bp, Homo sapiens
ttccatgcctgagggt

SEQ ID NO: 3885394 - DNA, 23 bp, Homo sapiens
ttccatgcctgagggtggagact

SEQ ID NO: 3885395 - DNA, 14 bp, Homo sapiens
ttccatgtccctgt

SEQ ID NO: 3885396 - DNA, 18 bp, Homo sapiens
ttccatgtcgcctctgca

SEQ ID NO: 3885397 - DNA, 13 bp, Homo sapiens
ttccatttctcaa

SEQ ID NO: 3885398 - DNA, 23 bp, Homo sapiens
ttccatttctcaatcagtgcagt

SEQ ID NO: 3885399 - DNA, 14 bp, Homo sapiens
ttcccaagaaatgc

SEQ ID NO: 3885400 - DNA, 14 bp, Homo sapiens
ttcccaataaaagt

SEQ ID NO: 3885401 - DNA, 16 bp, Homo sapiens
ttcccaatcagcactg

SEQ ID NO: 3885402 - DNA, 20 bp, Homo sapiens
ttcccaatcagcactgaaaa

SEQ ID NO: 3885403 - DNA, 18 bp, Homo sapiens
ttcccacaccccagcgcc

SEQ ID NO: 3885404 - DNA, 15 bp, Homo sapiens
ttcccaccaaggtct

SEQ ID NO: 3885405 - DNA, 15 bp, Homo sapiens
ttcccagaagggagt

SEQ ID NO: 3885406 - DNA, 23 bp, Homo sapiens
ttcccagagcaaaataattttaa

SEQ ID NO: 3885407 - DNA, 14 bp, Homo sapiens
ttcccagctctccc

SEQ ID NO: 3885408 - DNA, 18 bp, Homo sapiens
ttcccagctctccctctg

SEQ ID NO: 3885409 - DNA, 13 bp, Homo sapiens
ttcccagctgtct

SEQ ID NO: 3885410 - DNA, 23 bp, Homo sapiens
ttcccatcactggagcaccaggc

SEQ ID NO: 3885411 - DNA, 14 bp, Homo sapiens
ttcccatccccagc

SEQ ID NO: 3885412 - DNA, 17 bp, Homo sapiens
ttcccatccccagcgat

SEQ ID NO: 3885413 - DNA, 20 bp, Homo sapiens
ttcccatgctgaattatttt

SEQ ID NO: 3885414 - DNA, 13 bp, Homo sapiens
ttccccagacaca

SEQ ID NO: 3885415 - DNA, 14 bp, Homo sapiens
ttccccagacacat

SEQ ID NO: 3885416 - DNA, 18 bp, Homo sapiens
ttccccaggggaaaatga

SEQ ID NO: 3885417 - DNA, 12 bp, Homo sapiens
ttcccccacttg

SEQ ID NO: 3885418 - DNA, 18 bp, Homo sapiens
ttcccccatgtggctgaa

SEQ ID NO: 3885419 - DNA, 16 bp, Homo sapiens
ttccccgggggaggaa

SEQ ID NO: 3885420 - DNA, 19 bp, Homo sapiens
ttcccctacacctccctcc

SEQ ID NO: 3885421 - DNA, 14 bp, Homo sapiens
ttcccctgttcact

SEQ ID NO: 3885422 - DNA, 21 bp, Homo sapiens
ttccccttgcccttgccctga

SEQ ID NO: 3885423 - DNA, 22 bp, Homo sapiens
ttcccgagcaaagtctaaagtt

SEQ ID NO: 3885424 - DNA, 21 bp, Homo sapiens
ttcccgctcagccctccctgc

SEQ ID NO: 3885425 - DNA, 19 bp, Homo sapiens
ttcccggagcacagccctg

SEQ ID NO: 3885426 - DNA, 16 bp, Homo sapiens
ttccctacttcctgtg

SEQ ID NO: 3885427 - DNA, 17 bp, Homo sapiens
ttccctatcaaaacata

SEQ ID NO: 3885428 - DNA, 18 bp, Homo sapiens
ttccctatcaaaacatat

SEQ ID NO: 3885429 - DNA, 15 bp, Homo sapiens
ttccctctcccaggc

SEQ ID NO: 3885430 - DNA, 17 bp, Homo sapiens
ttccctctcccaggccc

SEQ ID NO: 3885431 - DNA, 12 bp, Homo sapiens
ttccctctctag

SEQ ID NO: 3885432 - DNA, 11 bp, Homo sapiens
ttccctctgag

SEQ ID NO: 3885433 - DNA, 15 bp, Homo sapiens
ttccctctttcccca

SEQ ID NO: 3885434 - DNA, 17 bp, Homo sapiens
ttccctgaaaacccaga

SEQ ID NO: 3885435 - DNA, 15 bp, Homo sapiens
ttccctgaatgtatt

SEQ ID NO: 3885436 - DNA, 18 bp, Homo sapiens
ttccctgagtcaccagga

SEQ ID NO: 3885437 - DNA, 19 bp, Homo sapiens
ttccctgagtcaccaggaa

SEQ ID NO: 3885438 - DNA, 16 bp, Homo sapiens
ttccctgcaccctgga

SEQ ID NO: 3885439 - DNA, 14 bp, Homo sapiens
ttccctgtcagagg

SEQ ID NO: 3885440 - DNA, 12 bp, Homo sapiens
ttccctgtgctg

SEQ ID NO: 3885441 - DNA, 19 bp, Homo sapiens
ttccctgttttaaattata

SEQ ID NO: 3885442 - DNA, 23 bp, Homo sapiens
ttcccttgaaattttaaactata

SEQ ID NO: 3885443 - DNA, 22 bp, Homo sapiens
ttccgctcctttacctaccacc

SEQ ID NO: 3885444 - DNA, 17 bp, Homo sapiens
ttcctaagtataaatgg

SEQ ID NO: 3885445 - DNA, 13 bp, Homo sapiens
ttcctacaaaatg

SEQ ID NO: 3885446 - DNA, 21 bp, Homo sapiens
ttcctacacccttggacttga

SEQ ID NO: 3885447 - DNA, 22 bp, Homo sapiens
ttcctacagaaatactgctctg

SEQ ID NO: 3885448 - DNA, 17 bp, Homo sapiens
ttcctaggccccagagc

SEQ ID NO: 3885449 - DNA, 12 bp, Homo sapiens
ttcctagtgaaa

SEQ ID NO: 3885450 - DNA, 19 bp, Homo sapiens
ttcctatatagtttattga

SEQ ID NO: 3885451 - DNA, 21 bp, Homo sapiens
ttcctatatagtttattgaca

SEQ ID NO: 3885452 - DNA, 12 bp, Homo sapiens
ttcctattttaa

SEQ ID NO: 3885453 - DNA, 23 bp, Homo sapiens
ttcctattttaaaaccatgcagc

SEQ ID NO: 3885454 - DNA, 15 bp, Homo sapiens
ttcctcagctgccaa

SEQ ID NO: 3885455 - DNA, 14 bp, Homo sapiens
ttcctcatgaatta

SEQ ID NO: 3885456 - DNA, 17 bp, Homo sapiens
ttcctccaaactcctgc

SEQ ID NO: 3885457 - DNA, 14 bp, Homo sapiens
ttcctccagacaga

SEQ ID NO: 3885458 - DNA, 22 bp, Homo sapiens
ttcctcccagttctacaagcat

SEQ ID NO: 3885459 - DNA, 16 bp, Homo sapiens
ttcctcccccagagcc

SEQ ID NO: 3885460 - DNA, 19 bp, Homo sapiens
ttcctccgtccacccaggc

SEQ ID NO: 3885461 - DNA, 18 bp, Homo sapiens
ttcctctcaagctagcca

SEQ ID NO: 3885462 - DNA, 17 bp, Homo sapiens
ttcctctcactaaactt

SEQ ID NO: 3885463 - DNA, 13 bp, Homo sapiens
ttcctctccactg

SEQ ID NO: 3885464 - DNA, 15 bp, Homo sapiens
ttcctctccactgcc

SEQ ID NO: 3885465 - DNA, 13 bp, Homo sapiens
ttcctctgttcta

SEQ ID NO: 3885466 - DNA, 15 bp, Homo sapiens
ttcctgaagccagat

SEQ ID NO: 3885467 - DNA, 18 bp, Homo sapiens
ttcctgaatattaatccc

SEQ ID NO: 3885468 - DNA, 23 bp, Homo sapiens
ttcctgagtgtgggcttctgaaa

SEQ ID NO: 3885469 - DNA, 19 bp, Homo sapiens
ttcctgataataattgatc

SEQ ID NO: 3885470 - DNA, 22 bp, Homo sapiens
ttcctgatggtacaggaaagct

SEQ ID NO: 3885471 - DNA, 17 bp, Homo sapiens
ttcctgcactccagaat

SEQ ID NO: 3885472 - DNA, 16 bp, Homo sapiens
ttcctgcatttgtgaa

SEQ ID NO: 3885473 - DNA, 23 bp, Homo sapiens
ttcctgccccaactccttccagc

SEQ ID NO: 3885474 - DNA, 12 bp, Homo sapiens
ttcctgctgctg

SEQ ID NO: 3885475 - DNA, 23 bp, Homo sapiens
ttcctgctgctgtaactgctgag

SEQ ID NO: 3885476 - DNA, 15 bp, Homo sapiens
tgtgtctgtgtggta

SEQ ID NO: 3885477 - DNA, 23 bp, Homo sapiens
tgtgtgacagaatcttgtatttg

SEQ ID NO: 3885478 - DNA, 23 bp, Homo sapiens
tgtgtgcaccttaccaactttct

SEQ ID NO: 3885479 - DNA, 13 bp, Homo sapiens
tgtgtgcagtgaa

SEQ ID NO: 3885480 - DNA, 16 bp, Homo sapiens
tgtgtgcatgtgagca

SEQ ID NO: 3885481 - DNA, 15 bp, Homo sapiens
tgtgtgcatgtgtgt

SEQ ID NO: 3885482 - DNA, 21 bp, Homo sapiens
tgtgtgccatagagtttaaca

SEQ ID NO: 3885483 - DNA, 13 bp, Homo sapiens
tgtgtgcctgtgg

SEQ ID NO: 3885484 - DNA, 16 bp, Homo sapiens
tgtgtgcctgtggcag

SEQ ID NO: 3885485 - DNA, 17 bp, Homo sapiens
tgtgtggaagaaggaaa

SEQ ID NO: 3885486 - DNA, 23 bp, Homo sapiens
tgtgtggaaggcagggacagaga

SEQ ID NO: 3885487 - DNA, 14 bp, Homo sapiens
tgtgtggacaggac

SEQ ID NO: 3885488 - DNA, 15 bp, Homo sapiens
tgtgtggatgtgtaa

SEQ ID NO: 3885489 - DNA, 15 bp, Homo sapiens
tgtgtggggaggcag

SEQ ID NO: 3885490 - DNA, 16 bp, Homo sapiens
tgtgtggggaggcagc

SEQ ID NO: 3885491 - DNA, 16 bp, Homo sapiens
tgtgtgggtctgggga

SEQ ID NO: 3885492 - DNA, 19 bp, Homo sapiens
tgtgtgggtctggggaggg

SEQ ID NO: 3885493 - DNA, 22 bp, Homo sapiens
tgtgtgtatatatgtgtatata

SEQ ID NO: 3885494 - DNA, 12 bp, Homo sapiens
tgtgtgtatgta

SEQ ID NO: 3885495 - DNA, 15 bp, Homo sapiens
tgtgtgtctgtcttt

SEQ ID NO: 3885496 - DNA, 16 bp, Homo sapiens
tgtgtgtgtgtgcatg

SEQ ID NO: 3885497 - DNA, 14 bp, Homo sapiens
tgtgtgtgtgtgtg

SEQ ID NO: 3885498 - DNA, 15 bp, Homo sapiens
tgtgtgtttaaataa

SEQ ID NO: 3885499 - DNA, 18 bp, Homo sapiens
tgtgtgtttaaataaagt

SEQ ID NO: 3885500 - DNA, 17 bp, Homo sapiens
tgtgttgcctcctacct

SEQ ID NO: 3885501 - DNA, 15 bp, Homo sapiens
tgtgttgctatcctg

SEQ ID NO: 3885502 - DNA, 13 bp, Homo sapiens
tgtgtttaaataa

SEQ ID NO: 3885503 - DNA, 14 bp, Homo sapiens
tgtgtttaaataaa

SEQ ID NO: 3885504 - DNA, 22 bp, Homo sapiens
tgtgtttaaataaagtatcatg

SEQ ID NO: 3885505 - DNA, 11 bp, Homo sapiens
tgtgtttcctt

SEQ ID NO: 3885506 - DNA, 10 bp, Homo sapiens
tgtgtttcta

SEQ ID NO: 3885507 - DNA, 15 bp, Homo sapiens
tgtgtttctaaaact

SEQ ID NO: 3885508 - DNA, 23 bp, Homo sapiens
tgtgttttgcacgtcttgctatt

SEQ ID NO: 3885509 - DNA, 14 bp, Homo sapiens
tgtgtttttaaaag

SEQ ID NO: 3885510 - DNA, 14 bp, Homo sapiens
tgttaaaataacta

SEQ ID NO: 3885511 - DNA, 14 bp, Homo sapiens
tgttaaatgaaacc

SEQ ID NO: 3885512 - DNA, 16 bp, Homo sapiens
tgttaaccagaataaa

SEQ ID NO: 3885513 - DNA, 22 bp, Homo sapiens
tgttaagcaaaggaaaccaaag

SEQ ID NO: 3885514 - DNA, 15 bp, Homo sapiens
tgttaattcagcact

SEQ ID NO: 3885515 - DNA, 14 bp, Homo sapiens
tgttaatttgttat

SEQ ID NO: 3885516 - DNA, 16 bp, Homo sapiens
tgttacaaggcacttg

SEQ ID NO: 3885517 - DNA, 12 bp, Homo sapiens
tgttacatcaca

SEQ ID NO: 3885518 - DNA, 23 bp, Homo sapiens
tgttactgaaatgaggagagaag

SEQ ID NO: 3885519 - DNA, 21 bp, Homo sapiens
tgttactgattctcctgtcag

SEQ ID NO: 3885520 - DNA, 12 bp, Homo sapiens
tgttacttacct

SEQ ID NO: 3885521 - DNA, 17 bp, Homo sapiens
tgttactttttagtctt

SEQ ID NO: 3885522 - DNA, 16 bp, Homo sapiens
tgttagtgtgtgtgca

SEQ ID NO: 3885523 - DNA, 15 bp, Homo sapiens
tgttattaatattgt

SEQ ID NO: 3885524 - DNA, 14 bp, Homo sapiens
tgttattgtggaag

SEQ ID NO: 3885525 - DNA, 15 bp, Homo sapiens
tgttattgtggaaga

SEQ ID NO: 3885526 - DNA, 18 bp, Homo sapiens
tgttattttcagtatttt

SEQ ID NO: 3885527 - DNA, 15 bp, Homo sapiens
tgttcaaatgcattt

SEQ ID NO: 3885528 - DNA, 16 bp, Homo sapiens
tgttcaccatcggcag

SEQ ID NO: 3885529 - DNA, 16 bp, Homo sapiens
tgttcaccttatgtat

SEQ ID NO: 3885530 - DNA, 19 bp, Homo sapiens
tgttcacttttcctccctc

SEQ ID NO: 3885531 - DNA, 18 bp, Homo sapiens
tgttcagaaggttgctct

SEQ ID NO: 3885532 - DNA, 16 bp, Homo sapiens
tgttcatgagtggatg

SEQ ID NO: 3885533 - DNA, 22 bp, Homo sapiens
tgttccacttctctagagaaca

SEQ ID NO: 3885534 - DNA, 17 bp, Homo sapiens
tgttccagctgcctggg

SEQ ID NO: 3885535 - DNA, 15 bp, Homo sapiens
tgttcccaaattgac

SEQ ID NO: 3885536 - DNA, 23 bp, Homo sapiens
tgttcccaagagcatcatgcctc

SEQ ID NO: 3885537 - DNA, 13 bp, Homo sapiens
tgttccccatctg

SEQ ID NO: 3885538 - DNA, 13 bp, Homo sapiens
tgttctcagaatc

SEQ ID NO: 3885539 - DNA, 21 bp, Homo sapiens
tgttctccgggtgtggcctca

SEQ ID NO: 3885540 - DNA, 22 bp, Homo sapiens
tgttctccgggtgtggcctcag

SEQ ID NO: 3885541 - DNA, 14 bp, Homo sapiens
tgttctgcactgaa

SEQ ID NO: 3885542 - DNA, 20 bp, Homo sapiens
tgttctggacctccccctct

SEQ ID NO: 3885543 - DNA, 17 bp, Homo sapiens
tgttcttacctgtatgt

SEQ ID NO: 3885544 - DNA, 16 bp, Homo sapiens
tgttctttctggagtc

SEQ ID NO: 3885545 - DNA, 17 bp, Homo sapiens
tgttgaaatcttaaaaa

SEQ ID NO: 3885546 - DNA, 14 bp, Homo sapiens
tgttgaaattatgt

SEQ ID NO: 3885547 - DNA, 22 bp, Homo sapiens
tgttgaaattatgtatgtttac

SEQ ID NO: 3885548 - DNA, 16 bp, Homo sapiens
tgttgagtgcaacaag

SEQ ID NO: 3885549 - DNA, 13 bp, Homo sapiens
tgttgagtgttca

SEQ ID NO: 3885550 - DNA, 23 bp, Homo sapiens
tgttgattacataatcaaagcta

SEQ ID NO: 3885551 - DNA, 21 bp, Homo sapiens
tgttgattttctagacttcag

SEQ ID NO: 3885552 - DNA, 17 bp, Homo sapiens
tgttgcaagtactgctg

SEQ ID NO: 3885553 - DNA, 17 bp, Homo sapiens
tgttgcatgatgtattt

SEQ ID NO: 3885554 - DNA, 20 bp, Homo sapiens
tgttgccaactaagccctcg

SEQ ID NO: 3885555 - DNA, 17 bp, Homo sapiens
tgttgccatttctctgc

SEQ ID NO: 3885556 - DNA, 18 bp, Homo sapiens
tgttgccatttctctgct

SEQ ID NO: 3885557 - DNA, 20 bp, Homo sapiens
tgttgccatttctctgctta

SEQ ID NO: 3885558 - DNA, 12 bp, Homo sapiens
tgttgccctggg

SEQ ID NO: 3885559 - DNA, 21 bp, Homo sapiens
tgttgctcaaatctattcaga

SEQ ID NO: 3885560 - DNA, 14 bp, Homo sapiens
tgttgctccctgtg

SEQ ID NO: 3885561 - DNA, 12 bp, Homo sapiens
tgttgctggact

SEQ ID NO: 3885562 - DNA, 15 bp, Homo sapiens
tgttggacagctgct

SEQ ID NO: 3885563 - DNA, 16 bp, Homo sapiens
tgtctcagcctcctca

SEQ ID NO: 3885564 - DNA, 20 bp, Homo sapiens
tgtctcagcgaggtgtaaag

SEQ ID NO: 3885565 - DNA, 13 bp, Homo sapiens
tgtctcagtgctg

SEQ ID NO: 3885566 - DNA, 18 bp, Homo sapiens
tgtctcgagcgccctgca

SEQ ID NO: 3885567 - DNA, 15 bp, Homo sapiens
tgtctctagccactt

SEQ ID NO: 3885568 - DNA, 22 bp, Homo sapiens
tgtctctcccaccccggcctcc

SEQ ID NO: 3885569 - DNA, 20 bp, Homo sapiens
tgtctctgcatctcattgta

SEQ ID NO: 3885570 - DNA, 16 bp, Homo sapiens
tgtctcttcctctgtt

SEQ ID NO: 3885571 - DNA, 15 bp, Homo sapiens
tgtctcttgtagaag

SEQ ID NO: 3885572 - DNA, 14 bp, Homo sapiens
tgtctgaggcctca

SEQ ID NO: 3885573 - DNA, 18 bp, Homo sapiens
tgtctgaggcctcatccc

SEQ ID NO: 3885574 - DNA, 15 bp, Homo sapiens
tgtctgatgtttgtt

SEQ ID NO: 3885575 - DNA, 16 bp, Homo sapiens
tgtctgcacccagggg

SEQ ID NO: 3885576 - DNA, 14 bp, Homo sapiens
tgtctgcttctgtc

SEQ ID NO: 3885577 - DNA, 19 bp, Homo sapiens
tgtctgcttctgtccagga

SEQ ID NO: 3885578 - DNA, 17 bp, Homo sapiens
tgtctggaagctgagca

SEQ ID NO: 3885579 - DNA, 14 bp, Homo sapiens
tgtctgtctgtccc

SEQ ID NO: 3885580 - DNA, 18 bp, Homo sapiens
tgtctgtctttgtgggag

SEQ ID NO: 3885581 - DNA, 14 bp, Homo sapiens
tgtcttccaacccc

SEQ ID NO: 3885582 - DNA, 18 bp, Homo sapiens
tgtcttccaaccccagct

SEQ ID NO: 3885583 - DNA, 21 bp, Homo sapiens
tgtcttccaaccccagctggc

SEQ ID NO: 3885584 - DNA, 15 bp, Homo sapiens
tgtcttccttggcct

SEQ ID NO: 3885585 - DNA, 19 bp, Homo sapiens
tgtgaaaatcatgaaaaga

SEQ ID NO: 3885586 - DNA, 18 bp, Homo sapiens
tgtgaaagtatgtgatat

SEQ ID NO: 3885587 - DNA, 15 bp, Homo sapiens
tgtgaacccaggaca

SEQ ID NO: 3885588 - DNA, 14 bp, Homo sapiens
tgtgaattctgtga

SEQ ID NO: 3885589 - DNA, 22 bp, Homo sapiens
tgtgaattgcctgcagagagaa

SEQ ID NO: 3885590 - DNA, 16 bp, Homo sapiens
tgtgacagaatcttgt

SEQ ID NO: 3885591 - DNA, 19 bp, Homo sapiens
tgtgacaggaaagccctcc

SEQ ID NO: 3885592 - DNA, 22 bp, Homo sapiens
tgtgacaggaaagccctccccc

SEQ ID NO: 3885593 - DNA, 22 bp, Homo sapiens
tgtgaccacatacgtgttagga

SEQ ID NO: 3885594 - DNA, 15 bp, Homo sapiens
tgtgacctgctgagc

SEQ ID NO: 3885595 - DNA, 13 bp, Homo sapiens
tgtgaccttctct

SEQ ID NO: 3885596 - DNA, 15 bp, Homo sapiens
tgtgactccagcctg

SEQ ID NO: 3885597 - DNA, 23 bp, Homo sapiens
tgtgactctttttagggccaggc

SEQ ID NO: 3885598 - DNA, 20 bp, Homo sapiens
tgtgactgaaggggcacacc

SEQ ID NO: 3885599 - DNA, 13 bp, Homo sapiens
tgtgactggtcag

SEQ ID NO: 3885600 - DNA, 19 bp, Homo sapiens
tgtgacttcagctctgttt

SEQ ID NO: 3885601 - DNA, 14 bp, Homo sapiens
tgtgagaatcaaaa

SEQ ID NO: 3885602 - DNA, 12 bp, Homo sapiens
tgtgagcccctg

SEQ ID NO: 3885603 - DNA, 17 bp, Homo sapiens
tgtgagcccctggtcct

SEQ ID NO: 3885604 - DNA, 13 bp, Homo sapiens
tgtgaggcagggg

SEQ ID NO: 3885605 - DNA, 18 bp, Homo sapiens
tgtgaggcctggccaggc

SEQ ID NO: 3885606 - DNA, 17 bp, Homo sapiens
tgtgaggctgggccagc

SEQ ID NO: 3885607 - DNA, 17 bp, Homo sapiens
tgtgagtggcagccatg

SEQ ID NO: 3885608 - DNA, 18 bp, Homo sapiens
tgtgagtggcagccatgc

SEQ ID NO: 3885609 - DNA, 23 bp, Homo sapiens
tgtgataacaaagagtcttggtt

SEQ ID NO: 3885610 - DNA, 18 bp, Homo sapiens
tgtgataaggatcagaac

SEQ ID NO: 3885611 - DNA, 13 bp, Homo sapiens
tgtgatatctgaa

SEQ ID NO: 3885612 - DNA, 23 bp, Homo sapiens
tgtgatgctggtaccactggaat

SEQ ID NO: 3885613 - DNA, 16 bp, Homo sapiens
tgtgatgttaactatt

SEQ ID NO: 3885614 - DNA, 17 bp, Homo sapiens
tgtgatgttaactatta

SEQ ID NO: 3885615 - DNA, 23 bp, Homo sapiens
tgtgatttagaactgtatgtcag

SEQ ID NO: 3885616 - DNA, 13 bp, Homo sapiens
tgtgattttgtac

SEQ ID NO: 3885617 - DNA, 18 bp, Homo sapiens
tgtgattttgtacagaat

SEQ ID NO: 3885618 - DNA, 15 bp, Homo sapiens
tgtgcaaattaacag

SEQ ID NO: 3885619 - DNA, 20 bp, Homo sapiens
tgtgcaaattttaaaaagga

SEQ ID NO: 3885620 - DNA, 21 bp, Homo sapiens
tgtgcaagtcttgtcagaatt

SEQ ID NO: 3885621 - DNA, 15 bp, Homo sapiens
tgtgcacaatgggca

SEQ ID NO: 3885622 - DNA, 13 bp, Homo sapiens
tgtgcacatgtgt

SEQ ID NO: 3885623 - DNA, 19 bp, Homo sapiens
tgtgcaccttacattccta

SEQ ID NO: 3885624 - DNA, 22 bp, Homo sapiens
tgtgcaccttaccaactttctg

SEQ ID NO: 3885625 - DNA, 12 bp, Homo sapiens
tgtgcagactga

SEQ ID NO: 3885626 - DNA, 12 bp, Homo sapiens
tgtgcagcagcc

SEQ ID NO: 3885627 - DNA, 21 bp, Homo sapiens
tgtgcagcagcccagcttcct

SEQ ID NO: 3885628 - DNA, 13 bp, Homo sapiens
tgtgcagtatttt

SEQ ID NO: 3885629 - DNA, 16 bp, Homo sapiens
tgtgcagtattttatt

SEQ ID NO: 3885630 - DNA, 20 bp, Homo sapiens
tgtgcagtgaaggttgctga

SEQ ID NO: 3885631 - DNA, 12 bp, Homo sapiens
tgtgcatgtatg

SEQ ID NO: 3885632 - DNA, 14 bp, Homo sapiens
tgtgcatgtatgtg

SEQ ID NO: 3885633 - DNA, 23 bp, Homo sapiens
tgtgcatgtatgtgcacatgtgt

SEQ ID NO: 3885634 - DNA, 14 bp, Homo sapiens
tgtgcatgtgtgta

SEQ ID NO: 3885635 - DNA, 15 bp, Homo sapiens
tgtgcatgtgtgtat

SEQ ID NO: 3885636 - DNA, 12 bp, Homo sapiens
tgtgccaaacta

SEQ ID NO: 3885637 - DNA, 12 bp, Homo sapiens
tgtgccagagcc

SEQ ID NO: 3885638 - DNA, 13 bp, Homo sapiens
tgtgccagagcct

SEQ ID NO: 3885639 - DNA, 20 bp, Homo sapiens
tgtgccagagcctggggctc

SEQ ID NO: 3885640 - DNA, 21 bp, Homo sapiens
tgtgccagagcctggggctct

SEQ ID NO: 3885641 - DNA, 22 bp, Homo sapiens
tgtgccagagcctggggctcta

SEQ ID NO: 3885642 - DNA, 22 bp, Homo sapiens
tgtgccagttggggccccgcgg

SEQ ID NO: 3885643 - DNA, 16 bp, Homo sapiens
tgtgccccatgtccaa

SEQ ID NO: 3885644 - DNA, 18 bp, Homo sapiens
tgtgcccctcagagaggc

SEQ ID NO: 3885645 - DNA, 11 bp, Homo sapiens
tgtgcctcagc

SEQ ID NO: 3885646 - DNA, 19 bp, Homo sapiens
tgtgcctcagcctcctaag

SEQ ID NO: 3885647 - DNA, 16 bp, Homo sapiens
tgtgcctcctcacccc

SEQ ID NO: 3885648 - DNA, 13 bp, Homo sapiens
tgtgcctctgcct

SEQ ID NO: 3885649 - DNA, 16 bp, Homo sapiens
tgttggacagctgctt

SEQ ID NO: 3885650 - DNA, 18 bp, Homo sapiens
tgttggacagctgcttgt

SEQ ID NO: 3885651 - DNA, 18 bp, Homo sapiens
tgttggacccgctctgga

SEQ ID NO: 3885652 - DNA, 13 bp, Homo sapiens
tgttgggaaaaag

SEQ ID NO: 3885653 - DNA, 13 bp, Homo sapiens
tgttgtaaataaa

SEQ ID NO: 3885654 - DNA, 14 bp, Homo sapiens
tgttgtaaatattt

SEQ ID NO: 3885655 - DNA, 21 bp, Homo sapiens
tgttgtaaatatttatgtaaa

SEQ ID NO: 3885656 - DNA, 13 bp, Homo sapiens
tgttgtaaatgac

SEQ ID NO: 3885657 - DNA, 17 bp, Homo sapiens
tgttgtaaatgaccaag

SEQ ID NO: 3885658 - DNA, 22 bp, Homo sapiens
tgttgtaaatgaccaagaaaaa

SEQ ID NO: 3885659 - DNA, 16 bp, Homo sapiens
tgttgtaatagtccat

SEQ ID NO: 3885660 - DNA, 13 bp, Homo sapiens
tgttgtacaagct

SEQ ID NO: 3885661 - DNA, 17 bp, Homo sapiens
tgttgtgactggcaccc

SEQ ID NO: 3885662 - DNA, 18 bp, Homo sapiens
tgttgttccttttgaaag

SEQ ID NO: 3885663 - DNA, 21 bp, Homo sapiens
tgttgttgcagggaagtctta

SEQ ID NO: 3885664 - DNA, 16 bp, Homo sapiens
tgtttaaaaacaggaa

SEQ ID NO: 3885665 - DNA, 19 bp, Homo sapiens
tgtttaaaaacaggaaaaa

SEQ ID NO: 3885666 - DNA, 14 bp, Homo sapiens
tgtttaaaatcatt

SEQ ID NO: 3885667 - DNA, 15 bp, Homo sapiens
tgtttaaataaagta

SEQ ID NO: 3885668 - DNA, 22 bp, Homo sapiens
tgtttaaataaagtatcatgca

SEQ ID NO: 3885669 - DNA, 17 bp, Homo sapiens
tgtttaatatttaaaca

SEQ ID NO: 3885670 - DNA, 13 bp, Homo sapiens
tgtttacaaaagg

SEQ ID NO: 3885671 - DNA, 13 bp, Homo sapiens
tgtttacagaact

SEQ ID NO: 3885672 - DNA, 15 bp, Homo sapiens
tgtttagattccagg

SEQ ID NO: 3885673 - DNA, 18 bp, Homo sapiens
tgtttatatttaattttt

SEQ ID NO: 3885674 - DNA, 20 bp, Homo sapiens
tgtttatgtaggtacttcac

SEQ ID NO: 3885675 - DNA, 19 bp, Homo sapiens
tgtttattaacaaattatg

SEQ ID NO: 3885676 - DNA, 18 bp, Homo sapiens
tgtttattcctgataata

SEQ ID NO: 3885677 - DNA, 12 bp, Homo sapiens
tgtttccttcag

SEQ ID NO: 3885678 - DNA, 17 bp, Homo sapiens
tgtttctccttctgaaa

SEQ ID NO: 3885679 - DNA, 17 bp, Homo sapiens
tgtttctgagaaaagaa

SEQ ID NO: 3885680 - DNA, 12 bp, Homo sapiens
tgtttctgcagt

SEQ ID NO: 3885681 - DNA, 13 bp, Homo sapiens
tgtttgagctcag

SEQ ID NO: 3885682 - DNA, 23 bp, Homo sapiens
tgtttggtgtaggtaaatctagt

SEQ ID NO: 3885683 - DNA, 22 bp, Homo sapiens
tgtttggttgtaaatgctcgtg

SEQ ID NO: 3885684 - DNA, 16 bp, Homo sapiens
tgtttgtaaattaata

SEQ ID NO: 3885685 - DNA, 13 bp, Homo sapiens
tgtttgtaagatt

SEQ ID NO: 3885686 - DNA, 15 bp, Homo sapiens
tgtttgtaagattta

SEQ ID NO: 3885687 - DNA, 17 bp, Homo sapiens
tgtttgtttcctttgtt

SEQ ID NO: 3885688 - DNA, 21 bp, Homo sapiens
tgttttaaccagtacttctaa

SEQ ID NO: 3885689 - DNA, 19 bp, Homo sapiens
tgttttcattatctcaaaa

SEQ ID NO: 3885690 - DNA, 22 bp, Homo sapiens
tgttttcccgagcaaagtctaa

SEQ ID NO: 3885691 - DNA, 14 bp, Homo sapiens
tgttttctcagaac

SEQ ID NO: 3885692 - DNA, 20 bp, Homo sapiens
tgttttctcagaacagctga

SEQ ID NO: 3885693 - DNA, 12 bp, Homo sapiens
tgttttctgaat

SEQ ID NO: 3885694 - DNA, 14 bp, Homo sapiens
tgttttgcactgac

SEQ ID NO: 3885695 - DNA, 21 bp, Homo sapiens
tgttttgcactgacaagatgg

SEQ ID NO: 3885696 - DNA, 13 bp, Homo sapiens
tgttttgtacaat

SEQ ID NO: 3885697 - DNA, 15 bp, Homo sapiens
tgttttgtatatgat

SEQ ID NO: 3885698 - DNA, 19 bp, Homo sapiens
tgtttttcaatctcatctg

SEQ ID NO: 3885699 - DNA, 19 bp, Homo sapiens
tgttttttttttccactta

SEQ ID NO: 3885700 - DNA, 14 bp, Homo sapiens
ttaaaaaaatgaca

SEQ ID NO: 3885701 - DNA, 23 bp, Homo sapiens
ttaaaaaacaaaaaccagcaggt

SEQ ID NO: 3885702 - DNA, 14 bp, Homo sapiens
ttaaaaaataaaaa

SEQ ID NO: 3885703 - DNA, 13 bp, Homo sapiens
ttaaaaaatacac

SEQ ID NO: 3885704 - DNA, 16 bp, Homo sapiens
ttaaaaaatggaacat

SEQ ID NO: 3885705 - DNA, 19 bp, Homo sapiens
ttaaaaacagctgtaacta

SEQ ID NO: 3885706 - DNA, 15 bp, Homo sapiens
ttaaaaacaggaaaa

SEQ ID NO: 3885707 - DNA, 15 bp, Homo sapiens
ttaaaaacttccatc

SEQ ID NO: 3885708 - DNA, 23 bp, Homo sapiens
ttaaaaaggaaagaaaactaaca

SEQ ID NO: 3885709 - DNA, 16 bp, Homo sapiens
ttaaaaagtactcttt

SEQ ID NO: 3885710 - DNA, 20 bp, Homo sapiens
ttaaaaatatggaacttcta

SEQ ID NO: 3885711 - DNA, 23 bp, Homo sapiens
ttaaaaatatggaacttctaata

SEQ ID NO: 3885712 - DNA, 19 bp, Homo sapiens
ttaaaaccatgcagcttca

SEQ ID NO: 3885713 - DNA, 16 bp, Homo sapiens
ttaaaagaagactgga

SEQ ID NO: 3885714 - DNA, 17 bp, Homo sapiens
ttaaaagaagactggaa

SEQ ID NO: 3885715 - DNA, 11 bp, Homo sapiens
ttaaaagacag

SEQ ID NO: 3885716 - DNA, 12 bp, Homo sapiens
ttaaaataatat

SEQ ID NO: 3885717 - DNA, 13 bp, Homo sapiens
ttaaaatataaat

SEQ ID NO: 3885718 - DNA, 17 bp, Homo sapiens
ttaaaatataaattaag

SEQ ID NO: 3885719 - DNA, 18 bp, Homo sapiens
ttaaaatataaattaaga

SEQ ID NO: 3885720 - DNA, 14 bp, Homo sapiens
ttaaaatatggcta

SEQ ID NO: 3885721 - DNA, 17 bp, Homo sapiens
ttaaaatctgatttaat

SEQ ID NO: 3885722 - DNA, 18 bp, Homo sapiens
ttaaaatctgatttaatg

SEQ ID NO: 3885723 - DNA, 20 bp, Homo sapiens
ttaaaatctgatttaatgtt

SEQ ID NO: 3885724 - DNA, 14 bp, Homo sapiens
ttaaaatctggaaa

SEQ ID NO: 3885725 - DNA, 16 bp, Homo sapiens
ttaaaatctggaaatc

SEQ ID NO: 3885726 - DNA, 21 bp, Homo sapiens
ttaaaatctggaaatctgttt

SEQ ID NO: 3885727 - DNA, 18 bp, Homo sapiens
ttaaaatgattgtaaaat

SEQ ID NO: 3885728 - DNA, 16 bp, Homo sapiens
ttaaaatgtacactgg

SEQ ID NO: 3885729 - DNA, 20 bp, Homo sapiens
ttaaacaaaatagaagctgt

SEQ ID NO: 3885730 - DNA, 11 bp, Homo sapiens
ttaaacacctg

SEQ ID NO: 3885731 - DNA, 14 bp, Homo sapiens
ttaaacacctgaca

SEQ ID NO: 3885732 - DNA, 15 bp, Homo sapiens
ttaaacactgtaatc

SEQ ID NO: 3885733 - DNA, 22 bp, Homo sapiens
ttaaacatgctaaatagttcta

SEQ ID NO: 3885734 - DNA, 17 bp, Homo sapiens
ttaaaccagcagaaaag

SEQ ID NO: 3885735 - DNA, 22 bp, Homo sapiens
ttaaaccagcagaaaagtgctt

SEQ ID NO: 3885736 - DNA, 17 bp, Homo sapiens
tgtaaatggagcttgta

SEQ ID NO: 3885737 - DNA, 15 bp, Homo sapiens
tgtaaattaatactt

SEQ ID NO: 3885738 - DNA, 17 bp, Homo sapiens
tgtaaattttagagcat

SEQ ID NO: 3885739 - DNA, 21 bp, Homo sapiens
tgtaaattttagagcatacca

SEQ ID NO: 3885740 - DNA, 20 bp, Homo sapiens
tgtaacacaagccacagaag

SEQ ID NO: 3885741 - DNA, 15 bp, Homo sapiens
tgtaacatccagaag

SEQ ID NO: 3885742 - DNA, 11 bp, Homo sapiens
tgtaactattg

SEQ ID NO: 3885743 - DNA, 14 bp, Homo sapiens
tgtaactattgaat

SEQ ID NO: 3885744 - DNA, 13 bp, Homo sapiens
tgtaactccacca

SEQ ID NO: 3885745 - DNA, 12 bp, Homo sapiens
tgtaactgctga

SEQ ID NO: 3885746 - DNA, 13 bp, Homo sapiens
tgtaacttcaaat

SEQ ID NO: 3885747 - DNA, 23 bp, Homo sapiens
tgtaagtaattgcatttctgctc

SEQ ID NO: 3885748 - DNA, 19 bp, Homo sapiens
tgtaagtttatgtctaaag

SEQ ID NO: 3885749 - DNA, 20 bp, Homo sapiens
tgtaagtttatgtctaaaga

SEQ ID NO: 3885750 - DNA, 13 bp, Homo sapiens
tgtaagtttattt

SEQ ID NO: 3885751 - DNA, 21 bp, Homo sapiens
tgtaataaaacttatgctagt

SEQ ID NO: 3885752 - DNA, 11 bp, Homo sapiens
tgtaataaatc

SEQ ID NO: 3885753 - DNA, 15 bp, Homo sapiens
tgtaataagaaagta

SEQ ID NO: 3885754 - DNA, 23 bp, Homo sapiens
tgtaataagaaagtataaagtca

SEQ ID NO: 3885755 - DNA, 18 bp, Homo sapiens
tgtaatagaaaactgaaa

SEQ ID NO: 3885756 - DNA, 20 bp, Homo sapiens
tgtaatagaaaactgaaaat

SEQ ID NO: 3885757 - DNA, 21 bp, Homo sapiens
tgtaatcccagctactcagga

SEQ ID NO: 3885758 - DNA, 22 bp, Homo sapiens
tgtaatcctcagctgacacata

SEQ ID NO: 3885759 - DNA, 21 bp, Homo sapiens
tgtaatcctgtatattatggt

SEQ ID NO: 3885760 - DNA, 12 bp, Homo sapiens
tgtaatcttaaa

SEQ ID NO: 3885761 - DNA, 14 bp, Homo sapiens
tgtaatcttaaaag

SEQ ID NO: 3885762 - DNA, 12 bp, Homo sapiens
tgtaatgcacaa

SEQ ID NO: 3885763 - DNA, 22 bp, Homo sapiens
tgtaatgcacaatttagaaaac

SEQ ID NO: 3885764 - DNA, 13 bp, Homo sapiens
tgtaatgtcacca

SEQ ID NO: 3885765 - DNA, 14 bp, Homo sapiens
tgtaattaatattc

SEQ ID NO: 3885766 - DNA, 15 bp, Homo sapiens
tgtaattgcttacat

SEQ ID NO: 3885767 - DNA, 23 bp, Homo sapiens
tgtaattgcttacatttttacaa

SEQ ID NO: 3885768 - DNA, 16 bp, Homo sapiens
tgtaatttataaaatt

SEQ ID NO: 3885769 - DNA, 18 bp, Homo sapiens
tgtaattttgtttgtaat

SEQ ID NO: 3885770 - DNA, 13 bp, Homo sapiens
tgtacaaaataaa

SEQ ID NO: 3885771 - DNA, 22 bp, Homo sapiens
tgtacaaaataaacaaataaca

SEQ ID NO: 3885772 - DNA, 19 bp, Homo sapiens
tgtacaagttttgtataaa

SEQ ID NO: 3885773 - DNA, 23 bp, Homo sapiens
tgtacaagttttgtataaataat

SEQ ID NO: 3885774 - DNA, 21 bp, Homo sapiens
tgtacaatacataactagttt

SEQ ID NO: 3885775 - DNA, 17 bp, Homo sapiens
tgtacaataccagatca

SEQ ID NO: 3885776 - DNA, 19 bp, Homo sapiens
tgtacaattactaaattgt

SEQ ID NO: 3885777 - DNA, 22 bp, Homo sapiens
tgtacaattactaaattgtata

SEQ ID NO: 3885778 - DNA, 22 bp, Homo sapiens
tgtacactggatatgttgttaa

SEQ ID NO: 3885779 - DNA, 15 bp, Homo sapiens
tgtacagaattttta

SEQ ID NO: 3885780 - DNA, 19 bp, Homo sapiens
tgtacagaatttttaatga

SEQ ID NO: 3885781 - DNA, 17 bp, Homo sapiens
tgtacagtgtgtaaagt

SEQ ID NO: 3885782 - DNA, 19 bp, Homo sapiens
tgtacagtgtgtaaagtgt

SEQ ID NO: 3885783 - DNA, 17 bp, Homo sapiens
tgtacagttatttatgc

SEQ ID NO: 3885784 - DNA, 14 bp, Homo sapiens
tgtacagttcagtt

SEQ ID NO: 3885785 - DNA, 15 bp, Homo sapiens
tgtacatagatgtat

SEQ ID NO: 3885786 - DNA, 13 bp, Homo sapiens
tgtacatatgtaa

SEQ ID NO: 3885787 - DNA, 18 bp, Homo sapiens
tgtacatatgtaaaataa

SEQ ID NO: 3885788 - DNA, 21 bp, Homo sapiens
tgtacatatgtaaaataaaat

SEQ ID NO: 3885789 - DNA, 14 bp, Homo sapiens
tgtacatgcattca

SEQ ID NO: 3885790 - DNA, 19 bp, Homo sapiens
tgtacccaatttaattcca

SEQ ID NO: 3885791 - DNA, 12 bp, Homo sapiens
tgtacccaccgg

SEQ ID NO: 3885792 - DNA, 16 bp, Homo sapiens
tgtacccaccgggcca

SEQ ID NO: 3885793 - DNA, 14 bp, Homo sapiens
tgtacccagctcct

SEQ ID NO: 3885794 - DNA, 12 bp, Homo sapiens
tgtaccccatcc

SEQ ID NO: 3885795 - DNA, 15 bp, Homo sapiens
tgtaccccatccctt

SEQ ID NO: 3885796 - DNA, 17 bp, Homo sapiens
tgtaccccatcccttcc

SEQ ID NO: 3885797 - DNA, 16 bp, Homo sapiens
tgtacccttccacctc

SEQ ID NO: 3885798 - DNA, 20 bp, Homo sapiens
tgtacccttccacctcctag

SEQ ID NO: 3885799 - DNA, 15 bp, Homo sapiens
tgtacgttatatatt

SEQ ID NO: 3885800 - DNA, 12 bp, Homo sapiens
tgtactcctccc

SEQ ID NO: 3885801 - DNA, 12 bp, Homo sapiens
tgtactgataaa

SEQ ID NO: 3885802 - DNA, 13 bp, Homo sapiens
tgtactgcctgct

SEQ ID NO: 3885803 - DNA, 16 bp, Homo sapiens
tgtacttaataaattc

SEQ ID NO: 3885804 - DNA, 21 bp, Homo sapiens
tgtacttaataaattcagata

SEQ ID NO: 3885805 - DNA, 12 bp, Homo sapiens
tgtacttcctgt

SEQ ID NO: 3885806 - DNA, 23 bp, Homo sapiens
tgtagaaacacagttttgaaaga

SEQ ID NO: 3885807 - DNA, 13 bp, Homo sapiens
tgtagaagatgga

SEQ ID NO: 3885808 - DNA, 21 bp, Homo sapiens
tgtagaagatggactctgaaa

SEQ ID NO: 3885809 - DNA, 16 bp, Homo sapiens
tgtagaatgatttcat

SEQ ID NO: 3885810 - DNA, 15 bp, Homo sapiens
tgtagaccactgtcc

SEQ ID NO: 3885811 - DNA, 12 bp, Homo sapiens
tgtagactatat

SEQ ID NO: 3885812 - DNA, 18 bp, Homo sapiens
tgtagactatatacatgt

SEQ ID NO: 3885813 - DNA, 19 bp, Homo sapiens
tgtagactatatacatgtg

SEQ ID NO: 3885814 - DNA, 22 bp, Homo sapiens
tgtagactatatacatgtgtgt

SEQ ID NO: 3885815 - DNA, 21 bp, Homo sapiens
tgtagattaaggtgatgtgat

SEQ ID NO: 3885816 - DNA, 20 bp, Homo sapiens
tgtagcaaccttctgcattc

SEQ ID NO: 3885817 - DNA, 12 bp, Homo sapiens
tgtagcagaaag

SEQ ID NO: 3885818 - DNA, 13 bp, Homo sapiens
tgtagcagaaagg

SEQ ID NO: 3885819 - DNA, 23 bp, Homo sapiens
tgtagcagtgagaaaaagctcct

SEQ ID NO: 3885820 - DNA, 14 bp, Homo sapiens
tgtagccatggctc

SEQ ID NO: 3885821 - DNA, 16 bp, Homo sapiens
tgtagccatggctcag

SEQ ID NO: 3885822 - DNA, 23 bp, Homo sapiens
tgtagcccggccagggcctggtg

SEQ ID NO: 3885823 - DNA, 17 bp, Homo sapiens
tgtagctcctctgctgc

SEQ ID NO: 3885824 - DNA, 13 bp, Homo sapiens
tgtagctgtgacc

SEQ ID NO: 3885825 - DNA, 15 bp, Homo sapiens
tgtagctttgctctt

SEQ ID NO: 3885826 - DNA, 12 bp, Homo sapiens
tgtagggctgga

SEQ ID NO: 3885827 - DNA, 20 bp, Homo sapiens
tgtaggtattaaagatgtgt

SEQ ID NO: 3885828 - DNA, 13 bp, Homo sapiens
tgtaggttgctta

SEQ ID NO: 3885829 - DNA, 20 bp, Homo sapiens
tgtataaacattaaatgtct

SEQ ID NO: 3885830 - DNA, 11 bp, Homo sapiens
tgtataaatgt

SEQ ID NO: 3885831 - DNA, 12 bp, Homo sapiens
tgtataaatgta

SEQ ID NO: 3885832 - DNA, 21 bp, Homo sapiens
tgtataacttcttaaaagttg

SEQ ID NO: 3885833 - DNA, 20 bp, Homo sapiens
tgtataagtgcacacagaaa

SEQ ID NO: 3885834 - DNA, 21 bp, Homo sapiens
tgtataagtgcacacagaaat

SEQ ID NO: 3885835 - DNA, 14 bp, Homo sapiens
tgtataatctattt

SEQ ID NO: 3885836 - DNA, 11 bp, Homo sapiens
tgtataatggg

SEQ ID NO: 3885837 - DNA, 19 bp, Homo sapiens
tgtatacacacatatacat

SEQ ID NO: 3885838 - DNA, 17 bp, Homo sapiens
tgtatacagattctagc

SEQ ID NO: 3885839 - DNA, 21 bp, Homo sapiens
tgtatacattttgttatagaa

SEQ ID NO: 3885840 - DNA, 15 bp, Homo sapiens
tgtatagtactggca

SEQ ID NO: 3885841 - DNA, 20 bp, Homo sapiens
tgtatagttaggatagcatt

SEQ ID NO: 3885842 - DNA, 22 bp, Homo sapiens
tgtatagttttataaaactcag

SEQ ID NO: 3885843 - DNA, 23 bp, Homo sapiens
tgtatagttttataaaactcagt

SEQ ID NO: 3885844 - DNA, 18 bp, Homo sapiens
tgtatataatactaaagt

SEQ ID NO: 3885845 - DNA, 13 bp, Homo sapiens
tgtatatacacat

SEQ ID NO: 3885846 - DNA, 16 bp, Homo sapiens
tgtatatacacatata

SEQ ID NO: 3885847 - DNA, 14 bp, Homo sapiens
tgtatatacatatt

SEQ ID NO: 3885848 - DNA, 19 bp, Homo sapiens
tgtatatacatattataaa

SEQ ID NO: 3885849 - DNA, 15 bp, Homo sapiens
tgtatatagatgtgc

SEQ ID NO: 3885850 - DNA, 18 bp, Homo sapiens
tgtatatatacatacact

SEQ ID NO: 3885851 - DNA, 20 bp, Homo sapiens
tgtatatatatatgtgtgtg

SEQ ID NO: 3885852 - DNA, 17 bp, Homo sapiens
tgtatatatctgcttca

SEQ ID NO: 3885853 - DNA, 20 bp, Homo sapiens
tgtatatatgtgtatatata

SEQ ID NO: 3885854 - DNA, 21 bp, Homo sapiens
tgtatatatgtgtatatatac

SEQ ID NO: 3885855 - DNA, 15 bp, Homo sapiens
tgtatatatgtgtgt

SEQ ID NO: 3885856 - DNA, 18 bp, Homo sapiens
tgtatatatgtgtgttta

SEQ ID NO: 3885857 - DNA, 20 bp, Homo sapiens
tgtatatatgtgtgtttaaa

SEQ ID NO: 3885858 - DNA, 13 bp, Homo sapiens
tgtatatcagaaa

SEQ ID NO: 3885859 - DNA, 14 bp, Homo sapiens
tgtatatcagaaaa

SEQ ID NO: 3885860 - DNA, 14 bp, Homo sapiens
tgtatatgtcattt

SEQ ID NO: 3885861 - DNA, 14 bp, Homo sapiens
tgtatatgttgtaa

SEQ ID NO: 3885862 - DNA, 16 bp, Homo sapiens
tgtatatgttgtaata

SEQ ID NO: 3885863 - DNA, 19 bp, Homo sapiens
tgtatattatggtgtaatg

SEQ ID NO: 3885864 - DNA, 16 bp, Homo sapiens
tgtatattccaccatt

SEQ ID NO: 3885865 - DNA, 18 bp, Homo sapiens
tgtatcacaaatcttaac

SEQ ID NO: 3885866 - DNA, 19 bp, Homo sapiens
tgtatccagtgatgtgctg

SEQ ID NO: 3885867 - DNA, 12 bp, Homo sapiens
tgtatctcctcc

SEQ ID NO: 3885868 - DNA, 23 bp, Homo sapiens
tgtatctgtagtcttttattttt

SEQ ID NO: 3885869 - DNA, 18 bp, Homo sapiens
tgtatggaaataaatgta

SEQ ID NO: 3885870 - DNA, 16 bp, Homo sapiens
tgtatggaatacagtg

SEQ ID NO: 3885871 - DNA, 17 bp, Homo sapiens
tgtatggaatacagtgt

SEQ ID NO: 3885872 - DNA, 23 bp, Homo sapiens
tgtatgtaagtaattgcatttct

SEQ ID NO: 3885873 - DNA, 17 bp, Homo sapiens
tgtatgtgcacatgtgt

SEQ ID NO: 3885874 - DNA, 23 bp, Homo sapiens
tgtatgtgtgtggtgtgtgtgct

SEQ ID NO: 3885875 - DNA, 14 bp, Homo sapiens
tgtatgttaaagca

SEQ ID NO: 3885876 - DNA, 13 bp, Homo sapiens
tgtatgtttacat

SEQ ID NO: 3885877 - DNA, 15 bp, Homo sapiens
tgtatgtttacatat

SEQ ID NO: 3885878 - DNA, 17 bp, Homo sapiens
tgtattaagccaaacat

SEQ ID NO: 3885879 - DNA, 21 bp, Homo sapiens
tgtattaagccaaacatgagt

SEQ ID NO: 3885880 - DNA, 20 bp, Homo sapiens
tgtattcatgaacttggctg

SEQ ID NO: 3885881 - DNA, 17 bp, Homo sapiens
tgtattctggctgcaag

SEQ ID NO: 3885882 - DNA, 16 bp, Homo sapiens
tgtatttaaaaaaatc

SEQ ID NO: 3885883 - DNA, 14 bp, Homo sapiens
tgtatttattgtca

SEQ ID NO: 3885884 - DNA, 17 bp, Homo sapiens
tgtcaatacccctgtta

SEQ ID NO: 3885885 - DNA, 17 bp, Homo sapiens
tgtcaatattaaataca

SEQ ID NO: 3885886 - DNA, 23 bp, Homo sapiens
tgtcaatttccctgactcctcta

SEQ ID NO: 3885887 - DNA, 16 bp, Homo sapiens
tgtcaatttgtatatc

SEQ ID NO: 3885888 - DNA, 17 bp, Homo sapiens
tgtcaccagcaacatct

SEQ ID NO: 3885889 - DNA, 17 bp, Homo sapiens
tgtcaccagtcctgccc

SEQ ID NO: 3885890 - DNA, 14 bp, Homo sapiens
tgtcaccctgcaga

SEQ ID NO: 3885891 - DNA, 19 bp, Homo sapiens
tgtcacgtgaaatatttaa

SEQ ID NO: 3885892 - DNA, 22 bp, Homo sapiens
tgtcacgtgaaatatttaagta

SEQ ID NO: 3885893 - DNA, 23 bp, Homo sapiens
tgtcactatgctatttctggcct

SEQ ID NO: 3885894 - DNA, 17 bp, Homo sapiens
tgtcagaatttctttgt

SEQ ID NO: 3885895 - DNA, 18 bp, Homo sapiens
tgtcagaatttctttgtc

SEQ ID NO: 3885896 - DNA, 23 bp, Homo sapiens
tgtcagacatccatgtttgtaaa

SEQ ID NO: 3885897 - DNA, 20 bp, Homo sapiens
tgtcagacctatttgacata

SEQ ID NO: 3885898 - DNA, 16 bp, Homo sapiens
tgtcagagccaggctc

SEQ ID NO: 3885899 - DNA, 20 bp, Homo sapiens
tgtcagagccaggctctgcc

SEQ ID NO: 3885900 - DNA, 20 bp, Homo sapiens
tgtcagagtaacatgccagc

SEQ ID NO: 3885901 - DNA, 15 bp, Homo sapiens
tgtcagatatgatat

SEQ ID NO: 3885902 - DNA, 17 bp, Homo sapiens
tgtcagccagccgccct

SEQ ID NO: 3885903 - DNA, 20 bp, Homo sapiens
tgtcagccagccgccctggg

SEQ ID NO: 3885904 - DNA, 20 bp, Homo sapiens
tgtcagccgagccgggcctg

SEQ ID NO: 3885905 - DNA, 22 bp, Homo sapiens
tgtcagccgagccgggcctggg

SEQ ID NO: 3885906 - DNA, 23 bp, Homo sapiens
tgtcagcgcaggtttagtttact

SEQ ID NO: 3885907 - DNA, 20 bp, Homo sapiens
tgtcagctcccctcggagaa

SEQ ID NO: 3885908 - DNA, 21 bp, Homo sapiens
tggggcatggttccttccctg

SEQ ID NO: 3885909 - DNA, 16 bp, Homo sapiens
tggggcatgtgtgcct

SEQ ID NO: 3885910 - DNA, 12 bp, Homo sapiens
tggggccctggg

SEQ ID NO: 3885911 - DNA, 16 bp, Homo sapiens
tggggccctgggcctc

SEQ ID NO: 3885912 - DNA, 19 bp, Homo sapiens
tggggcctggagaggggcc

SEQ ID NO: 3885913 - DNA, 12 bp, Homo sapiens
tggggcctggct

SEQ ID NO: 3885914 - DNA, 13 bp, Homo sapiens
tggggcctggctt

SEQ ID NO: 3885915 - DNA, 14 bp, Homo sapiens
tggggcctggcttg

SEQ ID NO: 3885916 - DNA, 23 bp, Homo sapiens
tggggcctggcttgctccagggt

SEQ ID NO: 3885917 - DNA, 18 bp, Homo sapiens
tggggctctaacgcctga

SEQ ID NO: 3885918 - DNA, 20 bp, Homo sapiens
tggggctctaacgcctgagc

SEQ ID NO: 3885919 - DNA, 21 bp, Homo sapiens
tggggctctaacgcctgagcc

SEQ ID NO: 3885920 - DNA, 14 bp, Homo sapiens
tggggctgctcctc

SEQ ID NO: 3885921 - DNA, 15 bp, Homo sapiens
tggggctgctcctcc

SEQ ID NO: 3885922 - DNA, 16 bp, Homo sapiens
tggggcttctcctgac

SEQ ID NO: 3885923 - DNA, 18 bp, Homo sapiens
tggggcttctcctgaccc

SEQ ID NO: 3885924 - DNA, 15 bp, Homo sapiens
tgggggaagccctgg

SEQ ID NO: 3885925 - DNA, 17 bp, Homo sapiens
tgggggagaggggagac

SEQ ID NO: 3885926 - DNA, 13 bp, Homo sapiens
tgggggcagaggg

SEQ ID NO: 3885927 - DNA, 19 bp, Homo sapiens
tgggggcagtgactggcag

SEQ ID NO: 3885928 - DNA, 13 bp, Homo sapiens
tgggggccagctg

SEQ ID NO: 3885929 - DNA, 18 bp, Homo sapiens
tgggggcgggggagccaa

SEQ ID NO: 3885930 - DNA, 14 bp, Homo sapiens
tggggggccgggca

SEQ ID NO: 3885931 - DNA, 20 bp, Homo sapiens
tggggggccgggcaggtcct

SEQ ID NO: 3885932 - DNA, 20 bp, Homo sapiens
tggggggtgatgagggcagc

SEQ ID NO: 3885933 - DNA, 19 bp, Homo sapiens
tgggggttggatgggaaga

SEQ ID NO: 3885934 - DNA, 20 bp, Homo sapiens
tggggtatttaccacagcag

SEQ ID NO: 3885935 - DNA, 24 bp, Homo sapiens
tggggtatttaccacagcagctga

SEQ ID NO: 3885936 - DNA, 13 bp, Homo sapiens
tggggtcagccag

SEQ ID NO: 3885937 - DNA, 13 bp, Homo sapiens
tggggtccccatc

SEQ ID NO: 3885938 - DNA, 19 bp, Homo sapiens
tggggtctccctctcctgc

SEQ ID NO: 3885939 - DNA, 21 bp, Homo sapiens
tggggtctccctctcctgcct

SEQ ID NO: 3885940 - DNA, 13 bp, Homo sapiens
tggggtgggccca

SEQ ID NO: 3885941 - DNA, 13 bp, Homo sapiens
tggggtggggcag

SEQ ID NO: 3885942 - DNA, 16 bp, Homo sapiens
tggggttgcaaccact

SEQ ID NO: 3885943 - DNA, 23 bp, Homo sapiens
tggggttttatgtgtgggaaagg

SEQ ID NO: 3885944 - DNA, 15 bp, Homo sapiens
tgggtacatgtgagg

SEQ ID NO: 3885945 - DNA, 21 bp, Homo sapiens
tgggtaggtgttgaaaatgag

SEQ ID NO: 3885946 - DNA, 15 bp, Homo sapiens
tgggtatttcctgct

SEQ ID NO: 3885947 - DNA, 12 bp, Homo sapiens
tgggtccaggaa

SEQ ID NO: 3885948 - DNA, 20 bp, Homo sapiens
tgggtccaggaaggcagctg

SEQ ID NO: 3885949 - DNA, 20 bp, Homo sapiens
tgggtccctcggagctgcca

SEQ ID NO: 3885950 - DNA, 21 bp, Homo sapiens
tgggtcctgcaatctccaggg

SEQ ID NO: 3885951 - DNA, 22 bp, Homo sapiens
tgggtcctgcaatctccagggc

SEQ ID NO: 3885952 - DNA, 23 bp, Homo sapiens
tgggtctaaggggttggttgagg

SEQ ID NO: 3885953 - DNA, 16 bp, Homo sapiens
tgggtctggggaggga

SEQ ID NO: 3885954 - DNA, 13 bp, Homo sapiens
tgggtgacggtcc

SEQ ID NO: 3885955 - DNA, 18 bp, Homo sapiens
tgggtgatcagaaggctg

SEQ ID NO: 3885956 - DNA, 20 bp, Homo sapiens
tgggtgatcagaaggctggg

SEQ ID NO: 3885957 - DNA, 22 bp, Homo sapiens
tgggtgccatgtggagtggaca

SEQ ID NO: 3885958 - DNA, 23 bp, Homo sapiens
tgggtgctaagggtaagggagag

SEQ ID NO: 3885959 - DNA, 15 bp, Homo sapiens
tgggtgctggaggat

SEQ ID NO: 3885960 - DNA, 11 bp, Homo sapiens
tgggtgctggc

SEQ ID NO: 3885961 - DNA, 13 bp, Homo sapiens
tgggtgctggcag

SEQ ID NO: 3885962 - DNA, 14 bp, Homo sapiens
tgggtggcacctcc

SEQ ID NO: 3885963 - DNA, 20 bp, Homo sapiens
tgggtggctactctgtgcca

SEQ ID NO: 3885964 - DNA, 13 bp, Homo sapiens
tgggtggggctgc

SEQ ID NO: 3885965 - DNA, 16 bp, Homo sapiens
tgggttggtgcttcta

SEQ ID NO: 3885966 - DNA, 19 bp, Homo sapiens
tgggttttattgtccttca

SEQ ID NO: 3885967 - DNA, 17 bp, Homo sapiens
tgggttttctaactgta

SEQ ID NO: 3885968 - DNA, 14 bp, Homo sapiens
tgggttttcttccc

SEQ ID NO: 3885969 - DNA, 17 bp, Homo sapiens
tgggttttttcacataa

SEQ ID NO: 3885970 - DNA, 21 bp, Homo sapiens
tggtaacatcctttctattga

SEQ ID NO: 3885971 - DNA, 20 bp, Homo sapiens
tggtacagcagggtcttgct

SEQ ID NO: 3885972 - DNA, 24 bp, Homo sapiens
tggtacttgtttcaccatacttca

SEQ ID NO: 3885973 - DNA, 13 bp, Homo sapiens
tggtagaagccag

SEQ ID NO: 3885974 - DNA, 16 bp, Homo sapiens
tggtagaagccagtac

SEQ ID NO: 3885975 - DNA, 17 bp, Homo sapiens
tggtatatttgtgtatg

SEQ ID NO: 3885976 - DNA, 19 bp, Homo sapiens
tggtatatttgtgtatgtg

SEQ ID NO: 3885977 - DNA, 19 bp, Homo sapiens
tggtatgaacttgaggaca

SEQ ID NO: 3885978 - DNA, 23 bp, Homo sapiens
tggtatgaacttgaggacacatg

SEQ ID NO: 3885979 - DNA, 14 bp, Homo sapiens
tggtatgagctgag

SEQ ID NO: 3885980 - DNA, 18 bp, Homo sapiens
tggtatgctggccagcac

SEQ ID NO: 3885981 - DNA, 19 bp, Homo sapiens
tggtatgctggccagcacc

SEQ ID NO: 3885982 - DNA, 21 bp, Homo sapiens
tggtatgctggccagcaccct

SEQ ID NO: 3885983 - DNA, 21 bp, Homo sapiens
tggtatgtagcccggccaggg

SEQ ID NO: 3885984 - DNA, 22 bp, Homo sapiens
tggtcacaggactctgcctcct

SEQ ID NO: 3885985 - DNA, 16 bp, Homo sapiens
tggtcaccatgaaact

SEQ ID NO: 3885986 - DNA, 16 bp, Homo sapiens
tggtcacccttaatat

SEQ ID NO: 3885987 - DNA, 21 bp, Homo sapiens
tggtcaggtatttcagttctt

SEQ ID NO: 3885988 - DNA, 21 bp, Homo sapiens
tggtcagtgtggagaggggtg

SEQ ID NO: 3885989 - DNA, 16 bp, Homo sapiens
tggtcccacatccctg

SEQ ID NO: 3885990 - DNA, 17 bp, Homo sapiens
tggtcccacatccctgg

SEQ ID NO: 3885991 - DNA, 19 bp, Homo sapiens
tggtcccacatccctgggc

SEQ ID NO: 3885992 - DNA, 22 bp, Homo sapiens
tggtcccacatccctgggcctg

SEQ ID NO: 3885993 - DNA, 23 bp, Homo sapiens
tggtcctccatttcaactccaga

SEQ ID NO: 3885994 - DNA, 21 bp, Homo sapiens
tggtcctgagtcttggcctgc

SEQ ID NO: 3885995 - DNA, 22 bp, Homo sapiens
tggtcggggagctggggtacag

SEQ ID NO: 3885996 - DNA, 17 bp, Homo sapiens
tggtcgtgaactcctga

SEQ ID NO: 3885997 - DNA, 22 bp, Homo sapiens
tggtctaggagctgtctccagg

SEQ ID NO: 3885998 - DNA, 23 bp, Homo sapiens
tggtctagtagcggatctcactc

SEQ ID NO: 3885999 - DNA, 17 bp, Homo sapiens
tggtctattttgatttt

SEQ ID NO: 3886000 - DNA, 12 bp, Homo sapiens
tggtctcctctg

SEQ ID NO: 3886001 - DNA, 18 bp, Homo sapiens
tggtctgagcaccccctc

SEQ ID NO: 3886002 - DNA, 15 bp, Homo sapiens
tggtctgctgacctg

SEQ ID NO: 3886003 - DNA, 20 bp, Homo sapiens
tggtctgtgctgccctgctc

SEQ ID NO: 3886004 - DNA, 16 bp, Homo sapiens
tggtcttgtggaattg

SEQ ID NO: 3886005 - DNA, 14 bp, Homo sapiens
tggtctttcctctg

SEQ ID NO: 3886006 - DNA, 11 bp, Homo sapiens
tggtgaaatta

SEQ ID NO: 3886007 - DNA, 13 bp, Homo sapiens
tggtgaaattatg

SEQ ID NO: 3886008 - DNA, 19 bp, Homo sapiens
tggtgaaatttattagtta

SEQ ID NO: 3886009 - DNA, 17 bp, Homo sapiens
tggtgacacacagcagc

SEQ ID NO: 3886010 - DNA, 14 bp, Homo sapiens
tggtgactgtccca

SEQ ID NO: 3886011 - DNA, 18 bp, Homo sapiens
tggtgagctgggaagctg

SEQ ID NO: 3886012 - DNA, 12 bp, Homo sapiens
tggtgaggaagc

SEQ ID NO: 3886013 - DNA, 13 bp, Homo sapiens
tggtgataagtgg

SEQ ID NO: 3886014 - DNA, 15 bp, Homo sapiens
tggtgataagtggaa

SEQ ID NO: 3886015 - DNA, 17 bp, Homo sapiens
tggtgataagtggaaaa

SEQ ID NO: 3886016 - DNA, 18 bp, Homo sapiens
tggtgataagtggaaaaa

SEQ ID NO: 3886017 - DNA, 18 bp, Homo sapiens
tggtgcaggatggctttg

SEQ ID NO: 3886018 - DNA, 23 bp, Homo sapiens
tggtgccacttcttaaaggcctg

SEQ ID NO: 3886019 - DNA, 14 bp, Homo sapiens
tggtgccagaggtt

SEQ ID NO: 3886020 - DNA, 11 bp, Homo sapiens
tggtgcctgcc

SEQ ID NO: 3886021 - DNA, 22 bp, Homo sapiens
tggtgctcacgactcttcctgc

SEQ ID NO: 3886022 - DNA, 15 bp, Homo sapiens
tggtgctgcaaggaa

SEQ ID NO: 3886023 - DNA, 20 bp, Homo sapiens
tggtgctgtggccagggtga

SEQ ID NO: 3886024 - DNA, 13 bp, Homo sapiens
tggtggaggagga

SEQ ID NO: 3886025 - DNA, 16 bp, Homo sapiens
tggtggcaccagatgc

SEQ ID NO: 3886026 - DNA, 15 bp, Homo sapiens
tggtgggctggccca

SEQ ID NO: 3886027 - DNA, 18 bp, Homo sapiens
tggtgtaatgcacaattt

SEQ ID NO: 3886028 - DNA, 22 bp, Homo sapiens
tggtgtaatgcacaatttagaa

SEQ ID NO: 3886029 - DNA, 13 bp, Homo sapiens
tggtgtaatttat

SEQ ID NO: 3886030 - DNA, 21 bp, Homo sapiens
tggtgtatttttcaggtaggc

SEQ ID NO: 3886031 - DNA, 23 bp, Homo sapiens
tggtgtggctgtattcagatcgt

SEQ ID NO: 3886032 - DNA, 21 bp, Homo sapiens
tggtgttacacagcccaagag

SEQ ID NO: 3886033 - DNA, 23 bp, Homo sapiens
tggtgttacacagcccaagagga

SEQ ID NO: 3886034 - DNA, 17 bp, Homo sapiens
tggttaaaataaagcct

SEQ ID NO: 3886035 - DNA, 15 bp, Homo sapiens
tggttactctggtgc

SEQ ID NO: 3886036 - DNA, 15 bp, Homo sapiens
tggttccatgcctga

SEQ ID NO: 3886037 - DNA, 19 bp, Homo sapiens
tggttccatgcctgagggt

SEQ ID NO: 3886038 - DNA, 16 bp, Homo sapiens
tggttcccaataaaag

SEQ ID NO: 3886039 - DNA, 23 bp, Homo sapiens
tggttcccctgttcactctactt

SEQ ID NO: 3886040 - DNA, 17 bp, Homo sapiens
tggttctgaaagtggct

SEQ ID NO: 3886041 - DNA, 20 bp, Homo sapiens
tggttgaactatgctgaaga

SEQ ID NO: 3886042 - DNA, 18 bp, Homo sapiens
tggttggggtggggcagg

SEQ ID NO: 3886043 - DNA, 18 bp, Homo sapiens
tggttgtaaatgctcgtg

SEQ ID NO: 3886044 - DNA, 22 bp, Homo sapiens
tggttgttgcaccatctgcttg

SEQ ID NO: 3886045 - DNA, 17 bp, Homo sapiens
tggtttacatgaacaca

SEQ ID NO: 3886046 - DNA, 23 bp, Homo sapiens
tggtttggcaacacctccttgct

SEQ ID NO: 3886047 - DNA, 15 bp, Homo sapiens
tggtttggggagaaa

SEQ ID NO: 3886048 - DNA, 20 bp, Homo sapiens
tggttttaacaactgtgctt

SEQ ID NO: 3886049 - DNA, 19 bp, Homo sapiens
tggtttttggctctttcag

SEQ ID NO: 3886050 - DNA, 13 bp, Homo sapiens
tgtaaaaaaaaaa

SEQ ID NO: 3886051 - DNA, 18 bp, Homo sapiens
tgtaaaataagaatgatt

SEQ ID NO: 3886052 - DNA, 14 bp, Homo sapiens
tgtaaaataagtat

SEQ ID NO: 3886053 - DNA, 12 bp, Homo sapiens
tgtaaaatagct

SEQ ID NO: 3886054 - DNA, 20 bp, Homo sapiens
tgtaaaatagcttgtatagt

SEQ ID NO: 3886055 - DNA, 13 bp, Homo sapiens
tgtaaaatgcagt

SEQ ID NO: 3886056 - DNA, 23 bp, Homo sapiens
tgtaaaatgcagtccagaataag

SEQ ID NO: 3886057 - DNA, 14 bp, Homo sapiens
tgtaaaattgtata

SEQ ID NO: 3886058 - DNA, 14 bp, Homo sapiens
tgtaaacagtgcct

SEQ ID NO: 3886059 - DNA, 17 bp, Homo sapiens
tgtaaacagtgcctgct

SEQ ID NO: 3886060 - DNA, 22 bp, Homo sapiens
tgtaaaccatcgcgtgcaatga

SEQ ID NO: 3886061 - DNA, 12 bp, Homo sapiens
tgtaaactataa

SEQ ID NO: 3886062 - DNA, 21 bp, Homo sapiens
tgtaaactataaactactgta

SEQ ID NO: 3886063 - DNA, 22 bp, Homo sapiens
tgtaaactataaactactgtaa

SEQ ID NO: 3886064 - DNA, 20 bp, Homo sapiens
tgtaaactgtatcaaatctg

SEQ ID NO: 3886065 - DNA, 19 bp, Homo sapiens
tgtaaaggtcagagtcaaa

SEQ ID NO: 3886066 - DNA, 19 bp, Homo sapiens
tgtaaagtaggaaaaataa

SEQ ID NO: 3886067 - DNA, 16 bp, Homo sapiens
tgtaaagtgtaaatcc

SEQ ID NO: 3886068 - DNA, 23 bp, Homo sapiens
tgtaaatacaaaataaaattatg

SEQ ID NO: 3886069 - DNA, 12 bp, Homo sapiens
tgtaaatacacc

SEQ ID NO: 3886070 - DNA, 13 bp, Homo sapiens
tgtaaatatgttt

SEQ ID NO: 3886071 - DNA, 15 bp, Homo sapiens
tgtaaatatgtttgt

SEQ ID NO: 3886072 - DNA, 17 bp, Homo sapiens
tgtaaatatgtttgtgc

SEQ ID NO: 3886073 - DNA, 12 bp, Homo sapiens
tgtaaatcactt

SEQ ID NO: 3886074 - DNA, 16 bp, Homo sapiens
tgtaaatcacttgtaa

SEQ ID NO: 3886075 - DNA, 18 bp, Homo sapiens
tgtaaatcacttgtaaat

SEQ ID NO: 3886076 - DNA, 19 bp, Homo sapiens
tgtaaatcacttgtaaata

SEQ ID NO: 3886077 - DNA, 20 bp, Homo sapiens
tgtaaatcctttttctttat

SEQ ID NO: 3886078 - DNA, 19 bp, Homo sapiens
tgtaaatgaccaagaaaaa

SEQ ID NO: 3886079 - DNA, 13 bp, Homo sapiens
tgtaaatgctcgt

SEQ ID NO: 3886080 - DNA, 16 bp, Homo sapiens
tgtcagtctggtttat

SEQ ID NO: 3886081 - DNA, 15 bp, Homo sapiens
tgtcataagaatgaa

SEQ ID NO: 3886082 - DNA, 22 bp, Homo sapiens
tgtcatagaaagtgccagaaag

SEQ ID NO: 3886083 - DNA, 17 bp, Homo sapiens
tgtcatatattcatgta

SEQ ID NO: 3886084 - DNA, 19 bp, Homo sapiens
tgtcatatattcatgtaat

SEQ ID NO: 3886085 - DNA, 20 bp, Homo sapiens
tgtcatatattcatgtaata

SEQ ID NO: 3886086 - DNA, 23 bp, Homo sapiens
tgtcatatattcatgtaataaat

SEQ ID NO: 3886087 - DNA, 15 bp, Homo sapiens
tgtcatcactccctg

SEQ ID NO: 3886088 - DNA, 20 bp, Homo sapiens
tgtcatcactccctggatgt

SEQ ID NO: 3886089 - DNA, 15 bp, Homo sapiens
tgtcatcagaagata

SEQ ID NO: 3886090 - DNA, 18 bp, Homo sapiens
tgtcatcattgtatatat

SEQ ID NO: 3886091 - DNA, 16 bp, Homo sapiens
tgtcatctctctgggg

SEQ ID NO: 3886092 - DNA, 23 bp, Homo sapiens
tgtcatctctctggggccctggg

SEQ ID NO: 3886093 - DNA, 13 bp, Homo sapiens
tgtcatctgagga

SEQ ID NO: 3886094 - DNA, 19 bp, Homo sapiens
tgtcatggaaaagcccagt

SEQ ID NO: 3886095 - DNA, 22 bp, Homo sapiens
tgtcattactgcctttggaaga

SEQ ID NO: 3886096 - DNA, 12 bp, Homo sapiens
tgtcattatgta

SEQ ID NO: 3886097 - DNA, 15 bp, Homo sapiens
tgtcattatgtagaa

SEQ ID NO: 3886098 - DNA, 16 bp, Homo sapiens
tgtcattcaaatgggt

SEQ ID NO: 3886099 - DNA, 21 bp, Homo sapiens
tgtcattcaaatgggtgatat

SEQ ID NO: 3886100 - DNA, 20 bp, Homo sapiens
tgtcattcaagcctgtgaat

SEQ ID NO: 3886101 - DNA, 12 bp, Homo sapiens
tgtcatttgctt

SEQ ID NO: 3886102 - DNA, 18 bp, Homo sapiens
tgtcattttaaaatctga

SEQ ID NO: 3886103 - DNA, 18 bp, Homo sapiens
tgtccaatggctgtaaac

SEQ ID NO: 3886104 - DNA, 15 bp, Homo sapiens
tgtccacagtctccc

SEQ ID NO: 3886105 - DNA, 20 bp, Homo sapiens
tgtccacagtctcccattct

SEQ ID NO: 3886106 - DNA, 11 bp, Homo sapiens
tgtccacctgg

SEQ ID NO: 3886107 - DNA, 12 bp, Homo sapiens
tgtccacctggc

SEQ ID NO: 3886108 - DNA, 13 bp, Homo sapiens
tgtccacctggcc

SEQ ID NO: 3886109 - DNA, 14 bp, Homo sapiens
tgtccacctggccc

SEQ ID NO: 3886110 - DNA, 18 bp, Homo sapiens
tgtccactctcggggccc

SEQ ID NO: 3886111 - DNA, 19 bp, Homo sapiens
tgtccactctcggggccct

SEQ ID NO: 3886112 - DNA, 15 bp, Homo sapiens
tgtccagaagaatat

SEQ ID NO: 3886113 - DNA, 16 bp, Homo sapiens
tgtccagaagaatatt

SEQ ID NO: 3886114 - DNA, 20 bp, Homo sapiens
tgtccagaagaatattcagg

SEQ ID NO: 3886115 - DNA, 21 bp, Homo sapiens
tgtccagaagaatattcagga

SEQ ID NO: 3886116 - DNA, 21 bp, Homo sapiens
tgtccagcagctgcgggtctg

SEQ ID NO: 3886117 - DNA, 19 bp, Homo sapiens
tgtccagctagccaactcc

SEQ ID NO: 3886118 - DNA, 21 bp, Homo sapiens
tgtccaggcactgctgcccag

SEQ ID NO: 3886119 - DNA, 12 bp, Homo sapiens
tgtccaggccac

SEQ ID NO: 3886120 - DNA, 19 bp, Homo sapiens
tgtccaggccactgtggcc

SEQ ID NO: 3886121 - DNA, 22 bp, Homo sapiens
tgtcccaccaactctgcactcc

SEQ ID NO: 3886122 - DNA, 23 bp, Homo sapiens
tgtcccaccaactctgcactcca

SEQ ID NO: 3886123 - DNA, 18 bp, Homo sapiens
tgtcccaccgggagcctc

SEQ ID NO: 3886124 - DNA, 13 bp, Homo sapiens
tgtcccacctctt

SEQ ID NO: 3886125 - DNA, 21 bp, Homo sapiens
tgtcccacctcttctcttcct

SEQ ID NO: 3886126 - DNA, 23 bp, Homo sapiens
tgtcccagaggttatctgcctgg

SEQ ID NO: 3886127 - DNA, 15 bp, Homo sapiens
tgtccccagggcccc

SEQ ID NO: 3886128 - DNA, 19 bp, Homo sapiens
tgtcccctgtcccaccaac

SEQ ID NO: 3886129 - DNA, 22 bp, Homo sapiens
tgtcccgccttcctcctccaca

SEQ ID NO: 3886130 - DNA, 17 bp, Homo sapiens
tgtcccggttcaccttg

SEQ ID NO: 3886131 - DNA, 12 bp, Homo sapiens
tgtccctaccca

SEQ ID NO: 3886132 - DNA, 18 bp, Homo sapiens
tgtccctacccactcttt

SEQ ID NO: 3886133 - DNA, 16 bp, Homo sapiens
tgtccctgtcaccaag

SEQ ID NO: 3886134 - DNA, 13 bp, Homo sapiens
tgtccgcctctgc

SEQ ID NO: 3886135 - DNA, 15 bp, Homo sapiens
tgtcctaaggacaca

SEQ ID NO: 3886136 - DNA, 16 bp, Homo sapiens
tgtcctaaggacacac

SEQ ID NO: 3886137 - DNA, 18 bp, Homo sapiens
tgtcctaaggacacacta

SEQ ID NO: 3886138 - DNA, 20 bp, Homo sapiens
tgtcctaaggacacactaat

SEQ ID NO: 3886139 - DNA, 20 bp, Homo sapiens
tgtcctatgtcaatttgtat

SEQ ID NO: 3886140 - DNA, 21 bp, Homo sapiens
tgtcctatgtcaatttgtata

SEQ ID NO: 3886141 - DNA, 22 bp, Homo sapiens
tgtcctccaacaataaagagct

SEQ ID NO: 3886142 - DNA, 23 bp, Homo sapiens
tgtcctcccatcccctggactgg

SEQ ID NO: 3886143 - DNA, 23 bp, Homo sapiens
tgtcctctcccctctgccctgta

SEQ ID NO: 3886144 - DNA, 20 bp, Homo sapiens
tgtcctctcgagcccagatg

SEQ ID NO: 3886145 - DNA, 15 bp, Homo sapiens
tgtcctcttgctcaa

SEQ ID NO: 3886146 - DNA, 17 bp, Homo sapiens
tgtcctctttactccct

SEQ ID NO: 3886147 - DNA, 13 bp, Homo sapiens
tgtcctgccagct

SEQ ID NO: 3886148 - DNA, 19 bp, Homo sapiens
tgtccttcagagctcttca

SEQ ID NO: 3886149 - DNA, 16 bp, Homo sapiens
tgtccttgcacctgca

SEQ ID NO: 3886150 - DNA, 20 bp, Homo sapiens
tgtcctttgagaaagaaata

SEQ ID NO: 3886151 - DNA, 14 bp, Homo sapiens
tgtccttttaggaa

SEQ ID NO: 3886152 - DNA, 17 bp, Homo sapiens
tgtccttttaggaatat

SEQ ID NO: 3886153 - DNA, 19 bp, Homo sapiens
tgtcgccccaggccctccc

SEQ ID NO: 3886154 - DNA, 23 bp, Homo sapiens
tgtcgccccaggccctccctgac

SEQ ID NO: 3886155 - DNA, 15 bp, Homo sapiens
tgtcgctgcttcgtg

SEQ ID NO: 3886156 - DNA, 18 bp, Homo sapiens
tgtcgctgggctgtgggt

SEQ ID NO: 3886157 - DNA, 16 bp, Homo sapiens
tgtcggagtagaaatt

SEQ ID NO: 3886158 - DNA, 22 bp, Homo sapiens
tgtctaagagatctggtcaaag

SEQ ID NO: 3886159 - DNA, 21 bp, Homo sapiens
tgtctagaggtgagaccaaag

SEQ ID NO: 3886160 - DNA, 21 bp, Homo sapiens
tgtctataatggaaacattta

SEQ ID NO: 3886161 - DNA, 14 bp, Homo sapiens
tgtctattctgagc

SEQ ID NO: 3886162 - DNA, 16 bp, Homo sapiens
tgtctattctgagcct

SEQ ID NO: 3886163 - DNA, 19 bp, Homo sapiens
tgtctcaagagggcactgg

SEQ ID NO: 3886164 - DNA, 23 bp, Homo sapiens
tgtctcaagagggcactggtggc

SEQ ID NO: 3886165 - DNA, 24 bp, Homo sapiens
tgcccttgtttggggcaggagtag

SEQ ID NO: 3886166 - DNA, 17 bp, Homo sapiens
tgccgacctcgtcctcc

SEQ ID NO: 3886167 - DNA, 21 bp, Homo sapiens
tgccgacctcgtcctccccct

SEQ ID NO: 3886168 - DNA, 13 bp, Homo sapiens
tgccgagagaggc

SEQ ID NO: 3886169 - DNA, 22 bp, Homo sapiens
tgccgagagaggcgcgtctgcc

SEQ ID NO: 3886170 - DNA, 21 bp, Homo sapiens
tgccgagcaaccgtggccctt

SEQ ID NO: 3886171 - DNA, 13 bp, Homo sapiens
tgccgcctcccag

SEQ ID NO: 3886172 - DNA, 14 bp, Homo sapiens
tgccgcctcccagc

SEQ ID NO: 3886173 - DNA, 12 bp, Homo sapiens
tgccgctgcacc

SEQ ID NO: 3886174 - DNA, 15 bp, Homo sapiens
tgccgctgcaccacg

SEQ ID NO: 3886175 - DNA, 13 bp, Homo sapiens
tgccggggacaga

SEQ ID NO: 3886176 - DNA, 19 bp, Homo sapiens
tgccgggttctagtctcct

SEQ ID NO: 3886177 - DNA, 14 bp, Homo sapiens
tgcctaagtggctg

SEQ ID NO: 3886178 - DNA, 16 bp, Homo sapiens
tgcctaatggagaaga

SEQ ID NO: 3886179 - DNA, 23 bp, Homo sapiens
tgcctaattcctggcatgacact

SEQ ID NO: 3886180 - DNA, 22 bp, Homo sapiens
tgcctcaagaaattgcctcctt

SEQ ID NO: 3886181 - DNA, 17 bp, Homo sapiens
tgcctcaagaacacctt

SEQ ID NO: 3886182 - DNA, 22 bp, Homo sapiens
tgcctcaatgtgaatcagaccc

SEQ ID NO: 3886183 - DNA, 13 bp, Homo sapiens
tgcctcagtttcc

SEQ ID NO: 3886184 - DNA, 14 bp, Homo sapiens
tgcctcagtttccc

SEQ ID NO: 3886185 - DNA, 17 bp, Homo sapiens
tgcctcatgccacacct

SEQ ID NO: 3886186 - DNA, 17 bp, Homo sapiens
tgcctccaccgctgcct

SEQ ID NO: 3886187 - DNA, 21 bp, Homo sapiens
tgcctcccagccctgccagga

SEQ ID NO: 3886188 - DNA, 22 bp, Homo sapiens
tgcctcccagccctgccaggag

SEQ ID NO: 3886189 - DNA, 14 bp, Homo sapiens
tgcctccctctcca

SEQ ID NO: 3886190 - DNA, 19 bp, Homo sapiens
tgcctccctttctgggagg

SEQ ID NO: 3886191 - DNA, 12 bp, Homo sapiens
tgcctcctcacc

SEQ ID NO: 3886192 - DNA, 14 bp, Homo sapiens
tgcctcgaggcacc

SEQ ID NO: 3886193 - DNA, 15 bp, Homo sapiens
tgcctcgaggcaccg

SEQ ID NO: 3886194 - DNA, 15 bp, Homo sapiens
tgcctctcacacaca

SEQ ID NO: 3886195 - DNA, 20 bp, Homo sapiens
tgcctctcccacgatgtcaa

SEQ ID NO: 3886196 - DNA, 18 bp, Homo sapiens
tgcctctctgctccagag

SEQ ID NO: 3886197 - DNA, 17 bp, Homo sapiens
tgcctctgaggccagcc

SEQ ID NO: 3886198 - DNA, 18 bp, Homo sapiens
tgcctctgaggccagcct

SEQ ID NO: 3886199 - DNA, 20 bp, Homo sapiens
tgcctctgaggccagcctgg

SEQ ID NO: 3886200 - DNA, 21 bp, Homo sapiens
tgcctctgaggccagcctggc

SEQ ID NO: 3886201 - DNA, 19 bp, Homo sapiens
tgcctctgatatgggactg

SEQ ID NO: 3886202 - DNA, 15 bp, Homo sapiens
tgcctctgccatgcc

SEQ ID NO: 3886203 - DNA, 18 bp, Homo sapiens
tgcctctgcctgtctccc

SEQ ID NO: 3886204 - DNA, 13 bp, Homo sapiens
tgcctcttcctcc

SEQ ID NO: 3886205 - DNA, 17 bp, Homo sapiens
tgcctcttgttgcagag

SEQ ID NO: 3886206 - DNA, 15 bp, Homo sapiens
tgcctgagcccagga

SEQ ID NO: 3886207 - DNA, 13 bp, Homo sapiens
tgcctgagctggg

SEQ ID NO: 3886208 - DNA, 15 bp, Homo sapiens
tgcctgaggctcaag

SEQ ID NO: 3886209 - DNA, 21 bp, Homo sapiens
tgcctgaggctcaagaggccc

SEQ ID NO: 3886210 - DNA, 23 bp, Homo sapiens
tgcctgaggctcaagaggcccag

SEQ ID NO: 3886211 - DNA, 13 bp, Homo sapiens
tgcctgccctgga

SEQ ID NO: 3886212 - DNA, 14 bp, Homo sapiens
tgcctgccctggag

SEQ ID NO: 3886213 - DNA, 17 bp, Homo sapiens
tgcctgccctggaggga

SEQ ID NO: 3886214 - DNA, 23 bp, Homo sapiens
tgcctgcctctgccatgcccaga

SEQ ID NO: 3886215 - DNA, 11 bp, Homo sapiens
tgcctggagga

SEQ ID NO: 3886216 - DNA, 19 bp, Homo sapiens
tgcctggagtcccgtccct

SEQ ID NO: 3886217 - DNA, 18 bp, Homo sapiens
tgcctggcccccctccag

SEQ ID NO: 3886218 - DNA, 12 bp, Homo sapiens
tgcctggcctgg

SEQ ID NO: 3886219 - DNA, 16 bp, Homo sapiens
tgcctggcctggctcc

SEQ ID NO: 3886220 - DNA, 14 bp, Homo sapiens
tgcctggctgtgga

SEQ ID NO: 3886221 - DNA, 15 bp, Homo sapiens
tgcctggctgtggag

SEQ ID NO: 3886222 - DNA, 17 bp, Homo sapiens
tgcctggctgtggaggc

SEQ ID NO: 3886223 - DNA, 15 bp, Homo sapiens
tgcctgggcctgtgc

SEQ ID NO: 3886224 - DNA, 23 bp, Homo sapiens
tgcctgggcctgtgcagcagccc

SEQ ID NO: 3886225 - DNA, 16 bp, Homo sapiens
tgcctgggcttatgcc

SEQ ID NO: 3886226 - DNA, 24 bp, Homo sapiens
tgcctgggtggggctgctcctcca

SEQ ID NO: 3886227 - DNA, 14 bp, Homo sapiens
tgcctgggttttct

SEQ ID NO: 3886228 - DNA, 15 bp, Homo sapiens
tgcctgggttttcta

SEQ ID NO: 3886229 - DNA, 19 bp, Homo sapiens
tgcctgggttttctaactg

SEQ ID NO: 3886230 - DNA, 20 bp, Homo sapiens
tgcctgggttttctaactgt

SEQ ID NO: 3886231 - DNA, 15 bp, Homo sapiens
tgcctgtagcagtga

SEQ ID NO: 3886232 - DNA, 15 bp, Homo sapiens
tgcctgtagttagga

SEQ ID NO: 3886233 - DNA, 17 bp, Homo sapiens
tgcctgtagttaggaaa

SEQ ID NO: 3886234 - DNA, 19 bp, Homo sapiens
tgcctgtagttaggaaata

SEQ ID NO: 3886235 - DNA, 20 bp, Homo sapiens
tgcctgtagttaggaaataa

SEQ ID NO: 3886236 - DNA, 20 bp, Homo sapiens
tgcctgtgcacggccagctg

SEQ ID NO: 3886237 - DNA, 15 bp, Homo sapiens
tgcctgtgcatgacc

SEQ ID NO: 3886238 - DNA, 21 bp, Homo sapiens
tgcctgtggccttgcccgcca

SEQ ID NO: 3886239 - DNA, 22 bp, Homo sapiens
tgcctgtgtttgtgtggatacc

SEQ ID NO: 3886240 - DNA, 23 bp, Homo sapiens
tgccttaataagaatggttgcct

SEQ ID NO: 3886241 - DNA, 14 bp, Homo sapiens
tgccttacctcctg

SEQ ID NO: 3886242 - DNA, 20 bp, Homo sapiens
tgccttacctcctgcccagg

SEQ ID NO: 3886243 - DNA, 21 bp, Homo sapiens
tgccttacctcctgcccagga

SEQ ID NO: 3886244 - DNA, 13 bp, Homo sapiens
tgccttcagctct

SEQ ID NO: 3886245 - DNA, 13 bp, Homo sapiens
tgccttctccctg

SEQ ID NO: 3886246 - DNA, 21 bp, Homo sapiens
tgccttcttattctcactcca

SEQ ID NO: 3886247 - DNA, 13 bp, Homo sapiens
tgccttcttcacc

SEQ ID NO: 3886248 - DNA, 19 bp, Homo sapiens
tgccttgtgtacagttatt

SEQ ID NO: 3886249 - DNA, 18 bp, Homo sapiens
tgcctttctctggctcca

SEQ ID NO: 3886250 - DNA, 20 bp, Homo sapiens
tgcctttctctggctccaga

SEQ ID NO: 3886251 - DNA, 16 bp, Homo sapiens
tgggcagcaccctccc

SEQ ID NO: 3886252 - DNA, 17 bp, Homo sapiens
tgggcagcaccctcccc

SEQ ID NO: 3886253 - DNA, 22 bp, Homo sapiens
tgggcagcaccctcccccgcag

SEQ ID NO: 3886254 - DNA, 14 bp, Homo sapiens
tgggcagctgtcat

SEQ ID NO: 3886255 - DNA, 14 bp, Homo sapiens
tgggcagtgcctcc

SEQ ID NO: 3886256 - DNA, 16 bp, Homo sapiens
tgggcagtgcctcctg

SEQ ID NO: 3886257 - DNA, 17 bp, Homo sapiens
tgggcatcttctggctt

SEQ ID NO: 3886258 - DNA, 14 bp, Homo sapiens
tgggcattgggctg

SEQ ID NO: 3886259 - DNA, 16 bp, Homo sapiens
tgggcattgggctgac

SEQ ID NO: 3886260 - DNA, 19 bp, Homo sapiens
tgggcattgggctgacacc

SEQ ID NO: 3886261 - DNA, 16 bp, Homo sapiens
tgggccaattaaaata

SEQ ID NO: 3886262 - DNA, 23 bp, Homo sapiens
tgggccaattaaaatatatataa

SEQ ID NO: 3886263 - DNA, 21 bp, Homo sapiens
tgggccactctcccctccctc

SEQ ID NO: 3886264 - DNA, 18 bp, Homo sapiens
tgggccactgccagcagc

SEQ ID NO: 3886265 - DNA, 20 bp, Homo sapiens
tgggccagcctcagctcagc

SEQ ID NO: 3886266 - DNA, 22 bp, Homo sapiens
tgggccagcctcagctcagcct

SEQ ID NO: 3886267 - DNA, 15 bp, Homo sapiens
tgggccagctgtcgc

SEQ ID NO: 3886268 - DNA, 19 bp, Homo sapiens
tgggccagctgtcgcatct

SEQ ID NO: 3886269 - DNA, 14 bp, Homo sapiens
tgggccaggacagg

SEQ ID NO: 3886270 - DNA, 16 bp, Homo sapiens
tgggccaggagctcag

SEQ ID NO: 3886271 - DNA, 17 bp, Homo sapiens
tgggcccacagagatgc

SEQ ID NO: 3886272 - DNA, 17 bp, Homo sapiens
tgggccccaccacctag

SEQ ID NO: 3886273 - DNA, 16 bp, Homo sapiens
tgggccccatgctctg

SEQ ID NO: 3886274 - DNA, 21 bp, Homo sapiens
tgggccccatgctctgcccca

SEQ ID NO: 3886275 - DNA, 13 bp, Homo sapiens
tgggcccctccac

SEQ ID NO: 3886276 - DNA, 22 bp, Homo sapiens
tgggcccctccacgcctcctgg

SEQ ID NO: 3886277 - DNA, 13 bp, Homo sapiens
tgggcccctggga

SEQ ID NO: 3886278 - DNA, 15 bp, Homo sapiens
tgggcctatggagag

SEQ ID NO: 3886279 - DNA, 18 bp, Homo sapiens
tgggcctatggagagccc

SEQ ID NO: 3886280 - DNA, 20 bp, Homo sapiens
tgggcctatggagagccctg

SEQ ID NO: 3886281 - DNA, 21 bp, Homo sapiens
tgggcctatggagagccctgg

SEQ ID NO: 3886282 - DNA, 12 bp, Homo sapiens
tgggcctgccca

SEQ ID NO: 3886283 - DNA, 16 bp, Homo sapiens
tgggcctgcccaatgc

SEQ ID NO: 3886284 - DNA, 13 bp, Homo sapiens
tgggcctgctgct

SEQ ID NO: 3886285 - DNA, 18 bp, Homo sapiens
tgggcctgctgctgagaa

SEQ ID NO: 3886286 - DNA, 19 bp, Homo sapiens
tgggcctgcttttccagga

SEQ ID NO: 3886287 - DNA, 21 bp, Homo sapiens
tgggcctgcttttccaggatc

SEQ ID NO: 3886288 - DNA, 13 bp, Homo sapiens
tgggcctggcctg

SEQ ID NO: 3886289 - DNA, 20 bp, Homo sapiens
tgggcctggcctgagctggg

SEQ ID NO: 3886290 - DNA, 13 bp, Homo sapiens
tgggcctgggcct

SEQ ID NO: 3886291 - DNA, 16 bp, Homo sapiens
tgggcctgggcctgct

SEQ ID NO: 3886292 - DNA, 23 bp, Homo sapiens
tgggcgaatctacagaacaaaga

SEQ ID NO: 3886293 - DNA, 14 bp, Homo sapiens
tgggctactggcag

SEQ ID NO: 3886294 - DNA, 17 bp, Homo sapiens
tgggctactggcagctc

SEQ ID NO: 3886295 - DNA, 15 bp, Homo sapiens
tgggctcagggctgg

SEQ ID NO: 3886296 - DNA, 16 bp, Homo sapiens
tgggctcagggctgga

SEQ ID NO: 3886297 - DNA, 18 bp, Homo sapiens
tgggctcctggctgccag

SEQ ID NO: 3886298 - DNA, 17 bp, Homo sapiens
tgggctctccacctcag

SEQ ID NO: 3886299 - DNA, 18 bp, Homo sapiens
tgggctctccacctcagc

SEQ ID NO: 3886300 - DNA, 21 bp, Homo sapiens
tgggctctccacctcagcctt

SEQ ID NO: 3886301 - DNA, 13 bp, Homo sapiens
tgggctgacacct

SEQ ID NO: 3886302 - DNA, 21 bp, Homo sapiens
tgggctgacacctaccatgct

SEQ ID NO: 3886303 - DNA, 17 bp, Homo sapiens
tgggctgccctggtgct

SEQ ID NO: 3886304 - DNA, 14 bp, Homo sapiens
tgggctggcccagc

SEQ ID NO: 3886305 - DNA, 21 bp, Homo sapiens
tgggctggcccagccaactgc

SEQ ID NO: 3886306 - DNA, 19 bp, Homo sapiens
tgggctgtcaacattcaaa

SEQ ID NO: 3886307 - DNA, 18 bp, Homo sapiens
tgggctgtctgtcaccag

SEQ ID NO: 3886308 - DNA, 19 bp, Homo sapiens
tgggctgtctgtcaccagc

SEQ ID NO: 3886309 - DNA, 17 bp, Homo sapiens
tgggcttggacttcctg

SEQ ID NO: 3886310 - DNA, 22 bp, Homo sapiens
tgggcttggacttcctggggcc

SEQ ID NO: 3886311 - DNA, 15 bp, Homo sapiens
tgggcttggccttgt

SEQ ID NO: 3886312 - DNA, 23 bp, Homo sapiens
tgggctttaacaaaacaagaaag

SEQ ID NO: 3886313 - DNA, 14 bp, Homo sapiens
tgggctttgcaggc

SEQ ID NO: 3886314 - DNA, 18 bp, Homo sapiens
tgggctttgcaggctctg

SEQ ID NO: 3886315 - DNA, 20 bp, Homo sapiens
tgggctttgcaggctctggg

SEQ ID NO: 3886316 - DNA, 22 bp, Homo sapiens
tgggctttgcaggctctgggct

SEQ ID NO: 3886317 - DNA, 15 bp, Homo sapiens
tggggacagttggca

SEQ ID NO: 3886318 - DNA, 16 bp, Homo sapiens
tggggagaaataattg

SEQ ID NO: 3886319 - DNA, 12 bp, Homo sapiens
tggggagcagag

SEQ ID NO: 3886320 - DNA, 13 bp, Homo sapiens
tggggagcagagt

SEQ ID NO: 3886321 - DNA, 23 bp, Homo sapiens
tggggagcagagtataggatgga

SEQ ID NO: 3886322 - DNA, 16 bp, Homo sapiens
tggggaggaaatagaa

SEQ ID NO: 3886323 - DNA, 19 bp, Homo sapiens
tggggaggaagggccagga

SEQ ID NO: 3886324 - DNA, 20 bp, Homo sapiens
tggggaggaagggccaggag

SEQ ID NO: 3886325 - DNA, 21 bp, Homo sapiens
tggggaggaagggccaggaga

SEQ ID NO: 3886326 - DNA, 22 bp, Homo sapiens
tggggaggaagggccaggagag

SEQ ID NO: 3886327 - DNA, 16 bp, Homo sapiens
tggggaggcagctcca

SEQ ID NO: 3886328 - DNA, 19 bp, Homo sapiens
tggggagggagacagagac

SEQ ID NO: 3886329 - DNA, 16 bp, Homo sapiens
tggggagggggaagag

SEQ ID NO: 3886330 - DNA, 20 bp, Homo sapiens
tggggagggtggaggggtga

SEQ ID NO: 3886331 - DNA, 21 bp, Homo sapiens
tggggcagaggggcagccgct

SEQ ID NO: 3886332 - DNA, 15 bp, Homo sapiens
tggggcagctcctct

SEQ ID NO: 3886333 - DNA, 12 bp, Homo sapiens
tggggcaggagt

SEQ ID NO: 3886334 - DNA, 21 bp, Homo sapiens
tggggcaggagtagctgagct

SEQ ID NO: 3886335 - DNA, 20 bp, Homo sapiens
tggggcatagaaactgagga

SEQ ID NO: 3886336 - DNA, 21 bp, Homo sapiens
tggggcatagaaactgaggag

SEQ ID NO: 3886337 - DNA, 16 bp, Homo sapiens
tggcttcctccgtcca

SEQ ID NO: 3886338 - DNA, 21 bp, Homo sapiens
tggcttcctccgtccacccag

SEQ ID NO: 3886339 - DNA, 13 bp, Homo sapiens
tggcttcctcctg

SEQ ID NO: 3886340 - DNA, 15 bp, Homo sapiens
tggcttctcctgtga

SEQ ID NO: 3886341 - DNA, 15 bp, Homo sapiens
tggcttctgggagat

SEQ ID NO: 3886342 - DNA, 12 bp, Homo sapiens
tggcttctgtgc

SEQ ID NO: 3886343 - DNA, 20 bp, Homo sapiens
tggcttctgttgcgccactg

SEQ ID NO: 3886344 - DNA, 15 bp, Homo sapiens
tggcttgctccaggg

SEQ ID NO: 3886345 - DNA, 17 bp, Homo sapiens
tggcttgctccagggtc

SEQ ID NO: 3886346 - DNA, 18 bp, Homo sapiens
tggcttgctccagggtct

SEQ ID NO: 3886347 - DNA, 16 bp, Homo sapiens
tggcttggggagcaga

SEQ ID NO: 3886348 - DNA, 17 bp, Homo sapiens
tggcttgtgattctggg

SEQ ID NO: 3886349 - DNA, 22 bp, Homo sapiens
tggcttgtgattctgggatgga

SEQ ID NO: 3886350 - DNA, 20 bp, Homo sapiens
tggctttctcccactgagtt

SEQ ID NO: 3886351 - DNA, 22 bp, Homo sapiens
tggctttctccgactgctaggg

SEQ ID NO: 3886352 - DNA, 23 bp, Homo sapiens
tggctttctccgactgctaggga

SEQ ID NO: 3886353 - DNA, 21 bp, Homo sapiens
tggcttttcgcttgcttctgc

SEQ ID NO: 3886354 - DNA, 14 bp, Homo sapiens
tgggaaacagggag

SEQ ID NO: 3886355 - DNA, 21 bp, Homo sapiens
tgggaaagaaggcaaagtccc

SEQ ID NO: 3886356 - DNA, 16 bp, Homo sapiens
tgggaaagcattgtaa

SEQ ID NO: 3886357 - DNA, 18 bp, Homo sapiens
tgggaaagcattgtaaat

SEQ ID NO: 3886358 - DNA, 20 bp, Homo sapiens
tgggaaaggaaaaccaggga

SEQ ID NO: 3886359 - DNA, 23 bp, Homo sapiens
tgggaaaggaaaaccagggatag

SEQ ID NO: 3886360 - DNA, 19 bp, Homo sapiens
tgggaaaggacccacccat

SEQ ID NO: 3886361 - DNA, 18 bp, Homo sapiens
tgggaacccgactgtgaa

SEQ ID NO: 3886362 - DNA, 19 bp, Homo sapiens
tgggaactccactctcctt

SEQ ID NO: 3886363 - DNA, 16 bp, Homo sapiens
tgggaagagaagggaa

SEQ ID NO: 3886364 - DNA, 18 bp, Homo sapiens
tgggaagatggtagcaga

SEQ ID NO: 3886365 - DNA, 22 bp, Homo sapiens
tgggaagatggtagcagataaa

SEQ ID NO: 3886366 - DNA, 12 bp, Homo sapiens
tgggaagctggg

SEQ ID NO: 3886367 - DNA, 22 bp, Homo sapiens
tgggaagctgtactcagagcag

SEQ ID NO: 3886368 - DNA, 13 bp, Homo sapiens
tgggaagcttgct

SEQ ID NO: 3886369 - DNA, 19 bp, Homo sapiens
tgggaaggctaagttcagt

SEQ ID NO: 3886370 - DNA, 21 bp, Homo sapiens
tgggaagggagagcggggcag

SEQ ID NO: 3886371 - DNA, 15 bp, Homo sapiens
tgggaagtgaagccc

SEQ ID NO: 3886372 - DNA, 22 bp, Homo sapiens
tgggaattctttacaataaaca

SEQ ID NO: 3886373 - DNA, 23 bp, Homo sapiens
tgggacaaaccagagcagagagc

SEQ ID NO: 3886374 - DNA, 22 bp, Homo sapiens
tgggacagaggagcaaggttta

SEQ ID NO: 3886375 - DNA, 14 bp, Homo sapiens
tgggacagccccag

SEQ ID NO: 3886376 - DNA, 15 bp, Homo sapiens
tgggacagccccagg

SEQ ID NO: 3886377 - DNA, 16 bp, Homo sapiens
tgggacagccccaggg

SEQ ID NO: 3886378 - DNA, 18 bp, Homo sapiens
tgggacagccccagggcc

SEQ ID NO: 3886379 - DNA, 18 bp, Homo sapiens
tgggaccagggatggggg

SEQ ID NO: 3886380 - DNA, 18 bp, Homo sapiens
tgggacccagctactctg

SEQ ID NO: 3886381 - DNA, 23 bp, Homo sapiens
tgggacccagctactctgtccag

SEQ ID NO: 3886382 - DNA, 22 bp, Homo sapiens
tgggaccccagctagggctgga

SEQ ID NO: 3886383 - DNA, 18 bp, Homo sapiens
tgggaccctttccttcct

SEQ ID NO: 3886384 - DNA, 22 bp, Homo sapiens
tgggagacgaacggaagggttg

SEQ ID NO: 3886385 - DNA, 23 bp, Homo sapiens
tgggagacgaacggaagggttgg

SEQ ID NO: 3886386 - DNA, 19 bp, Homo sapiens
tgggagagaatatttcaaa

SEQ ID NO: 3886387 - DNA, 17 bp, Homo sapiens
tgggagagacactccca

SEQ ID NO: 3886388 - DNA, 21 bp, Homo sapiens
tgggagagacactcccaggga

SEQ ID NO: 3886389 - DNA, 21 bp, Homo sapiens
tgggagagagacgtgtacata

SEQ ID NO: 3886390 - DNA, 18 bp, Homo sapiens
tgggagctggttagaaat

SEQ ID NO: 3886391 - DNA, 16 bp, Homo sapiens
tgggaggcatggccct

SEQ ID NO: 3886392 - DNA, 13 bp, Homo sapiens
tgggaggccaagg

SEQ ID NO: 3886393 - DNA, 14 bp, Homo sapiens
tgggaggccaaggc

SEQ ID NO: 3886394 - DNA, 16 bp, Homo sapiens
tgggaggccaaggcag

SEQ ID NO: 3886395 - DNA, 17 bp, Homo sapiens
tgggaggccaaggcagg

SEQ ID NO: 3886396 - DNA, 19 bp, Homo sapiens
tgggaggccaaggcaggta

SEQ ID NO: 3886397 - DNA, 23 bp, Homo sapiens
tgggaggcctcgtaccagccagg

SEQ ID NO: 3886398 - DNA, 19 bp, Homo sapiens
tgggagggagcagacagga

SEQ ID NO: 3886399 - DNA, 18 bp, Homo sapiens
tgggagggagggagaggt

SEQ ID NO: 3886400 - DNA, 23 bp, Homo sapiens
tgggagggggctatttctctccc

SEQ ID NO: 3886401 - DNA, 15 bp, Homo sapiens
tgggagggggctcca

SEQ ID NO: 3886402 - DNA, 17 bp, Homo sapiens
tgggagggggctccatg

SEQ ID NO: 3886403 - DNA, 22 bp, Homo sapiens
tgggagggggctccatggagga

SEQ ID NO: 3886404 - DNA, 22 bp, Homo sapiens
tgggagtagcatggactctggg

SEQ ID NO: 3886405 - DNA, 21 bp, Homo sapiens
tgggagtgttctgtgggcttg

SEQ ID NO: 3886406 - DNA, 20 bp, Homo sapiens
tgggatataagaggcagcgt

SEQ ID NO: 3886407 - DNA, 13 bp, Homo sapiens
tgggatatgacaa

SEQ ID NO: 3886408 - DNA, 13 bp, Homo sapiens
tgggatggaggag

SEQ ID NO: 3886409 - DNA, 20 bp, Homo sapiens
tgggattcaggaaaaggcct

SEQ ID NO: 3886410 - DNA, 21 bp, Homo sapiens
tgggattcaggaaaaggcctg

SEQ ID NO: 3886411 - DNA, 23 bp, Homo sapiens
tgggattcaggaaaaggcctggg

SEQ ID NO: 3886412 - DNA, 23 bp, Homo sapiens
tgggattcccaccaaggtcttca

SEQ ID NO: 3886413 - DNA, 18 bp, Homo sapiens
tgggatttatatctatag

SEQ ID NO: 3886414 - DNA, 21 bp, Homo sapiens
tgggcaaacccttctcttctc

SEQ ID NO: 3886415 - DNA, 14 bp, Homo sapiens
tgggcacatgagga

SEQ ID NO: 3886416 - DNA, 17 bp, Homo sapiens
tgggcacatgaggaggg

SEQ ID NO: 3886417 - DNA, 20 bp, Homo sapiens
tgggcacatgaggagggtgc

SEQ ID NO: 3886418 - DNA, 17 bp, Homo sapiens
tgggcacccacctccac

SEQ ID NO: 3886419 - DNA, 21 bp, Homo sapiens
tgggcacccccagcctgggcc

SEQ ID NO: 3886420 - DNA, 18 bp, Homo sapiens
tgggcagaagggagaagg

SEQ ID NO: 3886421 - DNA, 14 bp, Homo sapiens
tgggcagcaccctc

SEQ ID NO: 3886422 - DNA, 17 bp, Homo sapiens
tggccgggtgcggtggc

SEQ ID NO: 3886423 - DNA, 18 bp, Homo sapiens
tggccgggtgcggtggct

SEQ ID NO: 3886424 - DNA, 20 bp, Homo sapiens
tggcctattatattaaaata

SEQ ID NO: 3886425 - DNA, 13 bp, Homo sapiens
tggcctcactggc

SEQ ID NO: 3886426 - DNA, 19 bp, Homo sapiens
tggcctcactggctggggc

SEQ ID NO: 3886427 - DNA, 17 bp, Homo sapiens
tggcctcacttccctgg

SEQ ID NO: 3886428 - DNA, 13 bp, Homo sapiens
tggcctcagacca

SEQ ID NO: 3886429 - DNA, 14 bp, Homo sapiens
tggcctcagccctc

SEQ ID NO: 3886430 - DNA, 15 bp, Homo sapiens
tggcctcagccctca

SEQ ID NO: 3886431 - DNA, 21 bp, Homo sapiens
tggcctccacagttcgacctg

SEQ ID NO: 3886432 - DNA, 17 bp, Homo sapiens
tggcctcgcctgggccc

SEQ ID NO: 3886433 - DNA, 19 bp, Homo sapiens
tggcctcgggacacctgcc

SEQ ID NO: 3886434 - DNA, 21 bp, Homo sapiens
tggcctctagaacacccactg

SEQ ID NO: 3886435 - DNA, 14 bp, Homo sapiens
tggcctgagctggg

SEQ ID NO: 3886436 - DNA, 16 bp, Homo sapiens
tggcctgagctggggc

SEQ ID NO: 3886437 - DNA, 20 bp, Homo sapiens
tggcctgcctcccagccctg

SEQ ID NO: 3886438 - DNA, 22 bp, Homo sapiens
tggcctgcggccgggctgccct

SEQ ID NO: 3886439 - DNA, 15 bp, Homo sapiens
tggcctgctgggaac

SEQ ID NO: 3886440 - DNA, 20 bp, Homo sapiens
tggcctgctgggctctccac

SEQ ID NO: 3886441 - DNA, 21 bp, Homo sapiens
tggcctgctgggctctccacc

SEQ ID NO: 3886442 - DNA, 22 bp, Homo sapiens
tggcctgctgggctctccacct

SEQ ID NO: 3886443 - DNA, 13 bp, Homo sapiens
tggcctgtgtcca

SEQ ID NO: 3886444 - DNA, 16 bp, Homo sapiens
tggcctgtgtccagca

SEQ ID NO: 3886445 - DNA, 19 bp, Homo sapiens
tggcctgtgtccagcagct

SEQ ID NO: 3886446 - DNA, 21 bp, Homo sapiens
tggccttgtcaggacccaggc

SEQ ID NO: 3886447 - DNA, 22 bp, Homo sapiens
tggccttgtcaggacccaggcc

SEQ ID NO: 3886448 - DNA, 17 bp, Homo sapiens
tggcgattccctctcac

SEQ ID NO: 3886449 - DNA, 16 bp, Homo sapiens
tggcgcgggaggcacc

SEQ ID NO: 3886450 - DNA, 13 bp, Homo sapiens
tggcggcttcctg

SEQ ID NO: 3886451 - DNA, 19 bp, Homo sapiens
tggcggcttcctgtccact

SEQ ID NO: 3886452 - DNA, 18 bp, Homo sapiens
tggctactctgtgccaga

SEQ ID NO: 3886453 - DNA, 19 bp, Homo sapiens
tggctactctgtgccagag

SEQ ID NO: 3886454 - DNA, 21 bp, Homo sapiens
tggctactctgtgccagagcc

SEQ ID NO: 3886455 - DNA, 23 bp, Homo sapiens
tggctactctgtgccagagcctg

SEQ ID NO: 3886456 - DNA, 19 bp, Homo sapiens
tggctataaatatataaaa

SEQ ID NO: 3886457 - DNA, 18 bp, Homo sapiens
tggctataacatgtcttt

SEQ ID NO: 3886458 - DNA, 18 bp, Homo sapiens
tggctcacccctctcccc

SEQ ID NO: 3886459 - DNA, 13 bp, Homo sapiens
tggctcacgcctg

SEQ ID NO: 3886460 - DNA, 12 bp, Homo sapiens
tggctcaggcag

SEQ ID NO: 3886461 - DNA, 14 bp, Homo sapiens
tggctcaggcagac

SEQ ID NO: 3886462 - DNA, 11 bp, Homo sapiens
tggctccagaa

SEQ ID NO: 3886463 - DNA, 22 bp, Homo sapiens
tggctccccacgagtcacctgc

SEQ ID NO: 3886464 - DNA, 23 bp, Homo sapiens
tggctccccacgagtcacctgca

SEQ ID NO: 3886465 - DNA, 16 bp, Homo sapiens
tggctcctcccggtgc

SEQ ID NO: 3886466 - DNA, 18 bp, Homo sapiens
tggctcctcccggtgccc

SEQ ID NO: 3886467 - DNA, 16 bp, Homo sapiens
tggctctcagaaggta

SEQ ID NO: 3886468 - DNA, 16 bp, Homo sapiens
tggctctccaccttgt

SEQ ID NO: 3886469 - DNA, 23 bp, Homo sapiens
tggctctgcaatgggcactggga

SEQ ID NO: 3886470 - DNA, 15 bp, Homo sapiens
tggctctttcagaga

SEQ ID NO: 3886471 - DNA, 15 bp, Homo sapiens
tggctgaaaaaggcc

SEQ ID NO: 3886472 - DNA, 21 bp, Homo sapiens
tggctgaatagcttctccaaa

SEQ ID NO: 3886473 - DNA, 15 bp, Homo sapiens
tggctgacccagtcc

SEQ ID NO: 3886474 - DNA, 19 bp, Homo sapiens
tggctgacccagtccctgg

SEQ ID NO: 3886475 - DNA, 20 bp, Homo sapiens
tggctgaggatttcaagcct

SEQ ID NO: 3886476 - DNA, 15 bp, Homo sapiens
tggctgagggcagtt

SEQ ID NO: 3886477 - DNA, 23 bp, Homo sapiens
tggctgagggcagttcgcagcca

SEQ ID NO: 3886478 - DNA, 20 bp, Homo sapiens
tggctgcaagggccagagtt

SEQ ID NO: 3886479 - DNA, 14 bp, Homo sapiens
tggctgctgactga

SEQ ID NO: 3886480 - DNA, 22 bp, Homo sapiens
tggctggcagctgagagccctg

SEQ ID NO: 3886481 - DNA, 23 bp, Homo sapiens
tggctggcagctgagagccctgc

SEQ ID NO: 3886482 - DNA, 17 bp, Homo sapiens
tggctggcccgtcatgt

SEQ ID NO: 3886483 - DNA, 22 bp, Homo sapiens
tggctggctaactggaagcatg

SEQ ID NO: 3886484 - DNA, 16 bp, Homo sapiens
tggctgggacattttc

SEQ ID NO: 3886485 - DNA, 15 bp, Homo sapiens
tggctggggcagagg

SEQ ID NO: 3886486 - DNA, 20 bp, Homo sapiens
tggctggggcagaggggcag

SEQ ID NO: 3886487 - DNA, 12 bp, Homo sapiens
tggctgtattca

SEQ ID NO: 3886488 - DNA, 12 bp, Homo sapiens
tggctgtgagga

SEQ ID NO: 3886489 - DNA, 17 bp, Homo sapiens
tggctgtgcctctgcct

SEQ ID NO: 3886490 - DNA, 19 bp, Homo sapiens
tggctgtgcctctgcctgt

SEQ ID NO: 3886491 - DNA, 22 bp, Homo sapiens
tggctgtgcctctgcctgtctc

SEQ ID NO: 3886492 - DNA, 21 bp, Homo sapiens
tggctgtggaggcctgatgct

SEQ ID NO: 3886493 - DNA, 15 bp, Homo sapiens
tggctgtggcacaga

SEQ ID NO: 3886494 - DNA, 22 bp, Homo sapiens
tggctgtggttcctaagcctgt

SEQ ID NO: 3886495 - DNA, 14 bp, Homo sapiens
tggctgtgtgacag

SEQ ID NO: 3886496 - DNA, 23 bp, Homo sapiens
tggcttaaaaacttccatcccta

SEQ ID NO: 3886497 - DNA, 14 bp, Homo sapiens
tggcttaatgttta

SEQ ID NO: 3886498 - DNA, 15 bp, Homo sapiens
tggcttaatgtttat

SEQ ID NO: 3886499 - DNA, 13 bp, Homo sapiens
tggcttagaaatc

SEQ ID NO: 3886500 - DNA, 13 bp, Homo sapiens
tggcttataaatg

SEQ ID NO: 3886501 - DNA, 20 bp, Homo sapiens
tggcttccaggtatctccag

SEQ ID NO: 3886502 - DNA, 18 bp, Homo sapiens
tggcttcccatccccagc

SEQ ID NO: 3886503 - DNA, 15 bp, Homo sapiens
tggcttcccgctcag

SEQ ID NO: 3886504 - DNA, 18 bp, Homo sapiens
tggcttcccgctcagccc

SEQ ID NO: 3886505 - DNA, 19 bp, Homo sapiens
tggcttcccgctcagccct

SEQ ID NO: 3886506 - DNA, 21 bp, Homo sapiens
tggcttcccgctcagccctcc

SEQ ID NO: 3886507 - DNA, 15 bp, Homo sapiens
tggcttcctccgtcc

SEQ ID NO: 3886508 - DNA, 17 bp, Homo sapiens
tggagccaatggagact

SEQ ID NO: 3886509 - DNA, 15 bp, Homo sapiens
tggagcccgtgcagt

SEQ ID NO: 3886510 - DNA, 12 bp, Homo sapiens
tggagccctcag

SEQ ID NO: 3886511 - DNA, 14 bp, Homo sapiens
tggagcctggcaca

SEQ ID NO: 3886512 - DNA, 14 bp, Homo sapiens
tggagctcttggaa

SEQ ID NO: 3886513 - DNA, 21 bp, Homo sapiens
tggagctcttggaagagctct

SEQ ID NO: 3886514 - DNA, 21 bp, Homo sapiens
tggaggaaaaccaagccgtgg

SEQ ID NO: 3886515 - DNA, 16 bp, Homo sapiens
tggaggaaggtgctga

SEQ ID NO: 3886516 - DNA, 20 bp, Homo sapiens
tggaggaaggtgctgagctt

SEQ ID NO: 3886517 - DNA, 16 bp, Homo sapiens
tggaggacctgagcct

SEQ ID NO: 3886518 - DNA, 19 bp, Homo sapiens
tggaggactagaacctgga

SEQ ID NO: 3886519 - DNA, 20 bp, Homo sapiens
tggaggactagaacctggag

SEQ ID NO: 3886520 - DNA, 13 bp, Homo sapiens
tggaggagaaata

SEQ ID NO: 3886521 - DNA, 14 bp, Homo sapiens
tggaggagaagaat

SEQ ID NO: 3886522 - DNA, 23 bp, Homo sapiens
tggaggaggaggaggaggaggaa

SEQ ID NO: 3886523 - DNA, 15 bp, Homo sapiens
tggaggaggcctggg

SEQ ID NO: 3886524 - DNA, 18 bp, Homo sapiens
tggaggaggcctgggggc

SEQ ID NO: 3886525 - DNA, 21 bp, Homo sapiens
tggaggatgaatagatgtgat

SEQ ID NO: 3886526 - DNA, 14 bp, Homo sapiens
tggaggcagacagc

SEQ ID NO: 3886527 - DNA, 14 bp, Homo sapiens
tggaggcagggcct

SEQ ID NO: 3886528 - DNA, 14 bp, Homo sapiens
tggaggcctgatgc

SEQ ID NO: 3886529 - DNA, 20 bp, Homo sapiens
tggagggcaaggggtttcca

SEQ ID NO: 3886530 - DNA, 23 bp, Homo sapiens
tggagggctagaacctggagagc

SEQ ID NO: 3886531 - DNA, 21 bp, Homo sapiens
tggagggctagaacctggagg

SEQ ID NO: 3886532 - DNA, 15 bp, Homo sapiens
tggaggggaaacgca

SEQ ID NO: 3886533 - DNA, 19 bp, Homo sapiens
tggagggggcaagcctgta

SEQ ID NO: 3886534 - DNA, 19 bp, Homo sapiens
tggagggggtgtctggaag

SEQ ID NO: 3886535 - DNA, 17 bp, Homo sapiens
tggagggtaggggagtg

SEQ ID NO: 3886536 - DNA, 20 bp, Homo sapiens
tggagggtaggggagtgtgg

SEQ ID NO: 3886537 - DNA, 18 bp, Homo sapiens
tggagggtcgcctggctt

SEQ ID NO: 3886538 - DNA, 18 bp, Homo sapiens
tggaggtcacattcagga

SEQ ID NO: 3886539 - DNA, 15 bp, Homo sapiens
tggaggtgagaaaag

SEQ ID NO: 3886540 - DNA, 16 bp, Homo sapiens
tggagtataatattca

SEQ ID NO: 3886541 - DNA, 15 bp, Homo sapiens
tggagtctcattctg

SEQ ID NO: 3886542 - DNA, 13 bp, Homo sapiens
tggagtctccagt

SEQ ID NO: 3886543 - DNA, 17 bp, Homo sapiens
tggagtgagcagtagaa

SEQ ID NO: 3886544 - DNA, 19 bp, Homo sapiens
tggagtgaggcttccaggc

SEQ ID NO: 3886545 - DNA, 22 bp, Homo sapiens
tggagtgaggcttccaggctct

SEQ ID NO: 3886546 - DNA, 15 bp, Homo sapiens
tggagtgcagggagg

SEQ ID NO: 3886547 - DNA, 22 bp, Homo sapiens
tggagtgcgctcttggtccctg

SEQ ID NO: 3886548 - DNA, 17 bp, Homo sapiens
tggagttacattaatgt

SEQ ID NO: 3886549 - DNA, 18 bp, Homo sapiens
tggagttacattaatgtt

SEQ ID NO: 3886550 - DNA, 22 bp, Homo sapiens
tggatacaaggatcagaatgga

SEQ ID NO: 3886551 - DNA, 20 bp, Homo sapiens
tggatatgttgttaaacacg

SEQ ID NO: 3886552 - DNA, 17 bp, Homo sapiens
tggatcagcgtggcctt

SEQ ID NO: 3886553 - DNA, 16 bp, Homo sapiens
tggatcatgaaaagtg

SEQ ID NO: 3886554 - DNA, 14 bp, Homo sapiens
tggatctcaatctt

SEQ ID NO: 3886555 - DNA, 18 bp, Homo sapiens
tggatctccaaggaccag

SEQ ID NO: 3886556 - DNA, 20 bp, Homo sapiens
tggatctgtccaaggaaact

SEQ ID NO: 3886557 - DNA, 20 bp, Homo sapiens
tggatgaccagaacaaggtt

SEQ ID NO: 3886558 - DNA, 19 bp, Homo sapiens
tggatgatataatgcgggt

SEQ ID NO: 3886559 - DNA, 18 bp, Homo sapiens
tggatgctccagggcagc

SEQ ID NO: 3886560 - DNA, 19 bp, Homo sapiens
tggatgctccagggcagcc

SEQ ID NO: 3886561 - DNA, 13 bp, Homo sapiens
tggatggacagaa

SEQ ID NO: 3886562 - DNA, 16 bp, Homo sapiens
tggatggaggagaaat

SEQ ID NO: 3886563 - DNA, 17 bp, Homo sapiens
tggatggaggagaaata

SEQ ID NO: 3886564 - DNA, 19 bp, Homo sapiens
tggatggaggagaaataaa

SEQ ID NO: 3886565 - DNA, 14 bp, Homo sapiens
tggatggatggaca

SEQ ID NO: 3886566 - DNA, 16 bp, Homo sapiens
tggatggatggacaga

SEQ ID NO: 3886567 - DNA, 23 bp, Homo sapiens
tggatgggcattgggctgacacc

SEQ ID NO: 3886568 - DNA, 19 bp, Homo sapiens
tggattaatgttttgtaca

SEQ ID NO: 3886569 - DNA, 13 bp, Homo sapiens
tggattattcatt

SEQ ID NO: 3886570 - DNA, 16 bp, Homo sapiens
tggattattcatttaa

SEQ ID NO: 3886571 - DNA, 17 bp, Homo sapiens
tggattattcatttaaa

SEQ ID NO: 3886572 - DNA, 18 bp, Homo sapiens
tggattattcatttaaaa

SEQ ID NO: 3886573 - DNA, 19 bp, Homo sapiens
tggattattcatttaaaat

SEQ ID NO: 3886574 - DNA, 13 bp, Homo sapiens
tggattatttcat

SEQ ID NO: 3886575 - DNA, 16 bp, Homo sapiens
tggattccagcatttg

SEQ ID NO: 3886576 - DNA, 16 bp, Homo sapiens
tggattcctaagcagt

SEQ ID NO: 3886577 - DNA, 18 bp, Homo sapiens
tggattgcagtccccagt

SEQ ID NO: 3886578 - DNA, 14 bp, Homo sapiens
tggatttcagaaag

SEQ ID NO: 3886579 - DNA, 18 bp, Homo sapiens
tggatttcctattttaaa

SEQ ID NO: 3886580 - DNA, 18 bp, Homo sapiens
tggattttcccctgaaga

SEQ ID NO: 3886581 - DNA, 16 bp, Homo sapiens
tggatttttaaattat

SEQ ID NO: 3886582 - DNA, 12 bp, Homo sapiens
tggcaacagaag

SEQ ID NO: 3886583 - DNA, 21 bp, Homo sapiens
tggcaacagttagctggagct

SEQ ID NO: 3886584 - DNA, 14 bp, Homo sapiens
tggcaacctgttct

SEQ ID NO: 3886585 - DNA, 19 bp, Homo sapiens
tggcaagaaagctggtaaa

SEQ ID NO: 3886586 - DNA, 23 bp, Homo sapiens
tggcaagcagggaaagctccacg

SEQ ID NO: 3886587 - DNA, 21 bp, Homo sapiens
tggcaagctagaacctggagg

SEQ ID NO: 3886588 - DNA, 23 bp, Homo sapiens
tggcacagacttctggaaggctg

SEQ ID NO: 3886589 - DNA, 14 bp, Homo sapiens
tggcacaggactga

SEQ ID NO: 3886590 - DNA, 18 bp, Homo sapiens
tggcacagttttctgaga

SEQ ID NO: 3886591 - DNA, 21 bp, Homo sapiens
tggcaccactagggtcctggc

SEQ ID NO: 3886592 - DNA, 19 bp, Homo sapiens
tggcaccagaggctgcaga

SEQ ID NO: 3886593 - DNA, 12 bp, Homo sapiens
tggcaccagccc

SEQ ID NO: 3886594 - DNA, 19 bp, Homo sapiens
tggcaccagccccctggat

SEQ ID NO: 3886595 - DNA, 23 bp, Homo sapiens
tggcaccccggatcgaggacaag

SEQ ID NO: 3886596 - DNA, 15 bp, Homo sapiens
tggcacctcctgaga

SEQ ID NO: 3886597 - DNA, 22 bp, Homo sapiens
tggcactccctaaccaaatgct

SEQ ID NO: 3886598 - DNA, 23 bp, Homo sapiens
tggcacttagcccaagaggtctg

SEQ ID NO: 3886599 - DNA, 17 bp, Homo sapiens
tggcagaaaagaggaga

SEQ ID NO: 3886600 - DNA, 22 bp, Homo sapiens
tggcagaaaagaggagaccctg

SEQ ID NO: 3886601 - DNA, 14 bp, Homo sapiens
tggcagaccatctc

SEQ ID NO: 3886602 - DNA, 18 bp, Homo sapiens
tggcagaccatctccagc

SEQ ID NO: 3886603 - DNA, 14 bp, Homo sapiens
tggcagagaaggcc

SEQ ID NO: 3886604 - DNA, 18 bp, Homo sapiens
tggcagagaaggcctctt

SEQ ID NO: 3886605 - DNA, 18 bp, Homo sapiens
tggcagatgtaggaggga

SEQ ID NO: 3886606 - DNA, 11 bp, Homo sapiens
tggcagccaca

SEQ ID NO: 3886607 - DNA, 21 bp, Homo sapiens
tggcagccacacttctcagga

SEQ ID NO: 3886608 - DNA, 14 bp, Homo sapiens
tggcagccatgcct

SEQ ID NO: 3886609 - DNA, 18 bp, Homo sapiens
tggcagctcctctccttg

SEQ ID NO: 3886610 - DNA, 13 bp, Homo sapiens
tggcagctgtccc

SEQ ID NO: 3886611 - DNA, 14 bp, Homo sapiens
tggcagctgtcccc

SEQ ID NO: 3886612 - DNA, 20 bp, Homo sapiens
tggcaggaagtctctcccga

SEQ ID NO: 3886613 - DNA, 12 bp, Homo sapiens
tggcaggacaca

SEQ ID NO: 3886614 - DNA, 16 bp, Homo sapiens
tggcaggaccaggact

SEQ ID NO: 3886615 - DNA, 17 bp, Homo sapiens
tggcaggaccaggacta

SEQ ID NO: 3886616 - DNA, 19 bp, Homo sapiens
tggcaggcacacagcagcc

SEQ ID NO: 3886617 - DNA, 22 bp, Homo sapiens
tggcaggcacacagcagccccc

SEQ ID NO: 3886618 - DNA, 20 bp, Homo sapiens
tggcaggtgcagatgggctg

SEQ ID NO: 3886619 - DNA, 21 bp, Homo sapiens
tggcatatttatattgtatat

SEQ ID NO: 3886620 - DNA, 23 bp, Homo sapiens
tggcatcgtagaagagatgtggc

SEQ ID NO: 3886621 - DNA, 23 bp, Homo sapiens
tggcatgtcagagccaggctctg

SEQ ID NO: 3886622 - DNA, 16 bp, Homo sapiens
tggcatgtggagacac

SEQ ID NO: 3886623 - DNA, 23 bp, Homo sapiens
tggccaagctgaggtgcccagga

SEQ ID NO: 3886624 - DNA, 16 bp, Homo sapiens
tggccaccccgtgcca

SEQ ID NO: 3886625 - DNA, 19 bp, Homo sapiens
tggccacccgttctgctgg

SEQ ID NO: 3886626 - DNA, 11 bp, Homo sapiens
tggccaccctg

SEQ ID NO: 3886627 - DNA, 14 bp, Homo sapiens
tggccaccctggcc

SEQ ID NO: 3886628 - DNA, 22 bp, Homo sapiens
tggccactgggtctcactcctg

SEQ ID NO: 3886629 - DNA, 23 bp, Homo sapiens
tggccactgggtctcactcctga

SEQ ID NO: 3886630 - DNA, 16 bp, Homo sapiens
tggccactttaagaga

SEQ ID NO: 3886631 - DNA, 15 bp, Homo sapiens
tggccagacgctgcc

SEQ ID NO: 3886632 - DNA, 19 bp, Homo sapiens
tggccagacgctgccgctg

SEQ ID NO: 3886633 - DNA, 17 bp, Homo sapiens
tggccagagagggccca

SEQ ID NO: 3886634 - DNA, 20 bp, Homo sapiens
tggccagagagggcccagct

SEQ ID NO: 3886635 - DNA, 13 bp, Homo sapiens
tggccagagctgg

SEQ ID NO: 3886636 - DNA, 23 bp, Homo sapiens
tggccagagctggaaggcagggc

SEQ ID NO: 3886637 - DNA, 14 bp, Homo sapiens
tggccagagctggg

SEQ ID NO: 3886638 - DNA, 15 bp, Homo sapiens
tggccagagctggga

SEQ ID NO: 3886639 - DNA, 23 bp, Homo sapiens
tggccagagctgggaggcatggc

SEQ ID NO: 3886640 - DNA, 24 bp, Homo sapiens
tggccagagctgggaggcatggcc

SEQ ID NO: 3886641 - DNA, 18 bp, Homo sapiens
tggccagcaccctctcct

SEQ ID NO: 3886642 - DNA, 21 bp, Homo sapiens
tggccagcaccctctcctggg

SEQ ID NO: 3886643 - DNA, 22 bp, Homo sapiens
tggccaggaggttggtgactga

SEQ ID NO: 3886644 - DNA, 21 bp, Homo sapiens
tggccaggcaccccctggaga

SEQ ID NO: 3886645 - DNA, 13 bp, Homo sapiens
tggccagggtgag

SEQ ID NO: 3886646 - DNA, 18 bp, Homo sapiens
tggccagggtgagagctg

SEQ ID NO: 3886647 - DNA, 15 bp, Homo sapiens
tggccaggtggccac

SEQ ID NO: 3886648 - DNA, 16 bp, Homo sapiens
tggccagtcctagagc

SEQ ID NO: 3886649 - DNA, 16 bp, Homo sapiens
tggccatcagggtggg

SEQ ID NO: 3886650 - DNA, 13 bp, Homo sapiens
tggccatccctgg

SEQ ID NO: 3886651 - DNA, 19 bp, Homo sapiens
tggccatccctgggcccct

SEQ ID NO: 3886652 - DNA, 14 bp, Homo sapiens
tggccatttgcttt

SEQ ID NO: 3886653 - DNA, 16 bp, Homo sapiens
tggccattttcttgcc

SEQ ID NO: 3886654 - DNA, 23 bp, Homo sapiens
tggccattttcttgcctgaggct

SEQ ID NO: 3886655 - DNA, 22 bp, Homo sapiens
tggccccaccctcgtggacacc

SEQ ID NO: 3886656 - DNA, 15 bp, Homo sapiens
tggccccagggttga

SEQ ID NO: 3886657 - DNA, 16 bp, Homo sapiens
tggccccaggtgccac

SEQ ID NO: 3886658 - DNA, 23 bp, Homo sapiens
tggccccaggtgccaccaataaa

SEQ ID NO: 3886659 - DNA, 21 bp, Homo sapiens
tggccccatgtctctcagaat

SEQ ID NO: 3886660 - DNA, 16 bp, Homo sapiens
tggcccccctccaggc

SEQ ID NO: 3886661 - DNA, 24 bp, Homo sapiens
tggccccctgtgccagctcaggtg

SEQ ID NO: 3886662 - DNA, 18 bp, Homo sapiens
tggccccgggctctggcc

SEQ ID NO: 3886663 - DNA, 23 bp, Homo sapiens
tggccccgggctctggccaccct

SEQ ID NO: 3886664 - DNA, 18 bp, Homo sapiens
tggcccctcacctgggcc

SEQ ID NO: 3886665 - DNA, 19 bp, Homo sapiens
tggcccctcacctgggcct

SEQ ID NO: 3886666 - DNA, 20 bp, Homo sapiens
tggcccctcacctgggcctt

SEQ ID NO: 3886667 - DNA, 21 bp, Homo sapiens
tggcccctccagaccctgcct

SEQ ID NO: 3886668 - DNA, 14 bp, Homo sapiens
tggcccctgaacaa

SEQ ID NO: 3886669 - DNA, 13 bp, Homo sapiens
tggcccgcccctc

SEQ ID NO: 3886670 - DNA, 22 bp, Homo sapiens
tggcccgcccctcgctgctgct

SEQ ID NO: 3886671 - DNA, 18 bp, Homo sapiens
tggccctggcctgctggg

SEQ ID NO: 3886672 - DNA, 13 bp, Homo sapiens
tggccctggggtc

SEQ ID NO: 3886673 - DNA, 19 bp, Homo sapiens
tggcccttcccactggagg

SEQ ID NO: 3886674 - DNA, 16 bp, Homo sapiens
tggcccttcctggaca

SEQ ID NO: 3886675 - DNA, 17 bp, Homo sapiens
tggcccttcctggacag

SEQ ID NO: 3886676 - DNA, 21 bp, Homo sapiens
tggcccttcctggacagctgt

SEQ ID NO: 3886677 - DNA, 18 bp, Homo sapiens
tggccgccatccgggacg

SEQ ID NO: 3886678 - DNA, 19 bp, Homo sapiens
tggccggcccaggcctcca

SEQ ID NO: 3886679 - DNA, 15 bp, Homo sapiens
tgctgtgtctgcacc

SEQ ID NO: 3886680 - DNA, 15 bp, Homo sapiens
tgctgttgccatagc

SEQ ID NO: 3886681 - DNA, 15 bp, Homo sapiens
tgctgttgctggact

SEQ ID NO: 3886682 - DNA, 23 bp, Homo sapiens
tgcttaaaatatgtatgtctaat

SEQ ID NO: 3886683 - DNA, 15 bp, Homo sapiens
tgcttaaaattttac

SEQ ID NO: 3886684 - DNA, 14 bp, Homo sapiens
tgcttaactggctg

SEQ ID NO: 3886685 - DNA, 16 bp, Homo sapiens
tgcttacagtgactgt

SEQ ID NO: 3886686 - DNA, 15 bp, Homo sapiens
tgcttacccttcacc

SEQ ID NO: 3886687 - DNA, 18 bp, Homo sapiens
tgcttacccttcaccttt

SEQ ID NO: 3886688 - DNA, 15 bp, Homo sapiens
tgcttagcctcctga

SEQ ID NO: 3886689 - DNA, 21 bp, Homo sapiens
tgcttagtatggttctcagat

SEQ ID NO: 3886690 - DNA, 19 bp, Homo sapiens
tgcttcaaatccatccaga

SEQ ID NO: 3886691 - DNA, 17 bp, Homo sapiens
tgcttcatgctcagccc

SEQ ID NO: 3886692 - DNA, 20 bp, Homo sapiens
tgcttccctaggctgagctg

SEQ ID NO: 3886693 - DNA, 14 bp, Homo sapiens
tgcttctcatcccc

SEQ ID NO: 3886694 - DNA, 16 bp, Homo sapiens
tgcttctccctggctg

SEQ ID NO: 3886695 - DNA, 13 bp, Homo sapiens
tgcttctgcagca

SEQ ID NO: 3886696 - DNA, 21 bp, Homo sapiens
tgcttctgcagcaactcccac

SEQ ID NO: 3886697 - DNA, 20 bp, Homo sapiens
tgcttctggctcctccttcc

SEQ ID NO: 3886698 - DNA, 15 bp, Homo sapiens
tgcttctgtccagga

SEQ ID NO: 3886699 - DNA, 16 bp, Homo sapiens
tgcttcttcatcttga

SEQ ID NO: 3886700 - DNA, 18 bp, Homo sapiens
tgcttcttcatcttgaca

SEQ ID NO: 3886701 - DNA, 20 bp, Homo sapiens
tgcttgactatcacatacaa

SEQ ID NO: 3886702 - DNA, 21 bp, Homo sapiens
tgcttgactatcacatacaat

SEQ ID NO: 3886703 - DNA, 22 bp, Homo sapiens
tgcttgcactttgtaacatgtt

SEQ ID NO: 3886704 - DNA, 20 bp, Homo sapiens
tgcttgccgagcctaatgaa

SEQ ID NO: 3886705 - DNA, 15 bp, Homo sapiens
tgcttggtggggctc

SEQ ID NO: 3886706 - DNA, 20 bp, Homo sapiens
tgcttggtggggctcgtggc

SEQ ID NO: 3886707 - DNA, 18 bp, Homo sapiens
tgcttggttggctggcag

SEQ ID NO: 3886708 - DNA, 22 bp, Homo sapiens
tgcttgtcctgctctcttcagg

SEQ ID NO: 3886709 - DNA, 21 bp, Homo sapiens
tgctttaaagtacctgtagtg

SEQ ID NO: 3886710 - DNA, 23 bp, Homo sapiens
tgctttaaagtgtaataatatga

SEQ ID NO: 3886711 - DNA, 13 bp, Homo sapiens
tgctttaccttta

SEQ ID NO: 3886712 - DNA, 15 bp, Homo sapiens
tgctttacctttaaa

SEQ ID NO: 3886713 - DNA, 13 bp, Homo sapiens
tgctttcaggtct

SEQ ID NO: 3886714 - DNA, 18 bp, Homo sapiens
tgctttccagcctgggca

SEQ ID NO: 3886715 - DNA, 21 bp, Homo sapiens
tgctttcctaaagtctctgct

SEQ ID NO: 3886716 - DNA, 12 bp, Homo sapiens
tgctttgctgtt

SEQ ID NO: 3886717 - DNA, 14 bp, Homo sapiens
tgctttgcttttta

SEQ ID NO: 3886718 - DNA, 17 bp, Homo sapiens
tgctttgggaggccaag

SEQ ID NO: 3886719 - DNA, 14 bp, Homo sapiens
tgctttgggctgcc

SEQ ID NO: 3886720 - DNA, 15 bp, Homo sapiens
tgctttgggctgccc

SEQ ID NO: 3886721 - DNA, 18 bp, Homo sapiens
tgctttgggctgccctgg

SEQ ID NO: 3886722 - DNA, 20 bp, Homo sapiens
tgctttgggctgccctggtg

SEQ ID NO: 3886723 - DNA, 21 bp, Homo sapiens
tgctttgggctgccctggtgc

SEQ ID NO: 3886724 - DNA, 18 bp, Homo sapiens
tgctttgggctttgcagg

SEQ ID NO: 3886725 - DNA, 22 bp, Homo sapiens
tgctttgggctttgcaggctct

SEQ ID NO: 3886726 - DNA, 23 bp, Homo sapiens
tgctttgggctttgcaggctctg

SEQ ID NO: 3886727 - DNA, 17 bp, Homo sapiens
tgcttttaaaaaaaaat

SEQ ID NO: 3886728 - DNA, 12 bp, Homo sapiens
tgcttttgatgt

SEQ ID NO: 3886729 - DNA, 20 bp, Homo sapiens
tgcttttgatgtgaaaatca

SEQ ID NO: 3886730 - DNA, 19 bp, Homo sapiens
tgcttttgttgtgactttt

SEQ ID NO: 3886731 - DNA, 17 bp, Homo sapiens
tgctttttaagtgttaa

SEQ ID NO: 3886732 - DNA, 21 bp, Homo sapiens
tggaaaaaagagaaaaaccaa

SEQ ID NO: 3886733 - DNA, 23 bp, Homo sapiens
tggaaaaaagagaaaaaccaatg

SEQ ID NO: 3886734 - DNA, 18 bp, Homo sapiens
tggaaaaatccagaaaga

SEQ ID NO: 3886735 - DNA, 23 bp, Homo sapiens
tggaaaagaatccctgcagcctg

SEQ ID NO: 3886736 - DNA, 14 bp, Homo sapiens
tggaaaagcccagt

SEQ ID NO: 3886737 - DNA, 15 bp, Homo sapiens
tggaaaagcccagtg

SEQ ID NO: 3886738 - DNA, 15 bp, Homo sapiens
tggaaaataaatttt

SEQ ID NO: 3886739 - DNA, 15 bp, Homo sapiens
tggaaacagggcagt

SEQ ID NO: 3886740 - DNA, 17 bp, Homo sapiens
tggaaacagggcagtga

SEQ ID NO: 3886741 - DNA, 21 bp, Homo sapiens
tggaaaccacacttcttgaaa

SEQ ID NO: 3886742 - DNA, 15 bp, Homo sapiens
tggaaacctgaaaaa

SEQ ID NO: 3886743 - DNA, 16 bp, Homo sapiens
tggaaagaatctaata

SEQ ID NO: 3886744 - DNA, 22 bp, Homo sapiens
tggaaagacgtttttgtgctgt

SEQ ID NO: 3886745 - DNA, 20 bp, Homo sapiens
tggaaagactgattgtttta

SEQ ID NO: 3886746 - DNA, 13 bp, Homo sapiens
tggaaagagacca

SEQ ID NO: 3886747 - DNA, 12 bp, Homo sapiens
tggaaagcaaag

SEQ ID NO: 3886748 - DNA, 17 bp, Homo sapiens
tggaaaggggagttgag

SEQ ID NO: 3886749 - DNA, 22 bp, Homo sapiens
tggaaaggtttcaagacttgat

SEQ ID NO: 3886750 - DNA, 17 bp, Homo sapiens
tggaaagttcagccaga

SEQ ID NO: 3886751 - DNA, 17 bp, Homo sapiens
tggaaataaacctggag

SEQ ID NO: 3886752 - DNA, 19 bp, Homo sapiens
tggaaataaacctggagat

SEQ ID NO: 3886753 - DNA, 22 bp, Homo sapiens
tggaaataaacctggagatgat

SEQ ID NO: 3886754 - DNA, 15 bp, Homo sapiens
tggaaataaatgtat

SEQ ID NO: 3886755 - DNA, 21 bp, Homo sapiens
tggaaattcaggtgaaaatgt

SEQ ID NO: 3886756 - DNA, 21 bp, Homo sapiens
tggaacagtcacccttctggg

SEQ ID NO: 3886757 - DNA, 21 bp, Homo sapiens
tggaacataaaatacaatgtt

SEQ ID NO: 3886758 - DNA, 11 bp, Homo sapiens
tggaaccaatc

SEQ ID NO: 3886759 - DNA, 21 bp, Homo sapiens
tggaaccagggaggagaggaa

SEQ ID NO: 3886760 - DNA, 17 bp, Homo sapiens
tggaaccttccctccaa

SEQ ID NO: 3886761 - DNA, 21 bp, Homo sapiens
tggaactgaagggggcggcct

SEQ ID NO: 3886762 - DNA, 21 bp, Homo sapiens
tggaactgaccccctcccctg

SEQ ID NO: 3886763 - DNA, 18 bp, Homo sapiens
tggaagacaaaatgtttt

SEQ ID NO: 3886764 - DNA, 14 bp, Homo sapiens
tggaagagaaatct

SEQ ID NO: 3886765 - DNA, 18 bp, Homo sapiens
tggaagagaggcacctgc

SEQ ID NO: 3886766 - DNA, 19 bp, Homo sapiens
tggaagagaggcacctgct

SEQ ID NO: 3886767 - DNA, 21 bp, Homo sapiens
tggaagagaggcacctgctgg

SEQ ID NO: 3886768 - DNA, 17 bp, Homo sapiens
tggaagagcagcctgat

SEQ ID NO: 3886769 - DNA, 17 bp, Homo sapiens
tggaagcatgtaggaga

SEQ ID NO: 3886770 - DNA, 22 bp, Homo sapiens
tggaagcatgtaggagaatcca

SEQ ID NO: 3886771 - DNA, 12 bp, Homo sapiens
tggaagccctcc

SEQ ID NO: 3886772 - DNA, 13 bp, Homo sapiens
tggaagccctcct

SEQ ID NO: 3886773 - DNA, 15 bp, Homo sapiens
tggaagcctggactc

SEQ ID NO: 3886774 - DNA, 16 bp, Homo sapiens
tggaagctgagcaggc

SEQ ID NO: 3886775 - DNA, 15 bp, Homo sapiens
tggaagctgtgtcct

SEQ ID NO: 3886776 - DNA, 16 bp, Homo sapiens
tggaagctgtgtcctt

SEQ ID NO: 3886777 - DNA, 14 bp, Homo sapiens
tggaaggcagggca

SEQ ID NO: 3886778 - DNA, 13 bp, Homo sapiens
tggaaggctggct

SEQ ID NO: 3886779 - DNA, 15 bp, Homo sapiens
tggaaggctggctga

SEQ ID NO: 3886780 - DNA, 13 bp, Homo sapiens
tggaagggagggg

SEQ ID NO: 3886781 - DNA, 18 bp, Homo sapiens
tggaagggggtgtgcgtg

SEQ ID NO: 3886782 - DNA, 21 bp, Homo sapiens
tggaaggtttgtatattgtca

SEQ ID NO: 3886783 - DNA, 19 bp, Homo sapiens
tggaagtgtgtggaaggca

SEQ ID NO: 3886784 - DNA, 14 bp, Homo sapiens
tggaatacatgaaa

SEQ ID NO: 3886785 - DNA, 22 bp, Homo sapiens
tggaatactaaaaatcatgaga

SEQ ID NO: 3886786 - DNA, 19 bp, Homo sapiens
tggaatcaaggaatcctga

SEQ ID NO: 3886787 - DNA, 18 bp, Homo sapiens
tggaatcaatttcccaga

SEQ ID NO: 3886788 - DNA, 23 bp, Homo sapiens
tggaatcagcttttaataaaatt

SEQ ID NO: 3886789 - DNA, 18 bp, Homo sapiens
tggaatcgatctgtactg

SEQ ID NO: 3886790 - DNA, 22 bp, Homo sapiens
tggaatcgatctgtactgtaat

SEQ ID NO: 3886791 - DNA, 18 bp, Homo sapiens
tggaatgaattaaataaa

SEQ ID NO: 3886792 - DNA, 19 bp, Homo sapiens
tggaatgactataaacatt

SEQ ID NO: 3886793 - DNA, 18 bp, Homo sapiens
tggaatgcagggaagagg

SEQ ID NO: 3886794 - DNA, 13 bp, Homo sapiens
tggaattcagcac

SEQ ID NO: 3886795 - DNA, 20 bp, Homo sapiens
tggaattcagcaccctgggt

SEQ ID NO: 3886796 - DNA, 21 bp, Homo sapiens
tggaattctaaatgctggtct

SEQ ID NO: 3886797 - DNA, 14 bp, Homo sapiens
tggacaaaatggaa

SEQ ID NO: 3886798 - DNA, 13 bp, Homo sapiens
tggacaacccaga

SEQ ID NO: 3886799 - DNA, 16 bp, Homo sapiens
tggacaaggaggtctg

SEQ ID NO: 3886800 - DNA, 20 bp, Homo sapiens
tggacacattttctcctagg

SEQ ID NO: 3886801 - DNA, 11 bp, Homo sapiens
tggacacctgc

SEQ ID NO: 3886802 - DNA, 12 bp, Homo sapiens
tggacacctgcc

SEQ ID NO: 3886803 - DNA, 13 bp, Homo sapiens
tggacacctgccc

SEQ ID NO: 3886804 - DNA, 16 bp, Homo sapiens
tggacacctgccctgc

SEQ ID NO: 3886805 - DNA, 18 bp, Homo sapiens
tggacacctgccctgccc

SEQ ID NO: 3886806 - DNA, 12 bp, Homo sapiens
tggacagaagat

SEQ ID NO: 3886807 - DNA, 14 bp, Homo sapiens
tggacagaggggca

SEQ ID NO: 3886808 - DNA, 12 bp, Homo sapiens
tggacagctgct

SEQ ID NO: 3886809 - DNA, 13 bp, Homo sapiens
tggacagctgctt

SEQ ID NO: 3886810 - DNA, 14 bp, Homo sapiens
tggacagctgtgcc

SEQ ID NO: 3886811 - DNA, 18 bp, Homo sapiens
tggacagctgtgcctcgc

SEQ ID NO: 3886812 - DNA, 19 bp, Homo sapiens
tggacagctgtgcctcgct

SEQ ID NO: 3886813 - DNA, 16 bp, Homo sapiens
tggacatggtctcctc

SEQ ID NO: 3886814 - DNA, 19 bp, Homo sapiens
tggacatttgccttgctgg

SEQ ID NO: 3886815 - DNA, 14 bp, Homo sapiens
tggaccccgcctcc

SEQ ID NO: 3886816 - DNA, 19 bp, Homo sapiens
tggacccgctctggaccaa

SEQ ID NO: 3886817 - DNA, 17 bp, Homo sapiens
tggaccctcgcagcagg

SEQ ID NO: 3886818 - DNA, 17 bp, Homo sapiens
tggaccgcttcccagag

SEQ ID NO: 3886819 - DNA, 14 bp, Homo sapiens
tggaccgggtgggc

SEQ ID NO: 3886820 - DNA, 13 bp, Homo sapiens
tggacctctgctc

SEQ ID NO: 3886821 - DNA, 16 bp, Homo sapiens
tggacctctgctctga

SEQ ID NO: 3886822 - DNA, 17 bp, Homo sapiens
tggacctctgctctgag

SEQ ID NO: 3886823 - DNA, 16 bp, Homo sapiens
tggaccttttgtctca

SEQ ID NO: 3886824 - DNA, 13 bp, Homo sapiens
tggactcctccca

SEQ ID NO: 3886825 - DNA, 19 bp, Homo sapiens
tggactctaagctggagct

SEQ ID NO: 3886826 - DNA, 21 bp, Homo sapiens
tggactgactaccagctaact

SEQ ID NO: 3886827 - DNA, 13 bp, Homo sapiens
tggactgggaggt

SEQ ID NO: 3886828 - DNA, 19 bp, Homo sapiens
tggagaaattatttaataa

SEQ ID NO: 3886829 - DNA, 20 bp, Homo sapiens
tggagaactagaacctggag

SEQ ID NO: 3886830 - DNA, 12 bp, Homo sapiens
tggagaaggaag

SEQ ID NO: 3886831 - DNA, 16 bp, Homo sapiens
tggagagcagctggct

SEQ ID NO: 3886832 - DNA, 19 bp, Homo sapiens
tggagagccagaacctgga

SEQ ID NO: 3886833 - DNA, 13 bp, Homo sapiens
tggagagccctgg

SEQ ID NO: 3886834 - DNA, 14 bp, Homo sapiens
tggagagccctggg

SEQ ID NO: 3886835 - DNA, 15 bp, Homo sapiens
tggagagccctggga

SEQ ID NO: 3886836 - DNA, 16 bp, Homo sapiens
tggagagccctgggac

SEQ ID NO: 3886837 - DNA, 18 bp, Homo sapiens
tggagagctagaacctgg

SEQ ID NO: 3886838 - DNA, 21 bp, Homo sapiens
tggagagctagaacctggaga

SEQ ID NO: 3886839 - DNA, 14 bp, Homo sapiens
tggagagctaggag

SEQ ID NO: 3886840 - DNA, 22 bp, Homo sapiens
tggagagctaggagcaaagcct

SEQ ID NO: 3886841 - DNA, 13 bp, Homo sapiens
tggagaggggcct

SEQ ID NO: 3886842 - DNA, 21 bp, Homo sapiens
tggagaggggcctgggaaagg

SEQ ID NO: 3886843 - DNA, 15 bp, Homo sapiens
tggagagtaaaaact

SEQ ID NO: 3886844 - DNA, 17 bp, Homo sapiens
tggagagtgttcctgtt

SEQ ID NO: 3886845 - DNA, 11 bp, Homo sapiens
tggagatgatg

SEQ ID NO: 3886846 - DNA, 12 bp, Homo sapiens
tggagatgatga

SEQ ID NO: 3886847 - DNA, 13 bp, Homo sapiens
tggagatgcagag

SEQ ID NO: 3886848 - DNA, 22 bp, Homo sapiens
tggagcaagaaggaaggaggca

SEQ ID NO: 3886849 - DNA, 17 bp, Homo sapiens
tggagcaccaggcacga

SEQ ID NO: 3886850 - DNA, 14 bp, Homo sapiens
tggagcagaatcag

SEQ ID NO: 3886851 - DNA, 21 bp, Homo sapiens
tgcctttctctggctccagaa

SEQ ID NO: 3886852 - DNA, 13 bp, Homo sapiens
tgcctttgcctct

SEQ ID NO: 3886853 - DNA, 16 bp, Homo sapiens
tgccttttaaaagaaa

SEQ ID NO: 3886854 - DNA, 13 bp, Homo sapiens
tgccttttatagc

SEQ ID NO: 3886855 - DNA, 17 bp, Homo sapiens
tgccttttgctgctgct

SEQ ID NO: 3886856 - DNA, 23 bp, Homo sapiens
tgccttttgctgctgctgctgcg

SEQ ID NO: 3886857 - DNA, 13 bp, Homo sapiens
tgcgaatgtgcag

SEQ ID NO: 3886858 - DNA, 19 bp, Homo sapiens
tgcgcaacaacaaggaccc

SEQ ID NO: 3886859 - DNA, 12 bp, Homo sapiens
tgcgctcttggt

SEQ ID NO: 3886860 - DNA, 17 bp, Homo sapiens
tgcgctcttggtccctg

SEQ ID NO: 3886861 - DNA, 21 bp, Homo sapiens
tgcgctcttggtccctggtcc

SEQ ID NO: 3886862 - DNA, 13 bp, Homo sapiens
tgcggcaggagca

SEQ ID NO: 3886863 - DNA, 15 bp, Homo sapiens
tgcggcaggagcagg

SEQ ID NO: 3886864 - DNA, 18 bp, Homo sapiens
tgcggcaggagcaggaac

SEQ ID NO: 3886865 - DNA, 19 bp, Homo sapiens
tgcggccgcattccctgag

SEQ ID NO: 3886866 - DNA, 21 bp, Homo sapiens
tgcgggaccggtacagaaagg

SEQ ID NO: 3886867 - DNA, 23 bp, Homo sapiens
tgcgtatatgtgcgtctctcttt

SEQ ID NO: 3886868 - DNA, 13 bp, Homo sapiens
tgcgtcctgcaga

SEQ ID NO: 3886869 - DNA, 19 bp, Homo sapiens
tgcgtcctgcagaggacca

SEQ ID NO: 3886870 - DNA, 17 bp, Homo sapiens
tgcgtctctctttctcc

SEQ ID NO: 3886871 - DNA, 21 bp, Homo sapiens
tgcgtctctctttctccctca

SEQ ID NO: 3886872 - DNA, 23 bp, Homo sapiens
tgcgtgccgggagaggactctgc

SEQ ID NO: 3886873 - DNA, 15 bp, Homo sapiens
tgcgtggctgtggca

SEQ ID NO: 3886874 - DNA, 16 bp, Homo sapiens
tgcgtggctgtggcac

SEQ ID NO: 3886875 - DNA, 18 bp, Homo sapiens
tgcgtgtgtgtgtgtttg

SEQ ID NO: 3886876 - DNA, 20 bp, Homo sapiens
tgcgtgttagtgtgtgtgca

SEQ ID NO: 3886877 - DNA, 22 bp, Homo sapiens
tgcgtgttagtgtgtgtgcatg

SEQ ID NO: 3886878 - DNA, 13 bp, Homo sapiens
tgcgttggagcca

SEQ ID NO: 3886879 - DNA, 16 bp, Homo sapiens
tgcgttggagccactc

SEQ ID NO: 3886880 - DNA, 21 bp, Homo sapiens
tgctaaatactgtacatagat

SEQ ID NO: 3886881 - DNA, 19 bp, Homo sapiens
tgctaaatgcaaacactgt

SEQ ID NO: 3886882 - DNA, 22 bp, Homo sapiens
tgctaatcttcttatgcaattt

SEQ ID NO: 3886883 - DNA, 16 bp, Homo sapiens
tgctacaaaaacacag

SEQ ID NO: 3886884 - DNA, 15 bp, Homo sapiens
tgctacaataaatgc

SEQ ID NO: 3886885 - DNA, 19 bp, Homo sapiens
tgctacaataaatgctgaa

SEQ ID NO: 3886886 - DNA, 21 bp, Homo sapiens
tgctactacccgagcccagct

SEQ ID NO: 3886887 - DNA, 17 bp, Homo sapiens
tgctactcctgtgctct

SEQ ID NO: 3886888 - DNA, 13 bp, Homo sapiens
tgctactttgcct

SEQ ID NO: 3886889 - DNA, 19 bp, Homo sapiens
tgctagatgtgcaaatgca

SEQ ID NO: 3886890 - DNA, 20 bp, Homo sapiens
tgctagatgtgcaaatgcaa

SEQ ID NO: 3886891 - DNA, 13 bp, Homo sapiens
tgctagctgtaga

SEQ ID NO: 3886892 - DNA, 19 bp, Homo sapiens
tgctaggcgagtgccagga

SEQ ID NO: 3886893 - DNA, 23 bp, Homo sapiens
tgctagtactggggagaaataat

SEQ ID NO: 3886894 - DNA, 19 bp, Homo sapiens
tgctataggctggagaagc

SEQ ID NO: 3886895 - DNA, 17 bp, Homo sapiens
tgctatatatataaata

SEQ ID NO: 3886896 - DNA, 22 bp, Homo sapiens
tgctatattttcatgacttttc

SEQ ID NO: 3886897 - DNA, 20 bp, Homo sapiens
tgctatcaaaataaattgaa

SEQ ID NO: 3886898 - DNA, 22 bp, Homo sapiens
tgctatcgcaccactgtgtatt

SEQ ID NO: 3886899 - DNA, 16 bp, Homo sapiens
tgctatctctgtgtgc

SEQ ID NO: 3886900 - DNA, 15 bp, Homo sapiens
tgctattatgtaaca

SEQ ID NO: 3886901 - DNA, 14 bp, Homo sapiens
tgctattctgtgtt

SEQ ID NO: 3886902 - DNA, 15 bp, Homo sapiens
tgctattgaactgag

SEQ ID NO: 3886903 - DNA, 18 bp, Homo sapiens
tgctatttctggcctcag

SEQ ID NO: 3886904 - DNA, 19 bp, Homo sapiens
tgctatttctggcctcagc

SEQ ID NO: 3886905 - DNA, 21 bp, Homo sapiens
tgctatttctggcctcagcag

SEQ ID NO: 3886906 - DNA, 24 bp, Homo sapiens
tgctatttgagcatgcacagctgc

SEQ ID NO: 3886907 - DNA, 22 bp, Homo sapiens
tgctatttgttgtttttaacaa

SEQ ID NO: 3886908 - DNA, 19 bp, Homo sapiens
tgctattttatttgtattc

SEQ ID NO: 3886909 - DNA, 15 bp, Homo sapiens
tgctcaagaagacat

SEQ ID NO: 3886910 - DNA, 19 bp, Homo sapiens
tgctcaccaagctgttcca

SEQ ID NO: 3886911 - DNA, 14 bp, Homo sapiens
tgctcactcaggac

SEQ ID NO: 3886912 - DNA, 14 bp, Homo sapiens
tgctcactgttcta

SEQ ID NO: 3886913 - DNA, 17 bp, Homo sapiens
tgctcagccctgactgg

SEQ ID NO: 3886914 - DNA, 19 bp, Homo sapiens
tgctcaggcttgaaatgca

SEQ ID NO: 3886915 - DNA, 14 bp, Homo sapiens
tgctcagtgcctcc

SEQ ID NO: 3886916 - DNA, 16 bp, Homo sapiens
tgctcagtgcctcctg

SEQ ID NO: 3886917 - DNA, 14 bp, Homo sapiens
tgctcatcacccag

SEQ ID NO: 3886918 - DNA, 19 bp, Homo sapiens
tgctcatcacccagtcctg

SEQ ID NO: 3886919 - DNA, 22 bp, Homo sapiens
tgctcatcattccttgagaaaa

SEQ ID NO: 3886920 - DNA, 19 bp, Homo sapiens
tgctccagggtcttgggct

SEQ ID NO: 3886921 - DNA, 20 bp, Homo sapiens
tgctcccagcagccctaagg

SEQ ID NO: 3886922 - DNA, 21 bp, Homo sapiens
tgctcccagcagccctaagga

SEQ ID NO: 3886923 - DNA, 16 bp, Homo sapiens
tgctcccatctcctga

SEQ ID NO: 3886924 - DNA, 17 bp, Homo sapiens
tgctccccagccctggc

SEQ ID NO: 3886925 - DNA, 11 bp, Homo sapiens
tgctcctccag

SEQ ID NO: 3886926 - DNA, 16 bp, Homo sapiens
tgctcctccagggcca

SEQ ID NO: 3886927 - DNA, 21 bp, Homo sapiens
tgctcctccagggccacgtgc

SEQ ID NO: 3886928 - DNA, 15 bp, Homo sapiens
tgctctagccaggag

SEQ ID NO: 3886929 - DNA, 16 bp, Homo sapiens
tgctctagccaggagt

SEQ ID NO: 3886930 - DNA, 19 bp, Homo sapiens
tgctctagccaggagtctg

SEQ ID NO: 3886931 - DNA, 17 bp, Homo sapiens
tgctctagctggcagga

SEQ ID NO: 3886932 - DNA, 19 bp, Homo sapiens
tgctctagctggcaggaca

SEQ ID NO: 3886933 - DNA, 15 bp, Homo sapiens
tgctctagtcttgct

SEQ ID NO: 3886934 - DNA, 12 bp, Homo sapiens
tgctctcccctg

SEQ ID NO: 3886935 - DNA, 17 bp, Homo sapiens
tgctctcccctgccctg

SEQ ID NO: 3886936 - DNA, 12 bp, Homo sapiens
tgctctcctctt

SEQ ID NO: 3886937 - DNA, 22 bp, Homo sapiens
tgctctcctcttgccactgcct

SEQ ID NO: 3886938 - DNA, 12 bp, Homo sapiens
tgctctcttcag

SEQ ID NO: 3886939 - DNA, 15 bp, Homo sapiens
tgctctcttcaggag

SEQ ID NO: 3886940 - DNA, 20 bp, Homo sapiens
tgctctgcaggcaccttagt

SEQ ID NO: 3886941 - DNA, 16 bp, Homo sapiens
tgctctgccccaagcc

SEQ ID NO: 3886942 - DNA, 12 bp, Homo sapiens
tgctctgcccct

SEQ ID NO: 3886943 - DNA, 15 bp, Homo sapiens
tgctctggaggctgc

SEQ ID NO: 3886944 - DNA, 16 bp, Homo sapiens
tgctctggcggcttcc

SEQ ID NO: 3886945 - DNA, 18 bp, Homo sapiens
tgctctggcggcttcctg

SEQ ID NO: 3886946 - DNA, 22 bp, Homo sapiens
tgctctggcggcttcctgtcca

SEQ ID NO: 3886947 - DNA, 18 bp, Homo sapiens
tgctcttagctgtctgct

SEQ ID NO: 3886948 - DNA, 13 bp, Homo sapiens
tgctcttcagtgg

SEQ ID NO: 3886949 - DNA, 15 bp, Homo sapiens
tgctcttctgttctc

SEQ ID NO: 3886950 - DNA, 20 bp, Homo sapiens
tgctcttttggtggggagca

SEQ ID NO: 3886951 - DNA, 17 bp, Homo sapiens
tgctgaaacaacaaata

SEQ ID NO: 3886952 - DNA, 23 bp, Homo sapiens
tgctgaaggaataaattgctcct

SEQ ID NO: 3886953 - DNA, 13 bp, Homo sapiens
tgctgaagggacc

SEQ ID NO: 3886954 - DNA, 22 bp, Homo sapiens
tgctgaagggaccttgaagggt

SEQ ID NO: 3886955 - DNA, 13 bp, Homo sapiens
tgctgaatgaatc

SEQ ID NO: 3886956 - DNA, 17 bp, Homo sapiens
tgctgaatttcaggcat

SEQ ID NO: 3886957 - DNA, 22 bp, Homo sapiens
tgctgactccatatggaggcct

SEQ ID NO: 3886958 - DNA, 17 bp, Homo sapiens
tgctgagaacctggcct

SEQ ID NO: 3886959 - DNA, 20 bp, Homo sapiens
tgctgagaacctggccttca

SEQ ID NO: 3886960 - DNA, 21 bp, Homo sapiens
tgctgagaacctggccttcag

SEQ ID NO: 3886961 - DNA, 15 bp, Homo sapiens
tgctgagagacccaa

SEQ ID NO: 3886962 - DNA, 19 bp, Homo sapiens
tgctgagcaccctctccgg

SEQ ID NO: 3886963 - DNA, 12 bp, Homo sapiens
tgctgagccact

SEQ ID NO: 3886964 - DNA, 22 bp, Homo sapiens
tgctgagctctgagaggccctg

SEQ ID NO: 3886965 - DNA, 14 bp, Homo sapiens
tgctgagcttagcc

SEQ ID NO: 3886966 - DNA, 23 bp, Homo sapiens
tgctgagcttagccttgtgccct

SEQ ID NO: 3886967 - DNA, 18 bp, Homo sapiens
tgctgaggactccctcca

SEQ ID NO: 3886968 - DNA, 17 bp, Homo sapiens
tgctgatcaatgaaatg

SEQ ID NO: 3886969 - DNA, 14 bp, Homo sapiens
tgctgcaaagtgca

SEQ ID NO: 3886970 - DNA, 17 bp, Homo sapiens
tgctgcaaagtgcaaat

SEQ ID NO: 3886971 - DNA, 15 bp, Homo sapiens
tgctgccacacttca

SEQ ID NO: 3886972 - DNA, 12 bp, Homo sapiens
tgctgccatgcc

SEQ ID NO: 3886973 - DNA, 16 bp, Homo sapiens
tgctgccatgccactg

SEQ ID NO: 3886974 - DNA, 20 bp, Homo sapiens
tgctgccccgttccctgtca

SEQ ID NO: 3886975 - DNA, 16 bp, Homo sapiens
tgctgccgcctcccag

SEQ ID NO: 3886976 - DNA, 17 bp, Homo sapiens
tgctgccgcctcccagc

SEQ ID NO: 3886977 - DNA, 19 bp, Homo sapiens
tgctgccgcctcccagcct

SEQ ID NO: 3886978 - DNA, 21 bp, Homo sapiens
tgctgccgcctcccagcctgg

SEQ ID NO: 3886979 - DNA, 16 bp, Homo sapiens
tgctgcctccctctgc

SEQ ID NO: 3886980 - DNA, 13 bp, Homo sapiens
tgctgctactacc

SEQ ID NO: 3886981 - DNA, 22 bp, Homo sapiens
tgctgctgacctgatcacctct

SEQ ID NO: 3886982 - DNA, 21 bp, Homo sapiens
tgctgctgagaacctggcctt

SEQ ID NO: 3886983 - DNA, 15 bp, Homo sapiens
tgctgctgctgctgc

SEQ ID NO: 3886984 - DNA, 9 bp, Homo sapiens
tgctgctgt

SEQ ID NO: 3886985 - DNA, 19 bp, Homo sapiens
tgctgctgtaactgctgag

SEQ ID NO: 3886986 - DNA, 24 bp, Homo sapiens
tgctgctgtaactgctgagccact

SEQ ID NO: 3886987 - DNA, 14 bp, Homo sapiens
tgctgctgtgtttt

SEQ ID NO: 3886988 - DNA, 16 bp, Homo sapiens
tgctgcttctcttggg

SEQ ID NO: 3886989 - DNA, 18 bp, Homo sapiens
tgctgctttttggcacag

SEQ ID NO: 3886990 - DNA, 17 bp, Homo sapiens
tgctggaaaccacactt

SEQ ID NO: 3886991 - DNA, 20 bp, Homo sapiens
tgctggacggggactgggga

SEQ ID NO: 3886992 - DNA, 21 bp, Homo sapiens
tgctggacggggactggggat

SEQ ID NO: 3886993 - DNA, 15 bp, Homo sapiens
tgctggactgtcata

SEQ ID NO: 3886994 - DNA, 22 bp, Homo sapiens
tgctggagacagtagaggcatg

SEQ ID NO: 3886995 - DNA, 16 bp, Homo sapiens
tgctggattaatgttt

SEQ ID NO: 3886996 - DNA, 12 bp, Homo sapiens
tgctggcacctc

SEQ ID NO: 3886997 - DNA, 12 bp, Homo sapiens
tgctggccagca

SEQ ID NO: 3886998 - DNA, 17 bp, Homo sapiens
tgctggccagcaccctc

SEQ ID NO: 3886999 - DNA, 18 bp, Homo sapiens
tgctggccagcaccctct

SEQ ID NO: 3887000 - DNA, 22 bp, Homo sapiens
tgctggccagcaccctctcctg

SEQ ID NO: 3887001 - DNA, 23 bp, Homo sapiens
tgctggcctcccaataaagctgg

SEQ ID NO: 3887002 - DNA, 12 bp, Homo sapiens
tgctggcctgga

SEQ ID NO: 3887003 - DNA, 16 bp, Homo sapiens
tgctggcctggatctc

SEQ ID NO: 3887004 - DNA, 13 bp, Homo sapiens
tgctggctgcctt

SEQ ID NO: 3887005 - DNA, 15 bp, Homo sapiens
tgctggctgccttag

SEQ ID NO: 3887006 - DNA, 21 bp, Homo sapiens
tgctggctgccttagaacctt

SEQ ID NO: 3887007 - DNA, 22 bp, Homo sapiens
tgctgggaccccagctagggct

SEQ ID NO: 3887008 - DNA, 20 bp, Homo sapiens
tgctgggctctccacctcag

SEQ ID NO: 3887009 - DNA, 23 bp, Homo sapiens
tgctgggctctccacctcagcct

SEQ ID NO: 3887010 - DNA, 22 bp, Homo sapiens
tgctgggcttgtagaccactgt

SEQ ID NO: 3887011 - DNA, 12 bp, Homo sapiens
tgctggggcatg

SEQ ID NO: 3887012 - DNA, 20 bp, Homo sapiens
tgctggggcatgtgtgcctg

SEQ ID NO: 3887013 - DNA, 22 bp, Homo sapiens
tgctggggcatgtgtgcctgtg

SEQ ID NO: 3887014 - DNA, 17 bp, Homo sapiens
tgctggtgtcattgctg

SEQ ID NO: 3887015 - DNA, 21 bp, Homo sapiens
tgctgtaactcagacattcca

SEQ ID NO: 3887016 - DNA, 20 bp, Homo sapiens
tgctgtaactgctgagccac

SEQ ID NO: 3887017 - DNA, 20 bp, Homo sapiens
tgctgtacccttccacctcc

SEQ ID NO: 3887018 - DNA, 22 bp, Homo sapiens
tgctgtgaatagtctgtgtgca

SEQ ID NO: 3887019 - DNA, 12 bp, Homo sapiens
tgctgtggcctc

SEQ ID NO: 3887020 - DNA, 14 bp, Homo sapiens
tgctgtggcctcac

SEQ ID NO: 3887021 - DNA, 23 bp, Homo sapiens
tgctgtggcctcacttccctggg

SEQ ID NO: 3887022 - DNA, 11 bp, Homo sapiens
tgctgtgggca

SEQ ID NO: 3887023 - DNA, 18 bp, Homo sapiens
tgatcgagccactgcact

SEQ ID NO: 3887024 - DNA, 20 bp, Homo sapiens
tgatcgggataacaaaatca

SEQ ID NO: 3887025 - DNA, 13 bp, Homo sapiens
tgatctccctgcc

SEQ ID NO: 3887026 - DNA, 22 bp, Homo sapiens
tgatctgtatatacaataacat

SEQ ID NO: 3887027 - DNA, 23 bp, Homo sapiens
tgatctgtatttaatggttttta

SEQ ID NO: 3887028 - DNA, 13 bp, Homo sapiens
tgatctgtcccct

SEQ ID NO: 3887029 - DNA, 18 bp, Homo sapiens
tgatcttgagatttcttt

SEQ ID NO: 3887030 - DNA, 15 bp, Homo sapiens
tgatcttttcagtgt

SEQ ID NO: 3887031 - DNA, 16 bp, Homo sapiens
tgatcttttcagtgtt

SEQ ID NO: 3887032 - DNA, 15 bp, Homo sapiens
tgatgaaaataataa

SEQ ID NO: 3887033 - DNA, 22 bp, Homo sapiens
tgatgaaactcctgattttgta

SEQ ID NO: 3887034 - DNA, 23 bp, Homo sapiens
tgatgaactttctcttcatactt

SEQ ID NO: 3887035 - DNA, 14 bp, Homo sapiens
tgatgaagagagag

SEQ ID NO: 3887036 - DNA, 16 bp, Homo sapiens
tgatgagggcagcagc

SEQ ID NO: 3887037 - DNA, 21 bp, Homo sapiens
tgatgagggcagcagccagcc

SEQ ID NO: 3887038 - DNA, 22 bp, Homo sapiens
tgatgagggcagcagccagccc

SEQ ID NO: 3887039 - DNA, 24 bp, Homo sapiens
tgatgagggcagcagccagccctg

SEQ ID NO: 3887040 - DNA, 14 bp, Homo sapiens
tgatgatctttaaa

SEQ ID NO: 3887041 - DNA, 14 bp, Homo sapiens
tgatgatgtctctt

SEQ ID NO: 3887042 - DNA, 15 bp, Homo sapiens
tgatgatgtctcttg

SEQ ID NO: 3887043 - DNA, 21 bp, Homo sapiens
tgatgatgtctcttgtagaag

SEQ ID NO: 3887044 - DNA, 20 bp, Homo sapiens
tgatgattaaacacctgaca

SEQ ID NO: 3887045 - DNA, 15 bp, Homo sapiens
tgatgctcaggcttg

SEQ ID NO: 3887046 - DNA, 13 bp, Homo sapiens
tgatgctgccccg

SEQ ID NO: 3887047 - DNA, 23 bp, Homo sapiens
tgatggaccgggtgggcctggcc

SEQ ID NO: 3887048 - DNA, 15 bp, Homo sapiens
tgatggagaaggaag

SEQ ID NO: 3887049 - DNA, 17 bp, Homo sapiens
tgatggagaaggaaggc

SEQ ID NO: 3887050 - DNA, 22 bp, Homo sapiens
tgatggcacttagctatcagaa

SEQ ID NO: 3887051 - DNA, 15 bp, Homo sapiens
tgatggccaagagca

SEQ ID NO: 3887052 - DNA, 14 bp, Homo sapiens
tgatggccaagggg

SEQ ID NO: 3887053 - DNA, 22 bp, Homo sapiens
tgatggcgattccctctcaccc

SEQ ID NO: 3887054 - DNA, 18 bp, Homo sapiens
tgatggcgcgggaggcac

SEQ ID NO: 3887055 - DNA, 20 bp, Homo sapiens
tgatggcgcgggaggcacca

SEQ ID NO: 3887056 - DNA, 14 bp, Homo sapiens
tgatgggaaagcat

SEQ ID NO: 3887057 - DNA, 19 bp, Homo sapiens
tgatgggagagtagatggt

SEQ ID NO: 3887058 - DNA, 12 bp, Homo sapiens
tgatggggagaa

SEQ ID NO: 3887059 - DNA, 19 bp, Homo sapiens
tgatggggagaaagggcaa

SEQ ID NO: 3887060 - DNA, 16 bp, Homo sapiens
tgatggtgagctggga

SEQ ID NO: 3887061 - DNA, 14 bp, Homo sapiens
tgatggttcccctg

SEQ ID NO: 3887062 - DNA, 13 bp, Homo sapiens
tgatgtcagcctt

SEQ ID NO: 3887063 - DNA, 17 bp, Homo sapiens
tgatgtcagccttgcat

SEQ ID NO: 3887064 - DNA, 18 bp, Homo sapiens
tgatgtcagccttgcatc

SEQ ID NO: 3887065 - DNA, 23 bp, Homo sapiens
tgatgtccagaagaatattcagg

SEQ ID NO: 3887066 - DNA, 18 bp, Homo sapiens
tgatgtctcttgtagaag

SEQ ID NO: 3887067 - DNA, 12 bp, Homo sapiens
tgatgtgctgga

SEQ ID NO: 3887068 - DNA, 22 bp, Homo sapiens
tgatgttaaccagaataaagtt

SEQ ID NO: 3887069 - DNA, 15 bp, Homo sapiens
tgatgttaactatta

SEQ ID NO: 3887070 - DNA, 18 bp, Homo sapiens
tgatgttgtttgggagag

SEQ ID NO: 3887071 - DNA, 19 bp, Homo sapiens
tgatgttgtttgggagagt

SEQ ID NO: 3887072 - DNA, 17 bp, Homo sapiens
tgatgtttccagaaaat

SEQ ID NO: 3887073 - DNA, 18 bp, Homo sapiens
tgatgtttccagaaaata

SEQ ID NO: 3887074 - DNA, 15 bp, Homo sapiens
tgatgtttttatgat

SEQ ID NO: 3887075 - DNA, 21 bp, Homo sapiens
tgattaaacacctgacacatc

SEQ ID NO: 3887076 - DNA, 15 bp, Homo sapiens
tgattaatttgagaa

SEQ ID NO: 3887077 - DNA, 13 bp, Homo sapiens
tgattacacagtt

SEQ ID NO: 3887078 - DNA, 14 bp, Homo sapiens
tgattacacagttg

SEQ ID NO: 3887079 - DNA, 18 bp, Homo sapiens
tgattattctgattccac

SEQ ID NO: 3887080 - DNA, 16 bp, Homo sapiens
tgattcactattagag

SEQ ID NO: 3887081 - DNA, 12 bp, Homo sapiens
tgattcataaca

SEQ ID NO: 3887082 - DNA, 17 bp, Homo sapiens
tgattcataacaatgta

SEQ ID NO: 3887083 - DNA, 15 bp, Homo sapiens
tgattccacttttat

SEQ ID NO: 3887084 - DNA, 12 bp, Homo sapiens
tgattcccagca

SEQ ID NO: 3887085 - DNA, 21 bp, Homo sapiens
tgattccccactcaatgacat

SEQ ID NO: 3887086 - DNA, 18 bp, Homo sapiens
tgattccttgagcatttt

SEQ ID NO: 3887087 - DNA, 19 bp, Homo sapiens
tgattctgggatggaccct

SEQ ID NO: 3887088 - DNA, 12 bp, Homo sapiens
tgattggctcac

SEQ ID NO: 3887089 - DNA, 14 bp, Homo sapiens
tgattgtaaaatag

SEQ ID NO: 3887090 - DNA, 23 bp, Homo sapiens
tgattgtaaaatagcttgtatag

SEQ ID NO: 3887091 - DNA, 14 bp, Homo sapiens
tgatttaatgtttt

SEQ ID NO: 3887092 - DNA, 18 bp, Homo sapiens
tgatttaatgttttctgc

SEQ ID NO: 3887093 - DNA, 21 bp, Homo sapiens
tgatttagaactgtatgtcag

SEQ ID NO: 3887094 - DNA, 19 bp, Homo sapiens
tgatttagggaagcaggga

SEQ ID NO: 3887095 - DNA, 13 bp, Homo sapiens
tgatttatgcatg

SEQ ID NO: 3887096 - DNA, 15 bp, Homo sapiens
tgatttccaggcccc

SEQ ID NO: 3887097 - DNA, 20 bp, Homo sapiens
tgatttccaggcccctgagg

SEQ ID NO: 3887098 - DNA, 20 bp, Homo sapiens
tgatttctattcaaggtggc

SEQ ID NO: 3887099 - DNA, 13 bp, Homo sapiens
tgatttctctgaa

SEQ ID NO: 3887100 - DNA, 18 bp, Homo sapiens
tgatttgacccactcaca

SEQ ID NO: 3887101 - DNA, 19 bp, Homo sapiens
tgatttgacccactcacac

SEQ ID NO: 3887102 - DNA, 20 bp, Homo sapiens
tgattttcaaagctttttcc

SEQ ID NO: 3887103 - DNA, 13 bp, Homo sapiens
tgattttcatcaa

SEQ ID NO: 3887104 - DNA, 15 bp, Homo sapiens
tgattttcatcaatt

SEQ ID NO: 3887105 - DNA, 13 bp, Homo sapiens
tgattttggcatg

SEQ ID NO: 3887106 - DNA, 15 bp, Homo sapiens
tgattttgtacagaa

SEQ ID NO: 3887107 - DNA, 15 bp, Homo sapiens
tgcaaacactgtgta

SEQ ID NO: 3887108 - DNA, 19 bp, Homo sapiens
tgcaaacactgtgtattta

SEQ ID NO: 3887109 - DNA, 23 bp, Homo sapiens
tgccagtgccttacctcctgccc

SEQ ID NO: 3887110 - DNA, 12 bp, Homo sapiens
tgccataccgct

SEQ ID NO: 3887111 - DNA, 23 bp, Homo sapiens
tgccataccgctggggaacagag

SEQ ID NO: 3887112 - DNA, 16 bp, Homo sapiens
tgccatccattctgcc

SEQ ID NO: 3887113 - DNA, 16 bp, Homo sapiens
tgccatctgttttcaa

SEQ ID NO: 3887114 - DNA, 14 bp, Homo sapiens
tgccatgccactgc

SEQ ID NO: 3887115 - DNA, 13 bp, Homo sapiens
tgccattactctg

SEQ ID NO: 3887116 - DNA, 11 bp, Homo sapiens
tgccattccca

SEQ ID NO: 3887117 - DNA, 12 bp, Homo sapiens
tgccattcccac

SEQ ID NO: 3887118 - DNA, 14 bp, Homo sapiens
tgccattcccagcg

SEQ ID NO: 3887119 - DNA, 22 bp, Homo sapiens
tgccatttaaagcttattaaaa

SEQ ID NO: 3887120 - DNA, 15 bp, Homo sapiens
tgccatttgtactga

SEQ ID NO: 3887121 - DNA, 23 bp, Homo sapiens
tgccatttgtactgaccccatca

SEQ ID NO: 3887122 - DNA, 21 bp, Homo sapiens
tgcccaagaatagatgctgac

SEQ ID NO: 3887123 - DNA, 23 bp, Homo sapiens
tgcccaagaatagatgctgactg

SEQ ID NO: 3887124 - DNA, 22 bp, Homo sapiens
tgcccacttagccgtccatggc

SEQ ID NO: 3887125 - DNA, 23 bp, Homo sapiens
tgcccagagaatcagggcaggct

SEQ ID NO: 3887126 - DNA, 18 bp, Homo sapiens
tgcccagagatgcctcca

SEQ ID NO: 3887127 - DNA, 22 bp, Homo sapiens
tgcccagagatgcctccaccgc

SEQ ID NO: 3887128 - DNA, 22 bp, Homo sapiens
tgcccaggagagccagccctcc

SEQ ID NO: 3887129 - DNA, 20 bp, Homo sapiens
tgcccaggctgctcttgaat

SEQ ID NO: 3887130 - DNA, 15 bp, Homo sapiens
tgcccaggctggcct

SEQ ID NO: 3887131 - DNA, 20 bp, Homo sapiens
tgcccaggggcccacaggga

SEQ ID NO: 3887132 - DNA, 15 bp, Homo sapiens
tgcccatacccctgc

SEQ ID NO: 3887133 - DNA, 14 bp, Homo sapiens
tgcccatgtgtccc

SEQ ID NO: 3887134 - DNA, 18 bp, Homo sapiens
tgcccatgtgtcccctca

SEQ ID NO: 3887135 - DNA, 22 bp, Homo sapiens
tgcccatgtgtcccctcactct

SEQ ID NO: 3887136 - DNA, 15 bp, Homo sapiens
tgccccaactcctgg

SEQ ID NO: 3887137 - DNA, 18 bp, Homo sapiens
tgccccaactccttccag

SEQ ID NO: 3887138 - DNA, 19 bp, Homo sapiens
tgccccaactccttccagc

SEQ ID NO: 3887139 - DNA, 19 bp, Homo sapiens
tgccccaaggggcccacaa

SEQ ID NO: 3887140 - DNA, 13 bp, Homo sapiens
tgccccagagccc

SEQ ID NO: 3887141 - DNA, 20 bp, Homo sapiens
tgccccagctttatctgtca

SEQ ID NO: 3887142 - DNA, 15 bp, Homo sapiens
tgccccagggctccc

SEQ ID NO: 3887143 - DNA, 14 bp, Homo sapiens
tgcccccatcccac

SEQ ID NO: 3887144 - DNA, 18 bp, Homo sapiens
tgcccccatctccccagg

SEQ ID NO: 3887145 - DNA, 21 bp, Homo sapiens
tgcccccatctccccaggcct

SEQ ID NO: 3887146 - DNA, 17 bp, Homo sapiens
tgcccccgacagcccag

SEQ ID NO: 3887147 - DNA, 21 bp, Homo sapiens
tgcccccgacagcccagccta

SEQ ID NO: 3887148 - DNA, 17 bp, Homo sapiens
tgccccctcatctcact

SEQ ID NO: 3887149 - DNA, 15 bp, Homo sapiens
tgccccgcctccccg

SEQ ID NO: 3887150 - DNA, 18 bp, Homo sapiens
tgccccgttccctgtcag

SEQ ID NO: 3887151 - DNA, 19 bp, Homo sapiens
tgccccgttccctgtcaga

SEQ ID NO: 3887152 - DNA, 15 bp, Homo sapiens
tgcccctcagagagg

SEQ ID NO: 3887153 - DNA, 13 bp, Homo sapiens
tgcccctcccttc

SEQ ID NO: 3887154 - DNA, 15 bp, Homo sapiens
tgcccctcccttcaa

SEQ ID NO: 3887155 - DNA, 17 bp, Homo sapiens
tgcccctgtaggttgct

SEQ ID NO: 3887156 - DNA, 12 bp, Homo sapiens
tgccccttccac

SEQ ID NO: 3887157 - DNA, 19 bp, Homo sapiens
tgccccttcccatctcttc

SEQ ID NO: 3887158 - DNA, 16 bp, Homo sapiens
tgccccttccccaaga

SEQ ID NO: 3887159 - DNA, 17 bp, Homo sapiens
tgccccttccccatctc

SEQ ID NO: 3887160 - DNA, 18 bp, Homo sapiens
tgccccttccccatctcc

SEQ ID NO: 3887161 - DNA, 12 bp, Homo sapiens
tgccccttgggc

SEQ ID NO: 3887162 - DNA, 14 bp, Homo sapiens
tgcccgcagagccc

SEQ ID NO: 3887163 - DNA, 16 bp, Homo sapiens
tgcccgcagagcccac

SEQ ID NO: 3887164 - DNA, 19 bp, Homo sapiens
tgcccgcagagcccacgcc

SEQ ID NO: 3887165 - DNA, 14 bp, Homo sapiens
tgcccgccagcctc

SEQ ID NO: 3887166 - DNA, 18 bp, Homo sapiens
tgcccgcctaggagttga

SEQ ID NO: 3887167 - DNA, 14 bp, Homo sapiens
tgccctagcgctct

SEQ ID NO: 3887168 - DNA, 18 bp, Homo sapiens
tgccctcagatggagaca

SEQ ID NO: 3887169 - DNA, 13 bp, Homo sapiens
tgccctccctggg

SEQ ID NO: 3887170 - DNA, 20 bp, Homo sapiens
tgccctccctggggtccttg

SEQ ID NO: 3887171 - DNA, 16 bp, Homo sapiens
tgccctctccttcctt

SEQ ID NO: 3887172 - DNA, 17 bp, Homo sapiens
tgccctctccttcctta

SEQ ID NO: 3887173 - DNA, 19 bp, Homo sapiens
tgccctctggatcctgctg

SEQ ID NO: 3887174 - DNA, 17 bp, Homo sapiens
tgccctgccacctgtct

SEQ ID NO: 3887175 - DNA, 22 bp, Homo sapiens
tgccctgccacctgtctgtctg

SEQ ID NO: 3887176 - DNA, 11 bp, Homo sapiens
tgccctgccat

SEQ ID NO: 3887177 - DNA, 15 bp, Homo sapiens
tgccctgccctgcca

SEQ ID NO: 3887178 - DNA, 18 bp, Homo sapiens
tgccctgccctgccacct

SEQ ID NO: 3887179 - DNA, 14 bp, Homo sapiens
tgccctgcctccct

SEQ ID NO: 3887180 - DNA, 16 bp, Homo sapiens
tgccctgcctcccttt

SEQ ID NO: 3887181 - DNA, 15 bp, Homo sapiens
tgccctgctctgggg

SEQ ID NO: 3887182 - DNA, 11 bp, Homo sapiens
tgccctgctgc

SEQ ID NO: 3887183 - DNA, 16 bp, Homo sapiens
tgccctggtgctgcca

SEQ ID NO: 3887184 - DNA, 18 bp, Homo sapiens
tgccctggtgctgccaca

SEQ ID NO: 3887185 - DNA, 21 bp, Homo sapiens
tgccctggtgctgccacactt

SEQ ID NO: 3887186 - DNA, 17 bp, Homo sapiens
tgccctgtatataatac

SEQ ID NO: 3887187 - DNA, 19 bp, Homo sapiens
tgccctgtatataatacta

SEQ ID NO: 3887188 - DNA, 14 bp, Homo sapiens
tgccctgtggattc

SEQ ID NO: 3887189 - DNA, 19 bp, Homo sapiens
tgccctgttaaaagatgaa

SEQ ID NO: 3887190 - DNA, 15 bp, Homo sapiens
tgcccttcgctgcca

SEQ ID NO: 3887191 - DNA, 16 bp, Homo sapiens
tgcccttcgctgccag

SEQ ID NO: 3887192 - DNA, 13 bp, Homo sapiens
tgcccttgccctg

SEQ ID NO: 3887193 - DNA, 22 bp, Homo sapiens
tgcccttggggtaagccagagc

SEQ ID NO: 3887194 - DNA, 20 bp, Homo sapiens
tgcccttgtttggggcagga

SEQ ID NO: 3887195 - DNA, 15 bp, Homo sapiens
tgcatgcgcaggctc

SEQ ID NO: 3887196 - DNA, 12 bp, Homo sapiens
tgcatgctctgg

SEQ ID NO: 3887197 - DNA, 13 bp, Homo sapiens
tgcatgctctgga

SEQ ID NO: 3887198 - DNA, 14 bp, Homo sapiens
tgcatgctctggaa

SEQ ID NO: 3887199 - DNA, 15 bp, Homo sapiens
tgcatgctctggaag

SEQ ID NO: 3887200 - DNA, 22 bp, Homo sapiens
tgcatgctctggaagcctggac

SEQ ID NO: 3887201 - DNA, 15 bp, Homo sapiens
tgcatggaaacctga

SEQ ID NO: 3887202 - DNA, 19 bp, Homo sapiens
tgcatggaatttgtaagtt

SEQ ID NO: 3887203 - DNA, 20 bp, Homo sapiens
tgcatggcttggggagcaga

SEQ ID NO: 3887204 - DNA, 12 bp, Homo sapiens
tgcatgtatgtg

SEQ ID NO: 3887205 - DNA, 23 bp, Homo sapiens
tgcatgtatgtgcacatgtgtct

SEQ ID NO: 3887206 - DNA, 15 bp, Homo sapiens
tgcatgtatgtgtgt

SEQ ID NO: 3887207 - DNA, 18 bp, Homo sapiens
tgcatgtgagcacatgcg

SEQ ID NO: 3887208 - DNA, 13 bp, Homo sapiens
tgcatgtgtgtat

SEQ ID NO: 3887209 - DNA, 15 bp, Homo sapiens
tgcatgtgtgtataa

SEQ ID NO: 3887210 - DNA, 22 bp, Homo sapiens
tgcatgtgtgttgtccttcagc

SEQ ID NO: 3887211 - DNA, 17 bp, Homo sapiens
tgcatgtgttgtacaat

SEQ ID NO: 3887212 - DNA, 11 bp, Homo sapiens
tgcatgtttac

SEQ ID NO: 3887213 - DNA, 17 bp, Homo sapiens
tgcatgtttactttatt

SEQ ID NO: 3887214 - DNA, 20 bp, Homo sapiens
tgcattagaaatagacagta

SEQ ID NO: 3887215 - DNA, 15 bp, Homo sapiens
tgcattccatgattt

SEQ ID NO: 3887216 - DNA, 22 bp, Homo sapiens
tgcattccatgattttacagag

SEQ ID NO: 3887217 - DNA, 23 bp, Homo sapiens
tgcattccatgattttacagaga

SEQ ID NO: 3887218 - DNA, 22 bp, Homo sapiens
tgcattcttaatctccactgtt

SEQ ID NO: 3887219 - DNA, 20 bp, Homo sapiens
tgcattcttttaaagtttta

SEQ ID NO: 3887220 - DNA, 16 bp, Homo sapiens
tgcattgtgtgagctt

SEQ ID NO: 3887221 - DNA, 21 bp, Homo sapiens
tgcatttgagagaagccacgc

SEQ ID NO: 3887222 - DNA, 22 bp, Homo sapiens
tgcatttgagagaagccacgct

SEQ ID NO: 3887223 - DNA, 16 bp, Homo sapiens
tgccaaagcaaaagaa

SEQ ID NO: 3887224 - DNA, 22 bp, Homo sapiens
tgccaaagcaaaagaagtaaaa

SEQ ID NO: 3887225 - DNA, 16 bp, Homo sapiens
tgccaacaccttcttg

SEQ ID NO: 3887226 - DNA, 23 bp, Homo sapiens
tgccaacctgatgccccttcccc

SEQ ID NO: 3887227 - DNA, 16 bp, Homo sapiens
tgccaactaagccctc

SEQ ID NO: 3887228 - DNA, 21 bp, Homo sapiens
tgccaagtccaggtcctggtg

SEQ ID NO: 3887229 - DNA, 13 bp, Homo sapiens
tgccaagtttgtt

SEQ ID NO: 3887230 - DNA, 21 bp, Homo sapiens
tgccacaatgcctctcccacg

SEQ ID NO: 3887231 - DNA, 14 bp, Homo sapiens
tgccacacttcagg

SEQ ID NO: 3887232 - DNA, 13 bp, Homo sapiens
tgccacagcccca

SEQ ID NO: 3887233 - DNA, 22 bp, Homo sapiens
tgccacagccccacagcaccca

SEQ ID NO: 3887234 - DNA, 15 bp, Homo sapiens
tgccaccacgtctgc

SEQ ID NO: 3887235 - DNA, 17 bp, Homo sapiens
tgccaccacgtctgcca

SEQ ID NO: 3887236 - DNA, 21 bp, Homo sapiens
tgccaccacgtctgccaggcc

SEQ ID NO: 3887237 - DNA, 16 bp, Homo sapiens
tgccaccactagagct

SEQ ID NO: 3887238 - DNA, 21 bp, Homo sapiens
tgccacccagcaacacagagc

SEQ ID NO: 3887239 - DNA, 21 bp, Homo sapiens
tgccacccgtaggcagcctct

SEQ ID NO: 3887240 - DNA, 17 bp, Homo sapiens
tgccaccctctccatgc

SEQ ID NO: 3887241 - DNA, 21 bp, Homo sapiens
tgccaccggggaacccagccc

SEQ ID NO: 3887242 - DNA, 21 bp, Homo sapiens
tgccacctcccctatccaccc

SEQ ID NO: 3887243 - DNA, 10 bp, Homo sapiens
tgccacctgt

SEQ ID NO: 3887244 - DNA, 21 bp, Homo sapiens
tgccacctgttaaaatgtaca

SEQ ID NO: 3887245 - DNA, 15 bp, Homo sapiens
tgccactccctgagc

SEQ ID NO: 3887246 - DNA, 12 bp, Homo sapiens
tgccactgccag

SEQ ID NO: 3887247 - DNA, 16 bp, Homo sapiens
tgccactgccaggcac

SEQ ID NO: 3887248 - DNA, 20 bp, Homo sapiens
tgccactgccaggcacctgg

SEQ ID NO: 3887249 - DNA, 18 bp, Homo sapiens
tgccactgcctcttcctc

SEQ ID NO: 3887250 - DNA, 20 bp, Homo sapiens
tgccactgcctcttcctccc

SEQ ID NO: 3887251 - DNA, 14 bp, Homo sapiens
tgccacttccagga

SEQ ID NO: 3887252 - DNA, 22 bp, Homo sapiens
tgccacttccaggagcccagag

SEQ ID NO: 3887253 - DNA, 23 bp, Homo sapiens
tgccacttccaggagcccagagg

SEQ ID NO: 3887254 - DNA, 12 bp, Homo sapiens
tgccacttccca

SEQ ID NO: 3887255 - DNA, 22 bp, Homo sapiens
tgccacttcttaaaggcctgga

SEQ ID NO: 3887256 - DNA, 18 bp, Homo sapiens
tgccacttgacattcctt

SEQ ID NO: 3887257 - DNA, 19 bp, Homo sapiens
tgccagagcccaagtgcca

SEQ ID NO: 3887258 - DNA, 18 bp, Homo sapiens
tgccagagcctggggctc

SEQ ID NO: 3887259 - DNA, 23 bp, Homo sapiens
tgccagagctttgttttatatat

SEQ ID NO: 3887260 - DNA, 19 bp, Homo sapiens
tgccagcacaggggcccca

SEQ ID NO: 3887261 - DNA, 13 bp, Homo sapiens
tgccagccatcac

SEQ ID NO: 3887262 - DNA, 18 bp, Homo sapiens
tgccagccatcacaaggg

SEQ ID NO: 3887263 - DNA, 20 bp, Homo sapiens
tgccagccgtgatgctcagg

SEQ ID NO: 3887264 - DNA, 16 bp, Homo sapiens
tgccagctcaggtgac

SEQ ID NO: 3887265 - DNA, 14 bp, Homo sapiens
tgccagctgccttc

SEQ ID NO: 3887266 - DNA, 12 bp, Homo sapiens
tgccaggacacc

SEQ ID NO: 3887267 - DNA, 13 bp, Homo sapiens
tgccaggacacct

SEQ ID NO: 3887268 - DNA, 18 bp, Homo sapiens
tgccaggacacctgcccc

SEQ ID NO: 3887269 - DNA, 23 bp, Homo sapiens
tgccaggacacctgccccagcgc

SEQ ID NO: 3887270 - DNA, 22 bp, Homo sapiens
tgccaggactccccaggccagg

SEQ ID NO: 3887271 - DNA, 21 bp, Homo sapiens
tgccaggagggacaaaggagc

SEQ ID NO: 3887272 - DNA, 23 bp, Homo sapiens
tgccaggagggacaaaggagcct

SEQ ID NO: 3887273 - DNA, 17 bp, Homo sapiens
tgccaggcacctggcct

SEQ ID NO: 3887274 - DNA, 21 bp, Homo sapiens
tgccaggcacctggcctgctg

SEQ ID NO: 3887275 - DNA, 22 bp, Homo sapiens
tgccaggcacctggcctgctgg

SEQ ID NO: 3887276 - DNA, 11 bp, Homo sapiens
tgccaggcccg

SEQ ID NO: 3887277 - DNA, 21 bp, Homo sapiens
tgccagggcaggctacccctt

SEQ ID NO: 3887278 - DNA, 20 bp, Homo sapiens
tgccagtccccctgccccag

SEQ ID NO: 3887279 - DNA, 14 bp, Homo sapiens
tgccagtgaagact

SEQ ID NO: 3887280 - DNA, 12 bp, Homo sapiens
tgcactgaccct

SEQ ID NO: 3887281 - DNA, 23 bp, Homo sapiens
tgcactgacccttccagacatac

SEQ ID NO: 3887282 - DNA, 14 bp, Homo sapiens
tgcactgagggcca

SEQ ID NO: 3887283 - DNA, 16 bp, Homo sapiens
tgcactgagggccaca

SEQ ID NO: 3887284 - DNA, 17 bp, Homo sapiens
tgcactggccccaccct

SEQ ID NO: 3887285 - DNA, 15 bp, Homo sapiens
tgcactgggtgtggc

SEQ ID NO: 3887286 - DNA, 16 bp, Homo sapiens
tgcactgtcaagatga

SEQ ID NO: 3887287 - DNA, 16 bp, Homo sapiens
tgcactgttacttttt

SEQ ID NO: 3887288 - DNA, 15 bp, Homo sapiens
tgcacttcagacacc

SEQ ID NO: 3887289 - DNA, 21 bp, Homo sapiens
tgcagaaaaaaaaaaagaaac

SEQ ID NO: 3887290 - DNA, 23 bp, Homo sapiens
tgcagaaggaagggcatccttct

SEQ ID NO: 3887291 - DNA, 20 bp, Homo sapiens
tgcagactcctcagatctga

SEQ ID NO: 3887292 - DNA, 18 bp, Homo sapiens
tgcagagatttcctccat

SEQ ID NO: 3887293 - DNA, 21 bp, Homo sapiens
tgcagagatttcctccatggt

SEQ ID NO: 3887294 - DNA, 18 bp, Homo sapiens
tgcagagctgacccagag

SEQ ID NO: 3887295 - DNA, 20 bp, Homo sapiens
tgcagaggtgagcagaggag

SEQ ID NO: 3887296 - DNA, 23 bp, Homo sapiens
tgcagatagccagacacatggct

SEQ ID NO: 3887297 - DNA, 14 bp, Homo sapiens
tgcagatgggctgt

SEQ ID NO: 3887298 - DNA, 17 bp, Homo sapiens
tgcagattcctgggcct

SEQ ID NO: 3887299 - DNA, 23 bp, Homo sapiens
tgcagattcctgggcctgtcccc

SEQ ID NO: 3887300 - DNA, 15 bp, Homo sapiens
tgcagattctgattt

SEQ ID NO: 3887301 - DNA, 16 bp, Homo sapiens
tgcagattctgatttt

SEQ ID NO: 3887302 - DNA, 20 bp, Homo sapiens
tgcagcaactcccacgactg

SEQ ID NO: 3887303 - DNA, 11 bp, Homo sapiens
tgcagcacttt

SEQ ID NO: 3887304 - DNA, 19 bp, Homo sapiens
tgcagcactttaaccctct

SEQ ID NO: 3887305 - DNA, 20 bp, Homo sapiens
tgcagcactttaaccctctc

SEQ ID NO: 3887306 - DNA, 11 bp, Homo sapiens
tgcagcagccc

SEQ ID NO: 3887307 - DNA, 13 bp, Homo sapiens
tgcagcagcccag

SEQ ID NO: 3887308 - DNA, 19 bp, Homo sapiens
tgcagccagcccagcccag

SEQ ID NO: 3887309 - DNA, 14 bp, Homo sapiens
tgcagcctccccca

SEQ ID NO: 3887310 - DNA, 15 bp, Homo sapiens
tgcagcctcccccac

SEQ ID NO: 3887311 - DNA, 15 bp, Homo sapiens
tgcagcctcctcctg

SEQ ID NO: 3887312 - DNA, 15 bp, Homo sapiens
tgcagcctggtagaa

SEQ ID NO: 3887313 - DNA, 23 bp, Homo sapiens
tgcagctgcaccatcacacatgc

SEQ ID NO: 3887314 - DNA, 19 bp, Homo sapiens
tgcagctgggccccatgct

SEQ ID NO: 3887315 - DNA, 20 bp, Homo sapiens
tgcagctgggccccatgctc

SEQ ID NO: 3887316 - DNA, 23 bp, Homo sapiens
tgcagctgggccccatgctctgc

SEQ ID NO: 3887317 - DNA, 24 bp, Homo sapiens
tgcagctgggccccatgctctgcc

SEQ ID NO: 3887318 - DNA, 17 bp, Homo sapiens
tgcagcttgtagccagc

SEQ ID NO: 3887319 - DNA, 16 bp, Homo sapiens
tgcagctttacatgca

SEQ ID NO: 3887320 - DNA, 21 bp, Homo sapiens
tgcaggaacgagcactggcca

SEQ ID NO: 3887321 - DNA, 22 bp, Homo sapiens
tgcaggaacgagcactggccag

SEQ ID NO: 3887322 - DNA, 23 bp, Homo sapiens
tgcaggaacgagcactggccaga

SEQ ID NO: 3887323 - DNA, 19 bp, Homo sapiens
tgcaggccccgcttgtcca

SEQ ID NO: 3887324 - DNA, 21 bp, Homo sapiens
tgcaggcctgctcagggactg

SEQ ID NO: 3887325 - DNA, 12 bp, Homo sapiens
tgcaggctctgg

SEQ ID NO: 3887326 - DNA, 16 bp, Homo sapiens
tgcaggctctgggctc

SEQ ID NO: 3887327 - DNA, 18 bp, Homo sapiens
tgcaggctctgggctcag

SEQ ID NO: 3887328 - DNA, 15 bp, Homo sapiens
tgcagggaagagggc

SEQ ID NO: 3887329 - DNA, 20 bp, Homo sapiens
tgcagggaagagggcagtac

SEQ ID NO: 3887330 - DNA, 16 bp, Homo sapiens
tgcagggacaaagagg

SEQ ID NO: 3887331 - DNA, 23 bp, Homo sapiens
tgcagggagcatggctgtgagga

SEQ ID NO: 3887332 - DNA, 19 bp, Homo sapiens
tgcaggtacttcctcctga

SEQ ID NO: 3887333 - DNA, 22 bp, Homo sapiens
tgcaggtacttcctcctgatgg

SEQ ID NO: 3887334 - DNA, 13 bp, Homo sapiens
tgcagtacaggca

SEQ ID NO: 3887335 - DNA, 18 bp, Homo sapiens
tgcagtactttacctcct

SEQ ID NO: 3887336 - DNA, 18 bp, Homo sapiens
tgcagtagtctctgtgct

SEQ ID NO: 3887337 - DNA, 20 bp, Homo sapiens
tgcagtattttattaaagca

SEQ ID NO: 3887338 - DNA, 21 bp, Homo sapiens
tgcagtattttattaaagcaa

SEQ ID NO: 3887339 - DNA, 19 bp, Homo sapiens
tgcagtccagaataagtgc

SEQ ID NO: 3887340 - DNA, 14 bp, Homo sapiens
tgcagtccccagtc

SEQ ID NO: 3887341 - DNA, 16 bp, Homo sapiens
tgcagtgatacatgta

SEQ ID NO: 3887342 - DNA, 18 bp, Homo sapiens
tgcagtgatacatgtact

SEQ ID NO: 3887343 - DNA, 23 bp, Homo sapiens
tgcagtgatggcgcgggaggcac

SEQ ID NO: 3887344 - DNA, 14 bp, Homo sapiens
tgcagttttccagg

SEQ ID NO: 3887345 - DNA, 15 bp, Homo sapiens
tgcataaaccaatga

SEQ ID NO: 3887346 - DNA, 18 bp, Homo sapiens
tgcataagattaaaggaa

SEQ ID NO: 3887347 - DNA, 19 bp, Homo sapiens
tgcatagaggtaccagcaa

SEQ ID NO: 3887348 - DNA, 19 bp, Homo sapiens
tgcatcaagggctttatca

SEQ ID NO: 3887349 - DNA, 21 bp, Homo sapiens
tgcatcagaaagggagggctc

SEQ ID NO: 3887350 - DNA, 22 bp, Homo sapiens
tgcatcagaaagggagggctct

SEQ ID NO: 3887351 - DNA, 13 bp, Homo sapiens
tgcatcagctgct

SEQ ID NO: 3887352 - DNA, 14 bp, Homo sapiens
tgcatcagtattaa

SEQ ID NO: 3887353 - DNA, 17 bp, Homo sapiens
tgcatccaatctgctca

SEQ ID NO: 3887354 - DNA, 16 bp, Homo sapiens
tgcatccggagaattg

SEQ ID NO: 3887355 - DNA, 22 bp, Homo sapiens
tgcatccggagaattgcctcta

SEQ ID NO: 3887356 - DNA, 19 bp, Homo sapiens
tgcatccgtagttccctga

SEQ ID NO: 3887357 - DNA, 13 bp, Homo sapiens
tgcatctcagccc

SEQ ID NO: 3887358 - DNA, 14 bp, Homo sapiens
tgcatctcagccca

SEQ ID NO: 3887359 - DNA, 23 bp, Homo sapiens
tgcatctgggattcccaccaagg

SEQ ID NO: 3887360 - DNA, 17 bp, Homo sapiens
tgcatgattttatacat

SEQ ID NO: 3887361 - DNA, 19 bp, Homo sapiens
tgcatgattttatacatag

SEQ ID NO: 3887362 - DNA, 20 bp, Homo sapiens
tgcatgattttatacatagt

SEQ ID NO: 3887363 - DNA, 22 bp, Homo sapiens
tgcatgcagccactgtgctgaa

SEQ ID NO: 3887364 - DNA, 22 bp, Homo sapiens
tgcatgccaaattgtagttctt

SEQ ID NO: 3887365 - DNA, 17 bp, Homo sapiens
tgcaaacagttcttgga

SEQ ID NO: 3887366 - DNA, 12 bp, Homo sapiens
tgcaaactttat

SEQ ID NO: 3887367 - DNA, 20 bp, Homo sapiens
tgcaaagcactgacttctaa

SEQ ID NO: 3887368 - DNA, 17 bp, Homo sapiens
tgcaaagtgcaaatact

SEQ ID NO: 3887369 - DNA, 16 bp, Homo sapiens
tgcaaagtgccctcat

SEQ ID NO: 3887370 - DNA, 22 bp, Homo sapiens
tgcaaagtgttttctcagaaca

SEQ ID NO: 3887371 - DNA, 21 bp, Homo sapiens
tgcaaatactccaagcttcaa

SEQ ID NO: 3887372 - DNA, 13 bp, Homo sapiens
tgcaaatttcaaa

SEQ ID NO: 3887373 - DNA, 17 bp, Homo sapiens
tgcaaattttgcattta

SEQ ID NO: 3887374 - DNA, 11 bp, Homo sapiens
tgcaaccactg

SEQ ID NO: 3887375 - DNA, 13 bp, Homo sapiens
tgcaaccactgca

SEQ ID NO: 3887376 - DNA, 20 bp, Homo sapiens
tgcaacgctttttgggagaa

SEQ ID NO: 3887377 - DNA, 16 bp, Homo sapiens
tgcaacggcttagact

SEQ ID NO: 3887378 - DNA, 13 bp, Homo sapiens
tgcaactagccaa

SEQ ID NO: 3887379 - DNA, 16 bp, Homo sapiens
tgcaactagccaaggc

SEQ ID NO: 3887380 - DNA, 14 bp, Homo sapiens
tgcaagagacagag

SEQ ID NO: 3887381 - DNA, 20 bp, Homo sapiens
tgcaagagacagagccccca

SEQ ID NO: 3887382 - DNA, 18 bp, Homo sapiens
tgcaagagactctggcct

SEQ ID NO: 3887383 - DNA, 13 bp, Homo sapiens
tgcaagagtggac

SEQ ID NO: 3887384 - DNA, 18 bp, Homo sapiens
tgcaagatttaacactaa

SEQ ID NO: 3887385 - DNA, 20 bp, Homo sapiens
tgcaagcagggctctgcccc

SEQ ID NO: 3887386 - DNA, 14 bp, Homo sapiens
tgcaagccactatg

SEQ ID NO: 3887387 - DNA, 15 bp, Homo sapiens
tgcaagccactatgt

SEQ ID NO: 3887388 - DNA, 15 bp, Homo sapiens
tgcaagccccagggc

SEQ ID NO: 3887389 - DNA, 17 bp, Homo sapiens
tgcaagccccagggcct

SEQ ID NO: 3887390 - DNA, 23 bp, Homo sapiens
tgcaagccccagggcctgggggc

SEQ ID NO: 3887391 - DNA, 15 bp, Homo sapiens
tgcaaggaaaataat

SEQ ID NO: 3887392 - DNA, 24 bp, Homo sapiens
tgcaaggccgctgttcacccacag

SEQ ID NO: 3887393 - DNA, 14 bp, Homo sapiens
tgcaaggggctcag

SEQ ID NO: 3887394 - DNA, 20 bp, Homo sapiens
tgcaagtttcccgccaggag

SEQ ID NO: 3887395 - DNA, 14 bp, Homo sapiens
tgcaatctccaggg

SEQ ID NO: 3887396 - DNA, 16 bp, Homo sapiens
tgcaatctccagggct

SEQ ID NO: 3887397 - DNA, 15 bp, Homo sapiens
tgcaattgcttagga

SEQ ID NO: 3887398 - DNA, 22 bp, Homo sapiens
tgcaatttattaaaatgattgt

SEQ ID NO: 3887399 - DNA, 20 bp, Homo sapiens
tgcaattttaattgattatt

SEQ ID NO: 3887400 - DNA, 14 bp, Homo sapiens
tgcaatttttaaac

SEQ ID NO: 3887401 - DNA, 17 bp, Homo sapiens
tgcaatttttaaactag

SEQ ID NO: 3887402 - DNA, 19 bp, Homo sapiens
tgcaatttttaaactagta

SEQ ID NO: 3887403 - DNA, 15 bp, Homo sapiens
tgcacaaagcccttc

SEQ ID NO: 3887404 - DNA, 17 bp, Homo sapiens
tgcacaaagcccttcca

SEQ ID NO: 3887405 - DNA, 21 bp, Homo sapiens
tgcacaagcttgtatatacat

SEQ ID NO: 3887406 - DNA, 22 bp, Homo sapiens
tgcacaagcttgtatatacata

SEQ ID NO: 3887407 - DNA, 23 bp, Homo sapiens
tgcacaagcttgtatatacatat

SEQ ID NO: 3887408 - DNA, 19 bp, Homo sapiens
tgcacaatttagaaaacat

SEQ ID NO: 3887409 - DNA, 19 bp, Homo sapiens
tgcacaatttgagcaattc

SEQ ID NO: 3887410 - DNA, 21 bp, Homo sapiens
tgcacacaaacacctcctagc

SEQ ID NO: 3887411 - DNA, 13 bp, Homo sapiens
tgcacacacacag

SEQ ID NO: 3887412 - DNA, 12 bp, Homo sapiens
tgcacacacagc

SEQ ID NO: 3887413 - DNA, 16 bp, Homo sapiens
tgcacacagaaatata

SEQ ID NO: 3887414 - DNA, 18 bp, Homo sapiens
tgcacacagaaatatata

SEQ ID NO: 3887415 - DNA, 19 bp, Homo sapiens
tgcacactagcctctccag

SEQ ID NO: 3887416 - DNA, 21 bp, Homo sapiens
tgcacactagcctctccagga

SEQ ID NO: 3887417 - DNA, 18 bp, Homo sapiens
tgcacagcggcccctgca

SEQ ID NO: 3887418 - DNA, 12 bp, Homo sapiens
tgcacagctgct

SEQ ID NO: 3887419 - DNA, 14 bp, Homo sapiens
tgcacagctgcttg

SEQ ID NO: 3887420 - DNA, 12 bp, Homo sapiens
tgcacaggaggg

SEQ ID NO: 3887421 - DNA, 16 bp, Homo sapiens
tgcacagtgcatctca

SEQ ID NO: 3887422 - DNA, 20 bp, Homo sapiens
tgcacagtgcatctcagccc

SEQ ID NO: 3887423 - DNA, 13 bp, Homo sapiens
tgcacatatttga

SEQ ID NO: 3887424 - DNA, 15 bp, Homo sapiens
tgcacatatttgaat

SEQ ID NO: 3887425 - DNA, 16 bp, Homo sapiens
tgcacatctctgcagt

SEQ ID NO: 3887426 - DNA, 15 bp, Homo sapiens
tgcacatgtgtctgt

SEQ ID NO: 3887427 - DNA, 11 bp, Homo sapiens
tgcacattcct

SEQ ID NO: 3887428 - DNA, 16 bp, Homo sapiens
tgcacattcctggccc

SEQ ID NO: 3887429 - DNA, 13 bp, Homo sapiens
tgcacatttatat

SEQ ID NO: 3887430 - DNA, 16 bp, Homo sapiens
tgcacatttatatata

SEQ ID NO: 3887431 - DNA, 22 bp, Homo sapiens
tgcacatttatatatatatgta

SEQ ID NO: 3887432 - DNA, 14 bp, Homo sapiens
tgcaccaccatgcc

SEQ ID NO: 3887433 - DNA, 18 bp, Homo sapiens
tgcaccagcccttccctg

SEQ ID NO: 3887434 - DNA, 19 bp, Homo sapiens
tgcaccagcccttccctgc

SEQ ID NO: 3887435 - DNA, 22 bp, Homo sapiens
tgcaccagcccttccctgcttt

SEQ ID NO: 3887436 - DNA, 15 bp, Homo sapiens
tgcaccatctgcttg

SEQ ID NO: 3887437 - DNA, 18 bp, Homo sapiens
tgcacccactcaccaggg

SEQ ID NO: 3887438 - DNA, 23 bp, Homo sapiens
tgcacccagaaattccttcccac

SEQ ID NO: 3887439 - DNA, 14 bp, Homo sapiens
tgcacctcccccca

SEQ ID NO: 3887440 - DNA, 19 bp, Homo sapiens
  misc_feature (10)..(10): n is a, c, g or t
tgcacctgcnttgtccctg

SEQ ID NO: 3887441 - DNA, 17 bp, Homo sapiens
tgcaccttacattccta

SEQ ID NO: 3887442 - DNA, 13 bp, Homo sapiens
tgcaccttaccaa

SEQ ID NO: 3887443 - DNA, 18 bp, Homo sapiens
tgcaccttaccaactttc

SEQ ID NO: 3887444 - DNA, 19 bp, Homo sapiens
tgcactagcattttcttga

SEQ ID NO: 3887445 - DNA, 13 bp, Homo sapiens
tgcactagcctgt

SEQ ID NO: 3887446 - DNA, 14 bp, Homo sapiens
tgcactagcctgtg

SEQ ID NO: 3887447 - DNA, 16 bp, Homo sapiens
tgcactccatggccac

SEQ ID NO: 3887448 - DNA, 17 bp, Homo sapiens
tgcactccatggccacc

SEQ ID NO: 3887449 - DNA, 19 bp, Homo sapiens
tgcactccatggccacccc

SEQ ID NO: 3887450 - DNA, 10 bp, Homo sapiens
tgcactgaca

SEQ ID NO: 3887451 - DNA, 13 bp, Homo sapiens
tgcactgacaaga

SEQ ID NO: 3887452 - DNA, 16 bp, Homo sapiens
tgagggtcagggcagt

SEQ ID NO: 3887453 - DNA, 12 bp, Homo sapiens
tgagggtgactg

SEQ ID NO: 3887454 - DNA, 21 bp, Homo sapiens
tgagggtttcattgtgtgtta

SEQ ID NO: 3887455 - DNA, 14 bp, Homo sapiens
tgaggtcctgagca

SEQ ID NO: 3887456 - DNA, 16 bp, Homo sapiens
tgaggtcctgagcact

SEQ ID NO: 3887457 - DNA, 20 bp, Homo sapiens
tgaggtcctgagcactgcca

SEQ ID NO: 3887458 - DNA, 15 bp, Homo sapiens
tgaggtgaaacaatt

SEQ ID NO: 3887459 - DNA, 18 bp, Homo sapiens
tgaggtgaaatgggagat

SEQ ID NO: 3887460 - DNA, 12 bp, Homo sapiens
tgaggtgcccag

SEQ ID NO: 3887461 - DNA, 13 bp, Homo sapiens
tgaggtgcccagg

SEQ ID NO: 3887462 - DNA, 14 bp, Homo sapiens
tgaggtgcccagga

SEQ ID NO: 3887463 - DNA, 17 bp, Homo sapiens
tgaggtgcccaggagaa

SEQ ID NO: 3887464 - DNA, 17 bp, Homo sapiens
tgaggtgcttgccccca

SEQ ID NO: 3887465 - DNA, 17 bp, Homo sapiens
tgaggtggaagccctcc

SEQ ID NO: 3887466 - DNA, 21 bp, Homo sapiens
tgaggtgggttttcttcccat

SEQ ID NO: 3887467 - DNA, 21 bp, Homo sapiens
tgaggttaaaatataaattaa

SEQ ID NO: 3887468 - DNA, 18 bp, Homo sapiens
tgagtaaattggaaacat

SEQ ID NO: 3887469 - DNA, 19 bp, Homo sapiens
tgagtactagaatttgtat

SEQ ID NO: 3887470 - DNA, 20 bp, Homo sapiens
tgagtcaccctacctgtgcc

SEQ ID NO: 3887471 - DNA, 22 bp, Homo sapiens
tgagtcaccctacctgtgcctg

SEQ ID NO: 3887472 - DNA, 23 bp, Homo sapiens
tgagtcacctcctccactcactc

SEQ ID NO: 3887473 - DNA, 20 bp, Homo sapiens
tgagtcatgatctccctgcc

SEQ ID NO: 3887474 - DNA, 22 bp, Homo sapiens
tgagtcatgatctccctgccgc

SEQ ID NO: 3887475 - DNA, 15 bp, Homo sapiens
tgagtcctcctcttc

SEQ ID NO: 3887476 - DNA, 14 bp, Homo sapiens
tgagtcctgtctct

SEQ ID NO: 3887477 - DNA, 19 bp, Homo sapiens
tgagtcctgtctctgcctg

SEQ ID NO: 3887478 - DNA, 23 bp, Homo sapiens
tgagtctgggcaatgaaaccaaa

SEQ ID NO: 3887479 - DNA, 21 bp, Homo sapiens
tgagtctttaacatcttgaac

SEQ ID NO: 3887480 - DNA, 16 bp, Homo sapiens
tgagtgactcggtgta

SEQ ID NO: 3887481 - DNA, 13 bp, Homo sapiens
tgagtgcaacaag

SEQ ID NO: 3887482 - DNA, 14 bp, Homo sapiens
tgagtggaatgcag

SEQ ID NO: 3887483 - DNA, 17 bp, Homo sapiens
tgagtggaatgcaggga

SEQ ID NO: 3887484 - DNA, 19 bp, Homo sapiens
tgagtggaatgcagggaag

SEQ ID NO: 3887485 - DNA, 21 bp, Homo sapiens
tgagtggatggaggagaaata

SEQ ID NO: 3887486 - DNA, 13 bp, Homo sapiens
tgagtggcagcca

SEQ ID NO: 3887487 - DNA, 16 bp, Homo sapiens
tgagtggcagccatgc

SEQ ID NO: 3887488 - DNA, 20 bp, Homo sapiens
tgagtggcagccatgcctca

SEQ ID NO: 3887489 - DNA, 14 bp, Homo sapiens
tgagtgttcatttt

SEQ ID NO: 3887490 - DNA, 22 bp, Homo sapiens
tgagtgtttttactacagttgt

SEQ ID NO: 3887491 - DNA, 23 bp, Homo sapiens
tgagttacaccagacctgttctg

SEQ ID NO: 3887492 - DNA, 17 bp, Homo sapiens
tgagttattttaattat

SEQ ID NO: 3887493 - DNA, 16 bp, Homo sapiens
tgagttggacacactg

SEQ ID NO: 3887494 - DNA, 18 bp, Homo sapiens
tgagttttattgagaatt

SEQ ID NO: 3887495 - DNA, 19 bp, Homo sapiens
tgagtttttatggggctga

SEQ ID NO: 3887496 - DNA, 14 bp, Homo sapiens
tgataaaattgtga

SEQ ID NO: 3887497 - DNA, 16 bp, Homo sapiens
tgataaacattaaaca

SEQ ID NO: 3887498 - DNA, 16 bp, Homo sapiens
tgataaactaaaagca

SEQ ID NO: 3887499 - DNA, 13 bp, Homo sapiens
tgataagtggaaa

SEQ ID NO: 3887500 - DNA, 18 bp, Homo sapiens
tgataagtggaaaaaaga

SEQ ID NO: 3887501 - DNA, 22 bp, Homo sapiens
tgataatcaattattacattta

SEQ ID NO: 3887502 - DNA, 24 bp, Homo sapiens
tgataccctgcttggtcaaatccc

SEQ ID NO: 3887503 - DNA, 15 bp, Homo sapiens
tgatacgtacagcca

SEQ ID NO: 3887504 - DNA, 13 bp, Homo sapiens
tgatacttcaggt

SEQ ID NO: 3887505 - DNA, 15 bp, Homo sapiens
tgatacttcaggtgc

SEQ ID NO: 3887506 - DNA, 17 bp, Homo sapiens
tgatacttcaggtgctt

SEQ ID NO: 3887507 - DNA, 20 bp, Homo sapiens
tgatacttcaggtgcttttg

SEQ ID NO: 3887508 - DNA, 13 bp, Homo sapiens
tgataggaaaaga

SEQ ID NO: 3887509 - DNA, 18 bp, Homo sapiens
tgataggaaaagaaggct

SEQ ID NO: 3887510 - DNA, 16 bp, Homo sapiens
tgatatagaaagctgt

SEQ ID NO: 3887511 - DNA, 13 bp, Homo sapiens
tgatatatgtatt

SEQ ID NO: 3887512 - DNA, 13 bp, Homo sapiens
tgatatcacctct

SEQ ID NO: 3887513 - DNA, 16 bp, Homo sapiens
tgatatcacctctctt

SEQ ID NO: 3887514 - DNA, 18 bp, Homo sapiens
tgatatcacctctcttca

SEQ ID NO: 3887515 - DNA, 20 bp, Homo sapiens
tgatatccagtaagcacatg

SEQ ID NO: 3887516 - DNA, 17 bp, Homo sapiens
tgatatctgaacacata

SEQ ID NO: 3887517 - DNA, 16 bp, Homo sapiens
tgatatgagtatacaa

SEQ ID NO: 3887518 - DNA, 21 bp, Homo sapiens
tgatatgcagagtatttctgc

SEQ ID NO: 3887519 - DNA, 14 bp, Homo sapiens
tgatatgggactga

SEQ ID NO: 3887520 - DNA, 15 bp, Homo sapiens
tgatatgtaaacata

SEQ ID NO: 3887521 - DNA, 13 bp, Homo sapiens
tgatattaaagga

SEQ ID NO: 3887522 - DNA, 23 bp, Homo sapiens
tgatattaaaggagttaagagta

SEQ ID NO: 3887523 - DNA, 21 bp, Homo sapiens
tgatattttcaacgcagccct

SEQ ID NO: 3887524 - DNA, 17 bp, Homo sapiens
tgatcaaattcattttt

SEQ ID NO: 3887525 - DNA, 12 bp, Homo sapiens
tgatcaatgaaa

SEQ ID NO: 3887526 - DNA, 12 bp, Homo sapiens
tgatcagaaggc

SEQ ID NO: 3887527 - DNA, 13 bp, Homo sapiens
tgatcagaaggct

SEQ ID NO: 3887528 - DNA, 15 bp, Homo sapiens
tgatcagaaggctgg

SEQ ID NO: 3887529 - DNA, 15 bp, Homo sapiens
tgatcataagtctaa

SEQ ID NO: 3887530 - DNA, 21 bp, Homo sapiens
tgatcataagtctaaataaat

SEQ ID NO: 3887531 - DNA, 15 bp, Homo sapiens
tgatcatggtcagct

SEQ ID NO: 3887532 - DNA, 17 bp, Homo sapiens
tgatcatggtcagctca

SEQ ID NO: 3887533 - DNA, 15 bp, Homo sapiens
tgatcccacttcact

SEQ ID NO: 3887534 - DNA, 18 bp, Homo sapiens
tgatcccacttcactgtg

SEQ ID NO: 3887535 - DNA, 19 bp, Homo sapiens
tgatcccacttcactgtga

SEQ ID NO: 3887536 - DNA, 21 bp, Homo sapiens
tgatccctgttacccagagaa

SEQ ID NO: 3887537 - DNA, 14 bp, Homo sapiens
tgatccctttccca

SEQ ID NO: 3887538 - DNA, 20 bp, Homo sapiens
tgagccaggtaatgagggac

SEQ ID NO: 3887539 - DNA, 21 bp, Homo sapiens
tgagccatgatcgagccactg

SEQ ID NO: 3887540 - DNA, 14 bp, Homo sapiens
tgagcccaggagct

SEQ ID NO: 3887541 - DNA, 13 bp, Homo sapiens
tgagcccaggccg

SEQ ID NO: 3887542 - DNA, 11 bp, Homo sapiens
tgagcccaggg

SEQ ID NO: 3887543 - DNA, 12 bp, Homo sapiens
tgagcccaggga

SEQ ID NO: 3887544 - DNA, 20 bp, Homo sapiens
tgagccgagattgcgccact

SEQ ID NO: 3887545 - DNA, 20 bp, Homo sapiens
tgagccgcatcttctccatc

SEQ ID NO: 3887546 - DNA, 21 bp, Homo sapiens
tgagccgcatcttctccatct

SEQ ID NO: 3887547 - DNA, 21 bp, Homo sapiens
tgagccgctgtgagcccctgg

SEQ ID NO: 3887548 - DNA, 22 bp, Homo sapiens
tgagcctggcccatagaaacat

SEQ ID NO: 3887549 - DNA, 15 bp, Homo sapiens
tgagccttgagagaa

SEQ ID NO: 3887550 - DNA, 13 bp, Homo sapiens
tgagcgaaatcat

SEQ ID NO: 3887551 - DNA, 19 bp, Homo sapiens
tgagctagaagctggagga

SEQ ID NO: 3887552 - DNA, 17 bp, Homo sapiens
tgagctcacaaggcagc

SEQ ID NO: 3887553 - DNA, 20 bp, Homo sapiens
tgagctcacaaggcagcaag

SEQ ID NO: 3887554 - DNA, 23 bp, Homo sapiens
tgagctcacaaggcagcaaggcc

SEQ ID NO: 3887555 - DNA, 22 bp, Homo sapiens
tgagctcagacccccactctca

SEQ ID NO: 3887556 - DNA, 12 bp, Homo sapiens
tgagctcaggca

SEQ ID NO: 3887557 - DNA, 19 bp, Homo sapiens
tgagctctatttccccacc

SEQ ID NO: 3887558 - DNA, 20 bp, Homo sapiens
tgagctctgagaggccctgg

SEQ ID NO: 3887559 - DNA, 22 bp, Homo sapiens
tgagctctgagaggccctggat

SEQ ID NO: 3887560 - DNA, 15 bp, Homo sapiens
tgagctgaagacaaa

SEQ ID NO: 3887561 - DNA, 19 bp, Homo sapiens
tgagctgagatcgtgccgt

SEQ ID NO: 3887562 - DNA, 15 bp, Homo sapiens
tgagctgcagaaacg

SEQ ID NO: 3887563 - DNA, 22 bp, Homo sapiens
tgagctggcattggtctgctga

SEQ ID NO: 3887564 - DNA, 12 bp, Homo sapiens
tgagctggggcc

SEQ ID NO: 3887565 - DNA, 15 bp, Homo sapiens
tgagctggggccaca

SEQ ID NO: 3887566 - DNA, 14 bp, Homo sapiens
tgagctggggcctg

SEQ ID NO: 3887567 - DNA, 14 bp, Homo sapiens
tgagctgtatatat

SEQ ID NO: 3887568 - DNA, 12 bp, Homo sapiens
tgagctgtcact

SEQ ID NO: 3887569 - DNA, 20 bp, Homo sapiens
tgagcttagccttgtgccct

SEQ ID NO: 3887570 - DNA, 21 bp, Homo sapiens
tgagcttagccttgtgccctg

SEQ ID NO: 3887571 - DNA, 22 bp, Homo sapiens
tgagcttagccttgtgccctgc

SEQ ID NO: 3887572 - DNA, 18 bp, Homo sapiens
tgagcttctattaaatgt

SEQ ID NO: 3887573 - DNA, 19 bp, Homo sapiens
tgaggaattatcatgggaa

SEQ ID NO: 3887574 - DNA, 13 bp, Homo sapiens
tgaggaattttct

SEQ ID NO: 3887575 - DNA, 12 bp, Homo sapiens
tgaggacatgga

SEQ ID NO: 3887576 - DNA, 18 bp, Homo sapiens
tgaggacatggagagaga

SEQ ID NO: 3887577 - DNA, 21 bp, Homo sapiens
tgaggacatgtttttgttttc

SEQ ID NO: 3887578 - DNA, 21 bp, Homo sapiens
tgaggaccacactttgagaac

SEQ ID NO: 3887579 - DNA, 14 bp, Homo sapiens
tgaggactgggggc

SEQ ID NO: 3887580 - DNA, 16 bp, Homo sapiens
tgaggagcagcttcag

SEQ ID NO: 3887581 - DNA, 23 bp, Homo sapiens
tgaggaggattgcttcttgtgaa

SEQ ID NO: 3887582 - DNA, 13 bp, Homo sapiens
tgaggagggtgcc

SEQ ID NO: 3887583 - DNA, 23 bp, Homo sapiens
tgaggagtagctgagaggaagat

SEQ ID NO: 3887584 - DNA, 13 bp, Homo sapiens
tgaggagtctgag

SEQ ID NO: 3887585 - DNA, 17 bp, Homo sapiens
tgaggagtctgaggtcc

SEQ ID NO: 3887586 - DNA, 21 bp, Homo sapiens
tgaggagtctgaggtcctgag

SEQ ID NO: 3887587 - DNA, 21 bp, Homo sapiens
tgaggatcctcacaggagcag

SEQ ID NO: 3887588 - DNA, 23 bp, Homo sapiens
tgaggatcctcacaggagcagac

SEQ ID NO: 3887589 - DNA, 17 bp, Homo sapiens
tgaggatgcaacaaata

SEQ ID NO: 3887590 - DNA, 13 bp, Homo sapiens
tgaggattcctga

SEQ ID NO: 3887591 - DNA, 20 bp, Homo sapiens
tgaggcaaaggccagcagca

SEQ ID NO: 3887592 - DNA, 18 bp, Homo sapiens
tgaggcagaagaattgaa

SEQ ID NO: 3887593 - DNA, 15 bp, Homo sapiens
tgaggcaggggcgga

SEQ ID NO: 3887594 - DNA, 14 bp, Homo sapiens
tgaggccagcctgg

SEQ ID NO: 3887595 - DNA, 21 bp, Homo sapiens
tgaggccagcctggcctcctg

SEQ ID NO: 3887596 - DNA, 16 bp, Homo sapiens
tgaggccattatttca

SEQ ID NO: 3887597 - DNA, 12 bp, Homo sapiens
tgaggcccagcc

SEQ ID NO: 3887598 - DNA, 15 bp, Homo sapiens
tgaggcccagcctgt

SEQ ID NO: 3887599 - DNA, 14 bp, Homo sapiens
tgaggcctcatccc

SEQ ID NO: 3887600 - DNA, 15 bp, Homo sapiens
tgaggcctcttggac

SEQ ID NO: 3887601 - DNA, 23 bp, Homo sapiens
tgaggcctcttggacctctgctc

SEQ ID NO: 3887602 - DNA, 14 bp, Homo sapiens
tgaggcctggccag

SEQ ID NO: 3887603 - DNA, 15 bp, Homo sapiens
tgaggcctggccagg

SEQ ID NO: 3887604 - DNA, 16 bp, Homo sapiens
tgaggcctggccaggc

SEQ ID NO: 3887605 - DNA, 23 bp, Homo sapiens
tgaggcgccccaacccgtggagg

SEQ ID NO: 3887606 - DNA, 22 bp, Homo sapiens
tgaggctcaagaggcccaggga

SEQ ID NO: 3887607 - DNA, 23 bp, Homo sapiens
tgaggctcaagaggcccagggag

SEQ ID NO: 3887608 - DNA, 15 bp, Homo sapiens
tgaggctcctgtgct

SEQ ID NO: 3887609 - DNA, 16 bp, Homo sapiens
tgaggctcctgtgcta

SEQ ID NO: 3887610 - DNA, 24 bp, Homo sapiens
tgaggctgggccagcctcagctca

SEQ ID NO: 3887611 - DNA, 22 bp, Homo sapiens
tgaggcttccaggctcttcctg

SEQ ID NO: 3887612 - DNA, 22 bp, Homo sapiens
tgagggaacagacaggagaaat

SEQ ID NO: 3887613 - DNA, 13 bp, Homo sapiens
tgagggagagact

SEQ ID NO: 3887614 - DNA, 22 bp, Homo sapiens
tgagggagggggcgctcaggac

SEQ ID NO: 3887615 - DNA, 12 bp, Homo sapiens
tgagggcagcag

SEQ ID NO: 3887616 - DNA, 16 bp, Homo sapiens
tgagggcagcagccag

SEQ ID NO: 3887617 - DNA, 19 bp, Homo sapiens
tgagggcagttcgcagcca

SEQ ID NO: 3887618 - DNA, 23 bp, Homo sapiens
tgagggcagttcgcagccaccct

SEQ ID NO: 3887619 - DNA, 13 bp, Homo sapiens
tgagggctgggca

SEQ ID NO: 3887620 - DNA, 20 bp, Homo sapiens
tgaggggggccgtgcccagg

SEQ ID NO: 3887621 - DNA, 22 bp, Homo sapiens
tgaggggggccgtgcccagggg

SEQ ID NO: 3887622 - DNA, 14 bp, Homo sapiens
tgaggggtccctga

SEQ ID NO: 3887623 - DNA, 13 bp, Homo sapiens
tgagggtcagggc

SEQ ID NO: 3887624 - DNA, 13 bp, Homo sapiens
tgaaggagaaagg

SEQ ID NO: 3887625 - DNA, 17 bp, Homo sapiens
tgaaggagaaaggagcc

SEQ ID NO: 3887626 - DNA, 18 bp, Homo sapiens
tgaaggaggtgagagaag

SEQ ID NO: 3887627 - DNA, 17 bp, Homo sapiens
tgaaggaggtgagggat

SEQ ID NO: 3887628 - DNA, 16 bp, Homo sapiens
tgaaggataagagaaa

SEQ ID NO: 3887629 - DNA, 14 bp, Homo sapiens
tgaaggcagtctga

SEQ ID NO: 3887630 - DNA, 16 bp, Homo sapiens
tgaaggcagtctgaac

SEQ ID NO: 3887631 - DNA, 19 bp, Homo sapiens
tgaagggtgacatcccagg

SEQ ID NO: 3887632 - DNA, 13 bp, Homo sapiens
tgaagggtggggt

SEQ ID NO: 3887633 - DNA, 20 bp, Homo sapiens
tgaaggttaggatttaacag

SEQ ID NO: 3887634 - DNA, 19 bp, Homo sapiens
tgaagtcaccgggatgaac

SEQ ID NO: 3887635 - DNA, 14 bp, Homo sapiens
tgaagtgaaggaga

SEQ ID NO: 3887636 - DNA, 15 bp, Homo sapiens
tgaagtgaaggagaa

SEQ ID NO: 3887637 - DNA, 18 bp, Homo sapiens
tgaagtgaaggagaaagg

SEQ ID NO: 3887638 - DNA, 22 bp, Homo sapiens
tgaagtgtgtttccttcagtgc

SEQ ID NO: 3887639 - DNA, 20 bp, Homo sapiens
tgaagtgttttgttctttct

SEQ ID NO: 3887640 - DNA, 14 bp, Homo sapiens
tgaagttaacagag

SEQ ID NO: 3887641 - DNA, 18 bp, Homo sapiens
tgaagttcatggtgatca

SEQ ID NO: 3887642 - DNA, 16 bp, Homo sapiens
tgaataaacttcagca

SEQ ID NO: 3887643 - DNA, 15 bp, Homo sapiens
tgaataaagacacct

SEQ ID NO: 3887644 - DNA, 20 bp, Homo sapiens
tgaataaagcctgcttttta

SEQ ID NO: 3887645 - DNA, 15 bp, Homo sapiens
tgaatacccccagag

SEQ ID NO: 3887646 - DNA, 13 bp, Homo sapiens
tgaatagatgtga

SEQ ID NO: 3887647 - DNA, 15 bp, Homo sapiens
tgaatatcattaaat

SEQ ID NO: 3887648 - DNA, 22 bp, Homo sapiens
tgaatcagaccctaccccacca

SEQ ID NO: 3887649 - DNA, 19 bp, Homo sapiens
tgaatcatgttaatagaca

SEQ ID NO: 3887650 - DNA, 20 bp, Homo sapiens
tgaatctgcagggagcaact

SEQ ID NO: 3887651 - DNA, 19 bp, Homo sapiens
tgaatctgttactgaaatg

SEQ ID NO: 3887652 - DNA, 15 bp, Homo sapiens
tgaatcttactcctt

SEQ ID NO: 3887653 - DNA, 13 bp, Homo sapiens
tgaatctttgtgc

SEQ ID NO: 3887654 - DNA, 16 bp, Homo sapiens
tgaatgacatatttta

SEQ ID NO: 3887655 - DNA, 15 bp, Homo sapiens
tgaatgacatcaaca

SEQ ID NO: 3887656 - DNA, 20 bp, Homo sapiens
tgaatgccttccgggccggg

SEQ ID NO: 3887657 - DNA, 14 bp, Homo sapiens
tgaatgctgagacc

SEQ ID NO: 3887658 - DNA, 18 bp, Homo sapiens
tgaatggccctagaactg

SEQ ID NO: 3887659 - DNA, 21 bp, Homo sapiens
tgaatggttccatgcctgagg

SEQ ID NO: 3887660 - DNA, 16 bp, Homo sapiens
tgaatgtattgaactt

SEQ ID NO: 3887661 - DNA, 16 bp, Homo sapiens
tgaatgtcattcacaa

SEQ ID NO: 3887662 - DNA, 15 bp, Homo sapiens
tgaatgttatttgtt

SEQ ID NO: 3887663 - DNA, 21 bp, Homo sapiens
tgaatgtttccaacctggagt

SEQ ID NO: 3887664 - DNA, 11 bp, Homo sapiens
tgaattaaaac

SEQ ID NO: 3887665 - DNA, 14 bp, Homo sapiens
tgaattaagttatt

SEQ ID NO: 3887666 - DNA, 21 bp, Homo sapiens
tgaattattttgttgtgattt

SEQ ID NO: 3887667 - DNA, 22 bp, Homo sapiens
tgaattattttgttgtgatttt

SEQ ID NO: 3887668 - DNA, 17 bp, Homo sapiens
tgaattctgtgaagaat

SEQ ID NO: 3887669 - DNA, 20 bp, Homo sapiens
tgaatttagtgagatttacc

SEQ ID NO: 3887670 - DNA, 15 bp, Homo sapiens
tgaatttattattgt

SEQ ID NO: 3887671 - DNA, 19 bp, Homo sapiens
tgaatttcaggcattttgt

SEQ ID NO: 3887672 - DNA, 16 bp, Homo sapiens
tgaatttcctatctgt

SEQ ID NO: 3887673 - DNA, 14 bp, Homo sapiens
tgaatttgggcctc

SEQ ID NO: 3887674 - DNA, 17 bp, Homo sapiens
tgaatttgggcctcttg

SEQ ID NO: 3887675 - DNA, 17 bp, Homo sapiens
tgaattttaaatgttca

SEQ ID NO: 3887676 - DNA, 16 bp, Homo sapiens
tgaattttatcagcca

SEQ ID NO: 3887677 - DNA, 14 bp, Homo sapiens
tgaattttgttgct

SEQ ID NO: 3887678 - DNA, 19 bp, Homo sapiens
tgacaaagaaacccaagtg

SEQ ID NO: 3887679 - DNA, 22 bp, Homo sapiens
tgacaacagaagcttcagaagt

SEQ ID NO: 3887680 - DNA, 13 bp, Homo sapiens
tgacaacagactg

SEQ ID NO: 3887681 - DNA, 15 bp, Homo sapiens
tgacaacatcccaca

SEQ ID NO: 3887682 - DNA, 18 bp, Homo sapiens
tgacaacatcccacagtg

SEQ ID NO: 3887683 - DNA, 15 bp, Homo sapiens
tgacaagataaagga

SEQ ID NO: 3887684 - DNA, 15 bp, Homo sapiens
tgacaagcactgcta

SEQ ID NO: 3887685 - DNA, 16 bp, Homo sapiens
tgacaagggctgacct

SEQ ID NO: 3887686 - DNA, 17 bp, Homo sapiens
tgacaaggtagacatgg

SEQ ID NO: 3887687 - DNA, 14 bp, Homo sapiens
tgacaatatgattt

SEQ ID NO: 3887688 - DNA, 20 bp, Homo sapiens
tgacaatatgattttaaatt

SEQ ID NO: 3887689 - DNA, 12 bp, Homo sapiens
tgacaatgcaat

SEQ ID NO: 3887690 - DNA, 20 bp, Homo sapiens
tgacacaagaggaataagaa

SEQ ID NO: 3887691 - DNA, 20 bp, Homo sapiens
tgacacacgtatttatattt

SEQ ID NO: 3887692 - DNA, 17 bp, Homo sapiens
tgacaccgtccctcagt

SEQ ID NO: 3887693 - DNA, 21 bp, Homo sapiens
tgacaccgtccctcagtgata

SEQ ID NO: 3887694 - DNA, 19 bp, Homo sapiens
tgacacctaccatgctgct

SEQ ID NO: 3887695 - DNA, 23 bp, Homo sapiens
tgacacggtaggccaagctgaag

SEQ ID NO: 3887696 - DNA, 20 bp, Homo sapiens
tgacacggtgaaatccaggt

SEQ ID NO: 3887697 - DNA, 19 bp, Homo sapiens
tgacactctagtgacttcc

SEQ ID NO: 3887698 - DNA, 18 bp, Homo sapiens
tgacagaatcttgtattt

SEQ ID NO: 3887699 - DNA, 16 bp, Homo sapiens
tgacagaatgctgttt

SEQ ID NO: 3887700 - DNA, 20 bp, Homo sapiens
tgacagacattttcaataat

SEQ ID NO: 3887701 - DNA, 21 bp, Homo sapiens
tgacagatacatagatggacc

SEQ ID NO: 3887702 - DNA, 19 bp, Homo sapiens
tgacagatgtcagccgagc

SEQ ID NO: 3887703 - DNA, 19 bp, Homo sapiens
tgacagatgttgaatgccc

SEQ ID NO: 3887704 - DNA, 18 bp, Homo sapiens
tgacaggaaagccctccc

SEQ ID NO: 3887705 - DNA, 15 bp, Homo sapiens
tgacaggcccagtgg

SEQ ID NO: 3887706 - DNA, 20 bp, Homo sapiens
tgacaggcccagtggaacag

SEQ ID NO: 3887707 - DNA, 15 bp, Homo sapiens
tgacaggtaaactat

SEQ ID NO: 3887708 - DNA, 16 bp, Homo sapiens
tgacaggttcccagca

SEQ ID NO: 3887709 - DNA, 20 bp, Homo sapiens
tgacaggttcccagcagctg

SEQ ID NO: 3887710 - DNA, 20 bp, Homo sapiens
tgactcttgttttcagtttc

SEQ ID NO: 3887711 - DNA, 22 bp, Homo sapiens
tgactctttgacgggaggcctc

SEQ ID NO: 3887712 - DNA, 15 bp, Homo sapiens
tgactgccccaactc

SEQ ID NO: 3887713 - DNA, 19 bp, Homo sapiens
tgactgccccaactcctgg

SEQ ID NO: 3887714 - DNA, 16 bp, Homo sapiens
tgactgcgatcttcag

SEQ ID NO: 3887715 - DNA, 23 bp, Homo sapiens
tgactgctccccagccctggctc

SEQ ID NO: 3887716 - DNA, 16 bp, Homo sapiens
tgactggcaggtgcag

SEQ ID NO: 3887717 - DNA, 23 bp, Homo sapiens
tgactgggtttctctgtatagta

SEQ ID NO: 3887718 - DNA, 16 bp, Homo sapiens
tgactgtactcctccc

SEQ ID NO: 3887719 - DNA, 17 bp, Homo sapiens
tgactgtactcctccca

SEQ ID NO: 3887720 - DNA, 16 bp, Homo sapiens
tgactgtcactgttcc

SEQ ID NO: 3887721 - DNA, 22 bp, Homo sapiens
tgactgtcgtgtttacaaaagg

SEQ ID NO: 3887722 - DNA, 15 bp, Homo sapiens
tgacttctaagtaaa

SEQ ID NO: 3887723 - DNA, 20 bp, Homo sapiens
tgacttctgccccagcttta

SEQ ID NO: 3887724 - DNA, 18 bp, Homo sapiens
tgacttttccatgtatct

SEQ ID NO: 3887725 - DNA, 17 bp, Homo sapiens
tgactttttagccagtg

SEQ ID NO: 3887726 - DNA, 15 bp, Homo sapiens
tgactttttataatg

SEQ ID NO: 3887727 - DNA, 22 bp, Homo sapiens
tgactttttctgagcttttcat

SEQ ID NO: 3887728 - DNA, 21 bp, Homo sapiens
tgagaaaaatttacatggcaa

SEQ ID NO: 3887729 - DNA, 16 bp, Homo sapiens
tgagaaagaatgagca

SEQ ID NO: 3887730 - DNA, 20 bp, Homo sapiens
tgagaaagactattcaaaca

SEQ ID NO: 3887731 - DNA, 21 bp, Homo sapiens
tgagaacaagtcacagctgca

SEQ ID NO: 3887732 - DNA, 17 bp, Homo sapiens
tgagaagaagctgagga

SEQ ID NO: 3887733 - DNA, 16 bp, Homo sapiens
tgagaagagggcctgt

SEQ ID NO: 3887734 - DNA, 21 bp, Homo sapiens
tgagaagagggcctgtgggag

SEQ ID NO: 3887735 - DNA, 17 bp, Homo sapiens
tgagaagttttgtacag

SEQ ID NO: 3887736 - DNA, 24 bp, Homo sapiens
tgagaagttttgtacagagaatta

SEQ ID NO: 3887737 - DNA, 12 bp, Homo sapiens
tgagaatgtgat

SEQ ID NO: 3887738 - DNA, 19 bp, Homo sapiens
tgagaattattcctttcct

SEQ ID NO: 3887739 - DNA, 13 bp, Homo sapiens
tgagaattttaaa

SEQ ID NO: 3887740 - DNA, 16 bp, Homo sapiens
tgagacaagccctggc

SEQ ID NO: 3887741 - DNA, 17 bp, Homo sapiens
tgagacaagccctggca

SEQ ID NO: 3887742 - DNA, 20 bp, Homo sapiens
tgagacaagccctggcaaca

SEQ ID NO: 3887743 - DNA, 18 bp, Homo sapiens
tgagacagccacttggtt

SEQ ID NO: 3887744 - DNA, 17 bp, Homo sapiens
tgagacattacagtttg

SEQ ID NO: 3887745 - DNA, 15 bp, Homo sapiens
tgagaccacctctca

SEQ ID NO: 3887746 - DNA, 21 bp, Homo sapiens
tgagacggtgctcgcttctcc

SEQ ID NO: 3887747 - DNA, 20 bp, Homo sapiens
tgagactataactgtcatct

SEQ ID NO: 3887748 - DNA, 13 bp, Homo sapiens
tgagactccagaa

SEQ ID NO: 3887749 - DNA, 21 bp, Homo sapiens
tgagactccagaatctgctgt

SEQ ID NO: 3887750 - DNA, 19 bp, Homo sapiens
tgagactctcttaggagca

SEQ ID NO: 3887751 - DNA, 13 bp, Homo sapiens
tgagactggcact

SEQ ID NO: 3887752 - DNA, 14 bp, Homo sapiens
tgagacttgctctc

SEQ ID NO: 3887753 - DNA, 19 bp, Homo sapiens
tgagagaaaaagtgcccct

SEQ ID NO: 3887754 - DNA, 16 bp, Homo sapiens
tgagagaagccacgct

SEQ ID NO: 3887755 - DNA, 21 bp, Homo sapiens
tgagagaagccacgctgtcct

SEQ ID NO: 3887756 - DNA, 18 bp, Homo sapiens
tgagagaattgtatcatt

SEQ ID NO: 3887757 - DNA, 17 bp, Homo sapiens
tgagagccctgctgtgg

SEQ ID NO: 3887758 - DNA, 13 bp, Homo sapiens
tgagaggaagatg

SEQ ID NO: 3887759 - DNA, 22 bp, Homo sapiens
tgagaggaagatgaagagaagc

SEQ ID NO: 3887760 - DNA, 14 bp, Homo sapiens
tgagaggcagaagt

SEQ ID NO: 3887761 - DNA, 18 bp, Homo sapiens
tgagaggcagacttccct

SEQ ID NO: 3887762 - DNA, 12 bp, Homo sapiens
tgagaggccctg

SEQ ID NO: 3887763 - DNA, 13 bp, Homo sapiens
tgagaggccctgg

SEQ ID NO: 3887764 - DNA, 22 bp, Homo sapiens
tgagagggcatgcgcacaaggc

SEQ ID NO: 3887765 - DNA, 14 bp, Homo sapiens
tgagagttggctca

SEQ ID NO: 3887766 - DNA, 19 bp, Homo sapiens
tgagagttggctcaggcag

SEQ ID NO: 3887767 - DNA, 18 bp, Homo sapiens
tgagatctccctccaggg

SEQ ID NO: 3887768 - DNA, 19 bp, Homo sapiens
tgagatctccctccaggga

SEQ ID NO: 3887769 - DNA, 14 bp, Homo sapiens
tgagatgatgaaaa

SEQ ID NO: 3887770 - DNA, 19 bp, Homo sapiens
tgagatgtgaacacatcag

SEQ ID NO: 3887771 - DNA, 18 bp, Homo sapiens
tgagattactttgtcccg

SEQ ID NO: 3887772 - DNA, 14 bp, Homo sapiens
tgagatttctttta

SEQ ID NO: 3887773 - DNA, 15 bp, Homo sapiens
tgagatttcttttaa

SEQ ID NO: 3887774 - DNA, 21 bp, Homo sapiens
tgagatttcttttaaagaagt

SEQ ID NO: 3887775 - DNA, 20 bp, Homo sapiens
tgagatttgccagcacaggg

SEQ ID NO: 3887776 - DNA, 16 bp, Homo sapiens
tgagcaaatgtggctc

SEQ ID NO: 3887777 - DNA, 18 bp, Homo sapiens
tgagcaaatgtggctcct

SEQ ID NO: 3887778 - DNA, 19 bp, Homo sapiens
tgagcaaatgtggctcctg

SEQ ID NO: 3887779 - DNA, 23 bp, Homo sapiens
tgagcacatgcgtatatgtgcgt

SEQ ID NO: 3887780 - DNA, 18 bp, Homo sapiens
tgagcactgccaggaggg

SEQ ID NO: 3887781 - DNA, 22 bp, Homo sapiens
tgagcactgccaggagggacaa

SEQ ID NO: 3887782 - DNA, 20 bp, Homo sapiens
tgagcagatctgaaaggcac

SEQ ID NO: 3887783 - DNA, 20 bp, Homo sapiens
tgagcaggattttaatcttt

SEQ ID NO: 3887784 - DNA, 13 bp, Homo sapiens
tgagcaggcccga

SEQ ID NO: 3887785 - DNA, 18 bp, Homo sapiens
tgagcaggcccgacagag

SEQ ID NO: 3887786 - DNA, 21 bp, Homo sapiens
tgagcaggcccgacagagaga

SEQ ID NO: 3887787 - DNA, 12 bp, Homo sapiens
tgagcagggccg

SEQ ID NO: 3887788 - DNA, 14 bp, Homo sapiens
tgagcagggccggg

SEQ ID NO: 3887789 - DNA, 20 bp, Homo sapiens
tgagcagggccggggaactg

SEQ ID NO: 3887790 - DNA, 18 bp, Homo sapiens
tgagcatgcacagctgct

SEQ ID NO: 3887791 - DNA, 20 bp, Homo sapiens
tgagcatgcacagctgcttg

SEQ ID NO: 3887792 - DNA, 18 bp, Homo sapiens
tgagcatgggtgtgccct

SEQ ID NO: 3887793 - DNA, 18 bp, Homo sapiens
tgagccaaacacactgta

SEQ ID NO: 3887794 - DNA, 21 bp, Homo sapiens
tgagccaaacacactgtaaat

SEQ ID NO: 3887795 - DNA, 21 bp, Homo sapiens
tgacataacactataaaggtt

SEQ ID NO: 3887796 - DNA, 18 bp, Homo sapiens
tgacatcacttgtacaaa

SEQ ID NO: 3887797 - DNA, 21 bp, Homo sapiens
tgacatcacttgtacaaaata

SEQ ID NO: 3887798 - DNA, 12 bp, Homo sapiens
tgacatcccagg

SEQ ID NO: 3887799 - DNA, 12 bp, Homo sapiens
tgacatctcctc

SEQ ID NO: 3887800 - DNA, 14 bp, Homo sapiens
tgacatctctttga

SEQ ID NO: 3887801 - DNA, 13 bp, Homo sapiens
tgacatgcactga

SEQ ID NO: 3887802 - DNA, 17 bp, Homo sapiens
tgacatgcactgaccct

SEQ ID NO: 3887803 - DNA, 16 bp, Homo sapiens
tgacatgccaccctct

SEQ ID NO: 3887804 - DNA, 13 bp, Homo sapiens
tgacatggctttg

SEQ ID NO: 3887805 - DNA, 17 bp, Homo sapiens
tgacatgtaatgaatgg

SEQ ID NO: 3887806 - DNA, 20 bp, Homo sapiens
tgacatgtaatgaatggtca

SEQ ID NO: 3887807 - DNA, 14 bp, Homo sapiens
tgacatgtgcctgt

SEQ ID NO: 3887808 - DNA, 10 bp, Homo sapiens
tgacattcct

SEQ ID NO: 3887809 - DNA, 11 bp, Homo sapiens
tgacattcctt

SEQ ID NO: 3887810 - DNA, 17 bp, Homo sapiens
tgacattccttgtcacc

SEQ ID NO: 3887811 - DNA, 15 bp, Homo sapiens
tgacatttctaacat

SEQ ID NO: 3887812 - DNA, 22 bp, Homo sapiens
tgacatttctaacatatgtatt

SEQ ID NO: 3887813 - DNA, 17 bp, Homo sapiens
tgaccaagaaaaagaaa

SEQ ID NO: 3887814 - DNA, 14 bp, Homo sapiens
tgaccacacgctgt

SEQ ID NO: 3887815 - DNA, 21 bp, Homo sapiens
tgaccacacgctgtctcttga

SEQ ID NO: 3887816 - DNA, 17 bp, Homo sapiens
tgaccacatacgtgtta

SEQ ID NO: 3887817 - DNA, 21 bp, Homo sapiens
tgaccacggacgtttccatca

SEQ ID NO: 3887818 - DNA, 16 bp, Homo sapiens
tgaccacgggcctcag

SEQ ID NO: 3887819 - DNA, 21 bp, Homo sapiens
tgaccagacctagacctgggc

SEQ ID NO: 3887820 - DNA, 21 bp, Homo sapiens
tgaccagcctccatgctgcct

SEQ ID NO: 3887821 - DNA, 12 bp, Homo sapiens
tgaccaggacta

SEQ ID NO: 3887822 - DNA, 24 bp, Homo sapiens
tgaccagttctggccaggagctgg

SEQ ID NO: 3887823 - DNA, 16 bp, Homo sapiens
tgacccaaagaccaat

SEQ ID NO: 3887824 - DNA, 17 bp, Homo sapiens
tgacccaatgctcctgg

SEQ ID NO: 3887825 - DNA, 14 bp, Homo sapiens
tgacccacagcctc

SEQ ID NO: 3887826 - DNA, 15 bp, Homo sapiens
tgacccacagcctct

SEQ ID NO: 3887827 - DNA, 22 bp, Homo sapiens
tgacccagagtggagtctgagt

SEQ ID NO: 3887828 - DNA, 12 bp, Homo sapiens
tgacccagtccc

SEQ ID NO: 3887829 - DNA, 13 bp, Homo sapiens
tgaccccagggca

SEQ ID NO: 3887830 - DNA, 17 bp, Homo sapiens
tgaccccagggcacagg

SEQ ID NO: 3887831 - DNA, 18 bp, Homo sapiens
tgaccccagggcacagga

SEQ ID NO: 3887832 - DNA, 19 bp, Homo sapiens
tgaccccagggcacaggag

SEQ ID NO: 3887833 - DNA, 21 bp, Homo sapiens
tgaccccagggcacaggagct

SEQ ID NO: 3887834 - DNA, 19 bp, Homo sapiens
tgacccggcaccccctgca

SEQ ID NO: 3887835 - DNA, 20 bp, Homo sapiens
tgacccggcaccccctgcag

SEQ ID NO: 3887836 - DNA, 22 bp, Homo sapiens
tgacccggcaccccctgcagct

SEQ ID NO: 3887837 - DNA, 22 bp, Homo sapiens
tgaccctctgaatggtccaggg

SEQ ID NO: 3887838 - DNA, 12 bp, Homo sapiens
tgacccttcagg

SEQ ID NO: 3887839 - DNA, 15 bp, Homo sapiens
tgacccttcagggcc

SEQ ID NO: 3887840 - DNA, 17 bp, Homo sapiens
tgacccttcagggccag

SEQ ID NO: 3887841 - DNA, 23 bp, Homo sapiens
tgacccttcccaatcagcactga

SEQ ID NO: 3887842 - DNA, 15 bp, Homo sapiens
tgaccggcacctgcg

SEQ ID NO: 3887843 - DNA, 19 bp, Homo sapiens
tgaccgggacttcaaagcc

SEQ ID NO: 3887844 - DNA, 17 bp, Homo sapiens
tgaccgttttcatcctg

SEQ ID NO: 3887845 - DNA, 22 bp, Homo sapiens
tgaccgttttcatcctggcctc

SEQ ID NO: 3887846 - DNA, 23 bp, Homo sapiens
tgaccgttttcatcctggcctcc

SEQ ID NO: 3887847 - DNA, 14 bp, Homo sapiens
tgacctcagctgca

SEQ ID NO: 3887848 - DNA, 21 bp, Homo sapiens
tgacctcagctgcacattcct

SEQ ID NO: 3887849 - DNA, 22 bp, Homo sapiens
tgacctcagctgcacattcctg

SEQ ID NO: 3887850 - DNA, 12 bp, Homo sapiens
tgacctcccagc

SEQ ID NO: 3887851 - DNA, 14 bp, Homo sapiens
tgacctcccagccc

SEQ ID NO: 3887852 - DNA, 15 bp, Homo sapiens
tgacctcccagccct

SEQ ID NO: 3887853 - DNA, 20 bp, Homo sapiens
tgacctgaggctcctgtgct

SEQ ID NO: 3887854 - DNA, 11 bp, Homo sapiens
tgacctgctga

SEQ ID NO: 3887855 - DNA, 13 bp, Homo sapiens
tgacctgctgagc

SEQ ID NO: 3887856 - DNA, 14 bp, Homo sapiens
tgacctgctgagct

SEQ ID NO: 3887857 - DNA, 16 bp, Homo sapiens
tgacctgctgagctct

SEQ ID NO: 3887858 - DNA, 19 bp, Homo sapiens
tgacctgctgagctctgag

SEQ ID NO: 3887859 - DNA, 20 bp, Homo sapiens
tgacctgctgagctctgaga

SEQ ID NO: 3887860 - DNA, 21 bp, Homo sapiens
tgacctgctgagctctgagag

SEQ ID NO: 3887861 - DNA, 19 bp, Homo sapiens
tgacctgttagatgtgaca

SEQ ID NO: 3887862 - DNA, 15 bp, Homo sapiens
tgacgcatcctgcag

SEQ ID NO: 3887863 - DNA, 19 bp, Homo sapiens
tgacgggagcctcctctgc

SEQ ID NO: 3887864 - DNA, 15 bp, Homo sapiens
tgacgggaggcctca

SEQ ID NO: 3887865 - DNA, 18 bp, Homo sapiens
tgacgggaggcctcagtt

SEQ ID NO: 3887866 - DNA, 19 bp, Homo sapiens
tgacgtcaagtctccttcc

SEQ ID NO: 3887867 - DNA, 16 bp, Homo sapiens
tgacgtgaccatggtg

SEQ ID NO: 3887868 - DNA, 21 bp, Homo sapiens
tgactagaggcagggagggga

SEQ ID NO: 3887869 - DNA, 17 bp, Homo sapiens
tgactaggaagaaaaca

SEQ ID NO: 3887870 - DNA, 16 bp, Homo sapiens
tgactagtcatagaaa

SEQ ID NO: 3887871 - DNA, 20 bp, Homo sapiens
tgactatggctctggcacca

SEQ ID NO: 3887872 - DNA, 11 bp, Homo sapiens
tgactcaccca

SEQ ID NO: 3887873 - DNA, 15 bp, Homo sapiens
tgactcacccaagca

SEQ ID NO: 3887874 - DNA, 14 bp, Homo sapiens
tgactccagcctgc

SEQ ID NO: 3887875 - DNA, 17 bp, Homo sapiens
tgactccagtgagctgg

SEQ ID NO: 3887876 - DNA, 19 bp, Homo sapiens
tgactccatatggaggcct

SEQ ID NO: 3887877 - DNA, 18 bp, Homo sapiens
tgactccatgtgtgctgt

SEQ ID NO: 3887878 - DNA, 22 bp, Homo sapiens
tgactccatgtgtgctgtcctc

SEQ ID NO: 3887879 - DNA, 19 bp, Homo sapiens
tgactcggtgtaaaaccat

SEQ ID NO: 3887880 - DNA, 12 bp, Homo sapiens
tgactctaaatt

SEQ ID NO: 3887881 - DNA, 13 bp, Homo sapiens
tgaaaactgtaaa

SEQ ID NO: 3887882 - DNA, 20 bp, Homo sapiens
tgaaaactgtaaatacaaaa

SEQ ID NO: 3887883 - DNA, 14 bp, Homo sapiens
tgaaaagaggaaca

SEQ ID NO: 3887884 - DNA, 18 bp, Homo sapiens
tgaaaagcaattgccctg

SEQ ID NO: 3887885 - DNA, 21 bp, Homo sapiens
tgaaaatcatgaaaagaggaa

SEQ ID NO: 3887886 - DNA, 14 bp, Homo sapiens
tgaaaatgtcaaag

SEQ ID NO: 3887887 - DNA, 15 bp, Homo sapiens
tgaaaattattttaa

SEQ ID NO: 3887888 - DNA, 21 bp, Homo sapiens
tgaaacaagataactgagaat

SEQ ID NO: 3887889 - DNA, 13 bp, Homo sapiens
tgaaacagaaaca

SEQ ID NO: 3887890 - DNA, 23 bp, Homo sapiens
tgaaacccattaggcatgcctaa

SEQ ID NO: 3887891 - DNA, 16 bp, Homo sapiens
tgaaaccctgtctcta

SEQ ID NO: 3887892 - DNA, 19 bp, Homo sapiens
tgaaactagaagtcaaaaa

SEQ ID NO: 3887893 - DNA, 15 bp, Homo sapiens
tgaaagatgcaagca

SEQ ID NO: 3887894 - DNA, 11 bp, Homo sapiens
tgaaagcacag

SEQ ID NO: 3887895 - DNA, 21 bp, Homo sapiens
tgaaagcacaggagacactgt

SEQ ID NO: 3887896 - DNA, 14 bp, Homo sapiens
tgaaagcagcagct

SEQ ID NO: 3887897 - DNA, 16 bp, Homo sapiens
tgaaagcagcagctag

SEQ ID NO: 3887898 - DNA, 17 bp, Homo sapiens
tgaaagcagcagctagg

SEQ ID NO: 3887899 - DNA, 12 bp, Homo sapiens
tgaaagctgaat

SEQ ID NO: 3887900 - DNA, 15 bp, Homo sapiens
tgaaagggctatggc

SEQ ID NO: 3887901 - DNA, 17 bp, Homo sapiens
tgaaataatgttctgtc

SEQ ID NO: 3887902 - DNA, 18 bp, Homo sapiens
tgaaataattaaaaacca

SEQ ID NO: 3887903 - DNA, 22 bp, Homo sapiens
tgaaataccagtgaaccaaaga

SEQ ID NO: 3887904 - DNA, 23 bp, Homo sapiens
tgaaataccagtgaaccaaagag

SEQ ID NO: 3887905 - DNA, 14 bp, Homo sapiens
tgaaataccagtgt

SEQ ID NO: 3887906 - DNA, 15 bp, Homo sapiens
tgaaatgaaagaact

SEQ ID NO: 3887907 - DNA, 21 bp, Homo sapiens
tgaaatgaggagagaaggaca

SEQ ID NO: 3887908 - DNA, 11 bp, Homo sapiens
tgaaatgtctt

SEQ ID NO: 3887909 - DNA, 16 bp, Homo sapiens
tgaaattcttgaagtt

SEQ ID NO: 3887910 - DNA, 16 bp, Homo sapiens
tgaaattgaacctggt

SEQ ID NO: 3887911 - DNA, 13 bp, Homo sapiens
tgaaattgagaag

SEQ ID NO: 3887912 - DNA, 22 bp, Homo sapiens
tgaaatttcagattcccagagc

SEQ ID NO: 3887913 - DNA, 19 bp, Homo sapiens
tgaaattttctagactttc

SEQ ID NO: 3887914 - DNA, 22 bp, Homo sapiens
tgaacaaacactgaatcatgtt

SEQ ID NO: 3887915 - DNA, 23 bp, Homo sapiens
tgaacaaacactgaatcatgtta

SEQ ID NO: 3887916 - DNA, 18 bp, Homo sapiens
tgaacaagaattggaagc

SEQ ID NO: 3887917 - DNA, 23 bp, Homo sapiens
tgaacacagctgctgaagaggca

SEQ ID NO: 3887918 - DNA, 15 bp, Homo sapiens
tgaacacagtttagt

SEQ ID NO: 3887919 - DNA, 14 bp, Homo sapiens
tgaacatggactct

SEQ ID NO: 3887920 - DNA, 12 bp, Homo sapiens
tgaacccaggac

SEQ ID NO: 3887921 - DNA, 13 bp, Homo sapiens
tgaacccaggaca

SEQ ID NO: 3887922 - DNA, 19 bp, Homo sapiens
tgaacccattttgagtgac

SEQ ID NO: 3887923 - DNA, 13 bp, Homo sapiens
tgaaccccatggg

SEQ ID NO: 3887924 - DNA, 19 bp, Homo sapiens
tgaaccccatgggcttgga

SEQ ID NO: 3887925 - DNA, 16 bp, Homo sapiens
tgaacctcagtttcct

SEQ ID NO: 3887926 - DNA, 18 bp, Homo sapiens
tgaacctcagtttcctca

SEQ ID NO: 3887927 - DNA, 18 bp, Homo sapiens
tgaacctttaaagtaaag

SEQ ID NO: 3887928 - DNA, 15 bp, Homo sapiens
tgaacggggagaaaa

SEQ ID NO: 3887929 - DNA, 16 bp, Homo sapiens
tgaactaataaaagca

SEQ ID NO: 3887930 - DNA, 20 bp, Homo sapiens
tgaactatttctacacagtg

SEQ ID NO: 3887931 - DNA, 19 bp, Homo sapiens
tgaactcagagcccctccc

SEQ ID NO: 3887932 - DNA, 22 bp, Homo sapiens
tgaactcagagcccctccctgc

SEQ ID NO: 3887933 - DNA, 16 bp, Homo sapiens
tgaacttacacttgga

SEQ ID NO: 3887934 - DNA, 16 bp, Homo sapiens
tgaacttgaggacaca

SEQ ID NO: 3887935 - DNA, 17 bp, Homo sapiens
tgaacttgaggacacat

SEQ ID NO: 3887936 - DNA, 20 bp, Homo sapiens
tgaacttgagtaaataacaa

SEQ ID NO: 3887937 - DNA, 17 bp, Homo sapiens
tgaactttccaaaacct

SEQ ID NO: 3887938 - DNA, 22 bp, Homo sapiens
tgaactttctcttcatactttt

SEQ ID NO: 3887939 - DNA, 17 bp, Homo sapiens
tgaagaaaactccttta

SEQ ID NO: 3887940 - DNA, 15 bp, Homo sapiens
tgaagaaaatgaagc

SEQ ID NO: 3887941 - DNA, 18 bp, Homo sapiens
tgaagaaacagataccat

SEQ ID NO: 3887942 - DNA, 14 bp, Homo sapiens
tgaagaaaccacag

SEQ ID NO: 3887943 - DNA, 13 bp, Homo sapiens
tgaagaacagtaa

SEQ ID NO: 3887944 - DNA, 20 bp, Homo sapiens
tgaagaacagtaactgccat

SEQ ID NO: 3887945 - DNA, 16 bp, Homo sapiens
tgaagaatcaagaggg

SEQ ID NO: 3887946 - DNA, 22 bp, Homo sapiens
tgaagacaaaccactgtacata

SEQ ID NO: 3887947 - DNA, 23 bp, Homo sapiens
tgaagacaaaccactgtacatat

SEQ ID NO: 3887948 - DNA, 23 bp, Homo sapiens
tgaagacccagtgtaaagaataa

SEQ ID NO: 3887949 - DNA, 15 bp, Homo sapiens
tgaagagaagctgag

SEQ ID NO: 3887950 - DNA, 20 bp, Homo sapiens
tgaagagaagctgagaagaa

SEQ ID NO: 3887951 - DNA, 23 bp, Homo sapiens
tgaagagaccaagactctgaaat

SEQ ID NO: 3887952 - DNA, 24 bp, Homo sapiens
tgaagagtttaactttgggcccag

SEQ ID NO: 3887953 - DNA, 15 bp, Homo sapiens
tgaagattctcctgt

SEQ ID NO: 3887954 - DNA, 19 bp, Homo sapiens
tgaagattctcctgtgcta

SEQ ID NO: 3887955 - DNA, 17 bp, Homo sapiens
tgaagcaaagcaccagc

SEQ ID NO: 3887956 - DNA, 18 bp, Homo sapiens
tgaagcaaagcaccagct

SEQ ID NO: 3887957 - DNA, 13 bp, Homo sapiens
tgaagcagtgcct

SEQ ID NO: 3887958 - DNA, 23 bp, Homo sapiens
tgaagcagtgcctcgaggcaccg

SEQ ID NO: 3887959 - DNA, 15 bp, Homo sapiens
tgaagcccaataaac

SEQ ID NO: 3887960 - DNA, 22 bp, Homo sapiens
tgaagccccttgtcctctcccg

SEQ ID NO: 3887961 - DNA, 23 bp, Homo sapiens
tgaagccccttgtcctctcccgc

SEQ ID NO: 3887962 - DNA, 16 bp, Homo sapiens
tgaagcctatttattt

SEQ ID NO: 3887963 - DNA, 19 bp, Homo sapiens
tgaagcctctgccctgcct

SEQ ID NO: 3887964 - DNA, 15 bp, Homo sapiens
tgaagctattgatgt

SEQ ID NO: 3887965 - DNA, 23 bp, Homo sapiens
tgaagctattgatgtttccagaa

SEQ ID NO: 3887966 - DNA, 21 bp, Homo sapiens
tgaaggaatagccagagagga

SEQ ID NO: 3887967 - DNA, 12 bp, Homo sapiens
tctgtccaggcc

SEQ ID NO: 3887968 - DNA, 14 bp, Homo sapiens
tctgtccaggccac

SEQ ID NO: 3887969 - DNA, 18 bp, Homo sapiens
tctgtccaggccactgtg

SEQ ID NO: 3887970 - DNA, 13 bp, Homo sapiens
tctgtctctcttg

SEQ ID NO: 3887971 - DNA, 15 bp, Homo sapiens
tctgtctttgtggga

SEQ ID NO: 3887972 - DNA, 14 bp, Homo sapiens
tctgtgaagaatga

SEQ ID NO: 3887973 - DNA, 20 bp, Homo sapiens
tctgtgaagaatgaagtgga

SEQ ID NO: 3887974 - DNA, 18 bp, Homo sapiens
tctgtgaattgagctgca

SEQ ID NO: 3887975 - DNA, 13 bp, Homo sapiens
tctgtgccagagc

SEQ ID NO: 3887976 - DNA, 15 bp, Homo sapiens
tctgtgccagagcct

SEQ ID NO: 3887977 - DNA, 17 bp, Homo sapiens
tctgtgccagagcctgg

SEQ ID NO: 3887978 - DNA, 22 bp, Homo sapiens
tctgtgccagagcctggggctc

SEQ ID NO: 3887979 - DNA, 23 bp, Homo sapiens
tctgtgctgccctgctctgggga

SEQ ID NO: 3887980 - DNA, 15 bp, Homo sapiens
tctgtgctgtgcctg

SEQ ID NO: 3887981 - DNA, 14 bp, Homo sapiens
tctgtggcctgtgt

SEQ ID NO: 3887982 - DNA, 19 bp, Homo sapiens
tctgtgggcttggccttgt

SEQ ID NO: 3887983 - DNA, 11 bp, Homo sapiens
tctgtggtggg

SEQ ID NO: 3887984 - DNA, 18 bp, Homo sapiens
tctgtgtgatgaactttc

SEQ ID NO: 3887985 - DNA, 16 bp, Homo sapiens
tctgtgtgtctgatgt

SEQ ID NO: 3887986 - DNA, 19 bp, Homo sapiens
tctgtgtgtctgatgtttg

SEQ ID NO: 3887987 - DNA, 13 bp, Homo sapiens
tctgtgttgaaca

SEQ ID NO: 3887988 - DNA, 20 bp, Homo sapiens
tctgtgtttgaccttcacat

SEQ ID NO: 3887989 - DNA, 14 bp, Homo sapiens
tctgttactgaaat

SEQ ID NO: 3887990 - DNA, 21 bp, Homo sapiens
tctgttctcaaatgctaaatg

SEQ ID NO: 3887991 - DNA, 13 bp, Homo sapiens
tctgttctgttga

SEQ ID NO: 3887992 - DNA, 14 bp, Homo sapiens
tctgttgagtgcaa

SEQ ID NO: 3887993 - DNA, 23 bp, Homo sapiens
tctgttgagtgcaacaagagcaa

SEQ ID NO: 3887994 - DNA, 12 bp, Homo sapiens
tctgttgtaaat

SEQ ID NO: 3887995 - DNA, 11 bp, Homo sapiens
tctgttttctt

SEQ ID NO: 3887996 - DNA, 21 bp, Homo sapiens
tcttaaaataacttatatcat

SEQ ID NO: 3887997 - DNA, 21 bp, Homo sapiens
tcttaaagctgcctgtagtta

SEQ ID NO: 3887998 - DNA, 21 bp, Homo sapiens
tcttaattaaaagaatatttt

SEQ ID NO: 3887999 - DNA, 12 bp, Homo sapiens
tcttacatctgc

SEQ ID NO: 3888000 - DNA, 18 bp, Homo sapiens
tcttacccatatatctta

SEQ ID NO: 3888001 - DNA, 23 bp, Homo sapiens
tcttaccgagaaaaggagaaagg

SEQ ID NO: 3888002 - DNA, 21 bp, Homo sapiens
tcttacctgtatgtctccagt

SEQ ID NO: 3888003 - DNA, 13 bp, Homo sapiens
tcttacttaaaaa

SEQ ID NO: 3888004 - DNA, 20 bp, Homo sapiens
tcttacttatcaaaagacag

SEQ ID NO: 3888005 - DNA, 21 bp, Homo sapiens
tcttagaagtggaccaggaca

SEQ ID NO: 3888006 - DNA, 15 bp, Homo sapiens
tcttagtgcccgcct

SEQ ID NO: 3888007 - DNA, 12 bp, Homo sapiens
tcttatatagca

SEQ ID NO: 3888008 - DNA, 22 bp, Homo sapiens
tcttatatagcagcaaaaatat

SEQ ID NO: 3888009 - DNA, 13 bp, Homo sapiens
tcttatgaaatgg

SEQ ID NO: 3888010 - DNA, 22 bp, Homo sapiens
tcttattagaacaggcaagtga

SEQ ID NO: 3888011 - DNA, 23 bp, Homo sapiens
tcttattcatgctttctcctttt

SEQ ID NO: 3888012 - DNA, 15 bp, Homo sapiens
tcttattctcactcc

SEQ ID NO: 3888013 - DNA, 16 bp, Homo sapiens
tcttatttcatttctt

SEQ ID NO: 3888014 - DNA, 17 bp, Homo sapiens
tcttattttttaaaaag

SEQ ID NO: 3888015 - DNA, 16 bp, Homo sapiens
tcttcaactgaccagc

SEQ ID NO: 3888016 - DNA, 17 bp, Homo sapiens
tcttcaagcacctgcag

SEQ ID NO: 3888017 - DNA, 19 bp, Homo sapiens
tcttcaagggaagaaacac

SEQ ID NO: 3888018 - DNA, 12 bp, Homo sapiens
tcttcacaacct

SEQ ID NO: 3888019 - DNA, 14 bp, Homo sapiens
tcttcacaacctcc

SEQ ID NO: 3888020 - DNA, 16 bp, Homo sapiens
tcttcactcagccaca

SEQ ID NO: 3888021 - DNA, 17 bp, Homo sapiens
tcttcactcagccacac

SEQ ID NO: 3888022 - DNA, 16 bp, Homo sapiens
tcttcagagcaggggt

SEQ ID NO: 3888023 - DNA, 19 bp, Homo sapiens
tcttcagccacctctcttt

SEQ ID NO: 3888024 - DNA, 16 bp, Homo sapiens
tcttcagccatcaaca

SEQ ID NO: 3888025 - DNA, 12 bp, Homo sapiens
tcttcagctccc

SEQ ID NO: 3888026 - DNA, 16 bp, Homo sapiens
tcttcagctcccatag

SEQ ID NO: 3888027 - DNA, 16 bp, Homo sapiens
tcttcaggaggccctg

SEQ ID NO: 3888028 - DNA, 16 bp, Homo sapiens
tcttcaggtggaaaaa

SEQ ID NO: 3888029 - DNA, 19 bp, Homo sapiens
tcttcagtgggagaaaaca

SEQ ID NO: 3888030 - DNA, 19 bp, Homo sapiens
tcttcattttgagtctcag

SEQ ID NO: 3888031 - DNA, 16 bp, Homo sapiens
tcttccaaccccagct

SEQ ID NO: 3888032 - DNA, 17 bp, Homo sapiens
tcttccaaccccagctg

SEQ ID NO: 3888033 - DNA, 18 bp, Homo sapiens
tcttccaaccccagctgg

SEQ ID NO: 3888034 - DNA, 22 bp, Homo sapiens
tcttccaaccccagctggcctc

SEQ ID NO: 3888035 - DNA, 20 bp, Homo sapiens
tcttccagagcctaagaaaa

SEQ ID NO: 3888036 - DNA, 13 bp, Homo sapiens
tcttccccttgcc

SEQ ID NO: 3888037 - DNA, 15 bp, Homo sapiens
tcttccccttgccct

SEQ ID NO: 3888038 - DNA, 16 bp, Homo sapiens
tcttccccttgccctt

SEQ ID NO: 3888039 - DNA, 14 bp, Homo sapiens
tcttccctccttcc

SEQ ID NO: 3888040 - DNA, 15 bp, Homo sapiens
tcttccctccttccc

SEQ ID NO: 3888041 - DNA, 18 bp, Homo sapiens
tcttcctaccaaatataa

SEQ ID NO: 3888042 - DNA, 12 bp, Homo sapiens
tcttcctgctgc

SEQ ID NO: 3888043 - DNA, 18 bp, Homo sapiens
tcttcctggacctgagtc

SEQ ID NO: 3888044 - DNA, 11 bp, Homo sapiens
tcttccttccc

SEQ ID NO: 3888045 - DNA, 12 bp, Homo sapiens
tcttccttcccc

SEQ ID NO: 3888046 - DNA, 19 bp, Homo sapiens
tcttcggggaactcctgga

SEQ ID NO: 3888047 - DNA, 17 bp, Homo sapiens
tcttctacaaccagagc

SEQ ID NO: 3888048 - DNA, 19 bp, Homo sapiens
tcttctacaaccagagccc

SEQ ID NO: 3888049 - DNA, 20 bp, Homo sapiens
tcttctacaaccagagcccc

SEQ ID NO: 3888050 - DNA, 18 bp, Homo sapiens
tcttctatttaaaaaata

SEQ ID NO: 3888051 - DNA, 22 bp, Homo sapiens
tcttctatttaaaaaataaaaa

SEQ ID NO: 3888052 - DNA, 14 bp, Homo sapiens
tcttctccatctgg

SEQ ID NO: 3888053 - DNA, 20 bp, Homo sapiens
tcttctctattcctgaccct

SEQ ID NO: 3888054 - DNA, 11 bp, Homo sapiens
tcttctctcaa

SEQ ID NO: 3888055 - DNA, 13 bp, Homo sapiens
tcttctcttcctg

SEQ ID NO: 3888056 - DNA, 19 bp, Homo sapiens
tcttctgtatactgtggag

SEQ ID NO: 3888057 - DNA, 18 bp, Homo sapiens
tcttcttaagacttttgg

SEQ ID NO: 3888058 - DNA, 16 bp, Homo sapiens
tcttcttcagaagaca

SEQ ID NO: 3888059 - DNA, 22 bp, Homo sapiens
tcttgaatctagggagggggaa

SEQ ID NO: 3888060 - DNA, 16 bp, Homo sapiens
tcttgacacggtgaaa

SEQ ID NO: 3888061 - DNA, 19 bp, Homo sapiens
tcttgacagtatatttgaa

SEQ ID NO: 3888062 - DNA, 20 bp, Homo sapiens
tcttgacagtatatttgaaa

SEQ ID NO: 3888063 - DNA, 18 bp, Homo sapiens
tcttgagtactagaattt

SEQ ID NO: 3888064 - DNA, 23 bp, Homo sapiens
tcttgagtactagaatttgtatt

SEQ ID NO: 3888065 - DNA, 23 bp, Homo sapiens
tcttgcatggcaaggactgcagg

SEQ ID NO: 3888066 - DNA, 23 bp, Homo sapiens
tcttgccccctcatctcactgcc

SEQ ID NO: 3888067 - DNA, 14 bp, Homo sapiens
tcttgcctgaggct

SEQ ID NO: 3888068 - DNA, 22 bp, Homo sapiens
tcttgcctgaggctcaagaggc

SEQ ID NO: 3888069 - DNA, 23 bp, Homo sapiens
tcttgcctgaggctcaagaggcc

SEQ ID NO: 3888070 - DNA, 16 bp, Homo sapiens
tcttgctatttgagca

SEQ ID NO: 3888071 - DNA, 14 bp, Homo sapiens
tcttgctttgctgt

SEQ ID NO: 3888072 - DNA, 13 bp, Homo sapiens
tcttggaaaaaaa

SEQ ID NO: 3888073 - DNA, 15 bp, Homo sapiens
tcttggaaaaaaatt

SEQ ID NO: 3888074 - DNA, 16 bp, Homo sapiens
tcttggaagtgtgtgg

SEQ ID NO: 3888075 - DNA, 23 bp, Homo sapiens
tcttggacctctgctctgaggct

SEQ ID NO: 3888076 - DNA, 21 bp, Homo sapiens
tcttggcagcttaacattgac

SEQ ID NO: 3888077 - DNA, 13 bp, Homo sapiens
tcttggcctgcct

SEQ ID NO: 3888078 - DNA, 16 bp, Homo sapiens
tcttgggaactccact

SEQ ID NO: 3888079 - DNA, 21 bp, Homo sapiens
tcttgggaactccactctcct

SEQ ID NO: 3888080 - DNA, 15 bp, Homo sapiens
tcttgggctactggc

SEQ ID NO: 3888081 - DNA, 14 bp, Homo sapiens
tcttggtattctta

SEQ ID NO: 3888082 - DNA, 21 bp, Homo sapiens
tcttgtagaagatggactctg

SEQ ID NO: 3888083 - DNA, 11 bp, Homo sapiens
tcttgtatttg

SEQ ID NO: 3888084 - DNA, 14 bp, Homo sapiens
tcttgtccacagtc

SEQ ID NO: 3888085 - DNA, 15 bp, Homo sapiens
tcttgtccacagtct

SEQ ID NO: 3888086 - DNA, 11 bp, Homo sapiens
tcttgtgcatg

SEQ ID NO: 3888087 - DNA, 17 bp, Homo sapiens
tcttgtgcatgtttact

SEQ ID NO: 3888088 - DNA, 14 bp, Homo sapiens
tcttgtgcctcagc

SEQ ID NO: 3888089 - DNA, 18 bp, Homo sapiens
tcttgtgctcacgctccc

SEQ ID NO: 3888090 - DNA, 18 bp, Homo sapiens
tcttgtggaggatgaata

SEQ ID NO: 3888091 - DNA, 17 bp, Homo sapiens
tctttaaaatacacact

SEQ ID NO: 3888092 - DNA, 14 bp, Homo sapiens
tctttaatcccagt

SEQ ID NO: 3888093 - DNA, 17 bp, Homo sapiens
tctttaatgttgtccag

SEQ ID NO: 3888094 - DNA, 20 bp, Homo sapiens
tctttaatgttgtccaggaa

SEQ ID NO: 3888095 - DNA, 14 bp, Homo sapiens
tctttacaataaac

SEQ ID NO: 3888096 - DNA, 16 bp, Homo sapiens
tctttacctgagacca

SEQ ID NO: 3888097 - DNA, 22 bp, Homo sapiens
tctttactcccttcctggcctc

SEQ ID NO: 3888098 - DNA, 15 bp, Homo sapiens
tctttcacaaaaaag

SEQ ID NO: 3888099 - DNA, 13 bp, Homo sapiens
tctttccccacct

SEQ ID NO: 3888100 - DNA, 15 bp, Homo sapiens
tctttccccacctct

SEQ ID NO: 3888101 - DNA, 19 bp, Homo sapiens
tctttccccacctcttcct

SEQ ID NO: 3888102 - DNA, 22 bp, Homo sapiens
tctttccccacctcttccttcc

SEQ ID NO: 3888103 - DNA, 16 bp, Homo sapiens
tctttcccctcagagc

SEQ ID NO: 3888104 - DNA, 16 bp, Homo sapiens
tctttcctccaaactc

SEQ ID NO: 3888105 - DNA, 22 bp, Homo sapiens
tctttcctcttccccttgccct

SEQ ID NO: 3888106 - DNA, 21 bp, Homo sapiens
tctttctaactccagtgaagt

SEQ ID NO: 3888107 - DNA, 15 bp, Homo sapiens
tctttctattccaaa

SEQ ID NO: 3888108 - DNA, 21 bp, Homo sapiens
tctttctctccttcttccctg

SEQ ID NO: 3888109 - DNA, 17 bp, Homo sapiens
tctttctcttccctcct

SEQ ID NO: 3888110 - DNA, 15 bp, Homo sapiens
tctttcttcctctgc

SEQ ID NO: 3888111 - DNA, 17 bp, Homo sapiens
tctttctttacctgaga

SEQ ID NO: 3888112 - DNA, 12 bp, Homo sapiens
tctttctttgga

SEQ ID NO: 3888113 - DNA, 20 bp, Homo sapiens
tctttctttttctggaaatt

SEQ ID NO: 3888114 - DNA, 19 bp, Homo sapiens
tctttctttttctgtctct

SEQ ID NO: 3888115 - DNA, 22 bp, Homo sapiens
tctttctttttctgtctctctt

SEQ ID NO: 3888116 - DNA, 14 bp, Homo sapiens
tctttgaaaagaaa

SEQ ID NO: 3888117 - DNA, 22 bp, Homo sapiens
tctttgacgggaggcctcagtt

SEQ ID NO: 3888118 - DNA, 21 bp, Homo sapiens
tctttgagaaaggattaagat

SEQ ID NO: 3888119 - DNA, 13 bp, Homo sapiens
tctttgcacatgt

SEQ ID NO: 3888120 - DNA, 17 bp, Homo sapiens
tctttgcacatgtgacc

SEQ ID NO: 3888121 - DNA, 16 bp, Homo sapiens
tctttgctacaataaa

SEQ ID NO: 3888122 - DNA, 20 bp, Homo sapiens
tctttgctacaataaatgct

SEQ ID NO: 3888123 - DNA, 21 bp, Homo sapiens
tctttgctacaataaatgctg

SEQ ID NO: 3888124 - DNA, 22 bp, Homo sapiens
tctttgctacaataaatgctga

SEQ ID NO: 3888125 - DNA, 24 bp, Homo sapiens
tctttggaaggagtgagatcattt

SEQ ID NO: 3888126 - DNA, 19 bp, Homo sapiens
tcttttaaagaagtaaatt

SEQ ID NO: 3888127 - DNA, 16 bp, Homo sapiens
tcttttcccacattca

SEQ ID NO: 3888128 - DNA, 12 bp, Homo sapiens
tctttttcagtt

SEQ ID NO: 3888129 - DNA, 15 bp, Homo sapiens
tctttttctggaaat

SEQ ID NO: 3888130 - DNA, 21 bp, Homo sapiens
tcttttttcaactggctggga

SEQ ID NO: 3888131 - DNA, 14 bp, Homo sapiens
tgaaaaaaaagttt

SEQ ID NO: 3888132 - DNA, 18 bp, Homo sapiens
tgaaaaacattccaggaa

SEQ ID NO: 3888133 - DNA, 12 bp, Homo sapiens
tgaaaaactgat

SEQ ID NO: 3888134 - DNA, 21 bp, Homo sapiens
tgaaaaactgatcaaaaataa

SEQ ID NO: 3888135 - DNA, 23 bp, Homo sapiens
tgaaaaactgatcaaaaataaac

SEQ ID NO: 3888136 - DNA, 20 bp, Homo sapiens
tgaaaaatatgtgcttgaaa

SEQ ID NO: 3888137 - DNA, 12 bp, Homo sapiens
tgaaaaatgtca

SEQ ID NO: 3888138 - DNA, 16 bp, Homo sapiens
tgaaaacccagagagg

SEQ ID NO: 3888139 - DNA, 19 bp, Homo sapiens
tgaaaactcattacttttc

SEQ ID NO: 3888140 - DNA, 14 bp, Homo sapiens
tctgcctgtggcct

SEQ ID NO: 3888141 - DNA, 13 bp, Homo sapiens
tctgcctttttta

SEQ ID NO: 3888142 - DNA, 17 bp, Homo sapiens
tctgcggtggtgccaga

SEQ ID NO: 3888143 - DNA, 20 bp, Homo sapiens
tctgcggtggtgccagaggt

SEQ ID NO: 3888144 - DNA, 15 bp, Homo sapiens
tctgcgttacaacag

SEQ ID NO: 3888145 - DNA, 22 bp, Homo sapiens
tctgctcagacagaacccctac

SEQ ID NO: 3888146 - DNA, 22 bp, Homo sapiens
tctgctcagtaatttgaggaca

SEQ ID NO: 3888147 - DNA, 12 bp, Homo sapiens
tctgctccagag

SEQ ID NO: 3888148 - DNA, 12 bp, Homo sapiens
tctgctcctctc

SEQ ID NO: 3888149 - DNA, 16 bp, Homo sapiens
tctgctcctctccagg

SEQ ID NO: 3888150 - DNA, 18 bp, Homo sapiens
tctgctcctctccaggca

SEQ ID NO: 3888151 - DNA, 20 bp, Homo sapiens
tctgctcctctccaggcacc

SEQ ID NO: 3888152 - DNA, 13 bp, Homo sapiens
tctgctctagcca

SEQ ID NO: 3888153 - DNA, 11 bp, Homo sapiens
tctgctctgat

SEQ ID NO: 3888154 - DNA, 19 bp, Homo sapiens
tctgctgcctccctctgct

SEQ ID NO: 3888155 - DNA, 14 bp, Homo sapiens
tctgctggcctgga

SEQ ID NO: 3888156 - DNA, 17 bp, Homo sapiens
tctgctggcctggatct

SEQ ID NO: 3888157 - DNA, 17 bp, Homo sapiens
tctgctggttttaacaa

SEQ ID NO: 3888158 - DNA, 12 bp, Homo sapiens
tctgctgttgcc

SEQ ID NO: 3888159 - DNA, 13 bp, Homo sapiens
tctgctgttgcca

SEQ ID NO: 3888160 - DNA, 17 bp, Homo sapiens
tctgctgttgccatagc

SEQ ID NO: 3888161 - DNA, 19 bp, Homo sapiens
tctgctgttgccatagccc

SEQ ID NO: 3888162 - DNA, 21 bp, Homo sapiens
tctgctgttgccatagcccca

SEQ ID NO: 3888163 - DNA, 19 bp, Homo sapiens
tctgcttctgtccaggaca

SEQ ID NO: 3888164 - DNA, 11 bp, Homo sapiens
tctgcttgcat

SEQ ID NO: 3888165 - DNA, 20 bp, Homo sapiens
tctgcttgcatcacttgggg

SEQ ID NO: 3888166 - DNA, 15 bp, Homo sapiens
tctggaaaaaaaata

SEQ ID NO: 3888167 - DNA, 14 bp, Homo sapiens
tctggaaagcaaag

SEQ ID NO: 3888168 - DNA, 13 bp, Homo sapiens
tctggaaagggca

SEQ ID NO: 3888169 - DNA, 21 bp, Homo sapiens
tctggaagctgagcaggcccg

SEQ ID NO: 3888170 - DNA, 14 bp, Homo sapiens
tctggaaggctggc

SEQ ID NO: 3888171 - DNA, 14 bp, Homo sapiens
tctggaatacatga

SEQ ID NO: 3888172 - DNA, 21 bp, Homo sapiens
tctggacaagccaacttgtaa

SEQ ID NO: 3888173 - DNA, 20 bp, Homo sapiens
tctggacctccccctcttgg

SEQ ID NO: 3888174 - DNA, 18 bp, Homo sapiens
tctggactcctctgtcca

SEQ ID NO: 3888175 - DNA, 22 bp, Homo sapiens
tctggactcctctgtccaggca

SEQ ID NO: 3888176 - DNA, 15 bp, Homo sapiens
tctggagaagcagtg

SEQ ID NO: 3888177 - DNA, 14 bp, Homo sapiens
tctggagagctaga

SEQ ID NO: 3888178 - DNA, 23 bp, Homo sapiens
tctggagagctagaacctggagg

SEQ ID NO: 3888179 - DNA, 19 bp, Homo sapiens
tctggagtctccagtggtt

SEQ ID NO: 3888180 - DNA, 22 bp, Homo sapiens
tctggatcctgctgtggcctca

SEQ ID NO: 3888181 - DNA, 12 bp, Homo sapiens
tctggcacccag

SEQ ID NO: 3888182 - DNA, 11 bp, Homo sapiens
tctggcagcca

SEQ ID NO: 3888183 - DNA, 13 bp, Homo sapiens
tctggcagccaca

SEQ ID NO: 3888184 - DNA, 15 bp, Homo sapiens
tctggcagccacact

SEQ ID NO: 3888185 - DNA, 21 bp, Homo sapiens
tctggcagccacacttctcag

SEQ ID NO: 3888186 - DNA, 19 bp, Homo sapiens
tctggcagggtgggatgga

SEQ ID NO: 3888187 - DNA, 18 bp, Homo sapiens
tctggccaccctggcccg

SEQ ID NO: 3888188 - DNA, 15 bp, Homo sapiens
tctggccaggagctg

SEQ ID NO: 3888189 - DNA, 13 bp, Homo sapiens
tctggcccagcct

SEQ ID NO: 3888190 - DNA, 16 bp, Homo sapiens
tctggccctgccttct

SEQ ID NO: 3888191 - DNA, 16 bp, Homo sapiens
tctggcctcagaccaa

SEQ ID NO: 3888192 - DNA, 13 bp, Homo sapiens
tctggcctcagca

SEQ ID NO: 3888193 - DNA, 14 bp, Homo sapiens
tctggccttttcct

SEQ ID NO: 3888194 - DNA, 13 bp, Homo sapiens
tctggctccagaa

SEQ ID NO: 3888195 - DNA, 12 bp, Homo sapiens
tctggctcctgt

SEQ ID NO: 3888196 - DNA, 14 bp, Homo sapiens
tctggctcctgttt

SEQ ID NO: 3888197 - DNA, 14 bp, Homo sapiens
tctggctgagctga

SEQ ID NO: 3888198 - DNA, 20 bp, Homo sapiens
tctggctgcaagggccagag

SEQ ID NO: 3888199 - DNA, 24 bp, Homo sapiens
tctggcttccaggtatctccagga

SEQ ID NO: 3888200 - DNA, 14 bp, Homo sapiens
tctggcttgactgg

SEQ ID NO: 3888201 - DNA, 20 bp, Homo sapiens
tctgggaggcagaacaggct

SEQ ID NO: 3888202 - DNA, 18 bp, Homo sapiens
tctgggaggtctccactg

SEQ ID NO: 3888203 - DNA, 21 bp, Homo sapiens
tctgggagtgttctgtttccc

SEQ ID NO: 3888204 - DNA, 23 bp, Homo sapiens
tctgggatggaccctcgcagcag

SEQ ID NO: 3888205 - DNA, 22 bp, Homo sapiens
tctgggatgtagaacttcaaga

SEQ ID NO: 3888206 - DNA, 12 bp, Homo sapiens
tctgggctcagg

SEQ ID NO: 3888207 - DNA, 19 bp, Homo sapiens
tctggggaggaagggccag

SEQ ID NO: 3888208 - DNA, 15 bp, Homo sapiens
tctggggcagggtta

SEQ ID NO: 3888209 - DNA, 22 bp, Homo sapiens
tctggggttcagcccctcctct

SEQ ID NO: 3888210 - DNA, 22 bp, Homo sapiens
tctggtatgaacttgaggacac

SEQ ID NO: 3888211 - DNA, 21 bp, Homo sapiens
tctggtgtagctcctctgctg

SEQ ID NO: 3888212 - DNA, 15 bp, Homo sapiens
tctgtaatttttcag

SEQ ID NO: 3888213 - DNA, 15 bp, Homo sapiens
tctgtacaaaaacaa

SEQ ID NO: 3888214 - DNA, 14 bp, Homo sapiens
tctgtagggctgga

SEQ ID NO: 3888215 - DNA, 23 bp, Homo sapiens
tctgtataaaatgcaaaataaat

SEQ ID NO: 3888216 - DNA, 14 bp, Homo sapiens
tctgtataatctat

SEQ ID NO: 3888217 - DNA, 14 bp, Homo sapiens
tctgtatactgtgg

SEQ ID NO: 3888218 - DNA, 13 bp, Homo sapiens
tctgtatatacat

SEQ ID NO: 3888219 - DNA, 14 bp, Homo sapiens
tctgtatatacatt

SEQ ID NO: 3888220 - DNA, 15 bp, Homo sapiens
tctgtattttcatgt

SEQ ID NO: 3888221 - DNA, 20 bp, Homo sapiens
tctgtcaccagctatctgtc

SEQ ID NO: 3888222 - DNA, 17 bp, Homo sapiens
tctgtcacccaggctgg

SEQ ID NO: 3888223 - DNA, 18 bp, Homo sapiens
tctgtcacgtgaaatatt

SEQ ID NO: 3888224 - DNA, 19 bp, Homo sapiens
tctgtcagatgggaagaca

SEQ ID NO: 3888225 - DNA, 17 bp, Homo sapiens
tctgtcagccagccgcc

SEQ ID NO: 3888226 - DNA, 21 bp, Homo sapiens
tctgtcagccagccgccctgg

SEQ ID NO: 3888227 - DNA, 19 bp, Homo sapiens
tctaagctgcagcttcctg

SEQ ID NO: 3888228 - DNA, 15 bp, Homo sapiens
tctaagctggagctc

SEQ ID NO: 3888229 - DNA, 19 bp, Homo sapiens
tctaagctggagctcttgg

SEQ ID NO: 3888230 - DNA, 15 bp, Homo sapiens
tctaagtaaaaccac

SEQ ID NO: 3888231 - DNA, 20 bp, Homo sapiens
tctaagtagatagaaagcaa

SEQ ID NO: 3888232 - DNA, 20 bp, Homo sapiens
tctaatatggcaaaaatggc

SEQ ID NO: 3888233 - DNA, 18 bp, Homo sapiens
tctaatattaaaaatatg

SEQ ID NO: 3888234 - DNA, 20 bp, Homo sapiens
tctaatgtctcttcctctgt

SEQ ID NO: 3888235 - DNA, 14 bp, Homo sapiens
tctaatttatacaa

SEQ ID NO: 3888236 - DNA, 20 bp, Homo sapiens
tctaatttatacaaaataat

SEQ ID NO: 3888237 - DNA, 21 bp, Homo sapiens
tctaatttatacaaaataatt

SEQ ID NO: 3888238 - DNA, 16 bp, Homo sapiens
tctacaagcatttgcc

SEQ ID NO: 3888239 - DNA, 23 bp, Homo sapiens
tctacaagcatttgccctgtgga

SEQ ID NO: 3888240 - DNA, 23 bp, Homo sapiens
tctacacagtgggaactctgaca

SEQ ID NO: 3888241 - DNA, 16 bp, Homo sapiens
tctacagcatacagag

SEQ ID NO: 3888242 - DNA, 16 bp, Homo sapiens
tctacatactatggaa

SEQ ID NO: 3888243 - DNA, 14 bp, Homo sapiens
tctaccatttcaga

SEQ ID NO: 3888244 - DNA, 15 bp, Homo sapiens
tctaccatttcagag

SEQ ID NO: 3888245 - DNA, 16 bp, Homo sapiens
tctacccggcccagag

SEQ ID NO: 3888246 - DNA, 17 bp, Homo sapiens
tctacccggcccagaga

SEQ ID NO: 3888247 - DNA, 22 bp, Homo sapiens
tctacccggcccagagacccct

SEQ ID NO: 3888248 - DNA, 14 bp, Homo sapiens
tctacctgccctct

SEQ ID NO: 3888249 - DNA, 20 bp, Homo sapiens
tctacctgtgttcattctta

SEQ ID NO: 3888250 - DNA, 15 bp, Homo sapiens
tctacgctctccttt

SEQ ID NO: 3888251 - DNA, 18 bp, Homo sapiens
tctacgttctccagccca

SEQ ID NO: 3888252 - DNA, 19 bp, Homo sapiens
tctactccatgcacatagt

SEQ ID NO: 3888253 - DNA, 17 bp, Homo sapiens
tctactgagacatgact

SEQ ID NO: 3888254 - DNA, 20 bp, Homo sapiens
tctactgggaaggctacttc

SEQ ID NO: 3888255 - DNA, 21 bp, Homo sapiens
tctacttctttttctttgaga

SEQ ID NO: 3888256 - DNA, 14 bp, Homo sapiens
tctacttttaaaga

SEQ ID NO: 3888257 - DNA, 15 bp, Homo sapiens
tctagaacacccact

SEQ ID NO: 3888258 - DNA, 19 bp, Homo sapiens
tctagaacacccactggcc

SEQ ID NO: 3888259 - DNA, 22 bp, Homo sapiens
tctagaacacccactggccagt

SEQ ID NO: 3888260 - DNA, 14 bp, Homo sapiens
tctagactttctca

SEQ ID NO: 3888261 - DNA, 17 bp, Homo sapiens
tctagactttctcagtg

SEQ ID NO: 3888262 - DNA, 20 bp, Homo sapiens
tctagagattttcttggcag

SEQ ID NO: 3888263 - DNA, 20 bp, Homo sapiens
tctagagtgagaatctggct

SEQ ID NO: 3888264 - DNA, 21 bp, Homo sapiens
tctagatcaattaattcttaa

SEQ ID NO: 3888265 - DNA, 21 bp, Homo sapiens
tctagattaccccctcattgt

SEQ ID NO: 3888266 - DNA, 13 bp, Homo sapiens
tctagcagagtga

SEQ ID NO: 3888267 - DNA, 15 bp, Homo sapiens
tctagccctccctgg

SEQ ID NO: 3888268 - DNA, 14 bp, Homo sapiens
tctagcctgggcca

SEQ ID NO: 3888269 - DNA, 21 bp, Homo sapiens
tctagctagaaatatgatttt

SEQ ID NO: 3888270 - DNA, 16 bp, Homo sapiens
tctagctattattttc

SEQ ID NO: 3888271 - DNA, 13 bp, Homo sapiens
tctagctggcagg

SEQ ID NO: 3888272 - DNA, 18 bp, Homo sapiens
tctagcttcatgcctcag

SEQ ID NO: 3888273 - DNA, 17 bp, Homo sapiens
tctaggagctgggagga

SEQ ID NO: 3888274 - DNA, 18 bp, Homo sapiens
tctaggagctgggaggaa

SEQ ID NO: 3888275 - DNA, 21 bp, Homo sapiens
tctaggcagttcaaagcagga

SEQ ID NO: 3888276 - DNA, 18 bp, Homo sapiens
tctaggcatcccagggga

SEQ ID NO: 3888277 - DNA, 17 bp, Homo sapiens
tctagggagagaccctt

SEQ ID NO: 3888278 - DNA, 20 bp, Homo sapiens
tctagtctcctttgcactga

SEQ ID NO: 3888279 - DNA, 22 bp, Homo sapiens
tctagtctcctttgcactgagg

SEQ ID NO: 3888280 - DNA, 15 bp, Homo sapiens
tctagtgatttcctg

SEQ ID NO: 3888281 - DNA, 14 bp, Homo sapiens
tctagtttcttgtg

SEQ ID NO: 3888282 - DNA, 15 bp, Homo sapiens
tctataatggaaaca

SEQ ID NO: 3888283 - DNA, 13 bp, Homo sapiens
tctatagagaaaa

SEQ ID NO: 3888284 - DNA, 17 bp, Homo sapiens
tctatagtagtcaatta

SEQ ID NO: 3888285 - DNA, 15 bp, Homo sapiens
tctatcaatagtcaa

SEQ ID NO: 3888286 - DNA, 16 bp, Homo sapiens
tctatcctacaacaag

SEQ ID NO: 3888287 - DNA, 14 bp, Homo sapiens
tctatgcaattttt

SEQ ID NO: 3888288 - DNA, 20 bp, Homo sapiens
tctatgcagtattgccacaa

SEQ ID NO: 3888289 - DNA, 17 bp, Homo sapiens
tctattaagatttccaa

SEQ ID NO: 3888290 - DNA, 19 bp, Homo sapiens
tctattagttttctttgta

SEQ ID NO: 3888291 - DNA, 15 bp, Homo sapiens
tctattcctgaccct

SEQ ID NO: 3888292 - DNA, 17 bp, Homo sapiens
tctattcctgaccctcc

SEQ ID NO: 3888293 - DNA, 18 bp, Homo sapiens
tctattcctgaccctccc

SEQ ID NO: 3888294 - DNA, 20 bp, Homo sapiens
tctatttaaaaaataaaaaa

SEQ ID NO: 3888295 - DNA, 12 bp, Homo sapiens
tctatttaagcc

SEQ ID NO: 3888296 - DNA, 14 bp, Homo sapiens
tctattttgatttt

SEQ ID NO: 3888297 - DNA, 17 bp, Homo sapiens
tctattttgtaaactca

SEQ ID NO: 3888298 - DNA, 18 bp, Homo sapiens
tctcaaaataagttgaaa

SEQ ID NO: 3888299 - DNA, 17 bp, Homo sapiens
tctcaaattctcaacct

SEQ ID NO: 3888300 - DNA, 17 bp, Homo sapiens
tctcaagagggcactgg

SEQ ID NO: 3888301 - DNA, 18 bp, Homo sapiens
tctcaagagggcactggt

SEQ ID NO: 3888302 - DNA, 19 bp, Homo sapiens
tctcaagcactaaaaagtg

SEQ ID NO: 3888303 - DNA, 15 bp, Homo sapiens
tctcaagctcttcct

SEQ ID NO: 3888304 - DNA, 20 bp, Homo sapiens
tctcaatattcaataaagct

SEQ ID NO: 3888305 - DNA, 24 bp, Homo sapiens
tctcaatcttcggggtgtgatgaa

SEQ ID NO: 3888306 - DNA, 12 bp, Homo sapiens
tctcaatgtgaa

SEQ ID NO: 3888307 - DNA, 17 bp, Homo sapiens
tctcaccagctgctgct

SEQ ID NO: 3888308 - DNA, 15 bp, Homo sapiens
tctcactaaacttta

SEQ ID NO: 3888309 - DNA, 13 bp, Homo sapiens
tctcactcctacc

SEQ ID NO: 3888310 - DNA, 17 bp, Homo sapiens
tctcactcctacctggt

SEQ ID NO: 3888311 - DNA, 13 bp, Homo sapiens
tctcactcctgag

SEQ ID NO: 3888312 - DNA, 16 bp, Homo sapiens
tctcagaacagctgaa

SEQ ID NO: 3888313 - DNA, 14 bp, Homo sapiens
tctcaggaaatcaa

SEQ ID NO: 3888314 - DNA, 19 bp, Homo sapiens
tctcaggacacaggcctgt

SEQ ID NO: 3888315 - DNA, 15 bp, Homo sapiens
tctcaggagcacagg

SEQ ID NO: 3888316 - DNA, 19 bp, Homo sapiens
tctcaggaggcgcagcccg

SEQ ID NO: 3888317 - DNA, 20 bp, Homo sapiens
tctcagggggtcagcagagt

SEQ ID NO: 3888318 - DNA, 14 bp, Homo sapiens
tctcaggtcactcc

SEQ ID NO: 3888319 - DNA, 15 bp, Homo sapiens
tctcaggtccctgca

SEQ ID NO: 3888320 - DNA, 14 bp, Homo sapiens
tctcaggtgccact

SEQ ID NO: 3888321 - DNA, 16 bp, Homo sapiens
tctcaggtgccactcc

SEQ ID NO: 3888322 - DNA, 15 bp, Homo sapiens
tctcagtcagtaatt

SEQ ID NO: 3888323 - DNA, 19 bp, Homo sapiens
tctcagttattcagattga

SEQ ID NO: 3888324 - DNA, 16 bp, Homo sapiens
tctcagtttgtataga

SEQ ID NO: 3888325 - DNA, 19 bp, Homo sapiens
tctcatacctctgaccaac

SEQ ID NO: 3888326 - DNA, 21 bp, Homo sapiens
tctcataggaaaagtacattt

SEQ ID NO: 3888327 - DNA, 22 bp, Homo sapiens
tctcataggaaaagtacattta

SEQ ID NO: 3888328 - DNA, 24 bp, Homo sapiens
tctcataggaaaagtacatttaat

SEQ ID NO: 3888329 - DNA, 15 bp, Homo sapiens
tctcatcagaaatgt

SEQ ID NO: 3888330 - DNA, 21 bp, Homo sapiens
tctcatcagtgtcctcttgct

SEQ ID NO: 3888331 - DNA, 14 bp, Homo sapiens
tctcatcatattgt

SEQ ID NO: 3888332 - DNA, 16 bp, Homo sapiens
tctcatcatattgtat

SEQ ID NO: 3888333 - DNA, 18 bp, Homo sapiens
tctcatcatattgtatgt

SEQ ID NO: 3888334 - DNA, 16 bp, Homo sapiens
tctcatccccagtccc

SEQ ID NO: 3888335 - DNA, 16 bp, Homo sapiens
tctcatgcctgcctga

SEQ ID NO: 3888336 - DNA, 19 bp, Homo sapiens
tctcatgtgatccttttat

SEQ ID NO: 3888337 - DNA, 23 bp, Homo sapiens
tctcatgtgatccttttatgtta

SEQ ID NO: 3888338 - DNA, 17 bp, Homo sapiens
tctcattccaacagtga

SEQ ID NO: 3888339 - DNA, 13 bp, Homo sapiens
tctcattccccag

SEQ ID NO: 3888340 - DNA, 16 bp, Homo sapiens
tctcattccccaggtg

SEQ ID NO: 3888341 - DNA, 16 bp, Homo sapiens
tctcattctctttctt

SEQ ID NO: 3888342 - DNA, 23 bp, Homo sapiens
tctcattgtagagcttggtggct

SEQ ID NO: 3888343 - DNA, 18 bp, Homo sapiens
tctccaaaggggctgctg

SEQ ID NO: 3888344 - DNA, 19 bp, Homo sapiens
tctccaaaggggctgctgg

SEQ ID NO: 3888345 - DNA, 20 bp, Homo sapiens
tctccaaatattattcaagt

SEQ ID NO: 3888346 - DNA, 14 bp, Homo sapiens
tctccaaggaccag

SEQ ID NO: 3888347 - DNA, 16 bp, Homo sapiens
tctccaaggaccaggt

SEQ ID NO: 3888348 - DNA, 17 bp, Homo sapiens
tctccaattgtaaaaaa

SEQ ID NO: 3888349 - DNA, 14 bp, Homo sapiens
tctccacctcagcc

SEQ ID NO: 3888350 - DNA, 19 bp, Homo sapiens
tctccacctcagccttgga

SEQ ID NO: 3888351 - DNA, 14 bp, Homo sapiens
tctccactgccttc

SEQ ID NO: 3888352 - DNA, 19 bp, Homo sapiens
tctccaggcaccatctccc

SEQ ID NO: 3888353 - DNA, 16 bp, Homo sapiens
tctccagggctgcccc

SEQ ID NO: 3888354 - DNA, 17 bp, Homo sapiens
tctccagtggttgctgt

SEQ ID NO: 3888355 - DNA, 20 bp, Homo sapiens
tctccagtggttgctgttga

SEQ ID NO: 3888356 - DNA, 17 bp, Homo sapiens
tctccataatgccactg

SEQ ID NO: 3888357 - DNA, 16 bp, Homo sapiens
tctccatatctccttc

SEQ ID NO: 3888358 - DNA, 19 bp, Homo sapiens
tctccatttcacacaggtc

SEQ ID NO: 3888359 - DNA, 21 bp, Homo sapiens
tctcccaccccggcctccact

SEQ ID NO: 3888360 - DNA, 15 bp, Homo sapiens
tctcccacgtgggag

SEQ ID NO: 3888361 - DNA, 12 bp, Homo sapiens
tctcccaggccc

SEQ ID NO: 3888362 - DNA, 20 bp, Homo sapiens
tctcccataccatcactgag

SEQ ID NO: 3888363 - DNA, 13 bp, Homo sapiens
tctccccaggcct

SEQ ID NO: 3888364 - DNA, 18 bp, Homo sapiens
tctccccaggcctccagc

SEQ ID NO: 3888365 - DNA, 20 bp, Homo sapiens
tctccccaggcctccagcct

SEQ ID NO: 3888366 - DNA, 16 bp, Homo sapiens
tctcccccgacactgc

SEQ ID NO: 3888367 - DNA, 19 bp, Homo sapiens
tctcccccgacactgctgc

SEQ ID NO: 3888368 - DNA, 21 bp, Homo sapiens
tctcccccgacactgctgcac

SEQ ID NO: 3888369 - DNA, 14 bp, Homo sapiens
tctcccccgcccaa

SEQ ID NO: 3888370 - DNA, 13 bp, Homo sapiens
tctcccctccctc

SEQ ID NO: 3888371 - DNA, 15 bp, Homo sapiens
tctcccctccctctt

SEQ ID NO: 3888372 - DNA, 22 bp, Homo sapiens
tctcccctccctcttccttccc

SEQ ID NO: 3888373 - DNA, 14 bp, Homo sapiens
tctcccctgccctg

SEQ ID NO: 3888374 - DNA, 14 bp, Homo sapiens
tctcccggctgcct

SEQ ID NO: 3888375 - DNA, 16 bp, Homo sapiens
tctcccggctgcctgc

SEQ ID NO: 3888376 - DNA, 17 bp, Homo sapiens
tctccctctcctgccta

SEQ ID NO: 3888377 - DNA, 14 bp, Homo sapiens
tctccctctggccc

SEQ ID NO: 3888378 - DNA, 12 bp, Homo sapiens
tctccctgccgc

SEQ ID NO: 3888379 - DNA, 15 bp, Homo sapiens
tctccggggtctgtg

SEQ ID NO: 3888380 - DNA, 17 bp, Homo sapiens
tctccggggtctgtgct

SEQ ID NO: 3888381 - DNA, 21 bp, Homo sapiens
tctccggggtctgtgctgtgc

SEQ ID NO: 3888382 - DNA, 16 bp, Homo sapiens
tctccgggtgtggcct

SEQ ID NO: 3888383 - DNA, 18 bp, Homo sapiens
tctccgggtgtggcctca

SEQ ID NO: 3888384 - DNA, 21 bp, Homo sapiens
tctccgggtgtggcctcagcc

SEQ ID NO: 3888385 - DNA, 23 bp, Homo sapiens
tctcctaaaacatgaaaattatc

SEQ ID NO: 3888386 - DNA, 15 bp, Homo sapiens
tctcctaccccacct

SEQ ID NO: 3888387 - DNA, 16 bp, Homo sapiens
tctcctaccccacctc

SEQ ID NO: 3888388 - DNA, 16 bp, Homo sapiens
tctcctacctgctgct

SEQ ID NO: 3888389 - DNA, 15 bp, Homo sapiens
tctcctaggagaagc

SEQ ID NO: 3888390 - DNA, 16 bp, Homo sapiens
tctcctcttgccactg

SEQ ID NO: 3888391 - DNA, 15 bp, Homo sapiens
tctcctgcctactca

SEQ ID NO: 3888392 - DNA, 17 bp, Homo sapiens
tctcctgcctactcacg

SEQ ID NO: 3888393 - DNA, 20 bp, Homo sapiens
tctcctgggggtggcaggca

SEQ ID NO: 3888394 - DNA, 22 bp, Homo sapiens
tctcctgggggtggcaggcaca

SEQ ID NO: 3888395 - DNA, 22 bp, Homo sapiens
tctcctgtataaccccaccttg

SEQ ID NO: 3888396 - DNA, 22 bp, Homo sapiens
tctcctgtcagagatctgggag

SEQ ID NO: 3888397 - DNA, 16 bp, Homo sapiens
tctcctgtccaaccta

SEQ ID NO: 3888398 - DNA, 19 bp, Homo sapiens
tctcctgtgcccctcagag

SEQ ID NO: 3888399 - DNA, 17 bp, Homo sapiens
tctcctgtttttctggg

SEQ ID NO: 3888400 - DNA, 16 bp, Homo sapiens
tctccttactctgagc

SEQ ID NO: 3888401 - DNA, 20 bp, Homo sapiens
tctccttactctgagcccag

SEQ ID NO: 3888402 - DNA, 21 bp, Homo sapiens
tctccttactctgagcccagg

SEQ ID NO: 3888403 - DNA, 18 bp, Homo sapiens
tctccttcccctacacct

SEQ ID NO: 3888404 - DNA, 11 bp, Homo sapiens
tctccttccct

SEQ ID NO: 3888405 - DNA, 17 bp, Homo sapiens
tctccttccctctttcc

SEQ ID NO: 3888406 - DNA, 16 bp, Homo sapiens
tctccttgggctcctg

SEQ ID NO: 3888407 - DNA, 16 bp, Homo sapiens
tctcctttcacaacct

SEQ ID NO: 3888408 - DNA, 17 bp, Homo sapiens
tctcctttgcactgagg

SEQ ID NO: 3888409 - DNA, 13 bp, Homo sapiens
tctcgagcccaga

SEQ ID NO: 3888410 - DNA, 17 bp, Homo sapiens
tctcgagcgccctgcag

SEQ ID NO: 3888411 - DNA, 22 bp, Homo sapiens
tctcgagcgccctgcagaccct

SEQ ID NO: 3888412 - DNA, 21 bp, Homo sapiens
tctcggacctttcagctgtga

SEQ ID NO: 3888413 - DNA, 21 bp, Homo sapiens
tctcggcaactaagcagtccc

SEQ ID NO: 3888414 - DNA, 15 bp, Homo sapiens
tctcgggaaattatt

SEQ ID NO: 3888415 - DNA, 21 bp, Homo sapiens
tctcgggtccgattaatttat

SEQ ID NO: 3888416 - DNA, 12 bp, Homo sapiens
tctcgtctcctg

SEQ ID NO: 3888417 - DNA, 17 bp, Homo sapiens
tctcgtggtagaagcca

SEQ ID NO: 3888418 - DNA, 19 bp, Homo sapiens
tctcgtggtagaagccagt

SEQ ID NO: 3888419 - DNA, 16 bp, Homo sapiens
tctctaaaaataaaat

SEQ ID NO: 3888420 - DNA, 16 bp, Homo sapiens
tctctaagccacagct

SEQ ID NO: 3888421 - DNA, 12 bp, Homo sapiens
tctctagagaac

SEQ ID NO: 3888422 - DNA, 13 bp, Homo sapiens
tctctagagaaca

SEQ ID NO: 3888423 - DNA, 12 bp, Homo sapiens
tctctagccact

SEQ ID NO: 3888424 - DNA, 20 bp, Homo sapiens
tctctagctttaggggacca

SEQ ID NO: 3888425 - DNA, 17 bp, Homo sapiens
tctctattcctgaccct

SEQ ID NO: 3888426 - DNA, 17 bp, Homo sapiens
tctctatttaatattta

SEQ ID NO: 3888427 - DNA, 16 bp, Homo sapiens
tctctcaatatgctta

SEQ ID NO: 3888428 - DNA, 14 bp, Homo sapiens
tctctcaggagcac

SEQ ID NO: 3888429 - DNA, 16 bp, Homo sapiens
tctctcaggagtatct

SEQ ID NO: 3888430 - DNA, 17 bp, Homo sapiens
tctctcaggagtatctt

SEQ ID NO: 3888431 - DNA, 12 bp, Homo sapiens
tctctccacttt

SEQ ID NO: 3888432 - DNA, 14 bp, Homo sapiens
tctctccaggaagt

SEQ ID NO: 3888433 - DNA, 21 bp, Homo sapiens
tctctcccaccccggcctcca

SEQ ID NO: 3888434 - DNA, 19 bp, Homo sapiens
tctctccttcttccctgtt

SEQ ID NO: 3888435 - DNA, 16 bp, Homo sapiens
tctctcgggcccccca

SEQ ID NO: 3888436 - DNA, 23 bp, Homo sapiens
tctctcggttccacgtccccctg

SEQ ID NO: 3888437 - DNA, 20 bp, Homo sapiens
tctctcgtaactggtttcat

SEQ ID NO: 3888438 - DNA, 11 bp, Homo sapiens
tctctctcctg

SEQ ID NO: 3888439 - DNA, 12 bp, Homo sapiens
tctctctcctgt

SEQ ID NO: 3888440 - DNA, 18 bp, Homo sapiens
tctctctggggccctggg

SEQ ID NO: 3888441 - DNA, 10 bp, Homo sapiens
tctctcttcc

SEQ ID NO: 3888442 - DNA, 14 bp, Homo sapiens
tctctgaacagaaa

SEQ ID NO: 3888443 - DNA, 16 bp, Homo sapiens
tctctgagagagatga

SEQ ID NO: 3888444 - DNA, 22 bp, Homo sapiens
tctctgagatgcccctctgcct

SEQ ID NO: 3888445 - DNA, 18 bp, Homo sapiens
tctctgcagccagcccag

SEQ ID NO: 3888446 - DNA, 19 bp, Homo sapiens
tctctgcagccagcccagc

SEQ ID NO: 3888447 - DNA, 20 bp, Homo sapiens
tctctgcagccagcccagcc

SEQ ID NO: 3888448 - DNA, 18 bp, Homo sapiens
tctctgcagtatttataa

SEQ ID NO: 3888449 - DNA, 21 bp, Homo sapiens
tctctgcgtgcagggacaaag

SEQ ID NO: 3888450 - DNA, 14 bp, Homo sapiens
tctctgctccagag

SEQ ID NO: 3888451 - DNA, 17 bp, Homo sapiens
tctctgcttacccttca

SEQ ID NO: 3888452 - DNA, 13 bp, Homo sapiens
tctctggctccag

SEQ ID NO: 3888453 - DNA, 16 bp, Homo sapiens
tctctggctccagaat

SEQ ID NO: 3888454 - DNA, 19 bp, Homo sapiens
tctctgtaaaatttataca

SEQ ID NO: 3888455 - DNA, 13 bp, Homo sapiens
tctctgtacaaaa

SEQ ID NO: 3888456 - DNA, 16 bp, Homo sapiens
tctctgtataaacatt

SEQ ID NO: 3888457 - DNA, 11 bp, Homo sapiens
tctctgtgctt

SEQ ID NO: 3888458 - DNA, 14 bp, Homo sapiens
tctcttacccagaa

SEQ ID NO: 3888459 - DNA, 21 bp, Homo sapiens
tctcttaccgcgagactgaga

SEQ ID NO: 3888460 - DNA, 13 bp, Homo sapiens
tctcttcactccc

SEQ ID NO: 3888461 - DNA, 24 bp, Homo sapiens
tctcttcaggaggccctggtgtca

SEQ ID NO: 3888462 - DNA, 14 bp, Homo sapiens
tctcttcatacttt

SEQ ID NO: 3888463 - DNA, 12 bp, Homo sapiens
tctcttccctat

SEQ ID NO: 3888464 - DNA, 11 bp, Homo sapiens
tctcttctcca

SEQ ID NO: 3888465 - DNA, 14 bp, Homo sapiens
tctcttctccactg

SEQ ID NO: 3888466 - DNA, 18 bp, Homo sapiens
tctcttctctattcctga

SEQ ID NO: 3888467 - DNA, 13 bp, Homo sapiens
tctcttctttaaa

SEQ ID NO: 3888468 - DNA, 13 bp, Homo sapiens
tctcttgccagca

SEQ ID NO: 3888469 - DNA, 14 bp, Homo sapiens
tctcttgctttgtt

SEQ ID NO: 3888470 - DNA, 13 bp, Homo sapiens
tctcttgtagaag

SEQ ID NO: 3888471 - DNA, 13 bp, Homo sapiens
tctctttttcagt

SEQ ID NO: 3888472 - DNA, 17 bp, Homo sapiens
tctcttttttattctgt

SEQ ID NO: 3888473 - DNA, 22 bp, Homo sapiens
tctcttttttattctgttttct

SEQ ID NO: 3888474 - DNA, 21 bp, Homo sapiens
tctgaaaagcaattgccctgt

SEQ ID NO: 3888475 - DNA, 22 bp, Homo sapiens
tctgaaaatgttgttatgctat

SEQ ID NO: 3888476 - DNA, 19 bp, Homo sapiens
tctgaaacttcataaatgt

SEQ ID NO: 3888477 - DNA, 20 bp, Homo sapiens
tctgaaagacagaatgtcac

SEQ ID NO: 3888478 - DNA, 21 bp, Homo sapiens
tctgaaagacagaatgtcacc

SEQ ID NO: 3888479 - DNA, 12 bp, Homo sapiens
tctgaaagccac

SEQ ID NO: 3888480 - DNA, 16 bp, Homo sapiens
tctgaaagtatatttt

SEQ ID NO: 3888481 - DNA, 18 bp, Homo sapiens
tctgaaatcgccgtgtta

SEQ ID NO: 3888482 - DNA, 22 bp, Homo sapiens
tctgaacccttgtgcttggtgg

SEQ ID NO: 3888483 - DNA, 20 bp, Homo sapiens
tctgaaggaatagccagaga

SEQ ID NO: 3888484 - DNA, 18 bp, Homo sapiens
tctgaagtcactgcacag

SEQ ID NO: 3888485 - DNA, 14 bp, Homo sapiens
tctgaatattttgt

SEQ ID NO: 3888486 - DNA, 15 bp, Homo sapiens
tctgaatattttgta

SEQ ID NO: 3888487 - DNA, 22 bp, Homo sapiens
tctgacagttactcttcagttt

SEQ ID NO: 3888488 - DNA, 15 bp, Homo sapiens
tctgacccagtgaga

SEQ ID NO: 3888489 - DNA, 13 bp, Homo sapiens
tctgactccagag

SEQ ID NO: 3888490 - DNA, 17 bp, Homo sapiens
tctgactccagagtctg

SEQ ID NO: 3888491 - DNA, 17 bp, Homo sapiens
tctgacttctcccatct

SEQ ID NO: 3888492 - DNA, 19 bp, Homo sapiens
tctgagaaagactattcaa

SEQ ID NO: 3888493 - DNA, 21 bp, Homo sapiens
tctgagaaagactattcaaac

SEQ ID NO: 3888494 - DNA, 23 bp, Homo sapiens
tctgagaaagactattcaaacag

SEQ ID NO: 3888495 - DNA, 21 bp, Homo sapiens
tctgagaacagacgttaccaa

SEQ ID NO: 3888496 - DNA, 22 bp, Homo sapiens
tctgagactctcttaggagcag

SEQ ID NO: 3888497 - DNA, 15 bp, Homo sapiens
tctgagagagatgat

SEQ ID NO: 3888498 - DNA, 16 bp, Homo sapiens
tctgagcaagagctgg

SEQ ID NO: 3888499 - DNA, 15 bp, Homo sapiens
tctgagcaccccctc

SEQ ID NO: 3888500 - DNA, 19 bp, Homo sapiens
tctgagcaccccctcattc

SEQ ID NO: 3888501 - DNA, 22 bp, Homo sapiens
tctgagcaccccctcattcccc

SEQ ID NO: 3888502 - DNA, 14 bp, Homo sapiens
tctgagcccaggcc

SEQ ID NO: 3888503 - DNA, 17 bp, Homo sapiens
tctgagccttgagagaa

SEQ ID NO: 3888504 - DNA, 15 bp, Homo sapiens
tctgagcttcagtat

SEQ ID NO: 3888505 - DNA, 18 bp, Homo sapiens
tctgagcttttcatggaa

SEQ ID NO: 3888506 - DNA, 20 bp, Homo sapiens
tctgaggacatggagagaga

SEQ ID NO: 3888507 - DNA, 23 bp, Homo sapiens
tctgaggacatggagagagactc

SEQ ID NO: 3888508 - DNA, 15 bp, Homo sapiens
tctgaggccagcctg

SEQ ID NO: 3888509 - DNA, 16 bp, Homo sapiens
tctgaggccagcctgg

SEQ ID NO: 3888510 - DNA, 18 bp, Homo sapiens
tctgaggccagcctggcc

SEQ ID NO: 3888511 - DNA, 19 bp, Homo sapiens
tctgaggccagcctggcct

SEQ ID NO: 3888512 - DNA, 17 bp, Homo sapiens
tctgaggccccaggccc

SEQ ID NO: 3888513 - DNA, 14 bp, Homo sapiens
tctgagtcctgtct

SEQ ID NO: 3888514 - DNA, 16 bp, Homo sapiens
tctgagtcctgtctct

SEQ ID NO: 3888515 - DNA, 22 bp, Homo sapiens
tctgagtcctgtctctgcctgc

SEQ ID NO: 3888516 - DNA, 12 bp, Homo sapiens
tctgataaacac

SEQ ID NO: 3888517 - DNA, 15 bp, Homo sapiens
tctgataaacacaga

SEQ ID NO: 3888518 - DNA, 21 bp, Homo sapiens
tctgatatgggactgagcctg

SEQ ID NO: 3888519 - DNA, 15 bp, Homo sapiens
tctgatccctcgccc

SEQ ID NO: 3888520 - DNA, 19 bp, Homo sapiens
tctgatcgggataacaaaa

SEQ ID NO: 3888521 - DNA, 16 bp, Homo sapiens
tctgatggtgagctgg

SEQ ID NO: 3888522 - DNA, 13 bp, Homo sapiens
tctgatgtttgtt

SEQ ID NO: 3888523 - DNA, 13 bp, Homo sapiens
tctgattccatat

SEQ ID NO: 3888524 - DNA, 13 bp, Homo sapiens
tctgattggctca

SEQ ID NO: 3888525 - DNA, 14 bp, Homo sapiens
tctgatttaatgtt

SEQ ID NO: 3888526 - DNA, 18 bp, Homo sapiens
tctgatttaatgttttct

SEQ ID NO: 3888527 - DNA, 14 bp, Homo sapiens
tctgattttggcat

SEQ ID NO: 3888528 - DNA, 18 bp, Homo sapiens
tctgcaaagaatgagaag

SEQ ID NO: 3888529 - DNA, 16 bp, Homo sapiens
tctgcaactagccaag

SEQ ID NO: 3888530 - DNA, 17 bp, Homo sapiens
tctgcaaggtctttggt

SEQ ID NO: 3888531 - DNA, 19 bp, Homo sapiens
tctgcaatgggcactggga

SEQ ID NO: 3888532 - DNA, 15 bp, Homo sapiens
tctgcacccaggggt

SEQ ID NO: 3888533 - DNA, 15 bp, Homo sapiens
tctgcagcaactccc

SEQ ID NO: 3888534 - DNA, 17 bp, Homo sapiens
tctgcagcaactcccac

SEQ ID NO: 3888535 - DNA, 21 bp, Homo sapiens
tctgcagcaactcccacgact

SEQ ID NO: 3888536 - DNA, 20 bp, Homo sapiens
tctgcagcactttaaccctc

SEQ ID NO: 3888537 - DNA, 18 bp, Homo sapiens
tctgcagccagcccagcc

SEQ ID NO: 3888538 - DNA, 19 bp, Homo sapiens
tctgcagccagcccagccc

SEQ ID NO: 3888539 - DNA, 22 bp, Homo sapiens
tctgcagctatgcgcaatgtgg

SEQ ID NO: 3888540 - DNA, 14 bp, Homo sapiens
tctgcaggcacctt

SEQ ID NO: 3888541 - DNA, 17 bp, Homo sapiens
tctgcaggcaccttagt

SEQ ID NO: 3888542 - DNA, 22 bp, Homo sapiens
tctgcaggcaccttagtggctt

SEQ ID NO: 3888543 - DNA, 16 bp, Homo sapiens
tctgcagggagcaact

SEQ ID NO: 3888544 - DNA, 19 bp, Homo sapiens
tctgcagggggtgtgtctg

SEQ ID NO: 3888545 - DNA, 16 bp, Homo sapiens
tctgcagtagtctctg

SEQ ID NO: 3888546 - DNA, 21 bp, Homo sapiens
tctgcagtagtctctgtgctt

SEQ ID NO: 3888547 - DNA, 14 bp, Homo sapiens
tctgcatcagctgc

SEQ ID NO: 3888548 - DNA, 21 bp, Homo sapiens
tctgcatcagctgctgaaaca

SEQ ID NO: 3888549 - DNA, 17 bp, Homo sapiens
tctgcattcaggatcaa

SEQ ID NO: 3888550 - DNA, 19 bp, Homo sapiens
tctgcattccccgctgccc

SEQ ID NO: 3888551 - DNA, 13 bp, Homo sapiens
tctgccaagccct

SEQ ID NO: 3888552 - DNA, 19 bp, Homo sapiens
tctgccacagagagtcctt

SEQ ID NO: 3888553 - DNA, 14 bp, Homo sapiens
tctgccccaagcag

SEQ ID NO: 3888554 - DNA, 18 bp, Homo sapiens
tctgccccaagcagccag

SEQ ID NO: 3888555 - DNA, 16 bp, Homo sapiens
tctgccccaaggggcc

SEQ ID NO: 3888556 - DNA, 20 bp, Homo sapiens
tctgccccaaggggcccaca

SEQ ID NO: 3888557 - DNA, 15 bp, Homo sapiens
tctgccccagcttta

SEQ ID NO: 3888558 - DNA, 17 bp, Homo sapiens
tctgccccagctttatc

SEQ ID NO: 3888559 - DNA, 13 bp, Homo sapiens
tctgccccagtag

SEQ ID NO: 3888560 - DNA, 16 bp, Homo sapiens
tctgccccagtagtca

SEQ ID NO: 3888561 - DNA, 15 bp, Homo sapiens
tctgccccttgggca

SEQ ID NO: 3888562 - DNA, 14 bp, Homo sapiens
tctgccctgcctcc

SEQ ID NO: 3888563 - DNA, 15 bp, Homo sapiens
tctgccctgcctccc

SEQ ID NO: 3888564 - DNA, 13 bp, Homo sapiens
tctgccctgtata

SEQ ID NO: 3888565 - DNA, 16 bp, Homo sapiens
tctgcctatttattgg

SEQ ID NO: 3888566 - DNA, 15 bp, Homo sapiens
tctgcctcctcttca

SEQ ID NO: 3888567 - DNA, 12 bp, Homo sapiens
tctgcctggcct

SEQ ID NO: 3888568 - DNA, 13 bp, Homo sapiens
tctgcctggcctg

SEQ ID NO: 3888569 - DNA, 17 bp, Homo sapiens
tctgcctggcctggctc

SEQ ID NO: 3888570 - DNA, 10 bp, Homo sapiens
tctgcctggg

SEQ ID NO: 3888571 - DNA, 18 bp, Homo sapiens
tctgcctgggcctgtgca

SEQ ID NO: 3888572 - DNA, 19 bp, Homo sapiens
tcctgataaacattaaaca

SEQ ID NO: 3888573 - DNA, 19 bp, Homo sapiens
tcctgataataattgatca

SEQ ID NO: 3888574 - DNA, 13 bp, Homo sapiens
tcctgatggccaa

SEQ ID NO: 3888575 - DNA, 18 bp, Homo sapiens
tcctgatggtacaggaaa

SEQ ID NO: 3888576 - DNA, 13 bp, Homo sapiens
tcctgattcccca

SEQ ID NO: 3888577 - DNA, 17 bp, Homo sapiens
tcctgatttcagggaaa

SEQ ID NO: 3888578 - DNA, 19 bp, Homo sapiens
tcctgatttctctgaacag

SEQ ID NO: 3888579 - DNA, 17 bp, Homo sapiens
tcctgcaaagggaactg

SEQ ID NO: 3888580 - DNA, 18 bp, Homo sapiens
tcctgcaatctccagggc

SEQ ID NO: 3888581 - DNA, 20 bp, Homo sapiens
tcctgcaatctccagggctg

SEQ ID NO: 3888582 - DNA, 19 bp, Homo sapiens
tcctgcagcctcctcctga

SEQ ID NO: 3888583 - DNA, 16 bp, Homo sapiens
tcctgcatttgtgaaa

SEQ ID NO: 3888584 - DNA, 13 bp, Homo sapiens
tcctgccagctgc

SEQ ID NO: 3888585 - DNA, 20 bp, Homo sapiens
tcctgccagctgccttcctc

SEQ ID NO: 3888586 - DNA, 14 bp, Homo sapiens
tcctgcccaggaga

SEQ ID NO: 3888587 - DNA, 18 bp, Homo sapiens
tcctgcccaggagagcca

SEQ ID NO: 3888588 - DNA, 23 bp, Homo sapiens
tcctgcccaggagagccagccct

SEQ ID NO: 3888589 - DNA, 18 bp, Homo sapiens
tcctgcccatgtgtcccc

SEQ ID NO: 3888590 - DNA, 19 bp, Homo sapiens
tcctgcccccgacagccca

SEQ ID NO: 3888591 - DNA, 14 bp, Homo sapiens
tcctgcccctcgcc

SEQ ID NO: 3888592 - DNA, 15 bp, Homo sapiens
tcctgcccctcgcct

SEQ ID NO: 3888593 - DNA, 22 bp, Homo sapiens
tcctgcctctactgggaaggct

SEQ ID NO: 3888594 - DNA, 22 bp, Homo sapiens
tcctgcctctctgctccagaga

SEQ ID NO: 3888595 - DNA, 16 bp, Homo sapiens
tcctgctagctgtaga

SEQ ID NO: 3888596 - DNA, 16 bp, Homo sapiens
tcctgctctcttcagg

SEQ ID NO: 3888597 - DNA, 13 bp, Homo sapiens
tcctgctgctgta

SEQ ID NO: 3888598 - DNA, 22 bp, Homo sapiens
tcctgctgctgtaactgctgag

SEQ ID NO: 3888599 - DNA, 24 bp, Homo sapiens
tcctgctgctgtaactgctgagcc

SEQ ID NO: 3888600 - DNA, 15 bp, Homo sapiens
tcctgctgctgtgtt

SEQ ID NO: 3888601 - DNA, 12 bp, Homo sapiens
tcctgctggcac

SEQ ID NO: 3888602 - DNA, 16 bp, Homo sapiens
tcctgctggcacctca

SEQ ID NO: 3888603 - DNA, 18 bp, Homo sapiens
tcctgctggcacctcaga

SEQ ID NO: 3888604 - DNA, 14 bp, Homo sapiens
tcctgctgtggcct

SEQ ID NO: 3888605 - DNA, 15 bp, Homo sapiens
tcctgctgtggcctc

SEQ ID NO: 3888606 - DNA, 17 bp, Homo sapiens
tcctgctgtggcctcac

SEQ ID NO: 3888607 - DNA, 18 bp, Homo sapiens
tcctgctttccctcccca

SEQ ID NO: 3888608 - DNA, 23 bp, Homo sapiens
tcctggaaagactgattgtttta

SEQ ID NO: 3888609 - DNA, 15 bp, Homo sapiens
tcctggaaccaatcc

SEQ ID NO: 3888610 - DNA, 14 bp, Homo sapiens
tcctggaagctgtg

SEQ ID NO: 3888611 - DNA, 21 bp, Homo sapiens
tcctggaagctgtgtccttgc

SEQ ID NO: 3888612 - DNA, 13 bp, Homo sapiens
tcctggacagctg

SEQ ID NO: 3888613 - DNA, 16 bp, Homo sapiens
tcctggagcatcccag

SEQ ID NO: 3888614 - DNA, 18 bp, Homo sapiens
tcctggaggatgaccagg

SEQ ID NO: 3888615 - DNA, 23 bp, Homo sapiens
tcctggcaggaagtctctcccga

SEQ ID NO: 3888616 - DNA, 22 bp, Homo sapiens
tcctggccattttcttgcctga

SEQ ID NO: 3888617 - DNA, 12 bp, Homo sapiens
tcctggcccctc

SEQ ID NO: 3888618 - DNA, 22 bp, Homo sapiens
tcctggcccctccagaccctgc

SEQ ID NO: 3888619 - DNA, 13 bp, Homo sapiens
tcctggcctcctt

SEQ ID NO: 3888620 - DNA, 14 bp, Homo sapiens
tcctggctgccagg

SEQ ID NO: 3888621 - DNA, 20 bp, Homo sapiens
tcctggctgctctcatgcct

SEQ ID NO: 3888622 - DNA, 15 bp, Homo sapiens
tcctggggccccgct

SEQ ID NO: 3888623 - DNA, 21 bp, Homo sapiens
tcctggggccccgctgggatt

SEQ ID NO: 3888624 - DNA, 21 bp, Homo sapiens
tcctgggggttctttcttcct

SEQ ID NO: 3888625 - DNA, 23 bp, Homo sapiens
tcctgggggttctttcttcctct

SEQ ID NO: 3888626 - DNA, 15 bp, Homo sapiens
tcctgggtggctact

SEQ ID NO: 3888627 - DNA, 24 bp, Homo sapiens
tcctgggtggctactctgtgccag

SEQ ID NO: 3888628 - DNA, 18 bp, Homo sapiens
tcctggtacagcagggtc

SEQ ID NO: 3888629 - DNA, 16 bp, Homo sapiens
tcctggtgaggcccag

SEQ ID NO: 3888630 - DNA, 17 bp, Homo sapiens
tcctggtgaggcccagc

SEQ ID NO: 3888631 - DNA, 18 bp, Homo sapiens
tcctggtgaggcccagcc

SEQ ID NO: 3888632 - DNA, 21 bp, Homo sapiens
tcctggtgaggcccagcctgt

SEQ ID NO: 3888633 - DNA, 22 bp, Homo sapiens
tcctggtgaggcccagcctgtc

SEQ ID NO: 3888634 - DNA, 16 bp, Homo sapiens
tcctggtggggcagct

SEQ ID NO: 3888635 - DNA, 21 bp, Homo sapiens
tcctggtggggcagctcctct

SEQ ID NO: 3888636 - DNA, 21 bp, Homo sapiens
tcctgtaacacaagccacaga

SEQ ID NO: 3888637 - DNA, 22 bp, Homo sapiens
tcctgtataatctctctcctgt

SEQ ID NO: 3888638 - DNA, 14 bp, Homo sapiens
tcctgtatattatg

SEQ ID NO: 3888639 - DNA, 20 bp, Homo sapiens
tcctgtatttgttcccaaga

SEQ ID NO: 3888640 - DNA, 21 bp, Homo sapiens
tcctgtatttgttcccaagag

SEQ ID NO: 3888641 - DNA, 16 bp, Homo sapiens
tcctgtcatcccctac

SEQ ID NO: 3888642 - DNA, 18 bp, Homo sapiens
tcctgtccaacctaaccc

SEQ ID NO: 3888643 - DNA, 14 bp, Homo sapiens
tcctgtcccagagg

SEQ ID NO: 3888644 - DNA, 15 bp, Homo sapiens
tcctgtcccagaggt

SEQ ID NO: 3888645 - DNA, 18 bp, Homo sapiens
tcctgtccctacccactc

SEQ ID NO: 3888646 - DNA, 11 bp, Homo sapiens
tcctgtcctcc

SEQ ID NO: 3888647 - DNA, 14 bp, Homo sapiens
tcctgtctctgcct

SEQ ID NO: 3888648 - DNA, 15 bp, Homo sapiens
tcctgtctctgcctg

SEQ ID NO: 3888649 - DNA, 18 bp, Homo sapiens
tcctgtctgtcctggagg

SEQ ID NO: 3888650 - DNA, 22 bp, Homo sapiens
tcctgtgccaacctgatgcccc

SEQ ID NO: 3888651 - DNA, 17 bp, Homo sapiens
tcctgtgcccacatccc

SEQ ID NO: 3888652 - DNA, 13 bp, Homo sapiens
tcctgtgcccctc

SEQ ID NO: 3888653 - DNA, 16 bp, Homo sapiens
tcctgtgcccctcaga

SEQ ID NO: 3888654 - DNA, 14 bp, Homo sapiens
tcctgtgggagcct

SEQ ID NO: 3888655 - DNA, 15 bp, Homo sapiens
tcctgtgggagcctc

SEQ ID NO: 3888656 - DNA, 16 bp, Homo sapiens
tcctgtgggccaggag

SEQ ID NO: 3888657 - DNA, 18 bp, Homo sapiens
tcctgtgggccaggagct

SEQ ID NO: 3888658 - DNA, 14 bp, Homo sapiens
tcctgtgtggggag

SEQ ID NO: 3888659 - DNA, 16 bp, Homo sapiens
tcctgtgtggggaggc

SEQ ID NO: 3888660 - DNA, 14 bp, Homo sapiens
tcctgttgaatctt

SEQ ID NO: 3888661 - DNA, 13 bp, Homo sapiens
tcctgtttccatg

SEQ ID NO: 3888662 - DNA, 17 bp, Homo sapiens
tccttaattcactccca

SEQ ID NO: 3888663 - DNA, 20 bp, Homo sapiens
tccttactcctgtgggagcc

SEQ ID NO: 3888664 - DNA, 22 bp, Homo sapiens
tccttactcctgtgggagcctc

SEQ ID NO: 3888665 - DNA, 15 bp, Homo sapiens
tccttactctgagcc

SEQ ID NO: 3888666 - DNA, 16 bp, Homo sapiens
tccttactctgagccc

SEQ ID NO: 3888667 - DNA, 22 bp, Homo sapiens
tccttactctgagcccaggccg

SEQ ID NO: 3888668 - DNA, 22 bp, Homo sapiens
tccttaggaaaatgcttctgtt

SEQ ID NO: 3888669 - DNA, 23 bp, Homo sapiens
tccttaggaaaatgcttctgttg

SEQ ID NO: 3888670 - DNA, 14 bp, Homo sapiens
tccttatttatcaa

SEQ ID NO: 3888671 - DNA, 23 bp, Homo sapiens
tccttcagagctcttcaagctgt

SEQ ID NO: 3888672 - DNA, 18 bp, Homo sapiens
tccttcagcttccatttc

SEQ ID NO: 3888673 - DNA, 16 bp, Homo sapiens
tccttccagctagtga

SEQ ID NO: 3888674 - DNA, 18 bp, Homo sapiens
tccttcccccatcccctt

SEQ ID NO: 3888675 - DNA, 14 bp, Homo sapiens
tccttccctggctt

SEQ ID NO: 3888676 - DNA, 15 bp, Homo sapiens
tccttccctggcttg

SEQ ID NO: 3888677 - DNA, 14 bp, Homo sapiens
tccttcccttctct

SEQ ID NO: 3888678 - DNA, 16 bp, Homo sapiens
tccttccgctccttta

SEQ ID NO: 3888679 - DNA, 22 bp, Homo sapiens
tccttcctacacccttggactt

SEQ ID NO: 3888680 - DNA, 12 bp, Homo sapiens
tccttcctgccc

SEQ ID NO: 3888681 - DNA, 14 bp, Homo sapiens
tccttcctgcccca

SEQ ID NO: 3888682 - DNA, 15 bp, Homo sapiens
tccttccttccctgg

SEQ ID NO: 3888683 - DNA, 19 bp, Homo sapiens
tccttcgtgtctctcccac

SEQ ID NO: 3888684 - DNA, 14 bp, Homo sapiens
tccttctgcaccca

SEQ ID NO: 3888685 - DNA, 15 bp, Homo sapiens
tccttctgcacccag

SEQ ID NO: 3888686 - DNA, 21 bp, Homo sapiens
tccttctgcttctccctggct

SEQ ID NO: 3888687 - DNA, 12 bp, Homo sapiens
tccttctttctc

SEQ ID NO: 3888688 - DNA, 20 bp, Homo sapiens
tccttctttctcttccctcc

SEQ ID NO: 3888689 - DNA, 22 bp, Homo sapiens
tccttgcacccctcactctggc

SEQ ID NO: 3888690 - DNA, 24 bp, Homo sapiens
tccttgcacccctcactctggcct

SEQ ID NO: 3888691 - DNA, 17 bp, Homo sapiens
tccttgcacctgcatcc

SEQ ID NO: 3888692 - DNA, 15 bp, Homo sapiens
tccttgcatcaattt

SEQ ID NO: 3888693 - DNA, 16 bp, Homo sapiens
tccttgctttgctgtt

SEQ ID NO: 3888694 - DNA, 18 bp, Homo sapiens
tccttggagagcagctgg

SEQ ID NO: 3888695 - DNA, 19 bp, Homo sapiens
tccttggagagcagctggc

SEQ ID NO: 3888696 - DNA, 14 bp, Homo sapiens
tccttgggctcctg

SEQ ID NO: 3888697 - DNA, 15 bp, Homo sapiens
tccttgggctcctgg

SEQ ID NO: 3888698 - DNA, 14 bp, Homo sapiens
tccttggtctgctg

SEQ ID NO: 3888699 - DNA, 15 bp, Homo sapiens
tccttgtcaccagca

SEQ ID NO: 3888700 - DNA, 13 bp, Homo sapiens
tccttgtcactgg

SEQ ID NO: 3888701 - DNA, 22 bp, Homo sapiens
tccttgtggtttatgtcatcat

SEQ ID NO: 3888702 - DNA, 13 bp, Homo sapiens
tcctttacctacc

SEQ ID NO: 3888703 - DNA, 15 bp, Homo sapiens
tcctttacctaccac

SEQ ID NO: 3888704 - DNA, 22 bp, Homo sapiens
tcctttacctaccaccttccct

SEQ ID NO: 3888705 - DNA, 14 bp, Homo sapiens
tcctttaggcagcc

SEQ ID NO: 3888706 - DNA, 17 bp, Homo sapiens
tcctttaggcagcctgc

SEQ ID NO: 3888707 - DNA, 16 bp, Homo sapiens
tcctttatatttagtg

SEQ ID NO: 3888708 - DNA, 18 bp, Homo sapiens
tcctttcacaaccttctg

SEQ ID NO: 3888709 - DNA, 16 bp, Homo sapiens
tcctttgagaaagaaa

SEQ ID NO: 3888710 - DNA, 19 bp, Homo sapiens
tcctttgagaatgtgattc

SEQ ID NO: 3888711 - DNA, 14 bp, Homo sapiens
tcctttgagggcag

SEQ ID NO: 3888712 - DNA, 17 bp, Homo sapiens
tcctttgcactgagggc

SEQ ID NO: 3888713 - DNA, 10 bp, Homo sapiens
tcctttgttc

SEQ ID NO: 3888714 - DNA, 16 bp, Homo sapiens
tcctttgttcttacct

SEQ ID NO: 3888715 - DNA, 19 bp, Homo sapiens
tccttttaaaacacttcca

SEQ ID NO: 3888716 - DNA, 14 bp, Homo sapiens
tccttttattctgt

SEQ ID NO: 3888717 - DNA, 13 bp, Homo sapiens
tccttttcttcct

SEQ ID NO: 3888718 - DNA, 15 bp, Homo sapiens
tccttttcttccttc

SEQ ID NO: 3888719 - DNA, 17 bp, Homo sapiens
tccttttgatggggaga

SEQ ID NO: 3888720 - DNA, 14 bp, Homo sapiens
tccttttgctgtct

SEQ ID NO: 3888721 - DNA, 20 bp, Homo sapiens
tccttttgctgtctttctct

SEQ ID NO: 3888722 - DNA, 20 bp, Homo sapiens
tccttttgtccccagggccc

SEQ ID NO: 3888723 - DNA, 18 bp, Homo sapiens
tccttttgtgtacagtgt

SEQ ID NO: 3888724 - DNA, 14 bp, Homo sapiens
tcctttttctttat

SEQ ID NO: 3888725 - DNA, 23 bp, Homo sapiens
tcctttttgcagtatatttctga

SEQ ID NO: 3888726 - DNA, 19 bp, Homo sapiens
tcgaaaattcatttcacat

SEQ ID NO: 3888727 - DNA, 21 bp, Homo sapiens
tcgaaaattcatttcacatta

SEQ ID NO: 3888728 - DNA, 17 bp, Homo sapiens
tcgaaccaaggcagcct

SEQ ID NO: 3888729 - DNA, 22 bp, Homo sapiens
tcgaaccaaggcagcctccaga

SEQ ID NO: 3888730 - DNA, 21 bp, Homo sapiens
tcgaattaatagcttttattg

SEQ ID NO: 3888731 - DNA, 14 bp, Homo sapiens
tcgaccccaaagcc

SEQ ID NO: 3888732 - DNA, 15 bp, Homo sapiens
tcgaccctttctctg

SEQ ID NO: 3888733 - DNA, 20 bp, Homo sapiens
tcgacctgcggctgctgtgt

SEQ ID NO: 3888734 - DNA, 14 bp, Homo sapiens
tcgactcaggatcc

SEQ ID NO: 3888735 - DNA, 18 bp, Homo sapiens
tcgactttatacagaact

SEQ ID NO: 3888736 - DNA, 23 bp, Homo sapiens
tcgagaccatcctggcccctcca

SEQ ID NO: 3888737 - DNA, 14 bp, Homo sapiens
tcgagcagggtgct

SEQ ID NO: 3888738 - DNA, 20 bp, Homo sapiens
tcgagcagggtgctgtgggt

SEQ ID NO: 3888739 - DNA, 15 bp, Homo sapiens
tcgagccactgcact

SEQ ID NO: 3888740 - DNA, 18 bp, Homo sapiens
tcgagcgccctgcagacc

SEQ ID NO: 3888741 - DNA, 17 bp, Homo sapiens
tcgaggacaagtgagag

SEQ ID NO: 3888742 - DNA, 19 bp, Homo sapiens
tcgatctgtactgtaattt

SEQ ID NO: 3888743 - DNA, 19 bp, Homo sapiens
tcgatgaagcccaataaac

SEQ ID NO: 3888744 - DNA, 23 bp, Homo sapiens
tcgatgaagcccaataaacctct

SEQ ID NO: 3888745 - DNA, 21 bp, Homo sapiens
tcgcaccactgtgtatttaac

SEQ ID NO: 3888746 - DNA, 16 bp, Homo sapiens
tcgcaccttttatacc

SEQ ID NO: 3888747 - DNA, 16 bp, Homo sapiens
tcgcagcaggtgcaag

SEQ ID NO: 3888748 - DNA, 17 bp, Homo sapiens
tcgcagcaggtgcaaga

SEQ ID NO: 3888749 - DNA, 21 bp, Homo sapiens
tcgcagcaggtgcaagagaca

SEQ ID NO: 3888750 - DNA, 10 bp, Homo sapiens
tcgcagccac

SEQ ID NO: 3888751 - DNA, 12 bp, Homo sapiens
tcgcagccaccc

SEQ ID NO: 3888752 - DNA, 19 bp, Homo sapiens
tcgcagccaccctgaggag

SEQ ID NO: 3888753 - DNA, 21 bp, Homo sapiens
tcgcagcctggcggggcagga

SEQ ID NO: 3888754 - DNA, 19 bp, Homo sapiens
tcgcaggatccgctgccac

SEQ ID NO: 3888755 - DNA, 22 bp, Homo sapiens
tcgcccacaagccttactcacc

SEQ ID NO: 3888756 - DNA, 12 bp, Homo sapiens
tcgccccaccca

SEQ ID NO: 3888757 - DNA, 15 bp, Homo sapiens
tcgccccagatcacc

SEQ ID NO: 3888758 - DNA, 22 bp, Homo sapiens
tcgccccagatcaccagcccgg

SEQ ID NO: 3888759 - DNA, 15 bp, Homo sapiens
tcgcccccacacccc

SEQ ID NO: 3888760 - DNA, 14 bp, Homo sapiens
tcgcctaggcctgt

SEQ ID NO: 3888761 - DNA, 16 bp, Homo sapiens
tcgcctaggcctgtga

SEQ ID NO: 3888762 - DNA, 17 bp, Homo sapiens
tcgcctgggcccaggct

SEQ ID NO: 3888763 - DNA, 18 bp, Homo sapiens
tcgcctgggcccaggctc

SEQ ID NO: 3888764 - DNA, 23 bp, Homo sapiens
tcgccttttaggctcaggacgga

SEQ ID NO: 3888765 - DNA, 20 bp, Homo sapiens
tcgctccccactctgctctg

SEQ ID NO: 3888766 - DNA, 23 bp, Homo sapiens
tcgctccctgtagctctgcctcc

SEQ ID NO: 3888767 - DNA, 16 bp, Homo sapiens
tcgctgccaggacacc

SEQ ID NO: 3888768 - DNA, 17 bp, Homo sapiens
tcgctgccaggacacct

SEQ ID NO: 3888769 - DNA, 18 bp, Homo sapiens
tcgctgccaggacacctg

SEQ ID NO: 3888770 - DNA, 19 bp, Homo sapiens
tcgctgccaggacacctgc

SEQ ID NO: 3888771 - DNA, 17 bp, Homo sapiens
tcgctgctctagctggc

SEQ ID NO: 3888772 - DNA, 16 bp, Homo sapiens
tcgctgcttcgtggga

SEQ ID NO: 3888773 - DNA, 21 bp, Homo sapiens
tcgctggaatcaatttcccag

SEQ ID NO: 3888774 - DNA, 13 bp, Homo sapiens
tcgcttgcttctg

SEQ ID NO: 3888775 - DNA, 17 bp, Homo sapiens
tcggacctttcagctgt

SEQ ID NO: 3888776 - DNA, 15 bp, Homo sapiens
tcggaggctgggccc

SEQ ID NO: 3888777 - DNA, 17 bp, Homo sapiens
tcggaggtggtggagga

SEQ ID NO: 3888778 - DNA, 16 bp, Homo sapiens
tcggagtagaaattgt

SEQ ID NO: 3888779 - DNA, 18 bp, Homo sapiens
tcggcaactaagcagtcc

SEQ ID NO: 3888780 - DNA, 19 bp, Homo sapiens
tcggcccacagctcccacc

SEQ ID NO: 3888781 - DNA, 16 bp, Homo sapiens
tcgggaggctgagaca

SEQ ID NO: 3888782 - DNA, 18 bp, Homo sapiens
tcgggataacaaaatcac

SEQ ID NO: 3888783 - DNA, 23 bp, Homo sapiens
tcggggcccttggggcctggctt

SEQ ID NO: 3888784 - DNA, 15 bp, Homo sapiens
tcggggtgcacagga

SEQ ID NO: 3888785 - DNA, 16 bp, Homo sapiens
tcggggtgcacaggag

SEQ ID NO: 3888786 - DNA, 20 bp, Homo sapiens
tcgggtccgattaatttatg

SEQ ID NO: 3888787 - DNA, 13 bp, Homo sapiens
tcggtgggacagc

SEQ ID NO: 3888788 - DNA, 14 bp, Homo sapiens
tcggtgtaaaacca

SEQ ID NO: 3888789 - DNA, 23 bp, Homo sapiens
tcggttccacgtccccctggggc

SEQ ID NO: 3888790 - DNA, 14 bp, Homo sapiens
tcggtttctgagca

SEQ ID NO: 3888791 - DNA, 19 bp, Homo sapiens
tcgtccacaggggcaggcc

SEQ ID NO: 3888792 - DNA, 20 bp, Homo sapiens
tcgtccacaggggcaggcct

SEQ ID NO: 3888793 - DNA, 23 bp, Homo sapiens
tcgtcctccccctgccagtgcct

SEQ ID NO: 3888794 - DNA, 23 bp, Homo sapiens
tcgtcctgcccccgacagcccag

SEQ ID NO: 3888795 - DNA, 16 bp, Homo sapiens
tcgtcctgtcccagag

SEQ ID NO: 3888796 - DNA, 19 bp, Homo sapiens
tcgtccttactcctgtggg

SEQ ID NO: 3888797 - DNA, 13 bp, Homo sapiens
tcgtctgtcccag

SEQ ID NO: 3888798 - DNA, 18 bp, Homo sapiens
tcgtgacccttcagggcc

SEQ ID NO: 3888799 - DNA, 19 bp, Homo sapiens
tcgtgacccttcagggcca

SEQ ID NO: 3888800 - DNA, 20 bp, Homo sapiens
tcgtgacccttcagggccag

SEQ ID NO: 3888801 - DNA, 18 bp, Homo sapiens
tcgtgccatgatctgtat

SEQ ID NO: 3888802 - DNA, 12 bp, Homo sapiens
tcgtggacacct

SEQ ID NO: 3888803 - DNA, 13 bp, Homo sapiens
tcgtggacacctg

SEQ ID NO: 3888804 - DNA, 14 bp, Homo sapiens
tcgtggacacctgc

SEQ ID NO: 3888805 - DNA, 18 bp, Homo sapiens
tcgtggacacctgccctg

SEQ ID NO: 3888806 - DNA, 18 bp, Homo sapiens
tcgtggagagctaggagc

SEQ ID NO: 3888807 - DNA, 24 bp, Homo sapiens
tcgtggagagctaggagcaaagcc

SEQ ID NO: 3888808 - DNA, 16 bp, Homo sapiens
tcgtggtagaagccag

SEQ ID NO: 3888809 - DNA, 17 bp, Homo sapiens
tcgtggtagaagccagt

SEQ ID NO: 3888810 - DNA, 21 bp, Homo sapiens
tcgtgtgatttcctacagaaa

SEQ ID NO: 3888811 - DNA, 14 bp, Homo sapiens
tcgtgtttacaaaa

SEQ ID NO: 3888812 - DNA, 21 bp, Homo sapiens
tctaaaactatggttcccaat

SEQ ID NO: 3888813 - DNA, 23 bp, Homo sapiens
tctaaaactatggttcccaataa

SEQ ID NO: 3888814 - DNA, 14 bp, Homo sapiens
tctaaacattaatc

SEQ ID NO: 3888815 - DNA, 15 bp, Homo sapiens
tctaaagctttctga

SEQ ID NO: 3888816 - DNA, 19 bp, Homo sapiens
tctaaagttgttcacatat

SEQ ID NO: 3888817 - DNA, 13 bp, Homo sapiens
tctaaagtttaca

SEQ ID NO: 3888818 - DNA, 15 bp, Homo sapiens
tctaaagtttacagt

SEQ ID NO: 3888819 - DNA, 17 bp, Homo sapiens
tctaaagtttacagtaa

SEQ ID NO: 3888820 - DNA, 18 bp, Homo sapiens
tctaaagtttacagtaaa

SEQ ID NO: 3888821 - DNA, 19 bp, Homo sapiens
tctaaagtttacagtaaat

SEQ ID NO: 3888822 - DNA, 21 bp, Homo sapiens
tctaacccccagtgccacaga

SEQ ID NO: 3888823 - DNA, 22 bp, Homo sapiens
tctaacccccagtgccacagag

SEQ ID NO: 3888824 - DNA, 12 bp, Homo sapiens
tctaacctcagc

SEQ ID NO: 3888825 - DNA, 15 bp, Homo sapiens
tctaactgtaaatca

SEQ ID NO: 3888826 - DNA, 21 bp, Homo sapiens
tctaactgtaaatcacttgta

SEQ ID NO: 3888827 - DNA, 22 bp, Homo sapiens
tctaactgtaaatcacttgtaa

SEQ ID NO: 3888828 - DNA, 21 bp, Homo sapiens
tctaagcatcttgtcaagaaa

SEQ ID NO: 3888829 - DNA, 15 bp, Homo sapiens
tctaagctgcagctt

SEQ ID NO: 3888830 - DNA, 19 bp, Homo sapiens
tccctgaaaacccagagag

SEQ ID NO: 3888831 - DNA, 16 bp, Homo sapiens
tccctgaacctcagtt

SEQ ID NO: 3888832 - DNA, 19 bp, Homo sapiens
tccctgaacctcagtttcc

SEQ ID NO: 3888833 - DNA, 24 bp, Homo sapiens
tccctgacgacactgaagaatcaa

SEQ ID NO: 3888834 - DNA, 14 bp, Homo sapiens
tccctgagctttgg

SEQ ID NO: 3888835 - DNA, 19 bp, Homo sapiens
tccctgataacaacctgga

SEQ ID NO: 3888836 - DNA, 21 bp, Homo sapiens
tccctgataacaacctggaga

SEQ ID NO: 3888837 - DNA, 19 bp, Homo sapiens
tccctgcccctcccttcaa

SEQ ID NO: 3888838 - DNA, 21 bp, Homo sapiens
tccctgctaccaaggcccagc

SEQ ID NO: 3888839 - DNA, 12 bp, Homo sapiens
tccctgctcctc

SEQ ID NO: 3888840 - DNA, 23 bp, Homo sapiens
tccctggcatgtcagagccaggc

SEQ ID NO: 3888841 - DNA, 18 bp, Homo sapiens
tccctggcttgtaactcc

SEQ ID NO: 3888842 - DNA, 21 bp, Homo sapiens
tccctggcttgtaactccacc

SEQ ID NO: 3888843 - DNA, 17 bp, Homo sapiens
tccctgggaactcatcc

SEQ ID NO: 3888844 - DNA, 12 bp, Homo sapiens
tccctgggcctg

SEQ ID NO: 3888845 - DNA, 13 bp, Homo sapiens
tccctgggcctgc

SEQ ID NO: 3888846 - DNA, 18 bp, Homo sapiens
tccctgggcctgctgctg

SEQ ID NO: 3888847 - DNA, 19 bp, Homo sapiens
tccctgggcctgctgctga

SEQ ID NO: 3888848 - DNA, 17 bp, Homo sapiens
tccctggggatatgcaa

SEQ ID NO: 3888849 - DNA, 16 bp, Homo sapiens
tccctggggtccttgc

SEQ ID NO: 3888850 - DNA, 19 bp, Homo sapiens
tccctggtcccttggagac

SEQ ID NO: 3888851 - DNA, 16 bp, Homo sapiens
tccctggtgcagaggt

SEQ ID NO: 3888852 - DNA, 17 bp, Homo sapiens
tccctgtagctctgcct

SEQ ID NO: 3888853 - DNA, 14 bp, Homo sapiens
tccctgtcaccaag

SEQ ID NO: 3888854 - DNA, 15 bp, Homo sapiens
tccctgtcagaggct

SEQ ID NO: 3888855 - DNA, 12 bp, Homo sapiens
tccctgtcctcc

SEQ ID NO: 3888856 - DNA, 14 bp, Homo sapiens
tccctgtcctcctc

SEQ ID NO: 3888857 - DNA, 17 bp, Homo sapiens
tccctgtttcaaactga

SEQ ID NO: 3888858 - DNA, 13 bp, Homo sapiens
tcccttaggcatt

SEQ ID NO: 3888859 - DNA, 16 bp, Homo sapiens
tcccttaggcattatt

SEQ ID NO: 3888860 - DNA, 18 bp, Homo sapiens
tcccttaggcattattta

SEQ ID NO: 3888861 - DNA, 11 bp, Homo sapiens
tcccttcaacc

SEQ ID NO: 3888862 - DNA, 21 bp, Homo sapiens
tcccttcaaccattccccatg

SEQ ID NO: 3888863 - DNA, 22 bp, Homo sapiens
tcccttcaaccattccccatgg

SEQ ID NO: 3888864 - DNA, 15 bp, Homo sapiens
tcccttcccctgcct

SEQ ID NO: 3888865 - DNA, 15 bp, Homo sapiens
tcccttcctggcctc

SEQ ID NO: 3888866 - DNA, 15 bp, Homo sapiens
tcccttctctccttc

SEQ ID NO: 3888867 - DNA, 17 bp, Homo sapiens
tcccttctttttcttct

SEQ ID NO: 3888868 - DNA, 18 bp, Homo sapiens
tcccttgagacctcagcc

SEQ ID NO: 3888869 - DNA, 21 bp, Homo sapiens
tcccttgctcagtgcctcctg

SEQ ID NO: 3888870 - DNA, 22 bp, Homo sapiens
tcccttggaaagttcagccaga

SEQ ID NO: 3888871 - DNA, 22 bp, Homo sapiens
tccctttcccatccataaggtg

SEQ ID NO: 3888872 - DNA, 13 bp, Homo sapiens
tccctttctcttc

SEQ ID NO: 3888873 - DNA, 13 bp, Homo sapiens
tccctttctggga

SEQ ID NO: 3888874 - DNA, 14 bp, Homo sapiens
tccgagaacaacag

SEQ ID NO: 3888875 - DNA, 16 bp, Homo sapiens
tccgattaatttatgg

SEQ ID NO: 3888876 - DNA, 14 bp, Homo sapiens
tccgcaccagctgc

SEQ ID NO: 3888877 - DNA, 13 bp, Homo sapiens
tccgcacttggaa

SEQ ID NO: 3888878 - DNA, 17 bp, Homo sapiens
tccgccaaacactccac

SEQ ID NO: 3888879 - DNA, 21 bp, Homo sapiens
tccgcctgcagaggacagagc

SEQ ID NO: 3888880 - DNA, 19 bp, Homo sapiens
tccgctaagacctccccac

SEQ ID NO: 3888881 - DNA, 21 bp, Homo sapiens
tccgctcctttacctaccacc

SEQ ID NO: 3888882 - DNA, 20 bp, Homo sapiens
tccgctgtcgccccaggccc

SEQ ID NO: 3888883 - DNA, 23 bp, Homo sapiens
tccggaggggttgcgggggagct

SEQ ID NO: 3888884 - DNA, 15 bp, Homo sapiens
tccgggacgcttcca

SEQ ID NO: 3888885 - DNA, 17 bp, Homo sapiens
tccgggacgcttccaga

SEQ ID NO: 3888886 - DNA, 18 bp, Homo sapiens
tccgggacgcttccagac

SEQ ID NO: 3888887 - DNA, 23 bp, Homo sapiens
tccgggacgcttccagaccacct

SEQ ID NO: 3888888 - DNA, 20 bp, Homo sapiens
tccgggccgggcggaagggg

SEQ ID NO: 3888889 - DNA, 15 bp, Homo sapiens
tccggggtctgtgct

SEQ ID NO: 3888890 - DNA, 18 bp, Homo sapiens
tccggggtctgtgctgtg

SEQ ID NO: 3888891 - DNA, 14 bp, Homo sapiens
tccgggtgccattc

SEQ ID NO: 3888892 - DNA, 19 bp, Homo sapiens
tccgggtgtggcctcagcc

SEQ ID NO: 3888893 - DNA, 20 bp, Homo sapiens
tccgggtgtggcctcagccc

SEQ ID NO: 3888894 - DNA, 14 bp, Homo sapiens
tccgtagttccctg

SEQ ID NO: 3888895 - DNA, 15 bp, Homo sapiens
tccgtccacccaggc

SEQ ID NO: 3888896 - DNA, 16 bp, Homo sapiens
tccgtcccaaacagag

SEQ ID NO: 3888897 - DNA, 17 bp, Homo sapiens
tccgtccggaaatgaag

SEQ ID NO: 3888898 - DNA, 20 bp, Homo sapiens
tccgtttcagctgacagctg

SEQ ID NO: 3888899 - DNA, 15 bp, Homo sapiens
tcctaaagtctctgc

SEQ ID NO: 3888900 - DNA, 14 bp, Homo sapiens
tcctaactgagaat

SEQ ID NO: 3888901 - DNA, 13 bp, Homo sapiens
tcctaagcagctg

SEQ ID NO: 3888902 - DNA, 19 bp, Homo sapiens
tcctaagcagtgcttgtaa

SEQ ID NO: 3888903 - DNA, 13 bp, Homo sapiens
tcctaagcctgtt

SEQ ID NO: 3888904 - DNA, 14 bp, Homo sapiens
tcctacaaaatgga

SEQ ID NO: 3888905 - DNA, 17 bp, Homo sapiens
tcctacacccttggact

SEQ ID NO: 3888906 - DNA, 20 bp, Homo sapiens
tcctacacccttggacttga

SEQ ID NO: 3888907 - DNA, 13 bp, Homo sapiens
tcctaccaatgca

SEQ ID NO: 3888908 - DNA, 21 bp, Homo sapiens
tcctaccaatgcatgcagcca

SEQ ID NO: 3888909 - DNA, 15 bp, Homo sapiens
tcctacccaaccact

SEQ ID NO: 3888910 - DNA, 14 bp, Homo sapiens
tcctaccccacctc

SEQ ID NO: 3888911 - DNA, 14 bp, Homo sapiens
tcctacctgctgct

SEQ ID NO: 3888912 - DNA, 15 bp, Homo sapiens
tcctacctgctgctg

SEQ ID NO: 3888913 - DNA, 15 bp, Homo sapiens
tcctagaaccaagct

SEQ ID NO: 3888914 - DNA, 23 bp, Homo sapiens
tcctagactaattaaaatctgga

SEQ ID NO: 3888915 - DNA, 16 bp, Homo sapiens
tcctagagctcctgtc

SEQ ID NO: 3888916 - DNA, 18 bp, Homo sapiens
tcctagagctcctgtccc

SEQ ID NO: 3888917 - DNA, 23 bp, Homo sapiens
tcctagaggtgggcagctgggcc

SEQ ID NO: 3888918 - DNA, 14 bp, Homo sapiens
tcctaggagaagca

SEQ ID NO: 3888919 - DNA, 22 bp, Homo sapiens
tcctaggagaagcagcctccta

SEQ ID NO: 3888920 - DNA, 20 bp, Homo sapiens
tcctaggctccaccccatcc

SEQ ID NO: 3888921 - DNA, 13 bp, Homo sapiens
tcctagttttctc

SEQ ID NO: 3888922 - DNA, 14 bp, Homo sapiens
tcctataaggagag

SEQ ID NO: 3888923 - DNA, 17 bp, Homo sapiens
tcctatacatttctgtt

SEQ ID NO: 3888924 - DNA, 22 bp, Homo sapiens
tcctatccttggagagcagctg

SEQ ID NO: 3888925 - DNA, 15 bp, Homo sapiens
tcctatggaaaaggg

SEQ ID NO: 3888926 - DNA, 14 bp, Homo sapiens
tcctattctcacca

SEQ ID NO: 3888927 - DNA, 16 bp, Homo sapiens
tcctattctcaccagg

SEQ ID NO: 3888928 - DNA, 17 bp, Homo sapiens
tcctattctcaccagga

SEQ ID NO: 3888929 - DNA, 14 bp, Homo sapiens
tcctattttaaaac

SEQ ID NO: 3888930 - DNA, 16 bp, Homo sapiens
tcctattttaaaacca

SEQ ID NO: 3888931 - DNA, 22 bp, Homo sapiens
tcctattttaaaaccatgcagc

SEQ ID NO: 3888932 - DNA, 18 bp, Homo sapiens
tcctcaatggacttcaaa

SEQ ID NO: 3888933 - DNA, 13 bp, Homo sapiens
tcctcacaggagc

SEQ ID NO: 3888934 - DNA, 17 bp, Homo sapiens
tcctcagagaatttcta

SEQ ID NO: 3888935 - DNA, 14 bp, Homo sapiens
tcctcagctgccaa

SEQ ID NO: 3888936 - DNA, 20 bp, Homo sapiens
tcctcagctgccaagcactc

SEQ ID NO: 3888937 - DNA, 12 bp, Homo sapiens
tcctcatctgca

SEQ ID NO: 3888938 - DNA, 14 bp, Homo sapiens
tcctcatctgcaga

SEQ ID NO: 3888939 - DNA, 19 bp, Homo sapiens
tcctccaacaataaagagc

SEQ ID NO: 3888940 - DNA, 19 bp, Homo sapiens
tcctccaacgttaaaagac

SEQ ID NO: 3888941 - DNA, 19 bp, Homo sapiens
tcctccacagtgctgcttc

SEQ ID NO: 3888942 - DNA, 16 bp, Homo sapiens
tcctccactcactcca

SEQ ID NO: 3888943 - DNA, 17 bp, Homo sapiens
tcctccactcactccag

SEQ ID NO: 3888944 - DNA, 22 bp, Homo sapiens
tcctccagacagatacagcccc

SEQ ID NO: 3888945 - DNA, 20 bp, Homo sapiens
tcctccagacccctgtggca

SEQ ID NO: 3888946 - DNA, 23 bp, Homo sapiens
tcctccagggccacgtgccaggc

SEQ ID NO: 3888947 - DNA, 15 bp, Homo sapiens
tcctccatggtggaa

SEQ ID NO: 3888948 - DNA, 13 bp, Homo sapiens
tcctcccacaatc

SEQ ID NO: 3888949 - DNA, 13 bp, Homo sapiens
tcctcccatcccc

SEQ ID NO: 3888950 - DNA, 13 bp, Homo sapiens
tcctccccagtct

SEQ ID NO: 3888951 - DNA, 20 bp, Homo sapiens
tcctccccctgccagtgcct

SEQ ID NO: 3888952 - DNA, 23 bp, Homo sapiens
tcctccccctgccagtgccttac

SEQ ID NO: 3888953 - DNA, 17 bp, Homo sapiens
tcctcccctattttaag

SEQ ID NO: 3888954 - DNA, 14 bp, Homo sapiens
tcctcccttcctcc

SEQ ID NO: 3888955 - DNA, 15 bp, Homo sapiens
tcctccgtccaccca

SEQ ID NO: 3888956 - DNA, 12 bp, Homo sapiens
tcctcctccaca

SEQ ID NO: 3888957 - DNA, 13 bp, Homo sapiens
tcctcctccacag

SEQ ID NO: 3888958 - DNA, 14 bp, Homo sapiens
tcctcctgaagcct

SEQ ID NO: 3888959 - DNA, 16 bp, Homo sapiens
tcctcctgaagcctct

SEQ ID NO: 3888960 - DNA, 20 bp, Homo sapiens
tcctcctgatggccaagagc

SEQ ID NO: 3888961 - DNA, 16 bp, Homo sapiens
tcctcctgtgtacagg

SEQ ID NO: 3888962 - DNA, 18 bp, Homo sapiens
tcctccttcccctgtggt

SEQ ID NO: 3888963 - DNA, 14 bp, Homo sapiens
tcctcgccctgggt

SEQ ID NO: 3888964 - DNA, 14 bp, Homo sapiens
tcctcggccccctc

SEQ ID NO: 3888965 - DNA, 15 bp, Homo sapiens
tcctcggtactccca

SEQ ID NO: 3888966 - DNA, 12 bp, Homo sapiens
tcctctactact

SEQ ID NO: 3888967 - DNA, 14 bp, Homo sapiens
tcctctccaattgt

SEQ ID NO: 3888968 - DNA, 18 bp, Homo sapiens
tcctctccaattgtaaaa

SEQ ID NO: 3888969 - DNA, 14 bp, Homo sapiens
tcctctccactgcc

SEQ ID NO: 3888970 - DNA, 18 bp, Homo sapiens
tcctctccactgccttcg

SEQ ID NO: 3888971 - DNA, 12 bp, Homo sapiens
tcctctccaggc

SEQ ID NO: 3888972 - DNA, 18 bp, Homo sapiens
tcctctcccctctgccct

SEQ ID NO: 3888973 - DNA, 14 bp, Homo sapiens
tcctctccttgggc

SEQ ID NO: 3888974 - DNA, 18 bp, Homo sapiens
tcctctcgagcccagatg

SEQ ID NO: 3888975 - DNA, 14 bp, Homo sapiens
tcctctgcagcact

SEQ ID NO: 3888976 - DNA, 15 bp, Homo sapiens
tcctctgcagcactt

SEQ ID NO: 3888977 - DNA, 23 bp, Homo sapiens
tcctctgccacctcccctatcca

SEQ ID NO: 3888978 - DNA, 13 bp, Homo sapiens
tcctctggcccag

SEQ ID NO: 3888979 - DNA, 22 bp, Homo sapiens
tcctctgtccaggcactgctgc

SEQ ID NO: 3888980 - DNA, 12 bp, Homo sapiens
tcctctgttcta

SEQ ID NO: 3888981 - DNA, 17 bp, Homo sapiens
tcctctgttctatccca

SEQ ID NO: 3888982 - DNA, 19 bp, Homo sapiens
tcctcttaccgtagcctcc

SEQ ID NO: 3888983 - DNA, 13 bp, Homo sapiens
tcctcttatttgc

SEQ ID NO: 3888984 - DNA, 19 bp, Homo sapiens
tcctcttctattttgtaaa

SEQ ID NO: 3888985 - DNA, 19 bp, Homo sapiens
tcctcttgccactgcctct

SEQ ID NO: 3888986 - DNA, 13 bp, Homo sapiens
tcctcttgctcaa

SEQ ID NO: 3888987 - DNA, 14 bp, Homo sapiens
tcctcttgctcaaa

SEQ ID NO: 3888988 - DNA, 20 bp, Homo sapiens
tcctgaagaaaccacaggtt

SEQ ID NO: 3888989 - DNA, 13 bp, Homo sapiens
tcctgaagccaga

SEQ ID NO: 3888990 - DNA, 19 bp, Homo sapiens
tcctgaagccagatccacc

SEQ ID NO: 3888991 - DNA, 14 bp, Homo sapiens
tcctgaagcctctg

SEQ ID NO: 3888992 - DNA, 17 bp, Homo sapiens
tcctgaagcctctgccc

SEQ ID NO: 3888993 - DNA, 22 bp, Homo sapiens
tcctgacattaagacacacctc

SEQ ID NO: 3888994 - DNA, 12 bp, Homo sapiens
tcctgaccctcc

SEQ ID NO: 3888995 - DNA, 14 bp, Homo sapiens
tcctgaccctccct

SEQ ID NO: 3888996 - DNA, 14 bp, Homo sapiens
tcctgacgccctgc

SEQ ID NO: 3888997 - DNA, 23 bp, Homo sapiens
tcctgacgccctgcgttggagcc

SEQ ID NO: 3888998 - DNA, 20 bp, Homo sapiens
tcctgagaaggcgaggagag

SEQ ID NO: 3888999 - DNA, 23 bp, Homo sapiens
tcctgagaataagaaagtttcac

SEQ ID NO: 3889000 - DNA, 13 bp, Homo sapiens
tcctgagcactgc

SEQ ID NO: 3889001 - DNA, 20 bp, Homo sapiens
tcctgagcactgccaggagg

SEQ ID NO: 3889002 - DNA, 18 bp, Homo sapiens
tcctgagtcttggcctgc

SEQ ID NO: 3889003 - DNA, 22 bp, Homo sapiens
tcaataccccaagtccacctgc

SEQ ID NO: 3889004 - DNA, 17 bp, Homo sapiens
tcaatagtcaagaaaaa

SEQ ID NO: 3889005 - DNA, 14 bp, Homo sapiens
tcaatattaaatac

SEQ ID NO: 3889006 - DNA, 15 bp, Homo sapiens
tcaatattaaataca

SEQ ID NO: 3889007 - DNA, 17 bp, Homo sapiens
tcaatattaaatacaga

SEQ ID NO: 3889008 - DNA, 12 bp, Homo sapiens
tcaatatttaag

SEQ ID NO: 3889009 - DNA, 17 bp, Homo sapiens
tcaatatttaagtttgt

SEQ ID NO: 3889010 - DNA, 15 bp, Homo sapiens
tcaatcagtgcagtg

SEQ ID NO: 3889011 - DNA, 16 bp, Homo sapiens
tcaatcagtgcagtga

SEQ ID NO: 3889012 - DNA, 15 bp, Homo sapiens
tcaatcatctgtgtg

SEQ ID NO: 3889013 - DNA, 20 bp, Homo sapiens
tcaatcatctgtgtgaaaat

SEQ ID NO: 3889014 - DNA, 16 bp, Homo sapiens
tcaatctgtttttcat

SEQ ID NO: 3889015 - DNA, 18 bp, Homo sapiens
tcaatggaaacagggcag

SEQ ID NO: 3889016 - DNA, 23 bp, Homo sapiens
tcaatggaaacagggcagtgaca

SEQ ID NO: 3889017 - DNA, 15 bp, Homo sapiens
tcaatgtcaagtacc

SEQ ID NO: 3889018 - DNA, 18 bp, Homo sapiens
tcaatgtggtgatgaaat

SEQ ID NO: 3889019 - DNA, 14 bp, Homo sapiens
tcaatgtttttaaa

SEQ ID NO: 3889020 - DNA, 11 bp, Homo sapiens
tcaattaataa

SEQ ID NO: 3889021 - DNA, 14 bp, Homo sapiens
tcaattagtacagt

SEQ ID NO: 3889022 - DNA, 16 bp, Homo sapiens
tcaattattacattta

SEQ ID NO: 3889023 - DNA, 16 bp, Homo sapiens
tcaattcaacacatta

SEQ ID NO: 3889024 - DNA, 16 bp, Homo sapiens
tcaattcccattgcat

SEQ ID NO: 3889025 - DNA, 14 bp, Homo sapiens
tcaattgtatttta

SEQ ID NO: 3889026 - DNA, 15 bp, Homo sapiens
tcaatttaaataacc

SEQ ID NO: 3889027 - DNA, 13 bp, Homo sapiens
tcaatttcccaga

SEQ ID NO: 3889028 - DNA, 14 bp, Homo sapiens
tcaatttcccagaa

SEQ ID NO: 3889029 - DNA, 21 bp, Homo sapiens
tcaatttccctgactcctcta

SEQ ID NO: 3889030 - DNA, 16 bp, Homo sapiens
tcaatttgtatatcat

SEQ ID NO: 3889031 - DNA, 23 bp, Homo sapiens
tcaatttttcttatttcatttct

SEQ ID NO: 3889032 - DNA, 13 bp, Homo sapiens
tcaattttttgct

SEQ ID NO: 3889033 - DNA, 13 bp, Homo sapiens
tcacaaaaatggt

SEQ ID NO: 3889034 - DNA, 12 bp, Homo sapiens
tcacaaaatgca

SEQ ID NO: 3889035 - DNA, 14 bp, Homo sapiens
tcacaaaattttat

SEQ ID NO: 3889036 - DNA, 22 bp, Homo sapiens
tcacaaaattttattcctatat

SEQ ID NO: 3889037 - DNA, 20 bp, Homo sapiens
tcacaacctccgtgctgggc

SEQ ID NO: 3889038 - DNA, 17 bp, Homo sapiens
tcacaagagcccagcag

SEQ ID NO: 3889039 - DNA, 14 bp, Homo sapiens
tcacaagcaataat

SEQ ID NO: 3889040 - DNA, 17 bp, Homo sapiens
tcacaagcaataattag

SEQ ID NO: 3889041 - DNA, 16 bp, Homo sapiens
tcacaagcccaggctg

SEQ ID NO: 3889042 - DNA, 12 bp, Homo sapiens
tcacaaggcagc

SEQ ID NO: 3889043 - DNA, 23 bp, Homo sapiens
tcacaatgaaatgctctcctttc

SEQ ID NO: 3889044 - DNA, 14 bp, Homo sapiens
tcacacacatagat

SEQ ID NO: 3889045 - DNA, 12 bp, Homo sapiens
tcacacaggcat

SEQ ID NO: 3889046 - DNA, 20 bp, Homo sapiens
tcacacaggcatttcctggg

SEQ ID NO: 3889047 - DNA, 15 bp, Homo sapiens
tcacacatgcatcat

SEQ ID NO: 3889048 - DNA, 19 bp, Homo sapiens
tcacacctcacgctctgga

SEQ ID NO: 3889049 - DNA, 20 bp, Homo sapiens
tcacacctgtaatcccagca

SEQ ID NO: 3889050 - DNA, 20 bp, Homo sapiens
tcacactgcaagagccttgg

SEQ ID NO: 3889051 - DNA, 23 bp, Homo sapiens
tcacacttggagctaattaaggt

SEQ ID NO: 3889052 - DNA, 12 bp, Homo sapiens
tcacagaagaat

SEQ ID NO: 3889053 - DNA, 22 bp, Homo sapiens
tcacagacgctcctgaagttag

SEQ ID NO: 3889054 - DNA, 15 bp, Homo sapiens
tcacagcctctccct

SEQ ID NO: 3889055 - DNA, 13 bp, Homo sapiens
tcacagctgcagc

SEQ ID NO: 3889056 - DNA, 15 bp, Homo sapiens
tcacagctgcagctg

SEQ ID NO: 3889057 - DNA, 17 bp, Homo sapiens
tcacagctgcagctggg

SEQ ID NO: 3889058 - DNA, 17 bp, Homo sapiens
tcacaggggcggggcag

SEQ ID NO: 3889059 - DNA, 17 bp, Homo sapiens
tcacagtacaatgtttc

SEQ ID NO: 3889060 - DNA, 20 bp, Homo sapiens
tcacagtggcgagaggagag

SEQ ID NO: 3889061 - DNA, 22 bp, Homo sapiens
tcacagtggcgagaggagagga

SEQ ID NO: 3889062 - DNA, 11 bp, Homo sapiens
tcacagtgttt

SEQ ID NO: 3889063 - DNA, 14 bp, Homo sapiens
tcacatacaatttg

SEQ ID NO: 3889064 - DNA, 17 bp, Homo sapiens
tcacatacaatttgcac

SEQ ID NO: 3889065 - DNA, 21 bp, Homo sapiens
tcacatacaatttgcactgtt

SEQ ID NO: 3889066 - DNA, 16 bp, Homo sapiens
tcacataccctccccc

SEQ ID NO: 3889067 - DNA, 18 bp, Homo sapiens
tcacatatacaaaagcaa

SEQ ID NO: 3889068 - DNA, 18 bp, Homo sapiens
tcacatcaagcatgcaat

SEQ ID NO: 3889069 - DNA, 17 bp, Homo sapiens
tcacatccaatgcatag

SEQ ID NO: 3889070 - DNA, 19 bp, Homo sapiens
tcacattaatatttgctga

SEQ ID NO: 3889071 - DNA, 22 bp, Homo sapiens
tcacattaatggtctaaaaata

SEQ ID NO: 3889072 - DNA, 13 bp, Homo sapiens
tcacattcaggaa

SEQ ID NO: 3889073 - DNA, 16 bp, Homo sapiens
tcacatttgatgtaca

SEQ ID NO: 3889074 - DNA, 22 bp, Homo sapiens
tcacatttgatgtacatgtgta

SEQ ID NO: 3889075 - DNA, 19 bp, Homo sapiens
tcaccaaatgatgccactt

SEQ ID NO: 3889076 - DNA, 21 bp, Homo sapiens
tcaccaagctcacagttcctc

SEQ ID NO: 3889077 - DNA, 23 bp, Homo sapiens
tcaccaatgtacccaccgggcca

SEQ ID NO: 3889078 - DNA, 13 bp, Homo sapiens
tcaccacctctcc

SEQ ID NO: 3889079 - DNA, 18 bp, Homo sapiens
tcaccaccttcccagctc

SEQ ID NO: 3889080 - DNA, 18 bp, Homo sapiens
tcaccagaattgtgcaaa

SEQ ID NO: 3889081 - DNA, 21 bp, Homo sapiens
tcaccagatttgctaatttat

SEQ ID NO: 3889082 - DNA, 20 bp, Homo sapiens
tcaccagctgccaaaatcgt

SEQ ID NO: 3889083 - DNA, 18 bp, Homo sapiens
tcaccagctgctgctctg

SEQ ID NO: 3889084 - DNA, 22 bp, Homo sapiens
tcaccaggaatgttaaagtcag

SEQ ID NO: 3889085 - DNA, 23 bp, Homo sapiens
tcaccagggtccgcaccagctgc

SEQ ID NO: 3889086 - DNA, 18 bp, Homo sapiens
tcaccatacttcattcag

SEQ ID NO: 3889087 - DNA, 15 bp, Homo sapiens
tcaccatcttggcca

SEQ ID NO: 3889088 - DNA, 13 bp, Homo sapiens
tcaccatgtaaca

SEQ ID NO: 3889089 - DNA, 17 bp, Homo sapiens
tccccattcttcctagt

SEQ ID NO: 3889090 - DNA, 22 bp, Homo sapiens
tccccattcttcctagttttct

SEQ ID NO: 3889091 - DNA, 19 bp, Homo sapiens
tcccccaccccctccccag

SEQ ID NO: 3889092 - DNA, 15 bp, Homo sapiens
tcccccacctgacaa

SEQ ID NO: 3889093 - DNA, 22 bp, Homo sapiens
tcccccacctgacaatggcagc

SEQ ID NO: 3889094 - DNA, 14 bp, Homo sapiens
tcccccagacagag

SEQ ID NO: 3889095 - DNA, 15 bp, Homo sapiens
tcccccagagccact

SEQ ID NO: 3889096 - DNA, 23 bp, Homo sapiens
tcccccagtcattctgggaacat

SEQ ID NO: 3889097 - DNA, 17 bp, Homo sapiens
tcccccatgtggctgaa

SEQ ID NO: 3889098 - DNA, 19 bp, Homo sapiens
tccccccactgcaggcccc

SEQ ID NO: 3889099 - DNA, 16 bp, Homo sapiens
tcccccccctgtatag

SEQ ID NO: 3889100 - DNA, 17 bp, Homo sapiens
tcccccgacactgctgc

SEQ ID NO: 3889101 - DNA, 21 bp, Homo sapiens
tcccccgacactgctgcacca

SEQ ID NO: 3889102 - DNA, 22 bp, Homo sapiens
tcccccgcagtccccagccctt

SEQ ID NO: 3889103 - DNA, 16 bp, Homo sapiens
tccccctgccagtgcc

SEQ ID NO: 3889104 - DNA, 18 bp, Homo sapiens
tccccctgccagtgcctt

SEQ ID NO: 3889105 - DNA, 14 bp, Homo sapiens
tcccccttcccagt

SEQ ID NO: 3889106 - DNA, 21 bp, Homo sapiens
tccccgcaccccccaagctgt

SEQ ID NO: 3889107 - DNA, 13 bp, Homo sapiens
tccccgcctgtcc

SEQ ID NO: 3889108 - DNA, 16 bp, Homo sapiens
tccccgcctgtcctgc

SEQ ID NO: 3889109 - DNA, 16 bp, Homo sapiens
tccccgctgcccaatc

SEQ ID NO: 3889110 - DNA, 14 bp, Homo sapiens
tccccggctgcttc

SEQ ID NO: 3889111 - DNA, 16 bp, Homo sapiens
tcccctatccacccag

SEQ ID NO: 3889112 - DNA, 21 bp, Homo sapiens
tcccctatccacccagcccat

SEQ ID NO: 3889113 - DNA, 17 bp, Homo sapiens
tcccctcactctgtcag

SEQ ID NO: 3889114 - DNA, 22 bp, Homo sapiens
tcccctcactctgtcagccagc

SEQ ID NO: 3889115 - DNA, 13 bp, Homo sapiens
tcccctcattcag

SEQ ID NO: 3889116 - DNA, 15 bp, Homo sapiens
tcccctccactgtca

SEQ ID NO: 3889117 - DNA, 15 bp, Homo sapiens
tcccctccctcttcc

SEQ ID NO: 3889118 - DNA, 16 bp, Homo sapiens
tcccctccctcttcct

SEQ ID NO: 3889119 - DNA, 12 bp, Homo sapiens
tcccctgaagac

SEQ ID NO: 3889120 - DNA, 18 bp, Homo sapiens
tcccctgcccccatccca

SEQ ID NO: 3889121 - DNA, 15 bp, Homo sapiens
tcccctgccctgctg

SEQ ID NO: 3889122 - DNA, 12 bp, Homo sapiens
tcccctgcctgg

SEQ ID NO: 3889123 - DNA, 19 bp, Homo sapiens
tcccctgctactcctgtgc

SEQ ID NO: 3889124 - DNA, 23 bp, Homo sapiens
tcccctgctactcctgtgctctg

SEQ ID NO: 3889125 - DNA, 15 bp, Homo sapiens
tcccctggactggga

SEQ ID NO: 3889126 - DNA, 17 bp, Homo sapiens
tcccctggactgggagg

SEQ ID NO: 3889127 - DNA, 12 bp, Homo sapiens
tcccctgtccca

SEQ ID NO: 3889128 - DNA, 14 bp, Homo sapiens
tcccctgtcccacc

SEQ ID NO: 3889129 - DNA, 15 bp, Homo sapiens
tcccctgttcactct

SEQ ID NO: 3889130 - DNA, 14 bp, Homo sapiens
tccccttgcccttg

SEQ ID NO: 3889131 - DNA, 20 bp, Homo sapiens
tccccttgcccttgccctga

SEQ ID NO: 3889132 - DNA, 21 bp, Homo sapiens
tccccttgcccttgccctgac

SEQ ID NO: 3889133 - DNA, 23 bp, Homo sapiens
tccccttgcccttgccctgacct

SEQ ID NO: 3889134 - DNA, 16 bp, Homo sapiens
tccccttggcttcctc

SEQ ID NO: 3889135 - DNA, 14 bp, Homo sapiens
tcccctttattaat

SEQ ID NO: 3889136 - DNA, 12 bp, Homo sapiens
tcccctttcctc

SEQ ID NO: 3889137 - DNA, 13 bp, Homo sapiens
tcccctttcctcc

SEQ ID NO: 3889138 - DNA, 20 bp, Homo sapiens
tccccttttgcctggctgtg

SEQ ID NO: 3889139 - DNA, 21 bp, Homo sapiens
tccccttttgcctggctgtgg

SEQ ID NO: 3889140 - DNA, 24 bp, Homo sapiens
tccccttttgcctggctgtggagg

SEQ ID NO: 3889141 - DNA, 20 bp, Homo sapiens
tcccgagcaaagtctaaagt

SEQ ID NO: 3889142 - DNA, 22 bp, Homo sapiens
tcccgccaggaggtcctcctct

SEQ ID NO: 3889143 - DNA, 18 bp, Homo sapiens
tcccgccttcctcctcca

SEQ ID NO: 3889144 - DNA, 13 bp, Homo sapiens
tcccgctcagccc

SEQ ID NO: 3889145 - DNA, 13 bp, Homo sapiens
tcccggctgcctg

SEQ ID NO: 3889146 - DNA, 14 bp, Homo sapiens
tcccggctgcctgc

SEQ ID NO: 3889147 - DNA, 17 bp, Homo sapiens
tccctaaccaaatgctg

SEQ ID NO: 3889148 - DNA, 14 bp, Homo sapiens
tccctaactctcgg

SEQ ID NO: 3889149 - DNA, 18 bp, Homo sapiens
tccctaaggaatctgaaa

SEQ ID NO: 3889150 - DNA, 23 bp, Homo sapiens
tccctaccgagtctcttctccac

SEQ ID NO: 3889151 - DNA, 17 bp, Homo sapiens
tccctactagagacctc

SEQ ID NO: 3889152 - DNA, 15 bp, Homo sapiens
tccctacttttcaag

SEQ ID NO: 3889153 - DNA, 15 bp, Homo sapiens
tccctagcagtgaac

SEQ ID NO: 3889154 - DNA, 17 bp, Homo sapiens
tccctatcaaaacatat

SEQ ID NO: 3889155 - DNA, 19 bp, Homo sapiens
tccctcaaatgacccaaag

SEQ ID NO: 3889156 - DNA, 16 bp, Homo sapiens
tccctcaaccccacca

SEQ ID NO: 3889157 - DNA, 18 bp, Homo sapiens
tccctcacccccaggtgt

SEQ ID NO: 3889158 - DNA, 22 bp, Homo sapiens
tccctccagggaatccgcctgc

SEQ ID NO: 3889159 - DNA, 23 bp, Homo sapiens
tccctccccaaacccatcagaca

SEQ ID NO: 3889160 - DNA, 22 bp, Homo sapiens
tccctccccacagtcctcacag

SEQ ID NO: 3889161 - DNA, 15 bp, Homo sapiens
tccctccccagctcc

SEQ ID NO: 3889162 - DNA, 14 bp, Homo sapiens
tccctcggaagccg

SEQ ID NO: 3889163 - DNA, 16 bp, Homo sapiens
tccctcggacccacca

SEQ ID NO: 3889164 - DNA, 19 bp, Homo sapiens
tccctcgtccacaggggca

SEQ ID NO: 3889165 - DNA, 15 bp, Homo sapiens
tccctctcccaggcc

SEQ ID NO: 3889166 - DNA, 16 bp, Homo sapiens
tccctctcccaggccc

SEQ ID NO: 3889167 - DNA, 15 bp, Homo sapiens
tccctctcctgccta

SEQ ID NO: 3889168 - DNA, 13 bp, Homo sapiens
tccctctgcccca

SEQ ID NO: 3889169 - DNA, 23 bp, Homo sapiens
tccctctgccccaagcagccagc

SEQ ID NO: 3889170 - DNA, 19 bp, Homo sapiens
tccctctggccctgccttc

SEQ ID NO: 3889171 - DNA, 15 bp, Homo sapiens
tccctcttccttccc

SEQ ID NO: 3889172 - DNA, 18 bp, Homo sapiens
tccctctttccccacctc

SEQ ID NO: 3889173 - DNA, 17 bp, Homo sapiens
tccctgaaaacccagag

SEQ ID NO: 3889174 - DNA, 18 bp, Homo sapiens
tccctgaaaacccagaga

SEQ ID NO: 3889175 - DNA, 13 bp, Homo sapiens
tcccaattcattt

SEQ ID NO: 3889176 - DNA, 15 bp, Homo sapiens
tcccaattcatttca

SEQ ID NO: 3889177 - DNA, 17 bp, Homo sapiens
tcccacaccccagcgcc

SEQ ID NO: 3889178 - DNA, 19 bp, Homo sapiens
tcccaccaaccctcagagc

SEQ ID NO: 3889179 - DNA, 14 bp, Homo sapiens
tcccaccaactctg

SEQ ID NO: 3889180 - DNA, 19 bp, Homo sapiens
tcccaccaactctgcactc

SEQ ID NO: 3889181 - DNA, 20 bp, Homo sapiens
tcccaccaactctgcactcc

SEQ ID NO: 3889182 - DNA, 21 bp, Homo sapiens
tcccaccaactctgcactcca

SEQ ID NO: 3889183 - DNA, 23 bp, Homo sapiens
tcccacccaacagctcagagatg

SEQ ID NO: 3889184 - DNA, 13 bp, Homo sapiens
tcccaccccaccc

SEQ ID NO: 3889185 - DNA, 18 bp, Homo sapiens
tcccaccccacccccttc

SEQ ID NO: 3889186 - DNA, 13 bp, Homo sapiens
tcccaccccactc

SEQ ID NO: 3889187 - DNA, 17 bp, Homo sapiens
tcccaccccactccagc

SEQ ID NO: 3889188 - DNA, 18 bp, Homo sapiens
tcccaccccactccagcc

SEQ ID NO: 3889189 - DNA, 12 bp, Homo sapiens
tcccaccgggag

SEQ ID NO: 3889190 - DNA, 15 bp, Homo sapiens
tcccacgaatttgct

SEQ ID NO: 3889191 - DNA, 21 bp, Homo sapiens
tcccacgaatttgctggggaa

SEQ ID NO: 3889192 - DNA, 14 bp, Homo sapiens
tcccacgtgggaga

SEQ ID NO: 3889193 - DNA, 14 bp, Homo sapiens
tcccacttcactgt

SEQ ID NO: 3889194 - DNA, 18 bp, Homo sapiens
tcccacttcactgtgagg

SEQ ID NO: 3889195 - DNA, 14 bp, Homo sapiens
tcccagaagggagt

SEQ ID NO: 3889196 - DNA, 17 bp, Homo sapiens
tcccagactttctacac

SEQ ID NO: 3889197 - DNA, 16 bp, Homo sapiens
tcccagagacaggaaa

SEQ ID NO: 3889198 - DNA, 12 bp, Homo sapiens
tcccagagcagg

SEQ ID NO: 3889199 - DNA, 22 bp, Homo sapiens
tcccagagcttattggccactg

SEQ ID NO: 3889200 - DNA, 13 bp, Homo sapiens
tcccagaggcaga

SEQ ID NO: 3889201 - DNA, 15 bp, Homo sapiens
tcccagaggccagga

SEQ ID NO: 3889202 - DNA, 20 bp, Homo sapiens
tcccagagtcagaggagaag

SEQ ID NO: 3889203 - DNA, 15 bp, Homo sapiens
tcccagatgctgggg

SEQ ID NO: 3889204 - DNA, 24 bp, Homo sapiens
tcccagcactttgggaggccgagg

SEQ ID NO: 3889205 - DNA, 16 bp, Homo sapiens
tcccagccactcggga

SEQ ID NO: 3889206 - DNA, 16 bp, Homo sapiens
tcccagccctgccagg

SEQ ID NO: 3889207 - DNA, 14 bp, Homo sapiens
tcccagctctccct

SEQ ID NO: 3889208 - DNA, 14 bp, Homo sapiens
tcccagctgtctgt

SEQ ID NO: 3889209 - DNA, 16 bp, Homo sapiens
tcccaggagacagttc

SEQ ID NO: 3889210 - DNA, 12 bp, Homo sapiens
tcccaggccagg

SEQ ID NO: 3889211 - DNA, 20 bp, Homo sapiens
tcccaggcgccccttccccc

SEQ ID NO: 3889212 - DNA, 15 bp, Homo sapiens
tcccaggcttcaccc

SEQ ID NO: 3889213 - DNA, 14 bp, Homo sapiens
tcccagtcatttaa

SEQ ID NO: 3889214 - DNA, 22 bp, Homo sapiens
tcccagtcatttaataaatgtg

SEQ ID NO: 3889215 - DNA, 18 bp, Homo sapiens
tcccagttctacaagcat

SEQ ID NO: 3889216 - DNA, 21 bp, Homo sapiens
tcccagttctacaagcatatt

SEQ ID NO: 3889217 - DNA, 14 bp, Homo sapiens
tcccataccatcac

SEQ ID NO: 3889218 - DNA, 16 bp, Homo sapiens
tcccataccatcactg

SEQ ID NO: 3889219 - DNA, 19 bp, Homo sapiens
tcccatagcgctggctcag

SEQ ID NO: 3889220 - DNA, 14 bp, Homo sapiens
tcccatccccagcg

SEQ ID NO: 3889221 - DNA, 17 bp, Homo sapiens
tcccatctaagctgcag

SEQ ID NO: 3889222 - DNA, 19 bp, Homo sapiens
tcccatctaagctgcagct

SEQ ID NO: 3889223 - DNA, 23 bp, Homo sapiens
tcccatctaagctgcagcttcct

SEQ ID NO: 3889224 - DNA, 14 bp, Homo sapiens
tcccatctcttcct

SEQ ID NO: 3889225 - DNA, 16 bp, Homo sapiens
tcccatggccttccct

SEQ ID NO: 3889226 - DNA, 16 bp, Homo sapiens
tcccatgtcacctcag

SEQ ID NO: 3889227 - DNA, 13 bp, Homo sapiens
tcccatgtgcatg

SEQ ID NO: 3889228 - DNA, 16 bp, Homo sapiens
tcccatgttgcatgcc

SEQ ID NO: 3889229 - DNA, 22 bp, Homo sapiens
tcccattgcatcacctctgtaa

SEQ ID NO: 3889230 - DNA, 14 bp, Homo sapiens
tcccattgccctgg

SEQ ID NO: 3889231 - DNA, 18 bp, Homo sapiens
tcccattttggaagtttt

SEQ ID NO: 3889232 - DNA, 18 bp, Homo sapiens
tccccaaactgtgccctg

SEQ ID NO: 3889233 - DNA, 23 bp, Homo sapiens
tccccaaactgtgccctgccttc

SEQ ID NO: 3889234 - DNA, 15 bp, Homo sapiens
tccccaaaggcatcc

SEQ ID NO: 3889235 - DNA, 18 bp, Homo sapiens
tccccaaagtcttaaaat

SEQ ID NO: 3889236 - DNA, 23 bp, Homo sapiens
tccccacacgtgctcgcagcctg

SEQ ID NO: 3889237 - DNA, 20 bp, Homo sapiens
tccccacagtcctcacagcc

SEQ ID NO: 3889238 - DNA, 23 bp, Homo sapiens
tccccacagtcctcacagcctct

SEQ ID NO: 3889239 - DNA, 19 bp, Homo sapiens
tccccacccccgctggggg

SEQ ID NO: 3889240 - DNA, 17 bp, Homo sapiens
tccccacctcttccttc

SEQ ID NO: 3889241 - DNA, 20 bp, Homo sapiens
tccccaccttccccagactc

SEQ ID NO: 3889242 - DNA, 20 bp, Homo sapiens
tccccaccttcttcagccac

SEQ ID NO: 3889243 - DNA, 20 bp, Homo sapiens
tccccacgagtcacctgcaa

SEQ ID NO: 3889244 - DNA, 11 bp, Homo sapiens
tccccagacac

SEQ ID NO: 3889245 - DNA, 13 bp, Homo sapiens
tccccagacacat

SEQ ID NO: 3889246 - DNA, 14 bp, Homo sapiens
tccccagacacatt

SEQ ID NO: 3889247 - DNA, 15 bp, Homo sapiens
tccccagccctggct

SEQ ID NO: 3889248 - DNA, 18 bp, Homo sapiens
tccccagccctggctctg

SEQ ID NO: 3889249 - DNA, 14 bp, Homo sapiens
tccccagcccttct

SEQ ID NO: 3889250 - DNA, 19 bp, Homo sapiens
tccccagcccttctgcctt

SEQ ID NO: 3889251 - DNA, 22 bp, Homo sapiens
tccccaggccaggccaccagga

SEQ ID NO: 3889252 - DNA, 12 bp, Homo sapiens
tccccaggcctc

SEQ ID NO: 3889253 - DNA, 17 bp, Homo sapiens
tccccaggcctccagcc

SEQ ID NO: 3889254 - DNA, 18 bp, Homo sapiens
tccccaggcctccagcct

SEQ ID NO: 3889255 - DNA, 10 bp, Homo sapiens
tccccagggg

SEQ ID NO: 3889256 - DNA, 19 bp, Homo sapiens
tccccaggggaaaatgaag

SEQ ID NO: 3889257 - DNA, 23 bp, Homo sapiens
tccccaggggagagggtctggag

SEQ ID NO: 3889258 - DNA, 14 bp, Homo sapiens
tccccatcatccca

SEQ ID NO: 3889259 - DNA, 16 bp, Homo sapiens
tccccatcatcccagc

SEQ ID NO: 3889260 - DNA, 19 bp, Homo sapiens
tccccatctccatttcaca

SEQ ID NO: 3889261 - DNA, 12 bp, Homo sapiens
tccaggaaggca

SEQ ID NO: 3889262 - DNA, 15 bp, Homo sapiens
tccaggaaggcagct

SEQ ID NO: 3889263 - DNA, 16 bp, Homo sapiens
tccaggaaggcagctg

SEQ ID NO: 3889264 - DNA, 18 bp, Homo sapiens
tccaggaaggcagctgct

SEQ ID NO: 3889265 - DNA, 20 bp, Homo sapiens
tccaggaaggcagctgctct

SEQ ID NO: 3889266 - DNA, 16 bp, Homo sapiens
tccaggaataggcatt

SEQ ID NO: 3889267 - DNA, 23 bp, Homo sapiens
tccaggagcctggctccgtccag

SEQ ID NO: 3889268 - DNA, 18 bp, Homo sapiens
tccaggagcctgtgcctc

SEQ ID NO: 3889269 - DNA, 16 bp, Homo sapiens
tccaggatcctgcagg

SEQ ID NO: 3889270 - DNA, 17 bp, Homo sapiens
tccaggatcctgcagga

SEQ ID NO: 3889271 - DNA, 19 bp, Homo sapiens
tccaggcacccttctttcc

SEQ ID NO: 3889272 - DNA, 16 bp, Homo sapiens
tccaggcatgctggcc

SEQ ID NO: 3889273 - DNA, 14 bp, Homo sapiens
tccaggccactgtg

SEQ ID NO: 3889274 - DNA, 18 bp, Homo sapiens
tccaggccactgtggcca

SEQ ID NO: 3889275 - DNA, 20 bp, Homo sapiens
tccaggccactgtggccaga

SEQ ID NO: 3889276 - DNA, 22 bp, Homo sapiens
tccaggctctttggggtcagcc

SEQ ID NO: 3889277 - DNA, 13 bp, Homo sapiens
tccagggcagcct

SEQ ID NO: 3889278 - DNA, 14 bp, Homo sapiens
tccagggcagcctc

SEQ ID NO: 3889279 - DNA, 23 bp, Homo sapiens
tccagggccacgtgccaggcccg

SEQ ID NO: 3889280 - DNA, 14 bp, Homo sapiens
tccagggctgcccc

SEQ ID NO: 3889281 - DNA, 16 bp, Homo sapiens
tccagggtcttgggct

SEQ ID NO: 3889282 - DNA, 18 bp, Homo sapiens
tccagggttgatcacact

SEQ ID NO: 3889283 - DNA, 15 bp, Homo sapiens
tccaggtcctggtgg

SEQ ID NO: 3889284 - DNA, 17 bp, Homo sapiens
tccaggtgggagagaca

SEQ ID NO: 3889285 - DNA, 22 bp, Homo sapiens
tccagtaggtaatgattatgtg

SEQ ID NO: 3889286 - DNA, 19 bp, Homo sapiens
tccagtattcttgtcaaaa

SEQ ID NO: 3889287 - DNA, 17 bp, Homo sapiens
tccagtctcctgacatt

SEQ ID NO: 3889288 - DNA, 19 bp, Homo sapiens
tccagtgatgtgctggagc

SEQ ID NO: 3889289 - DNA, 18 bp, Homo sapiens
tccagtgttggctgtgtg

SEQ ID NO: 3889290 - DNA, 23 bp, Homo sapiens
tccagtgttggctgtgtgacaga

SEQ ID NO: 3889291 - DNA, 14 bp, Homo sapiens
tccagttagttctc

SEQ ID NO: 3889292 - DNA, 19 bp, Homo sapiens
tccagttcatgagaatcta

SEQ ID NO: 3889293 - DNA, 15 bp, Homo sapiens
tccagttgcaataaa

SEQ ID NO: 3889294 - DNA, 21 bp, Homo sapiens
tccagttgcaataaaatagta

SEQ ID NO: 3889295 - DNA, 13 bp, Homo sapiens
tccagtttcccac

SEQ ID NO: 3889296 - DNA, 17 bp, Homo sapiens
tccagtttgttctccgg

SEQ ID NO: 3889297 - DNA, 19 bp, Homo sapiens
tccagtttgttctccgggt

SEQ ID NO: 3889298 - DNA, 15 bp, Homo sapiens
tccataaagcaagct

SEQ ID NO: 3889299 - DNA, 21 bp, Homo sapiens
tccataaccccaggcatccca

SEQ ID NO: 3889300 - DNA, 16 bp, Homo sapiens
tccataatcaatctat

SEQ ID NO: 3889301 - DNA, 21 bp, Homo sapiens
tccataatctggactcctctg

SEQ ID NO: 3889302 - DNA, 13 bp, Homo sapiens
tccataatgccac

SEQ ID NO: 3889303 - DNA, 24 bp, Homo sapiens
tccatatctccttcccctacacct

SEQ ID NO: 3889304 - DNA, 13 bp, Homo sapiens
tccatattttcac

SEQ ID NO: 3889305 - DNA, 23 bp, Homo sapiens
tccatccccaaactgtgccctgc

SEQ ID NO: 3889306 - DNA, 20 bp, Homo sapiens
tccatgattttacagagaat

SEQ ID NO: 3889307 - DNA, 19 bp, Homo sapiens
tccatgcagactcctcaga

SEQ ID NO: 3889308 - DNA, 15 bp, Homo sapiens
tccatgcctgagggt

SEQ ID NO: 3889309 - DNA, 16 bp, Homo sapiens
tccatgcctgagggtg

SEQ ID NO: 3889310 - DNA, 14 bp, Homo sapiens
tccatggaggaggt

SEQ ID NO: 3889311 - DNA, 15 bp, Homo sapiens
tccatggaggaggtg

SEQ ID NO: 3889312 - DNA, 14 bp, Homo sapiens
tccatggccacccc

SEQ ID NO: 3889313 - DNA, 21 bp, Homo sapiens
tccatggccaccccgtgccac

SEQ ID NO: 3889314 - DNA, 15 bp, Homo sapiens
tccatgtagcaggac

SEQ ID NO: 3889315 - DNA, 14 bp, Homo sapiens
tccatgtccctgta

SEQ ID NO: 3889316 - DNA, 17 bp, Homo sapiens
tccatgtcctatgtgtg

SEQ ID NO: 3889317 - DNA, 18 bp, Homo sapiens
tccatgtcctatgtgtga

SEQ ID NO: 3889318 - DNA, 18 bp, Homo sapiens
tccatgtcgcctctgcat

SEQ ID NO: 3889319 - DNA, 19 bp, Homo sapiens
tccatgtcgcctctgcatt

SEQ ID NO: 3889320 - DNA, 22 bp, Homo sapiens
tccatgtggccccaggtgccac

SEQ ID NO: 3889321 - DNA, 10 bp, Homo sapiens
tccattccca

SEQ ID NO: 3889322 - DNA, 14 bp, Homo sapiens
tccattgctgttgt

SEQ ID NO: 3889323 - DNA, 15 bp, Homo sapiens
tccattgctgttgtt

SEQ ID NO: 3889324 - DNA, 17 bp, Homo sapiens
tccatttcaactccaga

SEQ ID NO: 3889325 - DNA, 20 bp, Homo sapiens
tccatttcaactccagaagt

SEQ ID NO: 3889326 - DNA, 23 bp, Homo sapiens
tccatttcacacaggtcctgaaa

SEQ ID NO: 3889327 - DNA, 19 bp, Homo sapiens
tccatttctcaatcagtgc

SEQ ID NO: 3889328 - DNA, 24 bp, Homo sapiens
tccatttctcaatcagtgcagtga

SEQ ID NO: 3889329 - DNA, 18 bp, Homo sapiens
tcccaaattccctggacc

SEQ ID NO: 3889330 - DNA, 16 bp, Homo sapiens
tcccaaatttcatacc

SEQ ID NO: 3889331 - DNA, 19 bp, Homo sapiens
tcccaacaacatccatgtc

SEQ ID NO: 3889332 - DNA, 22 bp, Homo sapiens
tcccaacccaattcaggactgg

SEQ ID NO: 3889333 - DNA, 16 bp, Homo sapiens
tcccaacctcaatgcc

SEQ ID NO: 3889334 - DNA, 21 bp, Homo sapiens
tcccaacctcaatgccctgcc

SEQ ID NO: 3889335 - DNA, 14 bp, Homo sapiens
tcccaactgctctg

SEQ ID NO: 3889336 - DNA, 16 bp, Homo sapiens
tcccaactgctctgcc

SEQ ID NO: 3889337 - DNA, 17 bp, Homo sapiens
tcccaactgctctgccc

SEQ ID NO: 3889338 - DNA, 14 bp, Homo sapiens
tcccaacttgtaaa

SEQ ID NO: 3889339 - DNA, 22 bp, Homo sapiens
tcccaagagcatcatgcctctg

SEQ ID NO: 3889340 - DNA, 23 bp, Homo sapiens
tcccaagctttgaatacccccag

SEQ ID NO: 3889341 - DNA, 15 bp, Homo sapiens
tcccaaggagctgat

SEQ ID NO: 3889342 - DNA, 18 bp, Homo sapiens
tcccaaggctctgagcaa

SEQ ID NO: 3889343 - DNA, 14 bp, Homo sapiens
tcccaataaaagtg

SEQ ID NO: 3889344 - DNA, 16 bp, Homo sapiens
tcccaataaaagtgac

SEQ ID NO: 3889345 - DNA, 12 bp, Homo sapiens
tcccaataaagc

SEQ ID NO: 3889346 - DNA, 16 bp, Homo sapiens
tcccaatcagcactga

SEQ ID NO: 3889347 - DNA, 20 bp, Homo sapiens
tcatgttgttcccacacaca

SEQ ID NO: 3889348 - DNA, 23 bp, Homo sapiens
tcattaaggtattattttttcca

SEQ ID NO: 3889349 - DNA, 15 bp, Homo sapiens
tcattactgcctttg

SEQ ID NO: 3889350 - DNA, 20 bp, Homo sapiens
tcattaggtttccttttatt

SEQ ID NO: 3889351 - DNA, 19 bp, Homo sapiens
tcattatctcaaaactgca

SEQ ID NO: 3889352 - DNA, 20 bp, Homo sapiens
tcattatctcaaaactgcac

SEQ ID NO: 3889353 - DNA, 13 bp, Homo sapiens
tcattatgtagaa

SEQ ID NO: 3889354 - DNA, 16 bp, Homo sapiens
tcattatgtagaaata

SEQ ID NO: 3889355 - DNA, 13 bp, Homo sapiens
tcattcaaaacaa

SEQ ID NO: 3889356 - DNA, 12 bp, Homo sapiens
tcattcaggaaa

SEQ ID NO: 3889357 - DNA, 13 bp, Homo sapiens
tcattcaggaaaa

SEQ ID NO: 3889358 - DNA, 19 bp, Homo sapiens
tcattcaggtgttctcttc

SEQ ID NO: 3889359 - DNA, 20 bp, Homo sapiens
tcattcagtgagacacagag

SEQ ID NO: 3889360 - DNA, 13 bp, Homo sapiens
tcattcccagagt

SEQ ID NO: 3889361 - DNA, 14 bp, Homo sapiens
tcattccccaggtg

SEQ ID NO: 3889362 - DNA, 14 bp, Homo sapiens
tcattctcctgcct

SEQ ID NO: 3889363 - DNA, 23 bp, Homo sapiens
tcattcttaccgagaaaaggaga

SEQ ID NO: 3889364 - DNA, 21 bp, Homo sapiens
tcattctttcccctcagagct

SEQ ID NO: 3889365 - DNA, 18 bp, Homo sapiens
tcattgggttttatcagt

SEQ ID NO: 3889366 - DNA, 23 bp, Homo sapiens
tcattgtagagcttggtggctga

SEQ ID NO: 3889367 - DNA, 15 bp, Homo sapiens
tcattgtcgctcagc

SEQ ID NO: 3889368 - DNA, 11 bp, Homo sapiens
tcattgtctca

SEQ ID NO: 3889369 - DNA, 13 bp, Homo sapiens
tcattgtggctat

SEQ ID NO: 3889370 - DNA, 18 bp, Homo sapiens
tcattgtggctatctgca

SEQ ID NO: 3889371 - DNA, 24 bp, Homo sapiens
tcattgttttacttttgtcttcct

SEQ ID NO: 3889372 - DNA, 13 bp, Homo sapiens
tcatttaaaatga

SEQ ID NO: 3889373 - DNA, 13 bp, Homo sapiens
tcatttattttgt

SEQ ID NO: 3889374 - DNA, 14 bp, Homo sapiens
tcatttcacattaa

SEQ ID NO: 3889375 - DNA, 17 bp, Homo sapiens
tcatttctaaaagaata

SEQ ID NO: 3889376 - DNA, 18 bp, Homo sapiens
tcatttctactgtgactg

SEQ ID NO: 3889377 - DNA, 16 bp, Homo sapiens
tcatttctgcatcagc

SEQ ID NO: 3889378 - DNA, 13 bp, Homo sapiens
tcatttggtgctg

SEQ ID NO: 3889379 - DNA, 19 bp, Homo sapiens
tcattttaagaagacatga

SEQ ID NO: 3889380 - DNA, 21 bp, Homo sapiens
tcattttcttatcttctgcaa

SEQ ID NO: 3889381 - DNA, 22 bp, Homo sapiens
tcattttgagtctcaggccctg

SEQ ID NO: 3889382 - DNA, 17 bp, Homo sapiens
tcattttgtaacaaatg

SEQ ID NO: 3889383 - DNA, 19 bp, Homo sapiens
tcattttttttttttgagg

SEQ ID NO: 3889384 - DNA, 23 bp, Homo sapiens
tccaaaatttgaaatattaaaat

SEQ ID NO: 3889385 - DNA, 12 bp, Homo sapiens
tccaaacaccgg

SEQ ID NO: 3889386 - DNA, 17 bp, Homo sapiens
tccaaagaaatgtaagg

SEQ ID NO: 3889387 - DNA, 17 bp, Homo sapiens
tccaaaggggctgctgg

SEQ ID NO: 3889388 - DNA, 21 bp, Homo sapiens
tccaaatgattttcatcaatt

SEQ ID NO: 3889389 - DNA, 22 bp, Homo sapiens
tccaaatgattttcatcaattt

SEQ ID NO: 3889390 - DNA, 18 bp, Homo sapiens
tccaacagcttgaccaga

SEQ ID NO: 3889391 - DNA, 21 bp, Homo sapiens
tccaacagcttgaccagacct

SEQ ID NO: 3889392 - DNA, 22 bp, Homo sapiens
tccaacccatgatgagctcctc

SEQ ID NO: 3889393 - DNA, 13 bp, Homo sapiens
tccaaccccagct

SEQ ID NO: 3889394 - DNA, 15 bp, Homo sapiens
tccaaccccagctgg

SEQ ID NO: 3889395 - DNA, 19 bp, Homo sapiens
tccaaccccagctggcctc

SEQ ID NO: 3889396 - DNA, 18 bp, Homo sapiens
tccaacctaacccctttc

SEQ ID NO: 3889397 - DNA, 21 bp, Homo sapiens
tccaacctaacccctttcctg

SEQ ID NO: 3889398 - DNA, 16 bp, Homo sapiens
tccaacgttaaaagac

SEQ ID NO: 3889399 - DNA, 19 bp, Homo sapiens
tccaacgttaaaagacagt

SEQ ID NO: 3889400 - DNA, 21 bp, Homo sapiens
tccaactggattataaataaa

SEQ ID NO: 3889401 - DNA, 17 bp, Homo sapiens
tccaagaaagatccacc

SEQ ID NO: 3889402 - DNA, 19 bp, Homo sapiens
tccaagaatacagaaaatg

SEQ ID NO: 3889403 - DNA, 11 bp, Homo sapiens
tccaagcaaag

SEQ ID NO: 3889404 - DNA, 16 bp, Homo sapiens
tccaagcttcaagtga

SEQ ID NO: 3889405 - DNA, 17 bp, Homo sapiens
tccaagcttcaagtgat

SEQ ID NO: 3889406 - DNA, 12 bp, Homo sapiens
tccaagcttttg

SEQ ID NO: 3889407 - DNA, 15 bp, Homo sapiens
tccaaggagaaacag

SEQ ID NO: 3889408 - DNA, 16 bp, Homo sapiens
tccaaggagaaacaga

SEQ ID NO: 3889409 - DNA, 20 bp, Homo sapiens
tccaaggagaaacagagaca

SEQ ID NO: 3889410 - DNA, 20 bp, Homo sapiens
tccaagggtatgggaagcca

SEQ ID NO: 3889411 - DNA, 22 bp, Homo sapiens
tccaagggtatgggaagccata

SEQ ID NO: 3889412 - DNA, 15 bp, Homo sapiens
tccaagtcaacactc

SEQ ID NO: 3889413 - DNA, 22 bp, Homo sapiens
tccaagtcaacactcttcttga

SEQ ID NO: 3889414 - DNA, 16 bp, Homo sapiens
tccaagtccaacctgc

SEQ ID NO: 3889415 - DNA, 18 bp, Homo sapiens
tccaagtccaacctgcct

SEQ ID NO: 3889416 - DNA, 23 bp, Homo sapiens
tccaagttcctgcactccagaat

SEQ ID NO: 3889417 - DNA, 12 bp, Homo sapiens
tccaatatttgg

SEQ ID NO: 3889418 - DNA, 22 bp, Homo sapiens
tccaatctgctcagcaggccct

SEQ ID NO: 3889419 - DNA, 16 bp, Homo sapiens
tccaatggctgtaaac

SEQ ID NO: 3889420 - DNA, 17 bp, Homo sapiens
tccaattatgcactggc

SEQ ID NO: 3889421 - DNA, 15 bp, Homo sapiens
tccaattgtaaaaaa

SEQ ID NO: 3889422 - DNA, 20 bp, Homo sapiens
tccacaaagccgtgcctttc

SEQ ID NO: 3889423 - DNA, 22 bp, Homo sapiens
tccacaaatctatattaaagtg

SEQ ID NO: 3889424 - DNA, 17 bp, Homo sapiens
tccacaagattcccaga

SEQ ID NO: 3889425 - DNA, 23 bp, Homo sapiens
tccacaagattcccagagacagg

SEQ ID NO: 3889426 - DNA, 23 bp, Homo sapiens
tccacaagcaatggacctttggg

SEQ ID NO: 3889427 - DNA, 15 bp, Homo sapiens
tccacacacagagga

SEQ ID NO: 3889428 - DNA, 23 bp, Homo sapiens
tccacacacagaggaagagcagg

SEQ ID NO: 3889429 - DNA, 19 bp, Homo sapiens
tccacacacgcaggaactc

SEQ ID NO: 3889430 - DNA, 11 bp, Homo sapiens
tccacagccaa

SEQ ID NO: 3889431 - DNA, 15 bp, Homo sapiens
tccacaggggcaggc

SEQ ID NO: 3889432 - DNA, 17 bp, Homo sapiens
tccacaggggcaggcct

SEQ ID NO: 3889433 - DNA, 18 bp, Homo sapiens
tccacaggggcaggcctg

SEQ ID NO: 3889434 - DNA, 15 bp, Homo sapiens
tccacagtgctgctt

SEQ ID NO: 3889435 - DNA, 16 bp, Homo sapiens
tccaccaacccatcag

SEQ ID NO: 3889436 - DNA, 15 bp, Homo sapiens
tccacccacctcagc

SEQ ID NO: 3889437 - DNA, 12 bp, Homo sapiens
tccacccagccc

SEQ ID NO: 3889438 - DNA, 13 bp, Homo sapiens
tccacccagccca

SEQ ID NO: 3889439 - DNA, 17 bp, Homo sapiens
tccacccagcccattct

SEQ ID NO: 3889440 - DNA, 12 bp, Homo sapiens
tccacccaggct

SEQ ID NO: 3889441 - DNA, 17 bp, Homo sapiens
tccacccaggctgcact

SEQ ID NO: 3889442 - DNA, 18 bp, Homo sapiens
tccacccaggctgcactg

SEQ ID NO: 3889443 - DNA, 22 bp, Homo sapiens
tccacccaggctgcactgcagt

SEQ ID NO: 3889444 - DNA, 23 bp, Homo sapiens
tccacccaggctgcactgcagtg

SEQ ID NO: 3889445 - DNA, 18 bp, Homo sapiens
tccacccagtgctgccat

SEQ ID NO: 3889446 - DNA, 21 bp, Homo sapiens
tccacccagtgctgccatgcc

SEQ ID NO: 3889447 - DNA, 15 bp, Homo sapiens
tccaccccctccagc

SEQ ID NO: 3889448 - DNA, 20 bp, Homo sapiens
tccaccccctccagctccag

SEQ ID NO: 3889449 - DNA, 22 bp, Homo sapiens
tccaccctcaaatgtcagagct

SEQ ID NO: 3889450 - DNA, 23 bp, Homo sapiens
tccaccctcaaatgtcagagcta

SEQ ID NO: 3889451 - DNA, 15 bp, Homo sapiens
tccaccgcagaagga

SEQ ID NO: 3889452 - DNA, 16 bp, Homo sapiens
tccaccgcagaaggaa

SEQ ID NO: 3889453 - DNA, 15 bp, Homo sapiens
tccaccgctgcctaa

SEQ ID NO: 3889454 - DNA, 17 bp, Homo sapiens
tccacctcagccttgga

SEQ ID NO: 3889455 - DNA, 20 bp, Homo sapiens
tccacctcctagaggtgggc

SEQ ID NO: 3889456 - DNA, 16 bp, Homo sapiens
tccacctctccttgga

SEQ ID NO: 3889457 - DNA, 18 bp, Homo sapiens
tccacctcttcacccccc

SEQ ID NO: 3889458 - DNA, 22 bp, Homo sapiens
tccacctgcctatccatcctgc

SEQ ID NO: 3889459 - DNA, 15 bp, Homo sapiens
tccaccttcccatgc

SEQ ID NO: 3889460 - DNA, 19 bp, Homo sapiens
tccaccttcccatgccctg

SEQ ID NO: 3889461 - DNA, 21 bp, Homo sapiens
tccaccttgctcttctttctg

SEQ ID NO: 3889462 - DNA, 17 bp, Homo sapiens
tccacgcctcctggcca

SEQ ID NO: 3889463 - DNA, 14 bp, Homo sapiens
tccacgggaagcct

SEQ ID NO: 3889464 - DNA, 19 bp, Homo sapiens
tccacggtcagatttgctg

SEQ ID NO: 3889465 - DNA, 22 bp, Homo sapiens
tccacggtcagatttgctgttc

SEQ ID NO: 3889466 - DNA, 16 bp, Homo sapiens
tccacggtgcgtggct

SEQ ID NO: 3889467 - DNA, 20 bp, Homo sapiens
tccactcaatatgtgatttt

SEQ ID NO: 3889468 - DNA, 17 bp, Homo sapiens
tccactcactccagccc

SEQ ID NO: 3889469 - DNA, 23 bp, Homo sapiens
tccactccatatttatttaaaca

SEQ ID NO: 3889470 - DNA, 18 bp, Homo sapiens
tccactcccccacctgac

SEQ ID NO: 3889471 - DNA, 21 bp, Homo sapiens
tccactctcggggcccttggg

SEQ ID NO: 3889472 - DNA, 13 bp, Homo sapiens
tccactgccttcg

SEQ ID NO: 3889473 - DNA, 17 bp, Homo sapiens
tccactgtcaccctcca

SEQ ID NO: 3889474 - DNA, 21 bp, Homo sapiens
tccacttagaaattgcatttc

SEQ ID NO: 3889475 - DNA, 14 bp, Homo sapiens
tccacttcaatctg

SEQ ID NO: 3889476 - DNA, 20 bp, Homo sapiens
tccacttctctagagaacat

SEQ ID NO: 3889477 - DNA, 18 bp, Homo sapiens
tccagaaaatataaatgc

SEQ ID NO: 3889478 - DNA, 20 bp, Homo sapiens
tccagaagaatattcaggac

SEQ ID NO: 3889479 - DNA, 15 bp, Homo sapiens
tccagaagtccctcc

SEQ ID NO: 3889480 - DNA, 14 bp, Homo sapiens
tccagaagtggggc

SEQ ID NO: 3889481 - DNA, 19 bp, Homo sapiens
tccagaagtggggctctgg

SEQ ID NO: 3889482 - DNA, 23 bp, Homo sapiens
tccagaagtggggctctgggagg

SEQ ID NO: 3889483 - DNA, 18 bp, Homo sapiens
tccagaataagtgctgtt

SEQ ID NO: 3889484 - DNA, 16 bp, Homo sapiens
tccagaatctgctgtt

SEQ ID NO: 3889485 - DNA, 15 bp, Homo sapiens
tccagaccacctgcc

SEQ ID NO: 3889486 - DNA, 18 bp, Homo sapiens
tccagaccacctgccagc

SEQ ID NO: 3889487 - DNA, 17 bp, Homo sapiens
tccagaccattgtcttc

SEQ ID NO: 3889488 - DNA, 19 bp, Homo sapiens
tccagaccattgtcttcca

SEQ ID NO: 3889489 - DNA, 23 bp, Homo sapiens
tccagacccctggcttttcactg

SEQ ID NO: 3889490 - DNA, 15 bp, Homo sapiens
tccagaccctgcctg

SEQ ID NO: 3889491 - DNA, 20 bp, Homo sapiens
tccagaccctgcctgagccc

SEQ ID NO: 3889492 - DNA, 16 bp, Homo sapiens
tccagagagtggctcc

SEQ ID NO: 3889493 - DNA, 14 bp, Homo sapiens
tccagagccagcct

SEQ ID NO: 3889494 - DNA, 16 bp, Homo sapiens
tccagagccagcctgg

SEQ ID NO: 3889495 - DNA, 18 bp, Homo sapiens
tccagagccagcctggga

SEQ ID NO: 3889496 - DNA, 19 bp, Homo sapiens
tccagagccagcctgggac

SEQ ID NO: 3889497 - DNA, 20 bp, Homo sapiens
tccagagcctaagaaaatca

SEQ ID NO: 3889498 - DNA, 17 bp, Homo sapiens
tccagagtctgagcccc

SEQ ID NO: 3889499 - DNA, 20 bp, Homo sapiens
tccagagtgtgcagactgat

SEQ ID NO: 3889500 - DNA, 20 bp, Homo sapiens
tccagatgccttcctgtctt

SEQ ID NO: 3889501 - DNA, 12 bp, Homo sapiens
tccagcagctgc

SEQ ID NO: 3889502 - DNA, 14 bp, Homo sapiens
tccagcagctgcgg

SEQ ID NO: 3889503 - DNA, 23 bp, Homo sapiens
tccagcagctgcgggtctgaagg

SEQ ID NO: 3889504 - DNA, 15 bp, Homo sapiens
tccagcatccagcct

SEQ ID NO: 3889505 - DNA, 16 bp, Homo sapiens
tccagcatccagcctg

SEQ ID NO: 3889506 - DNA, 18 bp, Homo sapiens
tccagcatccagcctgtg

SEQ ID NO: 3889507 - DNA, 19 bp, Homo sapiens
tccagcatccagcctgtgt

SEQ ID NO: 3889508 - DNA, 21 bp, Homo sapiens
tccagcatttgccattcctgg

SEQ ID NO: 3889509 - DNA, 23 bp, Homo sapiens
tccagccagcaatgatgtccaga

SEQ ID NO: 3889510 - DNA, 19 bp, Homo sapiens
tccagcctctcccggctgc

SEQ ID NO: 3889511 - DNA, 23 bp, Homo sapiens
tccagcctctcccggctgcctgc

SEQ ID NO: 3889512 - DNA, 13 bp, Homo sapiens
tccagcctgtgtg

SEQ ID NO: 3889513 - DNA, 14 bp, Homo sapiens
tccagcctgtgtgt

SEQ ID NO: 3889514 - DNA, 15 bp, Homo sapiens
tccagctagtgaccc

SEQ ID NO: 3889515 - DNA, 14 bp, Homo sapiens
tccagctgcctggg

SEQ ID NO: 3889516 - DNA, 15 bp, Homo sapiens
tccagcttgctcttc

SEQ ID NO: 3889517 - DNA, 16 bp, Homo sapiens
tccagcttgctcttca

SEQ ID NO: 3889518 - DNA, 19 bp, Homo sapiens
tccagcttgctcttcagtg

SEQ ID NO: 3889519 - DNA, 18 bp, Homo sapiens
tcaaaaaggtgtgtcaaa

SEQ ID NO: 3889520 - DNA, 14 bp, Homo sapiens
tcaaaaataaacta

SEQ ID NO: 3889521 - DNA, 15 bp, Homo sapiens
tcaaaaataaactag

SEQ ID NO: 3889522 - DNA, 18 bp, Homo sapiens
tcaaaaataaactagttt

SEQ ID NO: 3889523 - DNA, 19 bp, Homo sapiens
tcaaaaataaactagtttc

SEQ ID NO: 3889524 - DNA, 13 bp, Homo sapiens
tcaaaagacatgt

SEQ ID NO: 3889525 - DNA, 12 bp, Homo sapiens
tcaaaagcactt

SEQ ID NO: 3889526 - DNA, 23 bp, Homo sapiens
tcaaaagcacttgttccttctgc

SEQ ID NO: 3889527 - DNA, 15 bp, Homo sapiens
tcaaaagctgcttga

SEQ ID NO: 3889528 - DNA, 14 bp, Homo sapiens
tcaaaataaattga

SEQ ID NO: 3889529 - DNA, 19 bp, Homo sapiens
tcaaaatttcaaaagtgat

SEQ ID NO: 3889530 - DNA, 16 bp, Homo sapiens
tcaaacagaattttaa

SEQ ID NO: 3889531 - DNA, 13 bp, Homo sapiens
tcaaacagtctca

SEQ ID NO: 3889532 - DNA, 21 bp, Homo sapiens
tcaaaccataaacttcatggt

SEQ ID NO: 3889533 - DNA, 14 bp, Homo sapiens
tcaaaccatttaat

SEQ ID NO: 3889534 - DNA, 22 bp, Homo sapiens
tcaaaccatttaattcataatt

SEQ ID NO: 3889535 - DNA, 13 bp, Homo sapiens
tcaaactcaaggt

SEQ ID NO: 3889536 - DNA, 22 bp, Homo sapiens
tcaaactgagtaaattggaaac

SEQ ID NO: 3889537 - DNA, 15 bp, Homo sapiens
tcaaacttgtgctga

SEQ ID NO: 3889538 - DNA, 17 bp, Homo sapiens
tcaaacttgtgctgaga

SEQ ID NO: 3889539 - DNA, 12 bp, Homo sapiens
tcaaagagactc

SEQ ID NO: 3889540 - DNA, 15 bp, Homo sapiens
tcaaagctttttcca

SEQ ID NO: 3889541 - DNA, 16 bp, Homo sapiens
tcaaagctttttccag

SEQ ID NO: 3889542 - DNA, 17 bp, Homo sapiens
tcaaagtgtaagcactt

SEQ ID NO: 3889543 - DNA, 14 bp, Homo sapiens
tcaaagttcctgtt

SEQ ID NO: 3889544 - DNA, 18 bp, Homo sapiens
tcaaatatagagatattt

SEQ ID NO: 3889545 - DNA, 15 bp, Homo sapiens
tcaaatatctcagag

SEQ ID NO: 3889546 - DNA, 14 bp, Homo sapiens
tcaaatatgcaaag

SEQ ID NO: 3889547 - DNA, 17 bp, Homo sapiens
tcaaatcctcaccatcc

SEQ ID NO: 3889548 - DNA, 16 bp, Homo sapiens
tcaaatctattcagac

SEQ ID NO: 3889549 - DNA, 18 bp, Homo sapiens
tcaaatctattcagacaa

SEQ ID NO: 3889550 - DNA, 12 bp, Homo sapiens
tcaaatctgtat

SEQ ID NO: 3889551 - DNA, 20 bp, Homo sapiens
tcaaatctgtatatgttgta

SEQ ID NO: 3889552 - DNA, 12 bp, Homo sapiens
tcaaatgaacac

SEQ ID NO: 3889553 - DNA, 15 bp, Homo sapiens
tcaaatgacccaaag

SEQ ID NO: 3889554 - DNA, 13 bp, Homo sapiens
tcaaatgctaaat

SEQ ID NO: 3889555 - DNA, 15 bp, Homo sapiens
tcaaatgctaaatgc

SEQ ID NO: 3889556 - DNA, 15 bp, Homo sapiens
tcaaatgtcagagct

SEQ ID NO: 3889557 - DNA, 20 bp, Homo sapiens
tcaaattcatttttttcact

SEQ ID NO: 3889558 - DNA, 16 bp, Homo sapiens
tcaaattctcaaccta

SEQ ID NO: 3889559 - DNA, 20 bp, Homo sapiens
tcaacaagaatattgtatgt

SEQ ID NO: 3889560 - DNA, 12 bp, Homo sapiens
tcaacaataaag

SEQ ID NO: 3889561 - DNA, 20 bp, Homo sapiens
tcaacatctttttcctccct

SEQ ID NO: 3889562 - DNA, 14 bp, Homo sapiens
tcaacattctttgc

SEQ ID NO: 3889563 - DNA, 17 bp, Homo sapiens
tcaaccagcattttact

SEQ ID NO: 3889564 - DNA, 16 bp, Homo sapiens
tcaaccgcttgccata

SEQ ID NO: 3889565 - DNA, 15 bp, Homo sapiens
tcaacctaccacccc

SEQ ID NO: 3889566 - DNA, 22 bp, Homo sapiens
tcaacctaccaccccttcctgt

SEQ ID NO: 3889567 - DNA, 11 bp, Homo sapiens
tcaacctgctc

SEQ ID NO: 3889568 - DNA, 17 bp, Homo sapiens
tcaacctggtggcacca

SEQ ID NO: 3889569 - DNA, 15 bp, Homo sapiens
tcaacgcagccctgc

SEQ ID NO: 3889570 - DNA, 18 bp, Homo sapiens
tcaactgaccagcctcca

SEQ ID NO: 3889571 - DNA, 18 bp, Homo sapiens
tcaactggagcaagaagg

SEQ ID NO: 3889572 - DNA, 15 bp, Homo sapiens
tcaactggctgggac

SEQ ID NO: 3889573 - DNA, 18 bp, Homo sapiens
tcaacttgaagcaagctt

SEQ ID NO: 3889574 - DNA, 19 bp, Homo sapiens
tcaacttggaaaaagaaag

SEQ ID NO: 3889575 - DNA, 22 bp, Homo sapiens
tcaactttcttttgattagtgt

SEQ ID NO: 3889576 - DNA, 19 bp, Homo sapiens
tcaagaagacatggagact

SEQ ID NO: 3889577 - DNA, 17 bp, Homo sapiens
tcaagaagtaagagcta

SEQ ID NO: 3889578 - DNA, 15 bp, Homo sapiens
tcaagaatcctctgg

SEQ ID NO: 3889579 - DNA, 16 bp, Homo sapiens
tcaagaatcctctggg

SEQ ID NO: 3889580 - DNA, 16 bp, Homo sapiens
tcaagaccttctcccc

SEQ ID NO: 3889581 - DNA, 13 bp, Homo sapiens
tcaagacttgata

SEQ ID NO: 3889582 - DNA, 17 bp, Homo sapiens
tcaagagaagaaaaaat

SEQ ID NO: 3889583 - DNA, 14 bp, Homo sapiens
tcaagaggcccagg

SEQ ID NO: 3889584 - DNA, 20 bp, Homo sapiens
tcaagagggcactggtggcc

SEQ ID NO: 3889585 - DNA, 21 bp, Homo sapiens
tcaagagggcactggtggccc

SEQ ID NO: 3889586 - DNA, 17 bp, Homo sapiens
tcaagatttcaggatta

SEQ ID NO: 3889587 - DNA, 18 bp, Homo sapiens
tcaagattttttttgtaa

SEQ ID NO: 3889588 - DNA, 19 bp, Homo sapiens
tcaagattttttttgtaac

SEQ ID NO: 3889589 - DNA, 14 bp, Homo sapiens
tcaagcagtcctcc

SEQ ID NO: 3889590 - DNA, 22 bp, Homo sapiens
tcaagcatgcaataatgtgcaa

SEQ ID NO: 3889591 - DNA, 14 bp, Homo sapiens
tcaagcctgcctag

SEQ ID NO: 3889592 - DNA, 23 bp, Homo sapiens
tcaagcgattcttgtgcctcagc

SEQ ID NO: 3889593 - DNA, 16 bp, Homo sapiens
tcaagctagaaggcca

SEQ ID NO: 3889594 - DNA, 20 bp, Homo sapiens
tcaagctagaaggccacatg

SEQ ID NO: 3889595 - DNA, 12 bp, Homo sapiens
tcaagctgtccc

SEQ ID NO: 3889596 - DNA, 16 bp, Homo sapiens
tcaaggaccacatgtg

SEQ ID NO: 3889597 - DNA, 23 bp, Homo sapiens
tcaagggtaccaatcctggcagg

SEQ ID NO: 3889598 - DNA, 17 bp, Homo sapiens
tcaaggtcaacggctta

SEQ ID NO: 3889599 - DNA, 21 bp, Homo sapiens
tcaagtagaaaatttcttata

SEQ ID NO: 3889600 - DNA, 17 bp, Homo sapiens
tcaagtgatatatgtat

SEQ ID NO: 3889601 - DNA, 22 bp, Homo sapiens
tcaagtgatatatgtatttatt

SEQ ID NO: 3889602 - DNA, 20 bp, Homo sapiens
tcaagtgcatgctctctgca

SEQ ID NO: 3889603 - DNA, 17 bp, Homo sapiens
tcaagtgcctcttgttg

SEQ ID NO: 3889604 - DNA, 22 bp, Homo sapiens
tcaataaaaaaaagaaatgaaa

SEQ ID NO: 3889605 - DNA, 17 bp, Homo sapiens
tatgtcatttattttgt

SEQ ID NO: 3889606 - DNA, 15 bp, Homo sapiens
tatgtctatttaagc

SEQ ID NO: 3889607 - DNA, 21 bp, Homo sapiens
tatgtctgcttctgtccagga

SEQ ID NO: 3889608 - DNA, 15 bp, Homo sapiens
tatgtctgtgtgtgt

SEQ ID NO: 3889609 - DNA, 16 bp, Homo sapiens
tatgtgaaagtgtaaa

SEQ ID NO: 3889610 - DNA, 17 bp, Homo sapiens
tatgtgaaagtgtaaaa

SEQ ID NO: 3889611 - DNA, 22 bp, Homo sapiens
tatgtgaatatggactcagttt

SEQ ID NO: 3889612 - DNA, 15 bp, Homo sapiens
tatgtgcacatgtgt

SEQ ID NO: 3889613 - DNA, 16 bp, Homo sapiens
tatgtgcacatgtgtc

SEQ ID NO: 3889614 - DNA, 21 bp, Homo sapiens
tatgtgcacatgtgtctgtgt

SEQ ID NO: 3889615 - DNA, 14 bp, Homo sapiens
tatgtgcagtattt

SEQ ID NO: 3889616 - DNA, 17 bp, Homo sapiens
tatgtgtatatatacat

SEQ ID NO: 3889617 - DNA, 21 bp, Homo sapiens
tatgtgtatatatacatacac

SEQ ID NO: 3889618 - DNA, 18 bp, Homo sapiens
tatgtgtcacagctctgt

SEQ ID NO: 3889619 - DNA, 18 bp, Homo sapiens
tatgtgtgcatgtgtgta

SEQ ID NO: 3889620 - DNA, 20 bp, Homo sapiens
tatgtgtgcatgtgtgtata

SEQ ID NO: 3889621 - DNA, 20 bp, Homo sapiens
tatgtgtgtttaaataaagt

SEQ ID NO: 3889622 - DNA, 21 bp, Homo sapiens
tatgtgtgtttaaataaagta

SEQ ID NO: 3889623 - DNA, 20 bp, Homo sapiens
tatgttaatttgttatgtat

SEQ ID NO: 3889624 - DNA, 19 bp, Homo sapiens
tatgttacatctgttttaa

SEQ ID NO: 3889625 - DNA, 22 bp, Homo sapiens
tatgttacatctgttttaaatt

SEQ ID NO: 3889626 - DNA, 12 bp, Homo sapiens
tatgttcaatgc

SEQ ID NO: 3889627 - DNA, 15 bp, Homo sapiens
tatgttctcagaatc

SEQ ID NO: 3889628 - DNA, 20 bp, Homo sapiens
tatgttgtaataaaacttat

SEQ ID NO: 3889629 - DNA, 13 bp, Homo sapiens
tattaaaaaacaa

SEQ ID NO: 3889630 - DNA, 22 bp, Homo sapiens
tattaaaaatatggaacttcta

SEQ ID NO: 3889631 - DNA, 14 bp, Homo sapiens
tattaaagatgtgt

SEQ ID NO: 3889632 - DNA, 12 bp, Homo sapiens
tattaaatacag

SEQ ID NO: 3889633 - DNA, 18 bp, Homo sapiens
tattaaatacagacacta

SEQ ID NO: 3889634 - DNA, 16 bp, Homo sapiens
tattaacaaattatgt

SEQ ID NO: 3889635 - DNA, 17 bp, Homo sapiens
tattaagatttccaagt

SEQ ID NO: 3889636 - DNA, 15 bp, Homo sapiens
tattaagggcatttt

SEQ ID NO: 3889637 - DNA, 14 bp, Homo sapiens
tattaataccaaat

SEQ ID NO: 3889638 - DNA, 15 bp, Homo sapiens
tattaatcttatgtg

SEQ ID NO: 3889639 - DNA, 14 bp, Homo sapiens
tattaattatctga

SEQ ID NO: 3889640 - DNA, 14 bp, Homo sapiens
tattacatctaatg

SEQ ID NO: 3889641 - DNA, 16 bp, Homo sapiens
tattacatctaatgct

SEQ ID NO: 3889642 - DNA, 17 bp, Homo sapiens
tattacatctaatgctt

SEQ ID NO: 3889643 - DNA, 16 bp, Homo sapiens
tattacatggcagtgt

SEQ ID NO: 3889644 - DNA, 21 bp, Homo sapiens
tattaccaaaaaagtattttt

SEQ ID NO: 3889645 - DNA, 23 bp, Homo sapiens
tattacttatttttgacagtgtt

SEQ ID NO: 3889646 - DNA, 14 bp, Homo sapiens
tattacttgaactt

SEQ ID NO: 3889647 - DNA, 17 bp, Homo sapiens
tattaggggtaatatat

SEQ ID NO: 3889648 - DNA, 18 bp, Homo sapiens
tattagttttctttgtaa

SEQ ID NO: 3889649 - DNA, 15 bp, Homo sapiens
tattataaataaatg

SEQ ID NO: 3889650 - DNA, 18 bp, Homo sapiens
tattataaataaatgcca

SEQ ID NO: 3889651 - DNA, 16 bp, Homo sapiens
tattataacttaaaaa

SEQ ID NO: 3889652 - DNA, 15 bp, Homo sapiens
tattatggtgtaatg

SEQ ID NO: 3889653 - DNA, 18 bp, Homo sapiens
tattatggtgtaatgcac

SEQ ID NO: 3889654 - DNA, 23 bp, Homo sapiens
tattatggtgtaatgcacaattt

SEQ ID NO: 3889655 - DNA, 19 bp, Homo sapiens
tattatgtaacatccagaa

SEQ ID NO: 3889656 - DNA, 19 bp, Homo sapiens
tattattacttatttttga

SEQ ID NO: 3889657 - DNA, 19 bp, Homo sapiens
tattcaagtgcctcttgtt

SEQ ID NO: 3889658 - DNA, 16 bp, Homo sapiens
tattcaagttattgta

SEQ ID NO: 3889659 - DNA, 11 bp, Homo sapiens
tattcaataaa

SEQ ID NO: 3889660 - DNA, 20 bp, Homo sapiens
tattcaataaaaaaaagaaa

SEQ ID NO: 3889661 - DNA, 22 bp, Homo sapiens
tattcaataaaaaaaagaaatg

SEQ ID NO: 3889662 - DNA, 14 bp, Homo sapiens
tattcactgtaagt

SEQ ID NO: 3889663 - DNA, 22 bp, Homo sapiens
tattcagacaagcaacaggttt

SEQ ID NO: 3889664 - DNA, 20 bp, Homo sapiens
tattcagatcgtattaatta

SEQ ID NO: 3889665 - DNA, 21 bp, Homo sapiens
tattcagatcgtattaattat

SEQ ID NO: 3889666 - DNA, 14 bp, Homo sapiens
tattcatgccatct

SEQ ID NO: 3889667 - DNA, 18 bp, Homo sapiens
tattcatgccatctgttt

SEQ ID NO: 3889668 - DNA, 16 bp, Homo sapiens
tattcatgctttctcc

SEQ ID NO: 3889669 - DNA, 20 bp, Homo sapiens
tattcatgctttctcctttt

SEQ ID NO: 3889670 - DNA, 15 bp, Homo sapiens
tattcatgtaataaa

SEQ ID NO: 3889671 - DNA, 12 bp, Homo sapiens
tattcatttaaa

SEQ ID NO: 3889672 - DNA, 13 bp, Homo sapiens
tattcatttaaaa

SEQ ID NO: 3889673 - DNA, 17 bp, Homo sapiens
tattcatttaaaatgat

SEQ ID NO: 3889674 - DNA, 16 bp, Homo sapiens
tattcatttttgttat

SEQ ID NO: 3889675 - DNA, 19 bp, Homo sapiens
tattccaccattcacattt

SEQ ID NO: 3889676 - DNA, 19 bp, Homo sapiens
tattccatgggatgttaag

SEQ ID NO: 3889677 - DNA, 17 bp, Homo sapiens
tattcctgcatttgtga

SEQ ID NO: 3889678 - DNA, 20 bp, Homo sapiens
tattccttttgtgtacagtg

SEQ ID NO: 3889679 - DNA, 16 bp, Homo sapiens
tattctatgagaacaa

SEQ ID NO: 3889680 - DNA, 15 bp, Homo sapiens
tattctcaccaggaa

SEQ ID NO: 3889681 - DNA, 15 bp, Homo sapiens
tattctcactccacc

SEQ ID NO: 3889682 - DNA, 22 bp, Homo sapiens
tattctcactccaccacccaaa

SEQ ID NO: 3889683 - DNA, 17 bp, Homo sapiens
tattctctcctcagact

SEQ ID NO: 3889684 - DNA, 12 bp, Homo sapiens
tattctggaaaa

SEQ ID NO: 3889685 - DNA, 20 bp, Homo sapiens
tattctggaaaaaaaatata

SEQ ID NO: 3889686 - DNA, 18 bp, Homo sapiens
tattgaacttggaaagaa

SEQ ID NO: 3889687 - DNA, 16 bp, Homo sapiens
tattgaagaaaagcac

SEQ ID NO: 3889688 - DNA, 13 bp, Homo sapiens
tattgaatatatc

SEQ ID NO: 3889689 - DNA, 14 bp, Homo sapiens
tattgaatcttaat

SEQ ID NO: 3889690 - DNA, 13 bp, Homo sapiens
tattgacaataat

SEQ ID NO: 3889691 - DNA, 17 bp, Homo sapiens
tattgacaataatttca

SEQ ID NO: 3889692 - DNA, 17 bp, Homo sapiens
tattgatgtttccagaa

SEQ ID NO: 3889693 - DNA, 18 bp, Homo sapiens
tattgatgtttccagaaa

SEQ ID NO: 3889694 - DNA, 19 bp, Homo sapiens
tattgatgtttccagaaaa

SEQ ID NO: 3889695 - DNA, 22 bp, Homo sapiens
tattgccacaatgcctctccca

SEQ ID NO: 3889696 - DNA, 17 bp, Homo sapiens
tattgcctttgcctctt

SEQ ID NO: 3889697 - DNA, 19 bp, Homo sapiens
tattgcgaatgtgcagaaa

SEQ ID NO: 3889698 - DNA, 13 bp, Homo sapiens
tattgcttaatcc

SEQ ID NO: 3889699 - DNA, 22 bp, Homo sapiens
tattggtccagcttgctcttca

SEQ ID NO: 3889700 - DNA, 19 bp, Homo sapiens
tattgtatattctggaaaa

SEQ ID NO: 3889701 - DNA, 20 bp, Homo sapiens
tattgtatattctggaaaaa

SEQ ID NO: 3889702 - DNA, 14 bp, Homo sapiens
tattgtatgtaagt

SEQ ID NO: 3889703 - DNA, 20 bp, Homo sapiens
tattgtcattactgcctttg

SEQ ID NO: 3889704 - DNA, 14 bp, Homo sapiens
tattgtgttgcctt

SEQ ID NO: 3889705 - DNA, 21 bp, Homo sapiens
tattgtgttgccttagcactt

SEQ ID NO: 3889706 - DNA, 24 bp, Homo sapiens
tattgtttattctttttaaagtat

SEQ ID NO: 3889707 - DNA, 15 bp, Homo sapiens
tatttaaaaaataaa

SEQ ID NO: 3889708 - DNA, 18 bp, Homo sapiens
tatttaaaaaataaaaaa

SEQ ID NO: 3889709 - DNA, 18 bp, Homo sapiens
tatttaaatgttgaaatc

SEQ ID NO: 3889710 - DNA, 20 bp, Homo sapiens
tatttaaatgttgaaatctt

SEQ ID NO: 3889711 - DNA, 21 bp, Homo sapiens
tatttaactgccttgtgtaca

SEQ ID NO: 3889712 - DNA, 21 bp, Homo sapiens
tatttaagcctcatatttaaa

SEQ ID NO: 3889713 - DNA, 22 bp, Homo sapiens
tatttaagtttgttgctgtcaa

SEQ ID NO: 3889714 - DNA, 16 bp, Homo sapiens
tatttactaaaagaat

SEQ ID NO: 3889715 - DNA, 19 bp, Homo sapiens
tatttacttgtagaaatct

SEQ ID NO: 3889716 - DNA, 22 bp, Homo sapiens
tatttagattgttaaaataact

SEQ ID NO: 3889717 - DNA, 17 bp, Homo sapiens
tatttagttatagtttc

SEQ ID NO: 3889718 - DNA, 14 bp, Homo sapiens
tatttataagcaga

SEQ ID NO: 3889719 - DNA, 15 bp, Homo sapiens
tatttatactctaga

SEQ ID NO: 3889720 - DNA, 16 bp, Homo sapiens
tatttatatatttgaa

SEQ ID NO: 3889721 - DNA, 16 bp, Homo sapiens
tatttatatttggaaa

SEQ ID NO: 3889722 - DNA, 21 bp, Homo sapiens
tatttatatttggaaagagac

SEQ ID NO: 3889723 - DNA, 22 bp, Homo sapiens
tatttatctccgcaggctattt

SEQ ID NO: 3889724 - DNA, 12 bp, Homo sapiens
tatttatcttta

SEQ ID NO: 3889725 - DNA, 20 bp, Homo sapiens
tatttatgcttaaaatatgt

SEQ ID NO: 3889726 - DNA, 21 bp, Homo sapiens
tatttatgcttaaaatatgta

SEQ ID NO: 3889727 - DNA, 17 bp, Homo sapiens
tatttatggcttataaa

SEQ ID NO: 3889728 - DNA, 16 bp, Homo sapiens
tatttattagctgtaa

SEQ ID NO: 3889729 - DNA, 15 bp, Homo sapiens
tatttattcactgta

SEQ ID NO: 3889730 - DNA, 19 bp, Homo sapiens
tatttattcactgtaagtt

SEQ ID NO: 3889731 - DNA, 13 bp, Homo sapiens
tatttattcattc

SEQ ID NO: 3889732 - DNA, 15 bp, Homo sapiens
tatttattcattcag

SEQ ID NO: 3889733 - DNA, 14 bp, Homo sapiens
tatttattggggtg

SEQ ID NO: 3889734 - DNA, 20 bp, Homo sapiens
tatttcaaatgaacacgtgc

SEQ ID NO: 3889735 - DNA, 13 bp, Homo sapiens
tatttcatttctt

SEQ ID NO: 3889736 - DNA, 21 bp, Homo sapiens
tatttccccaggggaaaatga

SEQ ID NO: 3889737 - DNA, 22 bp, Homo sapiens
tatttccccaggggaaaatgaa

SEQ ID NO: 3889738 - DNA, 19 bp, Homo sapiens
tatttcccccttactactt

SEQ ID NO: 3889739 - DNA, 18 bp, Homo sapiens
tatttcctcccccagtta

SEQ ID NO: 3889740 - DNA, 13 bp, Homo sapiens
tatttctagcaga

SEQ ID NO: 3889741 - DNA, 14 bp, Homo sapiens
tatttctagcagag

SEQ ID NO: 3889742 - DNA, 17 bp, Homo sapiens
tatttctagcagagtga

SEQ ID NO: 3889743 - DNA, 20 bp, Homo sapiens
tatttctgtcattcaaatgg

SEQ ID NO: 3889744 - DNA, 22 bp, Homo sapiens
tatttctttgtgataacaaaga

SEQ ID NO: 3889745 - DNA, 19 bp, Homo sapiens
tatttgaaactgaatgttt

SEQ ID NO: 3889746 - DNA, 22 bp, Homo sapiens
tatttgaaattttatttagttc

SEQ ID NO: 3889747 - DNA, 16 bp, Homo sapiens
tatttgaatatcatta

SEQ ID NO: 3889748 - DNA, 23 bp, Homo sapiens
tatttgagcatgcacagctgctt

SEQ ID NO: 3889749 - DNA, 16 bp, Homo sapiens
tatttgtatgtactgt

SEQ ID NO: 3889750 - DNA, 14 bp, Homo sapiens
tatttgtgtaatag

SEQ ID NO: 3889751 - DNA, 13 bp, Homo sapiens
tatttgtgtatgt

SEQ ID NO: 3889752 - DNA, 19 bp, Homo sapiens
tattttaaaaaatgaaaat

SEQ ID NO: 3889753 - DNA, 17 bp, Homo sapiens
tattttaaaaccatgca

SEQ ID NO: 3889754 - DNA, 12 bp, Homo sapiens
tattttaaacaa

SEQ ID NO: 3889755 - DNA, 13 bp, Homo sapiens
tattttaaatgtt

SEQ ID NO: 3889756 - DNA, 16 bp, Homo sapiens
tattttaatattttgt

SEQ ID NO: 3889757 - DNA, 15 bp, Homo sapiens
tattttagatgcaat

SEQ ID NO: 3889758 - DNA, 18 bp, Homo sapiens
tattttaggcagggattt

SEQ ID NO: 3889759 - DNA, 21 bp, Homo sapiens
tattttaggcagggatttgag

SEQ ID NO: 3889760 - DNA, 22 bp, Homo sapiens
tattttaggcagggatttgagg

SEQ ID NO: 3889761 - DNA, 15 bp, Homo sapiens
tattttatatgagag

SEQ ID NO: 3889762 - DNA, 15 bp, Homo sapiens
tattttatgtatata

SEQ ID NO: 3889763 - DNA, 22 bp, Homo sapiens
tattttattaaagcaacatttt

SEQ ID NO: 3889764 - DNA, 19 bp, Homo sapiens
tattttattccctttcaca

SEQ ID NO: 3889765 - DNA, 21 bp, Homo sapiens
tattttcaacgcagccctgct

SEQ ID NO: 3889766 - DNA, 16 bp, Homo sapiens
tattttcaagaaactg

SEQ ID NO: 3889767 - DNA, 13 bp, Homo sapiens
tattttcattaca

SEQ ID NO: 3889768 - DNA, 21 bp, Homo sapiens
tattttcattacaatggaaac

SEQ ID NO: 3889769 - DNA, 16 bp, Homo sapiens
tatttttcaaccagca

SEQ ID NO: 3889770 - DNA, 17 bp, Homo sapiens
tatttttcaaccagcat

SEQ ID NO: 3889771 - DNA, 19 bp, Homo sapiens
tatttttcaaccagcattt

SEQ ID NO: 3889772 - DNA, 15 bp, Homo sapiens
tatttttccacattt

SEQ ID NO: 3889773 - DNA, 12 bp, Homo sapiens
tattttttaaag

SEQ ID NO: 3889774 - DNA, 21 bp, Homo sapiens
tattttttcaatttaaaggtt

SEQ ID NO: 3889775 - DNA, 15 bp, Homo sapiens
tattttttctacaca

SEQ ID NO: 3889776 - DNA, 14 bp, Homo sapiens
tcaaaaaaacacta

SEQ ID NO: 3889777 - DNA, 12 bp, Homo sapiens
tcagaagataac

SEQ ID NO: 3889778 - DNA, 14 bp, Homo sapiens
tcagaagcctgggg

SEQ ID NO: 3889779 - DNA, 16 bp, Homo sapiens
tcagaagcctgggggc

SEQ ID NO: 3889780 - DNA, 16 bp, Homo sapiens
tcagaaggagaaggaa

SEQ ID NO: 3889781 - DNA, 18 bp, Homo sapiens
tcagaaggagaaggaagg

SEQ ID NO: 3889782 - DNA, 19 bp, Homo sapiens
tcagaatatggacaaagaa

SEQ ID NO: 3889783 - DNA, 22 bp, Homo sapiens
tcagaatcaggttgacagtccc

SEQ ID NO: 3889784 - DNA, 15 bp, Homo sapiens
tcagaatggaaagaa

SEQ ID NO: 3889785 - DNA, 18 bp, Homo sapiens
tcagacaataccactggt

SEQ ID NO: 3889786 - DNA, 20 bp, Homo sapiens
tcagacaataccactggtta

SEQ ID NO: 3889787 - DNA, 16 bp, Homo sapiens
tcagacaatccactct

SEQ ID NO: 3889788 - DNA, 18 bp, Homo sapiens
tcagacaatccactctca

SEQ ID NO: 3889789 - DNA, 17 bp, Homo sapiens
tcagacaattcagaagc

SEQ ID NO: 3889790 - DNA, 18 bp, Homo sapiens
tcagacagaacccctaca

SEQ ID NO: 3889791 - DNA, 20 bp, Homo sapiens
tcagaccaactctctcctgt

SEQ ID NO: 3889792 - DNA, 14 bp, Homo sapiens
tcagaccctacccc

SEQ ID NO: 3889793 - DNA, 12 bp, Homo sapiens
tcagacctctga

SEQ ID NO: 3889794 - DNA, 16 bp, Homo sapiens
tcagacctctgatccc

SEQ ID NO: 3889795 - DNA, 19 bp, Homo sapiens
tcagacttttatcaaaatc

SEQ ID NO: 3889796 - DNA, 12 bp, Homo sapiens
tcagagaatttc

SEQ ID NO: 3889797 - DNA, 21 bp, Homo sapiens
tcagagacagaccccttggct

SEQ ID NO: 3889798 - DNA, 21 bp, Homo sapiens
tcagagaggccttttggaatg

SEQ ID NO: 3889799 - DNA, 22 bp, Homo sapiens
tcagagaggccttttgtttaaa

SEQ ID NO: 3889800 - DNA, 14 bp, Homo sapiens
tcagagcaggctca

SEQ ID NO: 3889801 - DNA, 14 bp, Homo sapiens
tcagagccaggctc

SEQ ID NO: 3889802 - DNA, 21 bp, Homo sapiens
tcagagccaggctctgcctgg

SEQ ID NO: 3889803 - DNA, 18 bp, Homo sapiens
tcagagccagtgaaggag

SEQ ID NO: 3889804 - DNA, 21 bp, Homo sapiens
tcagagccagtgaaggagcca

SEQ ID NO: 3889805 - DNA, 18 bp, Homo sapiens
tcagagcctagccacctc

SEQ ID NO: 3889806 - DNA, 21 bp, Homo sapiens
tcagagcctagccacctccca

SEQ ID NO: 3889807 - DNA, 23 bp, Homo sapiens
tcagagcctagccacctcccacc

SEQ ID NO: 3889808 - DNA, 13 bp, Homo sapiens
tcagagctcttaa

SEQ ID NO: 3889809 - DNA, 16 bp, Homo sapiens
tcagagctcttaatgt

SEQ ID NO: 3889810 - DNA, 23 bp, Homo sapiens
tcagagctcttcaagctgtcccc

SEQ ID NO: 3889811 - DNA, 23 bp, Homo sapiens
tcagagctgttggcctcgcctgg

SEQ ID NO: 3889812 - DNA, 15 bp, Homo sapiens
tcagagtcttgtccc

SEQ ID NO: 3889813 - DNA, 19 bp, Homo sapiens
tcagagtgacatccaggag

SEQ ID NO: 3889814 - DNA, 17 bp, Homo sapiens
tcagagttgctttaaag

SEQ ID NO: 3889815 - DNA, 18 bp, Homo sapiens
tcagatatatttttcaca

SEQ ID NO: 3889816 - DNA, 23 bp, Homo sapiens
tcagatattttttcagaaatatg

SEQ ID NO: 3889817 - DNA, 22 bp, Homo sapiens
tcagatcgtattaattatctga

SEQ ID NO: 3889818 - DNA, 17 bp, Homo sapiens
tcagatgatctctccac

SEQ ID NO: 3889819 - DNA, 18 bp, Homo sapiens
tcagatgggaagacatga

SEQ ID NO: 3889820 - DNA, 22 bp, Homo sapiens
tcagattgacaaggtagacatg

SEQ ID NO: 3889821 - DNA, 18 bp, Homo sapiens
tcagcacaccccaaggga

SEQ ID NO: 3889822 - DNA, 21 bp, Homo sapiens
tcagcacaccccaagggacaa

SEQ ID NO: 3889823 - DNA, 23 bp, Homo sapiens
tcagcaccctgggtgccattccc

SEQ ID NO: 3889824 - DNA, 11 bp, Homo sapiens
tcagcactgaa

SEQ ID NO: 3889825 - DNA, 14 bp, Homo sapiens
tcagcagccccctg

SEQ ID NO: 3889826 - DNA, 15 bp, Homo sapiens
tcagcagccctcctc

SEQ ID NO: 3889827 - DNA, 18 bp, Homo sapiens
tcagcagccctcctcacc

SEQ ID NO: 3889828 - DNA, 15 bp, Homo sapiens
tcagcaggaacctgt

SEQ ID NO: 3889829 - DNA, 17 bp, Homo sapiens
tcagcatacctttattg

SEQ ID NO: 3889830 - DNA, 17 bp, Homo sapiens
tcagcattctcactcct

SEQ ID NO: 3889831 - DNA, 20 bp, Homo sapiens
tcagccaccctgaggcctct

SEQ ID NO: 3889832 - DNA, 15 bp, Homo sapiens
tcagccagccgccct

SEQ ID NO: 3889833 - DNA, 18 bp, Homo sapiens
tcagccagccgccctggg

SEQ ID NO: 3889834 - DNA, 13 bp, Homo sapiens
tcagccagggcca

SEQ ID NO: 3889835 - DNA, 16 bp, Homo sapiens
tcagccagggccaggg

SEQ ID NO: 3889836 - DNA, 20 bp, Homo sapiens
tcagccataaagtgccagtt

SEQ ID NO: 3889837 - DNA, 18 bp, Homo sapiens
tcagccatcaacaagagt

SEQ ID NO: 3889838 - DNA, 15 bp, Homo sapiens
tcagcccctcctctg

SEQ ID NO: 3889839 - DNA, 21 bp, Homo sapiens
tcagcccctcctctgccacct

SEQ ID NO: 3889840 - DNA, 22 bp, Homo sapiens
tcagcccctcctctgccacctc

SEQ ID NO: 3889841 - DNA, 17 bp, Homo sapiens
tcagcccgaatgcctgt

SEQ ID NO: 3889842 - DNA, 13 bp, Homo sapiens
tcagccctccctg

SEQ ID NO: 3889843 - DNA, 19 bp, Homo sapiens
tcagccctccctgcccctc

SEQ ID NO: 3889844 - DNA, 18 bp, Homo sapiens
tcagccctgggccccacc

SEQ ID NO: 3889845 - DNA, 19 bp, Homo sapiens
tcagccgagccgggcctgg

SEQ ID NO: 3889846 - DNA, 10 bp, Homo sapiens
tcagccgtgc

SEQ ID NO: 3889847 - DNA, 16 bp, Homo sapiens
tcagccgtgcactccc

SEQ ID NO: 3889848 - DNA, 13 bp, Homo sapiens
tcagcctcccaga

SEQ ID NO: 3889849 - DNA, 14 bp, Homo sapiens
tcagcctcccagag

SEQ ID NO: 3889850 - DNA, 21 bp, Homo sapiens
tcagcctcccagagtgctagg

SEQ ID NO: 3889851 - DNA, 22 bp, Homo sapiens
tcagcctcccagagtgctagga

SEQ ID NO: 3889852 - DNA, 21 bp, Homo sapiens
tcagcctccccctgctgctca

SEQ ID NO: 3889853 - DNA, 13 bp, Homo sapiens
tcagcctcctcag

SEQ ID NO: 3889854 - DNA, 12 bp, Homo sapiens
tcagcctcttaa

SEQ ID NO: 3889855 - DNA, 22 bp, Homo sapiens
tcagcctcttaaagctgcctgt

SEQ ID NO: 3889856 - DNA, 19 bp, Homo sapiens
tcagcctgagtctcctgtg

SEQ ID NO: 3889857 - DNA, 22 bp, Homo sapiens
tcagcgccctggagtcccctgg

SEQ ID NO: 3889858 - DNA, 13 bp, Homo sapiens
tcagcgtggcctt

SEQ ID NO: 3889859 - DNA, 17 bp, Homo sapiens
tcagcgtggccttgttc

SEQ ID NO: 3889860 - DNA, 19 bp, Homo sapiens
tcagctactgatttttgtg

SEQ ID NO: 3889861 - DNA, 12 bp, Homo sapiens
tcagctcagcct

SEQ ID NO: 3889862 - DNA, 16 bp, Homo sapiens
tcagctcagcctcccc

SEQ ID NO: 3889863 - DNA, 22 bp, Homo sapiens
tcagctccagaataccttcttc

SEQ ID NO: 3889864 - DNA, 20 bp, Homo sapiens
tcagctcccatagcgctggc

SEQ ID NO: 3889865 - DNA, 22 bp, Homo sapiens
tcagctcccatagcgctggctc

SEQ ID NO: 3889866 - DNA, 18 bp, Homo sapiens
tcagctcccctcggagaa

SEQ ID NO: 3889867 - DNA, 22 bp, Homo sapiens
tcagctcccctcggagaagagc

SEQ ID NO: 3889868 - DNA, 21 bp, Homo sapiens
tcagctcccttcccctgcctg

SEQ ID NO: 3889869 - DNA, 22 bp, Homo sapiens
tcagctcccttcccctgcctgg

SEQ ID NO: 3889870 - DNA, 18 bp, Homo sapiens
tcagctctcctgctgcag

SEQ ID NO: 3889871 - DNA, 17 bp, Homo sapiens
tcagctgacacataatt

SEQ ID NO: 3889872 - DNA, 18 bp, Homo sapiens
tcagctgacagctgctca

SEQ ID NO: 3889873 - DNA, 16 bp, Homo sapiens
tcagctgcacattcct

SEQ ID NO: 3889874 - DNA, 16 bp, Homo sapiens
tcagctgctgaaacaa

SEQ ID NO: 3889875 - DNA, 12 bp, Homo sapiens
tcagctgtgaac

SEQ ID NO: 3889876 - DNA, 18 bp, Homo sapiens
tcagcttttaataaaatt

SEQ ID NO: 3889877 - DNA, 22 bp, Homo sapiens
tcaggaaaactgacagaggagg

SEQ ID NO: 3889878 - DNA, 14 bp, Homo sapiens
tcaggaagaaaccc

SEQ ID NO: 3889879 - DNA, 20 bp, Homo sapiens
tcaggaagaaaccccaagca

SEQ ID NO: 3889880 - DNA, 16 bp, Homo sapiens
tcaggaagagaaggag

SEQ ID NO: 3889881 - DNA, 20 bp, Homo sapiens
tcaggaagagaaggagcaga

SEQ ID NO: 3889882 - DNA, 16 bp, Homo sapiens
tcaggacacaggcctg

SEQ ID NO: 3889883 - DNA, 17 bp, Homo sapiens
tcaggacacaggcctgt

SEQ ID NO: 3889884 - DNA, 19 bp, Homo sapiens
tcaggacacaggcctgtgt

SEQ ID NO: 3889885 - DNA, 22 bp, Homo sapiens
tcaggacatggggcatagaaac

SEQ ID NO: 3889886 - DNA, 13 bp, Homo sapiens
tcaggacccaggc

SEQ ID NO: 3889887 - DNA, 14 bp, Homo sapiens
tcaggacccaggcc

SEQ ID NO: 3889888 - DNA, 19 bp, Homo sapiens
tcaggacccaggccctcca

SEQ ID NO: 3889889 - DNA, 22 bp, Homo sapiens
tcaggacctccggggagagcag

SEQ ID NO: 3889890 - DNA, 23 bp, Homo sapiens
tcaggacctccggggagagcaga

SEQ ID NO: 3889891 - DNA, 13 bp, Homo sapiens
tcaggactggctc

SEQ ID NO: 3889892 - DNA, 14 bp, Homo sapiens
tcaggactggctca

SEQ ID NO: 3889893 - DNA, 15 bp, Homo sapiens
tcaggactggctcac

SEQ ID NO: 3889894 - DNA, 21 bp, Homo sapiens
tcaggaggccctggtgtcagg

SEQ ID NO: 3889895 - DNA, 13 bp, Homo sapiens
tcaggaggctgag

SEQ ID NO: 3889896 - DNA, 15 bp, Homo sapiens
tcaggcaagcccctc

SEQ ID NO: 3889897 - DNA, 21 bp, Homo sapiens
tcaggcaagcccctcagccct

SEQ ID NO: 3889898 - DNA, 16 bp, Homo sapiens
tcaggcacaggcagga

SEQ ID NO: 3889899 - DNA, 19 bp, Homo sapiens
tcaggcacaggcaggaaga

SEQ ID NO: 3889900 - DNA, 14 bp, Homo sapiens
tcaggcactggtgg

SEQ ID NO: 3889901 - DNA, 16 bp, Homo sapiens
tcaggcactggtggca

SEQ ID NO: 3889902 - DNA, 17 bp, Homo sapiens
tcaggcactggtggcat

SEQ ID NO: 3889903 - DNA, 15 bp, Homo sapiens
tcaggcagacaagag

SEQ ID NO: 3889904 - DNA, 21 bp, Homo sapiens
tcaggcagacaagagctgctg

SEQ ID NO: 3889905 - DNA, 23 bp, Homo sapiens
tcaggcagacaagagctgctgtc

SEQ ID NO: 3889906 - DNA, 19 bp, Homo sapiens
tcaggcagaggatgttctg

SEQ ID NO: 3889907 - DNA, 12 bp, Homo sapiens
tcaggcagcctt

SEQ ID NO: 3889908 - DNA, 15 bp, Homo sapiens
tcaggcagccttcat

SEQ ID NO: 3889909 - DNA, 21 bp, Homo sapiens
tcaggcccggctaactctggc

SEQ ID NO: 3889910 - DNA, 23 bp, Homo sapiens
tcaggcccggctaactctggcac

SEQ ID NO: 3889911 - DNA, 19 bp, Homo sapiens
tcaggcccttattttcaag

SEQ ID NO: 3889912 - DNA, 16 bp, Homo sapiens
tcaggctccattagga

SEQ ID NO: 3889913 - DNA, 22 bp, Homo sapiens
tcaggctgctgctctgccttca

SEQ ID NO: 3889914 - DNA, 16 bp, Homo sapiens
tcagggaaatggaggg

SEQ ID NO: 3889915 - DNA, 19 bp, Homo sapiens
tcagggaagcaggcagagc

SEQ ID NO: 3889916 - DNA, 19 bp, Homo sapiens
tcagggccagaaggagggc

SEQ ID NO: 3889917 - DNA, 17 bp, Homo sapiens
tcagggtgaatcagatg

SEQ ID NO: 3889918 - DNA, 18 bp, Homo sapiens
tcagggtgggccactctc

SEQ ID NO: 3889919 - DNA, 23 bp, Homo sapiens
tcagggtgggccactctcccctc

SEQ ID NO: 3889920 - DNA, 12 bp, Homo sapiens
tcaggtccctgc

SEQ ID NO: 3889921 - DNA, 14 bp, Homo sapiens
tcaggtgaaaatgt

SEQ ID NO: 3889922 - DNA, 11 bp, Homo sapiens
tcaggtgccac

SEQ ID NO: 3889923 - DNA, 16 bp, Homo sapiens
tcaggtgccactccct

SEQ ID NO: 3889924 - DNA, 19 bp, Homo sapiens
tcaggtgccactccctgag

SEQ ID NO: 3889925 - DNA, 21 bp, Homo sapiens
tcaggtgccactccctgagct

SEQ ID NO: 3889926 - DNA, 14 bp, Homo sapiens
tcaggttgttctgt

SEQ ID NO: 3889927 - DNA, 13 bp, Homo sapiens
tcaggttttgtaa

SEQ ID NO: 3889928 - DNA, 16 bp, Homo sapiens
tcagtaaataatgaaa

SEQ ID NO: 3889929 - DNA, 14 bp, Homo sapiens
tcagtaatttgagg

SEQ ID NO: 3889930 - DNA, 17 bp, Homo sapiens
tcagtaatttgaggaca

SEQ ID NO: 3889931 - DNA, 17 bp, Homo sapiens
tcagtaggtccaagggc

SEQ ID NO: 3889932 - DNA, 20 bp, Homo sapiens
tcagtaggtccaagggccat

SEQ ID NO: 3889933 - DNA, 12 bp, Homo sapiens
tcagtatagcat

SEQ ID NO: 3889934 - DNA, 16 bp, Homo sapiens
tcagtattaatactaa

SEQ ID NO: 3889935 - DNA, 19 bp, Homo sapiens
tcagtattttggagaaatt

SEQ ID NO: 3889936 - DNA, 13 bp, Homo sapiens
tcagtcagttccc

SEQ ID NO: 3889937 - DNA, 15 bp, Homo sapiens
tcagtcagttcccgg

SEQ ID NO: 3889938 - DNA, 14 bp, Homo sapiens
tcagtcatattctt

SEQ ID NO: 3889939 - DNA, 20 bp, Homo sapiens
tcagtcttctctcactttga

SEQ ID NO: 3889940 - DNA, 19 bp, Homo sapiens
tcagtgcacacggatgcac

SEQ ID NO: 3889941 - DNA, 21 bp, Homo sapiens
tcagtgcagtgatacatgtac

SEQ ID NO: 3889942 - DNA, 14 bp, Homo sapiens
tcagtgccacttga

SEQ ID NO: 3889943 - DNA, 17 bp, Homo sapiens
tcagtgccacttgacat

SEQ ID NO: 3889944 - DNA, 21 bp, Homo sapiens
tcagtgccacttgacattcct

SEQ ID NO: 3889945 - DNA, 22 bp, Homo sapiens
tcagtgccacttgacattcctt

SEQ ID NO: 3889946 - DNA, 16 bp, Homo sapiens
tcagtgcctcctggcc

SEQ ID NO: 3889947 - DNA, 15 bp, Homo sapiens
tcagtgggaacgtga

SEQ ID NO: 3889948 - DNA, 13 bp, Homo sapiens
tcagtgggagaaa

SEQ ID NO: 3889949 - DNA, 18 bp, Homo sapiens
tcaccatgtaacaaccag

SEQ ID NO: 3889950 - DNA, 19 bp, Homo sapiens
tcacccaagcaaggccaaa

SEQ ID NO: 3889951 - DNA, 11 bp, Homo sapiens
tcacccacagg

SEQ ID NO: 3889952 - DNA, 12 bp, Homo sapiens
tcacccacaggg

SEQ ID NO: 3889953 - DNA, 23 bp, Homo sapiens
tcacccaggctctggagccagag

SEQ ID NO: 3889954 - DNA, 13 bp, Homo sapiens
tcacccagtcctg

SEQ ID NO: 3889955 - DNA, 14 bp, Homo sapiens
tcacccagtcctgg

SEQ ID NO: 3889956 - DNA, 15 bp, Homo sapiens
tcaccctacctgtgc

SEQ ID NO: 3889957 - DNA, 13 bp, Homo sapiens
tcaccctccacct

SEQ ID NO: 3889958 - DNA, 12 bp, Homo sapiens
tcaccctgcaga

SEQ ID NO: 3889959 - DNA, 17 bp, Homo sapiens
tcaccgacgcgtctcct

SEQ ID NO: 3889960 - DNA, 19 bp, Homo sapiens
tcaccgacttattctgatt

SEQ ID NO: 3889961 - DNA, 23 bp, Homo sapiens
tcaccgagacggctggacctgca

SEQ ID NO: 3889962 - DNA, 14 bp, Homo sapiens
tcaccggagctttc

SEQ ID NO: 3889963 - DNA, 19 bp, Homo sapiens
tcacctactcacacaggca

SEQ ID NO: 3889964 - DNA, 16 bp, Homo sapiens
tcacctcctccactca

SEQ ID NO: 3889965 - DNA, 20 bp, Homo sapiens
tcacctcctccactcactcc

SEQ ID NO: 3889966 - DNA, 23 bp, Homo sapiens
tcacctctctctaagtttagaag

SEQ ID NO: 3889967 - DNA, 15 bp, Homo sapiens
tcacctctgcctcaa

SEQ ID NO: 3889968 - DNA, 17 bp, Homo sapiens
tcacctgaggtcgggag

SEQ ID NO: 3889969 - DNA, 15 bp, Homo sapiens
tcacctgcaagcccc

SEQ ID NO: 3889970 - DNA, 16 bp, Homo sapiens
tcaccttatgtattat

SEQ ID NO: 3889971 - DNA, 19 bp, Homo sapiens
tcaccttgccgagagaggc

SEQ ID NO: 3889972 - DNA, 14 bp, Homo sapiens
tcaccttggagcct

SEQ ID NO: 3889973 - DNA, 20 bp, Homo sapiens
tcaccttggagcctgaacat

SEQ ID NO: 3889974 - DNA, 21 bp, Homo sapiens
tcaccttggagcctgaacatg

SEQ ID NO: 3889975 - DNA, 13 bp, Homo sapiens
tcacgactcttcc

SEQ ID NO: 3889976 - DNA, 14 bp, Homo sapiens
tcacgactcttcct

SEQ ID NO: 3889977 - DNA, 21 bp, Homo sapiens
tcacgcctgtaatcccagcag

SEQ ID NO: 3889978 - DNA, 20 bp, Homo sapiens
tcacgctcccccgcagtccc

SEQ ID NO: 3889979 - DNA, 21 bp, Homo sapiens
tcacgctcccccgcagtcccc

SEQ ID NO: 3889980 - DNA, 18 bp, Homo sapiens
tcacgggcagtagctgtg

SEQ ID NO: 3889981 - DNA, 15 bp, Homo sapiens
tcactatgctatttc

SEQ ID NO: 3889982 - DNA, 24 bp, Homo sapiens
tcactatgctatttctggcctcag

SEQ ID NO: 3889983 - DNA, 13 bp, Homo sapiens
tcactatggtatg

SEQ ID NO: 3889984 - DNA, 17 bp, Homo sapiens
tcactatggtatgctgg

SEQ ID NO: 3889985 - DNA, 22 bp, Homo sapiens
tcactatggtatgctggccagc

SEQ ID NO: 3889986 - DNA, 23 bp, Homo sapiens
tcactatggtatgctggccagca

SEQ ID NO: 3889987 - DNA, 19 bp, Homo sapiens
tcactatgttgcccaggct

SEQ ID NO: 3889988 - DNA, 18 bp, Homo sapiens
tcactattcaagtattag

SEQ ID NO: 3889989 - DNA, 23 bp, Homo sapiens
tcactcaaaaaggtgtgtcaaag

SEQ ID NO: 3889990 - DNA, 13 bp, Homo sapiens
tcactccaccacc

SEQ ID NO: 3889991 - DNA, 14 bp, Homo sapiens
tcactccaccaccc

SEQ ID NO: 3889992 - DNA, 16 bp, Homo sapiens
tcactccaccacccaa

SEQ ID NO: 3889993 - DNA, 18 bp, Homo sapiens
tcactcccataagctaag

SEQ ID NO: 3889994 - DNA, 15 bp, Homo sapiens
tcactcctacctggt

SEQ ID NO: 3889995 - DNA, 20 bp, Homo sapiens
tcactcctgttacttaccta

SEQ ID NO: 3889996 - DNA, 20 bp, Homo sapiens
tcactctacttagcatgtcc

SEQ ID NO: 3889997 - DNA, 18 bp, Homo sapiens
tcactctgtcagccagcc

SEQ ID NO: 3889998 - DNA, 23 bp, Homo sapiens
tcactctgtcagccagccgccct

SEQ ID NO: 3889999 - DNA, 14 bp, Homo sapiens
tcactcttatgaaa

SEQ ID NO: 3890000 - DNA, 17 bp, Homo sapiens
tcactgattgggtgcca

SEQ ID NO: 3890001 - DNA, 15 bp, Homo sapiens
tcactgctggctgcc

SEQ ID NO: 3890002 - DNA, 16 bp, Homo sapiens
tcactgctggctgcct

SEQ ID NO: 3890003 - DNA, 19 bp, Homo sapiens
tcactggagttacattaat

SEQ ID NO: 3890004 - DNA, 14 bp, Homo sapiens
tcactggatgaaga

SEQ ID NO: 3890005 - DNA, 16 bp, Homo sapiens
tcactggcaatgaaaa

SEQ ID NO: 3890006 - DNA, 11 bp, Homo sapiens
tcactggctgg

SEQ ID NO: 3890007 - DNA, 13 bp, Homo sapiens
tcactggctgggg

SEQ ID NO: 3890008 - DNA, 19 bp, Homo sapiens
tcactggtagaccaaaata

SEQ ID NO: 3890009 - DNA, 16 bp, Homo sapiens
tcactgtaagtttatt

SEQ ID NO: 3890010 - DNA, 20 bp, Homo sapiens
tcactgtagaatgatttcat

SEQ ID NO: 3890011 - DNA, 21 bp, Homo sapiens
tcactgtagaatgatttcatg

SEQ ID NO: 3890012 - DNA, 14 bp, Homo sapiens
tcactgtcaatgat

SEQ ID NO: 3890013 - DNA, 23 bp, Homo sapiens
tcactgtcaatgattattttcat

SEQ ID NO: 3890014 - DNA, 18 bp, Homo sapiens
tcactgtccctcaaatga

SEQ ID NO: 3890015 - DNA, 20 bp, Homo sapiens
tcactgtgttggccaggctg

SEQ ID NO: 3890016 - DNA, 15 bp, Homo sapiens
tcactgttgaaaatt

SEQ ID NO: 3890017 - DNA, 20 bp, Homo sapiens
tcactgttgaaaattatttt

SEQ ID NO: 3890018 - DNA, 22 bp, Homo sapiens
tcacttccagtgttggctgtgt

SEQ ID NO: 3890019 - DNA, 13 bp, Homo sapiens
tcacttccctggg

SEQ ID NO: 3890020 - DNA, 18 bp, Homo sapiens
tcacttccctgggaactc

SEQ ID NO: 3890021 - DNA, 19 bp, Homo sapiens
tcacttccctgggaactca

SEQ ID NO: 3890022 - DNA, 15 bp, Homo sapiens
tcactttaattctca

SEQ ID NO: 3890023 - DNA, 16 bp, Homo sapiens
tcactttaattctcat

SEQ ID NO: 3890024 - DNA, 18 bp, Homo sapiens
tcactttaattctcatgt

SEQ ID NO: 3890025 - DNA, 13 bp, Homo sapiens
tcacttttctgta

SEQ ID NO: 3890026 - DNA, 20 bp, Homo sapiens
tcactttttaaaccactgta

SEQ ID NO: 3890027 - DNA, 15 bp, Homo sapiens
tcagaaaagaaaacc

SEQ ID NO: 3890028 - DNA, 10 bp, Homo sapiens
tcagaaaagt

SEQ ID NO: 3890029 - DNA, 13 bp, Homo sapiens
tcagaaaagtaga

SEQ ID NO: 3890030 - DNA, 15 bp, Homo sapiens
tcagaaaccagactc

SEQ ID NO: 3890031 - DNA, 12 bp, Homo sapiens
tcagaaactgtt

SEQ ID NO: 3890032 - DNA, 12 bp, Homo sapiens
tcagaaatatgt

SEQ ID NO: 3890033 - DNA, 15 bp, Homo sapiens
tcagaacatgctgga

SEQ ID NO: 3890034 - DNA, 12 bp, Homo sapiens
tcagaagaaaga

SEQ ID NO: 3890035 - DNA, 21 bp, Homo sapiens
tcagtgtagttaaagggcaga

SEQ ID NO: 3890036 - DNA, 22 bp, Homo sapiens
tcagtgtatggaaataaatgta

SEQ ID NO: 3890037 - DNA, 15 bp, Homo sapiens
tcagttactcagccc

SEQ ID NO: 3890038 - DNA, 16 bp, Homo sapiens
tcagttactcagccct

SEQ ID NO: 3890039 - DNA, 17 bp, Homo sapiens
tcagttactcagccctg

SEQ ID NO: 3890040 - DNA, 14 bp, Homo sapiens
tcagttattcagat

SEQ ID NO: 3890041 - DNA, 23 bp, Homo sapiens
tcagttcccggagcacagccctg

SEQ ID NO: 3890042 - DNA, 18 bp, Homo sapiens
tcagtttctccatcagct

SEQ ID NO: 3890043 - DNA, 14 bp, Homo sapiens
tcagtttgtataga

SEQ ID NO: 3890044 - DNA, 23 bp, Homo sapiens
tcagtttttcggtgggacagccc

SEQ ID NO: 3890045 - DNA, 14 bp, Homo sapiens
tcataaagaattgt

SEQ ID NO: 3890046 - DNA, 14 bp, Homo sapiens
tcataaccattccc

SEQ ID NO: 3890047 - DNA, 13 bp, Homo sapiens
tcataaggcctgc

SEQ ID NO: 3890048 - DNA, 17 bp, Homo sapiens
tcataaggcctgccctc

SEQ ID NO: 3890049 - DNA, 12 bp, Homo sapiens
tcataattttca

SEQ ID NO: 3890050 - DNA, 13 bp, Homo sapiens
tcataattttcaa

SEQ ID NO: 3890051 - DNA, 14 bp, Homo sapiens
tcataattttcaag

SEQ ID NO: 3890052 - DNA, 20 bp, Homo sapiens
tcatagaaatacctcattcg

SEQ ID NO: 3890053 - DNA, 13 bp, Homo sapiens
tcatagaaatgta

SEQ ID NO: 3890054 - DNA, 20 bp, Homo sapiens
tcataggaaaagtacattta

SEQ ID NO: 3890055 - DNA, 18 bp, Homo sapiens
tcataggcggtcatgtgt

SEQ ID NO: 3890056 - DNA, 21 bp, Homo sapiens
tcataggcggtcatgtgtgca

SEQ ID NO: 3890057 - DNA, 23 bp, Homo sapiens
tcatatatttaagccttttgtgt

SEQ ID NO: 3890058 - DNA, 18 bp, Homo sapiens
tcatatccagctgagtga

SEQ ID NO: 3890059 - DNA, 12 bp, Homo sapiens
tcatatgaaaaa

SEQ ID NO: 3890060 - DNA, 15 bp, Homo sapiens
tcatatgtagccctc

SEQ ID NO: 3890061 - DNA, 19 bp, Homo sapiens
tcatattgaatgtttccaa

SEQ ID NO: 3890062 - DNA, 15 bp, Homo sapiens
tcatcaatttttata

SEQ ID NO: 3890063 - DNA, 21 bp, Homo sapiens
tcatcaatttttatacatatc

SEQ ID NO: 3890064 - DNA, 15 bp, Homo sapiens
tcatcactccctgga

SEQ ID NO: 3890065 - DNA, 15 bp, Homo sapiens
tcatcacttttcagt

SEQ ID NO: 3890066 - DNA, 15 bp, Homo sapiens
tcatcatacatgact

SEQ ID NO: 3890067 - DNA, 14 bp, Homo sapiens
tcatcatattgtat

SEQ ID NO: 3890068 - DNA, 17 bp, Homo sapiens
tcatcatattgtatgta

SEQ ID NO: 3890069 - DNA, 20 bp, Homo sapiens
tcatcattgtatatatgtgt

SEQ ID NO: 3890070 - DNA, 21 bp, Homo sapiens
tcatccaccaatctctaagcc

SEQ ID NO: 3890071 - DNA, 19 bp, Homo sapiens
tcatccagttgcaataaaa

SEQ ID NO: 3890072 - DNA, 14 bp, Homo sapiens
tcatcccagcccca

SEQ ID NO: 3890073 - DNA, 14 bp, Homo sapiens
tcatccccaccttg

SEQ ID NO: 3890074 - DNA, 14 bp, Homo sapiens
tcatccccagtccc

SEQ ID NO: 3890075 - DNA, 15 bp, Homo sapiens
tcatccccagtccca

SEQ ID NO: 3890076 - DNA, 20 bp, Homo sapiens
tcatcctggcctccttttgc

SEQ ID NO: 3890077 - DNA, 17 bp, Homo sapiens
tcatcgaacaaactgat

SEQ ID NO: 3890078 - DNA, 19 bp, Homo sapiens
tcatcgaacaaactgatgc

SEQ ID NO: 3890079 - DNA, 17 bp, Homo sapiens
tcatcgccagacaactg

SEQ ID NO: 3890080 - DNA, 19 bp, Homo sapiens
tcatcggaggctgggcccc

SEQ ID NO: 3890081 - DNA, 23 bp, Homo sapiens
tcatcggaggctgggcccctggg

SEQ ID NO: 3890082 - DNA, 20 bp, Homo sapiens
tcatctcaggcctccctcaa

SEQ ID NO: 3890083 - DNA, 18 bp, Homo sapiens
tcatctcctttattgcag

SEQ ID NO: 3890084 - DNA, 20 bp, Homo sapiens
tcatctctctggggccctgg

SEQ ID NO: 3890085 - DNA, 21 bp, Homo sapiens
tcatctctctggggccctggg

SEQ ID NO: 3890086 - DNA, 17 bp, Homo sapiens
tcatctgtgtgaaaatg

SEQ ID NO: 3890087 - DNA, 17 bp, Homo sapiens
tcatctgtttttctttt

SEQ ID NO: 3890088 - DNA, 13 bp, Homo sapiens
tcatcttgacatg

SEQ ID NO: 3890089 - DNA, 14 bp, Homo sapiens
tcatcttgccccct

SEQ ID NO: 3890090 - DNA, 15 bp, Homo sapiens
tcatcttgccccctc

SEQ ID NO: 3890091 - DNA, 19 bp, Homo sapiens
tcatgacatgttatatatt

SEQ ID NO: 3890092 - DNA, 16 bp, Homo sapiens
tcatgaccagcaaata

SEQ ID NO: 3890093 - DNA, 18 bp, Homo sapiens
tcatgacttttccatgta

SEQ ID NO: 3890094 - DNA, 12 bp, Homo sapiens
tcatgagtggat

SEQ ID NO: 3890095 - DNA, 16 bp, Homo sapiens
tcatgatctccctgcc

SEQ ID NO: 3890096 - DNA, 17 bp, Homo sapiens
tcatgccaaagcaaaag

SEQ ID NO: 3890097 - DNA, 16 bp, Homo sapiens
tcatgccatctgtttt

SEQ ID NO: 3890098 - DNA, 13 bp, Homo sapiens
tcatgcctctgag

SEQ ID NO: 3890099 - DNA, 14 bp, Homo sapiens
tcatgcctctgagg

SEQ ID NO: 3890100 - DNA, 16 bp, Homo sapiens
tcatgcctctgaggcc

SEQ ID NO: 3890101 - DNA, 22 bp, Homo sapiens
tcatgcctgcctgataccctgc

SEQ ID NO: 3890102 - DNA, 15 bp, Homo sapiens
tcatgctatctctgt

SEQ ID NO: 3890103 - DNA, 13 bp, Homo sapiens
tcatgcttcagtt

SEQ ID NO: 3890104 - DNA, 19 bp, Homo sapiens
tcatgcttcagttgtactt

SEQ ID NO: 3890105 - DNA, 13 bp, Homo sapiens
tcatgctttaaag

SEQ ID NO: 3890106 - DNA, 23 bp, Homo sapiens
tcatgctttcctaaagtctctgc

SEQ ID NO: 3890107 - DNA, 17 bp, Homo sapiens
tcatgcttttgccactt

SEQ ID NO: 3890108 - DNA, 20 bp, Homo sapiens
tcatggaagtggcagtgaaa

SEQ ID NO: 3890109 - DNA, 21 bp, Homo sapiens
tcatggcagatgtaggaggga

SEQ ID NO: 3890110 - DNA, 22 bp, Homo sapiens
tcatggcagatgtaggagggac

SEQ ID NO: 3890111 - DNA, 20 bp, Homo sapiens
tcatggcgtaatgggcctgc

SEQ ID NO: 3890112 - DNA, 21 bp, Homo sapiens
tcatgggaaaagaccagggct

SEQ ID NO: 3890113 - DNA, 19 bp, Homo sapiens
tcatggtgatcagtgcaat

SEQ ID NO: 3890114 - DNA, 14 bp, Homo sapiens
tcatgtacttcctg

SEQ ID NO: 3890115 - DNA, 23 bp, Homo sapiens
tcatgtacttcctgtgtactctt

SEQ ID NO: 3890116 - DNA, 20 bp, Homo sapiens
tcatgtagattttagttcac

SEQ ID NO: 3890117 - DNA, 19 bp, Homo sapiens
tcatgtctcagcctcctca

SEQ ID NO: 3890118 - DNA, 20 bp, Homo sapiens
tcatgtgatccttttatgtt

SEQ ID NO: 3890119 - DNA, 21 bp, Homo sapiens
tcatgtggaatggattataga

SEQ ID NO: 3890120 - DNA, 17 bp, Homo sapiens
tcatgtgtgcatgtgag

SEQ ID NO: 3890121 - DNA, 11 bp, Homo sapiens
aaaataaaatg

SEQ ID NO: 3890122 - DNA, 14 bp, Homo sapiens
aaaataaacaaata

SEQ ID NO: 3890123 - DNA, 12 bp, Homo sapiens
aaaataaactag

SEQ ID NO: 3890124 - DNA, 14 bp, Homo sapiens
aaaataaactagtt

SEQ ID NO: 3890125 - DNA, 13 bp, Homo sapiens
aaaataaagttgg

SEQ ID NO: 3890126 - DNA, 12 bp, Homo sapiens
aaaataaattga

SEQ ID NO: 3890127 - DNA, 15 bp, Homo sapiens
aaaataaattttgaa

SEQ ID NO: 3890128 - DNA, 14 bp, Homo sapiens
aaaataagctttat

SEQ ID NO: 3890129 - DNA, 13 bp, Homo sapiens
aaaataagtgaat

SEQ ID NO: 3890130 - DNA, 12 bp, Homo sapiens
aaaatacagtaa

SEQ ID NO: 3890131 - DNA, 22 bp, Homo sapiens
aaaatacagtaaagtttaaaaa

SEQ ID NO: 3890132 - DNA, 21 bp, Homo sapiens
aaaatagcaacactctatatt

SEQ ID NO: 3890133 - DNA, 19 bp, Homo sapiens
aaaatagcttgtatagtgt

SEQ ID NO: 3890134 - DNA, 21 bp, Homo sapiens
aaaatagcttgtatagtgtaa

SEQ ID NO: 3890135 - DNA, 18 bp, Homo sapiens
aaaatagtaagcctccct

SEQ ID NO: 3890136 - DNA, 16 bp, Homo sapiens
aaaatagttgtccata

SEQ ID NO: 3890137 - DNA, 20 bp, Homo sapiens
aaaatataaatgcatgattt

SEQ ID NO: 3890138 - DNA, 19 bp, Homo sapiens
aaaatatatatagtgctat

SEQ ID NO: 3890139 - DNA, 21 bp, Homo sapiens
aaaatatatatatatatttaa

SEQ ID NO: 3890140 - DNA, 20 bp, Homo sapiens
aaaatatggaacttctaata

SEQ ID NO: 3890141 - DNA, 13 bp, Homo sapiens
aaaatatgtctcg

SEQ ID NO: 3890142 - DNA, 23 bp, Homo sapiens
aaaatatgtctcgctagtgatgt

SEQ ID NO: 3890143 - DNA, 18 bp, Homo sapiens
aaaatcaaaacaaaaaaa

SEQ ID NO: 3890144 - DNA, 21 bp, Homo sapiens
aaaatcacaagcaataattag

SEQ ID NO: 3890145 - DNA, 13 bp, Homo sapiens
aaaatccttgctt

SEQ ID NO: 3890146 - DNA, 15 bp, Homo sapiens
aaaatctaatattaa

SEQ ID NO: 3890147 - DNA, 12 bp, Homo sapiens
aaaatctgattt

SEQ ID NO: 3890148 - DNA, 22 bp, Homo sapiens
aaaatctgatttaatgttttct

SEQ ID NO: 3890149 - DNA, 17 bp, Homo sapiens
aaaatgaaatgtttttg

SEQ ID NO: 3890150 - DNA, 20 bp, Homo sapiens
aaaatgaaggttaggattta

SEQ ID NO: 3890151 - DNA, 16 bp, Homo sapiens
aaaatgacaaggggag

SEQ ID NO: 3890152 - DNA, 18 bp, Homo sapiens
aaaatgacagatgttgaa

SEQ ID NO: 3890153 - DNA, 17 bp, Homo sapiens
aaaatgagcctgtaatc

SEQ ID NO: 3890154 - DNA, 14 bp, Homo sapiens
aaaatgaggaggat

SEQ ID NO: 3890155 - DNA, 23 bp, Homo sapiens
aaaatgagtttttatggggctga

SEQ ID NO: 3890156 - DNA, 21 bp, Homo sapiens
aaaatgcagtccagaataagt

SEQ ID NO: 3890157 - DNA, 14 bp, Homo sapiens
aaaatgcttctgtt

SEQ ID NO: 3890158 - DNA, 14 bp, Homo sapiens
aaaatggaaagaat

SEQ ID NO: 3890159 - DNA, 23 bp, Homo sapiens
aaaatggcttcagaattaaaact

SEQ ID NO: 3890160 - DNA, 16 bp, Homo sapiens
aaaatgttcagaaggt

SEQ ID NO: 3890161 - DNA, 20 bp, Homo sapiens
aaaattaagacaagcctggc

SEQ ID NO: 3890162 - DNA, 16 bp, Homo sapiens
aaaattcatttcacat

SEQ ID NO: 3890163 - DNA, 20 bp, Homo sapiens
aaaattctcagtcagtaatt

SEQ ID NO: 3890164 - DNA, 9 bp, Homo sapiens
aaaattgca

SEQ ID NO: 3890165 - DNA, 11 bp, Homo sapiens
aaaattgcaca

SEQ ID NO: 3890166 - DNA, 14 bp, Homo sapiens
aaaattgcacaatt

SEQ ID NO: 3890167 - DNA, 16 bp, Homo sapiens
aaaattgcacaatttg

SEQ ID NO: 3890168 - DNA, 17 bp, Homo sapiens
aaaattggtacttgttt

SEQ ID NO: 3890169 - DNA, 22 bp, Homo sapiens
aaaattgtgatgttttgttcaa

SEQ ID NO: 3890170 - DNA, 16 bp, Homo sapiens
aaaatttcaaaagtga

SEQ ID NO: 3890171 - DNA, 18 bp, Homo sapiens
aaaatttcaaaagtgatc

SEQ ID NO: 3890172 - DNA, 13 bp, Homo sapiens
aaaatttcacatt

SEQ ID NO: 3890173 - DNA, 20 bp, Homo sapiens
aaaatttcacattaatattt

SEQ ID NO: 3890174 - DNA, 16 bp, Homo sapiens
aaaatttgttttgacg

SEQ ID NO: 3890175 - DNA, 22 bp, Homo sapiens
aaaatttgttttgacggatgat

SEQ ID NO: 3890176 - DNA, 19 bp, Homo sapiens
aaaattttacttttgttct

SEQ ID NO: 3890177 - DNA, 13 bp, Homo sapiens
aaaattttattcc

SEQ ID NO: 3890178 - DNA, 15 bp, Homo sapiens
aaaattttgtgagtg

SEQ ID NO: 3890179 - DNA, 13 bp, Homo sapiens
aaacaaaaacact

SEQ ID NO: 3890180 - DNA, 14 bp, Homo sapiens
aaacaaaacaacaa

SEQ ID NO: 3890181 - DNA, 16 bp, Homo sapiens
aaacaagaaagaaacg

SEQ ID NO: 3890182 - DNA, 19 bp, Homo sapiens
aaacaagacacccaagtcc

SEQ ID NO: 3890183 - DNA, 19 bp, Homo sapiens
aaacaaggggctgttacat

SEQ ID NO: 3890184 - DNA, 13 bp, Homo sapiens
aaacacactgtaa

SEQ ID NO: 3890185 - DNA, 14 bp, Homo sapiens
aaacacagcaaggg

SEQ ID NO: 3890186 - DNA, 18 bp, Homo sapiens
aaacacatctttcctgtc

SEQ ID NO: 3890187 - DNA, 13 bp, Homo sapiens
aaacacctcccca

SEQ ID NO: 3890188 - DNA, 14 bp, Homo sapiens
aaacacctgacaca

SEQ ID NO: 3890189 - DNA, 17 bp, Homo sapiens
aaacactgaatcatgtt

SEQ ID NO: 3890190 - DNA, 14 bp, Homo sapiens
aaacactgtaatct

SEQ ID NO: 3890191 - DNA, 15 bp, Homo sapiens
aaacactgtaatctt

SEQ ID NO: 3890192 - DNA, 18 bp, Homo sapiens
aaacacttctcatcatat

SEQ ID NO: 3890193 - DNA, 19 bp, Homo sapiens
aaacagaaacaaaaacact

SEQ ID NO: 3890194 - DNA, 15 bp, Homo sapiens
aaacagagacaggcc

SEQ ID NO: 3890195 - DNA, 13 bp, Homo sapiens
aaacagagagaga

SEQ ID NO: 3890196 - DNA, 13 bp, Homo sapiens
aaacagataccat

SEQ ID NO: 3890197 - DNA, 15 bp, Homo sapiens
aaacagatataaatg

SEQ ID NO: 3890198 - DNA, 14 bp, Homo sapiens
aaacagctgtaact

SEQ ID NO: 3890199 - DNA, 12 bp, Homo sapiens
aaacaggaaaaa

SEQ ID NO: 3890200 - DNA, 22 bp, Homo sapiens
aaacaggaaaaaaaataatgta

SEQ ID NO: 3890201 - DNA, 21 bp, Homo sapiens
aaacaggacttaaaatgacat

SEQ ID NO: 3890202 - DNA, 16 bp, Homo sapiens
aaacaggggatcaaag

SEQ ID NO: 3890203 - DNA, 19 bp, Homo sapiens
aaacaggggatcaaagttc

SEQ ID NO: 3890204 - DNA, 21 bp, Homo sapiens
aaacaggggatcaaagttcct

SEQ ID NO: 3890205 - DNA, 15 bp, Homo sapiens
aaacagttcttggac

SEQ ID NO: 3890206 - DNA, 16 bp, Homo sapiens
aaacagttcttggacc

SEQ ID NO: 3890207 - DNA, 24 bp, Homo sapiens
aaacataaaatatacaaacatgtg

SEQ ID NO: 3890208 - DNA, 17 bp, Homo sapiens
aaacttaacatatttac

SEQ ID NO: 3890209 - DNA, 23 bp, Homo sapiens
aaacttatgctagtttattggaa

SEQ ID NO: 3890210 - DNA, 12 bp, Homo sapiens
aaacttatttga

SEQ ID NO: 3890211 - DNA, 13 bp, Homo sapiens
aaacttgaatctg

SEQ ID NO: 3890212 - DNA, 14 bp, Homo sapiens
aaacttgaatctgt

SEQ ID NO: 3890213 - DNA, 14 bp, Homo sapiens
aaactttctctgca

SEQ ID NO: 3890214 - DNA, 15 bp, Homo sapiens
aaactttgtgccttt

SEQ ID NO: 3890215 - DNA, 16 bp, Homo sapiens
aaactttgtgcctttg

SEQ ID NO: 3890216 - DNA, 22 bp, Homo sapiens
aaagaaaccgtaattttattat

SEQ ID NO: 3890217 - DNA, 13 bp, Homo sapiens
aaagaaagaaaca

SEQ ID NO: 3890218 - DNA, 20 bp, Homo sapiens
aaagaactccttattttgta

SEQ ID NO: 3890219 - DNA, 21 bp, Homo sapiens
aaagaactccttattttgtat

SEQ ID NO: 3890220 - DNA, 14 bp, Homo sapiens
aaagaactgcccca

SEQ ID NO: 3890221 - DNA, 16 bp, Homo sapiens
aaagaagtaaatttgt

SEQ ID NO: 3890222 - DNA, 18 bp, Homo sapiens
aaagaagtaaatttgtcc

SEQ ID NO: 3890223 - DNA, 15 bp, Homo sapiens
aaagaagtttgatat

SEQ ID NO: 3890224 - DNA, 18 bp, Homo sapiens
aaagaataaatgaatctt

SEQ ID NO: 3890225 - DNA, 22 bp, Homo sapiens
aaagaatattcagagaatatca

SEQ ID NO: 3890226 - DNA, 15 bp, Homo sapiens
aaagaatccctgcag

SEQ ID NO: 3890227 - DNA, 20 bp, Homo sapiens
aaagaattatttttgtgttt

SEQ ID NO: 3890228 - DNA, 22 bp, Homo sapiens
aaagaattatttttgtgtttct

SEQ ID NO: 3890229 - DNA, 19 bp, Homo sapiens
aaagacacctactgagtgg

SEQ ID NO: 3890230 - DNA, 20 bp, Homo sapiens
aaagaccctgagactccaga

SEQ ID NO: 3890231 - DNA, 20 bp, Homo sapiens
aaagactaatttaaaaaata

SEQ ID NO: 3890232 - DNA, 14 bp, Homo sapiens
aaagactattcaaa

SEQ ID NO: 3890233 - DNA, 23 bp, Homo sapiens
aaagactattcaaacagtctcag

SEQ ID NO: 3890234 - DNA, 13 bp, Homo sapiens
aaagactccaaag

SEQ ID NO: 3890235 - DNA, 14 bp, Homo sapiens
aaagactccaaaga

SEQ ID NO: 3890236 - DNA, 21 bp, Homo sapiens
aaagactccaaagaaatgtaa

SEQ ID NO: 3890237 - DNA, 11 bp, Homo sapiens
aaagacttaag

SEQ ID NO: 3890238 - DNA, 13 bp, Homo sapiens
aaagacttaagat

SEQ ID NO: 3890239 - DNA, 15 bp, Homo sapiens
aaagacttaagatta

SEQ ID NO: 3890240 - DNA, 15 bp, Homo sapiens
aaagacttcatgttc

SEQ ID NO: 3890241 - DNA, 12 bp, Homo sapiens
aaagagaaaaac

SEQ ID NO: 3890242 - DNA, 15 bp, Homo sapiens
aaagagaaaaaccaa

SEQ ID NO: 3890243 - DNA, 17 bp, Homo sapiens
aaagagaaaaagaaatg

SEQ ID NO: 3890244 - DNA, 23 bp, Homo sapiens
aaagagactaatagagacacaga

SEQ ID NO: 3890245 - DNA, 13 bp, Homo sapiens
aaagagagaaaac

SEQ ID NO: 3890246 - DNA, 15 bp, Homo sapiens
aaagagcaagtctgg

SEQ ID NO: 3890247 - DNA, 15 bp, Homo sapiens
aaagaggcagcttga

SEQ ID NO: 3890248 - DNA, 18 bp, Homo sapiens
aaagaggtgaccccaggg

SEQ ID NO: 3890249 - DNA, 16 bp, Homo sapiens
aaagagttcttaagga

SEQ ID NO: 3890250 - DNA, 20 bp, Homo sapiens
aaagataacaagatctttca

SEQ ID NO: 3890251 - DNA, 20 bp, Homo sapiens
aaagatgagctctgaacaaa

SEQ ID NO: 3890252 - DNA, 22 bp, Homo sapiens
aaagatgccgggttttatattt

SEQ ID NO: 3890253 - DNA, 22 bp, Homo sapiens
aaagatggctgtgcctctgcct

SEQ ID NO: 3890254 - DNA, 11 bp, Homo sapiens
aaagatgtgtt

SEQ ID NO: 3890255 - DNA, 21 bp, Homo sapiens
aaagatgtttgtcagatatga

SEQ ID NO: 3890256 - DNA, 20 bp, Homo sapiens
aaagattctagctattattt

SEQ ID NO: 3890257 - DNA, 13 bp, Homo sapiens
aaagcaaaagaag

SEQ ID NO: 3890258 - DNA, 19 bp, Homo sapiens
aaagcaattgccctgtaac

SEQ ID NO: 3890259 - DNA, 19 bp, Homo sapiens
aaagcacaggagacactgt

SEQ ID NO: 3890260 - DNA, 12 bp, Homo sapiens
aaagcacctgcc

SEQ ID NO: 3890261 - DNA, 21 bp, Homo sapiens
aaagcactcccttaggcatta

SEQ ID NO: 3890262 - DNA, 17 bp, Homo sapiens
aaagcactgacttctaa

SEQ ID NO: 3890263 - DNA, 21 bp, Homo sapiens
aaagcagcagctaggactgag

SEQ ID NO: 3890264 - DNA, 18 bp, Homo sapiens
aaagcagtagacaatccc

SEQ ID NO: 3890265 - DNA, 23 bp, Homo sapiens
aaagcagttaactttaagactga

SEQ ID NO: 3890266 - DNA, 23 bp, Homo sapiens
aaagccaacagtcaaaacagaga

SEQ ID NO: 3890267 - DNA, 18 bp, Homo sapiens
aaagccacgttccttact

SEQ ID NO: 3890268 - DNA, 23 bp, Homo sapiens
aaagcccttccatgtcgcctctg

SEQ ID NO: 3890269 - DNA, 17 bp, Homo sapiens
aaagcctatttttcaaa

SEQ ID NO: 3890270 - DNA, 17 bp, Homo sapiens
aaagcctgttcatggca

SEQ ID NO: 3890271 - DNA, 18 bp, Homo sapiens
aaagcctgttcatggcag

SEQ ID NO: 3890272 - DNA, 19 bp, Homo sapiens
aaagcgagatcccatctct

SEQ ID NO: 3890273 - DNA, 21 bp, Homo sapiens
aaagctcatattttgtatata

SEQ ID NO: 3890274 - DNA, 17 bp, Homo sapiens
aaagctctgcatgtgtg

SEQ ID NO: 3890275 - DNA, 15 bp, Homo sapiens
aaagctgcctgtagt

SEQ ID NO: 3890276 - DNA, 21 bp, Homo sapiens
aaagctgcttgactatcacat

SEQ ID NO: 3890277 - DNA, 20 bp, Homo sapiens
aaagctttctgacaagataa

SEQ ID NO: 3890278 - DNA, 21 bp, Homo sapiens
aaagctttgcttatggtaata

SEQ ID NO: 3890279 - DNA, 12 bp, Homo sapiens
aaaggaaggaaa

SEQ ID NO: 3890280 - DNA, 17 bp, Homo sapiens
aaaggaagtcaccaaaa

SEQ ID NO: 3890281 - DNA, 14 bp, Homo sapiens
aaaggaagtctagg

SEQ ID NO: 3890282 - DNA, 15 bp, Homo sapiens
aaaggacattatgtg

SEQ ID NO: 3890283 - DNA, 18 bp, Homo sapiens
aaaggacattatgtgtgc

SEQ ID NO: 3890284 - DNA, 21 bp, Homo sapiens
aaaggaccaactggcttctgt

SEQ ID NO: 3890285 - DNA, 15 bp, Homo sapiens
aaaggagaaaggagc

SEQ ID NO: 3890286 - DNA, 17 bp, Homo sapiens
aaaggagagaagaaagt

SEQ ID NO: 3890287 - DNA, 19 bp, Homo sapiens
aaaggagagaagagagaaa

SEQ ID NO: 3890288 - DNA, 12 bp, Homo sapiens
aaaggagcctgt

SEQ ID NO: 3890289 - DNA, 16 bp, Homo sapiens
aaaggaggcatgcctc

SEQ ID NO: 3890290 - DNA, 19 bp, Homo sapiens
aaaggattaagatacactc

SEQ ID NO: 3890291 - DNA, 21 bp, Homo sapiens
aaaggattaagatacactcct

SEQ ID NO: 3890292 - DNA, 21 bp, Homo sapiens
aaaggcataagaccctaagcc

SEQ ID NO: 3890293 - DNA, 16 bp, Homo sapiens
aaaggcctcatctcct

SEQ ID NO: 3890294 - DNA, 12 bp, Homo sapiens
aacaagaaagaa

SEQ ID NO: 3890295 - DNA, 14 bp, Homo sapiens
aacaagaaagaaac

SEQ ID NO: 3890296 - DNA, 19 bp, Homo sapiens
aacaagatctttcaggaaa

SEQ ID NO: 3890297 - DNA, 20 bp, Homo sapiens
aacaagtcacagctgcagct

SEQ ID NO: 3890298 - DNA, 14 bp, Homo sapiens
aacaatacaacaag

SEQ ID NO: 3890299 - DNA, 15 bp, Homo sapiens
aacaatacaacaaga

SEQ ID NO: 3890300 - DNA, 22 bp, Homo sapiens
aacaatacaacaagaacaacaa

SEQ ID NO: 3890301 - DNA, 23 bp, Homo sapiens
aacaatagctattgcatgtaaaa

SEQ ID NO: 3890302 - DNA, 20 bp, Homo sapiens
aacaatggtttacatgaaca

SEQ ID NO: 3890303 - DNA, 20 bp, Homo sapiens
aacaatgttgttttaagact

SEQ ID NO: 3890304 - DNA, 20 bp, Homo sapiens
aacaatttcctttatattta

SEQ ID NO: 3890305 - DNA, 22 bp, Homo sapiens
aacaatttcctttatatttagt

SEQ ID NO: 3890306 - DNA, 15 bp, Homo sapiens
aacacaaaccacaac

SEQ ID NO: 3890307 - DNA, 18 bp, Homo sapiens
aacacaagacaccttttg

SEQ ID NO: 3890308 - DNA, 16 bp, Homo sapiens
aacacaagccacagaa

SEQ ID NO: 3890309 - DNA, 15 bp, Homo sapiens
aacacaagctggaag

SEQ ID NO: 3890310 - DNA, 20 bp, Homo sapiens
aacacaattgatacttcagg

SEQ ID NO: 3890311 - DNA, 13 bp, Homo sapiens
aacacactgtaaa

SEQ ID NO: 3890312 - DNA, 15 bp, Homo sapiens
aacacactgtaaata

SEQ ID NO: 3890313 - DNA, 21 bp, Homo sapiens
aacacagagctggcgactgca

SEQ ID NO: 3890314 - DNA, 22 bp, Homo sapiens
aacacaggcaaaatccttgctt

SEQ ID NO: 3890315 - DNA, 20 bp, Homo sapiens
aacacagttttgaaagaaaa

SEQ ID NO: 3890316 - DNA, 18 bp, Homo sapiens
aacacattacttgcacaa

SEQ ID NO: 3890317 - DNA, 12 bp, Homo sapiens
aacacccactgg

SEQ ID NO: 3890318 - DNA, 21 bp, Homo sapiens
aacacccatgaatcaaagaca

SEQ ID NO: 3890319 - DNA, 13 bp, Homo sapiens
aacacctcccagg

SEQ ID NO: 3890320 - DNA, 23 bp, Homo sapiens
aacacctcccaggagacagttca

SEQ ID NO: 3890321 - DNA, 18 bp, Homo sapiens
aacactcagaagcctggg

SEQ ID NO: 3890322 - DNA, 20 bp, Homo sapiens
aacactcagaagcctggggg

SEQ ID NO: 3890323 - DNA, 21 bp, Homo sapiens
aacactctctgagatgcccct

SEQ ID NO: 3890324 - DNA, 16 bp, Homo sapiens
aacactgtgtatttat

SEQ ID NO: 3890325 - DNA, 11 bp, Homo sapiens
aacagacagga

SEQ ID NO: 3890326 - DNA, 14 bp, Homo sapiens
aacagacaggagaa

SEQ ID NO: 3890327 - DNA, 20 bp, Homo sapiens
aacagactatttaacttgag

SEQ ID NO: 3890328 - DNA, 13 bp, Homo sapiens
aacagagaaggca

SEQ ID NO: 3890329 - DNA, 11 bp, Homo sapiens
aacagagactc

SEQ ID NO: 3890330 - DNA, 16 bp, Homo sapiens
aacagagactctggaa

SEQ ID NO: 3890331 - DNA, 16 bp, Homo sapiens
aacagagcgggcctct

SEQ ID NO: 3890332 - DNA, 13 bp, Homo sapiens
aacagaggcagga

SEQ ID NO: 3890333 - DNA, 20 bp, Homo sapiens
aacagaggcaggagtggcag

SEQ ID NO: 3890334 - DNA, 19 bp, Homo sapiens
aacagattattaccttaca

SEQ ID NO: 3890335 - DNA, 15 bp, Homo sapiens
aacagcagtgttccc

SEQ ID NO: 3890336 - DNA, 14 bp, Homo sapiens
aacagcctcacaga

SEQ ID NO: 3890337 - DNA, 11 bp, Homo sapiens
aacagctcaga

SEQ ID NO: 3890338 - DNA, 23 bp, Homo sapiens
aacagctcttcactcagccacac

SEQ ID NO: 3890339 - DNA, 19 bp, Homo sapiens
aacaggaaaaaaaataatg

SEQ ID NO: 3890340 - DNA, 19 bp, Homo sapiens
aacaggacttaaaatgaca

SEQ ID NO: 3890341 - DNA, 17 bp, Homo sapiens
aacaggagacaggaagg

SEQ ID NO: 3890342 - DNA, 22 bp, Homo sapiens
aacagggaaggcaggcagggct

SEQ ID NO: 3890343 - DNA, 15 bp, Homo sapiens
aacagggcagtgaca

SEQ ID NO: 3890344 - DNA, 17 bp, Homo sapiens
aacaggggatcaaagtt

SEQ ID NO: 3890345 - DNA, 18 bp, Homo sapiens
aacaggggatcaaagttc

SEQ ID NO: 3890346 - DNA, 19 bp, Homo sapiens
aacaggtggcaggaccagg

SEQ ID NO: 3890347 - DNA, 23 bp, Homo sapiens
aacaggtggcaggaccaggacta

SEQ ID NO: 3890348 - DNA, 13 bp, Homo sapiens
aacagtgcctgct

SEQ ID NO: 3890349 - DNA, 15 bp, Homo sapiens
aacagtgcctgctga

SEQ ID NO: 3890350 - DNA, 15 bp, Homo sapiens
aacataaaatataca

SEQ ID NO: 3890351 - DNA, 19 bp, Homo sapiens
aacataaagcaaatagaca

SEQ ID NO: 3890352 - DNA, 17 bp, Homo sapiens
aacatacccttctttaa

SEQ ID NO: 3890353 - DNA, 13 bp, Homo sapiens
aacatatgtatta

SEQ ID NO: 3890354 - DNA, 22 bp, Homo sapiens
aacatccaaggagaaacagaga

SEQ ID NO: 3890355 - DNA, 16 bp, Homo sapiens
aacatcccattgccct

SEQ ID NO: 3890356 - DNA, 20 bp, Homo sapiens
aacatctattataaaaccat

SEQ ID NO: 3890357 - DNA, 14 bp, Homo sapiens
aacatctcgagccc

SEQ ID NO: 3890358 - DNA, 19 bp, Homo sapiens
aacatgcaattttgcattt

SEQ ID NO: 3890359 - DNA, 12 bp, Homo sapiens
aacatgcacatt

SEQ ID NO: 3890360 - DNA, 19 bp, Homo sapiens
aacatgcacatttatatat

SEQ ID NO: 3890361 - DNA, 19 bp, Homo sapiens
aacatggagaaaccctgtc

SEQ ID NO: 3890362 - DNA, 20 bp, Homo sapiens
aacatggagaaaccctgtct

SEQ ID NO: 3890363 - DNA, 19 bp, Homo sapiens
aacatgtcggagtagaaat

SEQ ID NO: 3890364 - DNA, 20 bp, Homo sapiens
aacatgtttacttttcaggg

SEQ ID NO: 3890365 - DNA, 21 bp, Homo sapiens
aacattaaaagaagactggaa

SEQ ID NO: 3890366 - DNA, 13 bp, Homo sapiens
aacattaaacact

SEQ ID NO: 3890367 - DNA, 16 bp, Homo sapiens
aacattaaacactgta

SEQ ID NO: 3890368 - DNA, 17 bp, Homo sapiens
aacattcaaagcagcag

SEQ ID NO: 3890369 - DNA, 22 bp, Homo sapiens
aacattcacacagggctctttg

SEQ ID NO: 3890370 - DNA, 20 bp, Homo sapiens
aacatttacaataaatattc

SEQ ID NO: 3890371 - DNA, 19 bp, Homo sapiens
aacatttgctttgttttct

SEQ ID NO: 3890372 - DNA, 19 bp, Homo sapiens
aaccaaagagactggagca

SEQ ID NO: 3890373 - DNA, 17 bp, Homo sapiens
aaccaactatttttgag

SEQ ID NO: 3890374 - DNA, 14 bp, Homo sapiens
aaccaagaagggct

SEQ ID NO: 3890375 - DNA, 18 bp, Homo sapiens
aaccaagccgtggcttcc

SEQ ID NO: 3890376 - DNA, 18 bp, Homo sapiens
aaccaagcttcagagcct

SEQ ID NO: 3890377 - DNA, 14 bp, Homo sapiens
aaccaaggcagcct

SEQ ID NO: 3890378 - DNA, 18 bp, Homo sapiens
aaccaatcccgtgaaaga

SEQ ID NO: 3890379 - DNA, 23 bp, Homo sapiens
aaccaatcccgtgaaagaattat

SEQ ID NO: 3890380 - DNA, 17 bp, Homo sapiens
aagactccaaagaaatg

SEQ ID NO: 3890381 - DNA, 15 bp, Homo sapiens
aagactgagcacctg

SEQ ID NO: 3890382 - DNA, 12 bp, Homo sapiens
aagactgcagct

SEQ ID NO: 3890383 - DNA, 13 bp, Homo sapiens
aagactgcagctg

SEQ ID NO: 3890384 - DNA, 15 bp, Homo sapiens
aagactgcagctgct

SEQ ID NO: 3890385 - DNA, 13 bp, Homo sapiens
aagactggaagca

SEQ ID NO: 3890386 - DNA, 24 bp, Homo sapiens
aagactgttgctcaaatctattca

SEQ ID NO: 3890387 - DNA, 13 bp, Homo sapiens
aagacttaagatt

SEQ ID NO: 3890388 - DNA, 15 bp, Homo sapiens
aagacttaagattaa

SEQ ID NO: 3890389 - DNA, 19 bp, Homo sapiens
aagacttggcaacagaagc

SEQ ID NO: 3890390 - DNA, 18 bp, Homo sapiens
aagagaaaaagaaatgca

SEQ ID NO: 3890391 - DNA, 11 bp, Homo sapiens
aagagaaatct

SEQ ID NO: 3890392 - DNA, 12 bp, Homo sapiens
aagagaagaaaa

SEQ ID NO: 3890393 - DNA, 12 bp, Homo sapiens
aagagaataaag

SEQ ID NO: 3890394 - DNA, 21 bp, Homo sapiens
aagagacaaacacctcccagg

SEQ ID NO: 3890395 - DNA, 17 bp, Homo sapiens
aagagacagagccccca

SEQ ID NO: 3890396 - DNA, 21 bp, Homo sapiens
aagagacagagcccccaagcc

SEQ ID NO: 3890397 - DNA, 17 bp, Homo sapiens
aagagacagttatttat

SEQ ID NO: 3890398 - DNA, 21 bp, Homo sapiens
aagagactaatagagacacag

SEQ ID NO: 3890399 - DNA, 14 bp, Homo sapiens
aagagactggagca

SEQ ID NO: 3890400 - DNA, 18 bp, Homo sapiens
aagagactggagcatctg

SEQ ID NO: 3890401 - DNA, 21 bp, Homo sapiens
aagagagaaagaagtaggcat

SEQ ID NO: 3890402 - DNA, 13 bp, Homo sapiens
aagagagagagag

SEQ ID NO: 3890403 - DNA, 15 bp, Homo sapiens
aagagagccctggtc

SEQ ID NO: 3890404 - DNA, 19 bp, Homo sapiens
aagagaggcacctgctgga

SEQ ID NO: 3890405 - DNA, 22 bp, Homo sapiens
aagagagggccatgcaattcat

SEQ ID NO: 3890406 - DNA, 14 bp, Homo sapiens
aagagatacattcc

SEQ ID NO: 3890407 - DNA, 13 bp, Homo sapiens
aagagatgaagag

SEQ ID NO: 3890408 - DNA, 20 bp, Homo sapiens
aagagatgtagcagaataat

SEQ ID NO: 3890409 - DNA, 21 bp, Homo sapiens
aagagatgtggcaaagtgctg

SEQ ID NO: 3890410 - DNA, 15 bp, Homo sapiens
aagagcagcctgatg

SEQ ID NO: 3890411 - DNA, 19 bp, Homo sapiens
aagagcagcctgatggcca

SEQ ID NO: 3890412 - DNA, 21 bp, Homo sapiens
aagagcatcatgcctctgagg

SEQ ID NO: 3890413 - DNA, 16 bp, Homo sapiens
aagagcctggagaagc

SEQ ID NO: 3890414 - DNA, 21 bp, Homo sapiens
aagagcctggagaagctgatg

SEQ ID NO: 3890415 - DNA, 21 bp, Homo sapiens
aagagccttggtgtccacctg

SEQ ID NO: 3890416 - DNA, 20 bp, Homo sapiens
aagagctagcgctgccgcac

SEQ ID NO: 3890417 - DNA, 11 bp, Homo sapiens
aagagctgctg

SEQ ID NO: 3890418 - DNA, 18 bp, Homo sapiens
aagagctgttcacagcca

SEQ ID NO: 3890419 - DNA, 12 bp, Homo sapiens
aagaggaaaaaa

SEQ ID NO: 3890420 - DNA, 19 bp, Homo sapiens
aagaggaaaagtgcaatgc

SEQ ID NO: 3890421 - DNA, 17 bp, Homo sapiens
aagaggcaagagacaga

SEQ ID NO: 3890422 - DNA, 12 bp, Homo sapiens
aagaggcccagg

SEQ ID NO: 3890423 - DNA, 14 bp, Homo sapiens
aagaggcccaggga

SEQ ID NO: 3890424 - DNA, 23 bp, Homo sapiens
aagagggaagaaagagaaggagc

SEQ ID NO: 3890425 - DNA, 19 bp, Homo sapiens
aagagggcctgtgggagcc

SEQ ID NO: 3890426 - DNA, 13 bp, Homo sapiens
aagaggtctgagc

SEQ ID NO: 3890427 - DNA, 17 bp, Homo sapiens
aagaggtgaccccaggg

SEQ ID NO: 3890428 - DNA, 24 bp, Homo sapiens
aagaggtgaccccagggcacagga

SEQ ID NO: 3890429 - DNA, 12 bp, Homo sapiens
aagaggtgggga

SEQ ID NO: 3890430 - DNA, 16 bp, Homo sapiens
aagagtgggctgcatc

SEQ ID NO: 3890431 - DNA, 18 bp, Homo sapiens
aagataaaatatcctcag

SEQ ID NO: 3890432 - DNA, 12 bp, Homo sapiens
aagataaagatg

SEQ ID NO: 3890433 - DNA, 14 bp, Homo sapiens
aagataaagatgat

SEQ ID NO: 3890434 - DNA, 20 bp, Homo sapiens
aagataacaagatctttcag

SEQ ID NO: 3890435 - DNA, 15 bp, Homo sapiens
aagatagcagggcat

SEQ ID NO: 3890436 - DNA, 20 bp, Homo sapiens
aagatatcagagctcttaat

SEQ ID NO: 3890437 - DNA, 22 bp, Homo sapiens
aagatatcagagctcttaatgt

SEQ ID NO: 3890438 - DNA, 18 bp, Homo sapiens
aagatatttatatatatt

SEQ ID NO: 3890439 - DNA, 22 bp, Homo sapiens
aagatcaaaagcttattcatct

SEQ ID NO: 3890440 - DNA, 23 bp, Homo sapiens
aagatgaaaaatggtcccttctt

SEQ ID NO: 3890441 - DNA, 13 bp, Homo sapiens
aagatgaaaatat

SEQ ID NO: 3890442 - DNA, 13 bp, Homo sapiens
aagatgaagagaa

SEQ ID NO: 3890443 - DNA, 23 bp, Homo sapiens
aagatgaagagaagctgagaaga

SEQ ID NO: 3890444 - DNA, 13 bp, Homo sapiens
aagatgacacaag

SEQ ID NO: 3890445 - DNA, 18 bp, Homo sapiens
aagatgagagaactggag

SEQ ID NO: 3890446 - DNA, 19 bp, Homo sapiens
aagatgagatttgccagca

SEQ ID NO: 3890447 - DNA, 16 bp, Homo sapiens
aagatgagctctgaac

SEQ ID NO: 3890448 - DNA, 21 bp, Homo sapiens
aagatgagctctgaacaaaca

SEQ ID NO: 3890449 - DNA, 17 bp, Homo sapiens
aagatgatctactcaga

SEQ ID NO: 3890450 - DNA, 11 bp, Homo sapiens
aagatgccctc

SEQ ID NO: 3890451 - DNA, 22 bp, Homo sapiens
aagatggactctgaaaaacatt

SEQ ID NO: 3890452 - DNA, 14 bp, Homo sapiens
aagatgggcacatg

SEQ ID NO: 3890453 - DNA, 19 bp, Homo sapiens
aagatgggcacatgaggag

SEQ ID NO: 3890454 - DNA, 14 bp, Homo sapiens
aagatggtagcaga

SEQ ID NO: 3890455 - DNA, 12 bp, Homo sapiens
aagatgtgttgt

SEQ ID NO: 3890456 - DNA, 13 bp, Homo sapiens
aagatgttgtcat

SEQ ID NO: 3890457 - DNA, 15 bp, Homo sapiens
aagattcaaagagac

SEQ ID NO: 3890458 - DNA, 18 bp, Homo sapiens
aagattcccagagacagg

SEQ ID NO: 3890459 - DNA, 19 bp, Homo sapiens
aagattcccagagacagga

SEQ ID NO: 3890460 - DNA, 16 bp, Homo sapiens
aagattgcttaaaata

SEQ ID NO: 3890461 - DNA, 22 bp, Homo sapiens
aagattggacatggtctcctct

SEQ ID NO: 3890462 - DNA, 21 bp, Homo sapiens
aagatttttaattacaataat

SEQ ID NO: 3890463 - DNA, 20 bp, Homo sapiens
aagattttttttgtaacttc

SEQ ID NO: 3890464 - DNA, 17 bp, Homo sapiens
aagcaaagcaccagctt

SEQ ID NO: 3890465 - DNA, 13 bp, Homo sapiens
aagcaaatttcaa

SEQ ID NO: 3890466 - DNA, 16 bp, Homo sapiens
aagcaagggctccagc

SEQ ID NO: 3890467 - DNA, 19 bp, Homo sapiens
aagggagaagaaatccata

SEQ ID NO: 3890468 - DNA, 17 bp, Homo sapiens
aagggagagcggggcag

SEQ ID NO: 3890469 - DNA, 24 bp, Homo sapiens
aagggagcactgggttgactttca

SEQ ID NO: 3890470 - DNA, 13 bp, Homo sapiens
aagggagggctct

SEQ ID NO: 3890471 - DNA, 14 bp, Homo sapiens
aagggagggctctg

SEQ ID NO: 3890472 - DNA, 18 bp, Homo sapiens
aagggagggctctgaggc

SEQ ID NO: 3890473 - DNA, 19 bp, Homo sapiens
aagggagggctctgaggcg

SEQ ID NO: 3890474 - DNA, 17 bp, Homo sapiens
aagggagttgctcactc

SEQ ID NO: 3890475 - DNA, 13 bp, Homo sapiens
aagggcagccagg

SEQ ID NO: 3890476 - DNA, 14 bp, Homo sapiens
aagggcagccaggg

SEQ ID NO: 3890477 - DNA, 19 bp, Homo sapiens
aagggcagccaggggctgc

SEQ ID NO: 3890478 - DNA, 9 bp, Homo sapiens
aagggccag

SEQ ID NO: 3890479 - DNA, 12 bp, Homo sapiens
aagggccagccc

SEQ ID NO: 3890480 - DNA, 14 bp, Homo sapiens
aagggccagcccta

SEQ ID NO: 3890481 - DNA, 16 bp, Homo sapiens
aagggccaggagagag

SEQ ID NO: 3890482 - DNA, 18 bp, Homo sapiens
aagggccaggagagagat

SEQ ID NO: 3890483 - DNA, 17 bp, Homo sapiens
aagggccatgctgaagg

SEQ ID NO: 3890484 - DNA, 17 bp, Homo sapiens
aagggctagaacctgga

SEQ ID NO: 3890485 - DNA, 21 bp, Homo sapiens
aagggctccagcatccagcct

SEQ ID NO: 3890486 - DNA, 18 bp, Homo sapiens
aagggctgacctgcctct

SEQ ID NO: 3890487 - DNA, 19 bp, Homo sapiens
aaggggagaagggccagcc

SEQ ID NO: 3890488 - DNA, 14 bp, Homo sapiens
aaggggcacaccac

SEQ ID NO: 3890489 - DNA, 17 bp, Homo sapiens
aaggggcacaccactgc

SEQ ID NO: 3890490 - DNA, 21 bp, Homo sapiens
aaggggcacaccactgccctg

SEQ ID NO: 3890491 - DNA, 23 bp, Homo sapiens
aaggggcacctgggaaaacagag

SEQ ID NO: 3890492 - DNA, 16 bp, Homo sapiens
aaggggcagataaagg

SEQ ID NO: 3890493 - DNA, 17 bp, Homo sapiens
aaggggctcagcaaggt

SEQ ID NO: 3890494 - DNA, 19 bp, Homo sapiens
aagggggagtttttagttt

SEQ ID NO: 3890495 - DNA, 16 bp, Homo sapiens
aagggggtccacccag

SEQ ID NO: 3890496 - DNA, 14 bp, Homo sapiens
aagggtaagggaga

SEQ ID NO: 3890497 - DNA, 17 bp, Homo sapiens
aagggtaagggagaggg

SEQ ID NO: 3890498 - DNA, 13 bp, Homo sapiens
aagggtccagaag

SEQ ID NO: 3890499 - DNA, 22 bp, Homo sapiens
aagggtctagggagagaccctt

SEQ ID NO: 3890500 - DNA, 16 bp, Homo sapiens
aagggtcttcttggca

SEQ ID NO: 3890501 - DNA, 21 bp, Homo sapiens
aagggtgatgggaaagcattg

SEQ ID NO: 3890502 - DNA, 15 bp, Homo sapiens
aagggttgaaggcag

SEQ ID NO: 3890503 - DNA, 17 bp, Homo sapiens
aagggttgaaggcagtc

SEQ ID NO: 3890504 - DNA, 19 bp, Homo sapiens
aagggttggtgggctggcc

SEQ ID NO: 3890505 - DNA, 23 bp, Homo sapiens
aagggtttctgacccaagaggtg

SEQ ID NO: 3890506 - DNA, 17 bp, Homo sapiens
aaggtagaacctcacct

SEQ ID NO: 3890507 - DNA, 22 bp, Homo sapiens
aaggtagacatggatttgatga

SEQ ID NO: 3890508 - DNA, 18 bp, Homo sapiens
aaggtagagatgtgtgtg

SEQ ID NO: 3890509 - DNA, 17 bp, Homo sapiens
aaggtcattgtggctat

SEQ ID NO: 3890510 - DNA, 21 bp, Homo sapiens
aaggtctccttactctgagcc

SEQ ID NO: 3890511 - DNA, 12 bp, Homo sapiens
aaggtctgcttt

SEQ ID NO: 3890512 - DNA, 23 bp, Homo sapiens
aaggtcttcttgtgtcctgatga

SEQ ID NO: 3890513 - DNA, 12 bp, Homo sapiens
aaggtctttgca

SEQ ID NO: 3890514 - DNA, 13 bp, Homo sapiens
aaggtctttggtt

SEQ ID NO: 3890515 - DNA, 18 bp, Homo sapiens
aaggtgcagtaggagcaa

SEQ ID NO: 3890516 - DNA, 18 bp, Homo sapiens
aaggtgcctgtgaggcag

SEQ ID NO: 3890517 - DNA, 14 bp, Homo sapiens
aaggtgctgagctt

SEQ ID NO: 3890518 - DNA, 15 bp, Homo sapiens
aaggtgggtccagga

SEQ ID NO: 3890519 - DNA, 17 bp, Homo sapiens
aaggtgtaaaatatcta

SEQ ID NO: 3890520 - DNA, 23 bp, Homo sapiens
aaggtgtaaaatatctacctgcc

SEQ ID NO: 3890521 - DNA, 18 bp, Homo sapiens
aaggttaggatttaacag

SEQ ID NO: 3890522 - DNA, 19 bp, Homo sapiens
aaggttcttcatccctttc

SEQ ID NO: 3890523 - DNA, 20 bp, Homo sapiens
aaggttcttcatccctttcc

SEQ ID NO: 3890524 - DNA, 13 bp, Homo sapiens
aaggtttggtgtg

SEQ ID NO: 3890525 - DNA, 15 bp, Homo sapiens
aagtaaaaccacagc

SEQ ID NO: 3890526 - DNA, 15 bp, Homo sapiens
aagtaacttttacaa

SEQ ID NO: 3890527 - DNA, 13 bp, Homo sapiens
aagtagaagagga

SEQ ID NO: 3890528 - DNA, 16 bp, Homo sapiens
aagtagaagaggagga

SEQ ID NO: 3890529 - DNA, 17 bp, Homo sapiens
aagtagaattatatcta

SEQ ID NO: 3890530 - DNA, 21 bp, Homo sapiens
aagtagaattatatctaattt

SEQ ID NO: 3890531 - DNA, 23 bp, Homo sapiens
aagtagaattatatctaatttat

SEQ ID NO: 3890532 - DNA, 17 bp, Homo sapiens
aagtagatagaaagcaa

SEQ ID NO: 3890533 - DNA, 21 bp, Homo sapiens
aagtagggacttctgtcttca

SEQ ID NO: 3890534 - DNA, 20 bp, Homo sapiens
aagtagtttgtataacttct

SEQ ID NO: 3890535 - DNA, 23 bp, Homo sapiens
aagtataaagtcacttccagtgt

SEQ ID NO: 3890536 - DNA, 18 bp, Homo sapiens
aagtatatagtatattta

SEQ ID NO: 3890537 - DNA, 13 bp, Homo sapiens
aagtatatattta

SEQ ID NO: 3890538 - DNA, 14 bp, Homo sapiens
aagtatcatgcatt

SEQ ID NO: 3890539 - DNA, 15 bp, Homo sapiens
aagtatcatgcattc

SEQ ID NO: 3890540 - DNA, 21 bp, Homo sapiens
aagtatgtaaacaggagacag

SEQ ID NO: 3890541 - DNA, 20 bp, Homo sapiens
aagtattaggggtaatatat

SEQ ID NO: 3890542 - DNA, 18 bp, Homo sapiens
aagtatttttttaagtta

SEQ ID NO: 3890543 - DNA, 23 bp, Homo sapiens
aagtatttttttaagttagagaa

SEQ ID NO: 3890544 - DNA, 17 bp, Homo sapiens
aagtcaacactcttctt

SEQ ID NO: 3890545 - DNA, 14 bp, Homo sapiens
aagtcaacatcttc

SEQ ID NO: 3890546 - DNA, 18 bp, Homo sapiens
aagtcaacatcttctctc

SEQ ID NO: 3890547 - DNA, 13 bp, Homo sapiens
aagtcaaggagaa

SEQ ID NO: 3890548 - DNA, 13 bp, Homo sapiens
aagtcacagctgc

SEQ ID NO: 3890549 - DNA, 20 bp, Homo sapiens
aagtcaccactccattccca

SEQ ID NO: 3890550 - DNA, 14 bp, Homo sapiens
aagtcacttccagt

SEQ ID NO: 3890551 - DNA, 19 bp, Homo sapiens
aagtcatgatggagacttc

SEQ ID NO: 3890552 - DNA, 16 bp, Homo sapiens
aagtccaacctgcctg

SEQ ID NO: 3890553 - DNA, 17 bp, Homo sapiens
aagtccaagcataccaa

SEQ ID NO: 3890554 - DNA, 20 bp, Homo sapiens
aatcctagaaccaagcttca

SEQ ID NO: 3890555 - DNA, 23 bp, Homo sapiens
aatcctagaaccaagcttcagag

SEQ ID NO: 3890556 - DNA, 11 bp, Homo sapiens
aatcctctggc

SEQ ID NO: 3890557 - DNA, 20 bp, Homo sapiens
aatcctctggggttcatcta

SEQ ID NO: 3890558 - DNA, 22 bp, Homo sapiens
aatcctgaagaaaccacaggtt

SEQ ID NO: 3890559 - DNA, 13 bp, Homo sapiens
aatcctgcctctc

SEQ ID NO: 3890560 - DNA, 17 bp, Homo sapiens
aatccttgcttatgaca

SEQ ID NO: 3890561 - DNA, 18 bp, Homo sapiens
aatccttgcttatgacat

SEQ ID NO: 3890562 - DNA, 18 bp, Homo sapiens
aatcggcccacagctccc

SEQ ID NO: 3890563 - DNA, 16 bp, Homo sapiens
aatctaatattaaaaa

SEQ ID NO: 3890564 - DNA, 17 bp, Homo sapiens
aatctaatattaaaaat

SEQ ID NO: 3890565 - DNA, 20 bp, Homo sapiens
aatctaatattaaaaatatg

SEQ ID NO: 3890566 - DNA, 20 bp, Homo sapiens
aatctagatcaattaattct

SEQ ID NO: 3890567 - DNA, 21 bp, Homo sapiens
aatctagatcaattaattctt

SEQ ID NO: 3890568 - DNA, 19 bp, Homo sapiens
aatctagttttttttgtaa

SEQ ID NO: 3890569 - DNA, 21 bp, Homo sapiens
aatctagttttttttgtaaac

SEQ ID NO: 3890570 - DNA, 23 bp, Homo sapiens
aatctagttttttttgtaaactg

SEQ ID NO: 3890571 - DNA, 14 bp, Homo sapiens
aatctatattaaag

SEQ ID NO: 3890572 - DNA, 21 bp, Homo sapiens
aattgtaaaattgtatagaga

SEQ ID NO: 3890573 - DNA, 18 bp, Homo sapiens
aattgtacattccctgca

SEQ ID NO: 3890574 - DNA, 13 bp, Homo sapiens
aattgtatacatt

SEQ ID NO: 3890575 - DNA, 18 bp, Homo sapiens
aattgtattttatatgag

SEQ ID NO: 3890576 - DNA, 18 bp, Homo sapiens
aattgtccctgtttcaaa

SEQ ID NO: 3890577 - DNA, 20 bp, Homo sapiens
aattgtttggcttcctcctg

SEQ ID NO: 3890578 - DNA, 20 bp, Homo sapiens
aatttaaaccagcagaaaag

SEQ ID NO: 3890579 - DNA, 22 bp, Homo sapiens
aatttaaaccagcagaaaagtg

SEQ ID NO: 3890580 - DNA, 17 bp, Homo sapiens
aatttaactaatttaaa

SEQ ID NO: 3890581 - DNA, 19 bp, Homo sapiens
aatttaataaaaacttcag

SEQ ID NO: 3890582 - DNA, 18 bp, Homo sapiens
aatttagcagtccaaaga

SEQ ID NO: 3890583 - DNA, 20 bp, Homo sapiens
aatttatacaaaataattta

SEQ ID NO: 3890584 - DNA, 22 bp, Homo sapiens
aatttatacaaaataatttaac

SEQ ID NO: 3890585 - DNA, 17 bp, Homo sapiens
aatttatatttgaaatt

SEQ ID NO: 3890586 - DNA, 18 bp, Homo sapiens
aatttatcctgaaatttc

SEQ ID NO: 3890587 - DNA, 19 bp, Homo sapiens
aatttatcctgaaatttca

SEQ ID NO: 3890588 - DNA, 15 bp, Homo sapiens
aatttattaaaatga

SEQ ID NO: 3890589 - DNA, 19 bp, Homo sapiens
aatttattacttgttgcaa

SEQ ID NO: 3890590 - DNA, 18 bp, Homo sapiens
aatttattagttaatata

SEQ ID NO: 3890591 - DNA, 16 bp, Homo sapiens
aatttattattgttct

SEQ ID NO: 3890592 - DNA, 19 bp, Homo sapiens
aatttcaaccagcattcat

SEQ ID NO: 3890593 - DNA, 16 bp, Homo sapiens
aatttcaggcattttg

SEQ ID NO: 3890594 - DNA, 21 bp, Homo sapiens
aatttcaggcattttgttcta

SEQ ID NO: 3890595 - DNA, 20 bp, Homo sapiens
aatttcaggttttgtaaaga

SEQ ID NO: 3890596 - DNA, 22 bp, Homo sapiens
aatttcaggttttgtaaagatg

SEQ ID NO: 3890597 - DNA, 22 bp, Homo sapiens
aatttcccacaccccagcgcct

SEQ ID NO: 3890598 - DNA, 16 bp, Homo sapiens
aatttctaccatttca

SEQ ID NO: 3890599 - DNA, 21 bp, Homo sapiens
aatttcttcactgttgaaaat

SEQ ID NO: 3890600 - DNA, 14 bp, Homo sapiens
aatttgagcaattc

SEQ ID NO: 3890601 - DNA, 14 bp, Homo sapiens
aatttgaggacaac

SEQ ID NO: 3890602 - DNA, 20 bp, Homo sapiens
aatttgatacatatgtgaat

SEQ ID NO: 3890603 - DNA, 15 bp, Homo sapiens
aatttgggcctcttg

SEQ ID NO: 3890604 - DNA, 19 bp, Homo sapiens
aatttgggcctcttgtaca

SEQ ID NO: 3890605 - DNA, 15 bp, Homo sapiens
aatttgtaagtttat

SEQ ID NO: 3890606 - DNA, 20 bp, Homo sapiens
aatttgtacatatgtaaaat

SEQ ID NO: 3890607 - DNA, 12 bp, Homo sapiens
aatttgtatctg

SEQ ID NO: 3890608 - DNA, 18 bp, Homo sapiens
aatttgtatctgaaggag

SEQ ID NO: 3890609 - DNA, 19 bp, Homo sapiens
aatttgtatctgaaggaga

SEQ ID NO: 3890610 - DNA, 14 bp, Homo sapiens
aattttaacatttt

SEQ ID NO: 3890611 - DNA, 17 bp, Homo sapiens
aattttaacttaaattt

SEQ ID NO: 3890612 - DNA, 21 bp, Homo sapiens
aattttacttttgttctgtat

SEQ ID NO: 3890613 - DNA, 23 bp, Homo sapiens
aattttattggtaggatttatat

SEQ ID NO: 3890614 - DNA, 15 bp, Homo sapiens
aattttcaagagaag

SEQ ID NO: 3890615 - DNA, 20 bp, Homo sapiens
aattttcaagagaagaaaaa

SEQ ID NO: 3890616 - DNA, 12 bp, Homo sapiens
aattttctagac

SEQ ID NO: 3890617 - DNA, 15 bp, Homo sapiens
aattttctagacttt

SEQ ID NO: 3890618 - DNA, 22 bp, Homo sapiens
aattttctggaatacatgaaat

SEQ ID NO: 3890619 - DNA, 20 bp, Homo sapiens
aattttcttacccatatatc

SEQ ID NO: 3890620 - DNA, 18 bp, Homo sapiens
aattttgaatgtttatgt

SEQ ID NO: 3890621 - DNA, 16 bp, Homo sapiens
aattttgtatgaaaaa

SEQ ID NO: 3890622 - DNA, 12 bp, Homo sapiens
aattttgtttca

SEQ ID NO: 3890623 - DNA, 13 bp, Homo sapiens
aattttgtttgta

SEQ ID NO: 3890624 - DNA, 18 bp, Homo sapiens
aattttgtttgtaatcct

SEQ ID NO: 3890625 - DNA, 13 bp, Homo sapiens
aatttttaaacta

SEQ ID NO: 3890626 - DNA, 18 bp, Homo sapiens
aatttttaaactagtaat

SEQ ID NO: 3890627 - DNA, 19 bp, Homo sapiens
aatttttaaagtatatatt

SEQ ID NO: 3890628 - DNA, 20 bp, Homo sapiens
aatttttaaagtatatattt

SEQ ID NO: 3890629 - DNA, 21 bp, Homo sapiens
aatttttaatgactttttata

SEQ ID NO: 3890630 - DNA, 16 bp, Homo sapiens
aatttttacatgacca

SEQ ID NO: 3890631 - DNA, 14 bp, Homo sapiens
aatttttatacata

SEQ ID NO: 3890632 - DNA, 19 bp, Homo sapiens
aatttttatacatatcaga

SEQ ID NO: 3890633 - DNA, 21 bp, Homo sapiens
aatttttatacatatcagaaa

SEQ ID NO: 3890634 - DNA, 16 bp, Homo sapiens
aatttttatttttcta

SEQ ID NO: 3890635 - DNA, 21 bp, Homo sapiens
aatttttcagctctctgtata

SEQ ID NO: 3890636 - DNA, 19 bp, Homo sapiens
aattttttgatgtcagcct

SEQ ID NO: 3890637 - DNA, 19 bp, Homo sapiens
aatttttttatactaccaa

SEQ ID NO: 3890638 - DNA, 20 bp, Homo sapiens
aattttttttaatgtacaag

SEQ ID NO: 3890639 - DNA, 12 bp, Homo sapiens
acaaaaaagaag

SEQ ID NO: 3890640 - DNA, 14 bp, Homo sapiens
acaaaaacaaaaca

SEQ ID NO: 3890641 - DNA, 14 bp, Homo sapiens
acaaaaacacagca

SEQ ID NO: 3890642 - DNA, 15 bp, Homo sapiens
acaaaaacacagcaa

SEQ ID NO: 3890643 - DNA, 16 bp, Homo sapiens
acaaaaacacagcaag

SEQ ID NO: 3890644 - DNA, 21 bp, Homo sapiens
acaaaaatgtaatgatcataa

SEQ ID NO: 3890645 - DNA, 13 bp, Homo sapiens
acaaaacaacaac

SEQ ID NO: 3890646 - DNA, 16 bp, Homo sapiens
acaaaacaagaaagaa

SEQ ID NO: 3890647 - DNA, 13 bp, Homo sapiens
acaaaacttcctg

SEQ ID NO: 3890648 - DNA, 14 bp, Homo sapiens
acaaaagagagaat

SEQ ID NO: 3890649 - DNA, 23 bp, Homo sapiens
acaaaagcaagactgttgctcaa

SEQ ID NO: 3890650 - DNA, 12 bp, Homo sapiens
acaaaataattt

SEQ ID NO: 3890651 - DNA, 13 bp, Homo sapiens
acaaaataattta

SEQ ID NO: 3890652 - DNA, 21 bp, Homo sapiens
acaaaataatttaactaattt

SEQ ID NO: 3890653 - DNA, 12 bp, Homo sapiens
acaaaatagaag

SEQ ID NO: 3890654 - DNA, 15 bp, Homo sapiens
acaaaatagaagctg

SEQ ID NO: 3890655 - DNA, 18 bp, Homo sapiens
acaaaatagaagctgtag

SEQ ID NO: 3890656 - DNA, 13 bp, Homo sapiens
acaaaatcacaag

SEQ ID NO: 3890657 - DNA, 15 bp, Homo sapiens
acaaaatcacaagca

SEQ ID NO: 3890658 - DNA, 23 bp, Homo sapiens
acaaaatcacaagcaataattag

SEQ ID NO: 3890659 - DNA, 15 bp, Homo sapiens
cctctttactccctt

SEQ ID NO: 3890660 - DNA, 16 bp, Homo sapiens
cctctttccccacctc

SEQ ID NO: 3890661 - DNA, 17 bp, Homo sapiens
cctctttccccacctct

SEQ ID NO: 3890662 - DNA, 22 bp, Homo sapiens
cctctttctacattctcatcta

SEQ ID NO: 3890663 - DNA, 15 bp, Homo sapiens
cctctttctctcctt

SEQ ID NO: 3890664 - DNA, 17 bp, Homo sapiens
cctctttctctccttct

SEQ ID NO: 3890665 - DNA, 14 bp, Homo sapiens
cctgaaaaactgat

SEQ ID NO: 3890666 - DNA, 13 bp, Homo sapiens
cctgaaaattgta

SEQ ID NO: 3890667 - DNA, 14 bp, Homo sapiens
cctgaaatttcaga

SEQ ID NO: 3890668 - DNA, 15 bp, Homo sapiens
cctgaacatgacatt

SEQ ID NO: 3890669 - DNA, 20 bp, Homo sapiens
cctgaaccccatgggcttgg

SEQ ID NO: 3890670 - DNA, 14 bp, Homo sapiens
cctgaacctcagtt

SEQ ID NO: 3890671 - DNA, 18 bp, Homo sapiens
cctgaacctcagtttcct

SEQ ID NO: 3890672 - DNA, 14 bp, Homo sapiens
cctgaagaacagta

SEQ ID NO: 3890673 - DNA, 13 bp, Homo sapiens
cctgaagcctctg

SEQ ID NO: 3890674 - DNA, 15 bp, Homo sapiens
cctgaagcctctgcc

SEQ ID NO: 3890675 - DNA, 21 bp, Homo sapiens
cctgaagcctctgccctgcct

SEQ ID NO: 3890676 - DNA, 20 bp, Homo sapiens
cctgaagggtgacatcccag

SEQ ID NO: 3890677 - DNA, 15 bp, Homo sapiens
cctgaaggttcctga

SEQ ID NO: 3890678 - DNA, 20 bp, Homo sapiens
cctgaatataacaaccttta

SEQ ID NO: 3890679 - DNA, 16 bp, Homo sapiens
cctgacagaaggactc

SEQ ID NO: 3890680 - DNA, 14 bp, Homo sapiens
cctgacatgtctca

SEQ ID NO: 3890681 - DNA, 21 bp, Homo sapiens
cctgacattaagacacacctc

SEQ ID NO: 3890682 - DNA, 23 bp, Homo sapiens
cctgacattaagacacacctctg

SEQ ID NO: 3890683 - DNA, 19 bp, Homo sapiens
cctgaccaacatggagaaa

SEQ ID NO: 3890684 - DNA, 13 bp, Homo sapiens
cctgaccggcacc

SEQ ID NO: 3890685 - DNA, 19 bp, Homo sapiens
cctgaccggcacctgcgag

SEQ ID NO: 3890686 - DNA, 12 bp, Homo sapiens
cctgacctccca

SEQ ID NO: 3890687 - DNA, 15 bp, Homo sapiens
cctgacctcccagcc

SEQ ID NO: 3890688 - DNA, 14 bp, Homo sapiens
cctgacctgaggct

SEQ ID NO: 3890689 - DNA, 15 bp, Homo sapiens
cctgacctgaggctc

SEQ ID NO: 3890690 - DNA, 18 bp, Homo sapiens
cctgacgccctgcgttgg

SEQ ID NO: 3890691 - DNA, 21 bp, Homo sapiens
cctgacgccctgcgttggagc

SEQ ID NO: 3890692 - DNA, 13 bp, Homo sapiens
cctgactcctcta

SEQ ID NO: 3890693 - DNA, 20 bp, Homo sapiens
cctgactcctctaagccact

SEQ ID NO: 3890694 - DNA, 21 bp, Homo sapiens
cctgactggtgctataggctg

SEQ ID NO: 3890695 - DNA, 19 bp, Homo sapiens
cctgagaaggcgaggagag

SEQ ID NO: 3890696 - DNA, 22 bp, Homo sapiens
cctgagaataagaaagtttcac

SEQ ID NO: 3890697 - DNA, 22 bp, Homo sapiens
cctgagaccagttgggagcact

SEQ ID NO: 3890698 - DNA, 15 bp, Homo sapiens
cctgagatcagagtc

SEQ ID NO: 3890699 - DNA, 16 bp, Homo sapiens
cctgagcactgccagg

SEQ ID NO: 3890700 - DNA, 16 bp, Homo sapiens
cctgagcccaggagct

SEQ ID NO: 3890701 - DNA, 13 bp, Homo sapiens
cctgagcccaggg

SEQ ID NO: 3890702 - DNA, 16 bp, Homo sapiens
cctgagcccagggagg

SEQ ID NO: 3890703 - DNA, 17 bp, Homo sapiens
cctgagcccagggaggc

SEQ ID NO: 3890704 - DNA, 18 bp, Homo sapiens
cctgagcccagggaggcc

SEQ ID NO: 3890705 - DNA, 12 bp, Homo sapiens
cctgagcctgcc

SEQ ID NO: 3890706 - DNA, 13 bp, Homo sapiens
cctgagcctgccg

SEQ ID NO: 3890707 - DNA, 14 bp, Homo sapiens
cctgagcctgccga

SEQ ID NO: 3890708 - DNA, 17 bp, Homo sapiens
cctgagcctgccgagca

SEQ ID NO: 3890709 - DNA, 11 bp, Homo sapiens
cctgagctaga

SEQ ID NO: 3890710 - DNA, 14 bp, Homo sapiens
cctgaggagtctga

SEQ ID NO: 3890711 - DNA, 15 bp, Homo sapiens
cctgaggctcaagag

SEQ ID NO: 3890712 - DNA, 16 bp, Homo sapiens
cctgaggctcaagagg

SEQ ID NO: 3890713 - DNA, 18 bp, Homo sapiens
cctgaggctcaagaggcc

SEQ ID NO: 3890714 - DNA, 16 bp, Homo sapiens
cctgagggtggagact

SEQ ID NO: 3890715 - DNA, 18 bp, Homo sapiens
cctgagtcaactggagca

SEQ ID NO: 3890716 - DNA, 19 bp, Homo sapiens
cctgagtcaactggagcaa

SEQ ID NO: 3890717 - DNA, 22 bp, Homo sapiens
cctgagtcaactggagcaagaa

SEQ ID NO: 3890718 - DNA, 15 bp, Homo sapiens
cctgagtcaccagga

SEQ ID NO: 3890719 - DNA, 19 bp, Homo sapiens
cctgagtcggccccacatg

SEQ ID NO: 3890720 - DNA, 16 bp, Homo sapiens
cctgagtctcctgtgc

SEQ ID NO: 3890721 - DNA, 19 bp, Homo sapiens
cctgagtcttggcctgcct

SEQ ID NO: 3890722 - DNA, 18 bp, Homo sapiens
cctgagtggatctccaag

SEQ ID NO: 3890723 - DNA, 23 bp, Homo sapiens
cctgataaacattaaacactgta

SEQ ID NO: 3890724 - DNA, 16 bp, Homo sapiens
cctgataccctgcttg

SEQ ID NO: 3890725 - DNA, 23 bp, Homo sapiens
cctgatcatggtcagctcacacc

SEQ ID NO: 3890726 - DNA, 12 bp, Homo sapiens
cctgatgcccct

SEQ ID NO: 3890727 - DNA, 13 bp, Homo sapiens
cctgatgcccctt

SEQ ID NO: 3890728 - DNA, 23 bp, Homo sapiens
cctgatgctgccccgttccctgt

SEQ ID NO: 3890729 - DNA, 18 bp, Homo sapiens
cctgatggtacaggaaag

SEQ ID NO: 3890730 - DNA, 13 bp, Homo sapiens
cctgattccccac

SEQ ID NO: 3890731 - DNA, 15 bp, Homo sapiens
cctgattttgtagtt

SEQ ID NO: 3890732 - DNA, 14 bp, Homo sapiens
cctgcaaactcact

SEQ ID NO: 3890733 - DNA, 22 bp, Homo sapiens
cctgcaaactcactgctcaaga

SEQ ID NO: 3890734 - DNA, 19 bp, Homo sapiens
cctgcaagccccagggcct

SEQ ID NO: 3890735 - DNA, 21 bp, Homo sapiens
cctgcaagccccagggcctgg

SEQ ID NO: 3890736 - DNA, 22 bp, Homo sapiens
cctgcaagccccagggcctggg

SEQ ID NO: 3890737 - DNA, 23 bp, Homo sapiens
cctgcaagccccagggcctgggg

SEQ ID NO: 3890738 - DNA, 16 bp, Homo sapiens
cctgcaatctccaggg

SEQ ID NO: 3890739 - DNA, 17 bp, Homo sapiens
cctgcaatctccagggc

SEQ ID NO: 3890740 - DNA, 18 bp, Homo sapiens
cctgcaatctccagggct

SEQ ID NO: 3890741 - DNA, 23 bp, Homo sapiens
cctgcaatctccagggctgcccc

SEQ ID NO: 3890742 - DNA, 18 bp, Homo sapiens
cctgcaccagcccttccc

SEQ ID NO: 3890743 - DNA, 18 bp, Homo sapiens
cctgcacctccccccact

SEQ ID NO: 3890744 - DNA, 12 bp, Homo sapiens
cctgcactccag

SEQ ID NO: 3890745 - DNA, 15 bp, Homo sapiens
cctgcactccagaat

SEQ ID NO: 3890746 - DNA, 11 bp, Homo sapiens
cgctgctgcta

SEQ ID NO: 3890747 - DNA, 18 bp, Homo sapiens
cgctgcttcgtgggatac

SEQ ID NO: 3890748 - DNA, 12 bp, Homo sapiens
cgctggaatcaa

SEQ ID NO: 3890749 - DNA, 16 bp, Homo sapiens
cgctggacaacccaga

SEQ ID NO: 3890750 - DNA, 22 bp, Homo sapiens
cgctgggatttcttcgctgctc

SEQ ID NO: 3890751 - DNA, 23 bp, Homo sapiens
cgctggggaacagagcgggcctc

SEQ ID NO: 3890752 - DNA, 14 bp, Homo sapiens
cgctgggggtgggg

SEQ ID NO: 3890753 - DNA, 17 bp, Homo sapiens
cgctgtcgccccaggcc

SEQ ID NO: 3890754 - DNA, 23 bp, Homo sapiens
cgctgtcgccccaggccctccct

SEQ ID NO: 3890755 - DNA, 14 bp, Homo sapiens
cgctgttcacccac

SEQ ID NO: 3890756 - DNA, 13 bp, Homo sapiens
cgcttcacccctg

SEQ ID NO: 3890757 - DNA, 15 bp, Homo sapiens
cgcttcacccctgca

SEQ ID NO: 3890758 - DNA, 12 bp, Homo sapiens
cgcttccagacc

SEQ ID NO: 3890759 - DNA, 13 bp, Homo sapiens
cgcttccagacca

SEQ ID NO: 3890760 - DNA, 15 bp, Homo sapiens
cgcttccagaccacc

SEQ ID NO: 3890761 - DNA, 19 bp, Homo sapiens
cgcttccagaccacctgcc

SEQ ID NO: 3890762 - DNA, 22 bp, Homo sapiens
cgcttccagaccacctgccagc

SEQ ID NO: 3890763 - DNA, 21 bp, Homo sapiens
cgcttccttagccttgctcag

SEQ ID NO: 3890764 - DNA, 14 bp, Homo sapiens
cgcttctcctccag

SEQ ID NO: 3890765 - DNA, 12 bp, Homo sapiens
cgcttgagccca

SEQ ID NO: 3890766 - DNA, 14 bp, Homo sapiens
cgcttgagcccagg

SEQ ID NO: 3890767 - DNA, 17 bp, Homo sapiens
cgcttgagcccaggagt

SEQ ID NO: 3890768 - DNA, 18 bp, Homo sapiens
cgcttgagcccaggagtt

SEQ ID NO: 3890769 - DNA, 13 bp, Homo sapiens
cgcttgcttctgc

SEQ ID NO: 3890770 - DNA, 17 bp, Homo sapiens
cgcttgcttctgcagca

SEQ ID NO: 3890771 - DNA, 22 bp, Homo sapiens
cgcttgcttctgcagcaactcc

SEQ ID NO: 3890772 - DNA, 23 bp, Homo sapiens
cgcttgcttctgcagcaactccc

SEQ ID NO: 3890773 - DNA, 20 bp, Homo sapiens
cggaagcctttttccccaaa

SEQ ID NO: 3890774 - DNA, 22 bp, Homo sapiens
cggaaggggacgcgggctgtgc

SEQ ID NO: 3890775 - DNA, 21 bp, Homo sapiens
cggaattctcgggaaattatt

SEQ ID NO: 3890776 - DNA, 20 bp, Homo sapiens
cggaccaagatgggcacatg

SEQ ID NO: 3890777 - DNA, 22 bp, Homo sapiens
cggaccaagatgggcacatgag

SEQ ID NO: 3890778 - DNA, 17 bp, Homo sapiens
cggaccgcgtagagagc

SEQ ID NO: 3890779 - DNA, 18 bp, Homo sapiens
cggaccgcgtagagagcc

SEQ ID NO: 3890780 - DNA, 21 bp, Homo sapiens
cggacgtcctgctggcacctc

SEQ ID NO: 3890781 - DNA, 15 bp, Homo sapiens
cggacgtttccatca

SEQ ID NO: 3890782 - DNA, 15 bp, Homo sapiens
cggagaattgcctct

SEQ ID NO: 3890783 - DNA, 14 bp, Homo sapiens
cggagaccctgagt

SEQ ID NO: 3890784 - DNA, 18 bp, Homo sapiens
cggagagtacagtgagcc

SEQ ID NO: 3890785 - DNA, 21 bp, Homo sapiens
cggagagtacagtgagccaag

SEQ ID NO: 3890786 - DNA, 22 bp, Homo sapiens
cggaggagctccgctaagacct

SEQ ID NO: 3890787 - DNA, 16 bp, Homo sapiens
cggaggcggctccagg

SEQ ID NO: 3890788 - DNA, 16 bp, Homo sapiens
cggaggggcctggcag

SEQ ID NO: 3890789 - DNA, 14 bp, Homo sapiens
cggaggtggtggag

SEQ ID NO: 3890790 - DNA, 19 bp, Homo sapiens
cggaggtggtggaggagga

SEQ ID NO: 3890791 - DNA, 16 bp, Homo sapiens
cggagtaatcaggcag

SEQ ID NO: 3890792 - DNA, 17 bp, Homo sapiens
cggagtaatcaggcagc

SEQ ID NO: 3890793 - DNA, 20 bp, Homo sapiens
cggatcgaggacaagtgaga

SEQ ID NO: 3890794 - DNA, 17 bp, Homo sapiens
cggcaaccccagttctg

SEQ ID NO: 3890795 - DNA, 19 bp, Homo sapiens
cggcaaccccagttctgct

SEQ ID NO: 3890796 - DNA, 20 bp, Homo sapiens
cggcaaccccagttctgctc

SEQ ID NO: 3890797 - DNA, 21 bp, Homo sapiens
cggcaaccccagttctgctcc

SEQ ID NO: 3890798 - DNA, 20 bp, Homo sapiens
cggcaccccctgcagcttgt

SEQ ID NO: 3890799 - DNA, 17 bp, Homo sapiens
cggcagagaccccagga

SEQ ID NO: 3890800 - DNA, 18 bp, Homo sapiens
cggcagagaccccaggat

SEQ ID NO: 3890801 - DNA, 10 bp, Homo sapiens
cggcagctgt

SEQ ID NO: 3890802 - DNA, 20 bp, Homo sapiens
cggcaggagcaggaacagag

SEQ ID NO: 3890803 - DNA, 15 bp, Homo sapiens
cggcaggctgggttc

SEQ ID NO: 3890804 - DNA, 19 bp, Homo sapiens
cggcatattattccatatc

SEQ ID NO: 3890805 - DNA, 11 bp, Homo sapiens
cggccaccctc

SEQ ID NO: 3890806 - DNA, 15 bp, Homo sapiens
cggccagggcctggt

SEQ ID NO: 3890807 - DNA, 18 bp, Homo sapiens
cggcccagaagtttccct

SEQ ID NO: 3890808 - DNA, 21 bp, Homo sapiens
cggcccagagaccccttcctt

SEQ ID NO: 3890809 - DNA, 13 bp, Homo sapiens
cggccgcattccc

SEQ ID NO: 3890810 - DNA, 13 bp, Homo sapiens
cggccgggctgcc

SEQ ID NO: 3890811 - DNA, 17 bp, Homo sapiens
cggcctatgacttgggc

SEQ ID NO: 3890812 - DNA, 18 bp, Homo sapiens
cggcctatgacttgggca

SEQ ID NO: 3890813 - DNA, 19 bp, Homo sapiens
cggcctatgacttgggcac

SEQ ID NO: 3890814 - DNA, 14 bp, Homo sapiens
cggcctcagcaccc

SEQ ID NO: 3890815 - DNA, 10 bp, Homo sapiens
cggcctccac

SEQ ID NO: 3890816 - DNA, 22 bp, Homo sapiens
cggcctccgtccaggagcctgg

SEQ ID NO: 3890817 - DNA, 19 bp, Homo sapiens
cggcctctctcttcccagc

SEQ ID NO: 3890818 - DNA, 12 bp, Homo sapiens
cggcctcttcca

SEQ ID NO: 3890819 - DNA, 15 bp, Homo sapiens
cggccttccaccggg

SEQ ID NO: 3890820 - DNA, 20 bp, Homo sapiens
cggcgcggtggctcacgcct

SEQ ID NO: 3890821 - DNA, 14 bp, Homo sapiens
cggctactcagcag

SEQ ID NO: 3890822 - DNA, 18 bp, Homo sapiens
cggctccaggtccggagg

SEQ ID NO: 3890823 - DNA, 20 bp, Homo sapiens
cggctgagtcatgatctccc

SEQ ID NO: 3890824 - DNA, 13 bp, Homo sapiens
cggctgcctgccg

SEQ ID NO: 3890825 - DNA, 14 bp, Homo sapiens
cggctgcctgccgc

SEQ ID NO: 3890826 - DNA, 17 bp, Homo sapiens
cggctgcctgccgccca

SEQ ID NO: 3890827 - DNA, 15 bp, Homo sapiens
cggcttcctgtccac

SEQ ID NO: 3890828 - DNA, 21 bp, Homo sapiens
cgggaagcctccgtcaggaga

SEQ ID NO: 3890829 - DNA, 15 bp, Homo sapiens
cgggacagagaggag

SEQ ID NO: 3890830 - DNA, 19 bp, Homo sapiens
cgggaccattgacctcagc

SEQ ID NO: 3890831 - DNA, 19 bp, Homo sapiens
cgggaccccctggccctgc

SEQ ID NO: 3890832 - DNA, 21 bp, Homo sapiens
cgggacgagaccctacaggag

SEQ ID NO: 3890833 - DNA, 14 bp, Homo sapiens
cgggacgcttccag

SEQ ID NO: 3890834 - DNA, 15 bp, Homo sapiens
cgggacgcttccaga

SEQ ID NO: 3890835 - DNA, 17 bp, Homo sapiens
cgggacgcttccagacc

SEQ ID NO: 3890836 - DNA, 20 bp, Homo sapiens
cgggacgcttccagaccacc

SEQ ID NO: 3890837 - DNA, 23 bp, Homo sapiens
cgggacgcttccagaccacctgc

SEQ ID NO: 3890838 - DNA, 15 bp, Homo sapiens
cgggagaggactctg

SEQ ID NO: 3890839 - DNA, 21 bp, Homo sapiens
cgggaggactccgggaccatt
